United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 82

SEQ ID NO: 3750350 - RNA, 21 nt, Human
gggcuccuggggguggggagg

SEQ ID NO: 3750351 - RNA, 18 nt, Human
gggcuccuugugggccug

SEQ ID NO: 3750352 - RNA, 22 nt, Human
gggcuccuugugggccugggcu

SEQ ID NO: 3750353 - RNA, 23 nt, Human
gggcuccuugugggccugggcuc

SEQ ID NO: 3750354 - RNA, 22 nt, Human
gggcuccuuucuccagccagca

SEQ ID NO: 3750355 - RNA, 14 nt, Human
gggcucgccaugcc

SEQ ID NO: 3750356 - RNA, 14 nt, Human
gggcucgucuuugc

SEQ ID NO: 3750357 - RNA, 17 nt, Human
gggcucgucuuugcaga

SEQ ID NO: 3750358 - RNA, 23 nt, Human
gggcucucauguuuucaacugcc

SEQ ID NO: 3750359 - RNA, 14 nt, Human
gggcucuccaccuc

SEQ ID NO: 3750360 - RNA, 19 nt, Human
gggcucuccaccucagccu

SEQ ID NO: 3750361 - RNA, 12 nt, Human
gggcucuccugg

SEQ ID NO: 3750362 - RNA, 11 nt, Human
gggcucugagg

SEQ ID NO: 3750363 - RNA, 10 nt, Human
gggcucugau

SEQ ID NO: 3750364 - RNA, 21 nt, Human
gggcucugcaauuccccucug

SEQ ID NO: 3750365 - RNA, 19 nt, Human
gggcucugccccagcucug

SEQ ID NO: 3750366 - RNA, 16 nt, Human
gggcucugcccucccu

SEQ ID NO: 3750367 - RNA, 22 nt, Human
gggcucugcccucccuccuucc

SEQ ID NO: 3750368 - RNA, 13 nt, Human
gggcucugccucc

SEQ ID NO: 3750369 - RNA, 17 nt, Human
gggcucugccucccauc

SEQ ID NO: 3750370 - RNA, 13 nt, Human
gggcucuggagag

SEQ ID NO: 3750371 - RNA, 15 nt, Human
gggcugaauguaugu

SEQ ID NO: 3750372 - RNA, 20 nt, Human
gggcugacuagaagggccag

SEQ ID NO: 3750373 - RNA, 15 nt, Human
gggcugagccugguc

SEQ ID NO: 3750374 - RNA, 14 nt, Human
gggcugagggccug

SEQ ID NO: 3750375 - RNA, 12 nt, Human
gggcugaggggc

SEQ ID NO: 3750376 - RNA, 16 nt, Human
gggcugaggugggagg

SEQ ID NO: 3750377 - RNA, 18 nt, Human
gggcugaucucagggaag

SEQ ID NO: 3750378 - RNA, 21 nt, Human
gggcugcaccggcuggccugg

SEQ ID NO: 3750379 - RNA, 22 nt, Human
gggcugcaccggcuggccuggc

SEQ ID NO: 3750380 - RNA, 16 nt, Human
gggcugcacucugugc

SEQ ID NO: 3750381 - RNA, 15 nt, Human
gggcugcagagugcc

SEQ ID NO: 3750382 - RNA, 11 nt, Human
gggcugcagca

SEQ ID NO: 3750383 - RNA, 22 nt, Human
gggcugcagcauguugcugagg

SEQ ID NO: 3750384 - RNA, 20 nt, Human
gggcugcaugauguuugccc

SEQ ID NO: 3750385 - RNA, 21 nt, Human
gggcugcaugcgggcuuccuc

SEQ ID NO: 3750386 - RNA, 18 nt, Human
gggcugcccgcucccagu

SEQ ID NO: 3750387 - RNA, 22 nt, Human
gggcugcccgcucccagugucu

SEQ ID NO: 3750388 - RNA, 13 nt, Human
gggcugcccugag

SEQ ID NO: 3750389 - RNA, 14 nt, Human
gggcugcccugaga

SEQ ID NO: 3750390 - RNA, 16 nt, Human
gggcugcccugagaag

SEQ ID NO: 3750391 - RNA, 12 nt, Human
gggcugccuggg

SEQ ID NO: 3750392 - RNA, 17 nt, Human
gggcugccuucuggccu

SEQ ID NO: 3750393 - RNA, 18 nt, Human
gggcugcucccaccuggc

SEQ ID NO: 3750394 - RNA, 17 nt, Human
gggcugcugaccuccac

SEQ ID NO: 3750395 - RNA, 17 nt, Human
gggcugcugcugggcuc

SEQ ID NO: 3750396 - RNA, 12 nt, Human
gggcugcuguga

SEQ ID NO: 3750397 - RNA, 19 nt, Human
gggcuggacugaggccuga

SEQ ID NO: 3750398 - RNA, 14 nt, Human
gggcuggaggagcc

SEQ ID NO: 3750399 - RNA, 15 nt, Human
gggcuggaggagccc

SEQ ID NO: 3750400 - RNA, 17 nt, Human
gggcuggaggagcccag

SEQ ID NO: 3750401 - RNA, 15 nt, Human
gggcuggaggcccag

SEQ ID NO: 3750402 - RNA, 13 nt, Human
gggcuggcccagc

SEQ ID NO: 3750403 - RNA, 19 nt, Human
gggcuggcccagcccugcu

SEQ ID NO: 3750404 - RNA, 12 nt, Human
gggcuggcuuca

SEQ ID NO: 3750405 - RNA, 20 nt, Human
gggcuggcuuuucuguuucc

SEQ ID NO: 3750406 - RNA, 21 nt, Human
gggcugggaaacacuccuugc

SEQ ID NO: 3750407 - RNA, 16 nt, Human
gggcugggcacugcuc

SEQ ID NO: 3750408 - RNA, 14 nt, Human
gggcugggcagcua

SEQ ID NO: 3750409 - RNA, 22 nt, Human
gggcugggcccacccaagcagg

SEQ ID NO: 3750410 - RNA, 22 nt, Human
gggcugggccucggaccccacu

SEQ ID NO: 3750411 - RNA, 11 nt, Human
gggcuggggca

SEQ ID NO: 3750412 - RNA, 17 nt, Human
gggcuggguucuaccca

SEQ ID NO: 3750413 - RNA, 16 nt, Human
gggcuggguuggcgca

SEQ ID NO: 3750414 - RNA, 21 nt, Human
gggcuggguuggcgcacccuc

SEQ ID NO: 3750415 - RNA, 18 nt, Human
gggcugguagcucaggug

SEQ ID NO: 3750416 - RNA, 21 nt, Human
gggcuggugacccagucagag

SEQ ID NO: 3750417 - RNA, 19 nt, Human
gggcuguaacguggcacug

SEQ ID NO: 3750418 - RNA, 16 nt, Human
gggcugucggcgcugc

SEQ ID NO: 3750419 - RNA, 23 nt, Human
gggcugugcuugaaggcccugcu

SEQ ID NO: 3750420 - RNA, 21 nt, Human
gggcuguugaagucaccuugu

SEQ ID NO: 3750421 - RNA, 22 nt, Human
gggcuguuuaggggaucuggaa

SEQ ID NO: 3750422 - RNA, 22 nt, Human
gggcuuaccuguacacugacuu

SEQ ID NO: 3750423 - RNA, 16 nt, Human
gggcuuacggcccugg

SEQ ID NO: 3750424 - RNA, 18 nt, Human
gggcuuacggcccuggcc

SEQ ID NO: 3750425 - RNA, 19 nt, Human
gggcuuauaucuggccucu

SEQ ID NO: 3750426 - RNA, 21 nt, Human
gggcuucaaccuugagacagc

SEQ ID NO: 3750427 - RNA, 16 nt, Human
gggcuucacuguauaa

SEQ ID NO: 3750428 - RNA, 14 nt, Human
gggcuucagggcag

SEQ ID NO: 3750429 - RNA, 19 nt, Human
gggcuucagggcagguggg

SEQ ID NO: 3750430 - RNA, 17 nt, Human
gggcuucaguggcagcu

SEQ ID NO: 3750431 - RNA, 21 nt, Human
gggcuucaguggcagcugcuu

SEQ ID NO: 3750432 - RNA, 19 nt, Human
gggcuucauccuccucaga

SEQ ID NO: 3750433 - RNA, 20 nt, Human
gggcuucccaguggcugcug

SEQ ID NO: 3750434 - RNA, 23 nt, Human
gggcuucccaguggcugcugccc

SEQ ID NO: 3750435 - RNA, 13 nt, Human
gggcuuccuggag

SEQ ID NO: 3750436 - RNA, 13 nt, Human
gggcuugaagcca

SEQ ID NO: 3750437 - RNA, 17 nt, Human
gggcuugaagccaaaga

SEQ ID NO: 3750438 - RNA, 13 nt, Human
gggcuugccuucu

SEQ ID NO: 3750439 - RNA, 21 nt, Human
gggcuugcuauucugucccua

SEQ ID NO: 3750440 - RNA, 14 nt, Human
gggcuuggcgugga

SEQ ID NO: 3750441 - RNA, 20 nt, Human
gggcuuggcguggagcaggc

SEQ ID NO: 3750442 - RNA, 22 nt, Human
gggcuuggggaccagagcugcc

SEQ ID NO: 3750443 - RNA, 17 nt, Human
gggcuugucauagccag

SEQ ID NO: 3750444 - RNA, 18 nt, Human
gggcuuguggggccuggg

SEQ ID NO: 3750445 - RNA, 19 nt, Human
gggcuuucguccacagcuu

SEQ ID NO: 3750446 - RNA, 14 nt, Human
gggcuuucuggaga

SEQ ID NO: 3750447 - RNA, 15 nt, Human
gggcuuucuggagag

SEQ ID NO: 3750448 - RNA, 20 nt, Human
gggcuuugugugaaggcaga

SEQ ID NO: 3750449 - RNA, 17 nt, Human
ggggaaaaucagccugc

SEQ ID NO: 3750450 - RNA, 23 nt, Human
ggggaaagacacugccugggcug

SEQ ID NO: 3750451 - RNA, 18 nt, Human
ggggaaagcaaagcacag

SEQ ID NO: 3750452 - RNA, 21 nt, Human
ggggaaagcaaagcacagaga

SEQ ID NO: 3750453 - RNA, 17 nt, Human
ggggaaaggcaaggucc

SEQ ID NO: 3750454 - RNA, 22 nt, Human
ggggaaaggcaagguccggccc

SEQ ID NO: 3750455 - RNA, 21 nt, Human
ggggaaccugccaugccagga

SEQ ID NO: 3750456 - RNA, 14 nt, Human
ggggaagagcacag

SEQ ID NO: 3750457 - RNA, 16 nt, Human
ggggaagaguguacug

SEQ ID NO: 3750458 - RNA, 13 nt, Human
ggggaagcccugg

SEQ ID NO: 3750459 - RNA, 14 nt, Human
ggggaagcccugga

SEQ ID NO: 3750460 - RNA, 15 nt, Human
ggggaaggagccagu

SEQ ID NO: 3750461 - RNA, 21 nt, Human
ggggaaggaggguacagcugg

SEQ ID NO: 3750462 - RNA, 22 nt, Human
ggggaaggaggguacagcuggg

SEQ ID NO: 3750463 - RNA, 13 nt, Human
ggggaagggccag

SEQ ID NO: 3750464 - RNA, 23 nt, Human
ggggaagggccagucugggcugc

SEQ ID NO: 3750465 - RNA, 16 nt, Human
ggggaaguccucuggg

SEQ ID NO: 3750466 - RNA, 12 nt, Human
ggggaaucuaag

SEQ ID NO: 3750467 - RNA, 23 nt, Human
ggggaaugagcccagagaacagc

SEQ ID NO: 3750468 - RNA, 12 nt, Human
ggggaaugaggg

SEQ ID NO: 3750469 - RNA, 20 nt, Human
ggggacaaccuuggcuuggc

SEQ ID NO: 3750470 - RNA, 17 nt, Human
ggggacacauguauuug

SEQ ID NO: 3750471 - RNA, 19 nt, Human
ggggacacauguauuuggu

SEQ ID NO: 3750472 - RNA, 20 nt, Human
ggggacagcuccuucugucc

SEQ ID NO: 3750473 - RNA, 15 nt, Human
ggggacagggcuggc

SEQ ID NO: 3750474 - RNA, 15 nt, Human
ggggacagguccuca

SEQ ID NO: 3750475 - RNA, 15 nt, Human
ggggaccagcuuggc

SEQ ID NO: 3750476 - RNA, 15 nt, Human
ggggacccagugcag

SEQ ID NO: 3750477 - RNA, 22 nt, Human
ggccugcugggcucuccaccuc

SEQ ID NO: 3750478 - RNA, 10 nt, Human
ggccugcugu

SEQ ID NO: 3750479 - RNA, 17 nt, Human
ggccugcuuccugucuu

SEQ ID NO: 3750480 - RNA, 13 nt, Human
ggccuggaccugc

SEQ ID NO: 3750481 - RNA, 21 nt, Human
ggccuggacuuuccugcaacu

SEQ ID NO: 3750482 - RNA, 19 nt, Human
ggccuggagcaggccuugc

SEQ ID NO: 3750483 - RNA, 20 nt, Human
ggccuggaugcccccugugg

SEQ ID NO: 3750484 - RNA, 20 nt, Human
ggccuggauucauuuccugc

SEQ ID NO: 3750485 - RNA, 22 nt, Human
ggccuggauucauuuccugccc

SEQ ID NO: 3750486 - RNA, 12 nt, Human
ggccuggcacag

SEQ ID NO: 3750487 - RNA, 14 nt, Human
ggccuggcagccgu

SEQ ID NO: 3750488 - RNA, 15 nt, Human
ggccuggcagggagg

SEQ ID NO: 3750489 - RNA, 15 nt, Human
ggccuggcauucuug

SEQ ID NO: 3750490 - RNA, 14 nt, Human
ggccuggccaggag

SEQ ID NO: 3750491 - RNA, 15 nt, Human
ggccuggccaggagc

SEQ ID NO: 3750492 - RNA, 18 nt, Human
ggccuggccaggagcucu

SEQ ID NO: 3750493 - RNA, 22 nt, Human
ggccuggccagggccuggaaga

SEQ ID NO: 3750494 - RNA, 14 nt, Human
ggccuggccagugc

SEQ ID NO: 3750495 - RNA, 13 nt, Human
ggccuggccccuc

SEQ ID NO: 3750496 - RNA, 14 nt, Human
ggccuggccccuca

SEQ ID NO: 3750497 - RNA, 17 nt, Human
ggccuggccccucaggg

SEQ ID NO: 3750498 - RNA, 21 nt, Human
ggccuggccggcaaccccagu

SEQ ID NO: 3750499 - RNA, 14 nt, Human
ggccuggccugagc

SEQ ID NO: 3750500 - RNA, 16 nt, Human
ggccuggccuggcccu

SEQ ID NO: 3750501 - RNA, 17 nt, Human
ggccuggccuggcccug

SEQ ID NO: 3750502 - RNA, 23 nt, Human
ggccuggcucccucacucucagg

SEQ ID NO: 3750503 - RNA, 18 nt, Human
ggccuggcuccgcugugu

SEQ ID NO: 3750504 - RNA, 12 nt, Human
ggccuggcuccu

SEQ ID NO: 3750505 - RNA, 14 nt, Human
ggccuggcuggcug

SEQ ID NO: 3750506 - RNA, 14 nt, Human
ggccuggcuugucu

SEQ ID NO: 3750507 - RNA, 15 nt, Human
ggccugggcaggagg

SEQ ID NO: 3750508 - RNA, 17 nt, Human
ggccugggcaggaggga

SEQ ID NO: 3750509 - RNA, 15 nt, Human
ggccugggccuggcu

SEQ ID NO: 3750510 - RNA, 17 nt, Human
ggccugggccuggcucc

SEQ ID NO: 3750511 - RNA, 17 nt, Human
ggccugggcuccuggac

SEQ ID NO: 3750512 - RNA, 16 nt, Human
ggccuggggccugaga

SEQ ID NO: 3750513 - RNA, 14 nt, Human
ggccuggggcuccu

SEQ ID NO: 3750514 - RNA, 14 nt, Human
ggccugggggcugg

SEQ ID NO: 3750515 - RNA, 15 nt, Human
ggccuggggugaccc

SEQ ID NO: 3750516 - RNA, 19 nt, Human
ggccuggggugacccggca

SEQ ID NO: 3750517 - RNA, 16 nt, Human
ggccuguacagucugu

SEQ ID NO: 3750518 - RNA, 17 nt, Human
ggccuguacugccugcu

SEQ ID NO: 3750519 - RNA, 20 nt, Human
ggccugucagcuaaagaagu

SEQ ID NO: 3750520 - RNA, 14 nt, Human
ggccuguccuccaa

SEQ ID NO: 3750521 - RNA, 17 nt, Human
ggccugucucaucccca

SEQ ID NO: 3750522 - RNA, 18 nt, Human
ggccugucucauccccag

SEQ ID NO: 3750523 - RNA, 16 nt, Human
ggccuguggaaugagu

SEQ ID NO: 3750524 - RNA, 18 nt, Human
ggccuguggaaugagugu

SEQ ID NO: 3750525 - RNA, 20 nt, Human
ggccuguggaucaaauccag

SEQ ID NO: 3750526 - RNA, 18 nt, Human
ggccuguggccugugucc

SEQ ID NO: 3750527 - RNA, 17 nt, Human
ggccugugggagccugc

SEQ ID NO: 3750528 - RNA, 17 nt, Human
ggccuguguagcuguga

SEQ ID NO: 3750529 - RNA, 21 nt, Human
ggccugugucccaugacccac

SEQ ID NO: 3750530 - RNA, 11 nt, Human
ggccuguugcc

SEQ ID NO: 3750531 - RNA, 21 nt, Human
ggccuguugcuauagagccua

SEQ ID NO: 3750532 - RNA, 12 nt, Human
ggccuuaagcuu

SEQ ID NO: 3750533 - RNA, 14 nt, Human
ggccuuaccccugc

SEQ ID NO: 3750534 - RNA, 19 nt, Human
ggccuuacuuaaacccagc

SEQ ID NO: 3750535 - RNA, 15 nt, Human
ggccuuaggaagagc

SEQ ID NO: 3750536 - RNA, 20 nt, Human
ggccuuagggcacugggcug

SEQ ID NO: 3750537 - RNA, 21 nt, Human
ggccuuaucgggcuccagcca

SEQ ID NO: 3750538 - RNA, 22 nt, Human
ggccuuaucgggcuccagccau

SEQ ID NO: 3750539 - RNA, 12 nt, Human
ggccuucacaau

SEQ ID NO: 3750540 - RNA, 14 nt, Human
ggccuuccagcugc

SEQ ID NO: 3750541 - RNA, 17 nt, Human
ggccuuccagcugcugu

SEQ ID NO: 3750542 - RNA, 15 nt, Human
ggccuuccccagccu

SEQ ID NO: 3750543 - RNA, 16 nt, Human
ggccuucggccuccau

SEQ ID NO: 3750544 - RNA, 22 nt, Human
ggccuucuuucuagagagggaa

SEQ ID NO: 3750545 - RNA, 22 nt, Human
ggccuugcgguauccgccccca

SEQ ID NO: 3750546 - RNA, 16 nt, Human
ggccuuggccuggagc

SEQ ID NO: 3750547 - RNA, 12 nt, Human
ggccuugggcuc

SEQ ID NO: 3750548 - RNA, 12 nt, Human
ggccuuguccca

SEQ ID NO: 3750549 - RNA, 13 nt, Human
ggccuuucccacu

SEQ ID NO: 3750550 - RNA, 16 nt, Human
ggccuuugagcucaga

SEQ ID NO: 3750551 - RNA, 23 nt, Human
ggccuuugcgcuccuggcccagc

SEQ ID NO: 3750552 - RNA, 14 nt, Human
ggccuuuggcuuca

SEQ ID NO: 3750553 - RNA, 17 nt, Human
ggccuuuguucuggggg

SEQ ID NO: 3750554 - RNA, 16 nt, Human
ggcgaagcccaggccc

SEQ ID NO: 3750555 - RNA, 22 nt, Human
ggcgaagcguuguccucagccc

SEQ ID NO: 3750556 - RNA, 17 nt, Human
ggcgaaucucaaaauua

SEQ ID NO: 3750557 - RNA, 23 nt, Human
ggcgacagagcgagagucugucu

SEQ ID NO: 3750558 - RNA, 20 nt, Human
ggcgaccccgucacagccuc

SEQ ID NO: 3750559 - RNA, 22 nt, Human
ggcgagaccugauuucuccugc

SEQ ID NO: 3750560 - RNA, 15 nt, Human
ggcgagagaggagcc

SEQ ID NO: 3750561 - RNA, 21 nt, Human
ggcgagccauuugucccaagu

SEQ ID NO: 3750562 - RNA, 21 nt, Human
ggcgagcccuguggaugagcc

SEQ ID NO: 3750563 - RNA, 12 nt, Human
ggcgaggcagag

SEQ ID NO: 3750564 - RNA, 17 nt, Human
ggcgaugccagccaagc

SEQ ID NO: 3750565 - RNA, 18 nt, Human
ggcgaugccagccaagcu

SEQ ID NO: 3750566 - RNA, 14 nt, Human
ggcgcacugccucu

SEQ ID NO: 3750567 - RNA, 16 nt, Human
ggcgcacugccucuca

SEQ ID NO: 3750568 - RNA, 14 nt, Human
ggcgcagccaaggc

SEQ ID NO: 3750569 - RNA, 15 nt, Human
ggcgcagccaaggcc

SEQ ID NO: 3750570 - RNA, 11 nt, Human
ggcgcaggagg

SEQ ID NO: 3750571 - RNA, 14 nt, Human
ggcgcaggugggcu

SEQ ID NO: 3750572 - RNA, 15 nt, Human
ggcgcaggugggcug

SEQ ID NO: 3750573 - RNA, 20 nt, Human
ggcgcaggugggcuggacuu

SEQ ID NO: 3750574 - RNA, 16 nt, Human
ggcgccaccagcucug

SEQ ID NO: 3750575 - RNA, 12 nt, Human
ggcgcccaccuc

SEQ ID NO: 3750576 - RNA, 16 nt, Human
ggcgccccaacccgug

SEQ ID NO: 3750577 - RNA, 14 nt, Human
ggcgcccccagugu

SEQ ID NO: 3750578 - RNA, 13 nt, Human
ggcgccccugcca

SEQ ID NO: 3750579 - RNA, 19 nt, Human
ggcgccgcaaaccacacug

SEQ ID NO: 3750580 - RNA, 16 nt, Human
ggcgccgugcugggca

SEQ ID NO: 3750581 - RNA, 20 nt, Human
ggcgccgugcugggcagccc

SEQ ID NO: 3750582 - RNA, 15 nt, Human
ggcgccugugguucu

SEQ ID NO: 3750583 - RNA, 22 nt, Human
ggcgcgaucucggcucacugca

SEQ ID NO: 3750584 - RNA, 14 nt, Human
ggcgcggccagccc

SEQ ID NO: 3750585 - RNA, 16 nt, Human
ggcgcggcugggagga

SEQ ID NO: 3750586 - RNA, 14 nt, Human
ggcgcgugaggccc

SEQ ID NO: 3750587 - RNA, 12 nt, Human
ggcgcuaacuug

SEQ ID NO: 3750588 - RNA, 23 nt, Human
ggcgcuaacuugcuuaaauguga

SEQ ID NO: 3750589 - RNA, 23 nt, Human
ggcgcugccccuggcagccccug

SEQ ID NO: 3750590 - RNA, 11 nt, Human
ggcgcuggccc

SEQ ID NO: 3750591 - RNA, 13 nt, Human
ggcgcuggcccag

SEQ ID NO: 3750592 - RNA, 15 nt, Human
ggcgcuggcccagcc

SEQ ID NO: 3750593 - RNA, 18 nt, Human
ggcgcuggcccagccggc

SEQ ID NO: 3750594 - RNA, 19 nt, Human
ggcgcuggcccagccggcc

SEQ ID NO: 3750595 - RNA, 20 nt, Human
ggcgcuggcccagccggccu

SEQ ID NO: 3750596 - RNA, 20 nt, Human
ggcggacaccuggcccccga

SEQ ID NO: 3750597 - RNA, 15 nt, Human
ggcggacguuccagc

SEQ ID NO: 3750598 - RNA, 16 nt, Human
ggcggacguuccagcc

SEQ ID NO: 3750599 - RNA, 21 nt, Human
ggcggagaguacagugagcca

SEQ ID NO: 3750600 - RNA, 23 nt, Human
ggcggagcuggccccgccgccug

SEQ ID NO: 3750601 - RNA, 20 nt, Human
ggcggaucaucuaauucucu

SEQ ID NO: 3750602 - RNA, 20 nt, Human
ggcggauguugaagugagcu

SEQ ID NO: 3750603 - RNA, 20 nt, Human
ggcggcacaggucgggcgca

SEQ ID NO: 3750604 - RNA, 14 nt, Human
ggcggcagcagcca

SEQ ID NO: 3750605 - RNA, 16 nt, Human
ggcggcagcagccauc

SEQ ID NO: 3750606 - RNA, 17 nt, Human
ggcggcaggggccugga

SEQ ID NO: 3750607 - RNA, 18 nt, Human
ggcggcaggggccuggag

SEQ ID NO: 3750608 - RNA, 17 nt, Human
ggcggccaugauggugc

SEQ ID NO: 3750609 - RNA, 13 nt, Human
ggcggccccagca

SEQ ID NO: 3750610 - RNA, 22 nt, Human
ggcggccuaugacuugggcacc

SEQ ID NO: 3750611 - RNA, 19 nt, Human
ggcggcuggggucccagca

SEQ ID NO: 3750612 - RNA, 16 nt, Human
ggcgggaugggccacc

SEQ ID NO: 3750613 - RNA, 18 nt, Human
ggcgggcagagggcugga

SEQ ID NO: 3750614 - RNA, 12 nt, Human
ggcgggccagcc

SEQ ID NO: 3750615 - RNA, 14 nt, Human
ggcgggccagccag

SEQ ID NO: 3750616 - RNA, 19 nt, Human
ggcggggguggcggcggcc

SEQ ID NO: 3750617 - RNA, 15 nt, Human
ggcggucccagcucc

SEQ ID NO: 3750618 - RNA, 20 nt, Human
ggcggucuucaacauccugc

SEQ ID NO: 3750619 - RNA, 21 nt, Human
ggcggugggcacccacccugg

SEQ ID NO: 3750620 - RNA, 16 nt, Human
ggcguaaguacagaga

SEQ ID NO: 3750621 - RNA, 17 nt, Human
ggcguacgcuggugcug

SEQ ID NO: 3750622 - RNA, 15 nt, Human
ggcguaggcuacaga

SEQ ID NO: 3750623 - RNA, 19 nt, Human
ggcguaggcuacagagaag

SEQ ID NO: 3750624 - RNA, 20 nt, Human
ggcguaggcuacagagaagc

SEQ ID NO: 3750625 - RNA, 21 nt, Human
ggcguaggcuacagagaagcc

SEQ ID NO: 3750626 - RNA, 18 nt, Human
ggcgucagccuccagccu

SEQ ID NO: 3750627 - RNA, 16 nt, Human
ggcgucuguauauuuu

SEQ ID NO: 3750628 - RNA, 16 nt, Human
gaaccggagagccagc

SEQ ID NO: 3750629 - RNA, 17 nt, Human
gaaccggagagccagcu

SEQ ID NO: 3750630 - RNA, 15 nt, Human
gaaccguaggaccca

SEQ ID NO: 3750631 - RNA, 17 nt, Human
gaaccguuuugaagcua

SEQ ID NO: 3750632 - RNA, 16 nt, Human
gaaccuaacuguaucu

SEQ ID NO: 3750633 - RNA, 20 nt, Human
gaaccuaacuguaucuugag

SEQ ID NO: 3750634 - RNA, 14 nt, Human
gaaccuagaagggc

SEQ ID NO: 3750635 - RNA, 15 nt, Human
gaaccuaugaagcaa

SEQ ID NO: 3750636 - RNA, 16 nt, Human
gaaccuauuucucuuu

SEQ ID NO: 3750637 - RNA, 21 nt, Human
gaaccucaccccgaggcccug

SEQ ID NO: 3750638 - RNA, 11 nt, Human
gaaccucaccu

SEQ ID NO: 3750639 - RNA, 17 nt, Human
gaaccucacucuugcca

SEQ ID NO: 3750640 - RNA, 18 nt, Human
gaaccucacucuugccaa

SEQ ID NO: 3750641 - RNA, 19 nt, Human
gaaccucacucuugccaac

SEQ ID NO: 3750642 - RNA, 22 nt, Human
gaaccucccagagguccagccc

SEQ ID NO: 3750643 - RNA, 15 nt, Human
gaaccuccccagccu

SEQ ID NO: 3750644 - RNA, 17 nt, Human
gaaccuccccagccugc

SEQ ID NO: 3750645 - RNA, 18 nt, Human
gaaccuccccagccugcg

SEQ ID NO: 3750646 - RNA, 15 nt, Human
gaaccuccucuguga

SEQ ID NO: 3750647 - RNA, 15 nt, Human
gaaccucgaguacug

SEQ ID NO: 3750648 - RNA, 14 nt, Human
gaaccucugauuua

SEQ ID NO: 3750649 - RNA, 18 nt, Human
gaaccucugucucauccu

SEQ ID NO: 3750650 - RNA, 17 nt, Human
gaaccucuuccccagaa

SEQ ID NO: 3750651 - RNA, 16 nt, Human
gaaccugaugaaaaua

SEQ ID NO: 3750652 - RNA, 20 nt, Human
gaaccuggaacuuggggagu

SEQ ID NO: 3750653 - RNA, 15 nt, Human
gaaccuggaguuccu

SEQ ID NO: 3750654 - RNA, 11 nt, Human
gaaccuggccu

SEQ ID NO: 3750655 - RNA, 13 nt, Human
gaaccuggccuuc

SEQ ID NO: 3750656 - RNA, 15 nt, Human
gaaccuguagagcua

SEQ ID NO: 3750657 - RNA, 21 nt, Human
gaaccuucuggccucccacag

SEQ ID NO: 3750658 - RNA, 16 nt, Human
gaaccuugugccuggc

SEQ ID NO: 3750659 - RNA, 18 nt, Human
gaaccuuguuauuucuca

SEQ ID NO: 3750660 - RNA, 18 nt, Human
gaaccuuuugagugccuu

SEQ ID NO: 3750661 - RNA, 19 nt, Human
gaaccuuuugagugccuua

SEQ ID NO: 3750662 - RNA, 21 nt, Human
gaaccuuuugagugccuuaca

SEQ ID NO: 3750663 - RNA, 18 nt, Human
gaacgauccuucaaaguc

SEQ ID NO: 3750664 - RNA, 16 nt, Human
gaacgaugugucugua

SEQ ID NO: 3750665 - RNA, 18 nt, Human
gaacgauuuagaaagaag

SEQ ID NO: 3750666 - RNA, 22 nt, Human
gaacgcagcccuagagccugcc

SEQ ID NO: 3750667 - RNA, 13 nt, Human
gaacgccagggac

SEQ ID NO: 3750668 - RNA, 20 nt, Human
gaacgcguguguacacggga

SEQ ID NO: 3750669 - RNA, 19 nt, Human
gaacggaacguuggacuuu

SEQ ID NO: 3750670 - RNA, 23 nt, Human
gaacggagccccaggccucugug

SEQ ID NO: 3750671 - RNA, 15 nt, Human
gaacggggagaaaag

SEQ ID NO: 3750672 - RNA, 19 nt, Human
gaacggggcucuucucauu

SEQ ID NO: 3750673 - RNA, 17 nt, Human
gaacguggcucugcugg

SEQ ID NO: 3750674 - RNA, 23 nt, Human
gaacgugggaguucagcugcuuc

SEQ ID NO: 3750675 - RNA, 13 nt, Human
gaacguucucuuu

SEQ ID NO: 3750676 - RNA, 19 nt, Human
gaacguuuuuuccucagug

SEQ ID NO: 3750677 - RNA, 19 nt, Human
gaacuaaacuaguuuuucc

SEQ ID NO: 3750678 - RNA, 12 nt, Human
gaacuaaacuuu

SEQ ID NO: 3750679 - RNA, 17 nt, Human
gaacuaaacuuucacac

SEQ ID NO: 3750680 - RNA, 19 nt, Human
gaacuaaagguggccacaa

SEQ ID NO: 3750681 - RNA, 21 nt, Human
gaacuaaagugcugcacucaa

SEQ ID NO: 3750682 - RNA, 12 nt, Human
gaacuaaauguu

SEQ ID NO: 3750683 - RNA, 13 nt, Human
gaacuaaauguuc

SEQ ID NO: 3750684 - RNA, 15 nt, Human
gaacuaaauguucua

SEQ ID NO: 3750685 - RNA, 18 nt, Human
gaacuaacacgugaugug

SEQ ID NO: 3750686 - RNA, 17 nt, Human
gaacuaacacuauuuua

SEQ ID NO: 3750687 - RNA, 15 nt, Human
gaacuaauaaaagca

SEQ ID NO: 3750688 - RNA, 19 nt, Human
gaacuaauuucuucuccug

SEQ ID NO: 3750689 - RNA, 22 nt, Human
gaacuacaaacaaaauuucuau

SEQ ID NO: 3750690 - RNA, 17 nt, Human
gaacuagagaugugcaa

SEQ ID NO: 3750691 - RNA, 22 nt, Human
gaacuagagguuuuaugauauu

SEQ ID NO: 3750692 - RNA, 21 nt, Human
gaacuagaguuuagcuggaaa

SEQ ID NO: 3750693 - RNA, 18 nt, Human
gaacuagcauauagccau

SEQ ID NO: 3750694 - RNA, 21 nt, Human
gaacuagcauauagccauuga

SEQ ID NO: 3750695 - RNA, 23 nt, Human
gaacuagccaccaacucuugcag

SEQ ID NO: 3750696 - RNA, 19 nt, Human
gaacuagcuggaauuuuuu

SEQ ID NO: 3750697 - RNA, 17 nt, Human
gaacuaggcugagcaau

SEQ ID NO: 3750698 - RNA, 19 nt, Human
gaacuagugguggcucuga

SEQ ID NO: 3750699 - RNA, 19 nt, Human
gaacuauuuucaaagacuu

SEQ ID NO: 3750700 - RNA, 20 nt, Human
gaacuauuuucaaagacuua

SEQ ID NO: 3750701 - RNA, 22 nt, Human
gaacucaaauggggccagaucc

SEQ ID NO: 3750702 - RNA, 15 nt, Human
gaacucaacuuugac

SEQ ID NO: 3750703 - RNA, 21 nt, Human
gaacucaccuggggcugcugg

SEQ ID NO: 3750704 - RNA, 22 nt, Human
gaacucaccuggggcugcuggc

SEQ ID NO: 3750705 - RNA, 14 nt, Human
gaacucacucuggg

SEQ ID NO: 3750706 - RNA, 18 nt, Human
gaacucacucugggcugu

SEQ ID NO: 3750707 - RNA, 18 nt, Human
gaacucagauccagggac

SEQ ID NO: 3750708 - RNA, 21 nt, Human
gaacucagauccagggacaga

SEQ ID NO: 3750709 - RNA, 17 nt, Human
gaacucagccaagcaca

SEQ ID NO: 3750710 - RNA, 19 nt, Human
gaacucagccaagcacagu

SEQ ID NO: 3750711 - RNA, 21 nt, Human
gaacucagcugucuguggcuu

SEQ ID NO: 3750712 - RNA, 18 nt, Human
gaacucaucacuguggcu

SEQ ID NO: 3750713 - RNA, 19 nt, Human
gaacucaucacuguggcug

SEQ ID NO: 3750714 - RNA, 20 nt, Human
gaacucaucuagguaaauua

SEQ ID NO: 3750715 - RNA, 14 nt, Human
gaacuccaggcccu

SEQ ID NO: 3750716 - RNA, 17 nt, Human
gaacucccagcaacaca

SEQ ID NO: 3750717 - RNA, 15 nt, Human
gaacuccuaaaucaa

SEQ ID NO: 3750718 - RNA, 16 nt, Human
gaacuccuaaaucaag

SEQ ID NO: 3750719 - RNA, 14 nt, Human
gaacuccugaccuc

SEQ ID NO: 3750720 - RNA, 20 nt, Human
gaacuccuggaaauaucagu

SEQ ID NO: 3750721 - RNA, 14 nt, Human
gaacuccuggccuc

SEQ ID NO: 3750722 - RNA, 15 nt, Human
gaacuccuggccuca

SEQ ID NO: 3750723 - RNA, 20 nt, Human
gaacuccugggcucaagcag

SEQ ID NO: 3750724 - RNA, 15 nt, Human
gaacuccuugauuuu

SEQ ID NO: 3750725 - RNA, 20 nt, Human
gaacuccuuggccuagccca

SEQ ID NO: 3750726 - RNA, 17 nt, Human
gaacucgcgcucaguaa

SEQ ID NO: 3750727 - RNA, 19 nt, Human
gaacucgcgcucaguaaac

SEQ ID NO: 3750728 - RNA, 20 nt, Human
gaacucgcuucucugugacu

SEQ ID NO: 3750729 - RNA, 23 nt, Human
gaacucuagggauagucaccuuu

SEQ ID NO: 3750730 - RNA, 21 nt, Human
gaacucuaucugggccugggc

SEQ ID NO: 3750731 - RNA, 22 nt, Human
gaacucuaucugggccugggcu

SEQ ID NO: 3750732 - RNA, 12 nt, Human
gaacucugaaau

SEQ ID NO: 3750733 - RNA, 17 nt, Human
gaacucugaacuuugga

SEQ ID NO: 3750734 - RNA, 15 nt, Human
gaacucugacaaggg

SEQ ID NO: 3750735 - RNA, 17 nt, Human
gaacucugacaagggcu

SEQ ID NO: 3750736 - RNA, 20 nt, Human
gaacucuggcuuccagguau

SEQ ID NO: 3750737 - RNA, 22 nt, Human
gaacucugggcucaagcaaucc

SEQ ID NO: 3750738 - RNA, 14 nt, Human
gaacucugguggca

SEQ ID NO: 3750739 - RNA, 13 nt, Human
gaacucuuaauca

SEQ ID NO: 3750740 - RNA, 20 nt, Human
gaacucuuaaucaaauagca

SEQ ID NO: 3750741 - RNA, 13 nt, Human
gaacugaaaacau

SEQ ID NO: 3750742 - RNA, 13 nt, Human
gaacugaaaagag

SEQ ID NO: 3750743 - RNA, 21 nt, Human
gaacugaacaccauugaaggc

SEQ ID NO: 3750744 - RNA, 18 nt, Human
gaacugaacuaauccuuc

SEQ ID NO: 3750745 - RNA, 19 nt, Human
gaacugaagggggcggccu

SEQ ID NO: 3750746 - RNA, 16 nt, Human
gaacugagcuuggaag

SEQ ID NO: 3750747 - RNA, 13 nt, Human
gaacugauaguua

SEQ ID NO: 3750748 - RNA, 17 nt, Human
gaacugauguaaguaaa

SEQ ID NO: 3750749 - RNA, 20 nt, Human
gaacugcacaugaagaaaua

SEQ ID NO: 3750750 - RNA, 11 nt, Human
gaacugcagca

SEQ ID NO: 3750751 - RNA, 21 nt, Human
gaacugcauauguuucgcuga

SEQ ID NO: 3750752 - RNA, 19 nt, Human
gaacugcaugcugcuggac

SEQ ID NO: 3750753 - RNA, 15 nt, Human
gaacugcauggaccu

SEQ ID NO: 3750754 - RNA, 22 nt, Human
gaacugcauggaccuaacauuc

SEQ ID NO: 3750755 - RNA, 20 nt, Human
gaacugcauguauaaaugaa

SEQ ID NO: 3750756 - RNA, 23 nt, Human
gaacugccauuauuuucugucag

SEQ ID NO: 3750757 - RNA, 17 nt, Human
gaacugccucuuuccug

SEQ ID NO: 3750758 - RNA, 21 nt, Human
gaacugccuuuggcagaguuc

SEQ ID NO: 3750759 - RNA, 21 nt, Human
gaacugcuuuaucccacggaa

SEQ ID NO: 3750760 - RNA, 22 nt, Human
gaacuggacccuguugcuaagc

SEQ ID NO: 3750761 - RNA, 15 nt, Human
gaacuggacucagga

SEQ ID NO: 3750762 - RNA, 16 nt, Human
gaacuggaggcaggga

SEQ ID NO: 3750763 - RNA, 15 nt, Human
gaacuggaggccagg

SEQ ID NO: 3750764 - RNA, 16 nt, Human
gaacugggcauauuuc

SEQ ID NO: 3750765 - RNA, 19 nt, Human
gaacugggcauauuucuaa

SEQ ID NO: 3750766 - RNA, 17 nt, Human
gaacugggccuguugcc

SEQ ID NO: 3750767 - RNA, 18 nt, Human
gaacuguagaugauguau

SEQ ID NO: 3750768 - RNA, 20 nt, Human
gaacuguagcugccauggcu

SEQ ID NO: 3750769 - RNA, 13 nt, Human
gaacuguccagag

SEQ ID NO: 3750770 - RNA, 14 nt, Human
gaacuguccagaga

SEQ ID NO: 3750771 - RNA, 16 nt, Human
gaacuguccagagagc

SEQ ID NO: 3750772 - RNA, 17 nt, Human
gaacugucucucaugaa

SEQ ID NO: 3750773 - RNA, 17 nt, Human
gaacugucugugaacag

SEQ ID NO: 3750774 - RNA, 19 nt, Human
gaacugugcauagugcugg

SEQ ID NO: 3750775 - RNA, 14 nt, Human
gaacugugccacaa

SEQ ID NO: 3750776 - RNA, 16 nt, Human
gaacugugccacaaug

SEQ ID NO: 3750777 - RNA, 16 nt, Human
ggcgucuguucccccu

SEQ ID NO: 3750778 - RNA, 17 nt, Human
ggcgugacucacccaag

SEQ ID NO: 3750779 - RNA, 16 nt, Human
ggcguggcccaaggcu

SEQ ID NO: 3750780 - RNA, 18 nt, Human
ggcgugggagccagccuc

SEQ ID NO: 3750781 - RNA, 17 nt, Human
ggcguggucaagcacuc

SEQ ID NO: 3750782 - RNA, 22 nt, Human
ggcguguaucugguauauguaa

SEQ ID NO: 3750783 - RNA, 23 nt, Human
ggcguugggagggggagaaaagg

SEQ ID NO: 3750784 - RNA, 13 nt, Human
ggcguuuguaaug

SEQ ID NO: 3750785 - RNA, 22 nt, Human
ggcuaaaaaagcugaaucagac

SEQ ID NO: 3750786 - RNA, 20 nt, Human
ggcuaaaugccuaauaaaca

SEQ ID NO: 3750787 - RNA, 17 nt, Human
ggcuaacuauauuugcu

SEQ ID NO: 3750788 - RNA, 16 nt, Human
ggcuaagaggcugcug

SEQ ID NO: 3750789 - RNA, 15 nt, Human
ggcuaaggcaccagc

SEQ ID NO: 3750790 - RNA, 19 nt, Human
ggcuaaggcguggagcugc

SEQ ID NO: 3750791 - RNA, 19 nt, Human
ggcuaauucccagagugug

SEQ ID NO: 3750792 - RNA, 13 nt, Human
ggcuaauuuuugu

SEQ ID NO: 3750793 - RNA, 12 nt, Human
ggcuacacaggg

SEQ ID NO: 3750794 - RNA, 18 nt, Human
ggcuacagagaagccuuc

SEQ ID NO: 3750795 - RNA, 19 nt, Human
ggcuacagagaagccuuca

SEQ ID NO: 3750796 - RNA, 14 nt, Human
ggcuacauuauaaa

SEQ ID NO: 3750797 - RNA, 17 nt, Human
ggcuacccgugagcccu

SEQ ID NO: 3750798 - RNA, 19 nt, Human
ggcuacccugagcugaggc

SEQ ID NO: 3750799 - RNA, 20 nt, Human
ggcuacucagcagcccuccu

SEQ ID NO: 3750800 - RNA, 21 nt, Human
ggcuacucagcagcccuccuc

SEQ ID NO: 3750801 - RNA, 16 nt, Human
ggcuacucugugccag

SEQ ID NO: 3750802 - RNA, 22 nt, Human
gagaaccuagggugauauuaac

SEQ ID NO: 3750803 - RNA, 22 nt, Human
gagaaccucacgcaccucccau

SEQ ID NO: 3750804 - RNA, 14 nt, Human
gagaaccucaggcu

SEQ ID NO: 3750805 - RNA, 13 nt, Human
gagaaccuggccu

SEQ ID NO: 3750806 - RNA, 16 nt, Human
gagaaccuggccuuca

SEQ ID NO: 3750807 - RNA, 13 nt, Human
gagaacgcagccc

SEQ ID NO: 3750808 - RNA, 24 nt, Human
gagaacgcagcccuagagccugcc

SEQ ID NO: 3750809 - RNA, 22 nt, Human
gagaacuaaacuaguuuuuccu

SEQ ID NO: 3750810 - RNA, 20 nt, Human
gagaacuagugguggcucug

SEQ ID NO: 3750811 - RNA, 23 nt, Human
gagaacucaucccuaaugcugca

SEQ ID NO: 3750812 - RNA, 15 nt, Human
gagaacuccugacug

SEQ ID NO: 3750813 - RNA, 19 nt, Human
gagaacugcauauguuucg

SEQ ID NO: 3750814 - RNA, 22 nt, Human
gagaacuuccagauccuggaaa

SEQ ID NO: 3750815 - RNA, 16 nt, Human
gagaacuuucauuuuu

SEQ ID NO: 3750816 - RNA, 18 nt, Human
gagaagaaaauguucuuc

SEQ ID NO: 3750817 - RNA, 16 nt, Human
gagaagaaagaacgga

SEQ ID NO: 3750818 - RNA, 21 nt, Human
gagaagaaagaacggaagaag

SEQ ID NO: 3750819 - RNA, 22 nt, Human
gagaagaaagaggugaccccag

SEQ ID NO: 3750820 - RNA, 16 nt, Human
gagaagaacugaaauc

SEQ ID NO: 3750821 - RNA, 11 nt, Human
gagaagaagaa

SEQ ID NO: 3750822 - RNA, 14 nt, Human
gagaagagaaugca

SEQ ID NO: 3750823 - RNA, 19 nt, Human
gagaagagagaaauagccu

SEQ ID NO: 3750824 - RNA, 12 nt, Human
gagaagagagga

SEQ ID NO: 3750825 - RNA, 16 nt, Human
gagaagagaggagagg

SEQ ID NO: 3750826 - RNA, 15 nt, Human
gagaagagccccacu

SEQ ID NO: 3750827 - RNA, 21 nt, Human
gagaagagccccacucucaga

SEQ ID NO: 3750828 - RNA, 15 nt, Human
gagaagagcuguuca

SEQ ID NO: 3750829 - RNA, 13 nt, Human
gagaagaggcugg

SEQ ID NO: 3750830 - RNA, 14 nt, Human
gagaagagggccug

SEQ ID NO: 3750831 - RNA, 16 nt, Human
gagaagagggccugug

SEQ ID NO: 3750832 - RNA, 20 nt, Human
gagaagauggauaugaccag

SEQ ID NO: 3750833 - RNA, 16 nt, Human
gagaagcagaggaagg

SEQ ID NO: 3750834 - RNA, 18 nt, Human
gagaagcauauagaggca

SEQ ID NO: 3750835 - RNA, 11 nt, Human
gagaagccagc

SEQ ID NO: 3750836 - RNA, 13 nt, Human
gagaagccagcuu

SEQ ID NO: 3750837 - RNA, 14 nt, Human
gagaagccagcuug

SEQ ID NO: 3750838 - RNA, 12 nt, Human
gagaagccagga

SEQ ID NO: 3750839 - RNA, 22 nt, Human
gagaagccaggaauuucccagg

SEQ ID NO: 3750840 - RNA, 20 nt, Human
gagaagccagugcggcaggu

SEQ ID NO: 3750841 - RNA, 23 nt, Human
gagaagccaucaccucagauggc

SEQ ID NO: 3750842 - RNA, 15 nt, Human
gagaagccccuuccc

SEQ ID NO: 3750843 - RNA, 21 nt, Human
gagaagccccuuccccauggg

SEQ ID NO: 3750844 - RNA, 14 nt, Human
gagaagcccgugug

SEQ ID NO: 3750845 - RNA, 12 nt, Human
gagaagccuuca

SEQ ID NO: 3750846 - RNA, 19 nt, Human
gagaagccuucaagcucug

SEQ ID NO: 3750847 - RNA, 15 nt, Human
gagaagcggcuggca

SEQ ID NO: 3750848 - RNA, 21 nt, Human
gagaagcguauguuuuuuauu

SEQ ID NO: 3750849 - RNA, 20 nt, Human
gagaagcuaaaaccugagcu

SEQ ID NO: 3750850 - RNA, 15 nt, Human
gagaagcuacuuugu

SEQ ID NO: 3750851 - RNA, 21 nt, Human
gagaagcucucgggcuaggaa

SEQ ID NO: 3750852 - RNA, 12 nt, Human
gagaagcugcag

SEQ ID NO: 3750853 - RNA, 14 nt, Human
gagaagcugcaucc

SEQ ID NO: 3750854 - RNA, 22 nt, Human
gagaagcugcucaacuugcaaa

SEQ ID NO: 3750855 - RNA, 20 nt, Human
gagaagcugcuccaggccug

SEQ ID NO: 3750856 - RNA, 12 nt, Human
gagaagcugcug

SEQ ID NO: 3750857 - RNA, 17 nt, Human
gagaagcugcugaccaa

SEQ ID NO: 3750858 - RNA, 18 nt, Human
gagaagcugcugaccaau

SEQ ID NO: 3750859 - RNA, 18 nt, Human
gagaaggaaaauuuuagc

SEQ ID NO: 3750860 - RNA, 12 nt, Human
gagaaggaagcc

SEQ ID NO: 3750861 - RNA, 23 nt, Human
gagaaggacccggaggggccugg

SEQ ID NO: 3750862 - RNA, 22 nt, Human
gagaaggauaggccuucauuaa

SEQ ID NO: 3750863 - RNA, 17 nt, Human
gagaaggaucuagaaug

SEQ ID NO: 3750864 - RNA, 13 nt, Human
gagaaggcaggaa

SEQ ID NO: 3750865 - RNA, 20 nt, Human
gagaagggauaacccuacac

SEQ ID NO: 3750866 - RNA, 21 nt, Human
gagaagggcagaguuacuuga

SEQ ID NO: 3750867 - RNA, 15 nt, Human
gagaaggggaggagg

SEQ ID NO: 3750868 - RNA, 14 nt, Human
gagaagucaaacau

SEQ ID NO: 3750869 - RNA, 18 nt, Human
gagaagucaaacauuuca

SEQ ID NO: 3750870 - RNA, 16 nt, Human
gagaagucacagggca

SEQ ID NO: 3750871 - RNA, 22 nt, Human
cuccccgccuuccgccccuucc

SEQ ID NO: 3750872 - RNA, 14 nt, Human
cuccccgcuucugc

SEQ ID NO: 3750873 - RNA, 15 nt, Human
cuccccggcacccuc

SEQ ID NO: 3750874 - RNA, 16 nt, Human
cuccccggcccuacca

SEQ ID NO: 3750875 - RNA, 14 nt, Human
cuccccggcucgag

SEQ ID NO: 3750876 - RNA, 20 nt, Human
cuccccuaaccucuuuucug

SEQ ID NO: 3750877 - RNA, 21 nt, Human
cuccccuauccacccagccca

SEQ ID NO: 3750878 - RNA, 20 nt, Human
cuccccucaaagucugcaac

SEQ ID NO: 3750879 - RNA, 20 nt, Human
cuccccucacagccucugac

SEQ ID NO: 3750880 - RNA, 21 nt, Human
cuccccucagccucuccccug

SEQ ID NO: 3750881 - RNA, 20 nt, Human
cuccccuccaaaaugugccu

SEQ ID NO: 3750882 - RNA, 12 nt, Human
cuccccuccagc

SEQ ID NO: 3750883 - RNA, 13 nt, Human
cuccccuccagcu

SEQ ID NO: 3750884 - RNA, 23 nt, Human
cuccccuccaucccuggcccccu

SEQ ID NO: 3750885 - RNA, 14 nt, Human
cuccccuccccugc

SEQ ID NO: 3750886 - RNA, 18 nt, Human
cuccccuccccugcugca

SEQ ID NO: 3750887 - RNA, 20 nt, Human
cuccccuccuccuggacucc

SEQ ID NO: 3750888 - RNA, 13 nt, Human
cuccccuccucug

SEQ ID NO: 3750889 - RNA, 14 nt, Human
cuccccucggagaa

SEQ ID NO: 3750890 - RNA, 10 nt, Human
cuccccucua

SEQ ID NO: 3750891 - RNA, 21 nt, Human
cuccccucuauuuagcaugac

SEQ ID NO: 3750892 - RNA, 16 nt, Human
cuccccucuccuuccu

SEQ ID NO: 3750893 - RNA, 15 nt, Human
cuccccucucuugca

SEQ ID NO: 3750894 - RNA, 13 nt, Human
cuccccucuuccu

SEQ ID NO: 3750895 - RNA, 22 nt, Human
cuccccugaccugugagcccag

SEQ ID NO: 3750896 - RNA, 13 nt, Human
cuccccugaggcu

SEQ ID NO: 3750897 - RNA, 22 nt, Human
cuccccugauuacaccagccuc

SEQ ID NO: 3750898 - RNA, 13 nt, Human
cuccccugcacug

SEQ ID NO: 3750899 - RNA, 15 nt, Human
cuccccugcacugga

SEQ ID NO: 3750900 - RNA, 14 nt, Human
cuccccugcacugu

SEQ ID NO: 3750901 - RNA, 16 nt, Human
cuccccugcacuguaa

SEQ ID NO: 3750902 - RNA, 17 nt, Human
cuccccugcacuguaaa

SEQ ID NO: 3750903 - RNA, 18 nt, Human
cuccccugccaccaggcc

SEQ ID NO: 3750904 - RNA, 15 nt, Human
cuccccugcccccag

SEQ ID NO: 3750905 - RNA, 16 nt, Human
cuccccugcccccagg

SEQ ID NO: 3750906 - RNA, 17 nt, Human
cuccccugcccccagga

SEQ ID NO: 3750907 - RNA, 18 nt, Human
cuccccugcccccaggac

SEQ ID NO: 3750908 - RNA, 19 nt, Human
cuccccugcccccaggacu

SEQ ID NO: 3750909 - RNA, 21 nt, Human
cuccccugcccccaggacugg

SEQ ID NO: 3750910 - RNA, 18 nt, Human
cuccccugcccccugcag

SEQ ID NO: 3750911 - RNA, 23 nt, Human
cuccccugcccccugcaggaagg

SEQ ID NO: 3750912 - RNA, 13 nt, Human
cuccccugcccuc

SEQ ID NO: 3750913 - RNA, 14 nt, Human
cuccccugcccugc

SEQ ID NO: 3750914 - RNA, 16 nt, Human
cuccccugcccugcug

SEQ ID NO: 3750915 - RNA, 15 nt, Human
cuccccugcugcagg

SEQ ID NO: 3750916 - RNA, 16 nt, Human
cuccccugcugcaggg

SEQ ID NO: 3750917 - RNA, 14 nt, Human
cuccccugcugggu

SEQ ID NO: 3750918 - RNA, 12 nt, Human
cuccccuggacu

SEQ ID NO: 3750919 - RNA, 18 nt, Human
cuccccuggggugcaggc

SEQ ID NO: 3750920 - RNA, 14 nt, Human
cuccccuguaccuu

SEQ ID NO: 3750921 - RNA, 17 nt, Human
cuccccuguuccccucu

SEQ ID NO: 3750922 - RNA, 18 nt, Human
cuccccuguuccccucuc

SEQ ID NO: 3750923 - RNA, 11 nt, Human
cuccccuuccc

SEQ ID NO: 3750924 - RNA, 12 nt, Human
cuccccuuccca

SEQ ID NO: 3750925 - RNA, 19 nt, Human
cuccccuuccccuuccuuc

SEQ ID NO: 3750926 - RNA, 15 nt, Human
cuccccuucccugca

SEQ ID NO: 3750927 - RNA, 14 nt, Human
cuccccuugagcug

SEQ ID NO: 3750928 - RNA, 22 nt, Human
cuccccuugauuuaaacacaca

SEQ ID NO: 3750929 - RNA, 17 nt, Human
cuccccuugccagcugc

SEQ ID NO: 3750930 - RNA, 13 nt, Human
cuccccuugccug

SEQ ID NO: 3750931 - RNA, 18 nt, Human
cuccccuugccugugcca

SEQ ID NO: 3750932 - RNA, 18 nt, Human
cuccccuugggcggcuga

SEQ ID NO: 3750933 - RNA, 16 nt, Human
cuccccuuuuuuuccc

SEQ ID NO: 3750934 - RNA, 16 nt, Human
cucccgaauagcuggg

SEQ ID NO: 3750935 - RNA, 17 nt, Human
cucccgaauagcuggga

SEQ ID NO: 3750936 - RNA, 19 nt, Human
cucccgaauagcugggacu

SEQ ID NO: 3750937 - RNA, 18 nt, Human
cucccgagaccgggcccu

SEQ ID NO: 3750938 - RNA, 23 nt, Human
cucccgagaccgggcccuggguu

SEQ ID NO: 3750939 - RNA, 20 nt, Human
cucccgagacggcacugaga

SEQ ID NO: 3750940 - RNA, 19 nt, Human
cucccgagcuccucuucca

SEQ ID NO: 3750941 - RNA, 17 nt, Human
cucccgauucccaacug

SEQ ID NO: 3750942 - RNA, 23 nt, Human
cucccgcccaaaccuuuccccca

SEQ ID NO: 3750943 - RNA, 13 nt, Human
cucccgcccccca

SEQ ID NO: 3750944 - RNA, 16 nt, Human
cucccgccccuuccca

SEQ ID NO: 3750945 - RNA, 21 nt, Human
cucccgccccuuccccgaggg

SEQ ID NO: 3750946 - RNA, 17 nt, Human
cucccgcuccgggcucc

SEQ ID NO: 3750947 - RNA, 20 nt, Human
cucccgcugcccaggggagc

SEQ ID NO: 3750948 - RNA, 14 nt, Human
cucccggcacucca

SEQ ID NO: 3750949 - RNA, 17 nt, Human
cucccggcaugggaaag

SEQ ID NO: 3750950 - RNA, 17 nt, Human
cucccggcccugccugc

SEQ ID NO: 3750951 - RNA, 22 nt, Human
cucccgggacucacuggcagcc

SEQ ID NO: 3750952 - RNA, 23 nt, Human
cucccgggacucacuggcagccc

SEQ ID NO: 3750953 - RNA, 18 nt, Human
cucccgggccccacagac

SEQ ID NO: 3750954 - RNA, 17 nt, Human
cucccggggcagggcag

SEQ ID NO: 3750955 - RNA, 15 nt, Human
cucccgguucuucca

SEQ ID NO: 3750956 - RNA, 15 nt, Human
cucccgucagggccc

SEQ ID NO: 3750957 - RNA, 19 nt, Human
cucccgucagggcccaagu

SEQ ID NO: 3750958 - RNA, 14 nt, Human
cucccuaaacugua

SEQ ID NO: 3750959 - RNA, 16 nt, Human
cucccuaagccagccu

SEQ ID NO: 3750960 - RNA, 18 nt, Human
cucccuaagccagccugg

SEQ ID NO: 3750961 - RNA, 22 nt, Human
cucccuaccaccuccccagccu

SEQ ID NO: 3750962 - RNA, 17 nt, Human
cucccuaccucaaccug

SEQ ID NO: 3750963 - RNA, 23 nt, Human
cucccuagugacccggaggccac

SEQ ID NO: 3750964 - RNA, 17 nt, Human
cucccuauaaugcugga

SEQ ID NO: 3750965 - RNA, 18 nt, Human
cucccuauacugcuugga

SEQ ID NO: 3750966 - RNA, 15 nt, Human
cucccucaaagcaca

SEQ ID NO: 3750967 - RNA, 14 nt, Human
cucccucaacccca

SEQ ID NO: 3750968 - RNA, 18 nt, Human
cucccucacccccuccuu

SEQ ID NO: 3750969 - RNA, 14 nt, Human
cucccucacucuca

SEQ ID NO: 3750970 - RNA, 22 nt, Human
cucccucaucaaggacacgggc

SEQ ID NO: 3750971 - RNA, 13 nt, Human
cucccucauucca

SEQ ID NO: 3750972 - RNA, 14 nt, Human
cucccucauuccac

SEQ ID NO: 3750973 - RNA, 22 nt, Human
cucccuccaccucccugcaaua

SEQ ID NO: 3750974 - RNA, 13 nt, Human
cucccuccagcac

SEQ ID NO: 3750975 - RNA, 16 nt, Human
cucccuccagcacaaa

SEQ ID NO: 3750976 - RNA, 21 nt, Human
cucccucccagagcaccugcu

SEQ ID NO: 3750977 - RNA, 11 nt, Human
cucccuccccu

SEQ ID NO: 3750978 - RNA, 15 nt, Human
cucccuccccugcca

SEQ ID NO: 3750979 - RNA, 18 nt, Human
cucccuccccugcccucg

SEQ ID NO: 3750980 - RNA, 21 nt, Human
cucccuccccuugccugugcc

SEQ ID NO: 3750981 - RNA, 13 nt, Human
cucccucccgcac

SEQ ID NO: 3750982 - RNA, 14 nt, Human
cucccucccucucc

SEQ ID NO: 3750983 - RNA, 18 nt, Human
cucccuccgauccuuccu

SEQ ID NO: 3750984 - RNA, 16 nt, Human
cucccuccgcccccag

SEQ ID NO: 3750985 - RNA, 17 nt, Human
cucccuccucaccucug

SEQ ID NO: 3750986 - RNA, 16 nt, Human
cucccuccuccaggcc

SEQ ID NO: 3750987 - RNA, 12 nt, Human
cucccuccucug

SEQ ID NO: 3750988 - RNA, 15 nt, Human
cucccuccucugucc

SEQ ID NO: 3750989 - RNA, 20 nt, Human
cucccuccuuccuucuugcu

SEQ ID NO: 3750990 - RNA, 21 nt, Human
cucccucgaacccacacugca

SEQ ID NO: 3750991 - RNA, 22 nt, Human
cucccucgaacccacacugcaa

SEQ ID NO: 3750992 - RNA, 22 nt, Human
cucccucuaggcucugccuucg

SEQ ID NO: 3750993 - RNA, 19 nt, Human
cucccucucaacacccagu

SEQ ID NO: 3750994 - RNA, 15 nt, Human
cucccucucccuguc

SEQ ID NO: 3750995 - RNA, 12 nt, Human
cucccucuccug

SEQ ID NO: 3750996 - RNA, 13 nt, Human
cucccucuccugc

SEQ ID NO: 3750997 - RNA, 17 nt, Human
cucccucuccugccuac

SEQ ID NO: 3750998 - RNA, 16 nt, Human
cucccucucucuucug

SEQ ID NO: 3750999 - RNA, 13 nt, Human
cucccucugaccu

SEQ ID NO: 3751000 - RNA, 14 nt, Human
cucccucugaccug

SEQ ID NO: 3751001 - RNA, 18 nt, Human
cucccucugaccugcagg

SEQ ID NO: 3751002 - RNA, 20 nt, Human
cucccucugaggcuguagga

SEQ ID NO: 3751003 - RNA, 17 nt, Human
cucccucugccggcucu

SEQ ID NO: 3751004 - RNA, 15 nt, Human
cucccucuggcccug

SEQ ID NO: 3751005 - RNA, 14 nt, Human
cucccucuucuuuc

SEQ ID NO: 3751006 - RNA, 12 nt, Human
cucccucuuguu

SEQ ID NO: 3751007 - RNA, 19 nt, Human
cucccucuuucccucccuu

SEQ ID NO: 3751008 - RNA, 20 nt, Human
cucccucuuucccucccuuc

SEQ ID NO: 3751009 - RNA, 19 nt, Human
cucccugaagccagccuuc

SEQ ID NO: 3751010 - RNA, 18 nt, Human
cucccugaagccuuugca

SEQ ID NO: 3751011 - RNA, 23 nt, Human
cucccugacccuguauauagccc

SEQ ID NO: 3751012 - RNA, 14 nt, Human
cucccugcaauaaa

SEQ ID NO: 3751013 - RNA, 16 nt, Human
cucccugcaauaaaau

SEQ ID NO: 3751014 - RNA, 20 nt, Human
cucccugcacaagccagggu

SEQ ID NO: 3751015 - RNA, 15 nt, Human
cucccugcagaugcc

SEQ ID NO: 3751016 - RNA, 23 nt, Human
cucccugcagaugccacccuagc

SEQ ID NO: 3751017 - RNA, 23 nt, Human
cucccugcauggcauccuccagc

SEQ ID NO: 3751018 - RNA, 18 nt, Human
cucccugccagcaccccc

SEQ ID NO: 3751019 - RNA, 12 nt, Human
cucccugccagu

SEQ ID NO: 3751020 - RNA, 17 nt, Human
cucccugccccccagcc

SEQ ID NO: 3751021 - RNA, 23 nt, Human
cucccugccccccagcccuccuu

SEQ ID NO: 3751022 - RNA, 23 nt, Human
gacuugccaugugacucuggcuu

SEQ ID NO: 3751023 - RNA, 16 nt, Human
gacuugccuccguguc

SEQ ID NO: 3751024 - RNA, 17 nt, Human
gacuugccuccguguca

SEQ ID NO: 3751025 - RNA, 17 nt, Human
gacuuggcaacagaagc

SEQ ID NO: 3751026 - RNA, 12 nt, Human
gacuuggccucu

SEQ ID NO: 3751027 - RNA, 22 nt, Human
gacuuggcuggugugguacaga

SEQ ID NO: 3751028 - RNA, 23 nt, Human
gacuuggcuggugugguacagag

SEQ ID NO: 3751029 - RNA, 16 nt, Human
gacuuggucaccagcu

SEQ ID NO: 3751030 - RNA, 23 nt, Human
gacuugguguccuuucccuccac

SEQ ID NO: 3751031 - RNA, 19 nt, Human
gacuuguauauuuguacaa

SEQ ID NO: 3751032 - RNA, 13 nt, Human
gacuugugucucu

SEQ ID NO: 3751033 - RNA, 18 nt, Human
gacuuuaacauaagcuau

SEQ ID NO: 3751034 - RNA, 19 nt, Human
gacuuuaacauaagcuauu

SEQ ID NO: 3751035 - RNA, 15 nt, Human
gacuuuaauuuaugu

SEQ ID NO: 3751036 - RNA, 21 nt, Human
gacuuuacccauuuggguggg

SEQ ID NO: 3751037 - RNA, 13 nt, Human
gacuuuagaaaua

SEQ ID NO: 3751038 - RNA, 22 nt, Human
gacuuuagccuaccuaacccag

SEQ ID NO: 3751039 - RNA, 17 nt, Human
gacuuuaggcuuucagc

SEQ ID NO: 3751040 - RNA, 19 nt, Human
gacuuuauagaucagccag

SEQ ID NO: 3751041 - RNA, 21 nt, Human
gacuuuaucuaauaccucugu

SEQ ID NO: 3751042 - RNA, 22 nt, Human
gacuuuaucuaauaccucugug

SEQ ID NO: 3751043 - RNA, 14 nt, Human
gacuuuauuauuua

SEQ ID NO: 3751044 - RNA, 14 nt, Human
gacuuucagguacu

SEQ ID NO: 3751045 - RNA, 15 nt, Human
gacuuucauuggaaa

SEQ ID NO: 3751046 - RNA, 18 nt, Human
gacuuuccacccccuccc

SEQ ID NO: 3751047 - RNA, 14 nt, Human
gacuuuccauuaca

SEQ ID NO: 3751048 - RNA, 18 nt, Human
gacuuuccccaccagaug

SEQ ID NO: 3751049 - RNA, 11 nt, Human
gacuuuccugc

SEQ ID NO: 3751050 - RNA, 12 nt, Human
gacuuuccugca

SEQ ID NO: 3751051 - RNA, 18 nt, Human
gacuuucggaguuggggg

SEQ ID NO: 3751052 - RNA, 19 nt, Human
gacuuucggaguugggggu

SEQ ID NO: 3751053 - RNA, 13 nt, Human
gacuuucucuaau

SEQ ID NO: 3751054 - RNA, 16 nt, Human
gacuuucucuaauaau

SEQ ID NO: 3751055 - RNA, 19 nt, Human
gacuuucucuaauaauaaa

SEQ ID NO: 3751056 - RNA, 15 nt, Human
gacuuucugccugga

SEQ ID NO: 3751057 - RNA, 23 nt, Human
gacuuucuuuuuugauauagaag

SEQ ID NO: 3751058 - RNA, 18 nt, Human
gacuuugaugucagcagu

SEQ ID NO: 3751059 - RNA, 20 nt, Human
gacuuugauugcacauuguu

SEQ ID NO: 3751060 - RNA, 14 nt, Human
gacuuugcuugcuu

SEQ ID NO: 3751061 - RNA, 14 nt, Human
gacuuuggaaagag

SEQ ID NO: 3751062 - RNA, 19 nt, Human
gacuuuggauaauaaggaa

SEQ ID NO: 3751063 - RNA, 22 nt, Human
gacuuugguuauuuuacuuuuu

SEQ ID NO: 3751064 - RNA, 15 nt, Human
gacuuuguuacacug

SEQ ID NO: 3751065 - RNA, 12 nt, Human
gacuuuguucac

SEQ ID NO: 3751066 - RNA, 17 nt, Human
gacuuuguuuuuaaaau

SEQ ID NO: 3751067 - RNA, 22 nt, Human
gacuuuucaaguauuuaagccu

SEQ ID NO: 3751068 - RNA, 20 nt, Human
gacuuuuccaacccucauca

SEQ ID NO: 3751069 - RNA, 17 nt, Human
gacuuuuccaauaugug

SEQ ID NO: 3751070 - RNA, 18 nt, Human
gacuuuuccauguaucua

SEQ ID NO: 3751071 - RNA, 18 nt, Human
gacuuuucguuaacauug

SEQ ID NO: 3751072 - RNA, 19 nt, Human
gacuuuucguuaacauuga

SEQ ID NO: 3751073 - RNA, 14 nt, Human
gacuuuucugcaaa

SEQ ID NO: 3751074 - RNA, 18 nt, Human
gacuuuugaaaagaggug

SEQ ID NO: 3751075 - RNA, 14 nt, Human
gacuuuugcuuuaa

SEQ ID NO: 3751076 - RNA, 18 nt, Human
gacuuuuuucuaguacac

SEQ ID NO: 3751077 - RNA, 19 nt, Human
gacuuuuuuuuuuuauaau

SEQ ID NO: 3751078 - RNA, 16 nt, Human
gagaaaaaaaaaauag

SEQ ID NO: 3751079 - RNA, 14 nt, Human
gagaaaaaagaagu

SEQ ID NO: 3751080 - RNA, 13 nt, Human
gagaaaaaugcuu

SEQ ID NO: 3751081 - RNA, 19 nt, Human
gagaaaagaaaaaaaaaga

SEQ ID NO: 3751082 - RNA, 18 nt, Human
gagaaaagcacacuugua

SEQ ID NO: 3751083 - RNA, 16 nt, Human
gagaaaaggaaaagaa

SEQ ID NO: 3751084 - RNA, 11 nt, Human
gagaaaauaaa

SEQ ID NO: 3751085 - RNA, 15 nt, Human
gagaaaauaaaaagu

SEQ ID NO: 3751086 - RNA, 21 nt, Human
gagaaaauggacguguuauga

SEQ ID NO: 3751087 - RNA, 18 nt, Human
gagaaaauugaauuuaac

SEQ ID NO: 3751088 - RNA, 17 nt, Human
gagaaacaauaaagaga

SEQ ID NO: 3751089 - RNA, 13 nt, Human
gagaaacacuuga

SEQ ID NO: 3751090 - RNA, 16 nt, Human
gagaaacagccugugu

SEQ ID NO: 3751091 - RNA, 21 nt, Human
gagaaacaguugguaacuuuu

SEQ ID NO: 3751092 - RNA, 15 nt, Human
gagaaaccagcuucc

SEQ ID NO: 3751093 - RNA, 21 nt, Human
gagaugacugaguccucguag

SEQ ID NO: 3751094 - RNA, 20 nt, Human
gagaugaggaguaaaauuca

SEQ ID NO: 3751095 - RNA, 17 nt, Human
gagaugaggccgccaug

SEQ ID NO: 3751096 - RNA, 22 nt, Human
gagaugauacauccaaagcaga

SEQ ID NO: 3751097 - RNA, 17 nt, Human
gagaugauucagaaggg

SEQ ID NO: 3751098 - RNA, 14 nt, Human
gagaugccuccacc

SEQ ID NO: 3751099 - RNA, 20 nt, Human
gagaugccuccaccgcugcc

SEQ ID NO: 3751100 - RNA, 22 nt, Human
gagaugccuccaccgcugccua

SEQ ID NO: 3751101 - RNA, 14 nt, Human
gagaugccucccug

SEQ ID NO: 3751102 - RNA, 16 nt, Human
gagaugcuagaacucc

SEQ ID NO: 3751103 - RNA, 20 nt, Human
gagaugcuagaacucccuuu

SEQ ID NO: 3751104 - RNA, 15 nt, Human
gagaugcuggagaag

SEQ ID NO: 3751105 - RNA, 16 nt, Human
gagaugcuggagaaga

SEQ ID NO: 3751106 - RNA, 19 nt, Human
gagaugcuggagaagagag

SEQ ID NO: 3751107 - RNA, 19 nt, Human
gagaugcuggcuugggcag

SEQ ID NO: 3751108 - RNA, 15 nt, Human
gagauggcccucugg

SEQ ID NO: 3751109 - RNA, 16 nt, Human
gagauggcccucuggu

SEQ ID NO: 3751110 - RNA, 22 nt, Human
gagaugggagcuccucuccugg

SEQ ID NO: 3751111 - RNA, 14 nt, Human
gagaugggcuuccc

SEQ ID NO: 3751112 - RNA, 16 nt, Human
gagaugggcuucccaa

SEQ ID NO: 3751113 - RNA, 17 nt, Human
gagauguaaaagguauu

SEQ ID NO: 3751114 - RNA, 12 nt, Human
gagaugucucuu

SEQ ID NO: 3751115 - RNA, 14 nt, Human
gagaugugcaccca

SEQ ID NO: 3751116 - RNA, 16 nt, Human
gagauguguaucagug

SEQ ID NO: 3751117 - RNA, 20 nt, Human
gagauguguggacuguggca

SEQ ID NO: 3751118 - RNA, 21 nt, Human
gagauguguguugauacuguu

SEQ ID NO: 3751119 - RNA, 14 nt, Human
gagauguuuuagag

SEQ ID NO: 3751120 - RNA, 18 nt, Human
gagauguuuuuaaaaguu

SEQ ID NO: 3751121 - RNA, 13 nt, Human
gagauuauaauaa

SEQ ID NO: 3751122 - RNA, 15 nt, Human
gagauuauguucuuu

SEQ ID NO: 3751123 - RNA, 14 nt, Human
gagauucagacugu

SEQ ID NO: 3751124 - RNA, 13 nt, Human
gagauucauuuuc

SEQ ID NO: 3751125 - RNA, 21 nt, Human
gagauucauuuucuagauaca

SEQ ID NO: 3751126 - RNA, 20 nt, Human
gagauucucauaacuugaga

SEQ ID NO: 3751127 - RNA, 15 nt, Human
gagauucugccuuug

SEQ ID NO: 3751128 - RNA, 15 nt, Human
gagauucugugaucu

SEQ ID NO: 3751129 - RNA, 13 nt, Human
gagauugagaagg

SEQ ID NO: 3751130 - RNA, 20 nt, Human
gagauugagaaggagagaaa

SEQ ID NO: 3751131 - RNA, 16 nt, Human
gagauuggcauggcuu

SEQ ID NO: 3751132 - RNA, 17 nt, Human
gagauugguuuuccugu

SEQ ID NO: 3751133 - RNA, 23 nt, Human
gagauuuaauuaaucaugaaugu

SEQ ID NO: 3751134 - RNA, 14 nt, Human
gagauuuauauaaa

SEQ ID NO: 3751135 - RNA, 16 nt, Human
gagauuuauauaaaug

SEQ ID NO: 3751136 - RNA, 17 nt, Human
gagauuucaucugcucu

SEQ ID NO: 3751137 - RNA, 19 nt, Human
gagauuucaucugcucucc

SEQ ID NO: 3751138 - RNA, 20 nt, Human
gagauuucaucugcucuccu

SEQ ID NO: 3751139 - RNA, 21 nt, Human
gagauuucaucugcucuccuu

SEQ ID NO: 3751140 - RNA, 20 nt, Human
gagauuuggggcuaaagacu

SEQ ID NO: 3751141 - RNA, 21 nt, Human
gagauuuucaacauuucaaaa

SEQ ID NO: 3751142 - RNA, 16 nt, Human
gagauuuuuuauugcu

SEQ ID NO: 3751143 - RNA, 20 nt, Human
gagcaaaaauaucccuuccg

SEQ ID NO: 3751144 - RNA, 12 nt, Human
gagcaaaauaau

SEQ ID NO: 3751145 - RNA, 18 nt, Human
gagcaaaaugcauguaau

SEQ ID NO: 3751146 - RNA, 19 nt, Human
gagcaaacugcaugcccag

SEQ ID NO: 3751147 - RNA, 20 nt, Human
gagcaaacugcaugcccaga

SEQ ID NO: 3751148 - RNA, 13 nt, Human
gagcaaagaucaa

SEQ ID NO: 3751149 - RNA, 13 nt, Human
gagcaaagccugu

SEQ ID NO: 3751150 - RNA, 14 nt, Human
gagcaaagccuguu

SEQ ID NO: 3751151 - RNA, 23 nt, Human
gagcaaagccuguucauggcaga

SEQ ID NO: 3751152 - RNA, 22 nt, Human
gagcaaaggcugagaacacugu

SEQ ID NO: 3751153 - RNA, 14 nt, Human
gagcaaauguuucu

SEQ ID NO: 3751154 - RNA, 22 nt, Human
gagcaaccccuggaccccagcc

SEQ ID NO: 3751155 - RNA, 15 nt, Human
gagcaaccucucacu

SEQ ID NO: 3751156 - RNA, 18 nt, Human
gagcaagacccugucucu

SEQ ID NO: 3751157 - RNA, 22 nt, Human
gagcaagacgcugugcugcccu

SEQ ID NO: 3751158 - RNA, 14 nt, Human
gagcaagacucugu

SEQ ID NO: 3751159 - RNA, 17 nt, Human
gagcaagcuuuuuuauu

SEQ ID NO: 3751160 - RNA, 15 nt, Human
gagcaagucugcagg

SEQ ID NO: 3751161 - RNA, 21 nt, Human
gagcaagucugcaggugcacc

SEQ ID NO: 3751162 - RNA, 18 nt, Human
gagcaaguuccuucuggu

SEQ ID NO: 3751163 - RNA, 15 nt, Human
gagcaaugucugugc

SEQ ID NO: 3751164 - RNA, 16 nt, Human
gagcacaaaauucaaa

SEQ ID NO: 3751165 - RNA, 15 nt, Human
gagcacaaacauuuu

SEQ ID NO: 3751166 - RNA, 16 nt, Human
gagcacaaacauuuuu

SEQ ID NO: 3751167 - RNA, 19 nt, Human
gagcacaacccccagcucc

SEQ ID NO: 3751168 - RNA, 13 nt, Human
gagcacacccagc

SEQ ID NO: 3751169 - RNA, 18 nt, Human
gagcacacuuggcccaag

SEQ ID NO: 3751170 - RNA, 17 nt, Human
gagcacagaucuguuuc

SEQ ID NO: 3751171 - RNA, 18 nt, Human
gagcacagcccucccgcc

SEQ ID NO: 3751172 - RNA, 13 nt, Human
gagcacaggcagc

SEQ ID NO: 3751173 - RNA, 13 nt, Human
gagcacagguccc

SEQ ID NO: 3751174 - RNA, 22 nt, Human
gagcacaggucccaccuccagc

SEQ ID NO: 3751175 - RNA, 15 nt, Human
gagcaccaggcacga

SEQ ID NO: 3751176 - RNA, 17 nt, Human
gagcaccgaauauugag

SEQ ID NO: 3751177 - RNA, 23 nt, Human
gagcaccgugucaagcugcucug

SEQ ID NO: 3751178 - RNA, 14 nt, Human
gagcaccuccacau

SEQ ID NO: 3751179 - RNA, 16 nt, Human
gagcaccucccagccc

SEQ ID NO: 3751180 - RNA, 16 nt, Human
gagcaccugcugucug

SEQ ID NO: 3751181 - RNA, 17 nt, Human
gagcaccugcugucugg

SEQ ID NO: 3751182 - RNA, 19 nt, Human
gagcaccuuagacaguccc

SEQ ID NO: 3751183 - RNA, 22 nt, Human
gagcacggcucuguccccagcc

SEQ ID NO: 3751184 - RNA, 23 nt, Human
gagcacggcucuguccccagccu

SEQ ID NO: 3751185 - RNA, 21 nt, Human
gagcacuaaggugugcucuga

SEQ ID NO: 3751186 - RNA, 15 nt, Human
gagcacucccaaguc

SEQ ID NO: 3751187 - RNA, 21 nt, Human
gagcacucugaguuuaccauu

SEQ ID NO: 3751188 - RNA, 15 nt, Human
gagcacugccaggag

SEQ ID NO: 3751189 - RNA, 18 nt, Human
gagcacugccaggaggga

SEQ ID NO: 3751190 - RNA, 13 nt, Human
gagcacuggguug

SEQ ID NO: 3751191 - RNA, 17 nt, Human
gagcacuggguugacuu

SEQ ID NO: 3751192 - RNA, 22 nt, Human
gagcacuguuuucuaguguauc

SEQ ID NO: 3751193 - RNA, 15 nt, Human
gagcacuuaagagaa

SEQ ID NO: 3751194 - RNA, 15 nt, Human
gagcacuuacuguaa

SEQ ID NO: 3751195 - RNA, 14 nt, Human
gagcagaaauucug

SEQ ID NO: 3751196 - RNA, 17 nt, Human
gagcagaaauucuguuu

SEQ ID NO: 3751197 - RNA, 12 nt, Human
gagcagaagcag

SEQ ID NO: 3751198 - RNA, 14 nt, Human
gagcagaagcagca

SEQ ID NO: 3751199 - RNA, 17 nt, Human
gagcagaaguggagcug

SEQ ID NO: 3751200 - RNA, 14 nt, Human
gagcagacaggagg

SEQ ID NO: 3751201 - RNA, 19 nt, Human
gagcagacuggugagcaga

SEQ ID NO: 3751202 - RNA, 20 nt, Human
gagcagacuggugagcagac

SEQ ID NO: 3751203 - RNA, 23 nt, Human
gagcagacuggugagcagacugg

SEQ ID NO: 3751204 - RNA, 17 nt, Human
gagcagagaaggccagg

SEQ ID NO: 3751205 - RNA, 16 nt, Human
gagcagagaauucucu

SEQ ID NO: 3751206 - RNA, 12 nt, Human
gagcagagacca

SEQ ID NO: 3751207 - RNA, 18 nt, Human
gagcagagaccaucccug

SEQ ID NO: 3751208 - RNA, 21 nt, Human
gagcagagaccaucccugaag

SEQ ID NO: 3751209 - RNA, 23 nt, Human
gagcagagaccaucccugaaggc

SEQ ID NO: 3751210 - RNA, 20 nt, Human
gagcagagaucacaccacug

SEQ ID NO: 3751211 - RNA, 22 nt, Human
gagcagagaucacaccacugca

SEQ ID NO: 3751212 - RNA, 20 nt, Human
gagcagaggggcagaggccc

SEQ ID NO: 3751213 - RNA, 14 nt, Human
gagcagaugcagag

SEQ ID NO: 3751214 - RNA, 17 nt, Human
cuccugcccaguccccc

SEQ ID NO: 3751215 - RNA, 23 nt, Human
cuccugcccgcagaccucuggau

SEQ ID NO: 3751216 - RNA, 11 nt, Human
cuccugcccuu

SEQ ID NO: 3751217 - RNA, 16 nt, Human
cuccugccgacuccug

SEQ ID NO: 3751218 - RNA, 17 nt, Human
cuccugccgacuccugg

SEQ ID NO: 3751219 - RNA, 18 nt, Human
cuccugccgcagagcugg

SEQ ID NO: 3751220 - RNA, 15 nt, Human
cuccugccucagccu

SEQ ID NO: 3751221 - RNA, 21 nt, Human
cuccugccucagccuccugag

SEQ ID NO: 3751222 - RNA, 22 nt, Human
cuccugccucgaacuggcugca

SEQ ID NO: 3751223 - RNA, 22 nt, Human
cuccugccucuacugggaaggc

SEQ ID NO: 3751224 - RNA, 14 nt, Human
cuccugccugcccc

SEQ ID NO: 3751225 - RNA, 19 nt, Human
cuccugccuguagcaguga

SEQ ID NO: 3751226 - RNA, 14 nt, Human
cuccugccugugcu

SEQ ID NO: 3751227 - RNA, 20 nt, Human
cuccugccuuccuccugggc

SEQ ID NO: 3751228 - RNA, 16 nt, Human
cuccugccuucugucc

SEQ ID NO: 3751229 - RNA, 22 nt, Human
cuccugccuucuguccuggugu

SEQ ID NO: 3751230 - RNA, 14 nt, Human
cuccugcugcacca

SEQ ID NO: 3751231 - RNA, 18 nt, Human
cuccugcugcaccaaccc

SEQ ID NO: 3751232 - RNA, 22 nt, Human
cuccugcugcaccaacccagcc

SEQ ID NO: 3751233 - RNA, 16 nt, Human
cuccugcugcagaggg

SEQ ID NO: 3751234 - RNA, 16 nt, Human
cuccugcugcucccuc

SEQ ID NO: 3751235 - RNA, 20 nt, Human
cuccugcugcucccucagac

SEQ ID NO: 3751236 - RNA, 17 nt, Human
cuccuggaaaggcucag

SEQ ID NO: 3751237 - RNA, 14 nt, Human
cuccuggaaauauu

SEQ ID NO: 3751238 - RNA, 17 nt, Human
cuccuggaaccuugcug

SEQ ID NO: 3751239 - RNA, 18 nt, Human
cuccuggaaccuugcugu

SEQ ID NO: 3751240 - RNA, 19 nt, Human
cuccuggaaccuugcuguc

SEQ ID NO: 3751241 - RNA, 22 nt, Human
cuccuggaaccuugcuguccug

SEQ ID NO: 3751242 - RNA, 11 nt, Human
cuccuggacuc

SEQ ID NO: 3751243 - RNA, 15 nt, Human
cuccuggacuccugc

SEQ ID NO: 3751244 - RNA, 10 nt, Human
cuccuggagg

SEQ ID NO: 3751245 - RNA, 15 nt, Human
cuccuggaucucccu

SEQ ID NO: 3751246 - RNA, 19 nt, Human
cuccuggaucucccugaga

SEQ ID NO: 3751247 - RNA, 21 nt, Human
cuccuggaucucccugagaug

SEQ ID NO: 3751248 - RNA, 16 nt, Human
cuccuggcccacugca

SEQ ID NO: 3751249 - RNA, 19 nt, Human
cuccuggcccacugcaucg

SEQ ID NO: 3751250 - RNA, 12 nt, Human
cuccuggcccag

SEQ ID NO: 3751251 - RNA, 15 nt, Human
cuccuggcccagccu

SEQ ID NO: 3751252 - RNA, 18 nt, Human
cuccuggcccagccuuug

SEQ ID NO: 3751253 - RNA, 14 nt, Human
cuccuggcccaggu

SEQ ID NO: 3751254 - RNA, 13 nt, Human
cuccuggccuauc

SEQ ID NO: 3751255 - RNA, 22 nt, Human
cuccuggccuauccgcugccag

SEQ ID NO: 3751256 - RNA, 19 nt, Human
cuccuggccucaagugauu

SEQ ID NO: 3751257 - RNA, 15 nt, Human
cuccuggccucagac

SEQ ID NO: 3751258 - RNA, 18 nt, Human
cuccuggccucagacugc

SEQ ID NO: 3751259 - RNA, 23 nt, Human
cuccuggccucagacugcaccca

SEQ ID NO: 3751260 - RNA, 22 nt, Human
cuccuggcucuugauacccccc

SEQ ID NO: 3751261 - RNA, 18 nt, Human
cuccuggcugucugaggc

SEQ ID NO: 3751262 - RNA, 19 nt, Human
cuccuggcugucugaggcu

SEQ ID NO: 3751263 - RNA, 21 nt, Human
cuccuggcuucccauccccag

SEQ ID NO: 3751264 - RNA, 23 nt, Human
cuccugggauuggcugugaacug

SEQ ID NO: 3751265 - RNA, 12 nt, Human
cuccugggcagc

SEQ ID NO: 3751266 - RNA, 14 nt, Human
cuccugggcagcug

SEQ ID NO: 3751267 - RNA, 20 nt, Human
cuccugggccccucccuacc

SEQ ID NO: 3751268 - RNA, 15 nt, Human
cuccugggcccucuc

SEQ ID NO: 3751269 - RNA, 21 nt, Human
cuccugggcccucucugcucu

SEQ ID NO: 3751270 - RNA, 22 nt, Human
cuccugggcccucucugcucug

SEQ ID NO: 3751271 - RNA, 13 nt, Human
cuccugggcucag

SEQ ID NO: 3751272 - RNA, 19 nt, Human
cuccuggggcgcgugaggc

SEQ ID NO: 3751273 - RNA, 20 nt, Human
cuccuggggguucuuucuuc

SEQ ID NO: 3751274 - RNA, 19 nt, Human
cuccuggguucaagcgauu

SEQ ID NO: 3751275 - RNA, 15 nt, Human
cuccugguccuaggc

SEQ ID NO: 3751276 - RNA, 23 nt, Human
cuccuggucuugagaugucuucu

SEQ ID NO: 3751277 - RNA, 17 nt, Human
cuccugguggguccagg

SEQ ID NO: 3751278 - RNA, 19 nt, Human
cuccuggugucaccccaga

SEQ ID NO: 3751279 - RNA, 22 nt, Human
cuccuggugucaccccagagcc

SEQ ID NO: 3751280 - RNA, 21 nt, Human
cuccuguaaaugguguacaua

SEQ ID NO: 3751281 - RNA, 20 nt, Human
cuccuguaagccaaagaaau

SEQ ID NO: 3751282 - RNA, 17 nt, Human
cuccuguacuuuuucca

SEQ ID NO: 3751283 - RNA, 20 nt, Human
cuccuguccaucagccagga

SEQ ID NO: 3751284 - RNA, 13 nt, Human
cuccuguccccug

SEQ ID NO: 3751285 - RNA, 21 nt, Human
cuccuguccccugcuacaccu

SEQ ID NO: 3751286 - RNA, 12 nt, Human
cuccuguccucc

SEQ ID NO: 3751287 - RNA, 15 nt, Human
cuccuguccucccau

SEQ ID NO: 3751288 - RNA, 13 nt, Human
cuccuguccuuua

SEQ ID NO: 3751289 - RNA, 16 nt, Human
cuccugucucccuccu

SEQ ID NO: 3751290 - RNA, 14 nt, Human
cuccugucuuccca

SEQ ID NO: 3751291 - RNA, 15 nt, Human
cuccugucuucccag

SEQ ID NO: 3751292 - RNA, 18 nt, Human
cuccugucuucccagggu

SEQ ID NO: 3751293 - RNA, 13 nt, Human
cuccugucuucug

SEQ ID NO: 3751294 - RNA, 17 nt, Human
cuccugucuucugcuuu

SEQ ID NO: 3751295 - RNA, 11 nt, Human
cuccugugacc

SEQ ID NO: 3751296 - RNA, 17 nt, Human
cuccugugcucagcccu

SEQ ID NO: 3751297 - RNA, 18 nt, Human
cuccuguggaacccagca

SEQ ID NO: 3751298 - RNA, 20 nt, Human
cuccuguggaacccagcagu

SEQ ID NO: 3751299 - RNA, 20 nt, Human
cuccuguggccccacccugg

SEQ ID NO: 3751300 - RNA, 13 nt, Human
cuccugugggagc

SEQ ID NO: 3751301 - RNA, 17 nt, Human
cuccugugggagccucg

SEQ ID NO: 3751302 - RNA, 19 nt, Human
cuccugugggagccucgca

SEQ ID NO: 3751303 - RNA, 11 nt, Human
cuccuguguaa

SEQ ID NO: 3751304 - RNA, 14 nt, Human
cuccuguguacugu

SEQ ID NO: 3751305 - RNA, 14 nt, Human
cuccugugugugcg

SEQ ID NO: 3751306 - RNA, 23 nt, Human
cuccuguuagcuccucacugugg

SEQ ID NO: 3751307 - RNA, 17 nt, Human
cuccuguugcacccagc

SEQ ID NO: 3751308 - RNA, 20 nt, Human
cuccuguugcacccagcccu

SEQ ID NO: 3751309 - RNA, 21 nt, Human
cuccuguugcacccagcccug

SEQ ID NO: 3751310 - RNA, 23 nt, Human
cuccuuaagcugcagagauuucu

SEQ ID NO: 3751311 - RNA, 22 nt, Human
cuccuuaaggcucuuuuguaag

SEQ ID NO: 3751312 - RNA, 20 nt, Human
cuccuuagaaguggaaguag

SEQ ID NO: 3751313 - RNA, 14 nt, Human
cuccuuagcugcca

SEQ ID NO: 3751314 - RNA, 18 nt, Human
cuccuuaggguuuucucu

SEQ ID NO: 3751315 - RNA, 22 nt, Human
cuccuuaucaaaggacaccauu

SEQ ID NO: 3751316 - RNA, 21 nt, Human
cuccuucaacaauucuaaaau

SEQ ID NO: 3751317 - RNA, 13 nt, Human
cuccuucaccuuu

SEQ ID NO: 3751318 - RNA, 14 nt, Human
cuccuucaccuuug

SEQ ID NO: 3751319 - RNA, 16 nt, Human
cuccuucaccuuuguc

SEQ ID NO: 3751320 - RNA, 13 nt, Human
cuccuucacuguu

SEQ ID NO: 3751321 - RNA, 15 nt, Human
cuccuucacuguuuc

SEQ ID NO: 3751322 - RNA, 15 nt, Human
cuccuucagcccuca

SEQ ID NO: 3751323 - RNA, 20 nt, Human
cuccuucagcccucaccccu

SEQ ID NO: 3751324 - RNA, 15 nt, Human
cuccuuccaacugcu

SEQ ID NO: 3751325 - RNA, 22 nt, Human
cuccuucccaaaggacuccacc

SEQ ID NO: 3751326 - RNA, 15 nt, Human
cuccuucccacucuu

SEQ ID NO: 3751327 - RNA, 18 nt, Human
cuccuucccacucuucuc

SEQ ID NO: 3751328 - RNA, 20 nt, Human
cuccuucccacucuucucau

SEQ ID NO: 3751329 - RNA, 14 nt, Human
cuccuucccagcug

SEQ ID NO: 3751330 - RNA, 15 nt, Human
cuccuucccagcugc

SEQ ID NO: 3751331 - RNA, 16 nt, Human
cuccuucccagcugcc

SEQ ID NO: 3751332 - RNA, 17 nt, Human
cuccuucccagcugccc

SEQ ID NO: 3751333 - RNA, 20 nt, Human
cuccuucccagcugccccuc

SEQ ID NO: 3751334 - RNA, 12 nt, Human
cuccuuccccau

SEQ ID NO: 3751335 - RNA, 17 nt, Human
cuccuucccuugcuacc

SEQ ID NO: 3751336 - RNA, 14 nt, Human
cuccuuccggggaa

SEQ ID NO: 3751337 - RNA, 20 nt, Human
cuccuuccggggaaggauuu

SEQ ID NO: 3751338 - RNA, 12 nt, Human
cuccuuccuaaa

SEQ ID NO: 3751339 - RNA, 21 nt, Human
cuccuuccugccccaacuccu

SEQ ID NO: 3751340 - RNA, 13 nt, Human
cuccuuccuggag

SEQ ID NO: 3751341 - RNA, 14 nt, Human
cuccuuccuggccu

SEQ ID NO: 3751342 - RNA, 17 nt, Human
cuccuuccuggccugag

SEQ ID NO: 3751343 - RNA, 15 nt, Human
cuccuuccugucuuc

SEQ ID NO: 3751344 - RNA, 18 nt, Human
cuccuuccuucaccucug

SEQ ID NO: 3751345 - RNA, 14 nt, Human
cuccuuccuugacc

SEQ ID NO: 3751346 - RNA, 20 nt, Human
cuccuucuaaaaacuucuca

SEQ ID NO: 3751347 - RNA, 21 nt, Human
cuccuucucugucucaugugu

SEQ ID NO: 3751348 - RNA, 13 nt, Human
cuccuucugagcu

SEQ ID NO: 3751349 - RNA, 16 nt, Human
cuccuucugagcuccu

SEQ ID NO: 3751350 - RNA, 11 nt, Human
cuccuucuucc

SEQ ID NO: 3751351 - RNA, 21 nt, Human
cuccuugaaaacacuguucuc

SEQ ID NO: 3751352 - RNA, 15 nt, Human
cuccuugaauaucuu

SEQ ID NO: 3751353 - RNA, 17 nt, Human
cuccuugauaacagcua

SEQ ID NO: 3751354 - RNA, 16 nt, Human
cuccuugcaucaaggg

SEQ ID NO: 3751355 - RNA, 14 nt, Human
cuccuugcucugca

SEQ ID NO: 3751356 - RNA, 11 nt, Human
cuccuuggccu

SEQ ID NO: 3751357 - RNA, 14 nt, Human
cuccuuggccuagc

SEQ ID NO: 3751358 - RNA, 13 nt, Human
cuccuuggcuuac

SEQ ID NO: 3751359 - RNA, 17 nt, Human
cuccuugggaggaagca

SEQ ID NO: 3751360 - RNA, 21 nt, Human
cuccuugggaggaagcagaau

SEQ ID NO: 3751361 - RNA, 13 nt, Human
cuccuugggaggc

SEQ ID NO: 3751362 - RNA, 21 nt, Human
cuccuugggaggccccacugg

SEQ ID NO: 3751363 - RNA, 15 nt, Human
cuccuugggcacuuu

SEQ ID NO: 3751364 - RNA, 16 nt, Human
cuccuugggcccuuug

SEQ ID NO: 3751365 - RNA, 16 nt, Human
gagcagaugcagagag

SEQ ID NO: 3751366 - RNA, 19 nt, Human
gagcagcaccuccucagcc

SEQ ID NO: 3751367 - RNA, 21 nt, Human
gagcagcaggaggggggaggg

SEQ ID NO: 3751368 - RNA, 22 nt, Human
gagcagccacauuccugaugcu

SEQ ID NO: 3751369 - RNA, 20 nt, Human
gagcagcccuggagucaugc

SEQ ID NO: 3751370 - RNA, 18 nt, Human
gagcagcgguuuggggag

SEQ ID NO: 3751371 - RNA, 18 nt, Human
gagcagcugagcagggcc

SEQ ID NO: 3751372 - RNA, 17 nt, Human
gagcagcuucugccacu

SEQ ID NO: 3751373 - RNA, 21 nt, Human
gagcagcuucugccacuuccc

SEQ ID NO: 3751374 - RNA, 17 nt, Human
gagcaggaaggccuggg

SEQ ID NO: 3751375 - RNA, 12 nt, Human
gagcaggaccuc

SEQ ID NO: 3751376 - RNA, 13 nt, Human
gagcaggaccucc

SEQ ID NO: 3751377 - RNA, 15 nt, Human
gagcaggacuccagg

SEQ ID NO: 3751378 - RNA, 16 nt, Human
gagcaggacuccaggc

SEQ ID NO: 3751379 - RNA, 16 nt, Human
gagcaggcagccagca

SEQ ID NO: 3751380 - RNA, 19 nt, Human
gagcaggcagccagcaucu

SEQ ID NO: 3751381 - RNA, 19 nt, Human
gagcaggcuggcagcucuc

SEQ ID NO: 3751382 - RNA, 21 nt, Human
gagcaggcuggcagcucucca

SEQ ID NO: 3751383 - RNA, 13 nt, Human
gagcagggaaggc

SEQ ID NO: 3751384 - RNA, 14 nt, Human
gagcagggaaggcc

SEQ ID NO: 3751385 - RNA, 17 nt, Human
gagcagggaaggccuga

SEQ ID NO: 3751386 - RNA, 18 nt, Human
gagcagggaaggccugac

SEQ ID NO: 3751387 - RNA, 22 nt, Human
gagcagggauuaaccucugcac

SEQ ID NO: 3751388 - RNA, 22 nt, Human
gagcagggccggggaacuggcc

SEQ ID NO: 3751389 - RNA, 16 nt, Human
gagcaggggcagggug

SEQ ID NO: 3751390 - RNA, 20 nt, Human
gagcagggguccuuggugug

SEQ ID NO: 3751391 - RNA, 16 nt, Human
gagcaguccugccuca

SEQ ID NO: 3751392 - RNA, 16 nt, Human
gagcaguccuuggccu

SEQ ID NO: 3751393 - RNA, 17 nt, Human
gagcaguccuuggccug

SEQ ID NO: 3751394 - RNA, 23 nt, Human
gagcaguccuuggccugcuaagg

SEQ ID NO: 3751395 - RNA, 21 nt, Human
gagcagugaaugauucagugu

SEQ ID NO: 3751396 - RNA, 14 nt, Human
gagcagugcaggca

SEQ ID NO: 3751397 - RNA, 23 nt, Human
gagcagugcuuuuggcggggagg

SEQ ID NO: 3751398 - RNA, 18 nt, Human
gagcagugggccuggcca

SEQ ID NO: 3751399 - RNA, 12 nt, Human
gagcagugucuu

SEQ ID NO: 3751400 - RNA, 19 nt, Human
gagcagugucuuccauaau

SEQ ID NO: 3751401 - RNA, 20 nt, Human
gagcauaauuuaaaaauaua

SEQ ID NO: 3751402 - RNA, 21 nt, Human
gagcauaggugauccauguaa

SEQ ID NO: 3751403 - RNA, 22 nt, Human
gagcauaggugauccauguaac

SEQ ID NO: 3751404 - RNA, 12 nt, Human
gagcaucacaga

SEQ ID NO: 3751405 - RNA, 13 nt, Human
gagcaucacagaa

SEQ ID NO: 3751406 - RNA, 12 nt, Human
gagcaucaggcc

SEQ ID NO: 3751407 - RNA, 15 nt, Human
gagcaucaggccagg

SEQ ID NO: 3751408 - RNA, 16 nt, Human
gagcaucaggccaggc

SEQ ID NO: 3751409 - RNA, 17 nt, Human
gagcaucaggccaggcc

SEQ ID NO: 3751410 - RNA, 22 nt, Human
gagcaucaggccaggcccucug

SEQ ID NO: 3751411 - RNA, 13 nt, Human
gagcaucaugccu

SEQ ID NO: 3751412 - RNA, 18 nt, Human
gagcaucaugccucugag

SEQ ID NO: 3751413 - RNA, 23 nt, Human
gagcaucaugccucugaggccag

SEQ ID NO: 3751414 - RNA, 14 nt, Human
gagcauccaccucc

SEQ ID NO: 3751415 - RNA, 13 nt, Human
gagcaucccggag

SEQ ID NO: 3751416 - RNA, 14 nt, Human
gagcauccugagcc

SEQ ID NO: 3751417 - RNA, 20 nt, Human
gagcaucggccuagggcccc

SEQ ID NO: 3751418 - RNA, 19 nt, Human
gagcaucucuugaggccag

SEQ ID NO: 3751419 - RNA, 14 nt, Human
gagcauggagcugg

SEQ ID NO: 3751420 - RNA, 17 nt, Human
gagcauggguucauccu

SEQ ID NO: 3751421 - RNA, 20 nt, Human
gagcauguuuuguauacaaa

SEQ ID NO: 3751422 - RNA, 21 nt, Human
gagcauuacgugagccaggua

SEQ ID NO: 3751423 - RNA, 22 nt, Human
gagcauuauaaucaccagggcc

SEQ ID NO: 3751424 - RNA, 13 nt, Human
gagcauuccaguc

SEQ ID NO: 3751425 - RNA, 15 nt, Human
gagcauuucucauca

SEQ ID NO: 3751426 - RNA, 19 nt, Human
gagcauuucucaucaguag

SEQ ID NO: 3751427 - RNA, 21 nt, Human
gagccaagaucgcgccacugc

SEQ ID NO: 3751428 - RNA, 22 nt, Human
gagccaauggaguagaccccug

SEQ ID NO: 3751429 - RNA, 14 nt, Human
gagccacaguggga

SEQ ID NO: 3751430 - RNA, 14 nt, Human
gagccaccaguucu

SEQ ID NO: 3751431 - RNA, 12 nt, Human
gagccaccucac

SEQ ID NO: 3751432 - RNA, 19 nt, Human
gagccaccugucccaccuc

SEQ ID NO: 3751433 - RNA, 12 nt, Human
gagccacucugu

SEQ ID NO: 3751434 - RNA, 18 nt, Human
gagccacugcaccgggcc

SEQ ID NO: 3751435 - RNA, 17 nt, Human
gagccagagaagugaca

SEQ ID NO: 3751436 - RNA, 18 nt, Human
gagccagagaagugacag

SEQ ID NO: 3751437 - RNA, 20 nt, Human
gagccagagaagugacaggg

SEQ ID NO: 3751438 - RNA, 19 nt, Human
gagccagauuucacucucc

SEQ ID NO: 3751439 - RNA, 20 nt, Human
gagccagauuucacucuccu

SEQ ID NO: 3751440 - RNA, 15 nt, Human
gagccagcagacauu

SEQ ID NO: 3751441 - RNA, 17 nt, Human
gagccagcagacauugu

SEQ ID NO: 3751442 - RNA, 23 nt, Human
gagccagcagacauugucagcaa

SEQ ID NO: 3751443 - RNA, 15 nt, Human
gagccagccacacuu

SEQ ID NO: 3751444 - RNA, 14 nt, Human
gagccagcccuccc

SEQ ID NO: 3751445 - RNA, 21 nt, Human
gagccagcccucccuguccuc

SEQ ID NO: 3751446 - RNA, 21 nt, Human
gagccagccgagcaggaggcc

SEQ ID NO: 3751447 - RNA, 22 nt, Human
gagccagcuaagggguggggcu

SEQ ID NO: 3751448 - RNA, 20 nt, Human
gagccaggaagaucccccag

SEQ ID NO: 3751449 - RNA, 13 nt, Human
gagccaggagaag

SEQ ID NO: 3751450 - RNA, 14 nt, Human
gagccaggagaagc

SEQ ID NO: 3751451 - RNA, 17 nt, Human
gagccaggagaagcuca

SEQ ID NO: 3751452 - RNA, 21 nt, Human
gagccaggagaagcucagcug

SEQ ID NO: 3751453 - RNA, 13 nt, Human
gagccaggcacac

SEQ ID NO: 3751454 - RNA, 22 nt, Human
gagccaggccugggucuguguc

SEQ ID NO: 3751455 - RNA, 22 nt, Human
gagccaggcuagcuggagccug

SEQ ID NO: 3751456 - RNA, 18 nt, Human
gagccagguaaugaggga

SEQ ID NO: 3751457 - RNA, 23 nt, Human
gagccaguucaguaccuggagga

SEQ ID NO: 3751458 - RNA, 14 nt, Human
gagccaugcuggga

SEQ ID NO: 3751459 - RNA, 21 nt, Human
gagccauguagaagcugcauc

SEQ ID NO: 3751460 - RNA, 18 nt, Human
gagccaugucuucucccu

SEQ ID NO: 3751461 - RNA, 13 nt, Human
gagccauuugaga

SEQ ID NO: 3751462 - RNA, 16 nt, Human
gagccauuugucccaa

SEQ ID NO: 3751463 - RNA, 18 nt, Human
gagccauuugucccaagu

SEQ ID NO: 3751464 - RNA, 21 nt, Human
gagccauuuuggggggccccc

SEQ ID NO: 3751465 - RNA, 23 nt, Human
gagccauuuuggggggccccccu

SEQ ID NO: 3751466 - RNA, 21 nt, Human
gagccauuuugugaauggauu

SEQ ID NO: 3751467 - RNA, 17 nt, Human
gagcccaccuuggcuca

SEQ ID NO: 3751468 - RNA, 12 nt, Human
gagcccacgccc

SEQ ID NO: 3751469 - RNA, 16 nt, Human
gagcccacgcccccac

SEQ ID NO: 3751470 - RNA, 14 nt, Human
gagcccacuccauc

SEQ ID NO: 3751471 - RNA, 23 nt, Human
gagcccacugcccacccccucaa

SEQ ID NO: 3751472 - RNA, 11 nt, Human
gagcccacugu

SEQ ID NO: 3751473 - RNA, 23 nt, Human
gagcccacuguacuugcucuuga

SEQ ID NO: 3751474 - RNA, 16 nt, Human
gagcccagagaacagc

SEQ ID NO: 3751475 - RNA, 23 nt, Human
gagcccagagguaacagaacagc

SEQ ID NO: 3751476 - RNA, 18 nt, Human
gagcccagagucccccca

SEQ ID NO: 3751477 - RNA, 22 nt, Human
gagcccagccauuaccauggag

SEQ ID NO: 3751478 - RNA, 12 nt, Human
gagcccagcucc

SEQ ID NO: 3751479 - RNA, 14 nt, Human
gagcccagcuccaa

SEQ ID NO: 3751480 - RNA, 14 nt, Human
gagcccagcucuga

SEQ ID NO: 3751481 - RNA, 13 nt, Human
gagcccagcuggg

SEQ ID NO: 3751482 - RNA, 19 nt, Human
gagcccagcugggucaggc

SEQ ID NO: 3751483 - RNA, 12 nt, Human
gagcccaggagc

SEQ ID NO: 3751484 - RNA, 13 nt, Human
gagcccaggagcu

SEQ ID NO: 3751485 - RNA, 17 nt, Human
gagcccaggagcucccc

SEQ ID NO: 3751486 - RNA, 18 nt, Human
gagcccaggccaggacuc

SEQ ID NO: 3751487 - RNA, 12 nt, Human
gagcccaggccu

SEQ ID NO: 3751488 - RNA, 13 nt, Human
gagcccaggcggg

SEQ ID NO: 3751489 - RNA, 17 nt, Human
gagcccagggaggccga

SEQ ID NO: 3751490 - RNA, 20 nt, Human
gagcccagggaggccgaagc

SEQ ID NO: 3751491 - RNA, 16 nt, Human
gagcccauacucagcc

SEQ ID NO: 3751492 - RNA, 18 nt, Human
gagcccauacucagccug

SEQ ID NO: 3751493 - RNA, 22 nt, Human
gagcccauacucagccugcugc

SEQ ID NO: 3751494 - RNA, 11 nt, Human
gagccccaagu

SEQ ID NO: 3751495 - RNA, 13 nt, Human
gagccccaagucc

SEQ ID NO: 3751496 - RNA, 15 nt, Human
gagccccaaguccug

SEQ ID NO: 3751497 - RNA, 14 nt, Human
gagccccacacgga

SEQ ID NO: 3751498 - RNA, 12 nt, Human
gagccccacacu

SEQ ID NO: 3751499 - RNA, 12 nt, Human
gagccccacagc

SEQ ID NO: 3751500 - RNA, 13 nt, Human
gagccccacagcc

SEQ ID NO: 3751501 - RNA, 20 nt, Human
gagccccacagccccaucug

SEQ ID NO: 3751502 - RNA, 14 nt, Human
gagccccacucuca

SEQ ID NO: 3751503 - RNA, 14 nt, Human
gagccccacugccc

SEQ ID NO: 3751504 - RNA, 15 nt, Human
gagccccacugcccu

SEQ ID NO: 3751505 - RNA, 12 nt, Human
gagccccagccc

SEQ ID NO: 3751506 - RNA, 13 nt, Human
gagccccagcccc

SEQ ID NO: 3751507 - RNA, 17 nt, Human
gagccccaggccucugu

SEQ ID NO: 3751508 - RNA, 13 nt, Human
gagccccaggguc

SEQ ID NO: 3751509 - RNA, 12 nt, Human
gagccccagugc

SEQ ID NO: 3751510 - RNA, 14 nt, Human
gagccccagugcca

SEQ ID NO: 3751511 - RNA, 12 nt, Human
gagccccaucug

SEQ ID NO: 3751512 - RNA, 13 nt, Human
gagccccaucuuc

SEQ ID NO: 3751513 - RNA, 23 nt, Human
gagcccccacccuguuccugcug

SEQ ID NO: 3751514 - RNA, 13 nt, Human
gagcccccagccu

SEQ ID NO: 3751515 - RNA, 15 nt, Human
gagcccccagccugu

SEQ ID NO: 3751516 - RNA, 14 nt, Human
gagcagccuguggc

SEQ ID NO: 3751517 - RNA, 17 nt, Human
gagcagcgagccugcua

SEQ ID NO: 3751518 - RNA, 15 nt, Human
gagcagcugagcagg

SEQ ID NO: 3751519 - RNA, 16 nt, Human
gagcagcugagcaggg

SEQ ID NO: 3751520 - RNA, 20 nt, Human
gagcagcugagcagggccgg

SEQ ID NO: 3751521 - RNA, 15 nt, Human
gagcagcuucaguug

SEQ ID NO: 3751522 - RNA, 16 nt, Human
gagcagcuucugccac

SEQ ID NO: 3751523 - RNA, 18 nt, Human
gagcagcuuuaaacucag

SEQ ID NO: 3751524 - RNA, 21 nt, Human
gagcagcuuuaaacucaggga

SEQ ID NO: 3751525 - RNA, 22 nt, Human
gagcagcuuuaaacucagggac

SEQ ID NO: 3751526 - RNA, 23 nt, Human
gagcagcuuuaaacucagggaca

SEQ ID NO: 3751527 - RNA, 18 nt, Human
gagcaggaaggccugggu

SEQ ID NO: 3751528 - RNA, 14 nt, Human
gagcaggaauggga

SEQ ID NO: 3751529 - RNA, 20 nt, Human
gagcaggacugaugucuccu

SEQ ID NO: 3751530 - RNA, 20 nt, Human
gagcaggagauugagaagga

SEQ ID NO: 3751531 - RNA, 22 nt, Human
gagcaggagauugagaaggaga

SEQ ID NO: 3751532 - RNA, 23 nt, Human
gagcaggagauugagaaggagag

SEQ ID NO: 3751533 - RNA, 17 nt, Human
gagcaggaggccccugg

SEQ ID NO: 3751534 - RNA, 11 nt, Human
gagcaggcagc

SEQ ID NO: 3751535 - RNA, 17 nt, Human
gagcaggcagccagcau

SEQ ID NO: 3751536 - RNA, 18 nt, Human
gagcaggcgguggggaga

SEQ ID NO: 3751537 - RNA, 20 nt, Human
gagcagggauuaaccucugc

SEQ ID NO: 3751538 - RNA, 15 nt, Human
gagcagggccgggga

SEQ ID NO: 3751539 - RNA, 21 nt, Human
gagcagggcucagcggggaca

SEQ ID NO: 3751540 - RNA, 16 nt, Human
gagcaggguguuggga

SEQ ID NO: 3751541 - RNA, 16 nt, Human
gagcaguaucaugaag

SEQ ID NO: 3751542 - RNA, 15 nt, Human
gagcagugcaggcac

SEQ ID NO: 3751543 - RNA, 13 nt, Human
gagcagugcuuuu

SEQ ID NO: 3751544 - RNA, 21 nt, Human
gagcagugggaggguaccagc

SEQ ID NO: 3751545 - RNA, 15 nt, Human
gagcagugggccugg

SEQ ID NO: 3751546 - RNA, 23 nt, Human
gagcagugugucuccugcaugca

SEQ ID NO: 3751547 - RNA, 16 nt, Human
gagcauaguccaaaaa

SEQ ID NO: 3751548 - RNA, 16 nt, Human
gagcaucaugccucug

SEQ ID NO: 3751549 - RNA, 19 nt, Human
gagcaucaugccucugagg

SEQ ID NO: 3751550 - RNA, 17 nt, Human
gagcauccaccuccuuc

SEQ ID NO: 3751551 - RNA, 18 nt, Human
gagcauccaccuccuucu

SEQ ID NO: 3751552 - RNA, 19 nt, Human
gagcaucccccaaaguuca

SEQ ID NO: 3751553 - RNA, 20 nt, Human
gagcaucccggaggaaaucu

SEQ ID NO: 3751554 - RNA, 16 nt, Human
gagcauccugagcccc

SEQ ID NO: 3751555 - RNA, 18 nt, Human
gagcauccugagccccgc

SEQ ID NO: 3751556 - RNA, 22 nt, Human
gagcauccugagccccgcccuc

SEQ ID NO: 3751557 - RNA, 22 nt, Human
gagcaucucuugaggccaggag

SEQ ID NO: 3751558 - RNA, 13 nt, Human
gagcaucugacuc

SEQ ID NO: 3751559 - RNA, 17 nt, Human
gagcaugacagccugca

SEQ ID NO: 3751560 - RNA, 23 nt, Human
gagcaugagaggaggcagcagga

SEQ ID NO: 3751561 - RNA, 15 nt, Human
gagcaugggccuggc

SEQ ID NO: 3751562 - RNA, 22 nt, Human
gagcaugguacuuggccuuugg

SEQ ID NO: 3751563 - RNA, 19 nt, Human
gagcauguaaaagcggaaa

SEQ ID NO: 3751564 - RNA, 22 nt, Human
gagcauguacugagccuuguaa

SEQ ID NO: 3751565 - RNA, 15 nt, Human
gagcaugucguggac

SEQ ID NO: 3751566 - RNA, 15 nt, Human
gagcauuacaggcaa

SEQ ID NO: 3751567 - RNA, 16 nt, Human
gagcauuacaggcaag

SEQ ID NO: 3751568 - RNA, 18 nt, Human
gagcauuacgugagccag

SEQ ID NO: 3751569 - RNA, 23 nt, Human
gagcauuauaaucaccagggcca

SEQ ID NO: 3751570 - RNA, 17 nt, Human
gagcauugccauucccu

SEQ ID NO: 3751571 - RNA, 15 nt, Human
gagcauuggcugaga

SEQ ID NO: 3751572 - RNA, 21 nt, Human
gagcauuggggauguuuuucu

SEQ ID NO: 3751573 - RNA, 14 nt, Human
gagccaaagagaau

SEQ ID NO: 3751574 - RNA, 15 nt, Human
gagccaacugcugcu

SEQ ID NO: 3751575 - RNA, 18 nt, Human
gagccaagggauggacau

SEQ ID NO: 3751576 - RNA, 19 nt, Human
gagccaagggauggacauc

SEQ ID NO: 3751577 - RNA, 19 nt, Human
gagccaaggguucagagac

SEQ ID NO: 3751578 - RNA, 18 nt, Human
gagccacacaugggcauc

SEQ ID NO: 3751579 - RNA, 16 nt, Human
gagccacagcagcauu

SEQ ID NO: 3751580 - RNA, 12 nt, Human
gagccaccaguu

SEQ ID NO: 3751581 - RNA, 13 nt, Human
gagccaccaguuc

SEQ ID NO: 3751582 - RNA, 20 nt, Human
gagccaccugucccaccuca

SEQ ID NO: 3751583 - RNA, 14 nt, Human
gagccacuccucug

SEQ ID NO: 3751584 - RNA, 15 nt, Human
gagccacuccucuga

SEQ ID NO: 3751585 - RNA, 18 nt, Human
gagccacucucuucccuu

SEQ ID NO: 3751586 - RNA, 19 nt, Human
gagccacugcaccgggcca

SEQ ID NO: 3751587 - RNA, 22 nt, Human
gagccacugcaccgggccacag

SEQ ID NO: 3751588 - RNA, 12 nt, Human
gagccagagaag

SEQ ID NO: 3751589 - RNA, 13 nt, Human
gagccagagaagu

SEQ ID NO: 3751590 - RNA, 14 nt, Human
gagccagagaagug

SEQ ID NO: 3751591 - RNA, 16 nt, Human
gagccagagaagugac

SEQ ID NO: 3751592 - RNA, 22 nt, Human
gagccagagaagugacagggaa

SEQ ID NO: 3751593 - RNA, 15 nt, Human
gagccagauggcaag

SEQ ID NO: 3751594 - RNA, 20 nt, Human
gagccagcagacauugucag

SEQ ID NO: 3751595 - RNA, 21 nt, Human
gagccagcagccuggcucucc

SEQ ID NO: 3751596 - RNA, 20 nt, Human
gagccagcccucccuguccu

SEQ ID NO: 3751597 - RNA, 14 nt, Human
gagccagccgagca

SEQ ID NO: 3751598 - RNA, 20 nt, Human
gagccagccgagcaggaggc

SEQ ID NO: 3751599 - RNA, 21 nt, Human
gagccagcuaagggguggggc

SEQ ID NO: 3751600 - RNA, 13 nt, Human
gagccagcucccu

SEQ ID NO: 3751601 - RNA, 21 nt, Human
gagccaggaagaucccccaga

SEQ ID NO: 3751602 - RNA, 12 nt, Human
gagccaggaggg

SEQ ID NO: 3751603 - RNA, 12 nt, Human
gagccagggucu

SEQ ID NO: 3751604 - RNA, 19 nt, Human
gagccagggucucacuaug

SEQ ID NO: 3751605 - RNA, 13 nt, Human
gagccagucccag

SEQ ID NO: 3751606 - RNA, 15 nt, Human
gagccagucccaggg

SEQ ID NO: 3751607 - RNA, 17 nt, Human
gagccaguuugccggau

SEQ ID NO: 3751608 - RNA, 17 nt, Human
gagccaugggcacaaag

SEQ ID NO: 3751609 - RNA, 12 nt, Human
gagccauguuuc

SEQ ID NO: 3751610 - RNA, 17 nt, Human
gagccauuugucccaag

SEQ ID NO: 3751611 - RNA, 22 nt, Human
gagccauuugucccaagugcca

SEQ ID NO: 3751612 - RNA, 23 nt, Human
gagccauuugucccaagugccaa

SEQ ID NO: 3751613 - RNA, 16 nt, Human
gagccauuuugugaau

SEQ ID NO: 3751614 - RNA, 13 nt, Human
gagcccaccuugg

SEQ ID NO: 3751615 - RNA, 22 nt, Human
gagcccacggcuaagaggcugc

SEQ ID NO: 3751616 - RNA, 20 nt, Human
gagcccacugcccacccccu

SEQ ID NO: 3751617 - RNA, 18 nt, Human
gagcccacuguacuugcu

SEQ ID NO: 3751618 - RNA, 21 nt, Human
gagcccacuguacuugcucuu

SEQ ID NO: 3751619 - RNA, 14 nt, Human
gagcccagaggagg

SEQ ID NO: 3751620 - RNA, 16 nt, Human
gagcccagaguccccc

SEQ ID NO: 3751621 - RNA, 18 nt, Human
gagcccagcccuccccau

SEQ ID NO: 3751622 - RNA, 18 nt, Human
gagcccagcccuguucug

SEQ ID NO: 3751623 - RNA, 21 nt, Human
gagcccaggagcuccccuccc

SEQ ID NO: 3751624 - RNA, 12 nt, Human
gagcccaggagu

SEQ ID NO: 3751625 - RNA, 13 nt, Human
gagcccaggccag

SEQ ID NO: 3751626 - RNA, 21 nt, Human
gagcccaggccaggacucugc

SEQ ID NO: 3751627 - RNA, 23 nt, Human
gagcccaggccaggacucugcag

SEQ ID NO: 3751628 - RNA, 24 nt, Human
gagcccaggccaggacucugcagc

SEQ ID NO: 3751629 - RNA, 11 nt, Human
gagcccaggcu

SEQ ID NO: 3751630 - RNA, 12 nt, Human
gagcccaggcuc

SEQ ID NO: 3751631 - RNA, 11 nt, Human
gagcccaggga

SEQ ID NO: 3751632 - RNA, 15 nt, Human
gagcccagggaggcc

SEQ ID NO: 3751633 - RNA, 19 nt, Human
gagcccauacucagccugc

SEQ ID NO: 3751634 - RNA, 18 nt, Human
gagcccauguucugcccc

SEQ ID NO: 3751635 - RNA, 21 nt, Human
gagcccauguucugcccccag

SEQ ID NO: 3751636 - RNA, 16 nt, Human
gagccccacacggagg

SEQ ID NO: 3751637 - RNA, 22 nt, Human
gagccccacacuggggugccgc

SEQ ID NO: 3751638 - RNA, 17 nt, Human
gagccccacccucagau

SEQ ID NO: 3751639 - RNA, 20 nt, Human
gagccccacucucagaggcc

SEQ ID NO: 3751640 - RNA, 21 nt, Human
gagccccacucucagaggccc

SEQ ID NO: 3751641 - RNA, 22 nt, Human
gagccccacucucagaggcccc

SEQ ID NO: 3751642 - RNA, 19 nt, Human
gagccccacugcccuucuc

SEQ ID NO: 3751643 - RNA, 13 nt, Human
gagccccagcuga

SEQ ID NO: 3751644 - RNA, 14 nt, Human
gagccccagggucu

SEQ ID NO: 3751645 - RNA, 19 nt, Human
gagccccagggucuucccu

SEQ ID NO: 3751646 - RNA, 19 nt, Human
gagccccagggugcccaga

SEQ ID NO: 3751647 - RNA, 17 nt, Human
gagccccagugccaagc

SEQ ID NO: 3751648 - RNA, 18 nt, Human
gagccccaucuucaccca

SEQ ID NO: 3751649 - RNA, 16 nt, Human
gagccccauuccuggg

SEQ ID NO: 3751650 - RNA, 17 nt, Human
gagccccauuccuggga

SEQ ID NO: 3751651 - RNA, 14 nt, Human
gagcccccagccug

SEQ ID NO: 3751652 - RNA, 17 nt, Human
gagcccccgccccgccc

SEQ ID NO: 3751653 - RNA, 14 nt, Human
gagccccgaggccu

SEQ ID NO: 3751654 - RNA, 17 nt, Human
gagccccgaggccuucu

SEQ ID NO: 3751655 - RNA, 22 nt, Human
gagccccgcagaccuccccagc

SEQ ID NO: 3751656 - RNA, 13 nt, Human
gagccccgcccuc

SEQ ID NO: 3751657 - RNA, 14 nt, Human
gagccccgcccucu

SEQ ID NO: 3751658 - RNA, 20 nt, Human
gagccccgcccucuuccuga

SEQ ID NO: 3751659 - RNA, 17 nt, Human
gagccccuaccccacac

SEQ ID NO: 3751660 - RNA, 20 nt, Human
gagccccuaccccacaccag

SEQ ID NO: 3751661 - RNA, 20 nt, Human
gagccccuccuccagccccu

SEQ ID NO: 3751662 - RNA, 22 nt, Human
gagccccuccuccagccccugu

SEQ ID NO: 3751663 - RNA, 11 nt, Human
gagccccuucc

SEQ ID NO: 3751664 - RNA, 21 nt, Human
gagccccuuccuugcucugca

SEQ ID NO: 3751665 - RNA, 16 nt, Human
gagcccccagccuguc

SEQ ID NO: 3751666 - RNA, 17 nt, Human
gagcccccagccuguca

SEQ ID NO: 3751667 - RNA, 18 nt, Human
gagcccccagccugucag

SEQ ID NO: 3751668 - RNA, 17 nt, Human
gagcccccagcuuccag

SEQ ID NO: 3751669 - RNA, 22 nt, Human
gagcccccagcuuccagcagga

SEQ ID NO: 3751670 - RNA, 22 nt, Human
gagcccccccaacacugugccc

SEQ ID NO: 3751671 - RNA, 17 nt, Human
gagccccgcccucuucc

SEQ ID NO: 3751672 - RNA, 12 nt, Human
gagccccuccua

SEQ ID NO: 3751673 - RNA, 15 nt, Human
gagccccuccuccag

SEQ ID NO: 3751674 - RNA, 21 nt, Human
gagccccuccuccagccccug

SEQ ID NO: 3751675 - RNA, 13 nt, Human
gagccccugggug

SEQ ID NO: 3751676 - RNA, 14 nt, Human
gagccccugggugg

SEQ ID NO: 3751677 - RNA, 12 nt, Human
gagccccugguc

SEQ ID NO: 3751678 - RNA, 14 nt, Human
gagccccugguccu

SEQ ID NO: 3751679 - RNA, 20 nt, Human
gagccccugucuagagaggg

SEQ ID NO: 3751680 - RNA, 17 nt, Human
gagcccgcacccccacc

SEQ ID NO: 3751681 - RNA, 19 nt, Human
gagcccgcacccccacccu

SEQ ID NO: 3751682 - RNA, 17 nt, Human
gagcccggaugcuucuc

SEQ ID NO: 3751683 - RNA, 16 nt, Human
gagcccuaaccccuuc

SEQ ID NO: 3751684 - RNA, 18 nt, Human
gagcccuaaccccuucca

SEQ ID NO: 3751685 - RNA, 21 nt, Human
gagcccuaaccccuuccagau

SEQ ID NO: 3751686 - RNA, 19 nt, Human
gagcccuacucccugcaga

SEQ ID NO: 3751687 - RNA, 15 nt, Human
gagcccucaaaguga

SEQ ID NO: 3751688 - RNA, 13 nt, Human
gagcccuccccag

SEQ ID NO: 3751689 - RNA, 14 nt, Human
gagcccuccccagg

SEQ ID NO: 3751690 - RNA, 18 nt, Human
gagcccuccgccuucaca

SEQ ID NO: 3751691 - RNA, 23 nt, Human
gagcccuggcaggaugacccugc

SEQ ID NO: 3751692 - RNA, 12 nt, Human
gagcccugggag

SEQ ID NO: 3751693 - RNA, 17 nt, Human
gagcccugggaggcucu

SEQ ID NO: 3751694 - RNA, 18 nt, Human
gagcccugggaggcucug

SEQ ID NO: 3751695 - RNA, 19 nt, Human
gagcccugggaggcucugg

SEQ ID NO: 3751696 - RNA, 13 nt, Human
gagcccugguggc

SEQ ID NO: 3751697 - RNA, 14 nt, Human
gagcccugguggca

SEQ ID NO: 3751698 - RNA, 15 nt, Human
gagcccugguggcag

SEQ ID NO: 3751699 - RNA, 16 nt, Human
gagcccugguggcagu

SEQ ID NO: 3751700 - RNA, 18 nt, Human
gagcccuugcccaugcug

SEQ ID NO: 3751701 - RNA, 16 nt, Human
gagcccuugccucccc

SEQ ID NO: 3751702 - RNA, 14 nt, Human
gagccgaagcccag

SEQ ID NO: 3751703 - RNA, 15 nt, Human
gagccgaagcccagg

SEQ ID NO: 3751704 - RNA, 22 nt, Human
gagccgagaucacgccacugca

SEQ ID NO: 3751705 - RNA, 13 nt, Human
gagccgcccaagg

SEQ ID NO: 3751706 - RNA, 19 nt, Human
gagccgcugugagccccug

SEQ ID NO: 3751707 - RNA, 22 nt, Human
gagccgggaaagaagagccgga

SEQ ID NO: 3751708 - RNA, 21 nt, Human
gagccgggcacauugagcugu

SEQ ID NO: 3751709 - RNA, 16 nt, Human
gagccgggccccuggg

SEQ ID NO: 3751710 - RNA, 14 nt, Human
gagccgggccuggg

SEQ ID NO: 3751711 - RNA, 19 nt, Human
gagccggggaguuucuuuc

SEQ ID NO: 3751712 - RNA, 20 nt, Human
gagccggggugggguggcug

SEQ ID NO: 3751713 - RNA, 22 nt, Human
gagccggggugggguggcugca

SEQ ID NO: 3751714 - RNA, 17 nt, Human
gagccgggucugccucu

SEQ ID NO: 3751715 - RNA, 20 nt, Human
gagccggguggaucgccuga

SEQ ID NO: 3751716 - RNA, 21 nt, Human
gagccgguaacuguccugucc

SEQ ID NO: 3751717 - RNA, 22 nt, Human
gagccgguaacuguccuguccu

SEQ ID NO: 3751718 - RNA, 16 nt, Human
gagccguggucccuga

SEQ ID NO: 3751719 - RNA, 13 nt, Human
gagccgugguccu

SEQ ID NO: 3751720 - RNA, 17 nt, Human
gagccgugguccuuugg

SEQ ID NO: 3751721 - RNA, 15 nt, Human
gagccuaaaaauaaa

SEQ ID NO: 3751722 - RNA, 15 nt, Human
gagccuagaagcugg

SEQ ID NO: 3751723 - RNA, 15 nt, Human
gagccucacagcagu

SEQ ID NO: 3751724 - RNA, 17 nt, Human
gagccucccaaggagaa

SEQ ID NO: 3751725 - RNA, 12 nt, Human
gagccucccugc

SEQ ID NO: 3751726 - RNA, 13 nt, Human
gagccucccugcc

SEQ ID NO: 3751727 - RNA, 15 nt, Human
gagccuccugcccag

SEQ ID NO: 3751728 - RNA, 19 nt, Human
gagccucgcaacccgugcc

SEQ ID NO: 3751729 - RNA, 16 nt, Human
gagccugacagccaga

SEQ ID NO: 3751730 - RNA, 15 nt, Human
gagccugagucaggg

SEQ ID NO: 3751731 - RNA, 16 nt, Human
gagccugagucagggc

SEQ ID NO: 3751732 - RNA, 15 nt, Human
gagccugaucucuuc

SEQ ID NO: 3751733 - RNA, 16 nt, Human
gagccugaucucuucc

SEQ ID NO: 3751734 - RNA, 18 nt, Human
gagccugaucucuuccug

SEQ ID NO: 3751735 - RNA, 21 nt, Human
gagccugcaaacucacugcuc

SEQ ID NO: 3751736 - RNA, 15 nt, Human
gagccugcagagcug

SEQ ID NO: 3751737 - RNA, 15 nt, Human
gagccugcaggaucu

SEQ ID NO: 3751738 - RNA, 16 nt, Human
gagccugcaggguggu

SEQ ID NO: 3751739 - RNA, 22 nt, Human
gagccugcaggguggugcuggg

SEQ ID NO: 3751740 - RNA, 18 nt, Human
gagccugcaggugcugcu

SEQ ID NO: 3751741 - RNA, 15 nt, Human
gagccugcaguuauu

SEQ ID NO: 3751742 - RNA, 23 nt, Human
gagccugcauuuccucgcagccu

SEQ ID NO: 3751743 - RNA, 17 nt, Human
gagccugccccagcgcu

SEQ ID NO: 3751744 - RNA, 18 nt, Human
gagccugccccagcgcug

SEQ ID NO: 3751745 - RNA, 15 nt, Human
gagccugccgagcaa

SEQ ID NO: 3751746 - RNA, 16 nt, Human
gagccugccgagcaac

SEQ ID NO: 3751747 - RNA, 21 nt, Human
gagccugccgagcaaccgugg

SEQ ID NO: 3751748 - RNA, 14 nt, Human
gagccugccuggag

SEQ ID NO: 3751749 - RNA, 19 nt, Human
gagccugcggccugcugga

SEQ ID NO: 3751750 - RNA, 11 nt, Human
gagccugcugg

SEQ ID NO: 3751751 - RNA, 12 nt, Human
gagccugcuggc

SEQ ID NO: 3751752 - RNA, 14 nt, Human
gagccuggagaagc

SEQ ID NO: 3751753 - RNA, 18 nt, Human
gagccuggcacaggacug

SEQ ID NO: 3751754 - RNA, 18 nt, Human
gagccuggcccauagaaa

SEQ ID NO: 3751755 - RNA, 12 nt, Human
gagccuggcucu

SEQ ID NO: 3751756 - RNA, 21 nt, Human
gagccugggauuucuaugcag

SEQ ID NO: 3751757 - RNA, 11 nt, Human
gagccuggggc

SEQ ID NO: 3751758 - RNA, 14 nt, Human
gagccuggugcccu

SEQ ID NO: 3751759 - RNA, 16 nt, Human
gagccuggugcugcug

SEQ ID NO: 3751760 - RNA, 17 nt, Human
gagccuggugcugcugc

SEQ ID NO: 3751761 - RNA, 12 nt, Human
gagccuguccug

SEQ ID NO: 3751762 - RNA, 21 nt, Human
gagccuguccugccuguggcc

SEQ ID NO: 3751763 - RNA, 16 nt, Human
gagccugugaacccag

SEQ ID NO: 3751764 - RNA, 17 nt, Human
gagccugugaacccagg

SEQ ID NO: 3751765 - RNA, 19 nt, Human
gagccugugaacccaggac

SEQ ID NO: 3751766 - RNA, 20 nt, Human
gagccugugaacccaggaca

SEQ ID NO: 3751767 - RNA, 21 nt, Human
gagccugugaacccaggacaa

SEQ ID NO: 3751768 - RNA, 23 nt, Human
gagccugugaacccaggacaagc

SEQ ID NO: 3751769 - RNA, 13 nt, Human
gagccuguguaac

SEQ ID NO: 3751770 - RNA, 17 nt, Human
gagccuguguaacagcu

SEQ ID NO: 3751771 - RNA, 17 nt, Human
gagccuucagccuuaau

SEQ ID NO: 3751772 - RNA, 15 nt, Human
gagccuuccacccag

SEQ ID NO: 3751773 - RNA, 12 nt, Human
gagccuuccagg

SEQ ID NO: 3751774 - RNA, 14 nt, Human
gagccuuccagggg

SEQ ID NO: 3751775 - RNA, 15 nt, Human
gagccuuccaggggu

SEQ ID NO: 3751776 - RNA, 16 nt, Human
gagccuuccaggggug

SEQ ID NO: 3751777 - RNA, 20 nt, Human
gagccuuccaggggugggac

SEQ ID NO: 3751778 - RNA, 13 nt, Human
gagccuucucaga

SEQ ID NO: 3751779 - RNA, 13 nt, Human
gagccuugaacuu

SEQ ID NO: 3751780 - RNA, 20 nt, Human
gagccuugguguccaccugg

SEQ ID NO: 3751781 - RNA, 18 nt, Human
gagccuugguucaucagu

SEQ ID NO: 3751782 - RNA, 18 nt, Human
gagccuuugguucuggcc

SEQ ID NO: 3751783 - RNA, 20 nt, Human
gagccuuuuuaaaacacaug

SEQ ID NO: 3751784 - RNA, 21 nt, Human
gagcgaggagaugcuccuugg

SEQ ID NO: 3751785 - RNA, 12 nt, Human
gagcgcaagaua

SEQ ID NO: 3751786 - RNA, 21 nt, Human
gagcgcacagggagugcacau

SEQ ID NO: 3751787 - RNA, 20 nt, Human
gagcgcaccugcccccuggu

SEQ ID NO: 3751788 - RNA, 15 nt, Human
gagcgcauggcaagu

SEQ ID NO: 3751789 - RNA, 12 nt, Human
gagcgccccucc

SEQ ID NO: 3751790 - RNA, 12 nt, Human
gagcgcccugca

SEQ ID NO: 3751791 - RNA, 16 nt, Human
gagcgcccugcagacc

SEQ ID NO: 3751792 - RNA, 22 nt, Human
gagcgcccugcagacccugccc

SEQ ID NO: 3751793 - RNA, 23 nt, Human
gagcgcccugcagacccugcccu

SEQ ID NO: 3751794 - RNA, 23 nt, Human
gagcgccuccauccaaggccagg

SEQ ID NO: 3751795 - RNA, 13 nt, Human
gagcgccugcccc

SEQ ID NO: 3751796 - RNA, 15 nt, Human
gagcgccugccccuc

SEQ ID NO: 3751797 - RNA, 16 nt, Human
gagcgccugccccucc

SEQ ID NO: 3751798 - RNA, 18 nt, Human
gagcgccugccccuccca

SEQ ID NO: 3751799 - RNA, 14 nt, Human
gagcggaaagcagc

SEQ ID NO: 3751800 - RNA, 17 nt, Human
gagcggaaagcagcuca

SEQ ID NO: 3751801 - RNA, 18 nt, Human
gagcggagaaaggaaggg

SEQ ID NO: 3751802 - RNA, 16 nt, Human
gagcggauugcaaagc

SEQ ID NO: 3751803 - RNA, 18 nt, Human
gagcggauugcaaagcaa

SEQ ID NO: 3751804 - RNA, 14 nt, Human
gagcgggaccugug

SEQ ID NO: 3751805 - RNA, 16 nt, Human
gagcgggaccuguggc

SEQ ID NO: 3751806 - RNA, 14 nt, Human
gagcgggaggcaga

SEQ ID NO: 3751807 - RNA, 15 nt, Human
gagcgggaggcagag

SEQ ID NO: 3751808 - RNA, 17 nt, Human
gagcgggucugcuccca

SEQ ID NO: 3751809 - RNA, 23 nt, Human
gagcggucucaggcuggugggag

SEQ ID NO: 3751810 - RNA, 14 nt, Human
gagcgguggcccug

SEQ ID NO: 3751811 - RNA, 17 nt, Human
gagcgugagcugagcag

SEQ ID NO: 3751812 - RNA, 22 nt, Human
gagcguggacugguugguuuug

SEQ ID NO: 3751813 - RNA, 22 nt, Human
gagcgugggaggcgggagugga

SEQ ID NO: 3751814 - RNA, 20 nt, Human
gagcguuagacugacuuguu

SEQ ID NO: 3751815 - RNA, 18 nt, Human
gagcuaaacuccuuccug

SEQ ID NO: 3751816 - RNA, 18 nt, Human
cuccuugggcccuuugag

SEQ ID NO: 3751817 - RNA, 15 nt, Human
cuccuuggugccugg

SEQ ID NO: 3751818 - RNA, 22 nt, Human
cuccuuggugccuggccuggca

SEQ ID NO: 3751819 - RNA, 21 nt, Human
cuccuugguucuugaggggac

SEQ ID NO: 3751820 - RNA, 18 nt, Human
cuccuuguggccugggcc

SEQ ID NO: 3751821 - RNA, 17 nt, Human
cuccuugugguuuaugu

SEQ ID NO: 3751822 - RNA, 13 nt, Human
cuccuuguuccua

SEQ ID NO: 3751823 - RNA, 17 nt, Human
cuccuuuaagagcucug

SEQ ID NO: 3751824 - RNA, 22 nt, Human
cuccuuuacaaaagaaauaccu

SEQ ID NO: 3751825 - RNA, 21 nt, Human
cuccuuuacccucaucugucu

SEQ ID NO: 3751826 - RNA, 17 nt, Human
cuccuuuagggacagcu

SEQ ID NO: 3751827 - RNA, 15 nt, Human
cuccuuucaccacau

SEQ ID NO: 3751828 - RNA, 14 nt, Human
cuccuuucagggcc

SEQ ID NO: 3751829 - RNA, 18 nt, Human
cuccuuuccccuuccuuu

SEQ ID NO: 3751830 - RNA, 14 nt, Human
cuccuuucuccagc

SEQ ID NO: 3751831 - RNA, 18 nt, Human
cuccuuucuccagccagc

SEQ ID NO: 3751832 - RNA, 12 nt, Human
cuccuuucugug

SEQ ID NO: 3751833 - RNA, 20 nt, Human
cuccuuucuuuuucuucuuc

SEQ ID NO: 3751834 - RNA, 18 nt, Human
cuccuuugcacugagggc

SEQ ID NO: 3751835 - RNA, 16 nt, Human
cuccuuugcaggcuca

SEQ ID NO: 3751836 - RNA, 18 nt, Human
cuccuuuguauucugucu

SEQ ID NO: 3751837 - RNA, 23 nt, Human
cuccuuugugaggaagccgcugg

SEQ ID NO: 3751838 - RNA, 14 nt, Human
cuccuuuuaaagaa

SEQ ID NO: 3751839 - RNA, 23 nt, Human
cuccuuuuaaagaaaaaaauuga

SEQ ID NO: 3751840 - RNA, 16 nt, Human
cuccuuuuccagagca

SEQ ID NO: 3751841 - RNA, 10 nt, Human
cuccuuuucu

SEQ ID NO: 3751842 - RNA, 18 nt, Human
cuccuuuucuuuuguuac

SEQ ID NO: 3751843 - RNA, 19 nt, Human
cuccuuuucuuuuguuacu

SEQ ID NO: 3751844 - RNA, 13 nt, Human
cuccuuuuguguu

SEQ ID NO: 3751845 - RNA, 18 nt, Human
cuccuuuuuauguugcca

SEQ ID NO: 3751846 - RNA, 14 nt, Human
cuccuuuuucuccc

SEQ ID NO: 3751847 - RNA, 15 nt, Human
cucgaaacacagaaa

SEQ ID NO: 3751848 - RNA, 22 nt, Human
cucgaacauggaacucauuccu

SEQ ID NO: 3751849 - RNA, 23 nt, Human
cucgaacauggaacucauuccug

SEQ ID NO: 3751850 - RNA, 18 nt, Human
cucgaacccacacugcaa

SEQ ID NO: 3751851 - RNA, 20 nt, Human
cucgaacuauuuucaaagac

SEQ ID NO: 3751852 - RNA, 13 nt, Human
cucgaacuccuga

SEQ ID NO: 3751853 - RNA, 16 nt, Human
cucgaacuccugaccu

SEQ ID NO: 3751854 - RNA, 15 nt, Human
cucgaacuccugggc

SEQ ID NO: 3751855 - RNA, 14 nt, Human
cucgaacuggcugc

SEQ ID NO: 3751856 - RNA, 15 nt, Human
cucgaacuggcugca

SEQ ID NO: 3751857 - RNA, 21 nt, Human
cucgaaguugaucuccccagc

SEQ ID NO: 3751858 - RNA, 14 nt, Human
cucgaaucucugug

SEQ ID NO: 3751859 - RNA, 17 nt, Human
cucgaaucucugugccu

SEQ ID NO: 3751860 - RNA, 18 nt, Human
cucgaaucucugugccuu

SEQ ID NO: 3751861 - RNA, 23 nt, Human
cucgacacgugggcuccccucuu

SEQ ID NO: 3751862 - RNA, 19 nt, Human
cucgacaugaaaauucaga

SEQ ID NO: 3751863 - RNA, 19 nt, Human
cucgacauuuuauggaaag

SEQ ID NO: 3751864 - RNA, 14 nt, Human
cucgacucugugcc

SEQ ID NO: 3751865 - RNA, 22 nt, Human
cucgacuggaggaccacacuca

SEQ ID NO: 3751866 - RNA, 13 nt, Human
cucgagaucccaa

SEQ ID NO: 3751867 - RNA, 21 nt, Human
cucgagaucccaacacugcca

SEQ ID NO: 3751868 - RNA, 15 nt, Human
cucgagcaacugcug

SEQ ID NO: 3751869 - RNA, 17 nt, Human
cucgagcaguccugccu

SEQ ID NO: 3751870 - RNA, 13 nt, Human
cucgagcaugccu

SEQ ID NO: 3751871 - RNA, 15 nt, Human
cucgagcaugccugg

SEQ ID NO: 3751872 - RNA, 19 nt, Human
cucgagcaugccuggaugg

SEQ ID NO: 3751873 - RNA, 22 nt, Human
cucgagcaugccuggauggggc

SEQ ID NO: 3751874 - RNA, 16 nt, Human
cucgagcgcccugcag

SEQ ID NO: 3751875 - RNA, 18 nt, Human
cucgagcgcccugcagac

SEQ ID NO: 3751876 - RNA, 20 nt, Human
cucgagcgcccugcagaccc

SEQ ID NO: 3751877 - RNA, 21 nt, Human
cucgagcgcccugcagacccu

SEQ ID NO: 3751878 - RNA, 20 nt, Human
cucgaggacuguauuuguga

SEQ ID NO: 3751879 - RNA, 19 nt, Human
cucgaggggugggcuggua

SEQ ID NO: 3751880 - RNA, 20 nt, Human
cucgaggugccuucuucagg

SEQ ID NO: 3751881 - RNA, 14 nt, Human
cucgaguacugugg

SEQ ID NO: 3751882 - RNA, 16 nt, Human
cucgaguacugugggc

SEQ ID NO: 3751883 - RNA, 15 nt, Human
cucgauccaaauugu

SEQ ID NO: 3751884 - RNA, 19 nt, Human
cucgauccaaauugugcuu

SEQ ID NO: 3751885 - RNA, 23 nt, Human
cucgaugcagacagggggccaga

SEQ ID NO: 3751886 - RNA, 17 nt, Human
cucgauucauauugaau

SEQ ID NO: 3751887 - RNA, 18 nt, Human
cucgauuuuguaucugca

SEQ ID NO: 3751888 - RNA, 16 nt, Human
cucgcaacccgugcca

SEQ ID NO: 3751889 - RNA, 16 nt, Human
cucgcaccccccuguu

SEQ ID NO: 3751890 - RNA, 19 nt, Human
cucgcaccccccuguucua

SEQ ID NO: 3751891 - RNA, 15 nt, Human
cucgcaccuuuccaa

SEQ ID NO: 3751892 - RNA, 19 nt, Human
cucgcagccucucagugcc

SEQ ID NO: 3751893 - RNA, 19 nt, Human
cucgcauaggaccuuucca

SEQ ID NO: 3751894 - RNA, 14 nt, Human
cucgcaucuuccca

SEQ ID NO: 3751895 - RNA, 18 nt, Human
cucgcccagucccagcag

SEQ ID NO: 3751896 - RNA, 20 nt, Human
cucgcccagucccagcagcc

SEQ ID NO: 3751897 - RNA, 19 nt, Human
cucgcccauccccuugagg

SEQ ID NO: 3751898 - RNA, 14 nt, Human
cucgccccuggcag

SEQ ID NO: 3751899 - RNA, 16 nt, Human
cucgccccuggcagag

SEQ ID NO: 3751900 - RNA, 20 nt, Human
cucgccccuggcagagaugc

SEQ ID NO: 3751901 - RNA, 12 nt, Human
cucgcccgccca

SEQ ID NO: 3751902 - RNA, 19 nt, Human
cucgcccuccuuucugugc

SEQ ID NO: 3751903 - RNA, 15 nt, Human
cucgcccugggucua

SEQ ID NO: 3751904 - RNA, 17 nt, Human
cucgccggaucugaggg

SEQ ID NO: 3751905 - RNA, 15 nt, Human
cucgccgucugugaa

SEQ ID NO: 3751906 - RNA, 18 nt, Human
cucgccucggaucagcug

SEQ ID NO: 3751907 - RNA, 13 nt, Human
cucgccucuccca

SEQ ID NO: 3751908 - RNA, 15 nt, Human
cucgcgacaaugcaa

SEQ ID NO: 3751909 - RNA, 16 nt, Human
cucgcggcccucagua

SEQ ID NO: 3751910 - RNA, 19 nt, Human
cucgcuauugucaccaggg

SEQ ID NO: 3751911 - RNA, 21 nt, Human
cucgcuauugucaccagggcu

SEQ ID NO: 3751912 - RNA, 16 nt, Human
cucgcuccccacucug

SEQ ID NO: 3751913 - RNA, 17 nt, Human
cucgcuccccacucugc

SEQ ID NO: 3751914 - RNA, 15 nt, Human
cucgcucugucaccc

SEQ ID NO: 3751915 - RNA, 16 nt, Human
cucgcucuguuaccca

SEQ ID NO: 3751916 - RNA, 20 nt, Human
cucgcucuguugcccaggcu

SEQ ID NO: 3751917 - RNA, 12 nt, Human
cucgcugagggc

SEQ ID NO: 3751918 - RNA, 19 nt, Human
cucgcugaugcugggcugg

SEQ ID NO: 3751919 - RNA, 20 nt, Human
cucgcugaugcugggcuggg

SEQ ID NO: 3751920 - RNA, 12 nt, Human
cucgcugccagc

SEQ ID NO: 3751921 - RNA, 13 nt, Human
cucgcugccagcu

SEQ ID NO: 3751922 - RNA, 20 nt, Human
cucgcugcugcgcccugggc

SEQ ID NO: 3751923 - RNA, 12 nt, Human
cucgcuggcccc

SEQ ID NO: 3751924 - RNA, 16 nt, Human
cucgcuggcccccacu

SEQ ID NO: 3751925 - RNA, 17 nt, Human
cucgcuggcccccacug

SEQ ID NO: 3751926 - RNA, 13 nt, Human
cucgcuguugcug

SEQ ID NO: 3751927 - RNA, 16 nt, Human
cucgcuucccccauag

SEQ ID NO: 3751928 - RNA, 11 nt, Human
cucgcuucuuu

SEQ ID NO: 3751929 - RNA, 13 nt, Human
cucgcuuguaaau

SEQ ID NO: 3751930 - RNA, 14 nt, Human
cucgcuuguaaaua

SEQ ID NO: 3751931 - RNA, 22 nt, Human
cucgcuugugcagaaaacauug

SEQ ID NO: 3751932 - RNA, 19 nt, Human
cucgcuuucuauguaguuu

SEQ ID NO: 3751933 - RNA, 20 nt, Human
cucggaaauuaaaguuugcu

SEQ ID NO: 3751934 - RNA, 19 nt, Human
cucggaacugcaugcugcu

SEQ ID NO: 3751935 - RNA, 22 nt, Human
cucggaacugcaugcugcugga

SEQ ID NO: 3751936 - RNA, 18 nt, Human
cucggacuuagcugggag

SEQ ID NO: 3751937 - RNA, 17 nt, Human
cucggagaagagcgcag

SEQ ID NO: 3751938 - RNA, 20 nt, Human
cucggagaagagcuguucac

SEQ ID NO: 3751939 - RNA, 12 nt, Human
cucggagccuca

SEQ ID NO: 3751940 - RNA, 13 nt, Human
cucggaggaagcc

SEQ ID NO: 3751941 - RNA, 13 nt, Human
cucggaggcccca

SEQ ID NO: 3751942 - RNA, 15 nt, Human
cucggaggccccaaa

SEQ ID NO: 3751943 - RNA, 18 nt, Human
cucggaggccccaaagga

SEQ ID NO: 3751944 - RNA, 16 nt, Human
cucggaggcugccccc

SEQ ID NO: 3751945 - RNA, 16 nt, Human
cucggaguucuucuug

SEQ ID NO: 3751946 - RNA, 20 nt, Human
cucggaucaccgagaguagc

SEQ ID NO: 3751947 - RNA, 14 nt, Human
cucggaucagcuga

SEQ ID NO: 3751948 - RNA, 17 nt, Human
cucggaucaggcuccca

SEQ ID NO: 3751949 - RNA, 23 nt, Human
cucggcagcccuuccaaacucuu

SEQ ID NO: 3751950 - RNA, 15 nt, Human
cucggccucccaaag

SEQ ID NO: 3751951 - RNA, 18 nt, Human
cucggccucccaaagugc

SEQ ID NO: 3751952 - RNA, 22 nt, Human
cucggccucccaaagugcuggg

SEQ ID NO: 3751953 - RNA, 17 nt, Human
cucggccuucacaaucu

SEQ ID NO: 3751954 - RNA, 17 nt, Human
cucggcucacugcaucc

SEQ ID NO: 3751955 - RNA, 16 nt, Human
cucggcucagugcaac

SEQ ID NO: 3751956 - RNA, 18 nt, Human
cucggcucagugcaaccu

SEQ ID NO: 3751957 - RNA, 15 nt, Human
cucggcuccugcugc

SEQ ID NO: 3751958 - RNA, 19 nt, Human
cucggcuccugcugcacca

SEQ ID NO: 3751959 - RNA, 12 nt, Human
cucggcuccugg

SEQ ID NO: 3751960 - RNA, 16 nt, Human
cucggcuggcuccccu

SEQ ID NO: 3751961 - RNA, 18 nt, Human
cucggcuuuucucagcug

SEQ ID NO: 3751962 - RNA, 15 nt, Human
cucgggacaccugcc

SEQ ID NO: 3751963 - RNA, 20 nt, Human
cucgggacaccugcccugcc

SEQ ID NO: 3751964 - RNA, 21 nt, Human
cucgggaggcugagacaggag

SEQ ID NO: 3751965 - RNA, 19 nt, Human
cucgggaggcugaggcaca

SEQ ID NO: 3751966 - RNA, 19 nt, Human
gagcuaacacuggccccua

SEQ ID NO: 3751967 - RNA, 13 nt, Human
gagcuaaggcucu

SEQ ID NO: 3751968 - RNA, 22 nt, Human
gagcuaagggugggugcucaga

SEQ ID NO: 3751969 - RNA, 22 nt, Human
gagcuaauuuacuggacaaaga

SEQ ID NO: 3751970 - RNA, 15 nt, Human
gagcuacauaauuua

SEQ ID NO: 3751971 - RNA, 22 nt, Human
gagcuaccuguguggacaggac

SEQ ID NO: 3751972 - RNA, 20 nt, Human
gagcuacuugggccauagcu

SEQ ID NO: 3751973 - RNA, 14 nt, Human
gagcuagaaccugg

SEQ ID NO: 3751974 - RNA, 18 nt, Human
gagcuagcgcugccgcac

SEQ ID NO: 3751975 - RNA, 19 nt, Human
gagcuaggagcaaagccug

SEQ ID NO: 3751976 - RNA, 20 nt, Human
gagcuaggagcaaagccugu

SEQ ID NO: 3751977 - RNA, 19 nt, Human
gagcuauacaguuuuccua

SEQ ID NO: 3751978 - RNA, 23 nt, Human
gagcuauauuuaaguauucaaga

SEQ ID NO: 3751979 - RNA, 13 nt, Human
gagcuaugacuua

SEQ ID NO: 3751980 - RNA, 14 nt, Human
gagcuauuaaaacu

SEQ ID NO: 3751981 - RNA, 16 nt, Human
gagcuauuaaaacuca

SEQ ID NO: 3751982 - RNA, 13 nt, Human
gagcuauuuccau

SEQ ID NO: 3751983 - RNA, 21 nt, Human
gagcuauuuccauuccagaau

SEQ ID NO: 3751984 - RNA, 16 nt, Human
gagcuauuuuaaacca

SEQ ID NO: 3751985 - RNA, 22 nt, Human
gagcucacaaggcagcaaggcc

SEQ ID NO: 3751986 - RNA, 19 nt, Human
gagcucacuguggugucug

SEQ ID NO: 3751987 - RNA, 19 nt, Human
gagcucagaaaauaucccu

SEQ ID NO: 3751988 - RNA, 23 nt, Human
gagcucagaaaauaucccuccug

SEQ ID NO: 3751989 - RNA, 18 nt, Human
gagcucagagagggcagg

SEQ ID NO: 3751990 - RNA, 17 nt, Human
gagcucaggacacuaau

SEQ ID NO: 3751991 - RNA, 15 nt, Human
gagcucauguagcaa

SEQ ID NO: 3751992 - RNA, 19 nt, Human
gagcuccaacucagaaggg

SEQ ID NO: 3751993 - RNA, 20 nt, Human
gagcuccagacccccagcaa

SEQ ID NO: 3751994 - RNA, 22 nt, Human
gagcuccagacccccagcaacc

SEQ ID NO: 3751995 - RNA, 19 nt, Human
gagcuccagcuccuuuggg

SEQ ID NO: 3751996 - RNA, 20 nt, Human
gagcuccagcuccuuugggc

SEQ ID NO: 3751997 - RNA, 21 nt, Human
gagcuccauacacacgcugcc

SEQ ID NO: 3751998 - RNA, 22 nt, Human
gagcuccauacacacgcugccu

SEQ ID NO: 3751999 - RNA, 23 nt, Human
gagcuccauacacacgcugccuu

SEQ ID NO: 3752000 - RNA, 19 nt, Human
gagcucccacaagccugag

SEQ ID NO: 3752001 - RNA, 20 nt, Human
gagcucccacaagccugagg

SEQ ID NO: 3752002 - RNA, 20 nt, Human
gagcucccacuucugccaga

SEQ ID NO: 3752003 - RNA, 21 nt, Human
gagcucccaggugcagccaga

SEQ ID NO: 3752004 - RNA, 22 nt, Human
gagcucccaggugcagccagag

SEQ ID NO: 3752005 - RNA, 20 nt, Human
gagcuccccaccaccccagc

SEQ ID NO: 3752006 - RNA, 22 nt, Human
gagcuccccaccaccccagcug

SEQ ID NO: 3752007 - RNA, 19 nt, Human
gagcuccccuacggaccag

SEQ ID NO: 3752008 - RNA, 17 nt, Human
gagcuccccuccccaac

SEQ ID NO: 3752009 - RNA, 14 nt, Human
gagcuccucugggc

SEQ ID NO: 3752010 - RNA, 16 nt, Human
gagcuccucugggcag

SEQ ID NO: 3752011 - RNA, 18 nt, Human
gagcuccucugggcagga

SEQ ID NO: 3752012 - RNA, 22 nt, Human
gagcuccucugggcaggaccuc

SEQ ID NO: 3752013 - RNA, 13 nt, Human
gagcuccucuucc

SEQ ID NO: 3752014 - RNA, 17 nt, Human
gagcuccuguccccugc

SEQ ID NO: 3752015 - RNA, 20 nt, Human
gagcuccuuaaggcucuuuu

SEQ ID NO: 3752016 - RNA, 15 nt, Human
gagcucgguggaccc

SEQ ID NO: 3752017 - RNA, 21 nt, Human
gagcucguguauccuggggcu

SEQ ID NO: 3752018 - RNA, 22 nt, Human
gagcucguguauccuggggcuc

SEQ ID NO: 3752019 - RNA, 23 nt, Human
gagcucguguauccuggggcucc

SEQ ID NO: 3752020 - RNA, 14 nt, Human
gagcucuacccagg

SEQ ID NO: 3752021 - RNA, 21 nt, Human
gagcucuacccagggccugca

SEQ ID NO: 3752022 - RNA, 14 nt, Human
gagcucucucuaca

SEQ ID NO: 3752023 - RNA, 15 nt, Human
gagcucugaaaucuu

SEQ ID NO: 3752024 - RNA, 19 nt, Human
gagcucugaaaucuuccca

SEQ ID NO: 3752025 - RNA, 13 nt, Human
gagcucugagagg

SEQ ID NO: 3752026 - RNA, 20 nt, Human
gagcucugagaggcccugga

SEQ ID NO: 3752027 - RNA, 16 nt, Human
gagcucugcagagcag

SEQ ID NO: 3752028 - RNA, 15 nt, Human
gagcucugcagccca

SEQ ID NO: 3752029 - RNA, 13 nt, Human
gagcucuggagcc

SEQ ID NO: 3752030 - RNA, 19 nt, Human
gagcucuggagccaccugu

SEQ ID NO: 3752031 - RNA, 20 nt, Human
gagcugaaaaaucacauccu

SEQ ID NO: 3752032 - RNA, 22 nt, Human
gagcugaagguuguggccuuug

SEQ ID NO: 3752033 - RNA, 13 nt, Human
gagcugacaaaau

SEQ ID NO: 3752034 - RNA, 14 nt, Human
gagcugagaagacu

SEQ ID NO: 3752035 - RNA, 13 nt, Human
gagcugagccagg

SEQ ID NO: 3752036 - RNA, 14 nt, Human
gagcugagccaggc

SEQ ID NO: 3752037 - RNA, 23 nt, Human
gagcugagguuucacccuuaacc

SEQ ID NO: 3752038 - RNA, 15 nt, Human
gagcugaguggggga

SEQ ID NO: 3752039 - RNA, 14 nt, Human
gagcugaugaaacu

SEQ ID NO: 3752040 - RNA, 18 nt, Human
gagcugauggagaaggaa

SEQ ID NO: 3752041 - RNA, 19 nt, Human
gagcugauggagaaggaag

SEQ ID NO: 3752042 - RNA, 16 nt, Human
gagcugcaccagguag

SEQ ID NO: 3752043 - RNA, 19 nt, Human
gagcugcaggggcauggga

SEQ ID NO: 3752044 - RNA, 15 nt, Human
gagcugccaccugcc

SEQ ID NO: 3752045 - RNA, 16 nt, Human
gagcugccaccugccu

SEQ ID NO: 3752046 - RNA, 13 nt, Human
gagcugccagugg

SEQ ID NO: 3752047 - RNA, 20 nt, Human
gagcugccauccagggaugc

SEQ ID NO: 3752048 - RNA, 18 nt, Human
gagcugcccacagcaggc

SEQ ID NO: 3752049 - RNA, 19 nt, Human
gagcugcccacagcaggcc

SEQ ID NO: 3752050 - RNA, 15 nt, Human
gagcugccccucucu

SEQ ID NO: 3752051 - RNA, 15 nt, Human
gagcugcccucuccu

SEQ ID NO: 3752052 - RNA, 19 nt, Human
gagcugcccucuccugggc

SEQ ID NO: 3752053 - RNA, 19 nt, Human
gagcugccuaagaggcaau

SEQ ID NO: 3752054 - RNA, 22 nt, Human
gagcugccuguucagcuccagc

SEQ ID NO: 3752055 - RNA, 19 nt, Human
gagcugccuucccuagcuu

SEQ ID NO: 3752056 - RNA, 15 nt, Human
gagcugccuuggcuc

SEQ ID NO: 3752057 - RNA, 14 nt, Human
gagcugcucugaau

SEQ ID NO: 3752058 - RNA, 16 nt, Human
gagcugcucuggaaaa

SEQ ID NO: 3752059 - RNA, 15 nt, Human
gagcugcugccauga

SEQ ID NO: 3752060 - RNA, 13 nt, Human
gagcugcugcccu

SEQ ID NO: 3752061 - RNA, 13 nt, Human
gagcugcuucccc

SEQ ID NO: 3752062 - RNA, 18 nt, Human
gagcugcuuuuuuugaaa

SEQ ID NO: 3752063 - RNA, 17 nt, Human
gagcuggaccucaccaa

SEQ ID NO: 3752064 - RNA, 12 nt, Human
gagcuggagccu

SEQ ID NO: 3752065 - RNA, 20 nt, Human
gagcuggcaaagguggcucu

SEQ ID NO: 3752066 - RNA, 17 nt, Human
gagcuggccgugggccu

SEQ ID NO: 3752067 - RNA, 20 nt, Human
gagcuggccgugggccuggg

SEQ ID NO: 3752068 - RNA, 16 nt, Human
gagcuggcgucugucu

SEQ ID NO: 3752069 - RNA, 19 nt, Human
gagcuggcuccagccugga

SEQ ID NO: 3752070 - RNA, 12 nt, Human
gagcuggcucug

SEQ ID NO: 3752071 - RNA, 21 nt, Human
gagcugggacacuuaacagau

SEQ ID NO: 3752072 - RNA, 17 nt, Human
gagcugggaggaaaaga

SEQ ID NO: 3752073 - RNA, 21 nt, Human
gagcugggccuggucucaccc

SEQ ID NO: 3752074 - RNA, 12 nt, Human
gagcuggggaag

SEQ ID NO: 3752075 - RNA, 15 nt, Human
gagcuggggaccugg

SEQ ID NO: 3752076 - RNA, 19 nt, Human
gagcuggggaugucucuca

SEQ ID NO: 3752077 - RNA, 24 nt, Human
gagcugggggccaugagcuccaga

SEQ ID NO: 3752078 - RNA, 18 nt, Human
gagcuggugcauuacaga

SEQ ID NO: 3752079 - RNA, 15 nt, Human
gagcuggugcccgga

SEQ ID NO: 3752080 - RNA, 21 nt, Human
gagcugugagaaggguguugu

SEQ ID NO: 3752081 - RNA, 20 nt, Human
gagcuguggacuuuguucac

SEQ ID NO: 3752082 - RNA, 17 nt, Human
gagcuguuuacuaggga

SEQ ID NO: 3752083 - RNA, 17 nt, Human
gagcuguuuauggccuc

SEQ ID NO: 3752084 - RNA, 18 nt, Human
gagcuguuuauggccuca

SEQ ID NO: 3752085 - RNA, 17 nt, Human
gagcuguuuauguuuuu

SEQ ID NO: 3752086 - RNA, 16 nt, Human
gagcuuaaaauacaag

SEQ ID NO: 3752087 - RNA, 15 nt, Human
gagcuuaacagugug

SEQ ID NO: 3752088 - RNA, 22 nt, Human
gagcuuaagccacugccucucc

SEQ ID NO: 3752089 - RNA, 21 nt, Human
gagcuuaaugcuacaugugag

SEQ ID NO: 3752090 - RNA, 13 nt, Human
gagcuuaccuccc

SEQ ID NO: 3752091 - RNA, 16 nt, Human
gagcuuaccucccacc

SEQ ID NO: 3752092 - RNA, 16 nt, Human
gagcuuagcauaucug

SEQ ID NO: 3752093 - RNA, 17 nt, Human
gagcuuagccaaugugg

SEQ ID NO: 3752094 - RNA, 13 nt, Human
gagcuuagggucu

SEQ ID NO: 3752095 - RNA, 16 nt, Human
gagcuucauggcagaa

SEQ ID NO: 3752096 - RNA, 19 nt, Human
gagcuucauggcagaaggc

SEQ ID NO: 3752097 - RNA, 17 nt, Human
gagcuucucuuuaacuc

SEQ ID NO: 3752098 - RNA, 22 nt, Human
gagcuucucuuuaacucaggac

SEQ ID NO: 3752099 - RNA, 14 nt, Human
gagcuucuggcacu

SEQ ID NO: 3752100 - RNA, 18 nt, Human
gagcuucuuguuuccuug

SEQ ID NO: 3752101 - RNA, 15 nt, Human
gagcuuggccagaag

SEQ ID NO: 3752102 - RNA, 20 nt, Human
gagcuugggggaugacuaga

SEQ ID NO: 3752103 - RNA, 22 nt, Human
gagcuuuauguaauaaugugaa

SEQ ID NO: 3752104 - RNA, 15 nt, Human
gagcuuucaaagaag

SEQ ID NO: 3752105 - RNA, 18 nt, Human
gagcuuucaaagaaggaa

SEQ ID NO: 3752106 - RNA, 18 nt, Human
gagcuuuccauguugcug

SEQ ID NO: 3752107 - RNA, 22 nt, Human
gagcuuucugaacagcuggugu

SEQ ID NO: 3752108 - RNA, 21 nt, Human
gagcuuugcauguuccacuaa

SEQ ID NO: 3752109 - RNA, 23 nt, Human
gagcuuugucuacuucaaaaguu

SEQ ID NO: 3752110 - RNA, 15 nt, Human
gagcuuuucuaggcu

SEQ ID NO: 3752111 - RNA, 17 nt, Human
gaggaaaaauaugugaa

SEQ ID NO: 3752112 - RNA, 12 nt, Human
gaggaaaauucu

SEQ ID NO: 3752113 - RNA, 17 nt, Human
gaggaaacucaccugcu

SEQ ID NO: 3752114 - RNA, 16 nt, Human
gaggaaagaaugaaag

SEQ ID NO: 3752115 - RNA, 20 nt, Human
gagccccuucugcucagcuc

SEQ ID NO: 3752116 - RNA, 21 nt, Human
gagccccuucugcucagcucu

SEQ ID NO: 3752117 - RNA, 15 nt, Human
gagcccgaggaggug

SEQ ID NO: 3752118 - RNA, 24 nt, Human
gagcccgaggaggugucucaggcu

SEQ ID NO: 3752119 - RNA, 16 nt, Human
gagcccgaggcaccag

SEQ ID NO: 3752120 - RNA, 20 nt, Human
gagcccgcacccccacccuu

SEQ ID NO: 3752121 - RNA, 17 nt, Human
gagcccggcgccccugc

SEQ ID NO: 3752122 - RNA, 14 nt, Human
gagcccgggcugcc

SEQ ID NO: 3752123 - RNA, 18 nt, Human
gagcccgggcugccuggg

SEQ ID NO: 3752124 - RNA, 16 nt, Human
gagcccuacuuccagg

SEQ ID NO: 3752125 - RNA, 23 nt, Human
gagcccuccgccuucacauuccc

SEQ ID NO: 3752126 - RNA, 14 nt, Human
gagcccugcucccu

SEQ ID NO: 3752127 - RNA, 16 nt, Human
gagcccugggaggcuc

SEQ ID NO: 3752128 - RNA, 20 nt, Human
gagcccugggaggcucugga

SEQ ID NO: 3752129 - RNA, 17 nt, Human
gagcccugguggcagug

SEQ ID NO: 3752130 - RNA, 18 nt, Human
gagcccugguggcagugg

SEQ ID NO: 3752131 - RNA, 22 nt, Human
gagcccuguccugccuaaggcu

SEQ ID NO: 3752132 - RNA, 12 nt, Human
gagcccugucuc

SEQ ID NO: 3752133 - RNA, 18 nt, Human
gagcccuuaucugugcuc

SEQ ID NO: 3752134 - RNA, 24 nt, Human
gagcccuucggaggaccagggcug

SEQ ID NO: 3752135 - RNA, 17 nt, Human
gagcccuugccucccca

SEQ ID NO: 3752136 - RNA, 20 nt, Human
gagccgagaucacgccacug

SEQ ID NO: 3752137 - RNA, 22 nt, Human
gagccggacuuucggaguuggg

SEQ ID NO: 3752138 - RNA, 20 nt, Human
gagccgggcaaacuggccgc

SEQ ID NO: 3752139 - RNA, 15 nt, Human
gagccgggccccugg

SEQ ID NO: 3752140 - RNA, 14 nt, Human
gagccgggccgcag

SEQ ID NO: 3752141 - RNA, 15 nt, Human
gagccgggccgcaga

SEQ ID NO: 3752142 - RNA, 22 nt, Human
gagccggggaguuucuuuccug

SEQ ID NO: 3752143 - RNA, 21 nt, Human
gagccgggucugccucuucug

SEQ ID NO: 3752144 - RNA, 22 nt, Human
gagccgggucugccucuucugg

SEQ ID NO: 3752145 - RNA, 20 nt, Human
gagccuaggaccacucagcc

SEQ ID NO: 3752146 - RNA, 22 nt, Human
gagccuaggaccacucagcccc

SEQ ID NO: 3752147 - RNA, 21 nt, Human
gagccucaaaugagaaaaugu

SEQ ID NO: 3752148 - RNA, 17 nt, Human
gagccucagcauccugg

SEQ ID NO: 3752149 - RNA, 20 nt, Human
gagccucagcauccuggcac

SEQ ID NO: 3752150 - RNA, 18 nt, Human
gagccucagucucccucc

SEQ ID NO: 3752151 - RNA, 19 nt, Human
gagccucagucucccuccc

SEQ ID NO: 3752152 - RNA, 23 nt, Human
gagccucagucucccucccuugg

SEQ ID NO: 3752153 - RNA, 17 nt, Human
gagccucauccgaggca

SEQ ID NO: 3752154 - RNA, 18 nt, Human
gagccucauccgaggcag

SEQ ID NO: 3752155 - RNA, 19 nt, Human
gagccucauccgaggcagg

SEQ ID NO: 3752156 - RNA, 20 nt, Human
gagccucauccgaggcaggg

SEQ ID NO: 3752157 - RNA, 21 nt, Human
gagccucccucaauucccccu

SEQ ID NO: 3752158 - RNA, 13 nt, Human
gagccuccugccc

SEQ ID NO: 3752159 - RNA, 14 nt, Human
gagccuccugccca

SEQ ID NO: 3752160 - RNA, 18 nt, Human
gagccuccugcccagucc

SEQ ID NO: 3752161 - RNA, 20 nt, Human
gagccucgcaacccgugcca

SEQ ID NO: 3752162 - RNA, 17 nt, Human
gagccucugcuccccag

SEQ ID NO: 3752163 - RNA, 19 nt, Human
gagccugaauuuuguugcu

SEQ ID NO: 3752164 - RNA, 21 nt, Human
gagccugacccucaucuuucu

SEQ ID NO: 3752165 - RNA, 12 nt, Human
gagccugaggga

SEQ ID NO: 3752166 - RNA, 22 nt, Human
gagccugagucagggcccagag

SEQ ID NO: 3752167 - RNA, 17 nt, Human
gagccugcacggugaau

SEQ ID NO: 3752168 - RNA, 13 nt, Human
gagccugcaggga

SEQ ID NO: 3752169 - RNA, 15 nt, Human
gagccugcagggugg

SEQ ID NO: 3752170 - RNA, 20 nt, Human
gagccugcaggguggugcug

SEQ ID NO: 3752171 - RNA, 18 nt, Human
gagccugccgagcaaccg

SEQ ID NO: 3752172 - RNA, 22 nt, Human
gagccugccgagcaaccguggc

SEQ ID NO: 3752173 - RNA, 10 nt, Human
gagccugcug

SEQ ID NO: 3752174 - RNA, 16 nt, Human
gagccugcuggaagcc

SEQ ID NO: 3752175 - RNA, 13 nt, Human
gagccugcuggca

SEQ ID NO: 3752176 - RNA, 12 nt, Human
gagccugcuggu

SEQ ID NO: 3752177 - RNA, 23 nt, Human
gagccugcuggucacagccuccu

SEQ ID NO: 3752178 - RNA, 13 nt, Human
gagccuggagaag

SEQ ID NO: 3752179 - RNA, 15 nt, Human
gagccuggagaagcu

SEQ ID NO: 3752180 - RNA, 19 nt, Human
gagccuggcacaggacuga

SEQ ID NO: 3752181 - RNA, 15 nt, Human
gagccuggccagccu

SEQ ID NO: 3752182 - RNA, 14 nt, Human
gagccuggcuccaa

SEQ ID NO: 3752183 - RNA, 13 nt, Human
gagccugggaggu

SEQ ID NO: 3752184 - RNA, 15 nt, Human
gagccuguccugccu

SEQ ID NO: 3752185 - RNA, 21 nt, Human
gagccuguguaacagcuccuu

SEQ ID NO: 3752186 - RNA, 19 nt, Human
gagccuuagccgcccaugc

SEQ ID NO: 3752187 - RNA, 13 nt, Human
gagccuuccaggg

SEQ ID NO: 3752188 - RNA, 23 nt, Human
gagccuuccaggggugggacacc

SEQ ID NO: 3752189 - RNA, 18 nt, Human
gagccuucucagaagcac

SEQ ID NO: 3752190 - RNA, 17 nt, Human
gagccuuuggaugacca

SEQ ID NO: 3752191 - RNA, 19 nt, Human
gagccuuuuaacugugcaa

SEQ ID NO: 3752192 - RNA, 14 nt, Human
gagcgacagagcag

SEQ ID NO: 3752193 - RNA, 15 nt, Human
gagcgacagagcagu

SEQ ID NO: 3752194 - RNA, 19 nt, Human
gagcgagagaucaaagaug

SEQ ID NO: 3752195 - RNA, 20 nt, Human
gagcgagagaucaaagauga

SEQ ID NO: 3752196 - RNA, 16 nt, Human
gagcgaguggagucug

SEQ ID NO: 3752197 - RNA, 20 nt, Human
gagcgaguggagucugccac

SEQ ID NO: 3752198 - RNA, 23 nt, Human
gagcgaguggagucugccaccca

SEQ ID NO: 3752199 - RNA, 13 nt, Human
gagcgcaagauag

SEQ ID NO: 3752200 - RNA, 12 nt, Human
gagcgcagcccg

SEQ ID NO: 3752201 - RNA, 22 nt, Human
gagcgcagccgccuucacagca

SEQ ID NO: 3752202 - RNA, 16 nt, Human
gagcgcaucaggccug

SEQ ID NO: 3752203 - RNA, 14 nt, Human
gagcgcccugcaga

SEQ ID NO: 3752204 - RNA, 20 nt, Human
gagcgcccugcagacccugc

SEQ ID NO: 3752205 - RNA, 22 nt, Human
gagcgccgugaguucucagggc

SEQ ID NO: 3752206 - RNA, 20 nt, Human
gagcgccugccccucccaga

SEQ ID NO: 3752207 - RNA, 17 nt, Human
gagcgccugugcacaca

SEQ ID NO: 3752208 - RNA, 16 nt, Human
gagcgcgccccuagcc

SEQ ID NO: 3752209 - RNA, 15 nt, Human
gagcgcuacccacuu

SEQ ID NO: 3752210 - RNA, 15 nt, Human
gagcgcuccugccgc

SEQ ID NO: 3752211 - RNA, 22 nt, Human
gagcgcuccugccgcagagcug

SEQ ID NO: 3752212 - RNA, 23 nt, Human
gagcgcuccugccgcagagcugg

SEQ ID NO: 3752213 - RNA, 12 nt, Human
gagcgcuugggc

SEQ ID NO: 3752214 - RNA, 15 nt, Human
gagcggaaagcagcu

SEQ ID NO: 3752215 - RNA, 17 nt, Human
gagcggagaaaggaagg

SEQ ID NO: 3752216 - RNA, 17 nt, Human
gagcgggaccuguggcu

SEQ ID NO: 3752217 - RNA, 12 nt, Human
gagcgggaggca

SEQ ID NO: 3752218 - RNA, 13 nt, Human
gagcgggaggcag

SEQ ID NO: 3752219 - RNA, 16 nt, Human
gagcgggaggcagagu

SEQ ID NO: 3752220 - RNA, 15 nt, Human
gagcgggucugcucc

SEQ ID NO: 3752221 - RNA, 17 nt, Human
gagcgguggcccugucc

SEQ ID NO: 3752222 - RNA, 20 nt, Human
gagcuaaacuccuuccuggc

SEQ ID NO: 3752223 - RNA, 22 nt, Human
gagcuaaacuccuuccuggccu

SEQ ID NO: 3752224 - RNA, 14 nt, Human
gagcuaacacuggc

SEQ ID NO: 3752225 - RNA, 14 nt, Human
gagcuaaggcucua

SEQ ID NO: 3752226 - RNA, 15 nt, Human
gagcuaagggugggu

SEQ ID NO: 3752227 - RNA, 20 nt, Human
gagcuaagggugggugcuca

SEQ ID NO: 3752228 - RNA, 11 nt, Human
gagcuacugcc

SEQ ID NO: 3752229 - RNA, 17 nt, Human
gagcuagaacccucugu

SEQ ID NO: 3752230 - RNA, 19 nt, Human
gagcuagaaccuggagagc

SEQ ID NO: 3752231 - RNA, 15 nt, Human
gagcuagaagcugga

SEQ ID NO: 3752232 - RNA, 18 nt, Human
gagcuagaagcuggagga

SEQ ID NO: 3752233 - RNA, 13 nt, Human
gagcuagagaaau

SEQ ID NO: 3752234 - RNA, 15 nt, Human
gagcuagcagcaggg

SEQ ID NO: 3752235 - RNA, 15 nt, Human
gagcuagccagagga

SEQ ID NO: 3752236 - RNA, 14 nt, Human
gagcuagcgcugcc

SEQ ID NO: 3752237 - RNA, 17 nt, Human
gagcuaggaagagucua

SEQ ID NO: 3752238 - RNA, 17 nt, Human
gagcuaggagcaaagcc

SEQ ID NO: 3752239 - RNA, 18 nt, Human
gagcuaggagcaaagccu

SEQ ID NO: 3752240 - RNA, 14 nt, Human
gagcuauacaguuu

SEQ ID NO: 3752241 - RNA, 20 nt, Human
gagcuauacaguuuuccuaa

SEQ ID NO: 3752242 - RNA, 19 nt, Human
gagcucaagggacaaggac

SEQ ID NO: 3752243 - RNA, 16 nt, Human
gagcucacaaggcagc

SEQ ID NO: 3752244 - RNA, 20 nt, Human
gagcucacaaggcagcaagg

SEQ ID NO: 3752245 - RNA, 14 nt, Human
gagcucagaccccc

SEQ ID NO: 3752246 - RNA, 21 nt, Human
gagcucagagagggcaggcau

SEQ ID NO: 3752247 - RNA, 23 nt, Human
gagcucagccccgagcugucccc

SEQ ID NO: 3752248 - RNA, 21 nt, Human
gagcucaggaaccgaggcagg

SEQ ID NO: 3752249 - RNA, 23 nt, Human
gagcucaggaaccgaggcaggga

SEQ ID NO: 3752250 - RNA, 12 nt, Human
gagcucaggaug

SEQ ID NO: 3752251 - RNA, 23 nt, Human
gagcucaggaugagggaaaagaa

SEQ ID NO: 3752252 - RNA, 19 nt, Human
gaggggacucugggcuaug

SEQ ID NO: 3752253 - RNA, 14 nt, Human
gaggggagccagga

SEQ ID NO: 3752254 - RNA, 17 nt, Human
gaggggagccaggaggg

SEQ ID NO: 3752255 - RNA, 15 nt, Human
gaggggaggaacagg

SEQ ID NO: 3752256 - RNA, 20 nt, Human
gaggggcaacgaagaaaaaa

SEQ ID NO: 3752257 - RNA, 14 nt, Human
gaggggcaggcuga

SEQ ID NO: 3752258 - RNA, 17 nt, Human
gaggggccccccugccc

SEQ ID NO: 3752259 - RNA, 17 nt, Human
gaggggccggcccugug

SEQ ID NO: 3752260 - RNA, 21 nt, Human
gaggggccggcccugugugca

SEQ ID NO: 3752261 - RNA, 22 nt, Human
gaggggccuaggccucagccag

SEQ ID NO: 3752262 - RNA, 13 nt, Human
gaggggccugcca

SEQ ID NO: 3752263 - RNA, 17 nt, Human
gaggggccugccaccug

SEQ ID NO: 3752264 - RNA, 21 nt, Human
gaggggccugccaccuggacc

SEQ ID NO: 3752265 - RNA, 18 nt, Human
gaggggcgcuggcccagc

SEQ ID NO: 3752266 - RNA, 19 nt, Human
gaggggcgcuggcccagcc

SEQ ID NO: 3752267 - RNA, 20 nt, Human
gaggggcgcuggcccagccg

SEQ ID NO: 3752268 - RNA, 22 nt, Human
gaggggcgcuggcccagccggc

SEQ ID NO: 3752269 - RNA, 16 nt, Human
gaggggcgggacccag

SEQ ID NO: 3752270 - RNA, 12 nt, Human
gaggggcuccug

SEQ ID NO: 3752271 - RNA, 14 nt, Human
gagggggagggggu

SEQ ID NO: 3752272 - RNA, 14 nt, Human
gagggguaggcaga

SEQ ID NO: 3752273 - RNA, 17 nt, Human
gagggguaggggcuggg

SEQ ID NO: 3752274 - RNA, 22 nt, Human
gaggggugcggcggucccagcu

SEQ ID NO: 3752275 - RNA, 22 nt, Human
gagggguuccuccccuccagcu

SEQ ID NO: 3752276 - RNA, 22 nt, Human
gagggguugccacaggccuccc

SEQ ID NO: 3752277 - RNA, 14 nt, Human
gaggguaggcagga

SEQ ID NO: 3752278 - RNA, 15 nt, Human
gaggguaggcaggau

SEQ ID NO: 3752279 - RNA, 13 nt, Human
gagggucaggaag

SEQ ID NO: 3752280 - RNA, 19 nt, Human
gagggucaggacugugacu

SEQ ID NO: 3752281 - RNA, 22 nt, Human
gaggguccagaaggagggggug

SEQ ID NO: 3752282 - RNA, 20 nt, Human
gagggucccaagcugggccc

SEQ ID NO: 3752283 - RNA, 13 nt, Human
gaggguccugcag

SEQ ID NO: 3752284 - RNA, 15 nt, Human
gagggucggugccuu

SEQ ID NO: 3752285 - RNA, 17 nt, Human
gagggucugggggcaca

SEQ ID NO: 3752286 - RNA, 23 nt, Human
gagggucuugguuccagccugcc

SEQ ID NO: 3752287 - RNA, 15 nt, Human
gagggugagugcaag

SEQ ID NO: 3752288 - RNA, 13 nt, Human
gaggguggcaggu

SEQ ID NO: 3752289 - RNA, 17 nt, Human
gagggugggggagggag

SEQ ID NO: 3752290 - RNA, 19 nt, Human
gagggugggggccaccugc

SEQ ID NO: 3752291 - RNA, 22 nt, Human
gagggugggggccaccugccug

SEQ ID NO: 3752292 - RNA, 14 nt, Human
gaggguuggggagg

SEQ ID NO: 3752293 - RNA, 13 nt, Human
gaggguugugcua

SEQ ID NO: 3752294 - RNA, 18 nt, Human
gaggguuguucuccuaga

SEQ ID NO: 3752295 - RNA, 22 nt, Human
gaggguuugagagagcagccag

SEQ ID NO: 3752296 - RNA, 21 nt, Human
gaggguuuuagguagaaaaac

SEQ ID NO: 3752297 - RNA, 23 nt, Human
gaggguuuuuaaaaauaaagcaa

SEQ ID NO: 3752298 - RNA, 18 nt, Human
gagguaacagaacagcuu

SEQ ID NO: 3752299 - RNA, 21 nt, Human
gagguaaggaauaccuguccc

SEQ ID NO: 3752300 - RNA, 24 nt, Human
gagguaaggaauaccugucccccu

SEQ ID NO: 3752301 - RNA, 13 nt, Human
gagguacccuggg

SEQ ID NO: 3752302 - RNA, 17 nt, Human
gagguagaaaagauugg

SEQ ID NO: 3752303 - RNA, 19 nt, Human
gagguagaaugacuccuug

SEQ ID NO: 3752304 - RNA, 18 nt, Human
gagguaucuuacuuuccu

SEQ ID NO: 3752305 - RNA, 14 nt, Human
gaggucaacagaga

SEQ ID NO: 3752306 - RNA, 16 nt, Human
cucuccugggcagcug

SEQ ID NO: 3752307 - RNA, 15 nt, Human
cucuccugggccccu

SEQ ID NO: 3752308 - RNA, 18 nt, Human
cucuccugggccccuccc

SEQ ID NO: 3752309 - RNA, 12 nt, Human
cucuccuguaag

SEQ ID NO: 3752310 - RNA, 19 nt, Human
cucuccuguaagccaaaga

SEQ ID NO: 3752311 - RNA, 20 nt, Human
cucuccuguaagccaaagaa

SEQ ID NO: 3752312 - RNA, 18 nt, Human
cucuccuguaccucuuga

SEQ ID NO: 3752313 - RNA, 22 nt, Human
cucuccuguaccucuugagccu

SEQ ID NO: 3752314 - RNA, 16 nt, Human
cucuccuguccucccu

SEQ ID NO: 3752315 - RNA, 17 nt, Human
cucuccugucucccucc

SEQ ID NO: 3752316 - RNA, 16 nt, Human
cucuccuuccuggagc

SEQ ID NO: 3752317 - RNA, 17 nt, Human
cucuccuuccuuaccca

SEQ ID NO: 3752318 - RNA, 14 nt, Human
cucuccuuccuugu

SEQ ID NO: 3752319 - RNA, 20 nt, Human
cucuccuugcuccuggccuu

SEQ ID NO: 3752320 - RNA, 14 nt, Human
cucuccuuucuuuu

SEQ ID NO: 3752321 - RNA, 21 nt, Human
cucuccuuucuuuuucuucuu

SEQ ID NO: 3752322 - RNA, 13 nt, Human
cucuccuuugaaa

SEQ ID NO: 3752323 - RNA, 13 nt, Human
cucuccuuuguau

SEQ ID NO: 3752324 - RNA, 15 nt, Human
cucuccuuuguauau

SEQ ID NO: 3752325 - RNA, 12 nt, Human
cucuccuuuucu

SEQ ID NO: 3752326 - RNA, 13 nt, Human
cucuccuuuucuu

SEQ ID NO: 3752327 - RNA, 17 nt, Human
cucuccuuuucuuuugu

SEQ ID NO: 3752328 - RNA, 21 nt, Human
cucuccuuuucuuuuguuacu

SEQ ID NO: 3752329 - RNA, 17 nt, Human
cucucgcaucuucccaa

SEQ ID NO: 3752330 - RNA, 19 nt, Human
cucucggaaggcuggcugg

SEQ ID NO: 3752331 - RNA, 18 nt, Human
cucucuacagucucgucu

SEQ ID NO: 3752332 - RNA, 13 nt, Human
cucucuacccagc

SEQ ID NO: 3752333 - RNA, 23 nt, Human
cucucuacuaaaacuacaaaaau

SEQ ID NO: 3752334 - RNA, 22 nt, Human
cucucuacuccuaccucagccu

SEQ ID NO: 3752335 - RNA, 14 nt, Human
cucucuacuggucc

SEQ ID NO: 3752336 - RNA, 13 nt, Human
cucucuagcacaa

SEQ ID NO: 3752337 - RNA, 16 nt, Human
cucucuauagcaccag

SEQ ID NO: 3752338 - RNA, 18 nt, Human
cucucuaugguaaagaua

SEQ ID NO: 3752339 - RNA, 20 nt, Human
cucucuaugguaaagauauu

SEQ ID NO: 3752340 - RNA, 21 nt, Human
cucucuauuucccccuuucuu

SEQ ID NO: 3752341 - RNA, 22 nt, Human
cucucuauuucccccuuucuuc

SEQ ID NO: 3752342 - RNA, 15 nt, Human
cucucucacuccuug

SEQ ID NO: 3752343 - RNA, 13 nt, Human
cucucucaggcca

SEQ ID NO: 3752344 - RNA, 12 nt, Human
cucucuccagau

SEQ ID NO: 3752345 - RNA, 17 nt, Human
cucucuccagucuucca

SEQ ID NO: 3752346 - RNA, 18 nt, Human
cucucuccagucuuccac

SEQ ID NO: 3752347 - RNA, 14 nt, Human
cucucuccaucaga

SEQ ID NO: 3752348 - RNA, 17 nt, Human
cucucuccccugcucca

SEQ ID NO: 3752349 - RNA, 14 nt, Human
cucucuccuccugc

SEQ ID NO: 3752350 - RNA, 20 nt, Human
cucucuccuguacuuuuucc

SEQ ID NO: 3752351 - RNA, 22 nt, Human
cucucuccuguuucccuucccu

SEQ ID NO: 3752352 - RNA, 19 nt, Human
cucucucuaaggaggaugu

SEQ ID NO: 3752353 - RNA, 15 nt, Human
cucucucucucuccc

SEQ ID NO: 3752354 - RNA, 14 nt, Human
cucucucugacucu

SEQ ID NO: 3752355 - RNA, 12 nt, Human
cucucucuucug

SEQ ID NO: 3752356 - RNA, 18 nt, Human
cucucucuucugcuccac

SEQ ID NO: 3752357 - RNA, 14 nt, Human
cucucugacucuca

SEQ ID NO: 3752358 - RNA, 19 nt, Human
cucucugaguccuggccca

SEQ ID NO: 3752359 - RNA, 17 nt, Human
cucucugcagccagccc

SEQ ID NO: 3752360 - RNA, 19 nt, Human
cucucugcagccagcccag

SEQ ID NO: 3752361 - RNA, 20 nt, Human
cucucugcagccagcccagc

SEQ ID NO: 3752362 - RNA, 12 nt, Human
cucucugcagcu

SEQ ID NO: 3752363 - RNA, 14 nt, Human
cucucugcagcugc

SEQ ID NO: 3752364 - RNA, 15 nt, Human
cucucugcagcugcc

SEQ ID NO: 3752365 - RNA, 16 nt, Human
cucucugcaggucccu

SEQ ID NO: 3752366 - RNA, 19 nt, Human
cucucugcaggucccuaau

SEQ ID NO: 3752367 - RNA, 16 nt, Human
cucucugcaucugacc

SEQ ID NO: 3752368 - RNA, 13 nt, Human
cucucugcccuaa

SEQ ID NO: 3752369 - RNA, 13 nt, Human
cucucugcccugu

SEQ ID NO: 3752370 - RNA, 15 nt, Human
cucucugcccugugu

SEQ ID NO: 3752371 - RNA, 17 nt, Human
cucucugcccuguguac

SEQ ID NO: 3752372 - RNA, 20 nt, Human
cucucugccugugagccagu

SEQ ID NO: 3752373 - RNA, 13 nt, Human
cucucugcuguac

SEQ ID NO: 3752374 - RNA, 18 nt, Human
cucucuggccucccaccc

SEQ ID NO: 3752375 - RNA, 19 nt, Human
cucucuggccuuuuccuau

SEQ ID NO: 3752376 - RNA, 15 nt, Human
cucucugguggcucu

SEQ ID NO: 3752377 - RNA, 16 nt, Human
cucucuguauaaacau

SEQ ID NO: 3752378 - RNA, 20 nt, Human
cucucuuaaaguuggaauuu

SEQ ID NO: 3752379 - RNA, 20 nt, Human
cucucuuaggagcagagcuc

SEQ ID NO: 3752380 - RNA, 23 nt, Human
cucucuuauugccucacuucagg

SEQ ID NO: 3752381 - RNA, 15 nt, Human
cucucuucagacucu

SEQ ID NO: 3752382 - RNA, 23 nt, Human
cucucuucagacucucagcccag

SEQ ID NO: 3752383 - RNA, 12 nt, Human
cucucuucccuc

SEQ ID NO: 3752384 - RNA, 15 nt, Human
cucucuucccucaga

SEQ ID NO: 3752385 - RNA, 20 nt, Human
cucucuucccuuuccccagc

SEQ ID NO: 3752386 - RNA, 14 nt, Human
cucucuuccuaucc

SEQ ID NO: 3752387 - RNA, 15 nt, Human
cucucuuccuauccc

SEQ ID NO: 3752388 - RNA, 16 nt, Human
cucucuuccuauccca

SEQ ID NO: 3752389 - RNA, 11 nt, Human
cucucuuccug

SEQ ID NO: 3752390 - RNA, 12 nt, Human
cucucuuccugc

SEQ ID NO: 3752391 - RNA, 17 nt, Human
cucucuucucagagugg

SEQ ID NO: 3752392 - RNA, 19 nt, Human
cucucuucucagaguggug

SEQ ID NO: 3752393 - RNA, 16 nt, Human
cucucuucucuccagc

SEQ ID NO: 3752394 - RNA, 12 nt, Human
cucucuucugcu

SEQ ID NO: 3752395 - RNA, 14 nt, Human
cucucuugcacccg

SEQ ID NO: 3752396 - RNA, 18 nt, Human
cucucuuuauacagcugu

SEQ ID NO: 3752397 - RNA, 20 nt, Human
cucucuuuccuucuugccuu

SEQ ID NO: 3752398 - RNA, 18 nt, Human
cucucuuugggaauguuu

SEQ ID NO: 3752399 - RNA, 15 nt, Human
cucucuuuguucuca

SEQ ID NO: 3752400 - RNA, 21 nt, Human
cucucuuuguucucagcuccc

SEQ ID NO: 3752401 - RNA, 18 nt, Human
cucucuuuuuggaggugc

SEQ ID NO: 3752402 - RNA, 19 nt, Human
cucucuuuuuggaggugcu

SEQ ID NO: 3752403 - RNA, 11 nt, Human
cucugaaacag

SEQ ID NO: 3752404 - RNA, 12 nt, Human
cucugaaacagc

SEQ ID NO: 3752405 - RNA, 19 nt, Human
cucugaaacagcugccuua

SEQ ID NO: 3752406 - RNA, 23 nt, Human
cucugaaacagcugccuuagcuu

SEQ ID NO: 3752407 - RNA, 13 nt, Human
cucugaaagagaa

SEQ ID NO: 3752408 - RNA, 17 nt, Human
cucugaaaguuguacau

SEQ ID NO: 3752409 - RNA, 17 nt, Human
cucugaaauaucccggg

SEQ ID NO: 3752410 - RNA, 16 nt, Human
cucugaaaucugaaga

SEQ ID NO: 3752411 - RNA, 22 nt, Human
cucugaaaucugaagaccucga

SEQ ID NO: 3752412 - RNA, 16 nt, Human
cucugaacacaggcag

SEQ ID NO: 3752413 - RNA, 17 nt, Human
cucugaacacaggcagc

SEQ ID NO: 3752414 - RNA, 22 nt, Human
cucugaacacaggcagcuuucu

SEQ ID NO: 3752415 - RNA, 13 nt, Human
cucugaacacauu

SEQ ID NO: 3752416 - RNA, 16 nt, Human
cucugaacuuuggaga

SEQ ID NO: 3752417 - RNA, 15 nt, Human
cucugaagcaaggcg

SEQ ID NO: 3752418 - RNA, 17 nt, Human
cucugaagcauguuuca

SEQ ID NO: 3752419 - RNA, 20 nt, Human
cucugaagcauguuucaugu

SEQ ID NO: 3752420 - RNA, 16 nt, Human
cucugaagccucuggg

SEQ ID NO: 3752421 - RNA, 19 nt, Human
cucugaaggacccuucaga

SEQ ID NO: 3752422 - RNA, 14 nt, Human
cucugaaggaggcc

SEQ ID NO: 3752423 - RNA, 16 nt, Human
cucugaaggaggccac

SEQ ID NO: 3752424 - RNA, 19 nt, Human
cucugaaggaggccaccuc

SEQ ID NO: 3752425 - RNA, 20 nt, Human
cucugaaggaggccaccucc

SEQ ID NO: 3752426 - RNA, 13 nt, Human
cucugaagggagg

SEQ ID NO: 3752427 - RNA, 13 nt, Human
cucugaagucaca

SEQ ID NO: 3752428 - RNA, 18 nt, Human
cucugaaugguccagggu

SEQ ID NO: 3752429 - RNA, 20 nt, Human
cucugaauuuacuuccuugc

SEQ ID NO: 3752430 - RNA, 22 nt, Human
cucugaauuuaucuuugauaac

SEQ ID NO: 3752431 - RNA, 12 nt, Human
cucugacagcag

SEQ ID NO: 3752432 - RNA, 17 nt, Human
cucugacagcagcaucu

SEQ ID NO: 3752433 - RNA, 23 nt, Human
cucugacagcagcaucucuaccu

SEQ ID NO: 3752434 - RNA, 23 nt, Human
cucugacauuaugugguuuuaga

SEQ ID NO: 3752435 - RNA, 13 nt, Human
cucugaccacuug

SEQ ID NO: 3752436 - RNA, 20 nt, Human
cucugaccacuugaggccug

SEQ ID NO: 3752437 - RNA, 19 nt, Human
cucugaccgaaacagcgcu

SEQ ID NO: 3752438 - RNA, 22 nt, Human
cucugaccgaaacagcgcuggg

SEQ ID NO: 3752439 - RNA, 12 nt, Human
cucugaccugca

SEQ ID NO: 3752440 - RNA, 13 nt, Human
cucugaccugcag

SEQ ID NO: 3752441 - RNA, 16 nt, Human
cucugacucagggcuc

SEQ ID NO: 3752442 - RNA, 20 nt, Human
cucugacucagggcuccugg

SEQ ID NO: 3752443 - RNA, 21 nt, Human
cucugacucccaaagagcugc

SEQ ID NO: 3752444 - RNA, 15 nt, Human
cucugacucucaaau

SEQ ID NO: 3752445 - RNA, 16 nt, Human
cucugacucucaaauc

SEQ ID NO: 3752446 - RNA, 18 nt, Human
cucugacuggcacagucu

SEQ ID NO: 3752447 - RNA, 19 nt, Human
cucugacuuaagcaaaaga

SEQ ID NO: 3752448 - RNA, 22 nt, Human
cucugacuuaagcaaaagaaaa

SEQ ID NO: 3752449 - RNA, 14 nt, Human
cucugacuucugcc

SEQ ID NO: 3752450 - RNA, 15 nt, Human
cucugacuucugccu

SEQ ID NO: 3752451 - RNA, 19 nt, Human
cucugacuucugccuggag

SEQ ID NO: 3752452 - RNA, 21 nt, Human
cucugacuucugccuggagac

SEQ ID NO: 3752453 - RNA, 18 nt, Human
cucugagaagaggagccc

SEQ ID NO: 3752454 - RNA, 15 nt, Human
cucugagacuccaga

SEQ ID NO: 3752455 - RNA, 23 nt, Human
cucugagacuccagaccugaggc

SEQ ID NO: 3752456 - RNA, 13 nt, Human
cucugagaggccc

SEQ ID NO: 3752457 - RNA, 21 nt, Human
gagggagacacuggccccuca

SEQ ID NO: 3752458 - RNA, 13 nt, Human
gagggagagagag

SEQ ID NO: 3752459 - RNA, 15 nt, Human
gagggagagagagag

SEQ ID NO: 3752460 - RNA, 16 nt, Human
gagggagagucuccca

SEQ ID NO: 3752461 - RNA, 12 nt, Human
gagggagcagac

SEQ ID NO: 3752462 - RNA, 17 nt, Human
gagggaggccccagggg

SEQ ID NO: 3752463 - RNA, 16 nt, Human
gagggagggcuccaga

SEQ ID NO: 3752464 - RNA, 20 nt, Human
gagggagggcuccagacaca

SEQ ID NO: 3752465 - RNA, 18 nt, Human
gagggagguguuuaaaga

SEQ ID NO: 3752466 - RNA, 13 nt, Human
gagggagugacag

SEQ ID NO: 3752467 - RNA, 15 nt, Human
gagggaucacagggc

SEQ ID NO: 3752468 - RNA, 23 nt, Human
gagggaucacagggccccagaag

SEQ ID NO: 3752469 - RNA, 17 nt, Human
gagggaugaugccacac

SEQ ID NO: 3752470 - RNA, 16 nt, Human
gagggaugggccuggc

SEQ ID NO: 3752471 - RNA, 21 nt, Human
gagggauucugguuccagggu

SEQ ID NO: 3752472 - RNA, 18 nt, Human
gagggcaagggccaugcu

SEQ ID NO: 3752473 - RNA, 22 nt, Human
gagggcacagaaaauggaagac

SEQ ID NO: 3752474 - RNA, 23 nt, Human
gagggcacagaaaauggaagaca

SEQ ID NO: 3752475 - RNA, 12 nt, Human
gagggcacuggu

SEQ ID NO: 3752476 - RNA, 21 nt, Human
gagggcagacuggggcauccu

SEQ ID NO: 3752477 - RNA, 23 nt, Human
gagggcagacuggggcauccugu

SEQ ID NO: 3752478 - RNA, 19 nt, Human
gagggcagcagaagggggu

SEQ ID NO: 3752479 - RNA, 21 nt, Human
gagggcagcagaagggggugg

SEQ ID NO: 3752480 - RNA, 22 nt, Human
gagggcagcagaaggggguggu

SEQ ID NO: 3752481 - RNA, 13 nt, Human
gagggcagcagcc

SEQ ID NO: 3752482 - RNA, 16 nt, Human
gagggcagcagccagc

SEQ ID NO: 3752483 - RNA, 19 nt, Human
gagggcagcagggcuaccc

SEQ ID NO: 3752484 - RNA, 16 nt, Human
gagggcagcgggagcc

SEQ ID NO: 3752485 - RNA, 18 nt, Human
gagggcagcgggagccuc

SEQ ID NO: 3752486 - RNA, 23 nt, Human
gagggcagcgggagccucccugc

SEQ ID NO: 3752487 - RNA, 17 nt, Human
gagggcauccauaccag

SEQ ID NO: 3752488 - RNA, 18 nt, Human
gagggcaugcgcacaagg

SEQ ID NO: 3752489 - RNA, 18 nt, Human
gagggccaagacuuggca

SEQ ID NO: 3752490 - RNA, 16 nt, Human
gagggccacaugggag

SEQ ID NO: 3752491 - RNA, 15 nt, Human
gagggcccagagcag

SEQ ID NO: 3752492 - RNA, 20 nt, Human
gagggcccagagcaggaagc

SEQ ID NO: 3752493 - RNA, 16 nt, Human
gagggcccaggcaggc

SEQ ID NO: 3752494 - RNA, 12 nt, Human
gagggccccucu

SEQ ID NO: 3752495 - RNA, 15 nt, Human
gagggccccucugcc

SEQ ID NO: 3752496 - RNA, 20 nt, Human
gagggccccucugcccagcu

SEQ ID NO: 3752497 - RNA, 15 nt, Human
gagggcccuaccuga

SEQ ID NO: 3752498 - RNA, 17 nt, Human
gagggccguaccccacc

SEQ ID NO: 3752499 - RNA, 20 nt, Human
gagggccguaccccacccuc

SEQ ID NO: 3752500 - RNA, 21 nt, Human
gagggccguaccccacccuca

SEQ ID NO: 3752501 - RNA, 14 nt, Human
gagggccugcugga

SEQ ID NO: 3752502 - RNA, 12 nt, Human
gagggccugggc

SEQ ID NO: 3752503 - RNA, 17 nt, Human
gagggccugggccuggc

SEQ ID NO: 3752504 - RNA, 20 nt, Human
gagggccugggccuggcucc

SEQ ID NO: 3752505 - RNA, 16 nt, Human
gagggcggagccggcc

SEQ ID NO: 3752506 - RNA, 19 nt, Human
gagggcggcaggggccugg

SEQ ID NO: 3752507 - RNA, 17 nt, Human
gagggcuagaaccuaga

SEQ ID NO: 3752508 - RNA, 18 nt, Human
gagggcuagaaccuggag

SEQ ID NO: 3752509 - RNA, 18 nt, Human
gagggcuagaacuggaga

SEQ ID NO: 3752510 - RNA, 12 nt, Human
gagggcuccaga

SEQ ID NO: 3752511 - RNA, 13 nt, Human
gagggcucugagg

SEQ ID NO: 3752512 - RNA, 14 nt, Human
gagggcucugugcu

SEQ ID NO: 3752513 - RNA, 9 nt, Human
gagggcugc

SEQ ID NO: 3752514 - RNA, 16 nt, Human
gagggcuggaggccca

SEQ ID NO: 3752515 - RNA, 20 nt, Human
gagggcuggaggcccaggcu

SEQ ID NO: 3752516 - RNA, 10 nt, Human
gagggcuggc

SEQ ID NO: 3752517 - RNA, 15 nt, Human
gaggggaacacugcc

SEQ ID NO: 3752518 - RNA, 16 nt, Human
gaggggaagaggccug

SEQ ID NO: 3752519 - RNA, 14 nt, Human
gaggggaagggcca

SEQ ID NO: 3752520 - RNA, 12 nt, Human
gaggggaccagg

SEQ ID NO: 3752521 - RNA, 16 nt, Human
gaggggaccaggagug

SEQ ID NO: 3752522 - RNA, 21 nt, Human
gaggggaccaggagugggugg

SEQ ID NO: 3752523 - RNA, 22 nt, Human
gaggggacuauuuaugaaggca

SEQ ID NO: 3752524 - RNA, 23 nt, Human
gaggggacucugggcuauggaca

SEQ ID NO: 3752525 - RNA, 20 nt, Human
gaggggagacuuugauguca

SEQ ID NO: 3752526 - RNA, 18 nt, Human
gaggggagcucugucugu

SEQ ID NO: 3752527 - RNA, 21 nt, Human
gaggggaggaucacuggagcc

SEQ ID NO: 3752528 - RNA, 17 nt, Human
gaggggauggggcuggg

SEQ ID NO: 3752529 - RNA, 23 nt, Human
gaggggaugugugugugcagagc

SEQ ID NO: 3752530 - RNA, 18 nt, Human
gaggggcagaacagccgc

SEQ ID NO: 3752531 - RNA, 13 nt, Human
gaggggcagagcc

SEQ ID NO: 3752532 - RNA, 14 nt, Human
gaggggcagcccuu

SEQ ID NO: 3752533 - RNA, 15 nt, Human
gaggggcagcccuug

SEQ ID NO: 3752534 - RNA, 16 nt, Human
gaggggcagcccuugc

SEQ ID NO: 3752535 - RNA, 13 nt, Human
gaggggcaggccc

SEQ ID NO: 3752536 - RNA, 14 nt, Human
gaggggcaggcccu

SEQ ID NO: 3752537 - RNA, 15 nt, Human
gaggggcaggcccug

SEQ ID NO: 3752538 - RNA, 16 nt, Human
gaggggcaggcugaca

SEQ ID NO: 3752539 - RNA, 17 nt, Human
gaggggcaucugccccu

SEQ ID NO: 3752540 - RNA, 22 nt, Human
gaggggcaucugccccuccccc

SEQ ID NO: 3752541 - RNA, 19 nt, Human
gaggggccgaugcccagag

SEQ ID NO: 3752542 - RNA, 12 nt, Human
gaggggccucuu

SEQ ID NO: 3752543 - RNA, 20 nt, Human
gaggggccugccaccuggac

SEQ ID NO: 3752544 - RNA, 16 nt, Human
gaggggcgcccaccuc

SEQ ID NO: 3752545 - RNA, 13 nt, Human
gaggggcgcuggc

SEQ ID NO: 3752546 - RNA, 14 nt, Human
gaggggcgcuggcc

SEQ ID NO: 3752547 - RNA, 15 nt, Human
gaggggcgcuggccc

SEQ ID NO: 3752548 - RNA, 16 nt, Human
gaggggcgcuggccca

SEQ ID NO: 3752549 - RNA, 16 nt, Human
gaggggcucaggaaaa

SEQ ID NO: 3752550 - RNA, 17 nt, Human
gaggggcugugggcgug

SEQ ID NO: 3752551 - RNA, 14 nt, Human
gagggggacugcug

SEQ ID NO: 3752552 - RNA, 21 nt, Human
gagggggacugcugcugccug

SEQ ID NO: 3752553 - RNA, 14 nt, Human
gagggggagagggc

SEQ ID NO: 3752554 - RNA, 20 nt, Human
gagggggccaccuccccagg

SEQ ID NO: 3752555 - RNA, 21 nt, Human
gagggggccgggcgcgguggc

SEQ ID NO: 3752556 - RNA, 21 nt, Human
gagggggcuauagcuacagga

SEQ ID NO: 3752557 - RNA, 15 nt, Human
gagggggcugcuccc

SEQ ID NO: 3752558 - RNA, 21 nt, Human
gagggggucguggagagcuag

SEQ ID NO: 3752559 - RNA, 13 nt, Human
gaggggguggagg

SEQ ID NO: 3752560 - RNA, 19 nt, Human
gaggggguuacaaacugca

SEQ ID NO: 3752561 - RNA, 16 nt, Human
gagggguaaaagcuga

SEQ ID NO: 3752562 - RNA, 20 nt, Human
gaggggucccuagcagccca

SEQ ID NO: 3752563 - RNA, 18 nt, Human
gaggggucuccaggagga

SEQ ID NO: 3752564 - RNA, 17 nt, Human
gaggggugcagaggcug

SEQ ID NO: 3752565 - RNA, 19 nt, Human
gaggggugcggcgguccca

SEQ ID NO: 3752566 - RNA, 17 nt, Human
gagggguguggcagugg

SEQ ID NO: 3752567 - RNA, 23 nt, Human
gagggguugccacaggccucccu

SEQ ID NO: 3752568 - RNA, 15 nt, Human
gaggguacagcuggg

SEQ ID NO: 3752569 - RNA, 15 nt, Human
gagggucaggaagga

SEQ ID NO: 3752570 - RNA, 19 nt, Human
gaggguccccaccugggac

SEQ ID NO: 3752571 - RNA, 13 nt, Human
gagggucugagga

SEQ ID NO: 3752572 - RNA, 14 nt, Human
gagggucugaggaa

SEQ ID NO: 3752573 - RNA, 15 nt, Human
gagggucuggagaag

SEQ ID NO: 3752574 - RNA, 22 nt, Human
gagggucugggaaaugagcagg

SEQ ID NO: 3752575 - RNA, 13 nt, Human
gaggguggagacu

SEQ ID NO: 3752576 - RNA, 18 nt, Human
gagggugggagagcccag

SEQ ID NO: 3752577 - RNA, 14 nt, Human
gagggugggggagg

SEQ ID NO: 3752578 - RNA, 13 nt, Human
gaggguguccugc

SEQ ID NO: 3752579 - RNA, 16 nt, Human
gaggguucagagagga

SEQ ID NO: 3752580 - RNA, 15 nt, Human
gagguaacagaacag

SEQ ID NO: 3752581 - RNA, 17 nt, Human
gagguaacagaacagcu

SEQ ID NO: 3752582 - RNA, 21 nt, Human
gagguaacagaacagcuucag

SEQ ID NO: 3752583 - RNA, 16 nt, Human
gagguaagggaggagg

SEQ ID NO: 3752584 - RNA, 21 nt, Human
gagguagaccaggauuucuaa

SEQ ID NO: 3752585 - RNA, 19 nt, Human
gagguagaguuugaaggag

SEQ ID NO: 3752586 - RNA, 21 nt, Human
gagguagcuuugagguggaag

SEQ ID NO: 3752587 - RNA, 21 nt, Human
gagguagguggaucaccugag

SEQ ID NO: 3752588 - RNA, 16 nt, Human
gagguaguuaagggau

SEQ ID NO: 3752589 - RNA, 15 nt, Human
gagguauaauugugu

SEQ ID NO: 3752590 - RNA, 13 nt, Human
gagguaugagguc

SEQ ID NO: 3752591 - RNA, 22 nt, Human
gagguauucaauauccuuugcc

SEQ ID NO: 3752592 - RNA, 22 nt, Human
gaggucaacagagaaggcagga

SEQ ID NO: 3752593 - RNA, 12 nt, Human
gaggucaagaga

SEQ ID NO: 3752594 - RNA, 15 nt, Human
gaggucaagcccagg

SEQ ID NO: 3752595 - RNA, 19 nt, Human
gaggucaagcccaggagga

SEQ ID NO: 3752596 - RNA, 20 nt, Human
gaggucaagcccaggaggac

SEQ ID NO: 3752597 - RNA, 17 nt, Human
gaggucaaggcugcagu

SEQ ID NO: 3752598 - RNA, 19 nt, Human
gaggucaaggcugcaguga

SEQ ID NO: 3752599 - RNA, 16 nt, Human
gaggucaaguaagaag

SEQ ID NO: 3752600 - RNA, 16 nt, Human
gaggucacauucagga

SEQ ID NO: 3752601 - RNA, 19 nt, Human
gaggucacauucaggaaga

SEQ ID NO: 3752602 - RNA, 20 nt, Human
gaggucacuggaaaggggag

SEQ ID NO: 3752603 - RNA, 12 nt, Human
gaggucagagcc

SEQ ID NO: 3752604 - RNA, 13 nt, Human
gaggucaggaguu

SEQ ID NO: 3752605 - RNA, 14 nt, Human
gaggucagggagug

SEQ ID NO: 3752606 - RNA, 18 nt, Human
gagguccacaacacacag

SEQ ID NO: 3752607 - RNA, 12 nt, Human
gagguccagccc

SEQ ID NO: 3752608 - RNA, 16 nt, Human
gaggucaacagagaag

SEQ ID NO: 3752609 - RNA, 17 nt, Human
gaggucagagccugcag

SEQ ID NO: 3752610 - RNA, 17 nt, Human
gaggucagcauuugauc

SEQ ID NO: 3752611 - RNA, 22 nt, Human
gaggucaggaaacuuuuaacug

SEQ ID NO: 3752612 - RNA, 14 nt, Human
gaggucaggcccug

SEQ ID NO: 3752613 - RNA, 15 nt, Human
gaggucaggcccugg

SEQ ID NO: 3752614 - RNA, 19 nt, Human
gagguccagcccuggcuga

SEQ ID NO: 3752615 - RNA, 22 nt, Human
gagguccagcccuggcugaagg

SEQ ID NO: 3752616 - RNA, 13 nt, Human
gaggucccaggaa

SEQ ID NO: 3752617 - RNA, 16 nt, Human
gagguccucuggagcc

SEQ ID NO: 3752618 - RNA, 20 nt, Human
gagguccucuggagcccuaa

SEQ ID NO: 3752619 - RNA, 16 nt, Human
gagguccugagcacug

SEQ ID NO: 3752620 - RNA, 18 nt, Human
gagguccugagcacugcc

SEQ ID NO: 3752621 - RNA, 13 nt, Human
gagguccuggggg

SEQ ID NO: 3752622 - RNA, 22 nt, Human
gaggucgaccccaaagccccuu

SEQ ID NO: 3752623 - RNA, 15 nt, Human
gaggucgaggcagga

SEQ ID NO: 3752624 - RNA, 20 nt, Human
gaggucgggaguucgagacc

SEQ ID NO: 3752625 - RNA, 23 nt, Human
gaggucgguagguucagccaagg

SEQ ID NO: 3752626 - RNA, 21 nt, Human
gaggucucagccccuuucccu

SEQ ID NO: 3752627 - RNA, 17 nt, Human
gaggucucgcugaugcu

SEQ ID NO: 3752628 - RNA, 15 nt, Human
gaggucucuugaggg

SEQ ID NO: 3752629 - RNA, 18 nt, Human
gaggucucuugagggagc

SEQ ID NO: 3752630 - RNA, 23 nt, Human
gaggucugcucggccgucuucac

SEQ ID NO: 3752631 - RNA, 13 nt, Human
gaggucugugcug

SEQ ID NO: 3752632 - RNA, 16 nt, Human
gaggucugugcugagg

SEQ ID NO: 3752633 - RNA, 19 nt, Human
gaggucugugcugaggccu

SEQ ID NO: 3752634 - RNA, 12 nt, Human
gaggucuguuua

SEQ ID NO: 3752635 - RNA, 22 nt, Human
gaggucuugcuagaaugggaag

SEQ ID NO: 3752636 - RNA, 19 nt, Human
gaggucuuuugacaugugg

SEQ ID NO: 3752637 - RNA, 15 nt, Human
gaggugaaaaggcca

SEQ ID NO: 3752638 - RNA, 21 nt, Human
gaggugauuccagugaagaua

SEQ ID NO: 3752639 - RNA, 19 nt, Human
gaggugcagagugcccaga

SEQ ID NO: 3752640 - RNA, 21 nt, Human
gaggugcagagugcccagaac

SEQ ID NO: 3752641 - RNA, 13 nt, Human
gaggugccacugg

SEQ ID NO: 3752642 - RNA, 14 nt, Human
gaggugccagcaaa

SEQ ID NO: 3752643 - RNA, 15 nt, Human
gaggugccagcaaag

SEQ ID NO: 3752644 - RNA, 19 nt, Human
gaggugccagcaaagcccc

SEQ ID NO: 3752645 - RNA, 17 nt, Human
gaggugccagcaacuga

SEQ ID NO: 3752646 - RNA, 20 nt, Human
gaggugccagcaacugaaua

SEQ ID NO: 3752647 - RNA, 13 nt, Human
gaggugcccagga

SEQ ID NO: 3752648 - RNA, 16 nt, Human
gaggugcccaggagaa

SEQ ID NO: 3752649 - RNA, 15 nt, Human
gaggugccuguccca

SEQ ID NO: 3752650 - RNA, 17 nt, Human
gagguggaagaagggag

SEQ ID NO: 3752651 - RNA, 18 nt, Human
gagguggaauuauuuuaa

SEQ ID NO: 3752652 - RNA, 19 nt, Human
gagguggaggcugcaguga

SEQ ID NO: 3752653 - RNA, 20 nt, Human
gagguggaucacagaggcuu

SEQ ID NO: 3752654 - RNA, 17 nt, Human
gagguggccagagcugg

SEQ ID NO: 3752655 - RNA, 22 nt, Human
gagguggccagagcugggaggc

SEQ ID NO: 3752656 - RNA, 14 nt, Human
gagguggcugccug

SEQ ID NO: 3752657 - RNA, 13 nt, Human
gaggugggagcag

SEQ ID NO: 3752658 - RNA, 15 nt, Human
gaggugggagcagga

SEQ ID NO: 3752659 - RNA, 18 nt, Human
gaggugggagcaggagau

SEQ ID NO: 3752660 - RNA, 16 nt, Human
gaggugggauaucccu

SEQ ID NO: 3752661 - RNA, 17 nt, Human
gaggugggauccuccag

SEQ ID NO: 3752662 - RNA, 18 nt, Human
gaggugggauccuccagg

SEQ ID NO: 3752663 - RNA, 23 nt, Human
gaggugggcaggugguggcacug

SEQ ID NO: 3752664 - RNA, 17 nt, Human
gaggugggccagucugu

SEQ ID NO: 3752665 - RNA, 12 nt, Human
gaggugggccca

SEQ ID NO: 3752666 - RNA, 15 nt, Human
gaggugggcccagga

SEQ ID NO: 3752667 - RNA, 13 nt, Human
gagguggucugaa

SEQ ID NO: 3752668 - RNA, 14 nt, Human
gaggugucaggcug

SEQ ID NO: 3752669 - RNA, 18 nt, Human
gaggugucaggcugcugg

SEQ ID NO: 3752670 - RNA, 22 nt, Human
gaggugucaggcugcuggcgcc

SEQ ID NO: 3752671 - RNA, 17 nt, Human
gaggugucucaggcugc

SEQ ID NO: 3752672 - RNA, 20 nt, Human
gaggugucucaggcugccug

SEQ ID NO: 3752673 - RNA, 16 nt, Human
gagguguggagccgag

SEQ ID NO: 3752674 - RNA, 15 nt, Human
gaggugugggggcug

SEQ ID NO: 3752675 - RNA, 16 nt, Human
gaggugugggggcugc

SEQ ID NO: 3752676 - RNA, 19 nt, Human
gagguguuuaaagagaggu

SEQ ID NO: 3752677 - RNA, 21 nt, Human
gagguuacagguaccaguucu

SEQ ID NO: 3752678 - RNA, 19 nt, Human
gagguuauaggucacuccu

SEQ ID NO: 3752679 - RNA, 14 nt, Human
gagguucccuuuga

SEQ ID NO: 3752680 - RNA, 17 nt, Human
gagguuccucugccugc

SEQ ID NO: 3752681 - RNA, 18 nt, Human
gagguuccucugccugcc

SEQ ID NO: 3752682 - RNA, 13 nt, Human
gagguugaagcca

SEQ ID NO: 3752683 - RNA, 15 nt, Human
gagguugaagccaag

SEQ ID NO: 3752684 - RNA, 15 nt, Human
gagguugauaacuuu

SEQ ID NO: 3752685 - RNA, 20 nt, Human
gagguugaucagaucugaca

SEQ ID NO: 3752686 - RNA, 15 nt, Human
gagguugggaggcca

SEQ ID NO: 3752687 - RNA, 17 nt, Human
gagguugggaggccauu

SEQ ID NO: 3752688 - RNA, 14 nt, Human
gagguugggugggc

SEQ ID NO: 3752689 - RNA, 18 nt, Human
gagguuguagugagccca

SEQ ID NO: 3752690 - RNA, 18 nt, Human
gagguuuauaguuaaucu

SEQ ID NO: 3752691 - RNA, 21 nt, Human
gagguuucacccuuaacccaa

SEQ ID NO: 3752692 - RNA, 19 nt, Human
gagguuucccaaugguguu

SEQ ID NO: 3752693 - RNA, 20 nt, Human
gagguuucucaaagaaauuu

SEQ ID NO: 3752694 - RNA, 16 nt, Human
gagguuugcaguccca

SEQ ID NO: 3752695 - RNA, 15 nt, Human
gagguuuuaaaguga

SEQ ID NO: 3752696 - RNA, 16 nt, Human
gagguuuuaugauauu

SEQ ID NO: 3752697 - RNA, 16 nt, Human
gagguuuucuccccca

SEQ ID NO: 3752698 - RNA, 16 nt, Human
gaguaaauacagguag

SEQ ID NO: 3752699 - RNA, 20 nt, Human
gaguaaaucagauguugaau

SEQ ID NO: 3752700 - RNA, 15 nt, Human
gaguaacaauacaaa

SEQ ID NO: 3752701 - RNA, 20 nt, Human
gaguaacaauacaaauggau

SEQ ID NO: 3752702 - RNA, 16 nt, Human
gaguaacauuugcugu

SEQ ID NO: 3752703 - RNA, 17 nt, Human
gaguaacauuugcuguu

SEQ ID NO: 3752704 - RNA, 21 nt, Human
gaguaacuauuauuauaggua

SEQ ID NO: 3752705 - RNA, 13 nt, Human
gaguaagacauug

SEQ ID NO: 3752706 - RNA, 14 nt, Human
gaguaagcugcuuu

SEQ ID NO: 3752707 - RNA, 15 nt, Human
gaguaagcugcuuuu

SEQ ID NO: 3752708 - RNA, 17 nt, Human
gaguaauaguaaacaca

SEQ ID NO: 3752709 - RNA, 13 nt, Human
gaguaaucaaucu

SEQ ID NO: 3752710 - RNA, 15 nt, Human
gaguaaucugagaaa

SEQ ID NO: 3752711 - RNA, 17 nt, Human
gaguaaucuuguugguu

SEQ ID NO: 3752712 - RNA, 22 nt, Human
gaguaaugguguagaacacuaa

SEQ ID NO: 3752713 - RNA, 14 nt, Human
gaguaauuuauugu

SEQ ID NO: 3752714 - RNA, 17 nt, Human
gaguaauuuuggauuuu

SEQ ID NO: 3752715 - RNA, 16 nt, Human
gaguacaggugaagca

SEQ ID NO: 3752716 - RNA, 18 nt, Human
gaguacguugugcauuug

SEQ ID NO: 3752717 - RNA, 20 nt, Human
gaguacuacaguccucccau

SEQ ID NO: 3752718 - RNA, 20 nt, Human
gaguacuccacacugcacaa

SEQ ID NO: 3752719 - RNA, 21 nt, Human
gaguacuccacacugcacaau

SEQ ID NO: 3752720 - RNA, 15 nt, Human
gaguacugugggcaa

SEQ ID NO: 3752721 - RNA, 17 nt, Human
gaguacugugggcaauu

SEQ ID NO: 3752722 - RNA, 16 nt, Human
gaguagaaaaugugac

SEQ ID NO: 3752723 - RNA, 19 nt, Human
gaguagaaacugcagggaa

SEQ ID NO: 3752724 - RNA, 17 nt, Human
gaguagaaagacagagc

SEQ ID NO: 3752725 - RNA, 20 nt, Human
gaguagaaagacagagcugg

SEQ ID NO: 3752726 - RNA, 22 nt, Human
gaguagaaagacagagcuggga

SEQ ID NO: 3752727 - RNA, 15 nt, Human
gaguagacacauuua

SEQ ID NO: 3752728 - RNA, 18 nt, Human
gaguagacacauuuaagg

SEQ ID NO: 3752729 - RNA, 17 nt, Human
gaguagaccccuggcug

SEQ ID NO: 3752730 - RNA, 12 nt, Human
gaguagagaagu

SEQ ID NO: 3752731 - RNA, 18 nt, Human
gaguagauauuacuuuau

SEQ ID NO: 3752732 - RNA, 23 nt, Human
gaguagccccaacccaaaccugg

SEQ ID NO: 3752733 - RNA, 18 nt, Human
gaguagccgagagccugc

SEQ ID NO: 3752734 - RNA, 21 nt, Human
gaguagccgagagccugcucc

SEQ ID NO: 3752735 - RNA, 12 nt, Human
gaguagcuggau

SEQ ID NO: 3752736 - RNA, 12 nt, Human
gaguagcuggga

SEQ ID NO: 3752737 - RNA, 21 nt, Human
gaguagcugggacuacaggca

SEQ ID NO: 3752738 - RNA, 17 nt, Human
gaguaggaagacuuugg

SEQ ID NO: 3752739 - RNA, 19 nt, Human
gaguaggaagacuuuggaa

SEQ ID NO: 3752740 - RNA, 14 nt, Human
gaguaguguggaau

SEQ ID NO: 3752741 - RNA, 20 nt, Human
gaguaguugauguugcauuu

SEQ ID NO: 3752742 - RNA, 15 nt, Human
gaguauaagaaaugc

SEQ ID NO: 3752743 - RNA, 17 nt, Human
gaguauaagaaaugcau

SEQ ID NO: 3752744 - RNA, 22 nt, Human
gaguauguuaagcucuuuauga

SEQ ID NO: 3752745 - RNA, 22 nt, Human
gaguauuaaaauguaugcaugu

SEQ ID NO: 3752746 - RNA, 20 nt, Human
gaguauuuaggcagauugaa

SEQ ID NO: 3752747 - RNA, 16 nt, Human
gaguauuuuugacaga

SEQ ID NO: 3752748 - RNA, 18 nt, Human
gaguauuuuugacagaau

SEQ ID NO: 3752749 - RNA, 17 nt, Human
gagucaaaacacuugua

SEQ ID NO: 3752750 - RNA, 21 nt, Human
gagucaaggccugcucccugu

SEQ ID NO: 3752751 - RNA, 20 nt, Human
gagucaauccccucauucag

SEQ ID NO: 3752752 - RNA, 15 nt, Human
gagucaaugugcagu

SEQ ID NO: 3752753 - RNA, 22 nt, Human
gagucacaaagaacauguagaa

SEQ ID NO: 3752754 - RNA, 13 nt, Human
gagucaccaagcc

SEQ ID NO: 3752755 - RNA, 16 nt, Human
gagucaccaagcccag

SEQ ID NO: 3752756 - RNA, 17 nt, Human
gagucaccaagcccagu

SEQ ID NO: 3752757 - RNA, 14 nt, Human
gagucaccaggaau

SEQ ID NO: 3752758 - RNA, 14 nt, Human
cucugagaggcccu

SEQ ID NO: 3752759 - RNA, 16 nt, Human
cucugagaggcccugg

SEQ ID NO: 3752760 - RNA, 18 nt, Human
cucugagagucuagauuc

SEQ ID NO: 3752761 - RNA, 19 nt, Human
cucugagagucuagauucu

SEQ ID NO: 3752762 - RNA, 16 nt, Human
cucugagcaaaugugg

SEQ ID NO: 3752763 - RNA, 13 nt, Human
cucugagcaguga

SEQ ID NO: 3752764 - RNA, 18 nt, Human
cucugagccaguucagua

SEQ ID NO: 3752765 - RNA, 13 nt, Human
cucugagccccug

SEQ ID NO: 3752766 - RNA, 22 nt, Human
cucugagccccugggacugcug

SEQ ID NO: 3752767 - RNA, 16 nt, Human
cucugagcgggaggca

SEQ ID NO: 3752768 - RNA, 17 nt, Human
cucugagcgggaggcag

SEQ ID NO: 3752769 - RNA, 19 nt, Human
cucugagcugucaacgaga

SEQ ID NO: 3752770 - RNA, 12 nt, Human
cucugaggacac

SEQ ID NO: 3752771 - RNA, 19 nt, Human
cucugaggaugauguacuu

SEQ ID NO: 3752772 - RNA, 10 nt, Human
cucugaggcg

SEQ ID NO: 3752773 - RNA, 19 nt, Human
cucugaggcgccccaaccc

SEQ ID NO: 3752774 - RNA, 21 nt, Human
cucugaggcuggauccuagcc

SEQ ID NO: 3752775 - RNA, 21 nt, Human
cucugaggcuuccagagaguc

SEQ ID NO: 3752776 - RNA, 18 nt, Human
cucugagggcuuccuuug

SEQ ID NO: 3752777 - RNA, 19 nt, Human
cucugaggugccuguccca

SEQ ID NO: 3752778 - RNA, 16 nt, Human
cucugaguaucuccuc

SEQ ID NO: 3752779 - RNA, 22 nt, Human
cucugaguguuuuaugagaaag

SEQ ID NO: 3752780 - RNA, 22 nt, Human
cucugaguuuaccauuuguaau

SEQ ID NO: 3752781 - RNA, 23 nt, Human
cucugauaaaagggcaaaucugc

SEQ ID NO: 3752782 - RNA, 17 nt, Human
cucugauacccagagca

SEQ ID NO: 3752783 - RNA, 18 nt, Human
cucugauacuuuuuugaa

SEQ ID NO: 3752784 - RNA, 14 nt, Human
cucugauaugggac

SEQ ID NO: 3752785 - RNA, 20 nt, Human
cucugauauuccaugaaugu

SEQ ID NO: 3752786 - RNA, 22 nt, Human
cucugaucuccauggcuuccuc

SEQ ID NO: 3752787 - RNA, 20 nt, Human
cucugaugcaucagaaaggg

SEQ ID NO: 3752788 - RNA, 13 nt, Human
cucugauguauuu

SEQ ID NO: 3752789 - RNA, 16 nt, Human
cucugauguauuuugu

SEQ ID NO: 3752790 - RNA, 15 nt, Human
cucugauucugucaa

SEQ ID NO: 3752791 - RNA, 14 nt, Human
cucugauuugcaaa

SEQ ID NO: 3752792 - RNA, 19 nt, Human
cucugauuuucaaagcuuu

SEQ ID NO: 3752793 - RNA, 22 nt, Human
cucugauuuucaaagcuuuuuc

SEQ ID NO: 3752794 - RNA, 22 nt, Human
cucugcaagaauugaagcagga

SEQ ID NO: 3752795 - RNA, 18 nt, Human
cucugcaaugggcacugg

SEQ ID NO: 3752796 - RNA, 15 nt, Human
cucugcaauuccccu

SEQ ID NO: 3752797 - RNA, 16 nt, Human
cucugcaauuccccuc

SEQ ID NO: 3752798 - RNA, 18 nt, Human
cucugcaauuccccucug

SEQ ID NO: 3752799 - RNA, 20 nt, Human
cucugcaauuccccucugcu

SEQ ID NO: 3752800 - RNA, 10 nt, Human
cucugcacaa

SEQ ID NO: 3752801 - RNA, 13 nt, Human
cucugcacaagcu

SEQ ID NO: 3752802 - RNA, 14 nt, Human
cucugcacaagcug

SEQ ID NO: 3752803 - RNA, 15 nt, Human
cucugcacaagcugc

SEQ ID NO: 3752804 - RNA, 19 nt, Human
cucugcacaagcugcaccc

SEQ ID NO: 3752805 - RNA, 20 nt, Human
cucugcacacccuccagaga

SEQ ID NO: 3752806 - RNA, 14 nt, Human
cucugcacagaugg

SEQ ID NO: 3752807 - RNA, 13 nt, Human
cucugcacauguc

SEQ ID NO: 3752808 - RNA, 13 nt, Human
cucugcaccccuc

SEQ ID NO: 3752809 - RNA, 23 nt, Human
cucugcacuacuccucugcagug

SEQ ID NO: 3752810 - RNA, 16 nt, Human
cucugcacuacugaca

SEQ ID NO: 3752811 - RNA, 20 nt, Human
cucugcacucccaccugaca

SEQ ID NO: 3752812 - RNA, 21 nt, Human
cucugcacuccccugcugggu

SEQ ID NO: 3752813 - RNA, 18 nt, Human
cucugcagacugcuagug

SEQ ID NO: 3752814 - RNA, 19 nt, Human
cucugcagacuucccagcu

SEQ ID NO: 3752815 - RNA, 13 nt, Human
cucugcagcaaua

SEQ ID NO: 3752816 - RNA, 23 nt, Human
cucugcagcaauaaagcagcguu

SEQ ID NO: 3752817 - RNA, 13 nt, Human
cucugcagccagc

SEQ ID NO: 3752818 - RNA, 14 nt, Human
cucugcagccagcc

SEQ ID NO: 3752819 - RNA, 16 nt, Human
cucugcagccagccca

SEQ ID NO: 3752820 - RNA, 16 nt, Human
cucugcagcccaggga

SEQ ID NO: 3752821 - RNA, 13 nt, Human
cucugcagccuca

SEQ ID NO: 3752822 - RNA, 15 nt, Human
cucugcagcugaccu

SEQ ID NO: 3752823 - RNA, 12 nt, Human
cucugcagcugc

SEQ ID NO: 3752824 - RNA, 13 nt, Human
cucugcagggccg

SEQ ID NO: 3752825 - RNA, 13 nt, Human
cucugcagguccc

SEQ ID NO: 3752826 - RNA, 16 nt, Human
cucugcaggucccuaa

SEQ ID NO: 3752827 - RNA, 21 nt, Human
cucugcaggucccuaauaaag

SEQ ID NO: 3752828 - RNA, 14 nt, Human
cucugcagugccuu

SEQ ID NO: 3752829 - RNA, 14 nt, Human
cucugcauccagag

SEQ ID NO: 3752830 - RNA, 13 nt, Human
cucugcaucccag

SEQ ID NO: 3752831 - RNA, 19 nt, Human
cucugcaucccagcaccug

SEQ ID NO: 3752832 - RNA, 22 nt, Human
cucugcaucccagcaccugccu

SEQ ID NO: 3752833 - RNA, 20 nt, Human
cucugcaucuacucccaagu

SEQ ID NO: 3752834 - RNA, 14 nt, Human
cucugcaucugacc

SEQ ID NO: 3752835 - RNA, 16 nt, Human
cucugcaugcggccca

SEQ ID NO: 3752836 - RNA, 15 nt, Human
cucugcauucuagua

SEQ ID NO: 3752837 - RNA, 19 nt, Human
cucugcauuugucuauucu

SEQ ID NO: 3752838 - RNA, 19 nt, Human
cucugcauuuuucugcaga

SEQ ID NO: 3752839 - RNA, 19 nt, Human
cucugccaacuucuucaga

SEQ ID NO: 3752840 - RNA, 14 nt, Human
cucugccacacucu

SEQ ID NO: 3752841 - RNA, 18 nt, Human
cucugccacccuaccugu

SEQ ID NO: 3752842 - RNA, 19 nt, Human
cucugccacugacugcagg

SEQ ID NO: 3752843 - RNA, 17 nt, Human
cucugccagaagauccc

SEQ ID NO: 3752844 - RNA, 18 nt, Human
cucugccagggcagugcu

SEQ ID NO: 3752845 - RNA, 19 nt, Human
cucugccagggcagugcua

SEQ ID NO: 3752846 - RNA, 17 nt, Human
cucugccaguccugucc

SEQ ID NO: 3752847 - RNA, 20 nt, Human
cucugcccagagcuggguga

SEQ ID NO: 3752848 - RNA, 13 nt, Human
cucugcccagcuu

SEQ ID NO: 3752849 - RNA, 22 nt, Human
cucugcccagcuuuucauugcu

SEQ ID NO: 3752850 - RNA, 14 nt, Human
cucugcccauuccc

SEQ ID NO: 3752851 - RNA, 18 nt, Human
cucugcccauuccccagc

SEQ ID NO: 3752852 - RNA, 15 nt, Human
cucugccccagaggc

SEQ ID NO: 3752853 - RNA, 18 nt, Human
cucugccccagaggccuc

SEQ ID NO: 3752854 - RNA, 12 nt, Human
cucugccccagc

SEQ ID NO: 3752855 - RNA, 17 nt, Human
cucugcccccugcuggc

SEQ ID NO: 3752856 - RNA, 23 nt, Human
cucugccccucccccagccaugc

SEQ ID NO: 3752857 - RNA, 20 nt, Human
cucugcccgggagcucagga

SEQ ID NO: 3752858 - RNA, 21 nt, Human
cucugcccuaaugcgcaggcu

SEQ ID NO: 3752859 - RNA, 23 nt, Human
cucugcccucauuacugggccuu

SEQ ID NO: 3752860 - RNA, 23 nt, Human
cucugcccuccaagaccuucucc

SEQ ID NO: 3752861 - RNA, 16 nt, Human
cucugcccugcccuag

SEQ ID NO: 3752862 - RNA, 23 nt, Human
cucugcccugcccuagcuccaca

SEQ ID NO: 3752863 - RNA, 12 nt, Human
cucugcccugcg

SEQ ID NO: 3752864 - RNA, 13 nt, Human
cucugcccugugu

SEQ ID NO: 3752865 - RNA, 21 nt, Human
cucugcccuugaucagcccca

SEQ ID NO: 3752866 - RNA, 19 nt, Human
cucugcccuuguucccuag

SEQ ID NO: 3752867 - RNA, 20 nt, Human
cucugccgcuaccucccucc

SEQ ID NO: 3752868 - RNA, 13 nt, Human
cucugccggcucu

SEQ ID NO: 3752869 - RNA, 15 nt, Human
cucugccggcucuuu

SEQ ID NO: 3752870 - RNA, 22 nt, Human
cucugccggcucuuuccuugcu

SEQ ID NO: 3752871 - RNA, 15 nt, Human
cucugccgucucugg

SEQ ID NO: 3752872 - RNA, 16 nt, Human
cucugccgucucugga

SEQ ID NO: 3752873 - RNA, 15 nt, Human
cucugccuacagaac

SEQ ID NO: 3752874 - RNA, 16 nt, Human
cucugccucccaucac

SEQ ID NO: 3752875 - RNA, 20 nt, Human
cucugccucccucacccuga

SEQ ID NO: 3752876 - RNA, 20 nt, Human
cucugccucugacacacagc

SEQ ID NO: 3752877 - RNA, 18 nt, Human
cucugccugaaccuucca

SEQ ID NO: 3752878 - RNA, 21 nt, Human
cucugccugaagucacacagu

SEQ ID NO: 3752879 - RNA, 14 nt, Human
cucugccugcauuc

SEQ ID NO: 3752880 - RNA, 12 nt, Human
cucugccugccc

SEQ ID NO: 3752881 - RNA, 20 nt, Human
cucugccugccccgccccca

SEQ ID NO: 3752882 - RNA, 13 nt, Human
cucugccuguccc

SEQ ID NO: 3752883 - RNA, 16 nt, Human
cucugccugugagcca

SEQ ID NO: 3752884 - RNA, 17 nt, Human
cucugccugugagccag

SEQ ID NO: 3752885 - RNA, 14 nt, Human
cucugccuugccuu

SEQ ID NO: 3752886 - RNA, 15 nt, Human
cucugccuuugacau

SEQ ID NO: 3752887 - RNA, 19 nt, Human
cucugccuuugacauuuaa

SEQ ID NO: 3752888 - RNA, 23 nt, Human
cucugccuuugacauuuaauuua

SEQ ID NO: 3752889 - RNA, 22 nt, Human
cucugccuuugcaccacgggac

SEQ ID NO: 3752890 - RNA, 13 nt, Human
cucugccuuugcu

SEQ ID NO: 3752891 - RNA, 17 nt, Human
cucugcggaccccagcu

SEQ ID NO: 3752892 - RNA, 19 nt, Human
cucugcggaccccagcugu

SEQ ID NO: 3752893 - RNA, 21 nt, Human
cucugcggagcacacuggcuc

SEQ ID NO: 3752894 - RNA, 21 nt, Human
cucugcgucgguccuggugcc

SEQ ID NO: 3752895 - RNA, 22 nt, Human
cucugcgugucaccugugcuuc

SEQ ID NO: 3752896 - RNA, 17 nt, Human
cucugcuaccuugcccc

SEQ ID NO: 3752897 - RNA, 19 nt, Human
cucugcuacguuccuauug

SEQ ID NO: 3752898 - RNA, 13 nt, Human
cucugcucagcca

SEQ ID NO: 3752899 - RNA, 14 nt, Human
cucugcuccaccac

SEQ ID NO: 3752900 - RNA, 13 nt, Human
cucugcuccccag

SEQ ID NO: 3752901 - RNA, 12 nt, Human
cucugcuccccc

SEQ ID NO: 3752902 - RNA, 17 nt, Human
cucugcuccuggagccu

SEQ ID NO: 3752903 - RNA, 22 nt, Human
cucugcuccuggagccuuugaa

SEQ ID NO: 3752904 - RNA, 20 nt, Human
cucugcucgcccuccuuucu

SEQ ID NO: 3752905 - RNA, 11 nt, Human
cucugcucuga

SEQ ID NO: 3752906 - RNA, 14 nt, Human
cucugcucugaugc

SEQ ID NO: 3752907 - RNA, 13 nt, Human
cucugcucuugca

SEQ ID NO: 3752908 - RNA, 14 nt, Human
gagguccagcccau

SEQ ID NO: 3752909 - RNA, 23 nt, Human
gagguccagcccuggcugaagga

SEQ ID NO: 3752910 - RNA, 20 nt, Human
gaggucccaagguucugggu

SEQ ID NO: 3752911 - RNA, 14 nt, Human
gagguccucuggag

SEQ ID NO: 3752912 - RNA, 12 nt, Human
gagguccugagc

SEQ ID NO: 3752913 - RNA, 13 nt, Human
gagguccugagca

SEQ ID NO: 3752914 - RNA, 14 nt, Human
gagguccugagcac

SEQ ID NO: 3752915 - RNA, 19 nt, Human
gagguccugagcacugcca

SEQ ID NO: 3752916 - RNA, 20 nt, Human
gagguccugagcacugccag

SEQ ID NO: 3752917 - RNA, 21 nt, Human
gagguccugagcacugccagg

SEQ ID NO: 3752918 - RNA, 23 nt, Human
gagguccugagcacugccaggag

SEQ ID NO: 3752919 - RNA, 18 nt, Human
gagguccugggggccuga

SEQ ID NO: 3752920 - RNA, 21 nt, Human
gagguccugugaucuuauuuu

SEQ ID NO: 3752921 - RNA, 23 nt, Human
gaggucucgcugaugcugggcug

SEQ ID NO: 3752922 - RNA, 16 nt, Human
gaggucucugccggcu

SEQ ID NO: 3752923 - RNA, 17 nt, Human
gaggucucuugagggag

SEQ ID NO: 3752924 - RNA, 14 nt, Human
gaggucugaaaugg

SEQ ID NO: 3752925 - RNA, 19 nt, Human
gaggucugcucggccgucu

SEQ ID NO: 3752926 - RNA, 15 nt, Human
gaggucugugcugag

SEQ ID NO: 3752927 - RNA, 16 nt, Human
gaggucuguuccuuuu

SEQ ID NO: 3752928 - RNA, 13 nt, Human
gaggucuguucuu

SEQ ID NO: 3752929 - RNA, 17 nt, Human
gaggugaaaaggccaag

SEQ ID NO: 3752930 - RNA, 16 nt, Human
gaggugaccccagggc

SEQ ID NO: 3752931 - RNA, 17 nt, Human
gaggugaccccagggca

SEQ ID NO: 3752932 - RNA, 14 nt, Human
gaggugauagcauu

SEQ ID NO: 3752933 - RNA, 14 nt, Human
gaggugcacuggga

SEQ ID NO: 3752934 - RNA, 14 nt, Human
gaggugccacugga

SEQ ID NO: 3752935 - RNA, 17 nt, Human
gaggugccagcaaagcc

SEQ ID NO: 3752936 - RNA, 13 nt, Human
gaggugccugucc

SEQ ID NO: 3752937 - RNA, 12 nt, Human
gaggugccuucu

SEQ ID NO: 3752938 - RNA, 20 nt, Human
gaggugccuucuucagggcc

SEQ ID NO: 3752939 - RNA, 22 nt, Human
gaggugccuucuucagggccug

SEQ ID NO: 3752940 - RNA, 20 nt, Human
gaggugcugcauugccugcg

SEQ ID NO: 3752941 - RNA, 16 nt, Human
gaggugcugggaggga

SEQ ID NO: 3752942 - RNA, 15 nt, Human
gagguggaagaaggg

SEQ ID NO: 3752943 - RNA, 15 nt, Human
gagguggaagcccuc

SEQ ID NO: 3752944 - RNA, 16 nt, Human
gagguggagggaggga

SEQ ID NO: 3752945 - RNA, 18 nt, Human
gagguggagggagggaag

SEQ ID NO: 3752946 - RNA, 19 nt, Human
gagguggagguugcauuga

SEQ ID NO: 3752947 - RNA, 18 nt, Human
gagguggcagcccuguag

SEQ ID NO: 3752948 - RNA, 19 nt, Human
gagguggccagagcuggga

SEQ ID NO: 3752949 - RNA, 21 nt, Human
gagguggccagagcugggagg

SEQ ID NO: 3752950 - RNA, 23 nt, Human
gagguggccagagcugggaggca

SEQ ID NO: 3752951 - RNA, 13 nt, Human
gagguggccuccu

SEQ ID NO: 3752952 - RNA, 20 nt, Human
gagguggcugagccccuguc

SEQ ID NO: 3752953 - RNA, 20 nt, Human
gagguggcuuuugcggccag

SEQ ID NO: 3752954 - RNA, 23 nt, Human
gaggugggagcaggagauugaga

SEQ ID NO: 3752955 - RNA, 14 nt, Human
gaggugggagggcc

SEQ ID NO: 3752956 - RNA, 12 nt, Human
gaggugggaucc

SEQ ID NO: 3752957 - RNA, 21 nt, Human
gaggugggauccuccaggugc

SEQ ID NO: 3752958 - RNA, 21 nt, Human
gaggugggcaggugguggcac

SEQ ID NO: 3752959 - RNA, 14 nt, Human
gaggugggcccagg

SEQ ID NO: 3752960 - RNA, 19 nt, Human
gagguggggcgaggcaggc

SEQ ID NO: 3752961 - RNA, 15 nt, Human
gaggugggguuggga

SEQ ID NO: 3752962 - RNA, 16 nt, Human
gagguggucugaaugu

SEQ ID NO: 3752963 - RNA, 12 nt, Human
gaggugguuuua

SEQ ID NO: 3752964 - RNA, 20 nt, Human
gagguguauggagagaaaac

SEQ ID NO: 3752965 - RNA, 15 nt, Human
gagguguccaacugg

SEQ ID NO: 3752966 - RNA, 13 nt, Human
gaggugucucagg

SEQ ID NO: 3752967 - RNA, 15 nt, Human
gaggugucucaggcu

SEQ ID NO: 3752968 - RNA, 16 nt, Human
gaggugucucaggcug

SEQ ID NO: 3752969 - RNA, 14 nt, Human
gagguguuuaaaga

SEQ ID NO: 3752970 - RNA, 21 nt, Human
gagguguuuaaagagagguua

SEQ ID NO: 3752971 - RNA, 19 nt, Human
gagguuaaggcugaggaaa

SEQ ID NO: 3752972 - RNA, 22 nt, Human
gagguuauaggucacuccuggg

SEQ ID NO: 3752973 - RNA, 19 nt, Human
gagguucaaagauauuuug

SEQ ID NO: 3752974 - RNA, 14 nt, Human
gagguucuaaggcc

SEQ ID NO: 3752975 - RNA, 18 nt, Human
gagguugauaacuuugcu

SEQ ID NO: 3752976 - RNA, 19 nt, Human
gagguugauaacuuugcuu

SEQ ID NO: 3752977 - RNA, 13 nt, Human
gagguugcaggga

SEQ ID NO: 3752978 - RNA, 19 nt, Human
gagguugcagggagccgag

SEQ ID NO: 3752979 - RNA, 15 nt, Human
gagguugcagugagc

SEQ ID NO: 3752980 - RNA, 19 nt, Human
gagguugcagugagccaag

SEQ ID NO: 3752981 - RNA, 12 nt, Human
gagguugggagg

SEQ ID NO: 3752982 - RNA, 13 nt, Human
gagguuguaguga

SEQ ID NO: 3752983 - RNA, 16 nt, Human
gagguugugcacuguu

SEQ ID NO: 3752984 - RNA, 16 nt, Human
gagguuucaaaccucc

SEQ ID NO: 3752985 - RNA, 23 nt, Human
gagguuugucgggcaccagccag

SEQ ID NO: 3752986 - RNA, 16 nt, Human
gaguaaaaagaaaaca

SEQ ID NO: 3752987 - RNA, 18 nt, Human
gaguaaagaauuauuuug

SEQ ID NO: 3752988 - RNA, 16 nt, Human
gaguaaaucagauguu

SEQ ID NO: 3752989 - RNA, 15 nt, Human
gaguaacauuugcug

SEQ ID NO: 3752990 - RNA, 20 nt, Human
gaguaaucugaucguucuuu

SEQ ID NO: 3752991 - RNA, 13 nt, Human
gaguaaucugugu

SEQ ID NO: 3752992 - RNA, 22 nt, Human
gaguaaucuguguacaaagaaa

SEQ ID NO: 3752993 - RNA, 22 nt, Human
gaguaauggguuucauauuucu

SEQ ID NO: 3752994 - RNA, 14 nt, Human
gaguacaaaugccu

SEQ ID NO: 3752995 - RNA, 18 nt, Human
gaguacauugaaggccug

SEQ ID NO: 3752996 - RNA, 14 nt, Human
gaguacugugggca

SEQ ID NO: 3752997 - RNA, 18 nt, Human
gaguacugugggcaauuu

SEQ ID NO: 3752998 - RNA, 23 nt, Human
gaguacugugggcaauuuagaaa

SEQ ID NO: 3752999 - RNA, 23 nt, Human
gaguagaaaaugugacccuccaa

SEQ ID NO: 3753000 - RNA, 17 nt, Human
gaguagaaauaaaagug

SEQ ID NO: 3753001 - RNA, 15 nt, Human
gaguagaauguaguu

SEQ ID NO: 3753002 - RNA, 17 nt, Human
gaguagaauugcauuga

SEQ ID NO: 3753003 - RNA, 18 nt, Human
gaguagaccccuggcugg

SEQ ID NO: 3753004 - RNA, 18 nt, Human
gaguagauggugaaauuu

SEQ ID NO: 3753005 - RNA, 17 nt, Human
gaguagccgagagccug

SEQ ID NO: 3753006 - RNA, 15 nt, Human
gaguagcgguccaag

SEQ ID NO: 3753007 - RNA, 20 nt, Human
gaguagcgguccaagccugc

SEQ ID NO: 3753008 - RNA, 14 nt, Human
gaguagcugagcuc

SEQ ID NO: 3753009 - RNA, 15 nt, Human
gaguagcugagcuca

SEQ ID NO: 3753010 - RNA, 13 nt, Human
gaguaggaagacu

SEQ ID NO: 3753011 - RNA, 18 nt, Human
gaguaggaagacuuugga

SEQ ID NO: 3753012 - RNA, 23 nt, Human
gaguaguuauauaauuguugaac

SEQ ID NO: 3753013 - RNA, 11 nt, Human
gaguauauguc

SEQ ID NO: 3753014 - RNA, 15 nt, Human
gaguauauuauaaua

SEQ ID NO: 3753015 - RNA, 22 nt, Human
gaguaucagaauugaaacacuu

SEQ ID NO: 3753016 - RNA, 21 nt, Human
gaguauuguuuaaaauguaau

SEQ ID NO: 3753017 - RNA, 14 nt, Human
gaguauuuuugaca

SEQ ID NO: 3753018 - RNA, 13 nt, Human
gaguauuuuugua

SEQ ID NO: 3753019 - RNA, 14 nt, Human
gagucaaaaagaac

SEQ ID NO: 3753020 - RNA, 14 nt, Human
gagucaaaacacuu

SEQ ID NO: 3753021 - RNA, 19 nt, Human
gagucaaaacuacaaauca

SEQ ID NO: 3753022 - RNA, 19 nt, Human
gagucaaaugguaggcauu

SEQ ID NO: 3753023 - RNA, 14 nt, Human
gagucaaguuguuc

SEQ ID NO: 3753024 - RNA, 19 nt, Human
gagucaauccccucauuca

SEQ ID NO: 3753025 - RNA, 18 nt, Human
gagucaauuggaaagacu

SEQ ID NO: 3753026 - RNA, 15 nt, Human
gagucaccuuccagg

SEQ ID NO: 3753027 - RNA, 18 nt, Human
gagucaccuuccaggacc

SEQ ID NO: 3753028 - RNA, 21 nt, Human
gagucaccuuccaggaccccu

SEQ ID NO: 3753029 - RNA, 21 nt, Human
gagucacugccucucccuggc

SEQ ID NO: 3753030 - RNA, 21 nt, Human
gagucacuggaacacuaauga

SEQ ID NO: 3753031 - RNA, 22 nt, Human
gagucagaaguuucugccgcag

SEQ ID NO: 3753032 - RNA, 16 nt, Human
gagucagccaggagcu

SEQ ID NO: 3753033 - RNA, 18 nt, Human
gagucagcucucugcccu

SEQ ID NO: 3753034 - RNA, 23 nt, Human
gagucaggacuugaacccagguc

SEQ ID NO: 3753035 - RNA, 17 nt, Human
gagucagggaccccugc

SEQ ID NO: 3753036 - RNA, 17 nt, Human
gagucagggcccagagg

SEQ ID NO: 3753037 - RNA, 18 nt, Human
gagucagugccagguccu

SEQ ID NO: 3753038 - RNA, 22 nt, Human
gagucaucuguuagggccuugg

SEQ ID NO: 3753039 - RNA, 19 nt, Human
gagucaugaucucccugcc

SEQ ID NO: 3753040 - RNA, 12 nt, Human
gagucaugccaa

SEQ ID NO: 3753041 - RNA, 14 nt, Human
gagucauuucugau

SEQ ID NO: 3753042 - RNA, 15 nt, Human
gagucauuucugauu

SEQ ID NO: 3753043 - RNA, 21 nt, Human
gagucauuuuguguugaagag

SEQ ID NO: 3753044 - RNA, 14 nt, Human
gagucauuuuuaca

SEQ ID NO: 3753045 - RNA, 22 nt, Human
gaguccaacguggggcagcaca

SEQ ID NO: 3753046 - RNA, 19 nt, Human
gaguccaagguuuaaagag

SEQ ID NO: 3753047 - RNA, 22 nt, Human
gaguccacuuuguuucgugggg

SEQ ID NO: 3753048 - RNA, 16 nt, Human
gaguccaggcacagga

SEQ ID NO: 3753049 - RNA, 13 nt, Human
gaguccagucucu

SEQ ID NO: 3753050 - RNA, 15 nt, Human
gagucccaaggaaag

SEQ ID NO: 3753051 - RNA, 18 nt, Human
gagucccaaggaaagccc

SEQ ID NO: 3753052 - RNA, 12 nt, Human
gagucccaccuu

SEQ ID NO: 3753053 - RNA, 14 nt, Human
gagucccacugccu

SEQ ID NO: 3753054 - RNA, 20 nt, Human
gagucccacugccucagguu

SEQ ID NO: 3753055 - RNA, 19 nt, Human
gagucccagagcaggaggc

SEQ ID NO: 3753056 - RNA, 20 nt, Human
gagucccaggagcugcccag

SEQ ID NO: 3753057 - RNA, 22 nt, Human
gagucccagguuggcucugcca

SEQ ID NO: 3753058 - RNA, 20 nt, Human
gagucacccaugaagacagg

SEQ ID NO: 3753059 - RNA, 23 nt, Human
gagucaccuuccaggaccccugg

SEQ ID NO: 3753060 - RNA, 14 nt, Human
gagucaccuucccu

SEQ ID NO: 3753061 - RNA, 14 nt, Human
gagucacuggaaca

SEQ ID NO: 3753062 - RNA, 18 nt, Human
gagucagaaguuucugcc

SEQ ID NO: 3753063 - RNA, 22 nt, Human
gagucagacauuuuaagauggu

SEQ ID NO: 3753064 - RNA, 20 nt, Human
gagucagccucgcaggccuc

SEQ ID NO: 3753065 - RNA, 14 nt, Human
gagucagcucucug

SEQ ID NO: 3753066 - RNA, 16 nt, Human
gagucagcuguuucua

SEQ ID NO: 3753067 - RNA, 18 nt, Human
gagucagggaccccugcc

SEQ ID NO: 3753068 - RNA, 22 nt, Human
gagucagggcccagaggcugag

SEQ ID NO: 3753069 - RNA, 24 nt, Human
gagucagucgccuuucagcaggca

SEQ ID NO: 3753070 - RNA, 18 nt, Human
gagucauucguucugugg

SEQ ID NO: 3753071 - RNA, 14 nt, Human
gagucauuuaaaug

SEQ ID NO: 3753072 - RNA, 15 nt, Human
gagucauuuaaaugu

SEQ ID NO: 3753073 - RNA, 16 nt, Human
gagucauuuaaaugug

SEQ ID NO: 3753074 - RNA, 20 nt, Human
gagucauuuaaauguguaca

SEQ ID NO: 3753075 - RNA, 15 nt, Human
gaguccaagaaucca

SEQ ID NO: 3753076 - RNA, 14 nt, Human
gaguccaagcuggg

SEQ ID NO: 3753077 - RNA, 12 nt, Human
gaguccagggaa

SEQ ID NO: 3753078 - RNA, 13 nt, Human
gaguccaucagcc

SEQ ID NO: 3753079 - RNA, 15 nt, Human
gaguccaucagccuc

SEQ ID NO: 3753080 - RNA, 17 nt, Human
gaguccauucucccagg

SEQ ID NO: 3753081 - RNA, 14 nt, Human
gagucccaaggaaa

SEQ ID NO: 3753082 - RNA, 16 nt, Human
gagucccaaggaaagc

SEQ ID NO: 3753083 - RNA, 13 nt, Human
gagucccaccuug

SEQ ID NO: 3753084 - RNA, 20 nt, Human
gagucccaccuuggcugcag

SEQ ID NO: 3753085 - RNA, 22 nt, Human
gagucccacugccucagguucc

SEQ ID NO: 3753086 - RNA, 23 nt, Human
gagucccacugccucagguuccu

SEQ ID NO: 3753087 - RNA, 18 nt, Human
gagucccagugggaggcg

SEQ ID NO: 3753088 - RNA, 22 nt, Human
gaguccccccucccaccuccag

SEQ ID NO: 3753089 - RNA, 17 nt, Human
gaguccccucaccuccu

SEQ ID NO: 3753090 - RNA, 14 nt, Human
gagucccgucagga

SEQ ID NO: 3753091 - RNA, 14 nt, Human
gagucccugccauc

SEQ ID NO: 3753092 - RNA, 19 nt, Human
gagucccugccuggaccag

SEQ ID NO: 3753093 - RNA, 22 nt, Human
gaguccgaccuggccugucugu

SEQ ID NO: 3753094 - RNA, 17 nt, Human
gaguccucacucccagu

SEQ ID NO: 3753095 - RNA, 19 nt, Human
gaguccuggaugauacuaa

SEQ ID NO: 3753096 - RNA, 18 nt, Human
gaguccuuaaacagggca

SEQ ID NO: 3753097 - RNA, 13 nt, Human
gagucgcugugcc

SEQ ID NO: 3753098 - RNA, 22 nt, Human
gagucguacagaaagcugccug

SEQ ID NO: 3753099 - RNA, 20 nt, Human
gagucguggggugugcuggg

SEQ ID NO: 3753100 - RNA, 21 nt, Human
gagucguggggugugcuggga

SEQ ID NO: 3753101 - RNA, 12 nt, Human
gagucuaaagau

SEQ ID NO: 3753102 - RNA, 22 nt, Human
gagucuaaagauggaguuucua

SEQ ID NO: 3753103 - RNA, 20 nt, Human
gagucuagaaguuguuuguc

SEQ ID NO: 3753104 - RNA, 11 nt, Human
gagucuagaug

SEQ ID NO: 3753105 - RNA, 17 nt, Human
gagucuagauucaaagg

SEQ ID NO: 3753106 - RNA, 21 nt, Human
gagucuagauucaaagguucu

SEQ ID NO: 3753107 - RNA, 22 nt, Human
gagucuagauucaaagguucua

SEQ ID NO: 3753108 - RNA, 15 nt, Human
gagucuaucaaucaa

SEQ ID NO: 3753109 - RNA, 20 nt, Human
gagucucacuguugcccagg

SEQ ID NO: 3753110 - RNA, 14 nt, Human
gagucucucugggc

SEQ ID NO: 3753111 - RNA, 12 nt, Human
gagucugaaggc

SEQ ID NO: 3753112 - RNA, 21 nt, Human
gagucugaaggcuggguucug

SEQ ID NO: 3753113 - RNA, 13 nt, Human
gagucugaggucc

SEQ ID NO: 3753114 - RNA, 14 nt, Human
gagucugagguccu

SEQ ID NO: 3753115 - RNA, 18 nt, Human
gagucugagguccugagc

SEQ ID NO: 3753116 - RNA, 23 nt, Human
gagucugagguccugagcacugc

SEQ ID NO: 3753117 - RNA, 18 nt, Human
gagucugccacccaggau

SEQ ID NO: 3753118 - RNA, 17 nt, Human
gagucuggagugggcag

SEQ ID NO: 3753119 - RNA, 17 nt, Human
gagucuggcccuagacu

SEQ ID NO: 3753120 - RNA, 12 nt, Human
gagucugucuca

SEQ ID NO: 3753121 - RNA, 15 nt, Human
gagucugucucuguc

SEQ ID NO: 3753122 - RNA, 20 nt, Human
gagucuguugugugucaugc

SEQ ID NO: 3753123 - RNA, 17 nt, Human
gagucuguuuuguaaag

SEQ ID NO: 3753124 - RNA, 20 nt, Human
gagucuuacucugccgccca

SEQ ID NO: 3753125 - RNA, 16 nt, Human
gagucuugcagugauu

SEQ ID NO: 3753126 - RNA, 19 nt, Human
gagucuugguuucucucua

SEQ ID NO: 3753127 - RNA, 15 nt, Human
gagucuuugguucua

SEQ ID NO: 3753128 - RNA, 17 nt, Human
gagucuuugguucuaag

SEQ ID NO: 3753129 - RNA, 23 nt, Human
gagucuuuguaaguaaacugccc

SEQ ID NO: 3753130 - RNA, 20 nt, Human
gagugaaaccuuuagggcag

SEQ ID NO: 3753131 - RNA, 22 nt, Human
gagugaaaccuuuagggcagcu

SEQ ID NO: 3753132 - RNA, 23 nt, Human
gagugaaaccuuuagggcagcuu

SEQ ID NO: 3753133 - RNA, 12 nt, Human
gagugaaauacu

SEQ ID NO: 3753134 - RNA, 19 nt, Human
gagugaacaaauuuacaga

SEQ ID NO: 3753135 - RNA, 23 nt, Human
gagugaacaaauuuacagagaca

SEQ ID NO: 3753136 - RNA, 15 nt, Human
gagugaaccaucauu

SEQ ID NO: 3753137 - RNA, 16 nt, Human
gagugaaccuaccuuc

SEQ ID NO: 3753138 - RNA, 14 nt, Human
gagugaagaggggc

SEQ ID NO: 3753139 - RNA, 15 nt, Human
gagugaagaggggca

SEQ ID NO: 3753140 - RNA, 16 nt, Human
gagugaagaggggcag

SEQ ID NO: 3753141 - RNA, 14 nt, Human
gagugaauaaaugu

SEQ ID NO: 3753142 - RNA, 15 nt, Human
gagugaauaaauguc

SEQ ID NO: 3753143 - RNA, 17 nt, Human
gagugaaugccagugug

SEQ ID NO: 3753144 - RNA, 17 nt, Human
gagugacagaggcagcc

SEQ ID NO: 3753145 - RNA, 20 nt, Human
gagugacagaggcagcccca

SEQ ID NO: 3753146 - RNA, 14 nt, Human
gagugacagaguaa

SEQ ID NO: 3753147 - RNA, 20 nt, Human
gagugacggucccacacugg

SEQ ID NO: 3753148 - RNA, 16 nt, Human
gagugacuacacacag

SEQ ID NO: 3753149 - RNA, 17 nt, Human
gagugacuccaagaaca

SEQ ID NO: 3753150 - RNA, 18 nt, Human
gagugacucgaggguugg

SEQ ID NO: 3753151 - RNA, 19 nt, Human
gagugagacaaaauuuuag

SEQ ID NO: 3753152 - RNA, 18 nt, Human
gagugagaggggaggcca

SEQ ID NO: 3753153 - RNA, 20 nt, Human
gagugaggauaugaguagcc

SEQ ID NO: 3753154 - RNA, 17 nt, Human
gagugauauggagcaag

SEQ ID NO: 3753155 - RNA, 23 nt, Human
gagugcaaaaggcuugcagaacu

SEQ ID NO: 3753156 - RNA, 21 nt, Human
gagugcaagccccugcuccag

SEQ ID NO: 3753157 - RNA, 19 nt, Human
gagugcaaugacacagucu

SEQ ID NO: 3753158 - RNA, 14 nt, Human
gagugcaccaaaga

SEQ ID NO: 3753159 - RNA, 17 nt, Human
gagugcaccaaagagaa

SEQ ID NO: 3753160 - RNA, 23 nt, Human
gagugcagccguuugagaagaaa

SEQ ID NO: 3753161 - RNA, 14 nt, Human
gagugcaggcccac

SEQ ID NO: 3753162 - RNA, 19 nt, Human
gagugcaggcccacccugc

SEQ ID NO: 3753163 - RNA, 17 nt, Human
gagugcaggccugcuca

SEQ ID NO: 3753164 - RNA, 11 nt, Human
gagugcaguga

SEQ ID NO: 3753165 - RNA, 13 nt, Human
gagugccaggacu

SEQ ID NO: 3753166 - RNA, 19 nt, Human
gagugccaggacuccccag

SEQ ID NO: 3753167 - RNA, 22 nt, Human
gagugccaggacuccccaggcc

SEQ ID NO: 3753168 - RNA, 14 nt, Human
gagugccccaccug

SEQ ID NO: 3753169 - RNA, 19 nt, Human
gagugccccaccugccacu

SEQ ID NO: 3753170 - RNA, 14 nt, Human
gagugccuggccaa

SEQ ID NO: 3753171 - RNA, 16 nt, Human
gagugccuucuguggg

SEQ ID NO: 3753172 - RNA, 19 nt, Human
gagugcugaaggaauggaa

SEQ ID NO: 3753173 - RNA, 22 nt, Human
gagugcuggcucacaguacagc

SEQ ID NO: 3753174 - RNA, 12 nt, Human
gagugcuguuuu

SEQ ID NO: 3753175 - RNA, 17 nt, Human
gaguggacuggagugga

SEQ ID NO: 3753176 - RNA, 19 nt, Human
gaguggacuguucccugag

SEQ ID NO: 3753177 - RNA, 18 nt, Human
gaguggaggaggccuggg

SEQ ID NO: 3753178 - RNA, 19 nt, Human
gaguggagguuaaggcuga

SEQ ID NO: 3753179 - RNA, 20 nt, Human
gaguggagucugccacccag

SEQ ID NO: 3753180 - RNA, 18 nt, Human
gaguggaguggaagaaga

SEQ ID NO: 3753181 - RNA, 16 nt, Human
gaguggauagaugccc

SEQ ID NO: 3753182 - RNA, 18 nt, Human
gaguggauagaugcccug

SEQ ID NO: 3753183 - RNA, 16 nt, Human
gaguggaucuccaagg

SEQ ID NO: 3753184 - RNA, 19 nt, Human
gaguggaucuccaaggacc

SEQ ID NO: 3753185 - RNA, 18 nt, Human
gaguggaugauguuucgu

SEQ ID NO: 3753186 - RNA, 16 nt, Human
gaguggcagcccagcc

SEQ ID NO: 3753187 - RNA, 21 nt, Human
gaguggcagcccagccagcgu

SEQ ID NO: 3753188 - RNA, 14 nt, Human
gaguggcaggggac

SEQ ID NO: 3753189 - RNA, 23 nt, Human
gaguggcauuggcagcaggugcu

SEQ ID NO: 3753190 - RNA, 13 nt, Human
gaguggccccacc

SEQ ID NO: 3753191 - RNA, 12 nt, Human
gaguggccuggc

SEQ ID NO: 3753192 - RNA, 13 nt, Human
gaguggccuggcc

SEQ ID NO: 3753193 - RNA, 19 nt, Human
gaguggccuggccaggagc

SEQ ID NO: 3753194 - RNA, 13 nt, Human
gaguggcuccucc

SEQ ID NO: 3753195 - RNA, 16 nt, Human
gaguggcucgccaggc

SEQ ID NO: 3753196 - RNA, 12 nt, Human
gagugggaagcc

SEQ ID NO: 3753197 - RNA, 13 nt, Human
gagugggaagccc

SEQ ID NO: 3753198 - RNA, 23 nt, Human
gagugggggaucacagccucuga

SEQ ID NO: 3753199 - RNA, 21 nt, Human
gagugggguuaucucuguguu

SEQ ID NO: 3753200 - RNA, 13 nt, Human
gagugggugaaua

SEQ ID NO: 3753201 - RNA, 15 nt, Human
gaguggguggggagu

SEQ ID NO: 3753202 - RNA, 16 nt, Human
gaguggucagaacaga

SEQ ID NO: 3753203 - RNA, 14 nt, Human
gaguggucuuucug

SEQ ID NO: 3753204 - RNA, 19 nt, Human
gagugguggcucaugccug

SEQ ID NO: 3753205 - RNA, 21 nt, Human
gagugguuuaggcuauuugua

SEQ ID NO: 3753206 - RNA, 13 nt, Human
gaguguagaagca

SEQ ID NO: 3753207 - RNA, 20 nt, Human
gaguguagaagcauuccuuc

SEQ ID NO: 3753208 - RNA, 12 nt, Human
cucugcugaaga

SEQ ID NO: 3753209 - RNA, 13 nt, Human
cucugcugaagac

SEQ ID NO: 3753210 - RNA, 14 nt, Human
cucugcugaagguu

SEQ ID NO: 3753211 - RNA, 13 nt, Human
cucugcugacaga

SEQ ID NO: 3753212 - RNA, 21 nt, Human
cucugcugccgccccacccag

SEQ ID NO: 3753213 - RNA, 13 nt, Human
cucugcugcuggc

SEQ ID NO: 3753214 - RNA, 14 nt, Human
cucugcugcuggcu

SEQ ID NO: 3753215 - RNA, 16 nt, Human
cucugcugcugucccu

SEQ ID NO: 3753216 - RNA, 13 nt, Human
cucugcugcuuag

SEQ ID NO: 3753217 - RNA, 15 nt, Human
cucugcuggccuggc

SEQ ID NO: 3753218 - RNA, 17 nt, Human
cucugcuggccuggccg

SEQ ID NO: 3753219 - RNA, 16 nt, Human
cucugcuggucuucaa

SEQ ID NO: 3753220 - RNA, 18 nt, Human
cucugcuggucuucaauu

SEQ ID NO: 3753221 - RNA, 23 nt, Human
cucugcuguacauauuugagacu

SEQ ID NO: 3753222 - RNA, 14 nt, Human
cucugcuucccagg

SEQ ID NO: 3753223 - RNA, 18 nt, Human
cucugcuugagucagguu

SEQ ID NO: 3753224 - RNA, 17 nt, Human
cucugcuugccaucccu

SEQ ID NO: 3753225 - RNA, 18 nt, Human
cucugcuugccgaaacug

SEQ ID NO: 3753226 - RNA, 21 nt, Human
cucugcuugccgaaacuggaa

SEQ ID NO: 3753227 - RNA, 22 nt, Human
cucugcuugccgaaacuggaag

SEQ ID NO: 3753228 - RNA, 14 nt, Human
cucugcuuuaaagu

SEQ ID NO: 3753229 - RNA, 13 nt, Human
cucugcuuucuga

SEQ ID NO: 3753230 - RNA, 24 nt, Human
cucugcuuugacugagcagacugg

SEQ ID NO: 3753231 - RNA, 21 nt, Human
cucuggaaugacaugugucaa

SEQ ID NO: 3753232 - RNA, 15 nt, Human
cucuggacagcccca

SEQ ID NO: 3753233 - RNA, 16 nt, Human
cucuggacaggcaugu

SEQ ID NO: 3753234 - RNA, 16 nt, Human
cucuggaccaacccug

SEQ ID NO: 3753235 - RNA, 13 nt, Human
cucuggaccagcc

SEQ ID NO: 3753236 - RNA, 14 nt, Human
cucuggaccugccc

SEQ ID NO: 3753237 - RNA, 21 nt, Human
cucuggaccugcccccgcauc

SEQ ID NO: 3753238 - RNA, 17 nt, Human
cucuggacggcaggcuc

SEQ ID NO: 3753239 - RNA, 21 nt, Human
cucuggacucuaaagaccaaa

SEQ ID NO: 3753240 - RNA, 12 nt, Human
cucuggacugug

SEQ ID NO: 3753241 - RNA, 16 nt, Human
cucuggagacagcccc

SEQ ID NO: 3753242 - RNA, 17 nt, Human
cucuggagacagcccca

SEQ ID NO: 3753243 - RNA, 13 nt, Human
cucuggagagaaa

SEQ ID NO: 3753244 - RNA, 15 nt, Human
cucuggagagaaaca

SEQ ID NO: 3753245 - RNA, 14 nt, Human
cucuggagccaccu

SEQ ID NO: 3753246 - RNA, 15 nt, Human
cucuggagccaccug

SEQ ID NO: 3753247 - RNA, 21 nt, Human
cucuggagccagccgagcagg

SEQ ID NO: 3753248 - RNA, 13 nt, Human
cucuggagcccua

SEQ ID NO: 3753249 - RNA, 16 nt, Human
cucuggaggccucugg

SEQ ID NO: 3753250 - RNA, 17 nt, Human
cucuggaggccucuggg

SEQ ID NO: 3753251 - RNA, 20 nt, Human
cucuggaggccucugggccu

SEQ ID NO: 3753252 - RNA, 14 nt, Human
cucuggaggggagg

SEQ ID NO: 3753253 - RNA, 20 nt, Human
cucuggagggguguggcucc

SEQ ID NO: 3753254 - RNA, 14 nt, Human
cucuggagguacga

SEQ ID NO: 3753255 - RNA, 16 nt, Human
cucuggaguggccacu

SEQ ID NO: 3753256 - RNA, 22 nt, Human
cucuggaucaaaguaggcagga

SEQ ID NO: 3753257 - RNA, 15 nt, Human
cucuggaugccugau

SEQ ID NO: 3753258 - RNA, 15 nt, Human
cucuggauggcacca

SEQ ID NO: 3753259 - RNA, 19 nt, Human
cucuggauggcaccagagg

SEQ ID NO: 3753260 - RNA, 19 nt, Human
cucuggauuauauuaugaa

SEQ ID NO: 3753261 - RNA, 22 nt, Human
cucuggauuggagauagggaaa

SEQ ID NO: 3753262 - RNA, 14 nt, Human
cucuggcagcaccg

SEQ ID NO: 3753263 - RNA, 17 nt, Human
cucuggcagccacacuu

SEQ ID NO: 3753264 - RNA, 12 nt, Human
cucuggcagcuc

SEQ ID NO: 3753265 - RNA, 15 nt, Human
cucuggcagcucaga

SEQ ID NO: 3753266 - RNA, 19 nt, Human
cucuggcagcucagagagg

SEQ ID NO: 3753267 - RNA, 20 nt, Human
cucuggcagcucagagaggg

SEQ ID NO: 3753268 - RNA, 19 nt, Human
cucuggcaguucuggaaug

SEQ ID NO: 3753269 - RNA, 23 nt, Human
cucuggcauuagaauuauuuaaa

SEQ ID NO: 3753270 - RNA, 14 nt, Human
cucuggccacaaca

SEQ ID NO: 3753271 - RNA, 10 nt, Human
cucuggccag

SEQ ID NO: 3753272 - RNA, 15 nt, Human
cucuggccaggaugg

SEQ ID NO: 3753273 - RNA, 19 nt, Human
cucuggccaggauggaggg

SEQ ID NO: 3753274 - RNA, 14 nt, Human
cucuggccccaagg

SEQ ID NO: 3753275 - RNA, 13 nt, Human
cucuggcccugcc

SEQ ID NO: 3753276 - RNA, 15 nt, Human
cucuggcccugccuu

SEQ ID NO: 3753277 - RNA, 18 nt, Human
cucuggcccugccuucuu

SEQ ID NO: 3753278 - RNA, 13 nt, Human
cucuggcccuggc

SEQ ID NO: 3753279 - RNA, 13 nt, Human
cucuggccuccca

SEQ ID NO: 3753280 - RNA, 18 nt, Human
cucuggccuucggccucc

SEQ ID NO: 3753281 - RNA, 16 nt, Human
cucuggcuagaggcca

SEQ ID NO: 3753282 - RNA, 22 nt, Human
cucuggcuagaggccagcccca

SEQ ID NO: 3753283 - RNA, 15 nt, Human
cucuggcuccagcug

SEQ ID NO: 3753284 - RNA, 16 nt, Human
cucuggcuccagcugg

SEQ ID NO: 3753285 - RNA, 17 nt, Human
cucuggcugaacccugu

SEQ ID NO: 3753286 - RNA, 21 nt, Human
cucuggcugaacccugugcug

SEQ ID NO: 3753287 - RNA, 19 nt, Human
cucuggcuguaaggcucua

SEQ ID NO: 3753288 - RNA, 12 nt, Human
cucuggcuucca

SEQ ID NO: 3753289 - RNA, 15 nt, Human
cucuggcuuuuggaa

SEQ ID NO: 3753290 - RNA, 22 nt, Human
cucugggaaaugagaaggcagc

SEQ ID NO: 3753291 - RNA, 15 nt, Human
cucugggaaccuccc

SEQ ID NO: 3753292 - RNA, 17 nt, Human
cucugggaaccucccag

SEQ ID NO: 3753293 - RNA, 23 nt, Human
cucugggaaccucccagaggucc

SEQ ID NO: 3753294 - RNA, 23 nt, Human
cucugggccaagucaaagacauu

SEQ ID NO: 3753295 - RNA, 17 nt, Human
cucugggccacuuggag

SEQ ID NO: 3753296 - RNA, 17 nt, Human
cucugggcuauggacac

SEQ ID NO: 3753297 - RNA, 20 nt, Human
cucugggcuauggacacagg

SEQ ID NO: 3753298 - RNA, 13 nt, Human
cucugggcucuga

SEQ ID NO: 3753299 - RNA, 21 nt, Human
cucugggcuggaugagcuccc

SEQ ID NO: 3753300 - RNA, 16 nt, Human
cucuggggcucuaggg

SEQ ID NO: 3753301 - RNA, 19 nt, Human
cucugggggguggccaggc

SEQ ID NO: 3753302 - RNA, 20 nt, Human
cucugggggguggccaggcc

SEQ ID NO: 3753303 - RNA, 20 nt, Human
cucuggggucccccaucccc

SEQ ID NO: 3753304 - RNA, 15 nt, Human
cucuggggugggcag

SEQ ID NO: 3753305 - RNA, 20 nt, Human
cucugggucagugguccaca

SEQ ID NO: 3753306 - RNA, 15 nt, Human
cucuggguccuuccu

SEQ ID NO: 3753307 - RNA, 18 nt, Human
cucuggguccuuccugaa

SEQ ID NO: 3753308 - RNA, 20 nt, Human
cucugguacaauuucuuuug

SEQ ID NO: 3753309 - RNA, 14 nt, Human
cucugguaucuaau

SEQ ID NO: 3753310 - RNA, 19 nt, Human
cucugguccauagagagca

SEQ ID NO: 3753311 - RNA, 17 nt, Human
cucuggucgcuccugcc

SEQ ID NO: 3753312 - RNA, 20 nt, Human
cucuggucgcuccugcccac

SEQ ID NO: 3753313 - RNA, 19 nt, Human
cucuggucuccucuuuguu

SEQ ID NO: 3753314 - RNA, 20 nt, Human
cucuggucuucuuuggguaa

SEQ ID NO: 3753315 - RNA, 16 nt, Human
cucuggucuuggaauu

SEQ ID NO: 3753316 - RNA, 16 nt, Human
cucuggugacaccagc

SEQ ID NO: 3753317 - RNA, 18 nt, Human
cucuggugacaccagccu

SEQ ID NO: 3753318 - RNA, 22 nt, Human
cucuggugagucuuggcggcag

SEQ ID NO: 3753319 - RNA, 13 nt, Human
cucuggugccucc

SEQ ID NO: 3753320 - RNA, 18 nt, Human
cucuggugccuccagagg

SEQ ID NO: 3753321 - RNA, 16 nt, Human
cucugguucuucauuu

SEQ ID NO: 3753322 - RNA, 13 nt, Human
cucugguucuuug

SEQ ID NO: 3753323 - RNA, 20 nt, Human
cucugguuguuucuguucca

SEQ ID NO: 3753324 - RNA, 22 nt, Human
cucugguuguuucuguuccaaa

SEQ ID NO: 3753325 - RNA, 14 nt, Human
cucugguuucucau

SEQ ID NO: 3753326 - RNA, 21 nt, Human
cucuguaaagcuaaaauaaag

SEQ ID NO: 3753327 - RNA, 18 nt, Human
cucuguaaucucguuuca

SEQ ID NO: 3753328 - RNA, 18 nt, Human
cucuguaauugaauauua

SEQ ID NO: 3753329 - RNA, 15 nt, Human
cucuguaauugcaaa

SEQ ID NO: 3753330 - RNA, 16 nt, Human
cucuguacauauuagc

SEQ ID NO: 3753331 - RNA, 20 nt, Human
cucuguacuuuucauucucu

SEQ ID NO: 3753332 - RNA, 15 nt, Human
cucugucaaugaaaa

SEQ ID NO: 3753333 - RNA, 16 nt, Human
cucugucacccuuguc

SEQ ID NO: 3753334 - RNA, 20 nt, Human
cucugucacuccucaugccu

SEQ ID NO: 3753335 - RNA, 13 nt, Human
cucugucagaugg

SEQ ID NO: 3753336 - RNA, 14 nt, Human
cucugucagucaca

SEQ ID NO: 3753337 - RNA, 20 nt, Human
cucugucagucacagccacc

SEQ ID NO: 3753338 - RNA, 12 nt, Human
cucuguccaggc

SEQ ID NO: 3753339 - RNA, 20 nt, Human
cucuguccagggcccugagc

SEQ ID NO: 3753340 - RNA, 21 nt, Human
cucuguccagggcccugagcu

SEQ ID NO: 3753341 - RNA, 18 nt, Human
cucugucccauucccugg

SEQ ID NO: 3753342 - RNA, 19 nt, Human
cucugucccauucccuggg

SEQ ID NO: 3753343 - RNA, 13 nt, Human
cucuguccccagc

SEQ ID NO: 3753344 - RNA, 16 nt, Human
cucugucccuugcugu

SEQ ID NO: 3753345 - RNA, 13 nt, Human
cucuguccugaag

SEQ ID NO: 3753346 - RNA, 17 nt, Human
cucuguccugaaggccu

SEQ ID NO: 3753347 - RNA, 19 nt, Human
cucuguccugaaggccuga

SEQ ID NO: 3753348 - RNA, 14 nt, Human
cucuguccugcuuc

SEQ ID NO: 3753349 - RNA, 13 nt, Human
cucuguccuggga

SEQ ID NO: 3753350 - RNA, 15 nt, Human
cucugucgcccaggc

SEQ ID NO: 3753351 - RNA, 18 nt, Human
cucugucgcccaggcugg

SEQ ID NO: 3753352 - RNA, 18 nt, Human
cucugucgcccaugcugg

SEQ ID NO: 3753353 - RNA, 15 nt, Human
cucugucuacaaaua

SEQ ID NO: 3753354 - RNA, 16 nt, Human
cucugucuaccaucuc

SEQ ID NO: 3753355 - RNA, 22 nt, Human
cucugucuaccaucucccucga

SEQ ID NO: 3753356 - RNA, 19 nt, Human
cucugucuacuugcucagg

SEQ ID NO: 3753357 - RNA, 15 nt, Human
cucugucucauccau

SEQ ID NO: 3753358 - RNA, 17 nt, Human
cucugucucauccuccu

SEQ ID NO: 3753359 - RNA, 15 nt, Human
gaguguagacugugg

SEQ ID NO: 3753360 - RNA, 11 nt, Human
gaguguaguga

SEQ ID NO: 3753361 - RNA, 18 nt, Human
gagugucaaccagacaga

SEQ ID NO: 3753362 - RNA, 20 nt, Human
gagugucaaccagacagagg

SEQ ID NO: 3753363 - RNA, 18 nt, Human
gagugucuggaauugugg

SEQ ID NO: 3753364 - RNA, 11 nt, Human
gagugugaagg

SEQ ID NO: 3753365 - RNA, 20 nt, Human
gagugugaauauaaaugugu

SEQ ID NO: 3753366 - RNA, 22 nt, Human
gagugugaauauaaaugugugu

SEQ ID NO: 3753367 - RNA, 16 nt, Human
gagugugacagggcca

SEQ ID NO: 3753368 - RNA, 18 nt, Human
gagugugagccaccuaag

SEQ ID NO: 3753369 - RNA, 15 nt, Human
gagugugcugcugua

SEQ ID NO: 3753370 - RNA, 15 nt, Human
gagugugcuggagga

SEQ ID NO: 3753371 - RNA, 16 nt, Human
gaguguggcuccccuc

SEQ ID NO: 3753372 - RNA, 16 nt, Human
gaguguggcugaggag

SEQ ID NO: 3753373 - RNA, 19 nt, Human
gagugugguuucuuuuuga

SEQ ID NO: 3753374 - RNA, 17 nt, Human
gaguguguaugccaaga

SEQ ID NO: 3753375 - RNA, 21 nt, Human
gaguguguccaagugugugug

SEQ ID NO: 3753376 - RNA, 19 nt, Human
gagugugugcaugugugug

SEQ ID NO: 3753377 - RNA, 15 nt, Human
gagugugugugugca

SEQ ID NO: 3753378 - RNA, 19 nt, Human
gaguguguguuugugcuga

SEQ ID NO: 3753379 - RNA, 14 nt, Human
gaguguuauguauu

SEQ ID NO: 3753380 - RNA, 13 nt, Human
gaguguucccuau

SEQ ID NO: 3753381 - RNA, 17 nt, Human
gaguguuugggggacgu

SEQ ID NO: 3753382 - RNA, 13 nt, Human
gaguuaagaagcu

SEQ ID NO: 3753383 - RNA, 12 nt, Human
gaguuaagaccu

SEQ ID NO: 3753384 - RNA, 17 nt, Human
gaguuaagaccuggcag

SEQ ID NO: 3753385 - RNA, 12 nt, Human
gaguuacagaca

SEQ ID NO: 3753386 - RNA, 15 nt, Human
gaguuacagacaaag

SEQ ID NO: 3753387 - RNA, 19 nt, Human
gaguuacagcgagaggcag

SEQ ID NO: 3753388 - RNA, 16 nt, Human
gaguuagaggccagcc

SEQ ID NO: 3753389 - RNA, 17 nt, Human
gaguuaggaaugagaag

SEQ ID NO: 3753390 - RNA, 14 nt, Human
gaguuauauguuca

SEQ ID NO: 3753391 - RNA, 17 nt, Human
gaguuaucaugaauuuu

SEQ ID NO: 3753392 - RNA, 19 nt, Human
gaguuaucaugaauuuuaa

SEQ ID NO: 3753393 - RNA, 23 nt, Human
gaguuaucaugaauuuuaaagua

SEQ ID NO: 3753394 - RNA, 20 nt, Human
gaguuauugaagcagagugg

SEQ ID NO: 3753395 - RNA, 19 nt, Human
gaguucaagaccagccugg

SEQ ID NO: 3753396 - RNA, 13 nt, Human
gaguucaaugauc

SEQ ID NO: 3753397 - RNA, 16 nt, Human
gaguucaaugaucuag

SEQ ID NO: 3753398 - RNA, 15 nt, Human
gaguucagcugcuuc

SEQ ID NO: 3753399 - RNA, 19 nt, Human
gaguucagguagcugcccc

SEQ ID NO: 3753400 - RNA, 20 nt, Human
gaguucauacccuguuacca

SEQ ID NO: 3753401 - RNA, 20 nt, Human
gaguucaucuugaauuguaa

SEQ ID NO: 3753402 - RNA, 16 nt, Human
gaguuccagaaaguaa

SEQ ID NO: 3753403 - RNA, 23 nt, Human
gaguuccugcggagugaagaggg

SEQ ID NO: 3753404 - RNA, 21 nt, Human
gaguuccuugaucuguauaua

SEQ ID NO: 3753405 - RNA, 19 nt, Human
gaguucgagaccagccugg

SEQ ID NO: 3753406 - RNA, 20 nt, Human
gaguucgagaccagccuggc

SEQ ID NO: 3753407 - RNA, 13 nt, Human
gaguucucagggc

SEQ ID NO: 3753408 - RNA, 18 nt, Human
gaguucucagggcuccug

SEQ ID NO: 3753409 - RNA, 19 nt, Human
gaguucucagggcuccugc

SEQ ID NO: 3753410 - RNA, 16 nt, Human
gaguucucccuguaca

SEQ ID NO: 3753411 - RNA, 22 nt, Human
gaguucucccuguacaguguua

SEQ ID NO: 3753412 - RNA, 21 nt, Human
gaguucuguguauuuucaguc

SEQ ID NO: 3753413 - RNA, 17 nt, Human
gaguucuuuuugaagua

SEQ ID NO: 3753414 - RNA, 16 nt, Human
cucuuuuuggaggugc

SEQ ID NO: 3753415 - RNA, 17 nt, Human
cucuuuuugggcuccuu

SEQ ID NO: 3753416 - RNA, 14 nt, Human
cucuuuuuguuuuu

SEQ ID NO: 3753417 - RNA, 14 nt, Human
cucuuuuuuacaaa

SEQ ID NO: 3753418 - RNA, 15 nt, Human
cucuuuuuuacucau

SEQ ID NO: 3753419 - RNA, 16 nt, Human
cucuuuuuuacucauu

SEQ ID NO: 3753420 - RNA, 17 nt, Human
cucuuuuuucguuuguu

SEQ ID NO: 3753421 - RNA, 14 nt, Human
cugaaaaaaaguuu

SEQ ID NO: 3753422 - RNA, 22 nt, Human
cugaaaaaacaccuagcuuuau

SEQ ID NO: 3753423 - RNA, 21 nt, Human
cugaaaaaucacauccuggcc

SEQ ID NO: 3753424 - RNA, 23 nt, Human
cugaaaaaucacauccuggccug

SEQ ID NO: 3753425 - RNA, 21 nt, Human
cugaaaaaugguaauuguugc

SEQ ID NO: 3753426 - RNA, 17 nt, Human
cugaaaacacugugcac

SEQ ID NO: 3753427 - RNA, 19 nt, Human
cugaaaaccaucuggccug

SEQ ID NO: 3753428 - RNA, 20 nt, Human
cugaaaaccaucuggccugg

SEQ ID NO: 3753429 - RNA, 19 nt, Human
cugaaaaccuaaguccuuu

SEQ ID NO: 3753430 - RNA, 17 nt, Human
cugaaaacggcccucuu

SEQ ID NO: 3753431 - RNA, 21 nt, Human
cugaaaacuggaauaagaagc

SEQ ID NO: 3753432 - RNA, 17 nt, Human
cugaaaacuucauucuu

SEQ ID NO: 3753433 - RNA, 18 nt, Human
cugaaaagaaggaaagau

SEQ ID NO: 3753434 - RNA, 18 nt, Human
cugaaaagacucaguguu

SEQ ID NO: 3753435 - RNA, 13 nt, Human
cugaaaagagagc

SEQ ID NO: 3753436 - RNA, 17 nt, Human
cugaaaagagagcagag

SEQ ID NO: 3753437 - RNA, 23 nt, Human
cugaaaagagagcagagaauaua

SEQ ID NO: 3753438 - RNA, 18 nt, Human
cugaaaauaccaucaggc

SEQ ID NO: 3753439 - RNA, 15 nt, Human
cugaaaauauaacca

SEQ ID NO: 3753440 - RNA, 22 nt, Human
cugaaaauauuguuuuacaaua

SEQ ID NO: 3753441 - RNA, 24 nt, Human
cugaaaauauuguuuuacaauagu

SEQ ID NO: 3753442 - RNA, 17 nt, Human
cugaaaaucuaauauua

SEQ ID NO: 3753443 - RNA, 20 nt, Human
cugaaaaucuaauauuaaaa

SEQ ID NO: 3753444 - RNA, 14 nt, Human
cugaaaauguaugu

SEQ ID NO: 3753445 - RNA, 18 nt, Human
cugaaaauguccuuguga

SEQ ID NO: 3753446 - RNA, 13 nt, Human
cugaaaaugugaa

SEQ ID NO: 3753447 - RNA, 12 nt, Human
cugaaaauguug

SEQ ID NO: 3753448 - RNA, 16 nt, Human
cugaaaauuaacacug

SEQ ID NO: 3753449 - RNA, 23 nt, Human
cugaaaauuggacagauugccug

SEQ ID NO: 3753450 - RNA, 13 nt, Human
cugaaacagauuu

SEQ ID NO: 3753451 - RNA, 10 nt, Human
cugaaacagc

SEQ ID NO: 3753452 - RNA, 12 nt, Human
cugaaacagcug

SEQ ID NO: 3753453 - RNA, 15 nt, Human
cugaaacagcugccu

SEQ ID NO: 3753454 - RNA, 16 nt, Human
cugaaacagcugccuu

SEQ ID NO: 3753455 - RNA, 18 nt, Human
cugaaacagcugccuuag

SEQ ID NO: 3753456 - RNA, 13 nt, Human
cugaaacaggaga

SEQ ID NO: 3753457 - RNA, 16 nt, Human
cugaaacccuggacca

SEQ ID NO: 3753458 - RNA, 17 nt, Human
cugaaaccuuuaagaaa

SEQ ID NO: 3753459 - RNA, 20 nt, Human
cugaaacgcuccuuugugug

SEQ ID NO: 3753460 - RNA, 15 nt, Human
cugaaacuaaugaaa

SEQ ID NO: 3753461 - RNA, 19 nt, Human
cugaaacucauagacacug

SEQ ID NO: 3753462 - RNA, 17 nt, Human
cugaaacuuacacacaa

SEQ ID NO: 3753463 - RNA, 20 nt, Human
cugaaacuucaagcaccagg

SEQ ID NO: 3753464 - RNA, 21 nt, Human
cugaaacuugcugagcuguuu

SEQ ID NO: 3753465 - RNA, 15 nt, Human
cugaaagacaauaua

SEQ ID NO: 3753466 - RNA, 21 nt, Human
cugaaagacugaagaaagugu

SEQ ID NO: 3753467 - RNA, 22 nt, Human
cugaaagaguccauuguuuaaa

SEQ ID NO: 3753468 - RNA, 16 nt, Human
cugaaagcacaggaga

SEQ ID NO: 3753469 - RNA, 16 nt, Human
cugaaagcccugagcu

SEQ ID NO: 3753470 - RNA, 18 nt, Human
cugaaagcccugagcuuu

SEQ ID NO: 3753471 - RNA, 16 nt, Human
cugaaaggaagcugug

SEQ ID NO: 3753472 - RNA, 19 nt, Human
cugaaagugaaaguccaga

SEQ ID NO: 3753473 - RNA, 21 nt, Human
cugaaaguguguguaguuuua

SEQ ID NO: 3753474 - RNA, 13 nt, Human
cugaaaguuaccc

SEQ ID NO: 3753475 - RNA, 22 nt, Human
cugaaaguuacccacugaagcc

SEQ ID NO: 3753476 - RNA, 15 nt, Human
cugaaaguuguacau

SEQ ID NO: 3753477 - RNA, 16 nt, Human
cugaaaguuguacaug

SEQ ID NO: 3753478 - RNA, 20 nt, Human
cugaaaguuguacaugaaau

SEQ ID NO: 3753479 - RNA, 17 nt, Human
cugaaaguuuuguaaaa

SEQ ID NO: 3753480 - RNA, 15 nt, Human
cugaaauaaaagcua

SEQ ID NO: 3753481 - RNA, 20 nt, Human
cugaaauaaacgucuuaaau

SEQ ID NO: 3753482 - RNA, 19 nt, Human
cugaaauauacacacagca

SEQ ID NO: 3753483 - RNA, 22 nt, Human
cugaaauaucccgggggugggg

SEQ ID NO: 3753484 - RNA, 14 nt, Human
cugaaauccugguu

SEQ ID NO: 3753485 - RNA, 17 nt, Human
cugaaauccugguuccu

SEQ ID NO: 3753486 - RNA, 13 nt, Human
cugaaaugaagau

SEQ ID NO: 3753487 - RNA, 17 nt, Human
cugaaaugccuuacuuu

SEQ ID NO: 3753488 - RNA, 23 nt, Human
cugaaaugccuuacuuuguauga

SEQ ID NO: 3753489 - RNA, 16 nt, Human
cugaaaugugugugau

SEQ ID NO: 3753490 - RNA, 19 nt, Human
cugaaaugugugugaugug

SEQ ID NO: 3753491 - RNA, 20 nt, Human
cugaaaugugugugauguga

SEQ ID NO: 3753492 - RNA, 16 nt, Human
cugaaauguguuuccu

SEQ ID NO: 3753493 - RNA, 14 nt, Human
cugaaauucuaaag

SEQ ID NO: 3753494 - RNA, 15 nt, Human
cugaaauucuccugg

SEQ ID NO: 3753495 - RNA, 15 nt, Human
cugaaauugaaaagu

SEQ ID NO: 3753496 - RNA, 14 nt, Human
cugaaauuucagau

SEQ ID NO: 3753497 - RNA, 13 nt, Human
cugaaauuuuaga

SEQ ID NO: 3753498 - RNA, 18 nt, Human
cugaaauuuuagaaauau

SEQ ID NO: 3753499 - RNA, 16 nt, Human
cugaaauuuuucuucu

SEQ ID NO: 3753500 - RNA, 19 nt, Human
cugaaauuuuucuucuuga

SEQ ID NO: 3753501 - RNA, 13 nt, Human
cugaacaaaaaaa

SEQ ID NO: 3753502 - RNA, 21 nt, Human
cugaacaaacuaaaggugcac

SEQ ID NO: 3753503 - RNA, 21 nt, Human
cugaacaaacuaucagaggaa

SEQ ID NO: 3753504 - RNA, 16 nt, Human
cugaacacaggcagcu

SEQ ID NO: 3753505 - RNA, 17 nt, Human
cugaacacaggcagcuu

SEQ ID NO: 3753506 - RNA, 11 nt, Human
cugaacaccau

SEQ ID NO: 3753507 - RNA, 23 nt, Human
cugaacacuccaauuaaggauuu

SEQ ID NO: 3753508 - RNA, 22 nt, Human
cugaacacugaagucaguucuc

SEQ ID NO: 3753509 - RNA, 13 nt, Human
cugaacagaagcu

SEQ ID NO: 3753510 - RNA, 14 nt, Human
cugaacagcuggug

SEQ ID NO: 3753511 - RNA, 15 nt, Human
cugaacagcuggugu

SEQ ID NO: 3753512 - RNA, 19 nt, Human
cugaacagcugguguagcu

SEQ ID NO: 3753513 - RNA, 13 nt, Human
cugaacagcugua

SEQ ID NO: 3753514 - RNA, 12 nt, Human
cugaacagugga

SEQ ID NO: 3753515 - RNA, 17 nt, Human
cugaacaucacagcuua

SEQ ID NO: 3753516 - RNA, 17 nt, Human
cugaacauccuuccuuc

SEQ ID NO: 3753517 - RNA, 15 nt, Human
cugaacaucugaguc

SEQ ID NO: 3753518 - RNA, 14 nt, Human
cugaacauugcaua

SEQ ID NO: 3753519 - RNA, 15 nt, Human
cugaaccacuuguag

SEQ ID NO: 3753520 - RNA, 18 nt, Human
cugaaccacuuguagauu

SEQ ID NO: 3753521 - RNA, 14 nt, Human
cugaaccaucccug

SEQ ID NO: 3753522 - RNA, 16 nt, Human
cugaaccccagggcug

SEQ ID NO: 3753523 - RNA, 17 nt, Human
cugaacccugugcuggu

SEQ ID NO: 3753524 - RNA, 17 nt, Human
cugaaccgcacagcuca

SEQ ID NO: 3753525 - RNA, 18 nt, Human
cugaaccgcacagcucag

SEQ ID NO: 3753526 - RNA, 19 nt, Human
cugaaccgcacagcucagg

SEQ ID NO: 3753527 - RNA, 20 nt, Human
cugaaccgcacagcucagga

SEQ ID NO: 3753528 - RNA, 23 nt, Human
cugaaccuauuucuuaaacacuu

SEQ ID NO: 3753529 - RNA, 17 nt, Human
cugaacggggagaaaag

SEQ ID NO: 3753530 - RNA, 23 nt, Human
cugaacguuugguucaaaugugu

SEQ ID NO: 3753531 - RNA, 18 nt, Human
cugaacucaaacugagga

SEQ ID NO: 3753532 - RNA, 13 nt, Human
cugaacucuccag

SEQ ID NO: 3753533 - RNA, 13 nt, Human
cugaacugaacac

SEQ ID NO: 3753534 - RNA, 15 nt, Human
cugaacuguguguaa

SEQ ID NO: 3753535 - RNA, 20 nt, Human
cugaacuuaauaacugugua

SEQ ID NO: 3753536 - RNA, 13 nt, Human
cugaacuuuggag

SEQ ID NO: 3753537 - RNA, 16 nt, Human
cugaacuuuggagagu

SEQ ID NO: 3753538 - RNA, 14 nt, Human
cugaacuuugggaa

SEQ ID NO: 3753539 - RNA, 15 nt, Human
cugaagaaccagucc

SEQ ID NO: 3753540 - RNA, 17 nt, Human
cugaagaacucucugga

SEQ ID NO: 3753541 - RNA, 17 nt, Human
cugaagaauuaagauac

SEQ ID NO: 3753542 - RNA, 14 nt, Human
cugaagaggcgggc

SEQ ID NO: 3753543 - RNA, 15 nt, Human
cugaagaggcgggcc

SEQ ID NO: 3753544 - RNA, 23 nt, Human
cugaagaguugccccgucucugu

SEQ ID NO: 3753545 - RNA, 19 nt, Human
cugaagauacaugucuuuc

SEQ ID NO: 3753546 - RNA, 15 nt, Human
cugaagauagaagaa

SEQ ID NO: 3753547 - RNA, 16 nt, Human
cugaagauagaagaaa

SEQ ID NO: 3753548 - RNA, 14 nt, Human
cugaagauuguuua

SEQ ID NO: 3753549 - RNA, 15 nt, Human
cugaagauuguuuau

SEQ ID NO: 3753550 - RNA, 16 nt, Human
cugaagauuguuuauc

SEQ ID NO: 3753551 - RNA, 13 nt, Human
gauauucuaagac

SEQ ID NO: 3753552 - RNA, 15 nt, Human
gauauucuuuguuaa

SEQ ID NO: 3753553 - RNA, 13 nt, Human
gauauugaauguu

SEQ ID NO: 3753554 - RNA, 18 nt, Human
gauauugaggccaagaau

SEQ ID NO: 3753555 - RNA, 15 nt, Human
gauauuguacauaaa

SEQ ID NO: 3753556 - RNA, 13 nt, Human
gauauugugaaca

SEQ ID NO: 3753557 - RNA, 17 nt, Human
gauauugugaaguacau

SEQ ID NO: 3753558 - RNA, 20 nt, Human
gauauuuaagaaaauacaau

SEQ ID NO: 3753559 - RNA, 23 nt, Human
gauauuuaagaaaauacaauaaa

SEQ ID NO: 3753560 - RNA, 11 nt, Human
gauauuucaga

SEQ ID NO: 3753561 - RNA, 23 nt, Human
gauauuucuauuuccuggaaugg

SEQ ID NO: 3753562 - RNA, 22 nt, Human
gauauuucucuaguaguuaaaa

SEQ ID NO: 3753563 - RNA, 13 nt, Human
gauauuuggcuua

SEQ ID NO: 3753564 - RNA, 18 nt, Human
gauauuuggcuuaaauau

SEQ ID NO: 3753565 - RNA, 20 nt, Human
gauauuuguauuuauucuuu

SEQ ID NO: 3753566 - RNA, 13 nt, Human
gauauuugugcau

SEQ ID NO: 3753567 - RNA, 21 nt, Human
gauauuuuaccucuuauugca

SEQ ID NO: 3753568 - RNA, 20 nt, Human
gauauuuuauuuugaaaugg

SEQ ID NO: 3753569 - RNA, 18 nt, Human
gauauuuucaaauuguau

SEQ ID NO: 3753570 - RNA, 20 nt, Human
gauauuuucaaauuguaucu

SEQ ID NO: 3753571 - RNA, 21 nt, Human
gauauuuucugugccugaaua

SEQ ID NO: 3753572 - RNA, 13 nt, Human
gauauuuuuaaua

SEQ ID NO: 3753573 - RNA, 17 nt, Human
gauauuuuucauaaaca

SEQ ID NO: 3753574 - RNA, 18 nt, Human
gauauuuuuccauuuuuu

SEQ ID NO: 3753575 - RNA, 14 nt, Human
gaucaaaaaggcuu

SEQ ID NO: 3753576 - RNA, 20 nt, Human
gaucaaaauaaaaagugaca

SEQ ID NO: 3753577 - RNA, 18 nt, Human
gaucaaauguuuaaucau

SEQ ID NO: 3753578 - RNA, 16 nt, Human
gaucaacaucuuuucu

SEQ ID NO: 3753579 - RNA, 17 nt, Human
gaucaacaucuuuucuu

SEQ ID NO: 3753580 - RNA, 16 nt, Human
gaucaacgccucacug

SEQ ID NO: 3753581 - RNA, 18 nt, Human
gaucaacgccucacugaa

SEQ ID NO: 3753582 - RNA, 20 nt, Human
gaucaagcaauaauaauuuu

SEQ ID NO: 3753583 - RNA, 18 nt, Human
gaucaaggagaggaggca

SEQ ID NO: 3753584 - RNA, 13 nt, Human
gaucaaguauuac

SEQ ID NO: 3753585 - RNA, 22 nt, Human
gaucaauccuuuauuauuauuu

SEQ ID NO: 3753586 - RNA, 12 nt, Human
gaucaaugacag

SEQ ID NO: 3753587 - RNA, 15 nt, Human
gaucaauuaaaugua

SEQ ID NO: 3753588 - RNA, 18 nt, Human
gaucaauuauaguuucug

SEQ ID NO: 3753589 - RNA, 12 nt, Human
gaucacaaauga

SEQ ID NO: 3753590 - RNA, 15 nt, Human
gaucacaacgugcau

SEQ ID NO: 3753591 - RNA, 22 nt, Human
gaucacaacgugcauugugcuu

SEQ ID NO: 3753592 - RNA, 14 nt, Human
gaucacaagaugga

SEQ ID NO: 3753593 - RNA, 16 nt, Human
gaucacagcagcuucu

SEQ ID NO: 3753594 - RNA, 19 nt, Human
gaucacagcuucagccagg

SEQ ID NO: 3753595 - RNA, 21 nt, Human
gaucacagcuucagccaggag

SEQ ID NO: 3753596 - RNA, 13 nt, Human
gaucacagggccc

SEQ ID NO: 3753597 - RNA, 20 nt, Human
gaucacagggccccagaagg

SEQ ID NO: 3753598 - RNA, 16 nt, Human
gaucacauguggacuu

SEQ ID NO: 3753599 - RNA, 20 nt, Human
gaucaccagcccggccugcu

SEQ ID NO: 3753600 - RNA, 23 nt, Human
gaucaccgacugaaaauauuguu

SEQ ID NO: 3753601 - RNA, 14 nt, Human
gaucaccugagguc

SEQ ID NO: 3753602 - RNA, 14 nt, Human
gaucaccugagguu

SEQ ID NO: 3753603 - RNA, 17 nt, Human
gaucacgacgcugcaga

SEQ ID NO: 3753604 - RNA, 21 nt, Human
gaucacgagaucaagagauca

SEQ ID NO: 3753605 - RNA, 15 nt, Human
gaucacgaggucagg

SEQ ID NO: 3753606 - RNA, 13 nt, Human
gaucacgccacug

SEQ ID NO: 3753607 - RNA, 15 nt, Human
gaucacgccacugca

SEQ ID NO: 3753608 - RNA, 15 nt, Human
gaucacggcucacug

SEQ ID NO: 3753609 - RNA, 23 nt, Human
gaucacggcucacugcagccuca

SEQ ID NO: 3753610 - RNA, 14 nt, Human
gaucacugaaauaa

SEQ ID NO: 3753611 - RNA, 16 nt, Human
gaucacugccacacuc

SEQ ID NO: 3753612 - RNA, 12 nt, Human
gaucacuggagc

SEQ ID NO: 3753613 - RNA, 13 nt, Human
gaucacuggagcc

SEQ ID NO: 3753614 - RNA, 14 nt, Human
gaucacuggagccc

SEQ ID NO: 3753615 - RNA, 15 nt, Human
gaucacuuguuguuu

SEQ ID NO: 3753616 - RNA, 22 nt, Human
gaucagaaaaauggagcaaagu

SEQ ID NO: 3753617 - RNA, 11 nt, Human
gaucagaaagu

SEQ ID NO: 3753618 - RNA, 12 nt, Human
gaucagaaagua

SEQ ID NO: 3753619 - RNA, 15 nt, Human
gaucagaaauacaga

SEQ ID NO: 3753620 - RNA, 13 nt, Human
gaucagaacaaau

SEQ ID NO: 3753621 - RNA, 16 nt, Human
gaucagaccauaaugu

SEQ ID NO: 3753622 - RNA, 23 nt, Human
gaucagagcaggaccucccuucc

SEQ ID NO: 3753623 - RNA, 16 nt, Human
gaucagagccgugguc

SEQ ID NO: 3753624 - RNA, 23 nt, Human
gaucagagccgugguccuuuggg

SEQ ID NO: 3753625 - RNA, 14 nt, Human
gaucagaucugaca

SEQ ID NO: 3753626 - RNA, 21 nt, Human
gaucagaugcuccaagauucu

SEQ ID NO: 3753627 - RNA, 16 nt, Human
gaucagccccacccug

SEQ ID NO: 3753628 - RNA, 15 nt, Human
gaucagcguggccuu

SEQ ID NO: 3753629 - RNA, 18 nt, Human
gaucagcuguuugucaua

SEQ ID NO: 3753630 - RNA, 12 nt, Human
gaucaggaagag

SEQ ID NO: 3753631 - RNA, 15 nt, Human
gaucaggaagagaag

SEQ ID NO: 3753632 - RNA, 16 nt, Human
gaucaggaagagaagg

SEQ ID NO: 3753633 - RNA, 18 nt, Human
gaucaggaagagaaggag

SEQ ID NO: 3753634 - RNA, 13 nt, Human
gaucaggugggga

SEQ ID NO: 3753635 - RNA, 14 nt, Human
gaucaguaaaauua

SEQ ID NO: 3753636 - RNA, 16 nt, Human
gaucaguaguuugcau

SEQ ID NO: 3753637 - RNA, 17 nt, Human
gaucaguaguuugcauu

SEQ ID NO: 3753638 - RNA, 20 nt, Human
gaucaguauaauuuuuuaaa

SEQ ID NO: 3753639 - RNA, 18 nt, Human
gaucaguuauaaguagca

SEQ ID NO: 3753640 - RNA, 17 nt, Human
gaucauaaggcuucaaa

SEQ ID NO: 3753641 - RNA, 15 nt, Human
gaucauaagugaauu

SEQ ID NO: 3753642 - RNA, 17 nt, Human
gaucauaagugaauuua

SEQ ID NO: 3753643 - RNA, 19 nt, Human
gaucauagauuucugauuu

SEQ ID NO: 3753644 - RNA, 18 nt, Human
gaucauagguauuucaaa

SEQ ID NO: 3753645 - RNA, 22 nt, Human
gaucaucccaucuaagcugcag

SEQ ID NO: 3753646 - RNA, 16 nt, Human
gaucaucgccagaggu

SEQ ID NO: 3753647 - RNA, 23 nt, Human
gaucaucgccagaggugcuucac

SEQ ID NO: 3753648 - RNA, 17 nt, Human
gaucaugcauagagugu

SEQ ID NO: 3753649 - RNA, 14 nt, Human
gaucauggcaucca

SEQ ID NO: 3753650 - RNA, 16 nt, Human
gaucauggcucacugc

SEQ ID NO: 3753651 - RNA, 20 nt, Human
gaucaugguguaauaagaca

SEQ ID NO: 3753652 - RNA, 20 nt, Human
gaucauugugaaauuauuca

SEQ ID NO: 3753653 - RNA, 15 nt, Human
gaucauuugaguuca

SEQ ID NO: 3753654 - RNA, 18 nt, Human
gaucauuuguuggaauga

SEQ ID NO: 3753655 - RNA, 14 nt, Human
gaucauuuuccccc

SEQ ID NO: 3753656 - RNA, 19 nt, Human
gaucauuuuccccccacuc

SEQ ID NO: 3753657 - RNA, 23 nt, Human
gaucauuuuccccccacucuccc

SEQ ID NO: 3753658 - RNA, 13 nt, Human
gaucauuuucuua

SEQ ID NO: 3753659 - RNA, 23 nt, Human
gauccaaaagaagcccccagcua

SEQ ID NO: 3753660 - RNA, 11 nt, Human
gauccaaagac

SEQ ID NO: 3753661 - RNA, 19 nt, Human
gauccaaauugugcuucuc

SEQ ID NO: 3753662 - RNA, 15 nt, Human
gauccaagcaaaugg

SEQ ID NO: 3753663 - RNA, 15 nt, Human
gauccaagcuaagca

SEQ ID NO: 3753664 - RNA, 22 nt, Human
gauccaagcuaagcacugccac

SEQ ID NO: 3753665 - RNA, 12 nt, Human
gauccaagcugg

SEQ ID NO: 3753666 - RNA, 16 nt, Human
gauccaauguuagaga

SEQ ID NO: 3753667 - RNA, 21 nt, Human
gauccacccaccucagccucc

SEQ ID NO: 3753668 - RNA, 22 nt, Human
gauccacccaccucagccuccc

SEQ ID NO: 3753669 - RNA, 13 nt, Human
gauccacuggcug

SEQ ID NO: 3753670 - RNA, 14 nt, Human
gauccagagcacag

SEQ ID NO: 3753671 - RNA, 19 nt, Human
gauccagcagauuauucac

SEQ ID NO: 3753672 - RNA, 23 nt, Human
gauccagcccugaguuccuagcc

SEQ ID NO: 3753673 - RNA, 13 nt, Human
gauccagccuggg

SEQ ID NO: 3753674 - RNA, 21 nt, Human
gauccagccuggggucuggag

SEQ ID NO: 3753675 - RNA, 19 nt, Human
gauccaggaagcaugagug

SEQ ID NO: 3753676 - RNA, 16 nt, Human
gauccaggagcuccag

SEQ ID NO: 3753677 - RNA, 13 nt, Human
gauccagggacag

SEQ ID NO: 3753678 - RNA, 19 nt, Human
gauccauuaauuuaaauga

SEQ ID NO: 3753679 - RNA, 17 nt, Human
gaucccagagagcccga

SEQ ID NO: 3753680 - RNA, 21 nt, Human
gaucccagagagcccgaggag

SEQ ID NO: 3753681 - RNA, 17 nt, Human
gaucccagcucacguca

SEQ ID NO: 3753682 - RNA, 18 nt, Human
gaucccaggccccuggag

SEQ ID NO: 3753683 - RNA, 23 nt, Human
gaucccaggggcccaaggcggcc

SEQ ID NO: 3753684 - RNA, 15 nt, Human
gaucccaugagcucc

SEQ ID NO: 3753685 - RNA, 17 nt, Human
gaucccaugagcuccuu

SEQ ID NO: 3753686 - RNA, 20 nt, Human
gauccccaagccuggcaagg

SEQ ID NO: 3753687 - RNA, 18 nt, Human
gauccccaagugugaaca

SEQ ID NO: 3753688 - RNA, 16 nt, Human
gauccccacgccacag

SEQ ID NO: 3753689 - RNA, 21 nt, Human
gauccccacgccacagcccuu

SEQ ID NO: 3753690 - RNA, 14 nt, Human
gauccccgccuggc

SEQ ID NO: 3753691 - RNA, 15 nt, Human
gauccccgccuggcc

SEQ ID NO: 3753692 - RNA, 16 nt, Human
gauccccgccuggcca

SEQ ID NO: 3753693 - RNA, 18 nt, Human
gauccccgccuggccagg

SEQ ID NO: 3753694 - RNA, 17 nt, Human
gauccccguuccugaca

SEQ ID NO: 3753695 - RNA, 21 nt, Human
gauccccucugucuacaaaua

SEQ ID NO: 3753696 - RNA, 18 nt, Human
gauccccuuccuaccacc

SEQ ID NO: 3753697 - RNA, 21 nt, Human
gaucccuagcugugaccucuc

SEQ ID NO: 3753698 - RNA, 12 nt, Human
gaucccucaucu

SEQ ID NO: 3753699 - RNA, 19 nt, Human
gaucccucccccccaugca

SEQ ID NO: 3753700 - RNA, 18 nt, Human
gaucccuguuacccagag

SEQ ID NO: 3753701 - RNA, 20 nt, Human
gaucccuuccaccugcucug

SEQ ID NO: 3753702 - RNA, 17 nt, Human
gauccaagcugguccca

SEQ ID NO: 3753703 - RNA, 16 nt, Human
gauccacacacagagg

SEQ ID NO: 3753704 - RNA, 17 nt, Human
gauccacacacagagga

SEQ ID NO: 3753705 - RNA, 18 nt, Human
gauccacacacagaggaa

SEQ ID NO: 3753706 - RNA, 18 nt, Human
gauccacccaccucagcc

SEQ ID NO: 3753707 - RNA, 20 nt, Human
gauccacccaccucagccuc

SEQ ID NO: 3753708 - RNA, 19 nt, Human
gauccaccugucucagccu

SEQ ID NO: 3753709 - RNA, 14 nt, Human
gauccacuuugggg

SEQ ID NO: 3753710 - RNA, 17 nt, Human
gauccagccucuccccu

SEQ ID NO: 3753711 - RNA, 12 nt, Human
gauccaggacua

SEQ ID NO: 3753712 - RNA, 15 nt, Human
gauccaggagcucca

SEQ ID NO: 3753713 - RNA, 23 nt, Human
gauccaggccggcuugccacacc

SEQ ID NO: 3753714 - RNA, 14 nt, Human
gauccagggacaga

SEQ ID NO: 3753715 - RNA, 18 nt, Human
gauccagggacagaggcc

SEQ ID NO: 3753716 - RNA, 16 nt, Human
gauccaguauaagacu

SEQ ID NO: 3753717 - RNA, 11 nt, Human
gauccaguuuu

SEQ ID NO: 3753718 - RNA, 18 nt, Human
gauccauccagcuugcca

SEQ ID NO: 3753719 - RNA, 15 nt, Human
gauccauuucuaauu

SEQ ID NO: 3753720 - RNA, 18 nt, Human
gauccauuuuuuauauuu

SEQ ID NO: 3753721 - RNA, 12 nt, Human
gaucccaacacu

SEQ ID NO: 3753722 - RNA, 16 nt, Human
gaucccaacacugcca

SEQ ID NO: 3753723 - RNA, 21 nt, Human
gaucccaaguagaaucucagu

SEQ ID NO: 3753724 - RNA, 15 nt, Human
gaucccacacaggcu

SEQ ID NO: 3753725 - RNA, 22 nt, Human
gaucccacuccuaggacauguu

SEQ ID NO: 3753726 - RNA, 19 nt, Human
gaucccaggccccuggagg

SEQ ID NO: 3753727 - RNA, 20 nt, Human
gauccccaagugugaacaaa

SEQ ID NO: 3753728 - RNA, 14 nt, Human
gauccccagcuguu

SEQ ID NO: 3753729 - RNA, 13 nt, Human
gauccccucagga

SEQ ID NO: 3753730 - RNA, 16 nt, Human
gauccccuuccuacca

SEQ ID NO: 3753731 - RNA, 15 nt, Human
gaucccucauccuca

SEQ ID NO: 3753732 - RNA, 18 nt, Human
gaucccucaucugucccu

SEQ ID NO: 3753733 - RNA, 23 nt, Human
gaucccucccccccaugcacugu

SEQ ID NO: 3753734 - RNA, 18 nt, Human
gaucccuguguugucucu

SEQ ID NO: 3753735 - RNA, 20 nt, Human
gaucccuguguugucucuag

SEQ ID NO: 3753736 - RNA, 20 nt, Human
gaucccuguuacccagagaa

SEQ ID NO: 3753737 - RNA, 20 nt, Human
gaucccuucuuacuuaaccu

SEQ ID NO: 3753738 - RNA, 18 nt, Human
gauccgacugcuuuggac

SEQ ID NO: 3753739 - RNA, 19 nt, Human
gauccuaacugaagagaca

SEQ ID NO: 3753740 - RNA, 18 nt, Human
gauccuaagggcucaccg

SEQ ID NO: 3753741 - RNA, 23 nt, Human
gauccuaaugaaugcauaaaaug

SEQ ID NO: 3753742 - RNA, 20 nt, Human
gauccuagccuuauccucug

SEQ ID NO: 3753743 - RNA, 22 nt, Human
gauccuagccuuauccucugau

SEQ ID NO: 3753744 - RNA, 23 nt, Human
gauccucauauggcccaguguca

SEQ ID NO: 3753745 - RNA, 16 nt, Human
gauccucccaggcuuc

SEQ ID NO: 3753746 - RNA, 16 nt, Human
gauccuccugcagacc

SEQ ID NO: 3753747 - RNA, 21 nt, Human
gauccucuccuuugaaaccug

SEQ ID NO: 3753748 - RNA, 12 nt, Human
gauccucucugg

SEQ ID NO: 3753749 - RNA, 19 nt, Human
gauccugagccagauuuca

SEQ ID NO: 3753750 - RNA, 21 nt, Human
gauccugagccagauuucacu

SEQ ID NO: 3753751 - RNA, 14 nt, Human
gauccugccacccu

SEQ ID NO: 3753752 - RNA, 16 nt, Human
gauccugccacccugu

SEQ ID NO: 3753753 - RNA, 17 nt, Human
gauccugcggguggggc

SEQ ID NO: 3753754 - RNA, 17 nt, Human
gauccuggaggcccagu

SEQ ID NO: 3753755 - RNA, 21 nt, Human
gauccuuagagguccucugga

SEQ ID NO: 3753756 - RNA, 13 nt, Human
gauccuucaaagu

SEQ ID NO: 3753757 - RNA, 21 nt, Human
gauccuucaaagucucaauga

SEQ ID NO: 3753758 - RNA, 15 nt, Human
gauccuuuuggaguc

SEQ ID NO: 3753759 - RNA, 21 nt, Human
gauccuuuuggagucagacag

SEQ ID NO: 3753760 - RNA, 16 nt, Human
gaucgagaccauccug

SEQ ID NO: 3753761 - RNA, 17 nt, Human
gaucgagaccauccugg

SEQ ID NO: 3753762 - RNA, 18 nt, Human
gaucgagaccauccuggc

SEQ ID NO: 3753763 - RNA, 18 nt, Human
gaucgcaguuugccuggu

SEQ ID NO: 3753764 - RNA, 17 nt, Human
gaucgguuaacaaauaa

SEQ ID NO: 3753765 - RNA, 18 nt, Human
gaucgucugacugguguu

SEQ ID NO: 3753766 - RNA, 19 nt, Human
gaucgugacgcugaauaaa

SEQ ID NO: 3753767 - RNA, 23 nt, Human
gaucgugccguuacucuccaacc

SEQ ID NO: 3753768 - RNA, 15 nt, Human
gaucguucucugccu

SEQ ID NO: 3753769 - RNA, 21 nt, Human
gaucuaaaaauaacuguaauu

SEQ ID NO: 3753770 - RNA, 11 nt, Human
gaucuaaauaa

SEQ ID NO: 3753771 - RNA, 17 nt, Human
gaucuaagccuuuccau

SEQ ID NO: 3753772 - RNA, 21 nt, Human
gaucuaaggaugucacagggc

SEQ ID NO: 3753773 - RNA, 23 nt, Human
gaucuaaggaugucacagggcca

SEQ ID NO: 3753774 - RNA, 13 nt, Human
gaucuacaugaau

SEQ ID NO: 3753775 - RNA, 15 nt, Human
gaucuaccuggaggg

SEQ ID NO: 3753776 - RNA, 18 nt, Human
gaucuagaauaaucuugc

SEQ ID NO: 3753777 - RNA, 14 nt, Human
gaucuaggaagacu

SEQ ID NO: 3753778 - RNA, 14 nt, Human
gaucuagguuuaac

SEQ ID NO: 3753779 - RNA, 16 nt, Human
gaucuagguuuaacuc

SEQ ID NO: 3753780 - RNA, 18 nt, Human
gaucuagguuuaacucag

SEQ ID NO: 3753781 - RNA, 19 nt, Human
gaucuagguuuaacucaga

SEQ ID NO: 3753782 - RNA, 21 nt, Human
gaucuagguuuaacucagauc

SEQ ID NO: 3753783 - RNA, 15 nt, Human
gaucuauguuucauc

SEQ ID NO: 3753784 - RNA, 19 nt, Human
gaucucagcucacugcaac

SEQ ID NO: 3753785 - RNA, 16 nt, Human
gaucucagcuuugaga

SEQ ID NO: 3753786 - RNA, 22 nt, Human
gaucucagcuuugagaagccuu

SEQ ID NO: 3753787 - RNA, 21 nt, Human
gaucucagggaagcccagcuc

SEQ ID NO: 3753788 - RNA, 17 nt, Human
gaucucaggggcuguuu

SEQ ID NO: 3753789 - RNA, 18 nt, Human
gaucucaggggcuguuug

SEQ ID NO: 3753790 - RNA, 19 nt, Human
gaucucaggggcuguuuga

SEQ ID NO: 3753791 - RNA, 13 nt, Human
gaucucagguucu

SEQ ID NO: 3753792 - RNA, 15 nt, Human
gaucucauucaguau

SEQ ID NO: 3753793 - RNA, 17 nt, Human
gaucucauucaguauua

SEQ ID NO: 3753794 - RNA, 21 nt, Human
gaucucauuggacccuuccau

SEQ ID NO: 3753795 - RNA, 12 nt, Human
gaucuccaaagc

SEQ ID NO: 3753796 - RNA, 13 nt, Human
gaucuccaaagcu

SEQ ID NO: 3753797 - RNA, 20 nt, Human
gaucuccaaggaccagguua

SEQ ID NO: 3753798 - RNA, 16 nt, Human
gaucucccugagaugg

SEQ ID NO: 3753799 - RNA, 19 nt, Human
gaucucucaggagcacagg

SEQ ID NO: 3753800 - RNA, 20 nt, Human
gaucucucaggagcacaggc

SEQ ID NO: 3753801 - RNA, 22 nt, Human
gaucucucaggagcacaggcag

SEQ ID NO: 3753802 - RNA, 23 nt, Human
gaucucucaggagcacaggcagc

SEQ ID NO: 3753803 - RNA, 24 nt, Human
gaucucucaggagcacaggcagcu

SEQ ID NO: 3753804 - RNA, 16 nt, Human
gaucucuccuggccua

SEQ ID NO: 3753805 - RNA, 12 nt, Human
gaucucugcagg

SEQ ID NO: 3753806 - RNA, 12 nt, Human
gaucucuuaaga

SEQ ID NO: 3753807 - RNA, 19 nt, Human
gaucucuucuuaauguaca

SEQ ID NO: 3753808 - RNA, 20 nt, Human
gaucucuuucuaaagacagg

SEQ ID NO: 3753809 - RNA, 17 nt, Human
gaucugacaugauuccu

SEQ ID NO: 3753810 - RNA, 22 nt, Human
gaucugacaugauuccuuccug

SEQ ID NO: 3753811 - RNA, 14 nt, Human
gaucugagaaucuu

SEQ ID NO: 3753812 - RNA, 18 nt, Human
gaucugagaaucuuuauu

SEQ ID NO: 3753813 - RNA, 17 nt, Human
gaucugagucagagcca

SEQ ID NO: 3753814 - RNA, 23 nt, Human
gaucugauugaccguguuggucu

SEQ ID NO: 3753815 - RNA, 20 nt, Human
gaucugcagggggugugucu

SEQ ID NO: 3753816 - RNA, 21 nt, Human
gaucugcccaucgugaagaag

SEQ ID NO: 3753817 - RNA, 20 nt, Human
gaucugccccucccugcuuc

SEQ ID NO: 3753818 - RNA, 16 nt, Human
gaucugccuaaggacu

SEQ ID NO: 3753819 - RNA, 20 nt, Human
gaucugccuaaggacuucuu

SEQ ID NO: 3753820 - RNA, 18 nt, Human
gaucugcggaucucagcu

SEQ ID NO: 3753821 - RNA, 13 nt, Human
gaucugcucagcc

SEQ ID NO: 3753822 - RNA, 18 nt, Human
gaucugcucagcccugga

SEQ ID NO: 3753823 - RNA, 12 nt, Human
gaucuggaaccc

SEQ ID NO: 3753824 - RNA, 18 nt, Human
gaucuggaacccagacuc

SEQ ID NO: 3753825 - RNA, 18 nt, Human
gaucuggaaccucagccu

SEQ ID NO: 3753826 - RNA, 13 nt, Human
gaucuggcugcag

SEQ ID NO: 3753827 - RNA, 18 nt, Human
gaucuggguucacugcaa

SEQ ID NO: 3753828 - RNA, 16 nt, Human
gaucugguccuaccca

SEQ ID NO: 3753829 - RNA, 19 nt, Human
gaucugguggucagcccua

SEQ ID NO: 3753830 - RNA, 20 nt, Human
gaucugguggucagcccuag

SEQ ID NO: 3753831 - RNA, 14 nt, Human
gaucugguuuugcu

SEQ ID NO: 3753832 - RNA, 16 nt, Human
gaucugguuuugcuau

SEQ ID NO: 3753833 - RNA, 17 nt, Human
gaucugucacaccagcc

SEQ ID NO: 3753834 - RNA, 14 nt, Human
gaucuguccucagc

SEQ ID NO: 3753835 - RNA, 17 nt, Human
gaucuguccucagccuu

SEQ ID NO: 3753836 - RNA, 13 nt, Human
gaucugucuugua

SEQ ID NO: 3753837 - RNA, 16 nt, Human
gaucugugcccagaga

SEQ ID NO: 3753838 - RNA, 18 nt, Human
gaucugugccccaugccu

SEQ ID NO: 3753839 - RNA, 19 nt, Human
gaucugugcuuuccagcuc

SEQ ID NO: 3753840 - RNA, 17 nt, Human
gaucuguuuugaaggca

SEQ ID NO: 3753841 - RNA, 20 nt, Human
gaucuguuuugaaggcaaaa

SEQ ID NO: 3753842 - RNA, 19 nt, Human
gaucuguuuuuaaaaauca

SEQ ID NO: 3753843 - RNA, 15 nt, Human
gaucuuaauauaaau

SEQ ID NO: 3753844 - RNA, 16 nt, Human
gaucuuaauauaaauu

SEQ ID NO: 3753845 - RNA, 19 nt, Human
gaucuuagggugaaccacu

SEQ ID NO: 3753846 - RNA, 15 nt, Human
gaucuucaacaaauu

SEQ ID NO: 3753847 - RNA, 14 nt, Human
gaucuucagagcag

SEQ ID NO: 3753848 - RNA, 18 nt, Human
gaucuucauuaccaauag

SEQ ID NO: 3753849 - RNA, 17 nt, Human
gaucuuccucugcuaaa

SEQ ID NO: 3753850 - RNA, 18 nt, Human
gaucuuccucugcuaaau

SEQ ID NO: 3753851 - RNA, 20 nt, Human
gauccgacugcuuuggaccu

SEQ ID NO: 3753852 - RNA, 14 nt, Human
gauccggaaagaag

SEQ ID NO: 3753853 - RNA, 16 nt, Human
gauccuaagcaucuaa

SEQ ID NO: 3753854 - RNA, 14 nt, Human
gauccuaccccuga

SEQ ID NO: 3753855 - RNA, 15 nt, Human
gauccuagauccuaa

SEQ ID NO: 3753856 - RNA, 23 nt, Human
gauccuagccuuauccucugauc

SEQ ID NO: 3753857 - RNA, 20 nt, Human
gauccuauucucaccaggaa

SEQ ID NO: 3753858 - RNA, 19 nt, Human
gauccucacaaccaccuaa

SEQ ID NO: 3753859 - RNA, 12 nt, Human
gauccuccaggu

SEQ ID NO: 3753860 - RNA, 14 nt, Human
gauccuccaggugc

SEQ ID NO: 3753861 - RNA, 17 nt, Human
gauccucccaccucagc

SEQ ID NO: 3753862 - RNA, 18 nt, Human
gauccucccaccucagcc

SEQ ID NO: 3753863 - RNA, 20 nt, Human
gauccucccaccucagccuc

SEQ ID NO: 3753864 - RNA, 17 nt, Human
gauccuccccuggacuc

SEQ ID NO: 3753865 - RNA, 12 nt, Human
gauccuccucau

SEQ ID NO: 3753866 - RNA, 21 nt, Human
gauccuccugcagaccacgcc

SEQ ID NO: 3753867 - RNA, 19 nt, Human
gauccucucaccucagccu

SEQ ID NO: 3753868 - RNA, 17 nt, Human
gauccucuccuuugaaa

SEQ ID NO: 3753869 - RNA, 13 nt, Human
gauccugagccag

SEQ ID NO: 3753870 - RNA, 15 nt, Human
gauccugagccagau

SEQ ID NO: 3753871 - RNA, 21 nt, Human
gauccugcacugacucuggaa

SEQ ID NO: 3753872 - RNA, 15 nt, Human
gauccugccacccug

SEQ ID NO: 3753873 - RNA, 17 nt, Human
gauccugccacccugua

SEQ ID NO: 3753874 - RNA, 18 nt, Human
gauccugcggguggggcu

SEQ ID NO: 3753875 - RNA, 14 nt, Human
gauccuggaaauca

SEQ ID NO: 3753876 - RNA, 12 nt, Human
gauccuggaggc

SEQ ID NO: 3753877 - RNA, 16 nt, Human
gauccuggaggcccag

SEQ ID NO: 3753878 - RNA, 23 nt, Human
gauccuggguggucugcaggcag

SEQ ID NO: 3753879 - RNA, 20 nt, Human
gauccuguauucagacagau

SEQ ID NO: 3753880 - RNA, 19 nt, Human
gauccuguguggagaggga

SEQ ID NO: 3753881 - RNA, 20 nt, Human
gauccuuguguuuaucagaa

SEQ ID NO: 3753882 - RNA, 19 nt, Human
gaucgagaccauccuggcu

SEQ ID NO: 3753883 - RNA, 23 nt, Human
gaucgcaucauugcacucuagcc

SEQ ID NO: 3753884 - RNA, 12 nt, Human
gaucgccuuccc

SEQ ID NO: 3753885 - RNA, 14 nt, Human
gaucgccuucccca

SEQ ID NO: 3753886 - RNA, 16 nt, Human
gaucgccuuccccacc

SEQ ID NO: 3753887 - RNA, 19 nt, Human
gaucggcaggacacccuga

SEQ ID NO: 3753888 - RNA, 20 nt, Human
gaucgugacgcugaauaaau

SEQ ID NO: 3753889 - RNA, 22 nt, Human
gaucgugacgcugaauaaaugu

SEQ ID NO: 3753890 - RNA, 18 nt, Human
gaucgugcuaaauuuuca

SEQ ID NO: 3753891 - RNA, 16 nt, Human
gaucguucaaagcaug

SEQ ID NO: 3753892 - RNA, 17 nt, Human
gaucuaaauaaaaugcu

SEQ ID NO: 3753893 - RNA, 18 nt, Human
gaucuaaauaaaaugcua

SEQ ID NO: 3753894 - RNA, 21 nt, Human
gaucuacaugaaugcaaaaca

SEQ ID NO: 3753895 - RNA, 23 nt, Human
gaucuacaugaggaacuguagau

SEQ ID NO: 3753896 - RNA, 17 nt, Human
gaucuaccuggagggaa

SEQ ID NO: 3753897 - RNA, 13 nt, Human
gaucuaggaagac

SEQ ID NO: 3753898 - RNA, 18 nt, Human
gaucuaggaagacuuugg

SEQ ID NO: 3753899 - RNA, 20 nt, Human
gaucuaggaagacuuuggaa

SEQ ID NO: 3753900 - RNA, 15 nt, Human
gaucuaggugaggau

SEQ ID NO: 3753901 - RNA, 15 nt, Human
gaucuagguuuaacu

SEQ ID NO: 3753902 - RNA, 20 nt, Human
gaucuagguuuaacucagau

SEQ ID NO: 3753903 - RNA, 16 nt, Human
gaucuauacuugcuuu

SEQ ID NO: 3753904 - RNA, 23 nt, Human
gaucuauacuugcuuuguguucu

SEQ ID NO: 3753905 - RNA, 16 nt, Human
gaucuaucaauaguca

SEQ ID NO: 3753906 - RNA, 13 nt, Human
gaucuauuucaug

SEQ ID NO: 3753907 - RNA, 14 nt, Human
gaucucaccaggca

SEQ ID NO: 3753908 - RNA, 15 nt, Human
gaucucaccaggcag

SEQ ID NO: 3753909 - RNA, 13 nt, Human
gaucucacucugc

SEQ ID NO: 3753910 - RNA, 17 nt, Human
gaucucagcucacuaca

SEQ ID NO: 3753911 - RNA, 17 nt, Human
gaucucagcucacugca

SEQ ID NO: 3753912 - RNA, 14 nt, Human
gaucucagcuuuga

SEQ ID NO: 3753913 - RNA, 18 nt, Human
gaucucagggaagcccag

SEQ ID NO: 3753914 - RNA, 19 nt, Human
gaucucagggaagcccagc

SEQ ID NO: 3753915 - RNA, 21 nt, Human
gaucucaggggucuuaccuug

SEQ ID NO: 3753916 - RNA, 21 nt, Human
gaucucauuguucaauuccca

SEQ ID NO: 3753917 - RNA, 19 nt, Human
gaucuccaaggaccagguu

SEQ ID NO: 3753918 - RNA, 11 nt, Human
gaucuccagcg

SEQ ID NO: 3753919 - RNA, 17 nt, Human
gaucuccauauguuaca

SEQ ID NO: 3753920 - RNA, 19 nt, Human
gaucuccauggcuuccucc

SEQ ID NO: 3753921 - RNA, 15 nt, Human
gaucucccagggcua

SEQ ID NO: 3753922 - RNA, 15 nt, Human
gaucucccugagaug

SEQ ID NO: 3753923 - RNA, 12 nt, Human
gaucucccugcc

SEQ ID NO: 3753924 - RNA, 14 nt, Human
gaucucccugccgc

SEQ ID NO: 3753925 - RNA, 14 nt, Human
gaucucucaggagc

SEQ ID NO: 3753926 - RNA, 14 nt, Human
gaucucuccuggcc

SEQ ID NO: 3753927 - RNA, 11 nt, Human
gaucucugaag

SEQ ID NO: 3753928 - RNA, 23 nt, Human
gaucucugcaggaaauggcugug

SEQ ID NO: 3753929 - RNA, 13 nt, Human
gaucucuuccugu

SEQ ID NO: 3753930 - RNA, 21 nt, Human
gaucucuucuuaauguacaua

SEQ ID NO: 3753931 - RNA, 12 nt, Human
gaucucuugagc

SEQ ID NO: 3753932 - RNA, 19 nt, Human
gaucugaacagaaauacca

SEQ ID NO: 3753933 - RNA, 19 nt, Human
gaucugacaugauuccuuc

SEQ ID NO: 3753934 - RNA, 14 nt, Human
gaucugacugcacg

SEQ ID NO: 3753935 - RNA, 22 nt, Human
gaucugagucagagccaugucu

SEQ ID NO: 3753936 - RNA, 17 nt, Human
gaucugaugcaagcaag

SEQ ID NO: 3753937 - RNA, 13 nt, Human
gaucugcccaucg

SEQ ID NO: 3753938 - RNA, 23 nt, Human
gaucugcccaucgugaagaagcc

SEQ ID NO: 3753939 - RNA, 13 nt, Human
gaucugccccucc

SEQ ID NO: 3753940 - RNA, 21 nt, Human
gaucugccuaaggacuucuuu

SEQ ID NO: 3753941 - RNA, 14 nt, Human
gaucugcucagccc

SEQ ID NO: 3753942 - RNA, 16 nt, Human
gaucugcucagcccug

SEQ ID NO: 3753943 - RNA, 21 nt, Human
gaucugcucagcccuggaggu

SEQ ID NO: 3753944 - RNA, 12 nt, Human
gaucugcugcag

SEQ ID NO: 3753945 - RNA, 18 nt, Human
gaucugcugcagagcagu

SEQ ID NO: 3753946 - RNA, 15 nt, Human
gaucuggaacccaga

SEQ ID NO: 3753947 - RNA, 17 nt, Human
gaucuggaaccucagcc

SEQ ID NO: 3753948 - RNA, 21 nt, Human
gaucuggaaccucagccuggc

SEQ ID NO: 3753949 - RNA, 17 nt, Human
gaucuggaagggccaag

SEQ ID NO: 3753950 - RNA, 17 nt, Human
gaucugggacccuuucc

SEQ ID NO: 3753951 - RNA, 23 nt, Human
gaucugggacccuuuccuuccuu

SEQ ID NO: 3753952 - RNA, 17 nt, Human
gaucuggggcucuggga

SEQ ID NO: 3753953 - RNA, 18 nt, Human
gaucuggggcucugggau

SEQ ID NO: 3753954 - RNA, 16 nt, Human
gaucugggucucuaau

SEQ ID NO: 3753955 - RNA, 15 nt, Human
gaucugguccuaccc

SEQ ID NO: 3753956 - RNA, 14 nt, Human
gaucugguggucag

SEQ ID NO: 3753957 - RNA, 16 nt, Human
gaucugguuugacucc

SEQ ID NO: 3753958 - RNA, 20 nt, Human
gaucuguauauacaauaaca

SEQ ID NO: 3753959 - RNA, 19 nt, Human
gaucugucacaccagccau

SEQ ID NO: 3753960 - RNA, 20 nt, Human
gaucugucacaccagccaua

SEQ ID NO: 3753961 - RNA, 13 nt, Human
gaucugucugugg

SEQ ID NO: 3753962 - RNA, 21 nt, Human
gaucugugauaguucaccccc

SEQ ID NO: 3753963 - RNA, 13 nt, Human
gaucugugcccca

SEQ ID NO: 3753964 - RNA, 22 nt, Human
gaucugugccuuuuuuauaucu

SEQ ID NO: 3753965 - RNA, 18 nt, Human
gaucugugcuuuccagcu

SEQ ID NO: 3753966 - RNA, 21 nt, Human
gaucuguugcaaacucagccu

SEQ ID NO: 3753967 - RNA, 19 nt, Human
gaucuguuuugaaggcaaa

SEQ ID NO: 3753968 - RNA, 22 nt, Human
gaucuguuuugugguuuggaau

SEQ ID NO: 3753969 - RNA, 21 nt, Human
gaucuguuuuuaaaaaucaua

SEQ ID NO: 3753970 - RNA, 13 nt, Human
gaucuuagauucu

SEQ ID NO: 3753971 - RNA, 14 nt, Human
gaucuuauuuuucu

SEQ ID NO: 3753972 - RNA, 19 nt, Human
gaucuucaaaaguaaugcc

SEQ ID NO: 3753973 - RNA, 12 nt, Human
gaucuucugaaa

SEQ ID NO: 3753974 - RNA, 15 nt, Human
gaucuucugaaauga

SEQ ID NO: 3753975 - RNA, 16 nt, Human
gaucuucugaaaugaa

SEQ ID NO: 3753976 - RNA, 20 nt, Human
gaucuucugggagcaggaac

SEQ ID NO: 3753977 - RNA, 13 nt, Human
gaucuugaaugug

SEQ ID NO: 3753978 - RNA, 16 nt, Human
gaucuugugacauauu

SEQ ID NO: 3753979 - RNA, 12 nt, Human
gaucuuucagaa

SEQ ID NO: 3753980 - RNA, 16 nt, Human
gaucuuugcagacagg

SEQ ID NO: 3753981 - RNA, 18 nt, Human
gaucuuugcagacaggca

SEQ ID NO: 3753982 - RNA, 21 nt, Human
gaucuuuggacagaagcagcu

SEQ ID NO: 3753983 - RNA, 15 nt, Human
gaucuuuuguuccca

SEQ ID NO: 3753984 - RNA, 14 nt, Human
gaucuuuuuuguca

SEQ ID NO: 3753985 - RNA, 15 nt, Human
gaugaaaaaauaaca

SEQ ID NO: 3753986 - RNA, 16 nt, Human
gaugaaaaagcaugua

SEQ ID NO: 3753987 - RNA, 17 nt, Human
gaugaaaaagcauguac

SEQ ID NO: 3753988 - RNA, 20 nt, Human
gaugaaaaagcauguacagu

SEQ ID NO: 3753989 - RNA, 14 nt, Human
gaugaaaaauagca

SEQ ID NO: 3753990 - RNA, 13 nt, Human
gaugaaaagauuu

SEQ ID NO: 3753991 - RNA, 11 nt, Human
gaugaaaauaa

SEQ ID NO: 3753992 - RNA, 14 nt, Human
gaugaaaauaaaga

SEQ ID NO: 3753993 - RNA, 14 nt, Human
gaugaaaauauuua

SEQ ID NO: 3753994 - RNA, 15 nt, Human
gaugaaaugagguca

SEQ ID NO: 3753995 - RNA, 14 nt, Human
gaugaacaucuaac

SEQ ID NO: 3753996 - RNA, 22 nt, Human
gaugaacccaggacgcuucuga

SEQ ID NO: 3753997 - RNA, 18 nt, Human
gaugaacucugaacuuug

SEQ ID NO: 3753998 - RNA, 18 nt, Human
gaugaacucuuagaaaug

SEQ ID NO: 3753999 - RNA, 13 nt, Human
gaugaacuuucuc

SEQ ID NO: 3754000 - RNA, 18 nt, Human
gaugaaggucuguuuugu

SEQ ID NO: 3754001 - RNA, 22 nt, Human
gaugaaguuuguaguuguuuua

SEQ ID NO: 3754002 - RNA, 18 nt, Human
gaucuucugaaaugaaac

SEQ ID NO: 3754003 - RNA, 19 nt, Human
gaucuucuuuauaauucua

SEQ ID NO: 3754004 - RNA, 15 nt, Human
gaucuugcagaaguu

SEQ ID NO: 3754005 - RNA, 13 nt, Human
gaucuuuaaaaua

SEQ ID NO: 3754006 - RNA, 21 nt, Human
gaucuuucacccacagaaaga

SEQ ID NO: 3754007 - RNA, 22 nt, Human
gaucuuucacccacagaaagag

SEQ ID NO: 3754008 - RNA, 18 nt, Human
gaucuuucagaaauauaa

SEQ ID NO: 3754009 - RNA, 15 nt, Human
gaucuuucaggaaag

SEQ ID NO: 3754010 - RNA, 17 nt, Human
gaucuuuuaaaguguua

SEQ ID NO: 3754011 - RNA, 15 nt, Human
gaucuuuuauuuugc

SEQ ID NO: 3754012 - RNA, 15 nt, Human
gaugaaaaagcaugu

SEQ ID NO: 3754013 - RNA, 18 nt, Human
gaugaaaaagcauguaca

SEQ ID NO: 3754014 - RNA, 22 nt, Human
gaugaaaaagcauguacagugu

SEQ ID NO: 3754015 - RNA, 20 nt, Human
gaugaaaaauugcugacugu

SEQ ID NO: 3754016 - RNA, 14 nt, Human
gaugaaaacauagc

SEQ ID NO: 3754017 - RNA, 21 nt, Human
gaugaaaaccuacauauucca

SEQ ID NO: 3754018 - RNA, 23 nt, Human
gaugaaaaguauauugauaaccu

SEQ ID NO: 3754019 - RNA, 19 nt, Human
gaugaaaauaaagaaugga

SEQ ID NO: 3754020 - RNA, 14 nt, Human
gaugaaaauauuug

SEQ ID NO: 3754021 - RNA, 15 nt, Human
gaugaaaauuugaga

SEQ ID NO: 3754022 - RNA, 16 nt, Human
gaugaaacuaaagcaa

SEQ ID NO: 3754023 - RNA, 18 nt, Human
gaugaaauaacuccuucu

SEQ ID NO: 3754024 - RNA, 20 nt, Human
gaugaaaucuuacagcuggg

SEQ ID NO: 3754025 - RNA, 21 nt, Human
gaugaaaugaggucagagccu

SEQ ID NO: 3754026 - RNA, 13 nt, Human
gaugaacccagga

SEQ ID NO: 3754027 - RNA, 22 nt, Human
gaugaacucuuagaaaugaagg

SEQ ID NO: 3754028 - RNA, 20 nt, Human
gaugaagaaaagugggccag

SEQ ID NO: 3754029 - RNA, 14 nt, Human
gaugaagacagccc

SEQ ID NO: 3754030 - RNA, 21 nt, Human
gaugaagagagagagggccug

SEQ ID NO: 3754031 - RNA, 14 nt, Human
gaugaagagugaga

SEQ ID NO: 3754032 - RNA, 16 nt, Human
gaugaagcaaacacau

SEQ ID NO: 3754033 - RNA, 22 nt, Human
gaugaaguuuuacauuguugag

SEQ ID NO: 3754034 - RNA, 22 nt, Human
gaugaauaaauguuauagcugc

SEQ ID NO: 3754035 - RNA, 19 nt, Human
gaugaaucucccacuccag

SEQ ID NO: 3754036 - RNA, 19 nt, Human
gaugaaugaggucccaggc

SEQ ID NO: 3754037 - RNA, 15 nt, Human
gaugaaugauaaacu

SEQ ID NO: 3754038 - RNA, 16 nt, Human
gaugaauuaaauuuaa

SEQ ID NO: 3754039 - RNA, 22 nt, Human
gaugaauuguaaaagcaacauc

SEQ ID NO: 3754040 - RNA, 19 nt, Human
gaugacaaauggagaagaa

SEQ ID NO: 3754041 - RNA, 17 nt, Human
gaugacaagaugguaca

SEQ ID NO: 3754042 - RNA, 20 nt, Human
gaugacaugcacucagcucu

SEQ ID NO: 3754043 - RNA, 23 nt, Human
gaugacauucuggucucgucuuc

SEQ ID NO: 3754044 - RNA, 14 nt, Human
gaugaccacuuuuu

SEQ ID NO: 3754045 - RNA, 13 nt, Human
gaugaccagaaca

SEQ ID NO: 3754046 - RNA, 13 nt, Human
gaugacccaggcu

SEQ ID NO: 3754047 - RNA, 21 nt, Human
gaugacccaggcugccugagc

SEQ ID NO: 3754048 - RNA, 20 nt, Human
gaugacgguauuaugcuucu

SEQ ID NO: 3754049 - RNA, 21 nt, Human
gaugacgguauuaugcuucuu

SEQ ID NO: 3754050 - RNA, 18 nt, Human
gaugacuaaaauauuuau

SEQ ID NO: 3754051 - RNA, 14 nt, Human
gaugacuauggaaa

SEQ ID NO: 3754052 - RNA, 18 nt, Human
gaugacucccuuaaaaua

SEQ ID NO: 3754053 - RNA, 21 nt, Human
gaugacucccuuaaaauagaa

SEQ ID NO: 3754054 - RNA, 17 nt, Human
gaugacugaguccucgu

SEQ ID NO: 3754055 - RNA, 17 nt, Human
gaugacuggcauuuuau

SEQ ID NO: 3754056 - RNA, 18 nt, Human
gaugacuuaguacaaagu

SEQ ID NO: 3754057 - RNA, 14 nt, Human
gaugagaagagggg

SEQ ID NO: 3754058 - RNA, 21 nt, Human
gaugagaguuuuggaugcagu

SEQ ID NO: 3754059 - RNA, 17 nt, Human
gaugagcauggagcugg

SEQ ID NO: 3754060 - RNA, 18 nt, Human
gaugagcauuuagggcaa

SEQ ID NO: 3754061 - RNA, 20 nt, Human
gaugagcccagcccuguucu

SEQ ID NO: 3754062 - RNA, 21 nt, Human
gaugagcccagcccuguucug

SEQ ID NO: 3754063 - RNA, 23 nt, Human
gaugagccgcugugagccccugg

SEQ ID NO: 3754064 - RNA, 12 nt, Human
gaugagcuccca

SEQ ID NO: 3754065 - RNA, 23 nt, Human
gaugagcucccacaagccugagg

SEQ ID NO: 3754066 - RNA, 11 nt, Human
gaugagcucua

SEQ ID NO: 3754067 - RNA, 19 nt, Human
gaugagcucuacccagggc

SEQ ID NO: 3754068 - RNA, 15 nt, Human
gaugaggccagacca

SEQ ID NO: 3754069 - RNA, 20 nt, Human
gaugaggcccuccacaccug

SEQ ID NO: 3754070 - RNA, 22 nt, Human
gaugaggcccuccacaccugcg

SEQ ID NO: 3754071 - RNA, 21 nt, Human
gaugaggccgcuagaggccug

SEQ ID NO: 3754072 - RNA, 21 nt, Human
gaugagggaaaagaaaaagau

SEQ ID NO: 3754073 - RNA, 19 nt, Human
gaugagggaugggccuggc

SEQ ID NO: 3754074 - RNA, 21 nt, Human
gaugagggcagcagccagccc

SEQ ID NO: 3754075 - RNA, 17 nt, Human
gaugaguguaacaagaa

SEQ ID NO: 3754076 - RNA, 19 nt, Human
gaugauaaagagacaguga

SEQ ID NO: 3754077 - RNA, 19 nt, Human
gaugauaaugaugaugacg

SEQ ID NO: 3754078 - RNA, 21 nt, Human
gaugauacaagauuagaagcu

SEQ ID NO: 3754079 - RNA, 20 nt, Human
gaugaucaauuauaguuucu

SEQ ID NO: 3754080 - RNA, 15 nt, Human
gaugaucuaggaaga

SEQ ID NO: 3754081 - RNA, 21 nt, Human
gaugaucuaggaagacuuugg

SEQ ID NO: 3754082 - RNA, 21 nt, Human
gaugaucuuugcagacaggca

SEQ ID NO: 3754083 - RNA, 19 nt, Human
gaugaugagaauuucuaaa

SEQ ID NO: 3754084 - RNA, 23 nt, Human
gaugaugauaaugaugaugacga

SEQ ID NO: 3754085 - RNA, 13 nt, Human
gaugaugccacac

SEQ ID NO: 3754086 - RNA, 19 nt, Human
gaugaugggaauuguguga

SEQ ID NO: 3754087 - RNA, 17 nt, Human
gaugaugugccugggug

SEQ ID NO: 3754088 - RNA, 13 nt, Human
gaugauguguaua

SEQ ID NO: 3754089 - RNA, 23 nt, Human
gaugauuaaauaagauucuaacg

SEQ ID NO: 3754090 - RNA, 18 nt, Human
gaugauuaauucaccuuc

SEQ ID NO: 3754091 - RNA, 16 nt, Human
gaugauucaagccauu

SEQ ID NO: 3754092 - RNA, 15 nt, Human
gaugauucagaaauu

SEQ ID NO: 3754093 - RNA, 22 nt, Human
gaugauuggaggggggaggugg

SEQ ID NO: 3754094 - RNA, 14 nt, Human
gaugauuucagaaa

SEQ ID NO: 3754095 - RNA, 23 nt, Human
gaugauuucuaugcugaguuugu

SEQ ID NO: 3754096 - RNA, 13 nt, Human
gaugauuugcaau

SEQ ID NO: 3754097 - RNA, 14 nt, Human
gaugcaaagaggca

SEQ ID NO: 3754098 - RNA, 18 nt, Human
gaugcaaaguacaaugug

SEQ ID NO: 3754099 - RNA, 17 nt, Human
gaugcaagauauuuaua

SEQ ID NO: 3754100 - RNA, 18 nt, Human
gaugcaauccuuacaaau

SEQ ID NO: 3754101 - RNA, 20 nt, Human
gaugcaauccuuacaaauga

SEQ ID NO: 3754102 - RNA, 18 nt, Human
gaugcaaugugcuacuga

SEQ ID NO: 3754103 - RNA, 13 nt, Human
gaugcacagagaa

SEQ ID NO: 3754104 - RNA, 15 nt, Human
gaugcacagagaagc

SEQ ID NO: 3754105 - RNA, 21 nt, Human
gaugcacagagaagcugggga

SEQ ID NO: 3754106 - RNA, 16 nt, Human
gaugcacaucccugga

SEQ ID NO: 3754107 - RNA, 21 nt, Human
gaugcacuuugcuuuaauaua

SEQ ID NO: 3754108 - RNA, 21 nt, Human
gaugcagacagggggccagaa

SEQ ID NO: 3754109 - RNA, 23 nt, Human
gaugcagagagccauuuugugaa

SEQ ID NO: 3754110 - RNA, 14 nt, Human
gaugcagcucaaga

SEQ ID NO: 3754111 - RNA, 22 nt, Human
gaugcaggauuuguucucuguc

SEQ ID NO: 3754112 - RNA, 20 nt, Human
gaugcaggcuccccugagga

SEQ ID NO: 3754113 - RNA, 13 nt, Human
gaugcagucuccu

SEQ ID NO: 3754114 - RNA, 22 nt, Human
gaugcagugcucgcuguugcug

SEQ ID NO: 3754115 - RNA, 18 nt, Human
gaugcaguucugaagaag

SEQ ID NO: 3754116 - RNA, 20 nt, Human
gaugcaucagaaagggaggg

SEQ ID NO: 3754117 - RNA, 20 nt, Human
gaugcauggagauagcccca

SEQ ID NO: 3754118 - RNA, 17 nt, Human
gaugcauguacccuaag

SEQ ID NO: 3754119 - RNA, 22 nt, Human
gaugcaugugguuugguuccuc

SEQ ID NO: 3754120 - RNA, 16 nt, Human
gaugcauuaaaagaaa

SEQ ID NO: 3754121 - RNA, 21 nt, Human
gaugcauucuugguuggcugg

SEQ ID NO: 3754122 - RNA, 20 nt, Human
gaugcauuguaguuuaacca

SEQ ID NO: 3754123 - RNA, 19 nt, Human
gaugcauuuggguccagga

SEQ ID NO: 3754124 - RNA, 20 nt, Human
gaugcauuuggguccaggag

SEQ ID NO: 3754125 - RNA, 19 nt, Human
gaugccaauauuaaaucug

SEQ ID NO: 3754126 - RNA, 15 nt, Human
gaugccacacaagga

SEQ ID NO: 3754127 - RNA, 19 nt, Human
gaugccacaccaagcugug

SEQ ID NO: 3754128 - RNA, 22 nt, Human
gaugccacaccaagcugugcca

SEQ ID NO: 3754129 - RNA, 22 nt, Human
gaugccacuaccccuugauuuu

SEQ ID NO: 3754130 - RNA, 18 nt, Human
gaugccacuccucccucc

SEQ ID NO: 3754131 - RNA, 17 nt, Human
gaugccagggccgacca

SEQ ID NO: 3754132 - RNA, 16 nt, Human
gaugccaucugugucc

SEQ ID NO: 3754133 - RNA, 17 nt, Human
gaugccaucuguguccu

SEQ ID NO: 3754134 - RNA, 15 nt, Human
gaugccauuacauuu

SEQ ID NO: 3754135 - RNA, 15 nt, Human
gaugcccacugagga

SEQ ID NO: 3754136 - RNA, 20 nt, Human
gaugcccagagggcccaggc

SEQ ID NO: 3754137 - RNA, 12 nt, Human
gaugccccagag

SEQ ID NO: 3754138 - RNA, 23 nt, Human
gaugcccccuaauccccuucucc

SEQ ID NO: 3754139 - RNA, 21 nt, Human
gaugccccgucccccucuggc

SEQ ID NO: 3754140 - RNA, 18 nt, Human
gaugccgagguaaaaguu

SEQ ID NO: 3754141 - RNA, 20 nt, Human
gaugccuccaccgcugccua

SEQ ID NO: 3754142 - RNA, 22 nt, Human
gaugccugauugccaagcucag

SEQ ID NO: 3754143 - RNA, 16 nt, Human
gaugccuggcggggug

SEQ ID NO: 3754144 - RNA, 18 nt, Human
gaugccugguggcagcug

SEQ ID NO: 3754145 - RNA, 19 nt, Human
gaugcgcagccccaucugu

SEQ ID NO: 3754146 - RNA, 14 nt, Human
gaugcgcagugccu

SEQ ID NO: 3754147 - RNA, 13 nt, Human
gaugcggccaaga

SEQ ID NO: 3754148 - RNA, 18 nt, Human
gaugcgggcauggcagcc

SEQ ID NO: 3754149 - RNA, 21 nt, Human
cugaagcaaggcgguggacuu

SEQ ID NO: 3754150 - RNA, 14 nt, Human
cugaagcagccucu

SEQ ID NO: 3754151 - RNA, 20 nt, Human
cugaagcagccucuccccag

SEQ ID NO: 3754152 - RNA, 20 nt, Human
cugaagcagguucccaagcu

SEQ ID NO: 3754153 - RNA, 23 nt, Human
cugaagcauguuucauguuuugu

SEQ ID NO: 3754154 - RNA, 13 nt, Human
cugaagcccuugu

SEQ ID NO: 3754155 - RNA, 15 nt, Human
cugaagccucuggga

SEQ ID NO: 3754156 - RNA, 13 nt, Human
cugaagccugcag

SEQ ID NO: 3754157 - RNA, 15 nt, Human
cugaagccugcagga

SEQ ID NO: 3754158 - RNA, 15 nt, Human
cugaagcucccacag

SEQ ID NO: 3754159 - RNA, 12 nt, Human
cugaagcugagg

SEQ ID NO: 3754160 - RNA, 12 nt, Human
cugaagcuuauu

SEQ ID NO: 3754161 - RNA, 16 nt, Human
cugaagcuuauuaaug

SEQ ID NO: 3754162 - RNA, 20 nt, Human
cugaagcuuauuaaugcuaa

SEQ ID NO: 3754163 - RNA, 14 nt, Human
cugaagcuugacuc

SEQ ID NO: 3754164 - RNA, 21 nt, Human
cugaagcuugacucccaaguu

SEQ ID NO: 3754165 - RNA, 16 nt, Human
cugaaggaaaaacaca

SEQ ID NO: 3754166 - RNA, 21 nt, Human
cugaaggaaaaacacaagcaa

SEQ ID NO: 3754167 - RNA, 13 nt, Human
cugaaggacugug

SEQ ID NO: 3754168 - RNA, 22 nt, Human
cugaaggacugugacaggcagc

SEQ ID NO: 3754169 - RNA, 23 nt, Human
cugaaggacugugacaggcagca

SEQ ID NO: 3754170 - RNA, 12 nt, Human
cugaaggagauu

SEQ ID NO: 3754171 - RNA, 19 nt, Human
cugaaggaggccaccuccu

SEQ ID NO: 3754172 - RNA, 18 nt, Human
cugaaggccccgcccagg

SEQ ID NO: 3754173 - RNA, 19 nt, Human
cugaaggccccgcccaggc

SEQ ID NO: 3754174 - RNA, 21 nt, Human
cugaaggccccgcccaggcuu

SEQ ID NO: 3754175 - RNA, 23 nt, Human
cugaaggcuuucagggccuccag

SEQ ID NO: 3754176 - RNA, 15 nt, Human
cugaaggcuuuguga

SEQ ID NO: 3754177 - RNA, 19 nt, Human
cugaagggauaugugaaac

SEQ ID NO: 3754178 - RNA, 22 nt, Human
cugaaggggaaggaaauagcuu

SEQ ID NO: 3754179 - RNA, 15 nt, Human
cugaaggggccauga

SEQ ID NO: 3754180 - RNA, 19 nt, Human
cugaagggguuuucuugau

SEQ ID NO: 3754181 - RNA, 22 nt, Human
cugaagguggccacuuuaagag

SEQ ID NO: 3754182 - RNA, 19 nt, Human
cugaagucacacagugagu

SEQ ID NO: 3754183 - RNA, 17 nt, Human
cugaagucacugcacag

SEQ ID NO: 3754184 - RNA, 15 nt, Human
cugaagucagaucug

SEQ ID NO: 3754185 - RNA, 14 nt, Human
cugaagucugaaau

SEQ ID NO: 3754186 - RNA, 24 nt, Human
cugaagucuuuguacagacaacaa

SEQ ID NO: 3754187 - RNA, 17 nt, Human
cugaagugaaacugcuu

SEQ ID NO: 3754188 - RNA, 19 nt, Human
cugaagugagcacagccua

SEQ ID NO: 3754189 - RNA, 21 nt, Human
cugaagugagcacagccuagg

SEQ ID NO: 3754190 - RNA, 18 nt, Human
cugaagugcauccaaagg

SEQ ID NO: 3754191 - RNA, 23 nt, Human
cugaaguggacucuuugguggcu

SEQ ID NO: 3754192 - RNA, 14 nt, Human
cugaaguuauauuu

SEQ ID NO: 3754193 - RNA, 14 nt, Human
cugaaguuaugugu

SEQ ID NO: 3754194 - RNA, 17 nt, Human
cugaaguugcagauguu

SEQ ID NO: 3754195 - RNA, 14 nt, Human
cugaaguuggacag

SEQ ID NO: 3754196 - RNA, 15 nt, Human
cugaaguuucauuua

SEQ ID NO: 3754197 - RNA, 17 nt, Human
cugaaguuuuuuugcug

SEQ ID NO: 3754198 - RNA, 23 nt, Human
cugaaguuuuuuugcugcugccu

SEQ ID NO: 3754199 - RNA, 15 nt, Human
cugaauaaagcaauu

SEQ ID NO: 3754200 - RNA, 21 nt, Human
cugaauaaauaccucuuagcu

SEQ ID NO: 3754201 - RNA, 21 nt, Human
cugaauaaauuguacagccgg

SEQ ID NO: 3754202 - RNA, 18 nt, Human
cugaauaagcacuuuuua

SEQ ID NO: 3754203 - RNA, 13 nt, Human
cugaauaauuucu

SEQ ID NO: 3754204 - RNA, 15 nt, Human
cugaauaauuucuua

SEQ ID NO: 3754205 - RNA, 16 nt, Human
cugaauaauuucuuac

SEQ ID NO: 3754206 - RNA, 16 nt, Human
cugaauacauucugcu

SEQ ID NO: 3754207 - RNA, 23 nt, Human
cugaauaccacucuguaauugca

SEQ ID NO: 3754208 - RNA, 17 nt, Human
cugaauacccuuuucug

SEQ ID NO: 3754209 - RNA, 16 nt, Human
cugaauagaaauggga

SEQ ID NO: 3754210 - RNA, 19 nt, Human
cugaauagucuucagagau

SEQ ID NO: 3754211 - RNA, 21 nt, Human
cugaauaugaacggugagcau

SEQ ID NO: 3754212 - RNA, 20 nt, Human
cugaauauuuauauuucacu

SEQ ID NO: 3754213 - RNA, 18 nt, Human
cugaauauuuuuugaggc

SEQ ID NO: 3754214 - RNA, 13 nt, Human
cugaaucaugagc

SEQ ID NO: 3754215 - RNA, 20 nt, Human
cugaaucaugagccugcugg

SEQ ID NO: 3754216 - RNA, 21 nt, Human
cugaaucaugagccugcugga

SEQ ID NO: 3754217 - RNA, 20 nt, Human
cugaauccaaacuaauccau

SEQ ID NO: 3754218 - RNA, 13 nt, Human
cugaaucccugua

SEQ ID NO: 3754219 - RNA, 22 nt, Human
cugaaucugcuaccaaaacagu

SEQ ID NO: 3754220 - RNA, 12 nt, Human
cugaaucuguac

SEQ ID NO: 3754221 - RNA, 20 nt, Human
cugaaugaaacccccacaca

SEQ ID NO: 3754222 - RNA, 22 nt, Human
cugaaugaaacccccacacaca

SEQ ID NO: 3754223 - RNA, 23 nt, Human
cugaaugaaacccccacacacac

SEQ ID NO: 3754224 - RNA, 17 nt, Human
cugaaugaaauaucaga

SEQ ID NO: 3754225 - RNA, 22 nt, Human
cugaaugaacaaccucggcucc

SEQ ID NO: 3754226 - RNA, 22 nt, Human
cugaaugccgcgaugggucagg

SEQ ID NO: 3754227 - RNA, 23 nt, Human
cugaaugccucaaugugaccagg

SEQ ID NO: 3754228 - RNA, 12 nt, Human
cugaaugcucug

SEQ ID NO: 3754229 - RNA, 22 nt, Human
cugaaugcuuauagguggccuc

SEQ ID NO: 3754230 - RNA, 14 nt, Human
cugaaugcuucuaa

SEQ ID NO: 3754231 - RNA, 20 nt, Human
cugaaugcuucuaaguaaau

SEQ ID NO: 3754232 - RNA, 15 nt, Human
cugaaugguccaggg

SEQ ID NO: 3754233 - RNA, 18 nt, Human
cugaaugguccaggguug

SEQ ID NO: 3754234 - RNA, 19 nt, Human
cugaaugguuuucaaaaua

SEQ ID NO: 3754235 - RNA, 14 nt, Human
cugaauguaauuug

SEQ ID NO: 3754236 - RNA, 17 nt, Human
cugaauguaauuugugu

SEQ ID NO: 3754237 - RNA, 22 nt, Human
cugaauguaauuuguguaauaa

SEQ ID NO: 3754238 - RNA, 13 nt, Human
cugaauguaugua

SEQ ID NO: 3754239 - RNA, 17 nt, Human
cugaaugugcugaucau

SEQ ID NO: 3754240 - RNA, 12 nt, Human
cugaauguucug

SEQ ID NO: 3754241 - RNA, 18 nt, Human
cugaauguucugacauua

SEQ ID NO: 3754242 - RNA, 20 nt, Human
cugaauguucugacauuaac

SEQ ID NO: 3754243 - RNA, 22 nt, Human
cugaauguuuaaagaucaugac

SEQ ID NO: 3754244 - RNA, 16 nt, Human
cugaauguuuauuccu

SEQ ID NO: 3754245 - RNA, 18 nt, Human
cugaauguuuuucuaaag

SEQ ID NO: 3754246 - RNA, 20 nt, Human
cugaauguuuuucuaaagga

SEQ ID NO: 3754247 - RNA, 23 nt, Human
cugaauguuuuucuaaaggaguu

SEQ ID NO: 3754248 - RNA, 22 nt, Human
cugaauuaaugacagagccagu

SEQ ID NO: 3754249 - RNA, 14 nt, Human
cugaauuaauuaau

SEQ ID NO: 3754250 - RNA, 17 nt, Human
cugaauuaucuauuuca

SEQ ID NO: 3754251 - RNA, 15 nt, Human
cugaauuaugaaacu

SEQ ID NO: 3754252 - RNA, 16 nt, Human
cugaauuaugaaacuu

SEQ ID NO: 3754253 - RNA, 16 nt, Human
cugaauucuauuugcu

SEQ ID NO: 3754254 - RNA, 20 nt, Human
cugaauugagccuaaaaaua

SEQ ID NO: 3754255 - RNA, 21 nt, Human
cugaauugagccuaaaaauaa

SEQ ID NO: 3754256 - RNA, 22 nt, Human
cugaauugagccuaaaaauaaa

SEQ ID NO: 3754257 - RNA, 15 nt, Human
cugaauuguccccag

SEQ ID NO: 3754258 - RNA, 17 nt, Human
cugaauuuaucuuugau

SEQ ID NO: 3754259 - RNA, 11 nt, Human
cugaauuuuua

SEQ ID NO: 3754260 - RNA, 19 nt, Human
cugaauuuuuuuguaauaa

SEQ ID NO: 3754261 - RNA, 20 nt, Human
cugaauuuuuuuguaauaag

SEQ ID NO: 3754262 - RNA, 23 nt, Human
cugacaaaucaaguuuccaagca

SEQ ID NO: 3754263 - RNA, 19 nt, Human
cugacaacagacuucugaa

SEQ ID NO: 3754264 - RNA, 13 nt, Human
cugacaacuugaa

SEQ ID NO: 3754265 - RNA, 23 nt, Human
cugacaagauuauaauauuuuaa

SEQ ID NO: 3754266 - RNA, 14 nt, Human
cugacaagccaucu

SEQ ID NO: 3754267 - RNA, 14 nt, Human
cugacaagggcuga

SEQ ID NO: 3754268 - RNA, 21 nt, Human
cugacaaucaacucuaauagu

SEQ ID NO: 3754269 - RNA, 18 nt, Human
cugacacaaaaaaaguug

SEQ ID NO: 3754270 - RNA, 18 nt, Human
cugacacaaaaaguagau

SEQ ID NO: 3754271 - RNA, 14 nt, Human
cugacacaaaccug

SEQ ID NO: 3754272 - RNA, 20 nt, Human
cugacacaaaccugccuggg

SEQ ID NO: 3754273 - RNA, 13 nt, Human
cugacacacagcu

SEQ ID NO: 3754274 - RNA, 15 nt, Human
cugacacacagcucu

SEQ ID NO: 3754275 - RNA, 17 nt, Human
cugacacacagcucugu

SEQ ID NO: 3754276 - RNA, 22 nt, Human
cugacacacagcucuguccugg

SEQ ID NO: 3754277 - RNA, 14 nt, Human
cugacacaccaggc

SEQ ID NO: 3754278 - RNA, 19 nt, Human
cugacacaccaggcgcuaa

SEQ ID NO: 3754279 - RNA, 23 nt, Human
cugacacaccaggcgcuaauuca

SEQ ID NO: 3754280 - RNA, 23 nt, Human
cugacacaccugcagccucccuc

SEQ ID NO: 3754281 - RNA, 16 nt, Human
cugacacacuaaccaa

SEQ ID NO: 3754282 - RNA, 19 nt, Human
cugacacacuaaccaagcu

SEQ ID NO: 3754283 - RNA, 17 nt, Human
cugacaccccacuuagc

SEQ ID NO: 3754284 - RNA, 18 nt, Human
cugacaccccacuuagcc

SEQ ID NO: 3754285 - RNA, 17 nt, Human
cugacacguccacccca

SEQ ID NO: 3754286 - RNA, 17 nt, Human
cugacacucccuugggc

SEQ ID NO: 3754287 - RNA, 22 nt, Human
cugacacugguauuccugccuc

SEQ ID NO: 3754288 - RNA, 14 nt, Human
cugacagaaagcag

SEQ ID NO: 3754289 - RNA, 16 nt, Human
cugacagaaggugcca

SEQ ID NO: 3754290 - RNA, 15 nt, Human
cugacagacacaggc

SEQ ID NO: 3754291 - RNA, 19 nt, Human
cugacagacagcccuccau

SEQ ID NO: 3754292 - RNA, 16 nt, Human
cugacagagggaugga

SEQ ID NO: 3754293 - RNA, 11 nt, Human
cugacagauuu

SEQ ID NO: 3754294 - RNA, 15 nt, Human
cugacagcagcaucu

SEQ ID NO: 3754295 - RNA, 15 nt, Human
cugacagcaugugcc

SEQ ID NO: 3754296 - RNA, 18 nt, Human
cugacagcaugugcccuc

SEQ ID NO: 3754297 - RNA, 20 nt, Human
cugacagcaugugcccuccu

SEQ ID NO: 3754298 - RNA, 20 nt, Human
gaugaaucacuguuuuuaga

SEQ ID NO: 3754299 - RNA, 13 nt, Human
gaugaaucuugcg

SEQ ID NO: 3754300 - RNA, 20 nt, Human
gaugaauuaggggacacugu

SEQ ID NO: 3754301 - RNA, 22 nt, Human
gaugaauugcguuggucucugc

SEQ ID NO: 3754302 - RNA, 20 nt, Human
gaugacaaaaauucaacuca

SEQ ID NO: 3754303 - RNA, 17 nt, Human
gaugacaacuucccagu

SEQ ID NO: 3754304 - RNA, 14 nt, Human
gaugacagagcgag

SEQ ID NO: 3754305 - RNA, 17 nt, Human
gaugacauucccugcua

SEQ ID NO: 3754306 - RNA, 17 nt, Human
gaugacauugacuauuu

SEQ ID NO: 3754307 - RNA, 14 nt, Human
gaugacauugcuaa

SEQ ID NO: 3754308 - RNA, 15 nt, Human
gaugacauugcuaag

SEQ ID NO: 3754309 - RNA, 21 nt, Human
gaugacauugcuaagaugcuc

SEQ ID NO: 3754310 - RNA, 17 nt, Human
gaugaccccuccccuaa

SEQ ID NO: 3754311 - RNA, 19 nt, Human
gaugaccuaaccuaagcaa

SEQ ID NO: 3754312 - RNA, 15 nt, Human
gaugacuagaggcag

SEQ ID NO: 3754313 - RNA, 16 nt, Human
gaugacucaagauucc

SEQ ID NO: 3754314 - RNA, 22 nt, Human
gaugacucaagauucccaggag

SEQ ID NO: 3754315 - RNA, 23 nt, Human
gaugacucaagauucccaggagu

SEQ ID NO: 3754316 - RNA, 17 nt, Human
gaugacuggaauuuuua

SEQ ID NO: 3754317 - RNA, 19 nt, Human
gaugacuggggugggaggu

SEQ ID NO: 3754318 - RNA, 15 nt, Human
gaugacuguuuuuaa

SEQ ID NO: 3754319 - RNA, 21 nt, Human
gaugacuucccaacugcaagu

SEQ ID NO: 3754320 - RNA, 23 nt, Human
gaugagaaauaaaguuucuguug

SEQ ID NO: 3754321 - RNA, 17 nt, Human
gaugagaacaaagcugu

SEQ ID NO: 3754322 - RNA, 20 nt, Human
gaugagaacagauaaagauu

SEQ ID NO: 3754323 - RNA, 18 nt, Human
gaugagaauucagcugcc

SEQ ID NO: 3754324 - RNA, 21 nt, Human
gaugagaauuucuaaaaagau

SEQ ID NO: 3754325 - RNA, 18 nt, Human
gaugagaguuuuggaugc

SEQ ID NO: 3754326 - RNA, 20 nt, Human
gaugagauuggcauggcuuu

SEQ ID NO: 3754327 - RNA, 16 nt, Human
gaugagcaucccagga

SEQ ID NO: 3754328 - RNA, 17 nt, Human
gaugagcaucccaggau

SEQ ID NO: 3754329 - RNA, 15 nt, Human
gaugagcauggagcu

SEQ ID NO: 3754330 - RNA, 15 nt, Human
gaugagcccucagaa

SEQ ID NO: 3754331 - RNA, 13 nt, Human
gaugagccgcugu

SEQ ID NO: 3754332 - RNA, 22 nt, Human
gaugagccuucgugcccccccu

SEQ ID NO: 3754333 - RNA, 21 nt, Human
gaugagcucccacaagccuga

SEQ ID NO: 3754334 - RNA, 16 nt, Human
gaugagcucuacccag

SEQ ID NO: 3754335 - RNA, 22 nt, Human
gaugaggaguaaaauucaguuu

SEQ ID NO: 3754336 - RNA, 15 nt, Human
gaugaggcccuccac

SEQ ID NO: 3754337 - RNA, 23 nt, Human
gaugaggccucuuggaccucugc

SEQ ID NO: 3754338 - RNA, 13 nt, Human
gaugagggcagca

SEQ ID NO: 3754339 - RNA, 16 nt, Human
gaugagggcagcagcc

SEQ ID NO: 3754340 - RNA, 14 nt, Human
gaugaggugcuggg

SEQ ID NO: 3754341 - RNA, 19 nt, Human
gaugaggugcugggaggga

SEQ ID NO: 3754342 - RNA, 19 nt, Human
gaugaguuuugggaaguua

SEQ ID NO: 3754343 - RNA, 16 nt, Human
gaugauaaacgacuuu

SEQ ID NO: 3754344 - RNA, 20 nt, Human
gaugauaaguuccuuuccuu

SEQ ID NO: 3754345 - RNA, 18 nt, Human
gaugauagaggauuuuau

SEQ ID NO: 3754346 - RNA, 22 nt, Human
gaugaucaauuauaguuucuga

SEQ ID NO: 3754347 - RNA, 23 nt, Human
gaugauccaugaguuugcccugg

SEQ ID NO: 3754348 - RNA, 16 nt, Human
gaugauccccacgcca

SEQ ID NO: 3754349 - RNA, 15 nt, Human
gaugaucuacucaga

SEQ ID NO: 3754350 - RNA, 15 nt, Human
gaugaugccacacca

SEQ ID NO: 3754351 - RNA, 14 nt, Human
gaugaugcugccag

SEQ ID NO: 3754352 - RNA, 22 nt, Human
gaugaugcuuguaacaagaaaa

SEQ ID NO: 3754353 - RNA, 15 nt, Human
gaugaugugccuggg

SEQ ID NO: 3754354 - RNA, 14 nt, Human
gaugauugaagaaa

SEQ ID NO: 3754355 - RNA, 15 nt, Human
gaugauugaagaaac

SEQ ID NO: 3754356 - RNA, 13 nt, Human
gaugauuguacag

SEQ ID NO: 3754357 - RNA, 14 nt, Human
gaugauuuaagugu

SEQ ID NO: 3754358 - RNA, 21 nt, Human
gaugcaaaguacaauguguuu

SEQ ID NO: 3754359 - RNA, 19 nt, Human
gaugcaauccuuacaaaug

SEQ ID NO: 3754360 - RNA, 13 nt, Human
gaugcaaugaaca

SEQ ID NO: 3754361 - RNA, 21 nt, Human
gaugcacagaguuguuacauu

SEQ ID NO: 3754362 - RNA, 22 nt, Human
gaugcacagaguuguuacauuu

SEQ ID NO: 3754363 - RNA, 14 nt, Human
gaugcaccagcccu

SEQ ID NO: 3754364 - RNA, 15 nt, Human
gaugcaccagcccuu

SEQ ID NO: 3754365 - RNA, 23 nt, Human
gaugcaccagcccuuagcaggga

SEQ ID NO: 3754366 - RNA, 20 nt, Human
gaugcagacagggggccaga

SEQ ID NO: 3754367 - RNA, 23 nt, Human
gaugcagacagggggccagaaca

SEQ ID NO: 3754368 - RNA, 17 nt, Human
gaugcagcaaaauguga

SEQ ID NO: 3754369 - RNA, 13 nt, Human
gaugcagcauuug

SEQ ID NO: 3754370 - RNA, 14 nt, Human
gaugcagccgccuu

SEQ ID NO: 3754371 - RNA, 22 nt, Human
gaugcagccgccuuccuugacc

SEQ ID NO: 3754372 - RNA, 15 nt, Human
gaugcagcuuauacg

SEQ ID NO: 3754373 - RNA, 17 nt, Human
gaugcaggcuccccuga

SEQ ID NO: 3754374 - RNA, 22 nt, Human
gaugcaggugagcccauggccc

SEQ ID NO: 3754375 - RNA, 14 nt, Human
gaugcagugcuucc

SEQ ID NO: 3754376 - RNA, 22 nt, Human
gaugcaucuaccgcucuuggga

SEQ ID NO: 3754377 - RNA, 13 nt, Human
gaugcauggagau

SEQ ID NO: 3754378 - RNA, 14 nt, Human
gaugcaugucuuuu

SEQ ID NO: 3754379 - RNA, 16 nt, Human
gaugcaugucuuuuaa

SEQ ID NO: 3754380 - RNA, 22 nt, Human
gaugcauuuggguccaggagga

SEQ ID NO: 3754381 - RNA, 19 nt, Human
gaugccaaaaaaaaauaca

SEQ ID NO: 3754382 - RNA, 20 nt, Human
gaugccaaguuguuugagaa

SEQ ID NO: 3754383 - RNA, 16 nt, Human
gaugccacaccaagcu

SEQ ID NO: 3754384 - RNA, 16 nt, Human
gaugccacccuagcca

SEQ ID NO: 3754385 - RNA, 15 nt, Human
gaugccacuccuccc

SEQ ID NO: 3754386 - RNA, 17 nt, Human
gaugccacuccucccuc

SEQ ID NO: 3754387 - RNA, 19 nt, Human
gaugccacuccucccuccg

SEQ ID NO: 3754388 - RNA, 15 nt, Human
gaugccagccaagcu

SEQ ID NO: 3754389 - RNA, 16 nt, Human
gaugccagggacccac

SEQ ID NO: 3754390 - RNA, 14 nt, Human
gaugccagguucua

SEQ ID NO: 3754391 - RNA, 22 nt, Human
gaugccagguucuauuuggaau

SEQ ID NO: 3754392 - RNA, 20 nt, Human
gaugccaucuguguccuggu

SEQ ID NO: 3754393 - RNA, 22 nt, Human
gaugccaugagccgcccaaggc

SEQ ID NO: 3754394 - RNA, 19 nt, Human
gaugcccaaagaugcagcc

SEQ ID NO: 3754395 - RNA, 20 nt, Human
gaugcccaaagaugcagccg

SEQ ID NO: 3754396 - RNA, 18 nt, Human
gaugcccagaggacuccc

SEQ ID NO: 3754397 - RNA, 18 nt, Human
gaugcccagagggcccag

SEQ ID NO: 3754398 - RNA, 13 nt, Human
gaugcccugcccu

SEQ ID NO: 3754399 - RNA, 12 nt, Human
gaugcccuggag

SEQ ID NO: 3754400 - RNA, 18 nt, Human
gaugcccuggagguggcu

SEQ ID NO: 3754401 - RNA, 19 nt, Human
gaugcccuggagguggcug

SEQ ID NO: 3754402 - RNA, 19 nt, Human
gaugccugguggcagcugc

SEQ ID NO: 3754403 - RNA, 20 nt, Human
gaugccugguggcagcugcg

SEQ ID NO: 3754404 - RNA, 18 nt, Human
gaugccuuuuuuguaguu

SEQ ID NO: 3754405 - RNA, 14 nt, Human
gaugcgcacugcau

SEQ ID NO: 3754406 - RNA, 16 nt, Human
gaugcgcagccccauc

SEQ ID NO: 3754407 - RNA, 13 nt, Human
gaugcuaaaaccu

SEQ ID NO: 3754408 - RNA, 21 nt, Human
gaugcuagcgcguugccuguc

SEQ ID NO: 3754409 - RNA, 16 nt, Human
gaugcuaucaguuuua

SEQ ID NO: 3754410 - RNA, 14 nt, Human
gaugcucaggcuug

SEQ ID NO: 3754411 - RNA, 21 nt, Human
gaugcucaggcuugaaaugca

SEQ ID NO: 3754412 - RNA, 19 nt, Human
gaugcucagguacagagaa

SEQ ID NO: 3754413 - RNA, 20 nt, Human
gaugcucagguacagagaag

SEQ ID NO: 3754414 - RNA, 19 nt, Human
gaugcucaguugcuaaaca

SEQ ID NO: 3754415 - RNA, 17 nt, Human
gaugcuccaagauucua

SEQ ID NO: 3754416 - RNA, 20 nt, Human
gaugcuccaagauucuagau

SEQ ID NO: 3754417 - RNA, 12 nt, Human
gaugcuccagcc

SEQ ID NO: 3754418 - RNA, 16 nt, Human
gaugcuccagccaacc

SEQ ID NO: 3754419 - RNA, 22 nt, Human
gaugcuccagccaaccccugug

SEQ ID NO: 3754420 - RNA, 23 nt, Human
gaugcuccagccaaccccugugg

SEQ ID NO: 3754421 - RNA, 13 nt, Human
gaugcucccuccc

SEQ ID NO: 3754422 - RNA, 15 nt, Human
gaugcucccuccccu

SEQ ID NO: 3754423 - RNA, 13 nt, Human
gaugcuccuuggg

SEQ ID NO: 3754424 - RNA, 14 nt, Human
gaugcuccuugggc

SEQ ID NO: 3754425 - RNA, 21 nt, Human
gaugcuccuugggcccuuuga

SEQ ID NO: 3754426 - RNA, 15 nt, Human
gaugcucuucugugg

SEQ ID NO: 3754427 - RNA, 12 nt, Human
gaugcucuuucc

SEQ ID NO: 3754428 - RNA, 19 nt, Human
gaugcugaaagagaaaaga

SEQ ID NO: 3754429 - RNA, 17 nt, Human
gaugcugacuguacucc

SEQ ID NO: 3754430 - RNA, 19 nt, Human
gaugcugauguucagugua

SEQ ID NO: 3754431 - RNA, 23 nt, Human
gaugcugccagggcgccaucgcc

SEQ ID NO: 3754432 - RNA, 14 nt, Human
gaugcugccugagu

SEQ ID NO: 3754433 - RNA, 16 nt, Human
gaugcugccugaguca

SEQ ID NO: 3754434 - RNA, 11 nt, Human
gaugcugcuuu

SEQ ID NO: 3754435 - RNA, 16 nt, Human
gaugcuggagagguua

SEQ ID NO: 3754436 - RNA, 16 nt, Human
gaugcuggaugcuccu

SEQ ID NO: 3754437 - RNA, 22 nt, Human
gaugcuggaugucugccaauuu

SEQ ID NO: 3754438 - RNA, 12 nt, Human
gaugcuggccca

SEQ ID NO: 3754439 - RNA, 23 nt, Human
gaugcugggcacuucaucugauc

SEQ ID NO: 3754440 - RNA, 12 nt, Human
gaugcugggugg

SEQ ID NO: 3754441 - RNA, 19 nt, Human
gaugcuggguuggugcaca

SEQ ID NO: 3754442 - RNA, 20 nt, Human
gaugcuggguuggugcacag

SEQ ID NO: 3754443 - RNA, 13 nt, Human
gaugcugugaaau

SEQ ID NO: 3754444 - RNA, 12 nt, Human
gaugcuguugcc

SEQ ID NO: 3754445 - RNA, 14 nt, Human
gaugcuguuugaca

SEQ ID NO: 3754446 - RNA, 22 nt, Human
gaugcuuagagggauuucuuug

SEQ ID NO: 3754447 - RNA, 16 nt, Human
gaugcgguggcucacg

SEQ ID NO: 3754448 - RNA, 13 nt, Human
gaugcuauuugca

SEQ ID NO: 3754449 - RNA, 20 nt, Human
gaugcucaaaaucuuuccaa

SEQ ID NO: 3754450 - RNA, 23 nt, Human
gaugcucagguacagagaaggaa

SEQ ID NO: 3754451 - RNA, 22 nt, Human
gaugcucaguugcuaaacacug

SEQ ID NO: 3754452 - RNA, 13 nt, Human
gaugcuccagcca

SEQ ID NO: 3754453 - RNA, 23 nt, Human
gaugcucccuccccugcccuggu

SEQ ID NO: 3754454 - RNA, 18 nt, Human
gaugcucugugcagacac

SEQ ID NO: 3754455 - RNA, 13 nt, Human
gaugcucuuuccc

SEQ ID NO: 3754456 - RNA, 17 nt, Human
gaugcugaaaauguccu

SEQ ID NO: 3754457 - RNA, 21 nt, Human
gaugcugacauucaccugccc

SEQ ID NO: 3754458 - RNA, 15 nt, Human
gaugcugacuaguga

SEQ ID NO: 3754459 - RNA, 14 nt, Human
gaugcugauggagc

SEQ ID NO: 3754460 - RNA, 15 nt, Human
gaugcugauguucag

SEQ ID NO: 3754461 - RNA, 16 nt, Human
gaugcugauguucagu

SEQ ID NO: 3754462 - RNA, 17 nt, Human
gaugcugauguucagug

SEQ ID NO: 3754463 - RNA, 14 nt, Human
gaugcuggagaaga

SEQ ID NO: 3754464 - RNA, 16 nt, Human
gaugcuggagaagaga

SEQ ID NO: 3754465 - RNA, 19 nt, Human
gaugcuggagaagagagga

SEQ ID NO: 3754466 - RNA, 15 nt, Human
gaugcuggagagguu

SEQ ID NO: 3754467 - RNA, 20 nt, Human
gaugcuggaugucugccaau

SEQ ID NO: 3754468 - RNA, 17 nt, Human
gaugcuggcccagggcc

SEQ ID NO: 3754469 - RNA, 19 nt, Human
gaugcuggcccagggccca

SEQ ID NO: 3754470 - RNA, 22 nt, Human
gaugcuggcccagggcccagag

SEQ ID NO: 3754471 - RNA, 23 nt, Human
gaugcuggcccagggcccagagc

SEQ ID NO: 3754472 - RNA, 11 nt, Human
gaugcugggau

SEQ ID NO: 3754473 - RNA, 13 nt, Human
gaugcugggcugg

SEQ ID NO: 3754474 - RNA, 22 nt, Human
gaugcugggcuggcucccucuu

SEQ ID NO: 3754475 - RNA, 17 nt, Human
gaugcuggguggcccug

SEQ ID NO: 3754476 - RNA, 23 nt, Human
gaugcuucucacugccaugccag

SEQ ID NO: 3754477 - RNA, 24 nt, Human
gaugcuugccuagggccuggucca

SEQ ID NO: 3754478 - RNA, 23 nt, Human
gaugcuugcggcaaaaggaaagc

SEQ ID NO: 3754479 - RNA, 20 nt, Human
gaugcuuguaacaagaaaac

SEQ ID NO: 3754480 - RNA, 14 nt, Human
gaugcuuuaccaaa

SEQ ID NO: 3754481 - RNA, 21 nt, Human
gaugcuuuaccaaacagcaaa

SEQ ID NO: 3754482 - RNA, 17 nt, Human
gaugcuuuuagcucaaa

SEQ ID NO: 3754483 - RNA, 21 nt, Human
gaugcuuuucugucucugccu

SEQ ID NO: 3754484 - RNA, 16 nt, Human
gaugcuuuugucuaau

SEQ ID NO: 3754485 - RNA, 15 nt, Human
gauggaaacaaagug

SEQ ID NO: 3754486 - RNA, 22 nt, Human
gauggaacccuuuuggcccccg

SEQ ID NO: 3754487 - RNA, 18 nt, Human
gauggaaccgcaggaagc

SEQ ID NO: 3754488 - RNA, 15 nt, Human
gauggaagcuuccag

SEQ ID NO: 3754489 - RNA, 17 nt, Human
gauggaaguaaagccuc

SEQ ID NO: 3754490 - RNA, 15 nt, Human
gauggaauucuuccu

SEQ ID NO: 3754491 - RNA, 12 nt, Human
gauggacagacu

SEQ ID NO: 3754492 - RNA, 22 nt, Human
gauggacaguucacacccugca

SEQ ID NO: 3754493 - RNA, 13 nt, Human
gauggacaucuug

SEQ ID NO: 3754494 - RNA, 12 nt, Human
gauggagaagga

SEQ ID NO: 3754495 - RNA, 13 nt, Human
gauggagaaggaa

SEQ ID NO: 3754496 - RNA, 22 nt, Human
gauggagacugguccugugugc

SEQ ID NO: 3754497 - RNA, 22 nt, Human
gauggagcgcaccugcccccug

SEQ ID NO: 3754498 - RNA, 23 nt, Human
gauggaggaaaaccaagccgugg

SEQ ID NO: 3754499 - RNA, 11 nt, Human
gauggaggagg

SEQ ID NO: 3754500 - RNA, 21 nt, Human
gauggaggggugguccugacu

SEQ ID NO: 3754501 - RNA, 22 nt, Human
gauggaggggugguccugacuc

SEQ ID NO: 3754502 - RNA, 17 nt, Human
gauggaguuucuaaggu

SEQ ID NO: 3754503 - RNA, 12 nt, Human
gauggauuccaa

SEQ ID NO: 3754504 - RNA, 21 nt, Human
gauggauuccaaccccaacuc

SEQ ID NO: 3754505 - RNA, 14 nt, Human
gauggauucucaga

SEQ ID NO: 3754506 - RNA, 16 nt, Human
gauggauucucagaua

SEQ ID NO: 3754507 - RNA, 14 nt, Human
gauggauuugccug

SEQ ID NO: 3754508 - RNA, 15 nt, Human
gauggauuuguauca

SEQ ID NO: 3754509 - RNA, 13 nt, Human
gauggauuuuaua

SEQ ID NO: 3754510 - RNA, 20 nt, Human
gauggcaaagaaggagagca

SEQ ID NO: 3754511 - RNA, 17 nt, Human
gauggcaacagaucugg

SEQ ID NO: 3754512 - RNA, 18 nt, Human
gauggcaaccagaccauu

SEQ ID NO: 3754513 - RNA, 15 nt, Human
gauggcaccagaggc

SEQ ID NO: 3754514 - RNA, 21 nt, Human
gauggcacuuauaaccaaagc

SEQ ID NO: 3754515 - RNA, 17 nt, Human
gauggcagcuuuuaaaa

SEQ ID NO: 3754516 - RNA, 18 nt, Human
gauggcagcuuuuaaaag

SEQ ID NO: 3754517 - RNA, 19 nt, Human
gauggccagccccuuagac

SEQ ID NO: 3754518 - RNA, 13 nt, Human
gauggccaggcug

SEQ ID NO: 3754519 - RNA, 19 nt, Human
gauggcccauucuacuugc

SEQ ID NO: 3754520 - RNA, 15 nt, Human
gauggcccucuggua

SEQ ID NO: 3754521 - RNA, 22 nt, Human
gauggcccuucccacuggaggu

SEQ ID NO: 3754522 - RNA, 22 nt, Human
gauggcccuuccuccuccacca

SEQ ID NO: 3754523 - RNA, 21 nt, Human
gauggccuggccagggccugg

SEQ ID NO: 3754524 - RNA, 14 nt, Human
gauggcgcuaggca

SEQ ID NO: 3754525 - RNA, 14 nt, Human
gauggcgggugggg

SEQ ID NO: 3754526 - RNA, 16 nt, Human
gauggcgggugggggu

SEQ ID NO: 3754527 - RNA, 20 nt, Human
gauggcuaacuuacaaagau

SEQ ID NO: 3754528 - RNA, 14 nt, Human
gauggcucagaggg

SEQ ID NO: 3754529 - RNA, 13 nt, Human
gauggcucccagg

SEQ ID NO: 3754530 - RNA, 16 nt, Human
gaugggaaugaagcuu

SEQ ID NO: 3754531 - RNA, 18 nt, Human
gaugggaaugaagcuugu

SEQ ID NO: 3754532 - RNA, 23 nt, Human
gaugggaaugaggugggaggugg

SEQ ID NO: 3754533 - RNA, 15 nt, Human
gaugggacugggagg

SEQ ID NO: 3754534 - RNA, 17 nt, Human
gaugggacugggagggc

SEQ ID NO: 3754535 - RNA, 21 nt, Human
gaugggagcuccucuccugga

SEQ ID NO: 3754536 - RNA, 22 nt, Human
gaugggagcuccucuccuggag

SEQ ID NO: 3754537 - RNA, 20 nt, Human
gaugggaugauugaagaaac

SEQ ID NO: 3754538 - RNA, 15 nt, Human
gaugggcacuugaga

SEQ ID NO: 3754539 - RNA, 21 nt, Human
gaugggcauggggugggccuc

SEQ ID NO: 3754540 - RNA, 22 nt, Human
gaugggcauggggugggccucu

SEQ ID NO: 3754541 - RNA, 15 nt, Human
gaugggccaccgccg

SEQ ID NO: 3754542 - RNA, 16 nt, Human
gaugggcccaauucuu

SEQ ID NO: 3754543 - RNA, 10 nt, Human
gaugggccug

SEQ ID NO: 3754544 - RNA, 12 nt, Human
gaugggccugag

SEQ ID NO: 3754545 - RNA, 14 nt, Human
gaugggccuggcau

SEQ ID NO: 3754546 - RNA, 13 nt, Human
gaugggcuuccca

SEQ ID NO: 3754547 - RNA, 15 nt, Human
gaugggcuucccaag

SEQ ID NO: 3754548 - RNA, 13 nt, Human
gauggggaaggag

SEQ ID NO: 3754549 - RNA, 21 nt, Human
gauggggagaucggggccaga

SEQ ID NO: 3754550 - RNA, 19 nt, Human
gauggggcugcaccggcug

SEQ ID NO: 3754551 - RNA, 17 nt, Human
gaugggggaaagcacag

SEQ ID NO: 3754552 - RNA, 16 nt, Human
gaugggggcagggcug

SEQ ID NO: 3754553 - RNA, 16 nt, Human
gauggggucuguaaaa

SEQ ID NO: 3754554 - RNA, 15 nt, Human
gaugggucagagcua

SEQ ID NO: 3754555 - RNA, 21 nt, Human
gaugggucaguuguaucagca

SEQ ID NO: 3754556 - RNA, 23 nt, Human
gaugggucugguuugcagagcuu

SEQ ID NO: 3754557 - RNA, 16 nt, Human
gaugggugaaggcugg

SEQ ID NO: 3754558 - RNA, 22 nt, Human
gaugggugggugggguauuuuu

SEQ ID NO: 3754559 - RNA, 14 nt, Human
gaugguaagagaaa

SEQ ID NO: 3754560 - RNA, 18 nt, Human
gaugguaagagaaaagag

SEQ ID NO: 3754561 - RNA, 23 nt, Human
gaugguaucuauagucaagacga

SEQ ID NO: 3754562 - RNA, 15 nt, Human
gauggucagcucccu

SEQ ID NO: 3754563 - RNA, 15 nt, Human
gaugguccuggggcu

SEQ ID NO: 3754564 - RNA, 24 nt, Human
gaugguccuggggcucugugcagg

SEQ ID NO: 3754565 - RNA, 12 nt, Human
gauggugcaaug

SEQ ID NO: 3754566 - RNA, 20 nt, Human
gauggugcaaugaccuuuca

SEQ ID NO: 3754567 - RNA, 19 nt, Human
gaugguguggccuguggcu

SEQ ID NO: 3754568 - RNA, 15 nt, Human
gaugguuacacuguu

SEQ ID NO: 3754569 - RNA, 14 nt, Human
cugaggccacacuc

SEQ ID NO: 3754570 - RNA, 20 nt, Human
cugaggccacacucagcaca

SEQ ID NO: 3754571 - RNA, 14 nt, Human
cugaggccagccug

SEQ ID NO: 3754572 - RNA, 15 nt, Human
cugaggcccagaggg

SEQ ID NO: 3754573 - RNA, 17 nt, Human
cugaggcccagagggcc

SEQ ID NO: 3754574 - RNA, 19 nt, Human
cugaggcccagagggccug

SEQ ID NO: 3754575 - RNA, 21 nt, Human
cugaggccccuucuagguggc

SEQ ID NO: 3754576 - RNA, 18 nt, Human
cugaggcccuucucucca

SEQ ID NO: 3754577 - RNA, 24 nt, Human
cugaggcccuucucuccagccccu

SEQ ID NO: 3754578 - RNA, 20 nt, Human
cugaggccguugcugacuua

SEQ ID NO: 3754579 - RNA, 19 nt, Human
cugaggccuaaaaguaaac

SEQ ID NO: 3754580 - RNA, 19 nt, Human
cugaggccuagacucuguc

SEQ ID NO: 3754581 - RNA, 15 nt, Human
cugaggccugagacc

SEQ ID NO: 3754582 - RNA, 22 nt, Human
cugaggccugagcgcuccugcc

SEQ ID NO: 3754583 - RNA, 16 nt, Human
cugaggccugcagcac

SEQ ID NO: 3754584 - RNA, 20 nt, Human
cugaggccuggacuuuccug

SEQ ID NO: 3754585 - RNA, 19 nt, Human
cugaggccugggccgcugc

SEQ ID NO: 3754586 - RNA, 22 nt, Human
cugaggccugggccgcugccac

SEQ ID NO: 3754587 - RNA, 23 nt, Human
cugaggcgccccaacccguggag

SEQ ID NO: 3754588 - RNA, 17 nt, Human
cugaggcuccugugcua

SEQ ID NO: 3754589 - RNA, 15 nt, Human
cugaggcugagacug

SEQ ID NO: 3754590 - RNA, 24 nt, Human
cugaggcuggacuccagaucugca

SEQ ID NO: 3754591 - RNA, 21 nt, Human
cugaggcuggauccuagccuu

SEQ ID NO: 3754592 - RNA, 11 nt, Human
cugaggcuggc

SEQ ID NO: 3754593 - RNA, 13 nt, Human
cugaggcuggcac

SEQ ID NO: 3754594 - RNA, 19 nt, Human
cugaggcuggcacaggaca

SEQ ID NO: 3754595 - RNA, 20 nt, Human
cugaggcuggcacaggacau

SEQ ID NO: 3754596 - RNA, 22 nt, Human
cugaggcugggcucccuuccca

SEQ ID NO: 3754597 - RNA, 19 nt, Human
cugaggcuguggucacagc

SEQ ID NO: 3754598 - RNA, 18 nt, Human
cugaggcuuccagagagu

SEQ ID NO: 3754599 - RNA, 18 nt, Human
cugaggcuuuggauuuga

SEQ ID NO: 3754600 - RNA, 18 nt, Human
cugagggaaaggccagca

SEQ ID NO: 3754601 - RNA, 20 nt, Human
cugagggaaaggccagcacu

SEQ ID NO: 3754602 - RNA, 21 nt, Human
cugagggaaaggccagcacuc

SEQ ID NO: 3754603 - RNA, 21 nt, Human
cugagggaaauguuuuguaaa

SEQ ID NO: 3754604 - RNA, 23 nt, Human
cugagggaaauguuuuguaaaca

SEQ ID NO: 3754605 - RNA, 22 nt, Human
cugagggacucugaagccucug

SEQ ID NO: 3754606 - RNA, 23 nt, Human
cugagggacucugaagccucugg

SEQ ID NO: 3754607 - RNA, 13 nt, Human
cugagggagccug

SEQ ID NO: 3754608 - RNA, 15 nt, Human
cugagggaggaccug

SEQ ID NO: 3754609 - RNA, 19 nt, Human
cugagggaggaccuggggc

SEQ ID NO: 3754610 - RNA, 13 nt, Human
cugagggaggagg

SEQ ID NO: 3754611 - RNA, 21 nt, Human
cugagggaggaggccaccucu

SEQ ID NO: 3754612 - RNA, 22 nt, Human
cugagggaggaggccaccucuc

SEQ ID NO: 3754613 - RNA, 15 nt, Human
cugagggaucuuuac

SEQ ID NO: 3754614 - RNA, 20 nt, Human
cugagggauggacugaugcu

SEQ ID NO: 3754615 - RNA, 21 nt, Human
cugagggauggacugaugcuu

SEQ ID NO: 3754616 - RNA, 12 nt, Human
cugagggcaaau

SEQ ID NO: 3754617 - RNA, 20 nt, Human
cugagggcagaaagguucug

SEQ ID NO: 3754618 - RNA, 20 nt, Human
cugagggcagacuggggcau

SEQ ID NO: 3754619 - RNA, 16 nt, Human
cugagggcagucgaua

SEQ ID NO: 3754620 - RNA, 12 nt, Human
cugagggcaguu

SEQ ID NO: 3754621 - RNA, 22 nt, Human
cugagggcaguucgcagccacc

SEQ ID NO: 3754622 - RNA, 13 nt, Human
cugagggccacac

SEQ ID NO: 3754623 - RNA, 19 nt, Human
cugagggccccucugccca

SEQ ID NO: 3754624 - RNA, 22 nt, Human
cugagggccccucugcccagcu

SEQ ID NO: 3754625 - RNA, 16 nt, Human
cugagggccugcugga

SEQ ID NO: 3754626 - RNA, 21 nt, Human
cugaggggaggaucacuggag

SEQ ID NO: 3754627 - RNA, 23 nt, Human
cugaggggaggaucacuggagcc

SEQ ID NO: 3754628 - RNA, 21 nt, Human
cugaggggcaacgaagaaaaa

SEQ ID NO: 3754629 - RNA, 19 nt, Human
cugaggggcagccugccuu

SEQ ID NO: 3754630 - RNA, 20 nt, Human
cugaggggcaucugccccuc

SEQ ID NO: 3754631 - RNA, 18 nt, Human
cugaggggcuaccaggaa

SEQ ID NO: 3754632 - RNA, 13 nt, Human
cugagggggagcc

SEQ ID NO: 3754633 - RNA, 20 nt, Human
cugaggggggccgugcccag

SEQ ID NO: 3754634 - RNA, 22 nt, Human
cugaggggggccgugcccaggg

SEQ ID NO: 3754635 - RNA, 15 nt, Human
gauuuucagcccuca

SEQ ID NO: 3754636 - RNA, 19 nt, Human
gauuuucagcccucagaau

SEQ ID NO: 3754637 - RNA, 12 nt, Human
gauuuucaguua

SEQ ID NO: 3754638 - RNA, 14 nt, Human
gauuuucaguuacu

SEQ ID NO: 3754639 - RNA, 16 nt, Human
gauuuucauaacuuau

SEQ ID NO: 3754640 - RNA, 14 nt, Human
gauuuucauguucu

SEQ ID NO: 3754641 - RNA, 13 nt, Human
gauuuuccaaaug

SEQ ID NO: 3754642 - RNA, 11 nt, Human
gauuuuccauc

SEQ ID NO: 3754643 - RNA, 21 nt, Human
gauuuuccaucuaaaaauaua

SEQ ID NO: 3754644 - RNA, 23 nt, Human
gauuuucuauuauggaaaacugu

SEQ ID NO: 3754645 - RNA, 15 nt, Human
gauuuucugguucua

SEQ ID NO: 3754646 - RNA, 15 nt, Human
gauuuucuuuugccu

SEQ ID NO: 3754647 - RNA, 16 nt, Human
gauuuugaaaacuaca

SEQ ID NO: 3754648 - RNA, 21 nt, Human
gauuuugaaaucaugaagaua

SEQ ID NO: 3754649 - RNA, 21 nt, Human
gauuuugggguuguguuguca

SEQ ID NO: 3754650 - RNA, 17 nt, Human
gauuuuguaagaaguuu

SEQ ID NO: 3754651 - RNA, 21 nt, Human
gauuuuguguuuauucuugau

SEQ ID NO: 3754652 - RNA, 13 nt, Human
gauuuuuaaaaug

SEQ ID NO: 3754653 - RNA, 16 nt, Human
gauuuuuaaaauguac

SEQ ID NO: 3754654 - RNA, 22 nt, Human
gauuuuuacguuugaagacauu

SEQ ID NO: 3754655 - RNA, 18 nt, Human
gauuuuuacuguguuuua

SEQ ID NO: 3754656 - RNA, 22 nt, Human
gauuuuuauauuaguugcuuug

SEQ ID NO: 3754657 - RNA, 15 nt, Human
gauuuuuaugucugg

SEQ ID NO: 3754658 - RNA, 16 nt, Human
gauuuuucuaaccuug

SEQ ID NO: 3754659 - RNA, 23 nt, Human
gauuuuucuaaccuugaaugcug

SEQ ID NO: 3754660 - RNA, 15 nt, Human
gauuuuucuuuaacu

SEQ ID NO: 3754661 - RNA, 14 nt, Human
gauuuuucuuuaca

SEQ ID NO: 3754662 - RNA, 15 nt, Human
gauuuuucuuuacaa

SEQ ID NO: 3754663 - RNA, 21 nt, Human
gauuuuugagcccuuguuuca

SEQ ID NO: 3754664 - RNA, 15 nt, Human
gauuuuugucuugug

SEQ ID NO: 3754665 - RNA, 14 nt, Human
gauuuuuguugauu

SEQ ID NO: 3754666 - RNA, 18 nt, Human
gauuuuuuaauuguuuaa

SEQ ID NO: 3754667 - RNA, 14 nt, Human
gauuuuuuauugcu

SEQ ID NO: 3754668 - RNA, 18 nt, Human
gauuuuuuauugcuagua

SEQ ID NO: 3754669 - RNA, 22 nt, Human
gauuuuuuauugcuaguauuug

SEQ ID NO: 3754670 - RNA, 21 nt, Human
gauuuuuucagacuugucaag

SEQ ID NO: 3754671 - RNA, 23 nt, Human
gauuuuuuuuuagaacagaaaac

SEQ ID NO: 3754672 - RNA, 21 nt, Human
gauuuuuuuuuccuucagugc

SEQ ID NO: 3754673 - RNA, 14 nt, Human
gcaaaaaagaaaac

SEQ ID NO: 3754674 - RNA, 15 nt, Human
gcaaaaaagaaaacc

SEQ ID NO: 3754675 - RNA, 12 nt, Human
gcaaaaaauacu

SEQ ID NO: 3754676 - RNA, 12 nt, Human
gcaaaaaaucuu

SEQ ID NO: 3754677 - RNA, 13 nt, Human
gcaaaaagcaaaa

SEQ ID NO: 3754678 - RNA, 18 nt, Human
gcaaaaauccgaggugcu

SEQ ID NO: 3754679 - RNA, 12 nt, Human
gcaaaaaugcua

SEQ ID NO: 3754680 - RNA, 13 nt, Human
gcaaaaaugcuaa

SEQ ID NO: 3754681 - RNA, 22 nt, Human
gcaaaacagcguuuaagacugu

SEQ ID NO: 3754682 - RNA, 21 nt, Human
gcaaaaccacuagaacucucc

SEQ ID NO: 3754683 - RNA, 16 nt, Human
gcaaaaccauugcuuc

SEQ ID NO: 3754684 - RNA, 20 nt, Human
gcaaaacuaaauacuugcuc

SEQ ID NO: 3754685 - RNA, 23 nt, Human
gcaaaacuaaauacuugcuccau

SEQ ID NO: 3754686 - RNA, 23 nt, Human
gcaaaacucuacuuaauccaaug

SEQ ID NO: 3754687 - RNA, 14 nt, Human
gcaaaacuuuuaaa

SEQ ID NO: 3754688 - RNA, 16 nt, Human
gcaaaacuuuuaaacu

SEQ ID NO: 3754689 - RNA, 11 nt, Human
gcaaaagaaga

SEQ ID NO: 3754690 - RNA, 19 nt, Human
gcaaaagaauggcagaaaa

SEQ ID NO: 3754691 - RNA, 16 nt, Human
gcaaaagacuaauuua

SEQ ID NO: 3754692 - RNA, 21 nt, Human
gcaaaagaguguaaaauauuu

SEQ ID NO: 3754693 - RNA, 15 nt, Human
gcaaaagaugcuucu

SEQ ID NO: 3754694 - RNA, 23 nt, Human
gcaaaagccuuguguauauuugu

SEQ ID NO: 3754695 - RNA, 12 nt, Human
gcaaaaggagag

SEQ ID NO: 3754696 - RNA, 23 nt, Human
gcaaaaggaucuuuguggccaag

SEQ ID NO: 3754697 - RNA, 17 nt, Human
gcaaaaggccucuugua

SEQ ID NO: 3754698 - RNA, 18 nt, Human
gcaaaaguucugacuuga

SEQ ID NO: 3754699 - RNA, 15 nt, Human
gcaaaauaauuuuaa

SEQ ID NO: 3754700 - RNA, 20 nt, Human
gcaaaauaauuuuaaacaaa

SEQ ID NO: 3754701 - RNA, 15 nt, Human
gcaaaaucaagagau

SEQ ID NO: 3754702 - RNA, 15 nt, Human
gcaaaaucaguuuuc

SEQ ID NO: 3754703 - RNA, 17 nt, Human
gcaaaaugaggaaugua

SEQ ID NO: 3754704 - RNA, 19 nt, Human
gcaaaauguuacagaaucu

SEQ ID NO: 3754705 - RNA, 20 nt, Human
gcaaaauuugaugccaggac

SEQ ID NO: 3754706 - RNA, 22 nt, Human
gcaaaauuugaugccaggacac

SEQ ID NO: 3754707 - RNA, 16 nt, Human
gcaaaauuuuauagcu

SEQ ID NO: 3754708 - RNA, 12 nt, Human
gcaaacacuuaa

SEQ ID NO: 3754709 - RNA, 13 nt, Human
gcaaacagaacag

SEQ ID NO: 3754710 - RNA, 14 nt, Human
gcaaacagaacagg

SEQ ID NO: 3754711 - RNA, 23 nt, Human
gcaaacagaggaagaauuuguua

SEQ ID NO: 3754712 - RNA, 18 nt, Human
gcaaacagggccucugcg

SEQ ID NO: 3754713 - RNA, 13 nt, Human
gcaaaccaacaag

SEQ ID NO: 3754714 - RNA, 20 nt, Human
gcaaaccaacaagaauaaag

SEQ ID NO: 3754715 - RNA, 17 nt, Human
gcaaaccacacuggacu

SEQ ID NO: 3754716 - RNA, 18 nt, Human
gcaaaccacacuggacuc

SEQ ID NO: 3754717 - RNA, 21 nt, Human
gcaaaccaucauugaaaucuu

SEQ ID NO: 3754718 - RNA, 15 nt, Human
gcaaacccugucaaa

SEQ ID NO: 3754719 - RNA, 17 nt, Human
gcaaaccugccccaucc

SEQ ID NO: 3754720 - RNA, 18 nt, Human
gcaaaccugccccauccc

SEQ ID NO: 3754721 - RNA, 16 nt, Human
gcaaacgcugccugcc

SEQ ID NO: 3754722 - RNA, 21 nt, Human
gcaaacucaagcuucuucacu

SEQ ID NO: 3754723 - RNA, 10 nt, Human
gcaaacucuu

SEQ ID NO: 3754724 - RNA, 22 nt, Human
gcaaacucuuuggucguuuuuu

SEQ ID NO: 3754725 - RNA, 15 nt, Human
gcaaacugcaugccc

SEQ ID NO: 3754726 - RNA, 16 nt, Human
gcaaacugcaugccca

SEQ ID NO: 3754727 - RNA, 22 nt, Human
gcaaacugcaugcccagagacc

SEQ ID NO: 3754728 - RNA, 22 nt, Human
gcaaacugggaaccccuuuccc

SEQ ID NO: 3754729 - RNA, 23 nt, Human
gcaaacuuuguaugucauuuccu

SEQ ID NO: 3754730 - RNA, 23 nt, Human
gcaaagaaagugggaggucagga

SEQ ID NO: 3754731 - RNA, 22 nt, Human
gcaaagaauuucaauuuguuca

SEQ ID NO: 3754732 - RNA, 17 nt, Human
gcaaagacagaagccuc

SEQ ID NO: 3754733 - RNA, 14 nt, Human
gcaaagagagauuu

SEQ ID NO: 3754734 - RNA, 20 nt, Human
gcaaagagccagcacccuga

SEQ ID NO: 3754735 - RNA, 16 nt, Human
gcaaagaggacucgcu

SEQ ID NO: 3754736 - RNA, 20 nt, Human
gcaaagaggacucgcuugua

SEQ ID NO: 3754737 - RNA, 13 nt, Human
gcaaagaggcaag

SEQ ID NO: 3754738 - RNA, 16 nt, Human
gcaaagaucaaaauaa

SEQ ID NO: 3754739 - RNA, 20 nt, Human
gcaaagaucuguccucagcc

SEQ ID NO: 3754740 - RNA, 18 nt, Human
gcaaagaugaaggucugu

SEQ ID NO: 3754741 - RNA, 13 nt, Human
gcaaagcaccagc

SEQ ID NO: 3754742 - RNA, 21 nt, Human
gcaaagcaccagcuucuccag

SEQ ID NO: 3754743 - RNA, 23 nt, Human
gcaaagcacugacuucuaaguaa

SEQ ID NO: 3754744 - RNA, 20 nt, Human
gcaaagcauguuuugcaugu

SEQ ID NO: 3754745 - RNA, 13 nt, Human
gcaaagcccagcu

SEQ ID NO: 3754746 - RNA, 18 nt, Human
gcaaagccccaugcugga

SEQ ID NO: 3754747 - RNA, 12 nt, Human
gcaaagcuguuc

SEQ ID NO: 3754748 - RNA, 18 nt, Human
gcaaagcuguucuuccug

SEQ ID NO: 3754749 - RNA, 15 nt, Human
gcaaaggaaggugga

SEQ ID NO: 3754750 - RNA, 20 nt, Human
gcaaaggaagguggauggcc

SEQ ID NO: 3754751 - RNA, 13 nt, Human
gcaaaggcuggga

SEQ ID NO: 3754752 - RNA, 17 nt, Human
gcaaagggagcagaacu

SEQ ID NO: 3754753 - RNA, 19 nt, Human
gcaaagggcugaaagccau

SEQ ID NO: 3754754 - RNA, 19 nt, Human
gcaaaggggacagcugugu

SEQ ID NO: 3754755 - RNA, 22 nt, Human
gcaaaggguccagaaggagaca

SEQ ID NO: 3754756 - RNA, 20 nt, Human
gcaaaguacagguacuuugu

SEQ ID NO: 3754757 - RNA, 13 nt, Human
gcaaaguaguacu

SEQ ID NO: 3754758 - RNA, 14 nt, Human
gcaaagucuaaagu

SEQ ID NO: 3754759 - RNA, 22 nt, Human
gcaaagucuaaaguuuacagua

SEQ ID NO: 3754760 - RNA, 15 nt, Human
gcaaagugguucccu

SEQ ID NO: 3754761 - RNA, 14 nt, Human
gcaaaguguuuugu

SEQ ID NO: 3754762 - RNA, 19 nt, Human
gcaaauaauuuccuggugu

SEQ ID NO: 3754763 - RNA, 14 nt, Human
gcaaauauaaaacu

SEQ ID NO: 3754764 - RNA, 22 nt, Human
gcaaaucagaaacuugugaagu

SEQ ID NO: 3754765 - RNA, 19 nt, Human
gcaaaucaguguuuuucuu

SEQ ID NO: 3754766 - RNA, 19 nt, Human
gcaaauccuaugugauuuu

SEQ ID NO: 3754767 - RNA, 22 nt, Human
gcaaauccuugugggaaaagaa

SEQ ID NO: 3754768 - RNA, 18 nt, Human
gcaaauccuuugugaaaa

SEQ ID NO: 3754769 - RNA, 16 nt, Human
gcaaaugacaugcacu

SEQ ID NO: 3754770 - RNA, 14 nt, Human
gcaaaugccagggc

SEQ ID NO: 3754771 - RNA, 14 nt, Human
gcaaaugcccaagg

SEQ ID NO: 3754772 - RNA, 23 nt, Human
gcaaaugcuaaugucaaacuuga

SEQ ID NO: 3754773 - RNA, 21 nt, Human
gcaaaugucagauacaaugua

SEQ ID NO: 3754774 - RNA, 18 nt, Human
gcaaaugucaugcugccu

SEQ ID NO: 3754775 - RNA, 20 nt, Human
gcaaaugucaugcugccuua

SEQ ID NO: 3754776 - RNA, 12 nt, Human
gcaaaugugaau

SEQ ID NO: 3754777 - RNA, 12 nt, Human
gcaaauguuaaa

SEQ ID NO: 3754778 - RNA, 21 nt, Human
gcaaauuaauuggcagcagau

SEQ ID NO: 3754779 - RNA, 16 nt, Human
gcaaauucuuuugaau

SEQ ID NO: 3754780 - RNA, 17 nt, Human
gcaaauucuuuugaauu

SEQ ID NO: 3754781 - RNA, 20 nt, Human
gcaaauucuuuugaauuguu

SEQ ID NO: 3754782 - RNA, 14 nt, Human
gcaaauuggagaaa

SEQ ID NO: 3754783 - RNA, 15 nt, Human
gcaaauuggagaaaa

SEQ ID NO: 3754784 - RNA, 16 nt, Human
gcaaauuuauaauuuu

SEQ ID NO: 3754785 - RNA, 18 nt, Human
gauuauuuuuucagaccg

SEQ ID NO: 3754786 - RNA, 14 nt, Human
gauucaaaauauuu

SEQ ID NO: 3754787 - RNA, 15 nt, Human
gauucaaagguucua

SEQ ID NO: 3754788 - RNA, 18 nt, Human
gauucaaagguucuaggu

SEQ ID NO: 3754789 - RNA, 10 nt, Human
gauucaaauu

SEQ ID NO: 3754790 - RNA, 14 nt, Human
gauucaaauuuauu

SEQ ID NO: 3754791 - RNA, 19 nt, Human
gauucaacagguuuuccug

SEQ ID NO: 3754792 - RNA, 23 nt, Human
gauucaacuaaaaaaaaaaaagu

SEQ ID NO: 3754793 - RNA, 13 nt, Human
gauucaagccauu

SEQ ID NO: 3754794 - RNA, 18 nt, Human
gauucaaucuguaaacug

SEQ ID NO: 3754795 - RNA, 19 nt, Human
gauucaaucuguaaacugu

SEQ ID NO: 3754796 - RNA, 18 nt, Human
gauucaaugccucuggcu

SEQ ID NO: 3754797 - RNA, 17 nt, Human
gauucaauuuucuuuaa

SEQ ID NO: 3754798 - RNA, 18 nt, Human
gauucacaaugaaaugcu

SEQ ID NO: 3754799 - RNA, 16 nt, Human
gauucacaccccaccu

SEQ ID NO: 3754800 - RNA, 19 nt, Human
gauucacaccccaccugcg

SEQ ID NO: 3754801 - RNA, 21 nt, Human
gauucacaccugacucugaaa

SEQ ID NO: 3754802 - RNA, 14 nt, Human
gauucacaucugca

SEQ ID NO: 3754803 - RNA, 13 nt, Human
gauucacauguuu

SEQ ID NO: 3754804 - RNA, 20 nt, Human
gauucacauguuuucaaaug

SEQ ID NO: 3754805 - RNA, 14 nt, Human
gauucaccugagca

SEQ ID NO: 3754806 - RNA, 13 nt, Human
gauucaccuguaa

SEQ ID NO: 3754807 - RNA, 19 nt, Human
gauucaccuguaaaacuuu

SEQ ID NO: 3754808 - RNA, 12 nt, Human
gauucagacagc

SEQ ID NO: 3754809 - RNA, 13 nt, Human
gauucagacagcu

SEQ ID NO: 3754810 - RNA, 20 nt, Human
gauucagauuucucuuugaa

SEQ ID NO: 3754811 - RNA, 15 nt, Human
gauucagccuucuuu

SEQ ID NO: 3754812 - RNA, 21 nt, Human
gauucagccuucuuuuucugg

SEQ ID NO: 3754813 - RNA, 15 nt, Human
gauucagcucugcaa

SEQ ID NO: 3754814 - RNA, 18 nt, Human
gauucaggaaaaggccug

SEQ ID NO: 3754815 - RNA, 20 nt, Human
gauucaggaaaaggccuggg

SEQ ID NO: 3754816 - RNA, 21 nt, Human
gauucaggaaaaggccugggg

SEQ ID NO: 3754817 - RNA, 23 nt, Human
gauucaggaaaaggccuggggug

SEQ ID NO: 3754818 - RNA, 13 nt, Human
gauucaggaaugu

SEQ ID NO: 3754819 - RNA, 22 nt, Human
gauucagggaaagugggacagc

SEQ ID NO: 3754820 - RNA, 20 nt, Human
gauucaggugcagaggaagu

SEQ ID NO: 3754821 - RNA, 14 nt, Human
gauucagucacaug

SEQ ID NO: 3754822 - RNA, 15 nt, Human
gauucaguuuucauu

SEQ ID NO: 3754823 - RNA, 17 nt, Human
gauucauauuuacuucu

SEQ ID NO: 3754824 - RNA, 22 nt, Human
gauucaucuacccugcugaccu

SEQ ID NO: 3754825 - RNA, 16 nt, Human
gauucauuuccugccc

SEQ ID NO: 3754826 - RNA, 23 nt, Human
gauucauuuccugcccuuccuca

SEQ ID NO: 3754827 - RNA, 10 nt, Human
gauucauuuu

SEQ ID NO: 3754828 - RNA, 19 nt, Human
gauucauuuuaacaucuga

SEQ ID NO: 3754829 - RNA, 22 nt, Human
gauuccagagaguggcuccucc

SEQ ID NO: 3754830 - RNA, 18 nt, Human
gauuccagccaucaccuu

SEQ ID NO: 3754831 - RNA, 15 nt, Human
gauuccagcccacau

SEQ ID NO: 3754832 - RNA, 14 nt, Human
gauuccaucuccuu

SEQ ID NO: 3754833 - RNA, 15 nt, Human
gauuccaucuccuug

SEQ ID NO: 3754834 - RNA, 20 nt, Human
gauuccaugcuaagcaagcu

SEQ ID NO: 3754835 - RNA, 17 nt, Human
gauuccauuuacugcau

SEQ ID NO: 3754836 - RNA, 17 nt, Human
gauucccaagcucugcu

SEQ ID NO: 3754837 - RNA, 21 nt, Human
gauucccaagcucugcuccuc

SEQ ID NO: 3754838 - RNA, 13 nt, Human
gauucccagagac

SEQ ID NO: 3754839 - RNA, 19 nt, Human
gauucccagagcaaaauaa

SEQ ID NO: 3754840 - RNA, 12 nt, Human
gauucccaggag

SEQ ID NO: 3754841 - RNA, 21 nt, Human
gauucccaggaguucugcuca

SEQ ID NO: 3754842 - RNA, 23 nt, Human
gauucccauugaaaauguaagua

SEQ ID NO: 3754843 - RNA, 19 nt, Human
gauucccucucccaggccc

SEQ ID NO: 3754844 - RNA, 16 nt, Human
gauuccgcagugagag

SEQ ID NO: 3754845 - RNA, 22 nt, Human
gauuccuaaucacucagagcag

SEQ ID NO: 3754846 - RNA, 17 nt, Human
gauuccucucuaagugg

SEQ ID NO: 3754847 - RNA, 17 nt, Human
gauuccugacccaggcc

SEQ ID NO: 3754848 - RNA, 12 nt, Human
gauuccuuccca

SEQ ID NO: 3754849 - RNA, 13 nt, Human
gauuccuucucug

SEQ ID NO: 3754850 - RNA, 22 nt, Human
gauuccuucucugaacacaggc

SEQ ID NO: 3754851 - RNA, 13 nt, Human
gauuccuuuaaca

SEQ ID NO: 3754852 - RNA, 15 nt, Human
gauuccuuuaacaac

SEQ ID NO: 3754853 - RNA, 20 nt, Human
gauuccuuuaacaacauguu

SEQ ID NO: 3754854 - RNA, 17 nt, Human
gauuccuuugaagagga

SEQ ID NO: 3754855 - RNA, 15 nt, Human
gauuccuuuucuugu

SEQ ID NO: 3754856 - RNA, 16 nt, Human
gauuccuuuuuucaaa

SEQ ID NO: 3754857 - RNA, 17 nt, Human
gauucgaaugacacugu

SEQ ID NO: 3754858 - RNA, 21 nt, Human
gauucgagcuauauuuaagua

SEQ ID NO: 3754859 - RNA, 13 nt, Human
gauucggcugucu

SEQ ID NO: 3754860 - RNA, 16 nt, Human
gauucgguaucccccc

SEQ ID NO: 3754861 - RNA, 11 nt, Human
gauucuaaaau

SEQ ID NO: 3754862 - RNA, 15 nt, Human
gauucuaaaggucca

SEQ ID NO: 3754863 - RNA, 19 nt, Human
gauucuaauuuuuaagcaa

SEQ ID NO: 3754864 - RNA, 23 nt, Human
gauucuaccacacagcagcaguu

SEQ ID NO: 3754865 - RNA, 18 nt, Human
gauucuagaucagaugcu

SEQ ID NO: 3754866 - RNA, 13 nt, Human
gauucuaggaccu

SEQ ID NO: 3754867 - RNA, 17 nt, Human
gauucuauguuaauauu

SEQ ID NO: 3754868 - RNA, 15 nt, Human
gauucuauuuauaug

SEQ ID NO: 3754869 - RNA, 21 nt, Human
gauucuauuuauauguacaug

SEQ ID NO: 3754870 - RNA, 15 nt, Human
gauucucaccagcug

SEQ ID NO: 3754871 - RNA, 12 nt, Human
gauucucagggu

SEQ ID NO: 3754872 - RNA, 17 nt, Human
gauucucagggucucug

SEQ ID NO: 3754873 - RNA, 18 nt, Human
gauucuccugccucagcc

SEQ ID NO: 3754874 - RNA, 19 nt, Human
gauucuccugccucagccu

SEQ ID NO: 3754875 - RNA, 13 nt, Human
gauucuccuucag

SEQ ID NO: 3754876 - RNA, 22 nt, Human
gauucucuccauuuuggugucu

SEQ ID NO: 3754877 - RNA, 14 nt, Human
gauucucuugccuc

SEQ ID NO: 3754878 - RNA, 23 nt, Human
gauucucuugccucagcuucccc

SEQ ID NO: 3754879 - RNA, 13 nt, Human
gauucugagagcu

SEQ ID NO: 3754880 - RNA, 15 nt, Human
gauucugcaguaaau

SEQ ID NO: 3754881 - RNA, 16 nt, Human
gauucugcaguaaauc

SEQ ID NO: 3754882 - RNA, 18 nt, Human
gauucugcaguaaaucuu

SEQ ID NO: 3754883 - RNA, 13 nt, Human
gauucugcuuuua

SEQ ID NO: 3754884 - RNA, 16 nt, Human
gauucuggcuuuaagc

SEQ ID NO: 3754885 - RNA, 22 nt, Human
gauucugggaggaagcagguug

SEQ ID NO: 3754886 - RNA, 17 nt, Human
gauucugggaugcuccu

SEQ ID NO: 3754887 - RNA, 17 nt, Human
gauucugguuccagggu

SEQ ID NO: 3754888 - RNA, 12 nt, Human
gauucuguacau

SEQ ID NO: 3754889 - RNA, 22 nt, Human
gauucuguguguuuucauaaua

SEQ ID NO: 3754890 - RNA, 13 nt, Human
gauucuuccagau

SEQ ID NO: 3754891 - RNA, 15 nt, Human
gauucuucugcuuca

SEQ ID NO: 3754892 - RNA, 20 nt, Human
gauucuucugcuucagccuc

SEQ ID NO: 3754893 - RNA, 20 nt, Human
gauucuuucaguucuuugga

SEQ ID NO: 3754894 - RNA, 18 nt, Human
gauucuuuccauuugcau

SEQ ID NO: 3754895 - RNA, 17 nt, Human
gauucuuuccugaggcu

SEQ ID NO: 3754896 - RNA, 16 nt, Human
gauucuuuugcccaca

SEQ ID NO: 3754897 - RNA, 19 nt, Human
gauugaaaacuuuucucag

SEQ ID NO: 3754898 - RNA, 18 nt, Human
gauugaaaauguccagga

SEQ ID NO: 3754899 - RNA, 20 nt, Human
gauugaaaauguccaggaaa

SEQ ID NO: 3754900 - RNA, 23 nt, Human
gauugaaguauuuugcuggaaua

SEQ ID NO: 3754901 - RNA, 15 nt, Human
gauugacaguaacuu

SEQ ID NO: 3754902 - RNA, 18 nt, Human
gauugacaguaacuuggu

SEQ ID NO: 3754903 - RNA, 14 nt, Human
gauugaccugcucc

SEQ ID NO: 3754904 - RNA, 16 nt, Human
gauugagaaggagaga

SEQ ID NO: 3754905 - RNA, 22 nt, Human
gauugagaaguuacuuuccauu

SEQ ID NO: 3754906 - RNA, 19 nt, Human
gauugagaccuacaggcug

SEQ ID NO: 3754907 - RNA, 13 nt, Human
gauugaggccugc

SEQ ID NO: 3754908 - RNA, 15 nt, Human
gauugauuugaagaa

SEQ ID NO: 3754909 - RNA, 15 nt, Human
gauugcaacaggcug

SEQ ID NO: 3754910 - RNA, 16 nt, Human
gauugcaacaggcugg

SEQ ID NO: 3754911 - RNA, 17 nt, Human
gauugcaacaggcuggg

SEQ ID NO: 3754912 - RNA, 18 nt, Human
gauugcaacaggcugggc

SEQ ID NO: 3754913 - RNA, 21 nt, Human
gauugcaacaggcugggcuuc

SEQ ID NO: 3754914 - RNA, 18 nt, Human
gauugcaauaucugaagc

SEQ ID NO: 3754915 - RNA, 21 nt, Human
gauugcaauaucugaagcccu

SEQ ID NO: 3754916 - RNA, 14 nt, Human
gauugcaauuugca

SEQ ID NO: 3754917 - RNA, 15 nt, Human
gauugcacguggccu

SEQ ID NO: 3754918 - RNA, 19 nt, Human
gauugcagaaaauucugug

SEQ ID NO: 3754919 - RNA, 16 nt, Human
gauugcagaauuguuu

SEQ ID NO: 3754920 - RNA, 23 nt, Human
gauugcaggagucccugccauca

SEQ ID NO: 3754921 - RNA, 19 nt, Human
gauugcagguggaacucag

SEQ ID NO: 3754922 - RNA, 15 nt, Human
gauugccuuuuuaua

SEQ ID NO: 3754923 - RNA, 14 nt, Human
gauugcgagagaug

SEQ ID NO: 3754924 - RNA, 17 nt, Human
gauugcgagagaugugu

SEQ ID NO: 3754925 - RNA, 16 nt, Human
gauugcuaaauguaac

SEQ ID NO: 3754926 - RNA, 20 nt, Human
gauugcuaaauguaacaguc

SEQ ID NO: 3754927 - RNA, 13 nt, Human
gauugcugccacu

SEQ ID NO: 3754928 - RNA, 18 nt, Human
gauugcuguguccaacuc

SEQ ID NO: 3754929 - RNA, 19 nt, Human
gauugcuguguccaacucc

SEQ ID NO: 3754930 - RNA, 22 nt, Human
gauugcuguguccaacuccagu

SEQ ID NO: 3754931 - RNA, 23 nt, Human
gauugcuguguccaacuccagua

SEQ ID NO: 3754932 - RNA, 17 nt, Human
gauugcuuaaaauagca

SEQ ID NO: 3754933 - RNA, 14 nt, Human
gauugcuucuguag

SEQ ID NO: 3754934 - RNA, 16 nt, Human
gauugcuucuguagua

SEQ ID NO: 3754935 - RNA, 23 nt, Human
cugaggggggccgugcccagggg

SEQ ID NO: 3754936 - RNA, 18 nt, Human
cugagggucugggcggcg

SEQ ID NO: 3754937 - RNA, 12 nt, Human
cugagggucugu

SEQ ID NO: 3754938 - RNA, 19 nt, Human
cugaggguggagacuaagc

SEQ ID NO: 3754939 - RNA, 22 nt, Human
cugagguaaccucauuaucagu

SEQ ID NO: 3754940 - RNA, 17 nt, Human
cugaggucagggagugc

SEQ ID NO: 3754941 - RNA, 18 nt, Human
cugagguccugagcacug

SEQ ID NO: 3754942 - RNA, 19 nt, Human
cugaggucucgcugaugcu

SEQ ID NO: 3754943 - RNA, 16 nt, Human
cugaggucuggcugcu

SEQ ID NO: 3754944 - RNA, 19 nt, Human
cugaggugaaagggagcua

SEQ ID NO: 3754945 - RNA, 19 nt, Human
cugaggugccugucccacc

SEQ ID NO: 3754946 - RNA, 12 nt, Human
cugaggugggag

SEQ ID NO: 3754947 - RNA, 22 nt, Human
cugaggugggaggaucucuuga

SEQ ID NO: 3754948 - RNA, 14 nt, Human
cugaggugggcaga

SEQ ID NO: 3754949 - RNA, 23 nt, Human
cugaggugggcccaggaccagcu

SEQ ID NO: 3754950 - RNA, 16 nt, Human
cugaggugugggggcu

SEQ ID NO: 3754951 - RNA, 20 nt, Human
cugaggugugggggcugcag

SEQ ID NO: 3754952 - RNA, 17 nt, Human
cugagguuacuggaaau

SEQ ID NO: 3754953 - RNA, 21 nt, Human
cugagguuacuggaaauuagg

SEQ ID NO: 3754954 - RNA, 17 nt, Human
cugagguuccucugccu

SEQ ID NO: 3754955 - RNA, 20 nt, Human
cugagguugggagaggugca

SEQ ID NO: 3754956 - RNA, 21 nt, Human
cugagguugggagaggugcac

SEQ ID NO: 3754957 - RNA, 21 nt, Human
cugaguaaaaaagcugugugc

SEQ ID NO: 3754958 - RNA, 15 nt, Human
cugaguacuccacac

SEQ ID NO: 3754959 - RNA, 19 nt, Human
cugaguagaaaggccuuua

SEQ ID NO: 3754960 - RNA, 22 nt, Human
cugaguagaugcgcagccccau

SEQ ID NO: 3754961 - RNA, 20 nt, Human
cugaguagcuggauuacagg

SEQ ID NO: 3754962 - RNA, 13 nt, Human
cugaguaugugga

SEQ ID NO: 3754963 - RNA, 23 nt, Human
cugaguauuaaaauguaugcaug

SEQ ID NO: 3754964 - RNA, 14 nt, Human
cugagucaccagga

SEQ ID NO: 3754965 - RNA, 20 nt, Human
cugagucacccaugaagaca

SEQ ID NO: 3754966 - RNA, 22 nt, Human
cugagucacccaugaagacagg

SEQ ID NO: 3754967 - RNA, 23 nt, Human
cugagucacccuaccugugccug

SEQ ID NO: 3754968 - RNA, 19 nt, Human
cugagucagagccaugucu

SEQ ID NO: 3754969 - RNA, 22 nt, Human
cugagucaucuguuagggccuu

SEQ ID NO: 3754970 - RNA, 21 nt, Human
cugagucccaggagcugccca

SEQ ID NO: 3754971 - RNA, 22 nt, Human
cugagucccaggagcugcccag

SEQ ID NO: 3754972 - RNA, 13 nt, Human
cugagucccaucc

SEQ ID NO: 3754973 - RNA, 18 nt, Human
cugagucguacagaaagc

SEQ ID NO: 3754974 - RNA, 16 nt, Human
cugagucucccaaggc

SEQ ID NO: 3754975 - RNA, 14 nt, Human
cugagucuccugug

SEQ ID NO: 3754976 - RNA, 15 nt, Human
cugagucuccugugc

SEQ ID NO: 3754977 - RNA, 16 nt, Human
cugagucuccugugcc

SEQ ID NO: 3754978 - RNA, 13 nt, Human
cugagucugaagg

SEQ ID NO: 3754979 - RNA, 18 nt, Human
cugagucugaaggcuggg

SEQ ID NO: 3754980 - RNA, 14 nt, Human
cugagucugggcag

SEQ ID NO: 3754981 - RNA, 14 nt, Human
cugagugcaggccc

SEQ ID NO: 3754982 - RNA, 15 nt, Human
cugagugcaggccca

SEQ ID NO: 3754983 - RNA, 21 nt, Human
cugagugcaggcccacccugc

SEQ ID NO: 3754984 - RNA, 13 nt, Human
cugagugccuggc

SEQ ID NO: 3754985 - RNA, 18 nt, Human
cugagugccuucuguggg

SEQ ID NO: 3754986 - RNA, 23 nt, Human
cugagugccuucuguggggacuc

SEQ ID NO: 3754987 - RNA, 16 nt, Human
cugagugccuuuuggu

SEQ ID NO: 3754988 - RNA, 17 nt, Human
cugagugcuugcuuuuc

SEQ ID NO: 3754989 - RNA, 18 nt, Human
cugaguggaucuccaagg

SEQ ID NO: 3754990 - RNA, 13 nt, Human
cugaguggcaggg

SEQ ID NO: 3754991 - RNA, 18 nt, Human
cugaguggcaggggacag

SEQ ID NO: 3754992 - RNA, 13 nt, Human
cugaguggcuuca

SEQ ID NO: 3754993 - RNA, 15 nt, Human
cugaguggcuucacu

SEQ ID NO: 3754994 - RNA, 16 nt, Human
cugaguggcuucacuc

SEQ ID NO: 3754995 - RNA, 22 nt, Human
cugaguggcuucacuccugcug

SEQ ID NO: 3754996 - RNA, 17 nt, Human
cugaguguacagagugg

SEQ ID NO: 3754997 - RNA, 17 nt, Human
cugaguuacauugucau

SEQ ID NO: 3754998 - RNA, 17 nt, Human
cugaguucaagggcugu

SEQ ID NO: 3754999 - RNA, 15 nt, Human
cugaguuccuagcca

SEQ ID NO: 3755000 - RNA, 14 nt, Human
cugaguuccugcau

SEQ ID NO: 3755001 - RNA, 22 nt, Human
cugaguugaagucaugcucccc

SEQ ID NO: 3755002 - RNA, 18 nt, Human
cugaguugccaagacaaa

SEQ ID NO: 3755003 - RNA, 16 nt, Human
cugaguugcuuuucag

SEQ ID NO: 3755004 - RNA, 20 nt, Human
cugaguuguugagucuguuu

SEQ ID NO: 3755005 - RNA, 15 nt, Human
cugaguuuaccauuu

SEQ ID NO: 3755006 - RNA, 20 nt, Human
cugaguuuaccauuuguaau

SEQ ID NO: 3755007 - RNA, 23 nt, Human
cugaguuuaccauuuguaauaaa

SEQ ID NO: 3755008 - RNA, 18 nt, Human
cugaguuucauucuccug

SEQ ID NO: 3755009 - RNA, 11 nt, Human
cugaguuuccu

SEQ ID NO: 3755010 - RNA, 12 nt, Human
cugaguuuccua

SEQ ID NO: 3755011 - RNA, 20 nt, Human
cugaguuuccuaugggaaca

SEQ ID NO: 3755012 - RNA, 19 nt, Human
cugaguuuuguguuuguug

SEQ ID NO: 3755013 - RNA, 18 nt, Human
cugauaaagcacagcugu

SEQ ID NO: 3755014 - RNA, 17 nt, Human
cugauaacaaccuggag

SEQ ID NO: 3755015 - RNA, 23 nt, Human
cugauaacuagauggugcugaga

SEQ ID NO: 3755016 - RNA, 17 nt, Human
cugauacauaacuaaau

SEQ ID NO: 3755017 - RNA, 12 nt, Human
cugauaccucaa

SEQ ID NO: 3755018 - RNA, 20 nt, Human
cugauacuuugacaguguuu

SEQ ID NO: 3755019 - RNA, 20 nt, Human
cugauagaggaagccugauu

SEQ ID NO: 3755020 - RNA, 23 nt, Human
cugauagcguuggaauuaaaaca

SEQ ID NO: 3755021 - RNA, 17 nt, Human
cugauagggauacaugc

SEQ ID NO: 3755022 - RNA, 20 nt, Human
cugauaggguuugugacagg

SEQ ID NO: 3755023 - RNA, 23 nt, Human
cugauaggguuugugacagggcg

SEQ ID NO: 3755024 - RNA, 15 nt, Human
cugauaguuacuguu

SEQ ID NO: 3755025 - RNA, 21 nt, Human
cugauaguuacuguugugacc

SEQ ID NO: 3755026 - RNA, 16 nt, Human
cugauauaaauucugu

SEQ ID NO: 3755027 - RNA, 12 nt, Human
cugauauagaau

SEQ ID NO: 3755028 - RNA, 14 nt, Human
cugauauauuuaaa

SEQ ID NO: 3755029 - RNA, 16 nt, Human
cugauauauuuuccag

SEQ ID NO: 3755030 - RNA, 23 nt, Human
cugauaucuggccuaaaaucuug

SEQ ID NO: 3755031 - RNA, 16 nt, Human
cugauaugauuuaaaa

SEQ ID NO: 3755032 - RNA, 23 nt, Human
cugauaugauuuaaaacauguaa

SEQ ID NO: 3755033 - RNA, 16 nt, Human
cugauaugggacugag

SEQ ID NO: 3755034 - RNA, 20 nt, Human
cugauauuaauuuaucagau

SEQ ID NO: 3755035 - RNA, 19 nt, Human
cugauauuccaugaaugua

SEQ ID NO: 3755036 - RNA, 14 nt, Human
cugauauugaagua

SEQ ID NO: 3755037 - RNA, 16 nt, Human
cugauauugaaguaaa

SEQ ID NO: 3755038 - RNA, 17 nt, Human
cugauauuuuaccucuu

SEQ ID NO: 3755039 - RNA, 15 nt, Human
cugauauuuucucua

SEQ ID NO: 3755040 - RNA, 16 nt, Human
cugauauuuucucuag

SEQ ID NO: 3755041 - RNA, 16 nt, Human
cugaucaacaauuugg

SEQ ID NO: 3755042 - RNA, 20 nt, Human
cugaucacuaugcauuuuaa

SEQ ID NO: 3755043 - RNA, 15 nt, Human
cugaucacugaaaua

SEQ ID NO: 3755044 - RNA, 18 nt, Human
cugaucaggaccuccaag

SEQ ID NO: 3755045 - RNA, 12 nt, Human
cugaucaugcau

SEQ ID NO: 3755046 - RNA, 14 nt, Human
cugaucaugcauug

SEQ ID NO: 3755047 - RNA, 20 nt, Human
cugauccaguuuuguuugga

SEQ ID NO: 3755048 - RNA, 17 nt, Human
cugaucccacuccuagg

SEQ ID NO: 3755049 - RNA, 18 nt, Human
cugaucccagagagcccg

SEQ ID NO: 3755050 - RNA, 20 nt, Human
cugaucccauuuuccucuga

SEQ ID NO: 3755051 - RNA, 17 nt, Human
cugaucccugaucccuu

SEQ ID NO: 3755052 - RNA, 18 nt, Human
cugaucccuuccaccugc

SEQ ID NO: 3755053 - RNA, 12 nt, Human
cugauccuggag

SEQ ID NO: 3755054 - RNA, 19 nt, Human
cugauccuggaggcccagu

SEQ ID NO: 3755055 - RNA, 21 nt, Human
cugauccuggaggcccaguuc

SEQ ID NO: 3755056 - RNA, 20 nt, Human
cugauccugugaaguaagga

SEQ ID NO: 3755057 - RNA, 23 nt, Human
cugauccugugaaguaaggaugu

SEQ ID NO: 3755058 - RNA, 20 nt, Human
cugaucgccaaccuuucccc

SEQ ID NO: 3755059 - RNA, 21 nt, Human
cugaucgugacgcugaauaaa

SEQ ID NO: 3755060 - RNA, 15 nt, Human
cugaucguucuuucu

SEQ ID NO: 3755061 - RNA, 15 nt, Human
cugaucucagggaag

SEQ ID NO: 3755062 - RNA, 20 nt, Human
cugaucucagggaagcccag

SEQ ID NO: 3755063 - RNA, 21 nt, Human
cugaucuccauaaacaugaaa

SEQ ID NO: 3755064 - RNA, 13 nt, Human
cugaucuccaugg

SEQ ID NO: 3755065 - RNA, 14 nt, Human
cugaucuccauggc

SEQ ID NO: 3755066 - RNA, 13 nt, Human
cugaucucguuuu

SEQ ID NO: 3755067 - RNA, 18 nt, Human
cugaucucucgugauuga

SEQ ID NO: 3755068 - RNA, 15 nt, Human
cugaucucuuccugu

SEQ ID NO: 3755069 - RNA, 23 nt, Human
cugaucugcccaucgugaagaag

SEQ ID NO: 3755070 - RNA, 20 nt, Human
cugaucugcggaucucagcu

SEQ ID NO: 3755071 - RNA, 15 nt, Human
cugaucuggcugcag

SEQ ID NO: 3755072 - RNA, 21 nt, Human
cugaucugugcuuuccagcuc

SEQ ID NO: 3755073 - RNA, 22 nt, Human
cugaucugugcuuuccagcuca

SEQ ID NO: 3755074 - RNA, 14 nt, Human
cugaucuguuauag

SEQ ID NO: 3755075 - RNA, 22 nt, Human
cugaugaaaaauugcugacugu

SEQ ID NO: 3755076 - RNA, 12 nt, Human
cugaugaaaaca

SEQ ID NO: 3755077 - RNA, 13 nt, Human
cugaugaaaauaa

SEQ ID NO: 3755078 - RNA, 19 nt, Human
cugaugaaaauaaagaaug

SEQ ID NO: 3755079 - RNA, 15 nt, Human
cugaugaaucuugcg

SEQ ID NO: 3755080 - RNA, 14 nt, Human
cugaugacacugag

SEQ ID NO: 3755081 - RNA, 15 nt, Human
cugaugacccaggcu

SEQ ID NO: 3755082 - RNA, 15 nt, Human
cugaugacucaagau

SEQ ID NO: 3755083 - RNA, 22 nt, Human
cugaugacucaagauucccagg

SEQ ID NO: 3755084 - RNA, 22 nt, Human
gcaaauuucaaaagacauguug

SEQ ID NO: 3755085 - RNA, 21 nt, Human
gcaacaaacugcacaugauuu

SEQ ID NO: 3755086 - RNA, 20 nt, Human
gcaacaagguccucugucag

SEQ ID NO: 3755087 - RNA, 13 nt, Human
gcaacaauaaaua

SEQ ID NO: 3755088 - RNA, 22 nt, Human
gcaacaauacaugcugcuaauu

SEQ ID NO: 3755089 - RNA, 13 nt, Human
gcaacacacagac

SEQ ID NO: 3755090 - RNA, 23 nt, Human
gcaacacagccugggccccagcu

SEQ ID NO: 3755091 - RNA, 16 nt, Human
gcaacacgcaugguca

SEQ ID NO: 3755092 - RNA, 18 nt, Human
gcaacacuggucugcugu

SEQ ID NO: 3755093 - RNA, 18 nt, Human
gcaacacuuuuuauguua

SEQ ID NO: 3755094 - RNA, 19 nt, Human
gcaacagagugagacccug

SEQ ID NO: 3755095 - RNA, 16 nt, Human
gcaacagaucaguaaa

SEQ ID NO: 3755096 - RNA, 14 nt, Human
gcaacagaucugga

SEQ ID NO: 3755097 - RNA, 20 nt, Human
gcaacagaucuggaaccuca

SEQ ID NO: 3755098 - RNA, 17 nt, Human
gcaacagcauaacaagg

SEQ ID NO: 3755099 - RNA, 18 nt, Human
gcaacaggaaucaagagc

SEQ ID NO: 3755100 - RNA, 17 nt, Human
gcaacaguagcauagga

SEQ ID NO: 3755101 - RNA, 17 nt, Human
gcaacaguuugacauuu

SEQ ID NO: 3755102 - RNA, 17 nt, Human
gcaacauccaaaauagu

SEQ ID NO: 3755103 - RNA, 22 nt, Human
gcaacauuguucaccuuuguag

SEQ ID NO: 3755104 - RNA, 15 nt, Human
gcaaccaaaaagaaa

SEQ ID NO: 3755105 - RNA, 13 nt, Human
gcaaccacacacc

SEQ ID NO: 3755106 - RNA, 11 nt, Human
gcaaccaggaa

SEQ ID NO: 3755107 - RNA, 17 nt, Human
gcaaccaggaacagcaa

SEQ ID NO: 3755108 - RNA, 14 nt, Human
gcaaccaguuggcu

SEQ ID NO: 3755109 - RNA, 20 nt, Human
gcaacccaaggacugaggga

SEQ ID NO: 3755110 - RNA, 14 nt, Human
gcaacccacgugua

SEQ ID NO: 3755111 - RNA, 19 nt, Human
gcaaccccaguucugcucc

SEQ ID NO: 3755112 - RNA, 14 nt, Human
gcaacccccagccu

SEQ ID NO: 3755113 - RNA, 14 nt, Human
gcaaccccuggacc

SEQ ID NO: 3755114 - RNA, 18 nt, Human
gcaacccgugccaagucc

SEQ ID NO: 3755115 - RNA, 23 nt, Human
gcaacccuccuaucaccuccccu

SEQ ID NO: 3755116 - RNA, 21 nt, Human
gcaacccuuaccccuuagccu

SEQ ID NO: 3755117 - RNA, 20 nt, Human
gcaaccguggcccuuccugg

SEQ ID NO: 3755118 - RNA, 21 nt, Human
gcaaccguggcccuuccugga

SEQ ID NO: 3755119 - RNA, 22 nt, Human
gcaaccguggcccuuccuggac

SEQ ID NO: 3755120 - RNA, 14 nt, Human
gcaaccuacccagc

SEQ ID NO: 3755121 - RNA, 18 nt, Human
gcaaccuacccagcgugg

SEQ ID NO: 3755122 - RNA, 13 nt, Human
gcaaccuccaccu

SEQ ID NO: 3755123 - RNA, 17 nt, Human
gcaaccuccaccuccug

SEQ ID NO: 3755124 - RNA, 22 nt, Human
gcaaccuuucaccuuuguguau

SEQ ID NO: 3755125 - RNA, 23 nt, Human
gcaaccuuucaccuuuguguauu

SEQ ID NO: 3755126 - RNA, 14 nt, Human
gcaacgaagaaaaa

SEQ ID NO: 3755127 - RNA, 20 nt, Human
gcaacgaccagggccgagga

SEQ ID NO: 3755128 - RNA, 22 nt, Human
gcaacgaccagggccgaggagg

SEQ ID NO: 3755129 - RNA, 21 nt, Human
gcaacgaucacaaaugacuuu

SEQ ID NO: 3755130 - RNA, 19 nt, Human
gcaacuaucagacuaagcc

SEQ ID NO: 3755131 - RNA, 22 nt, Human
gcaacuaucagacuaagccagc

SEQ ID NO: 3755132 - RNA, 16 nt, Human
gcaacugaacaaaaaa

SEQ ID NO: 3755133 - RNA, 12 nt, Human
gcaacugaauaa

SEQ ID NO: 3755134 - RNA, 14 nt, Human
gcaacugaggcaga

SEQ ID NO: 3755135 - RNA, 15 nt, Human
gcaacugaggcagac

SEQ ID NO: 3755136 - RNA, 18 nt, Human
gcaacugagucugcggga

SEQ ID NO: 3755137 - RNA, 19 nt, Human
gcaacugucuauuucugcu

SEQ ID NO: 3755138 - RNA, 20 nt, Human
gcaacugucuauuucugcug

SEQ ID NO: 3755139 - RNA, 12 nt, Human
gcaacuguuaug

SEQ ID NO: 3755140 - RNA, 21 nt, Human
gcaacuguuaugaaauaaaga

SEQ ID NO: 3755141 - RNA, 16 nt, Human
gcaacuucaguccugg

SEQ ID NO: 3755142 - RNA, 20 nt, Human
gcaacuucuucuccaucccu

SEQ ID NO: 3755143 - RNA, 19 nt, Human
gcaacuugaaauuauaucu

SEQ ID NO: 3755144 - RNA, 23 nt, Human
gcaacuugucuuuuucuggacug

SEQ ID NO: 3755145 - RNA, 22 nt, Human
gcaacuuuguauaaaagggacu

SEQ ID NO: 3755146 - RNA, 21 nt, Human
gcaagaacucaucacuguggc

SEQ ID NO: 3755147 - RNA, 14 nt, Human
gcaagaaggaggcu

SEQ ID NO: 3755148 - RNA, 16 nt, Human
gcaagaaggcaaaaau

SEQ ID NO: 3755149 - RNA, 13 nt, Human
gcaagaaguagca

SEQ ID NO: 3755150 - RNA, 17 nt, Human
gcaagaauaaaaaagaa

SEQ ID NO: 3755151 - RNA, 21 nt, Human
gcaagaaucagagaaggaaca

SEQ ID NO: 3755152 - RNA, 15 nt, Human
gcaagaauuugaucg

SEQ ID NO: 3755153 - RNA, 15 nt, Human
gcaagaccaguugaa

SEQ ID NO: 3755154 - RNA, 21 nt, Human
gcaagacgcugugcugcccug

SEQ ID NO: 3755155 - RNA, 22 nt, Human
gcaagacgcugugcugcccugc

SEQ ID NO: 3755156 - RNA, 19 nt, Human
gcaagagaauugcuugaac

SEQ ID NO: 3755157 - RNA, 20 nt, Human
gcaagagacucuggccucca

SEQ ID NO: 3755158 - RNA, 14 nt, Human
gcaagagagaaccu

SEQ ID NO: 3755159 - RNA, 23 nt, Human
gcaagaggccguggcugcugugg

SEQ ID NO: 3755160 - RNA, 13 nt, Human
gcaagaggggugg

SEQ ID NO: 3755161 - RNA, 17 nt, Human
gcaagagggguggagac

SEQ ID NO: 3755162 - RNA, 15 nt, Human
gcaagauaaacauua

SEQ ID NO: 3755163 - RNA, 16 nt, Human
gcaagauauuuauaua

SEQ ID NO: 3755164 - RNA, 22 nt, Human
gcaagauuuuccacaagauucc

SEQ ID NO: 3755165 - RNA, 14 nt, Human
gcaagcaagaggcc

SEQ ID NO: 3755166 - RNA, 23 nt, Human
gcaagcaagaggccguggcugcu

SEQ ID NO: 3755167 - RNA, 17 nt, Human
gcaagcaagcucucuug

SEQ ID NO: 3755168 - RNA, 18 nt, Human
gcaagcaccuccugccuc

SEQ ID NO: 3755169 - RNA, 21 nt, Human
gcaagcagaggaccagggccu

SEQ ID NO: 3755170 - RNA, 15 nt, Human
gcaagcaguuucaau

SEQ ID NO: 3755171 - RNA, 16 nt, Human
gcaagcaugcuuguga

SEQ ID NO: 3755172 - RNA, 18 nt, Human
gcaagcauucagaagaaa

SEQ ID NO: 3755173 - RNA, 20 nt, Human
gcaagcauuuauguuuauuu

SEQ ID NO: 3755174 - RNA, 13 nt, Human
gcaagccaggcuc

SEQ ID NO: 3755175 - RNA, 21 nt, Human
gcaagccaggcucacucacag

SEQ ID NO: 3755176 - RNA, 20 nt, Human
gcaagcccuacagagcugug

SEQ ID NO: 3755177 - RNA, 21 nt, Human
gcaagcccuacagagcugugg

SEQ ID NO: 3755178 - RNA, 19 nt, Human
gcaagccuaagggauccug

SEQ ID NO: 3755179 - RNA, 15 nt, Human
gcaagcuaaccuuau

SEQ ID NO: 3755180 - RNA, 23 nt, Human
gcaagcuaaccuuauccugcauu

SEQ ID NO: 3755181 - RNA, 15 nt, Human
gcaagcuccgcagga

SEQ ID NO: 3755182 - RNA, 11 nt, Human
gcaaggaaaaa

SEQ ID NO: 3755183 - RNA, 14 nt, Human
gcaaggaaaaagaa

SEQ ID NO: 3755184 - RNA, 17 nt, Human
gcaaggaaaaagaaaau

SEQ ID NO: 3755185 - RNA, 18 nt, Human
gcaaggaaaaagaaaaua

SEQ ID NO: 3755186 - RNA, 10 nt, Human
gcaaggaaag

SEQ ID NO: 3755187 - RNA, 22 nt, Human
gcaaggacuacguuaagggaag

SEQ ID NO: 3755188 - RNA, 14 nt, Human
gcaaggacuuugua

SEQ ID NO: 3755189 - RNA, 16 nt, Human
gcaaggacuuuguaca

SEQ ID NO: 3755190 - RNA, 19 nt, Human
gcaaggacuuuguacauuu

SEQ ID NO: 3755191 - RNA, 15 nt, Human
gcaaggaggcuggcu

SEQ ID NO: 3755192 - RNA, 20 nt, Human
gcaaggaggcuggcuggggc

SEQ ID NO: 3755193 - RNA, 22 nt, Human
gcaaggcaaauguuuauuuaaa

SEQ ID NO: 3755194 - RNA, 21 nt, Human
gcaaggcaggugccuccaggu

SEQ ID NO: 3755195 - RNA, 22 nt, Human
gcaaggcaggugccuccaggug

SEQ ID NO: 3755196 - RNA, 13 nt, Human
gcaaggcccacag

SEQ ID NO: 3755197 - RNA, 16 nt, Human
gcaaggcccacaggag

SEQ ID NO: 3755198 - RNA, 14 nt, Human
gcaaggcccgagca

SEQ ID NO: 3755199 - RNA, 16 nt, Human
gcaaggcccgagcagc

SEQ ID NO: 3755200 - RNA, 17 nt, Human
gcaaggcccgagcagcu

SEQ ID NO: 3755201 - RNA, 21 nt, Human
gcaaggcccgagcagcugagc

SEQ ID NO: 3755202 - RNA, 19 nt, Human
gcaaggcccugcugcccaa

SEQ ID NO: 3755203 - RNA, 20 nt, Human
gcaaggccgcuguucaccca

SEQ ID NO: 3755204 - RNA, 20 nt, Human
gcaaggccugguguuucuug

SEQ ID NO: 3755205 - RNA, 16 nt, Human
gcaaggcgcuaacuug

SEQ ID NO: 3755206 - RNA, 20 nt, Human
gcaaggcgcuaacuugcuua

SEQ ID NO: 3755207 - RNA, 23 nt, Human
gcaaggcgguggacuugaacuuu

SEQ ID NO: 3755208 - RNA, 11 nt, Human
gcaaggcuguc

SEQ ID NO: 3755209 - RNA, 13 nt, Human
gcaaggcugucaa

SEQ ID NO: 3755210 - RNA, 14 nt, Human
gcaaggcugucaau

SEQ ID NO: 3755211 - RNA, 18 nt, Human
gcaaggcugucaauuaca

SEQ ID NO: 3755212 - RNA, 18 nt, Human
gcaaggcugugcucccug

SEQ ID NO: 3755213 - RNA, 21 nt, Human
gcaagggcggccuuucccacu

SEQ ID NO: 3755214 - RNA, 14 nt, Human
gcaaggggcucugc

SEQ ID NO: 3755215 - RNA, 14 nt, Human
gcaaggggugccug

SEQ ID NO: 3755216 - RNA, 16 nt, Human
gcaaggggugccuggg

SEQ ID NO: 3755217 - RNA, 15 nt, Human
gcaagguacucuggu

SEQ ID NO: 3755218 - RNA, 17 nt, Human
gcaagguacucugguga

SEQ ID NO: 3755219 - RNA, 18 nt, Human
gcaaggucuugcucuccu

SEQ ID NO: 3755220 - RNA, 21 nt, Human
gcaaggugcucacaccccauu

SEQ ID NO: 3755221 - RNA, 13 nt, Human
gcaagguggagug

SEQ ID NO: 3755222 - RNA, 23 nt, Human
gcaagguggaguggaugccucag

SEQ ID NO: 3755223 - RNA, 14 nt, Human
gcaagguuuaaguu

SEQ ID NO: 3755224 - RNA, 21 nt, Human
gcaagguuuaggcugguggcc

SEQ ID NO: 3755225 - RNA, 15 nt, Human
gcaagucagaggaug

SEQ ID NO: 3755226 - RNA, 21 nt, Human
gcaagucagaggauggccagu

SEQ ID NO: 3755227 - RNA, 23 nt, Human
gcaagucagaggauggccagugu

SEQ ID NO: 3755228 - RNA, 16 nt, Human
gcaaguccugcaacca

SEQ ID NO: 3755229 - RNA, 12 nt, Human
gcaagucugcag

SEQ ID NO: 3755230 - RNA, 13 nt, Human
gcaagucugcagg

SEQ ID NO: 3755231 - RNA, 18 nt, Human
gcaagugaagguuuacaa

SEQ ID NO: 3755232 - RNA, 15 nt, Human
gcaagugagagcugg

SEQ ID NO: 3755233 - RNA, 13 nt, Human
gauugcuuuuaaa

SEQ ID NO: 3755234 - RNA, 16 nt, Human
gauugcuuuuaaaauu

SEQ ID NO: 3755235 - RNA, 21 nt, Human
gauuggaaggagacacagaug

SEQ ID NO: 3755236 - RNA, 22 nt, Human
gauuggaaggagacacagaugu

SEQ ID NO: 3755237 - RNA, 14 nt, Human
gauuggacaaaaug

SEQ ID NO: 3755238 - RNA, 16 nt, Human
gauuggacggccugau

SEQ ID NO: 3755239 - RNA, 14 nt, Human
gauuggauuauuca

SEQ ID NO: 3755240 - RNA, 22 nt, Human
gauuggauuauuuaauaacauu

SEQ ID NO: 3755241 - RNA, 19 nt, Human
gauuggauuuuauguugac

SEQ ID NO: 3755242 - RNA, 22 nt, Human
gauuggauuuuauguugacauu

SEQ ID NO: 3755243 - RNA, 11 nt, Human
gauuggccugu

SEQ ID NO: 3755244 - RNA, 20 nt, Human
gauuggccuguagaguugcu

SEQ ID NO: 3755245 - RNA, 17 nt, Human
gauuggcucacacugag

SEQ ID NO: 3755246 - RNA, 20 nt, Human
gauuggcucacacugagaau

SEQ ID NO: 3755247 - RNA, 18 nt, Human
gauuggcuuguguguuuc

SEQ ID NO: 3755248 - RNA, 15 nt, Human
gauugggccccugcc

SEQ ID NO: 3755249 - RNA, 22 nt, Human
gauuggggaagagagccugcag

SEQ ID NO: 3755250 - RNA, 14 nt, Human
gauugggggcuggu

SEQ ID NO: 3755251 - RNA, 17 nt, Human
gauugggggcuggugcc

SEQ ID NO: 3755252 - RNA, 12 nt, Human
gauugggucuag

SEQ ID NO: 3755253 - RNA, 20 nt, Human
gauugggugggcaggaaaag

SEQ ID NO: 3755254 - RNA, 15 nt, Human
gauugguuucucuuc

SEQ ID NO: 3755255 - RNA, 16 nt, Human
gauugguuucucuucu

SEQ ID NO: 3755256 - RNA, 12 nt, Human
gauuguaaaaua

SEQ ID NO: 3755257 - RNA, 23 nt, Human
gauuguaaaauagcuuguauagu

SEQ ID NO: 3755258 - RNA, 13 nt, Human
gauuguaaacuuc

SEQ ID NO: 3755259 - RNA, 19 nt, Human
gauuguaacguugcugugg

SEQ ID NO: 3755260 - RNA, 11 nt, Human
gauuguaacuc

SEQ ID NO: 3755261 - RNA, 21 nt, Human
gauuguacagaaucauugcuu

SEQ ID NO: 3755262 - RNA, 20 nt, Human
gauuguaggugcaagaugga

SEQ ID NO: 3755263 - RNA, 10 nt, Human
gauuguauug

SEQ ID NO: 3755264 - RNA, 15 nt, Human
gauuguauugcuguc

SEQ ID NO: 3755265 - RNA, 21 nt, Human
gauugucaaugcuggagaaaa

SEQ ID NO: 3755266 - RNA, 16 nt, Human
gauuguccuuuugcaa

SEQ ID NO: 3755267 - RNA, 18 nt, Human
gauuguccuuuugcaaag

SEQ ID NO: 3755268 - RNA, 19 nt, Human
gauugugucccauuccccc

SEQ ID NO: 3755269 - RNA, 16 nt, Human
gauuguuauuaaaugu

SEQ ID NO: 3755270 - RNA, 17 nt, Human
gauuguuugcucugaga

SEQ ID NO: 3755271 - RNA, 18 nt, Human
gauuuaaaagccugcuca

SEQ ID NO: 3755272 - RNA, 16 nt, Human
gauuuaaacaaacaaa

SEQ ID NO: 3755273 - RNA, 20 nt, Human
gauuuaaacacauuaaaggu

SEQ ID NO: 3755274 - RNA, 12 nt, Human
gauuuaaaucag

SEQ ID NO: 3755275 - RNA, 12 nt, Human
gauuuaaaugcc

SEQ ID NO: 3755276 - RNA, 14 nt, Human
gauuuaaauuuaag

SEQ ID NO: 3755277 - RNA, 14 nt, Human
gauuuaacagaaau

SEQ ID NO: 3755278 - RNA, 15 nt, Human
gauuuaacagaaaug

SEQ ID NO: 3755279 - RNA, 18 nt, Human
gauuuaacagaaauguac

SEQ ID NO: 3755280 - RNA, 19 nt, Human
gauuuaacagaaauguaca

SEQ ID NO: 3755281 - RNA, 23 nt, Human
gauuuaacagaaauguacagcaa

SEQ ID NO: 3755282 - RNA, 18 nt, Human
gauuuaacauuaucuagu

SEQ ID NO: 3755283 - RNA, 20 nt, Human
gauuuaagggcccaggucag

SEQ ID NO: 3755284 - RNA, 13 nt, Human
gauuuaagguauu

SEQ ID NO: 3755285 - RNA, 17 nt, Human
gauuuaaguuacaaugu

SEQ ID NO: 3755286 - RNA, 15 nt, Human
gauuuaauaguguua

SEQ ID NO: 3755287 - RNA, 21 nt, Human
gauuuaauaguguuaaucaau

SEQ ID NO: 3755288 - RNA, 14 nt, Human
gauuuaauauggau

SEQ ID NO: 3755289 - RNA, 13 nt, Human
gauuuaauucucu

SEQ ID NO: 3755290 - RNA, 16 nt, Human
gauuuaauuugaaaua

SEQ ID NO: 3755291 - RNA, 19 nt, Human
gauuuaauuugauaucaca

SEQ ID NO: 3755292 - RNA, 23 nt, Human
gauuuaauuugauaucacagucu

SEQ ID NO: 3755293 - RNA, 15 nt, Human
gauuuaauuugccaa

SEQ ID NO: 3755294 - RNA, 23 nt, Human
gauuuaauuugccaaaauaaugu

SEQ ID NO: 3755295 - RNA, 16 nt, Human
gauuuacacugggaga

SEQ ID NO: 3755296 - RNA, 22 nt, Human
gauuuacaguuucaaaaacugu

SEQ ID NO: 3755297 - RNA, 21 nt, Human
gauuuacccagaaugucagau

SEQ ID NO: 3755298 - RNA, 12 nt, Human
gauuuagaaaaa

SEQ ID NO: 3755299 - RNA, 20 nt, Human
gauuuagaaaaaaguuuaca

SEQ ID NO: 3755300 - RNA, 21 nt, Human
gauuuagaaaaaaguuuacaa

SEQ ID NO: 3755301 - RNA, 21 nt, Human
gauuuaguguuuuuaccucug

SEQ ID NO: 3755302 - RNA, 15 nt, Human
gauuuaguuucagua

SEQ ID NO: 3755303 - RNA, 15 nt, Human
gauuuauacucauuu

SEQ ID NO: 3755304 - RNA, 15 nt, Human
gauuuaucaaaucag

SEQ ID NO: 3755305 - RNA, 15 nt, Human
gauuuaucacacaaa

SEQ ID NO: 3755306 - RNA, 12 nt, Human
gauuuauuaaag

SEQ ID NO: 3755307 - RNA, 19 nt, Human
gauuuauuaaagaaaaaaa

SEQ ID NO: 3755308 - RNA, 12 nt, Human
gauuuauuuaaa

SEQ ID NO: 3755309 - RNA, 18 nt, Human
gauuuauuuaaaauagca

SEQ ID NO: 3755310 - RNA, 22 nt, Human
gauuuauuucaucauauuauac

SEQ ID NO: 3755311 - RNA, 13 nt, Human
gauuuauuugcuu

SEQ ID NO: 3755312 - RNA, 22 nt, Human
gauuucaagaaaaaauaaaugg

SEQ ID NO: 3755313 - RNA, 15 nt, Human
gauuucaagauccuc

SEQ ID NO: 3755314 - RNA, 14 nt, Human
gauuucacaaauau

SEQ ID NO: 3755315 - RNA, 12 nt, Human
gauuucacucuc

SEQ ID NO: 3755316 - RNA, 16 nt, Human
gauuucacucuccuug

SEQ ID NO: 3755317 - RNA, 17 nt, Human
gauuucagcucacugca

SEQ ID NO: 3755318 - RNA, 17 nt, Human
gauuucauaguucagaa

SEQ ID NO: 3755319 - RNA, 18 nt, Human
gauuucauaguucagaau

SEQ ID NO: 3755320 - RNA, 20 nt, Human
gauuucaucugcucuccuuc

SEQ ID NO: 3755321 - RNA, 21 nt, Human
gauuucaucugcucuccuucc

SEQ ID NO: 3755322 - RNA, 22 nt, Human
gauuucaucugcucuccuuccu

SEQ ID NO: 3755323 - RNA, 18 nt, Human
gauuucaugcuaucucug

SEQ ID NO: 3755324 - RNA, 18 nt, Human
gauuuccaaguaauauaa

SEQ ID NO: 3755325 - RNA, 22 nt, Human
gauuucccauccccugugggaa

SEQ ID NO: 3755326 - RNA, 21 nt, Human
gauuuccccccuccgccucca

SEQ ID NO: 3755327 - RNA, 21 nt, Human
gauuuccucuugaaccagaac

SEQ ID NO: 3755328 - RNA, 12 nt, Human
gauuuccuucuu

SEQ ID NO: 3755329 - RNA, 22 nt, Human
gauuuccuugaauguggcuuga

SEQ ID NO: 3755330 - RNA, 23 nt, Human
gauuucuagaaagccuguucccc

SEQ ID NO: 3755331 - RNA, 20 nt, Human
gauuucuaguuauuuauucu

SEQ ID NO: 3755332 - RNA, 13 nt, Human
gauuucucuuuga

SEQ ID NO: 3755333 - RNA, 11 nt, Human
gauuucugauu

SEQ ID NO: 3755334 - RNA, 16 nt, Human
gauuucugccuuccuu

SEQ ID NO: 3755335 - RNA, 17 nt, Human
gauuucugccuuccuug

SEQ ID NO: 3755336 - RNA, 16 nt, Human
gauuucugguucugau

SEQ ID NO: 3755337 - RNA, 18 nt, Human
gauuucugguucugaugc

SEQ ID NO: 3755338 - RNA, 21 nt, Human
gauuucuguuuagauaauaca

SEQ ID NO: 3755339 - RNA, 11 nt, Human
gauuucuuucc

SEQ ID NO: 3755340 - RNA, 15 nt, Human
gauuucuuuccagag

SEQ ID NO: 3755341 - RNA, 17 nt, Human
gauuucuuuccagaggg

SEQ ID NO: 3755342 - RNA, 17 nt, Human
gauuucuuugcuguaag

SEQ ID NO: 3755343 - RNA, 22 nt, Human
gauuucuuuuguaauaaacuau

SEQ ID NO: 3755344 - RNA, 16 nt, Human
gauuugaacucagauc

SEQ ID NO: 3755345 - RNA, 20 nt, Human
gauuugaagaacaugugaga

SEQ ID NO: 3755346 - RNA, 16 nt, Human
gauuugaagcaaagca

SEQ ID NO: 3755347 - RNA, 13 nt, Human
gauuugacauugc

SEQ ID NO: 3755348 - RNA, 17 nt, Human
gauuugaccuccucccu

SEQ ID NO: 3755349 - RNA, 18 nt, Human
gauuugacuguuuuuacc

SEQ ID NO: 3755350 - RNA, 21 nt, Human
gauuugaugcuggagagguua

SEQ ID NO: 3755351 - RNA, 11 nt, Human
gauuugcaaua

SEQ ID NO: 3755352 - RNA, 19 nt, Human
gauuugcauauucauucau

SEQ ID NO: 3755353 - RNA, 17 nt, Human
gauuugccauagaguac

SEQ ID NO: 3755354 - RNA, 15 nt, Human
gauuugccugugcca

SEQ ID NO: 3755355 - RNA, 21 nt, Human
gauuugcugggcaguuuuucu

SEQ ID NO: 3755356 - RNA, 12 nt, Human
gauuuggaaaaa

SEQ ID NO: 3755357 - RNA, 15 nt, Human
gauuugggaaccaag

SEQ ID NO: 3755358 - RNA, 23 nt, Human
gauuugggcuggaacagauucac

SEQ ID NO: 3755359 - RNA, 20 nt, Human
gauuuggggcucagaguggg

SEQ ID NO: 3755360 - RNA, 19 nt, Human
gauuuguaacccacugaga

SEQ ID NO: 3755361 - RNA, 21 nt, Human
gauuuguacuacaguucuuuu

SEQ ID NO: 3755362 - RNA, 23 nt, Human
gauuuguaggaaggucucauucu

SEQ ID NO: 3755363 - RNA, 17 nt, Human
gauuugucacugcuuca

SEQ ID NO: 3755364 - RNA, 14 nt, Human
gauuugucccaggu

SEQ ID NO: 3755365 - RNA, 21 nt, Human
gauuuguccuuggggacaucu

SEQ ID NO: 3755366 - RNA, 11 nt, Human
gauuugugaac

SEQ ID NO: 3755367 - RNA, 20 nt, Human
gauuugugaacucagccaag

SEQ ID NO: 3755368 - RNA, 19 nt, Human
gauuuguuaaugauagcua

SEQ ID NO: 3755369 - RNA, 22 nt, Human
gauuuguugccaugugcaccuu

SEQ ID NO: 3755370 - RNA, 17 nt, Human
gauuuguuuuagaauga

SEQ ID NO: 3755371 - RNA, 22 nt, Human
gauuuguuuuuaaacuguacag

SEQ ID NO: 3755372 - RNA, 12 nt, Human
gauuuuaaaaug

SEQ ID NO: 3755373 - RNA, 22 nt, Human
gauuuuaaagagugaaaaauga

SEQ ID NO: 3755374 - RNA, 12 nt, Human
gauuuuaaaugu

SEQ ID NO: 3755375 - RNA, 21 nt, Human
gauuuuaaauucacaauagaa

SEQ ID NO: 3755376 - RNA, 14 nt, Human
gauuuuaacaauaa

SEQ ID NO: 3755377 - RNA, 17 nt, Human
gauuuuaacaauaacua

SEQ ID NO: 3755378 - RNA, 15 nt, Human
gauuuuaacuuaacu

SEQ ID NO: 3755379 - RNA, 20 nt, Human
gauuuuaacuuaacugaaau

SEQ ID NO: 3755380 - RNA, 22 nt, Human
gauuuuaauagggaauauaucu

SEQ ID NO: 3755381 - RNA, 17 nt, Human
gauuuuaaucaaguuga

SEQ ID NO: 3755382 - RNA, 18 nt, Human
gauuuuaaucaaguugaa

SEQ ID NO: 3755383 - RNA, 16 nt, Human
cugaugagaauuuaua

SEQ ID NO: 3755384 - RNA, 11 nt, Human
cugaugagcaa

SEQ ID NO: 3755385 - RNA, 17 nt, Human
cugaugaugugccuggg

SEQ ID NO: 3755386 - RNA, 21 nt, Human
cugaugauuuagagugcuguc

SEQ ID NO: 3755387 - RNA, 20 nt, Human
cugaugauuucuugaaaagg

SEQ ID NO: 3755388 - RNA, 23 nt, Human
cugaugcagucacguggaggagc

SEQ ID NO: 3755389 - RNA, 14 nt, Human
cugaugcaucagaa

SEQ ID NO: 3755390 - RNA, 22 nt, Human
cugaugcaucagaaagggaggg

SEQ ID NO: 3755391 - RNA, 14 nt, Human
cugaugcucccucc

SEQ ID NO: 3755392 - RNA, 15 nt, Human
cugaugcucccuccc

SEQ ID NO: 3755393 - RNA, 23 nt, Human
cugaugcugagauucuucaggcu

SEQ ID NO: 3755394 - RNA, 14 nt, Human
cugaugcugccccu

SEQ ID NO: 3755395 - RNA, 19 nt, Human
cugaugcugggcugggugc

SEQ ID NO: 3755396 - RNA, 18 nt, Human
cugaugcuucuucagaga

SEQ ID NO: 3755397 - RNA, 18 nt, Human
cugauggaaacaaagugg

SEQ ID NO: 3755398 - RNA, 18 nt, Human
cugauggaauuuuuuugu

SEQ ID NO: 3755399 - RNA, 17 nt, Human
cugauggagaaggaagg

SEQ ID NO: 3755400 - RNA, 22 nt, Human
cugauggcacuuagcuaucaga

SEQ ID NO: 3755401 - RNA, 16 nt, Human
cugauggcaggauggc

SEQ ID NO: 3755402 - RNA, 19 nt, Human
cugauggccuuaauuuccu

SEQ ID NO: 3755403 - RNA, 20 nt, Human
cugauggccuuaauuuccuu

SEQ ID NO: 3755404 - RNA, 21 nt, Human
cugauggccuuaauuuccuuu

SEQ ID NO: 3755405 - RNA, 12 nt, Human
cugauggcuucu

SEQ ID NO: 3755406 - RNA, 22 nt, Human
cugaugggaaaacugccaauau

SEQ ID NO: 3755407 - RNA, 18 nt, Human
cugaugggcaacccccag

SEQ ID NO: 3755408 - RNA, 23 nt, Human
cugaugggcguacgcuggugcug

SEQ ID NO: 3755409 - RNA, 21 nt, Human
cugaugggguggaaggcaugg

SEQ ID NO: 3755410 - RNA, 16 nt, Human
cugaugguacaggaaa

SEQ ID NO: 3755411 - RNA, 14 nt, Human
cugauggucagcuc

SEQ ID NO: 3755412 - RNA, 15 nt, Human
cugauggucagcucc

SEQ ID NO: 3755413 - RNA, 14 nt, Human
cugauggugcaaug

SEQ ID NO: 3755414 - RNA, 19 nt, Human
cugauggugcaaugaccuu

SEQ ID NO: 3755415 - RNA, 21 nt, Human
cugaugguguggccuguggcu

SEQ ID NO: 3755416 - RNA, 16 nt, Human
cugauguaaaugaagu

SEQ ID NO: 3755417 - RNA, 18 nt, Human
cugauguacaguugggaa

SEQ ID NO: 3755418 - RNA, 15 nt, Human
cugauguccucacca

SEQ ID NO: 3755419 - RNA, 15 nt, Human
cugaugucuccuaag

SEQ ID NO: 3755420 - RNA, 20 nt, Human
cugauguguccucagggagc

SEQ ID NO: 3755421 - RNA, 17 nt, Human
cugauguuaggcugggc

SEQ ID NO: 3755422 - RNA, 13 nt, Human
cugauguucagug

SEQ ID NO: 3755423 - RNA, 15 nt, Human
cugauguucagugua

SEQ ID NO: 3755424 - RNA, 17 nt, Human
cugauguucaguguaau

SEQ ID NO: 3755425 - RNA, 20 nt, Human
cugauguuccuagugaaaga

SEQ ID NO: 3755426 - RNA, 21 nt, Human
cugauguuccuagugaaagag

SEQ ID NO: 3755427 - RNA, 15 nt, Human
cugauguuggaagag

SEQ ID NO: 3755428 - RNA, 12 nt, Human
cugauguugugu

SEQ ID NO: 3755429 - RNA, 21 nt, Human
cugauuaaaaugcuuccuccc

SEQ ID NO: 3755430 - RNA, 12 nt, Human
cugauuagcuuu

SEQ ID NO: 3755431 - RNA, 15 nt, Human
cugauuagcuuugug

SEQ ID NO: 3755432 - RNA, 22 nt, Human
cugauuaguaagucuugccuau

SEQ ID NO: 3755433 - RNA, 23 nt, Human
cugauuaugucuuuuauauuugu

SEQ ID NO: 3755434 - RNA, 13 nt, Human
cugauucacugca

SEQ ID NO: 3755435 - RNA, 17 nt, Human
cugauucgaaugacacu

SEQ ID NO: 3755436 - RNA, 15 nt, Human
cugauucucaggguc

SEQ ID NO: 3755437 - RNA, 21 nt, Human
cugauucucagggucucugcu

SEQ ID NO: 3755438 - RNA, 14 nt, Human
cugauucugggaug

SEQ ID NO: 3755439 - RNA, 22 nt, Human
cugauucuuguugcuguacaaa

SEQ ID NO: 3755440 - RNA, 16 nt, Human
cugauugaccugcucc

SEQ ID NO: 3755441 - RNA, 23 nt, Human
cugauuguaacguugcuguggga

SEQ ID NO: 3755442 - RNA, 13 nt, Human
cugauuguauuua

SEQ ID NO: 3755443 - RNA, 21 nt, Human
cugauugugucucuugguccu

SEQ ID NO: 3755444 - RNA, 17 nt, Human
cugauuguuucauugcg

SEQ ID NO: 3755445 - RNA, 12 nt, Human
cugauuuacagu

SEQ ID NO: 3755446 - RNA, 16 nt, Human
cugauuuaggagaagc

SEQ ID NO: 3755447 - RNA, 20 nt, Human
cugauuuaggagaagccagg

SEQ ID NO: 3755448 - RNA, 22 nt, Human
cugauuuaggagaagccaggaa

SEQ ID NO: 3755449 - RNA, 13 nt, Human
cugauuuccccuu

SEQ ID NO: 3755450 - RNA, 18 nt, Human
cugauuuccccuuuugca

SEQ ID NO: 3755451 - RNA, 14 nt, Human
cugauuuccuuugg

SEQ ID NO: 3755452 - RNA, 21 nt, Human
cugauuucuagaacccgugac

SEQ ID NO: 3755453 - RNA, 14 nt, Human
cugauuucuccugc

SEQ ID NO: 3755454 - RNA, 13 nt, Human
cugauuucuucag

SEQ ID NO: 3755455 - RNA, 13 nt, Human
cugauuucuuuuc

SEQ ID NO: 3755456 - RNA, 21 nt, Human
cugauuugacauagucuggcu

SEQ ID NO: 3755457 - RNA, 23 nt, Human
cugauuugacauagucuggcugu

SEQ ID NO: 3755458 - RNA, 11 nt, Human
cugauuugcaa

SEQ ID NO: 3755459 - RNA, 16 nt, Human
cugauuugcugcucuu

SEQ ID NO: 3755460 - RNA, 21 nt, Human
cugauuugcugggcaguuuuu

SEQ ID NO: 3755461 - RNA, 23 nt, Human
cugauuugguacuuuugagugug

SEQ ID NO: 3755462 - RNA, 12 nt, Human
cugauuuuaaca

SEQ ID NO: 3755463 - RNA, 22 nt, Human
cugauuuuaauggauuguuaau

SEQ ID NO: 3755464 - RNA, 23 nt, Human
cugauuuuaauggauuguuaauu

SEQ ID NO: 3755465 - RNA, 10 nt, Human
cugauuuuau

SEQ ID NO: 3755466 - RNA, 15 nt, Human
cugauuuuauucuug

SEQ ID NO: 3755467 - RNA, 16 nt, Human
cugauuuuauucuuga

SEQ ID NO: 3755468 - RNA, 21 nt, Human
cugauuuucaaagcuuuuucc

SEQ ID NO: 3755469 - RNA, 15 nt, Human
cugauuuuuuuuccu

SEQ ID NO: 3755470 - RNA, 23 nt, Human
cugauuuuuuuuuccuucagugc

SEQ ID NO: 3755471 - RNA, 14 nt, Human
cugcaaaaagaaaa

SEQ ID NO: 3755472 - RNA, 15 nt, Human
cugcaaaaauauuua

SEQ ID NO: 3755473 - RNA, 20 nt, Human
cugcaaaaauauuuauaaaa

SEQ ID NO: 3755474 - RNA, 21 nt, Human
cugcaaaaauauuuauaaaac

SEQ ID NO: 3755475 - RNA, 18 nt, Human
cugcaaaaggacucucag

SEQ ID NO: 3755476 - RNA, 12 nt, Human
cugcaaaauaga

SEQ ID NO: 3755477 - RNA, 13 nt, Human
cugcaaaaucugu

SEQ ID NO: 3755478 - RNA, 14 nt, Human
cugcaaaaugagac

SEQ ID NO: 3755479 - RNA, 22 nt, Human
cugcaaacaccaacauguuggg

SEQ ID NO: 3755480 - RNA, 21 nt, Human
cugcaaacagaacagggucau

SEQ ID NO: 3755481 - RNA, 13 nt, Human
cugcaaacgcugc

SEQ ID NO: 3755482 - RNA, 17 nt, Human
cugcaaacgcugccugc

SEQ ID NO: 3755483 - RNA, 18 nt, Human
cugcaaacgcugccugcc

SEQ ID NO: 3755484 - RNA, 19 nt, Human
cugcaaacgcugccugccc

SEQ ID NO: 3755485 - RNA, 15 nt, Human
cugcaaacugccuuc

SEQ ID NO: 3755486 - RNA, 15 nt, Human
cugcaaacugggaac

SEQ ID NO: 3755487 - RNA, 23 nt, Human
cugcaaacugggaaccccuuucc

SEQ ID NO: 3755488 - RNA, 17 nt, Human
cugcaaagcccagcuug

SEQ ID NO: 3755489 - RNA, 18 nt, Human
cugcaaagcccagcuuga

SEQ ID NO: 3755490 - RNA, 14 nt, Human
cugcaaaggacaga

SEQ ID NO: 3755491 - RNA, 22 nt, Human
cugcaaaggacuguuuuuuccu

SEQ ID NO: 3755492 - RNA, 13 nt, Human
cugcaaagguaau

SEQ ID NO: 3755493 - RNA, 23 nt, Human
cugcaaaguguuuuguaccagug

SEQ ID NO: 3755494 - RNA, 21 nt, Human
cugcaaaucagccaugugcug

SEQ ID NO: 3755495 - RNA, 20 nt, Human
cugcaaaucugauggccuua

SEQ ID NO: 3755496 - RNA, 12 nt, Human
cugcaacaaaau

SEQ ID NO: 3755497 - RNA, 12 nt, Human
cugcaacaggcu

SEQ ID NO: 3755498 - RNA, 21 nt, Human
cugcaaccaaacucccaucag

SEQ ID NO: 3755499 - RNA, 16 nt, Human
cugcaaccuccaccuc

SEQ ID NO: 3755500 - RNA, 20 nt, Human
cugcaaccuccgccucuugg

SEQ ID NO: 3755501 - RNA, 19 nt, Human
cugcaaccugauugugucu

SEQ ID NO: 3755502 - RNA, 21 nt, Human
cugcaaccugauugugucucu

SEQ ID NO: 3755503 - RNA, 22 nt, Human
cugcaaccugauugugucucuu

SEQ ID NO: 3755504 - RNA, 15 nt, Human
cugcaacucaaggac

SEQ ID NO: 3755505 - RNA, 14 nt, Human
cugcaacuucugcc

SEQ ID NO: 3755506 - RNA, 19 nt, Human
cugcaacuuguaaaugugg

SEQ ID NO: 3755507 - RNA, 17 nt, Human
cugcaacuuuaagcagc

SEQ ID NO: 3755508 - RNA, 18 nt, Human
cugcaagaauugaagcag

SEQ ID NO: 3755509 - RNA, 19 nt, Human
cugcaagagccuugguguc

SEQ ID NO: 3755510 - RNA, 16 nt, Human
cugcaagaggcuccug

SEQ ID NO: 3755511 - RNA, 20 nt, Human
cugcaagauucugaaacauu

SEQ ID NO: 3755512 - RNA, 21 nt, Human
cugcaagcuccgccucccggg

SEQ ID NO: 3755513 - RNA, 16 nt, Human
cugcaaggcccacagg

SEQ ID NO: 3755514 - RNA, 17 nt, Human
cugcaaggcccacagga

SEQ ID NO: 3755515 - RNA, 17 nt, Human
cugcaaggccuuucugu

SEQ ID NO: 3755516 - RNA, 12 nt, Human
cugcaagggagu

SEQ ID NO: 3755517 - RNA, 22 nt, Human
cugcaagggcuccccacugccu

SEQ ID NO: 3755518 - RNA, 23 nt, Human
cugcaagguuuaggcugguggcc

SEQ ID NO: 3755519 - RNA, 15 nt, Human
cugcaagucagagga

SEQ ID NO: 3755520 - RNA, 15 nt, Human
cugcaaguccuuuug

SEQ ID NO: 3755521 - RNA, 19 nt, Human
cugcaagugagguguguca

SEQ ID NO: 3755522 - RNA, 14 nt, Human
cugcaauagagacu

SEQ ID NO: 3755523 - RNA, 15 nt, Human
cugcaauagagacug

SEQ ID NO: 3755524 - RNA, 23 nt, Human
cugcaauccugucuuucugagca

SEQ ID NO: 3755525 - RNA, 13 nt, Human
cugcaaugaaagg

SEQ ID NO: 3755526 - RNA, 18 nt, Human
cugcaaugugaucuaugu

SEQ ID NO: 3755527 - RNA, 23 nt, Human
cugcaauuaaagugauacugaaa

SEQ ID NO: 3755528 - RNA, 22 nt, Human
cugcaauucaaaaguuccaaga

SEQ ID NO: 3755529 - RNA, 18 nt, Human
cugcaauuucauaugcug

SEQ ID NO: 3755530 - RNA, 20 nt, Human
cugcaauuucauaugcugua

SEQ ID NO: 3755531 - RNA, 21 nt, Human
cugcacaaagcccuuccaugu

SEQ ID NO: 3755532 - RNA, 16 nt, Human
gcaagugagagcuggg

SEQ ID NO: 3755533 - RNA, 19 nt, Human
gcaagugagagcugggugu

SEQ ID NO: 3755534 - RNA, 15 nt, Human
gcaagugcuggaguc

SEQ ID NO: 3755535 - RNA, 21 nt, Human
gcaagugcuggagucuccuga

SEQ ID NO: 3755536 - RNA, 15 nt, Human
gcaagugucugugug

SEQ ID NO: 3755537 - RNA, 22 nt, Human
gcaagugugggggguccuucuc

SEQ ID NO: 3755538 - RNA, 23 nt, Human
gcaagugugugcacaugugugcg

SEQ ID NO: 3755539 - RNA, 21 nt, Human
gcaagugugugcaugugugcg

SEQ ID NO: 3755540 - RNA, 22 nt, Human
gcaagugugugcaugugugcga

SEQ ID NO: 3755541 - RNA, 14 nt, Human
gcaaguuaagagaa

SEQ ID NO: 3755542 - RNA, 19 nt, Human
gcaaguuaagagaaacuuu

SEQ ID NO: 3755543 - RNA, 13 nt, Human
gcaaguucccagu

SEQ ID NO: 3755544 - RNA, 15 nt, Human
gcaaguucccaguug

SEQ ID NO: 3755545 - RNA, 17 nt, Human
gcaaguucuagagaaga

SEQ ID NO: 3755546 - RNA, 20 nt, Human
gcaaguucuagagaagaggc

SEQ ID NO: 3755547 - RNA, 18 nt, Human
gcaaguuuccaucaucua

SEQ ID NO: 3755548 - RNA, 19 nt, Human
gcaauaaaauuauuugcag

SEQ ID NO: 3755549 - RNA, 12 nt, Human
gcaauaaaauuu

SEQ ID NO: 3755550 - RNA, 19 nt, Human
gcaauaaaauuuaaaaaau

SEQ ID NO: 3755551 - RNA, 21 nt, Human
gcaauaaaauuuaaaaaauaa

SEQ ID NO: 3755552 - RNA, 21 nt, Human
gcaauaaagcagcguuucuau

SEQ ID NO: 3755553 - RNA, 18 nt, Human
gcaauaaaucugacccag

SEQ ID NO: 3755554 - RNA, 14 nt, Human
gcaauaaauuuuga

SEQ ID NO: 3755555 - RNA, 14 nt, Human
gcaauaacuucuga

SEQ ID NO: 3755556 - RNA, 14 nt, Human
gcaauaagaacaaa

SEQ ID NO: 3755557 - RNA, 21 nt, Human
gcaauaagaauuuagggagaa

SEQ ID NO: 3755558 - RNA, 23 nt, Human
gcaauaccguguugguuuugacu

SEQ ID NO: 3755559 - RNA, 13 nt, Human
gcaauagaaacaa

SEQ ID NO: 3755560 - RNA, 14 nt, Human
gcaauagagacugu

SEQ ID NO: 3755561 - RNA, 13 nt, Human
gcaauaguguguu

SEQ ID NO: 3755562 - RNA, 17 nt, Human
gcaauauaucuaaauug

SEQ ID NO: 3755563 - RNA, 19 nt, Human
gcaauauauuuuguaugca

SEQ ID NO: 3755564 - RNA, 20 nt, Human
gcaauaucuucguuaguaau

SEQ ID NO: 3755565 - RNA, 21 nt, Human
gcaauauucucuguacauauu

SEQ ID NO: 3755566 - RNA, 21 nt, Human
gcaauauuuauggaugcaaca

SEQ ID NO: 3755567 - RNA, 20 nt, Human
gcaaucagauuuuccugugg

SEQ ID NO: 3755568 - RNA, 21 nt, Human
gcaauccauguuaguuuuuac

SEQ ID NO: 3755569 - RNA, 23 nt, Human
gcaauccucccacuucagccucc

SEQ ID NO: 3755570 - RNA, 17 nt, Human
gcaauccucucaccuca

SEQ ID NO: 3755571 - RNA, 13 nt, Human
gcaauccuuacaa

SEQ ID NO: 3755572 - RNA, 14 nt, Human
gcaauccuuacaaa

SEQ ID NO: 3755573 - RNA, 23 nt, Human
gcaaucuggggauacuggcaaag

SEQ ID NO: 3755574 - RNA, 12 nt, Human
gcaaucuuugaa

SEQ ID NO: 3755575 - RNA, 17 nt, Human
gcaaucuuugaaagacu

SEQ ID NO: 3755576 - RNA, 18 nt, Human
gcaaucuuugaaagacuu

SEQ ID NO: 3755577 - RNA, 14 nt, Human
gcaaugaacacuua

SEQ ID NO: 3755578 - RNA, 13 nt, Human
gcaaugaaggaaa

SEQ ID NO: 3755579 - RNA, 19 nt, Human
gcaaugaagucucugaagu

SEQ ID NO: 3755580 - RNA, 19 nt, Human
gcaaugacagguaaauuaa

SEQ ID NO: 3755581 - RNA, 16 nt, Human
gcaaugacaucucagg

SEQ ID NO: 3755582 - RNA, 21 nt, Human
gcaaugacaucucaggggcca

SEQ ID NO: 3755583 - RNA, 15 nt, Human
gcaaugaccuuucaa

SEQ ID NO: 3755584 - RNA, 17 nt, Human
gcaaugaugaaugagaa

SEQ ID NO: 3755585 - RNA, 16 nt, Human
gcaaugauuacucuuu

SEQ ID NO: 3755586 - RNA, 11 nt, Human
gcaaugcauuu

SEQ ID NO: 3755587 - RNA, 13 nt, Human
gcaaugccacagc

SEQ ID NO: 3755588 - RNA, 20 nt, Human
gcaaugcugaugaaucacug

SEQ ID NO: 3755589 - RNA, 23 nt, Human
gcaaugcuggcuguuggcugggg

SEQ ID NO: 3755590 - RNA, 19 nt, Human
gcaaugggagcugaggcca

SEQ ID NO: 3755591 - RNA, 20 nt, Human
gcaaugggagcugaggccac

SEQ ID NO: 3755592 - RNA, 17 nt, Human
gcaaugguaguuucugu

SEQ ID NO: 3755593 - RNA, 17 nt, Human
gcaauguaagcauacuu

SEQ ID NO: 3755594 - RNA, 22 nt, Human
gcaauguagaggggaaaagaga

SEQ ID NO: 3755595 - RNA, 15 nt, Human
gcaaugugggcagag

SEQ ID NO: 3755596 - RNA, 17 nt, Human
gcaauguguauaaacaa

SEQ ID NO: 3755597 - RNA, 20 nt, Human
gcaauguguauaaacaagaa

SEQ ID NO: 3755598 - RNA, 23 nt, Human
gcaauguguauaaacaagaaaaa

SEQ ID NO: 3755599 - RNA, 19 nt, Human
gcaauguguguauauggac

SEQ ID NO: 3755600 - RNA, 15 nt, Human
gcaauguuuauuuca

SEQ ID NO: 3755601 - RNA, 14 nt, Human
gcaauguuuugcuu

SEQ ID NO: 3755602 - RNA, 17 nt, Human
gcaauguuuugcuuuug

SEQ ID NO: 3755603 - RNA, 21 nt, Human
gcaauuaaacuuccaaagaaa

SEQ ID NO: 3755604 - RNA, 16 nt, Human
gcaauuaauuccuuca

SEQ ID NO: 3755605 - RNA, 19 nt, Human
gcaauuagguuuuuccuua

SEQ ID NO: 3755606 - RNA, 14 nt, Human
gcaauuccccucug

SEQ ID NO: 3755607 - RNA, 16 nt, Human
gcaauuccugcuccua

SEQ ID NO: 3755608 - RNA, 20 nt, Human
gcaauucuccugccucagcc

SEQ ID NO: 3755609 - RNA, 15 nt, Human
gcaauugauuucuuu

SEQ ID NO: 3755610 - RNA, 23 nt, Human
gcaauuggcaccgaagcccagag

SEQ ID NO: 3755611 - RNA, 12 nt, Human
gcaauugucuga

SEQ ID NO: 3755612 - RNA, 13 nt, Human
gcaauuucaaggu

SEQ ID NO: 3755613 - RNA, 14 nt, Human
gcaauuucauaugc

SEQ ID NO: 3755614 - RNA, 18 nt, Human
gcaauuuccuuuuuuguu

SEQ ID NO: 3755615 - RNA, 20 nt, Human
gcaauuuguuugugcuucua

SEQ ID NO: 3755616 - RNA, 17 nt, Human
gcaauuuuccuugaagc

SEQ ID NO: 3755617 - RNA, 18 nt, Human
gcaauuuugcauuugaau

SEQ ID NO: 3755618 - RNA, 14 nt, Human
gcaauuuuguaacg

SEQ ID NO: 3755619 - RNA, 14 nt, Human
gcaauuuugugguu

SEQ ID NO: 3755620 - RNA, 23 nt, Human
gcaauuuuuccaugaaguuugaa

SEQ ID NO: 3755621 - RNA, 23 nt, Human
gcacaaaaagauaccuuaaaauu

SEQ ID NO: 3755622 - RNA, 23 nt, Human
gcacaaaaugaaugaggucuggg

SEQ ID NO: 3755623 - RNA, 22 nt, Human
gcacaaaauucgaccugauuua

SEQ ID NO: 3755624 - RNA, 13 nt, Human
gcacaaacauuuu

SEQ ID NO: 3755625 - RNA, 18 nt, Human
gcacaaacucaccaucug

SEQ ID NO: 3755626 - RNA, 17 nt, Human
gcacaaagacccuggcu

SEQ ID NO: 3755627 - RNA, 13 nt, Human
gcacaaauauuua

SEQ ID NO: 3755628 - RNA, 18 nt, Human
gcacaacccccagcuccc

SEQ ID NO: 3755629 - RNA, 24 nt, Human
gcacaagaagcgugagacgccacc

SEQ ID NO: 3755630 - RNA, 16 nt, Human
gcacaagaauggauca

SEQ ID NO: 3755631 - RNA, 15 nt, Human
gcacaagcuccaagc

SEQ ID NO: 3755632 - RNA, 18 nt, Human
gcacaagcuccaagcucc

SEQ ID NO: 3755633 - RNA, 22 nt, Human
gcacaagcuccaagcucccagg

SEQ ID NO: 3755634 - RNA, 19 nt, Human
gcacaaguguaaugaauac

SEQ ID NO: 3755635 - RNA, 17 nt, Human
gcacaauaaaaauguuu

SEQ ID NO: 3755636 - RNA, 18 nt, Human
gcacaauaacuccuccca

SEQ ID NO: 3755637 - RNA, 21 nt, Human
gcacaauaacuccucccaggg

SEQ ID NO: 3755638 - RNA, 12 nt, Human
gcacaaugucuu

SEQ ID NO: 3755639 - RNA, 14 nt, Human
gcacaaugucuugg

SEQ ID NO: 3755640 - RNA, 12 nt, Human
gcacaauuauaa

SEQ ID NO: 3755641 - RNA, 12 nt, Human
gcacacacacaa

SEQ ID NO: 3755642 - RNA, 14 nt, Human
gcacacacacacac

SEQ ID NO: 3755643 - RNA, 16 nt, Human
gcacacacacacacag

SEQ ID NO: 3755644 - RNA, 20 nt, Human
gcacacacacacacaggagg

SEQ ID NO: 3755645 - RNA, 22 nt, Human
gcacacacacacacaugcacac

SEQ ID NO: 3755646 - RNA, 15 nt, Human
gcacacaccagagcc

SEQ ID NO: 3755647 - RNA, 17 nt, Human
gcacacaccagagccca

SEQ ID NO: 3755648 - RNA, 13 nt, Human
gcacacaccugua

SEQ ID NO: 3755649 - RNA, 17 nt, Human
gcacacacugugcuuuc

SEQ ID NO: 3755650 - RNA, 23 nt, Human
gcacacagcuuuuaguacccacc

SEQ ID NO: 3755651 - RNA, 16 nt, Human
gcacaccaaucuuacu

SEQ ID NO: 3755652 - RNA, 15 nt, Human
gcacacccagguuug

SEQ ID NO: 3755653 - RNA, 14 nt, Human
gcacaccgggcacu

SEQ ID NO: 3755654 - RNA, 17 nt, Human
gcacacgccucccacug

SEQ ID NO: 3755655 - RNA, 16 nt, Human
gcacacgcguuauagu

SEQ ID NO: 3755656 - RNA, 14 nt, Human
gcacacgcugcucu

SEQ ID NO: 3755657 - RNA, 18 nt, Human
gcacacgcugcucugccc

SEQ ID NO: 3755658 - RNA, 23 nt, Human
gcacacggggugcgucuccccgg

SEQ ID NO: 3755659 - RNA, 21 nt, Human
gcacacuccccugcacuggag

SEQ ID NO: 3755660 - RNA, 16 nt, Human
gcacacucuggucuug

SEQ ID NO: 3755661 - RNA, 20 nt, Human
gcacacuuggcccaaguggc

SEQ ID NO: 3755662 - RNA, 16 nt, Human
gcacagaaaacuagaa

SEQ ID NO: 3755663 - RNA, 23 nt, Human
gcacagaaaauggaagacagcuc

SEQ ID NO: 3755664 - RNA, 12 nt, Human
gcacagaaggag

SEQ ID NO: 3755665 - RNA, 15 nt, Human
gcacagaaguccugu

SEQ ID NO: 3755666 - RNA, 17 nt, Human
gcacagaaguccuguau

SEQ ID NO: 3755667 - RNA, 11 nt, Human
gcacagacagg

SEQ ID NO: 3755668 - RNA, 16 nt, Human
gcacagagaagacaaa

SEQ ID NO: 3755669 - RNA, 18 nt, Human
gcacagagcucuccagcu

SEQ ID NO: 3755670 - RNA, 23 nt, Human
gcacagagcucuccagcuccaag

SEQ ID NO: 3755671 - RNA, 12 nt, Human
gcacagaggccu

SEQ ID NO: 3755672 - RNA, 21 nt, Human
gcacagaguuguuacauuuuu

SEQ ID NO: 3755673 - RNA, 19 nt, Human
gcacagauggauuugccug

SEQ ID NO: 3755674 - RNA, 14 nt, Human
gcacagauggccag

SEQ ID NO: 3755675 - RNA, 13 nt, Human
gcacagauuuuaa

SEQ ID NO: 3755676 - RNA, 19 nt, Human
gcacagcaaggaggcuggc

SEQ ID NO: 3755677 - RNA, 22 nt, Human
gcacagcaaggaggcuggcugg

SEQ ID NO: 3755678 - RNA, 13 nt, Human
gcacagcagcauc

SEQ ID NO: 3755679 - RNA, 14 nt, Human
gcacagcagccugc

SEQ ID NO: 3755680 - RNA, 20 nt, Human
gcacagcagccugcuuccca

SEQ ID NO: 3755681 - RNA, 15 nt, Human
gcacagcagccuggg

SEQ ID NO: 3755682 - RNA, 15 nt, Human
gauuuuaauugucau

SEQ ID NO: 3755683 - RNA, 12 nt, Human
gauuuuacauga

SEQ ID NO: 3755684 - RNA, 24 nt, Human
gauuuuagcuaggauuugaacacu

SEQ ID NO: 3755685 - RNA, 19 nt, Human
gauuuuaugaucaguguug

SEQ ID NO: 3755686 - RNA, 22 nt, Human
gauuuuauuacuggcguggauu

SEQ ID NO: 3755687 - RNA, 20 nt, Human
gauuuuauuauguaaauccc

SEQ ID NO: 3755688 - RNA, 13 nt, Human
gauuuuauucuug

SEQ ID NO: 3755689 - RNA, 15 nt, Human
gauuuuauucuugau

SEQ ID NO: 3755690 - RNA, 17 nt, Human
gauuuucaaaagauaau

SEQ ID NO: 3755691 - RNA, 19 nt, Human
gauuuucaaagcuuuuucc

SEQ ID NO: 3755692 - RNA, 14 nt, Human
gauuuucauaacuu

SEQ ID NO: 3755693 - RNA, 15 nt, Human
gauuuucauguucuu

SEQ ID NO: 3755694 - RNA, 22 nt, Human
gauuuuccaggacuguuucaaa

SEQ ID NO: 3755695 - RNA, 16 nt, Human
gauuuuccaucuaaaa

SEQ ID NO: 3755696 - RNA, 13 nt, Human
gauuuuccugugg

SEQ ID NO: 3755697 - RNA, 13 nt, Human
gauuuucuccagc

SEQ ID NO: 3755698 - RNA, 16 nt, Human
gauuuucuccagcuca

SEQ ID NO: 3755699 - RNA, 20 nt, Human
gauuuucugcuacuuugcug

SEQ ID NO: 3755700 - RNA, 21 nt, Human
gauuuucugggccuaaaggau

SEQ ID NO: 3755701 - RNA, 16 nt, Human
gauuuucugguucuaa

SEQ ID NO: 3755702 - RNA, 21 nt, Human
gauuuugaaaacuacauuuua

SEQ ID NO: 3755703 - RNA, 21 nt, Human
gauuuugaaauuuuuauuaaa

SEQ ID NO: 3755704 - RNA, 12 nt, Human
gauuuugauaac

SEQ ID NO: 3755705 - RNA, 13 nt, Human
gauuuugauaacu

SEQ ID NO: 3755706 - RNA, 15 nt, Human
gauuuugcuguauau

SEQ ID NO: 3755707 - RNA, 22 nt, Human
gauuuugggagugacucaagaa

SEQ ID NO: 3755708 - RNA, 13 nt, Human
gauuuuguaaccc

SEQ ID NO: 3755709 - RNA, 16 nt, Human
gauuuuguaacccaga

SEQ ID NO: 3755710 - RNA, 13 nt, Human
gauuuuguguuua

SEQ ID NO: 3755711 - RNA, 15 nt, Human
gauuuuguuuugcuu

SEQ ID NO: 3755712 - RNA, 22 nt, Human
gauuuuguuuugcuuuuucuga

SEQ ID NO: 3755713 - RNA, 17 nt, Human
gauuuuuaaaaaauauu

SEQ ID NO: 3755714 - RNA, 21 nt, Human
gauuuuuaaaaaauauuuucu

SEQ ID NO: 3755715 - RNA, 22 nt, Human
gauuuuuaauuaaaaacuagua

SEQ ID NO: 3755716 - RNA, 20 nt, Human
gauuuuuauauuaguugcuu

SEQ ID NO: 3755717 - RNA, 20 nt, Human
gauuuuuauccaaucuuguu

SEQ ID NO: 3755718 - RNA, 23 nt, Human
gauuuuucuggagguugauaacu

SEQ ID NO: 3755719 - RNA, 13 nt, Human
gauuuuucuuuaa

SEQ ID NO: 3755720 - RNA, 13 nt, Human
gauuuuugccucu

SEQ ID NO: 3755721 - RNA, 17 nt, Human
gauuuuuuaaaagaaau

SEQ ID NO: 3755722 - RNA, 20 nt, Human
gauuuuuuacagcugccugc

SEQ ID NO: 3755723 - RNA, 13 nt, Human
aaccacuucccuc

SEQ ID NO: 3755724 - RNA, 17 nt, Human
aaccacuuguagauuug

SEQ ID NO: 3755725 - RNA, 21 nt, Human
gcacugagagagcgcagccgc

SEQ ID NO: 3755726 - RNA, 13 nt, Human
gcacugagcagag

SEQ ID NO: 3755727 - RNA, 11 nt, Human
gcacugaggaa

SEQ ID NO: 3755728 - RNA, 13 nt, Human
gcacugaggaaga

SEQ ID NO: 3755729 - RNA, 17 nt, Human
gcacugaggaccagcca

SEQ ID NO: 3755730 - RNA, 15 nt, Human
gcacugagggccaca

SEQ ID NO: 3755731 - RNA, 22 nt, Human
gcacugauauauuuaaaaacaa

SEQ ID NO: 3755732 - RNA, 14 nt, Human
gcacugauauuuua

SEQ ID NO: 3755733 - RNA, 20 nt, Human
gcacugauuucacaacagau

SEQ ID NO: 3755734 - RNA, 14 nt, Human
gcacugccaugcag

SEQ ID NO: 3755735 - RNA, 17 nt, Human
gcacugccaugcagggc

SEQ ID NO: 3755736 - RNA, 19 nt, Human
gcacugcccugguggcccu

SEQ ID NO: 3755737 - RNA, 14 nt, Human
gcacugccucucac

SEQ ID NO: 3755738 - RNA, 19 nt, Human
gcacugccucucacagcug

SEQ ID NO: 3755739 - RNA, 11 nt, Human
gcacugccuga

SEQ ID NO: 3755740 - RNA, 21 nt, Human
gcacugcuaggcgagugccag

SEQ ID NO: 3755741 - RNA, 12 nt, Human
gcacugcugccc

SEQ ID NO: 3755742 - RNA, 14 nt, Human
gcacugcugcccag

SEQ ID NO: 3755743 - RNA, 20 nt, Human
gcacugcugcccagccucca

SEQ ID NO: 3755744 - RNA, 15 nt, Human
gcacugcuggguggc

SEQ ID NO: 3755745 - RNA, 11 nt, Human
gcacugcugug

SEQ ID NO: 3755746 - RNA, 16 nt, Human
gcacugcuuccaguga

SEQ ID NO: 3755747 - RNA, 23 nt, Human
gcacugcuuccagugaggcucug

SEQ ID NO: 3755748 - RNA, 16 nt, Human
gcacugcuugaggaaa

SEQ ID NO: 3755749 - RNA, 14 nt, Human
gcacuggaguccag

SEQ ID NO: 3755750 - RNA, 18 nt, Human
gcacuggaguccagucuc

SEQ ID NO: 3755751 - RNA, 16 nt, Human
gcacuggagugcaggg

SEQ ID NO: 3755752 - RNA, 16 nt, Human
gcacuggauguggccc

SEQ ID NO: 3755753 - RNA, 19 nt, Human
gcacuggcaaacagggccu

SEQ ID NO: 3755754 - RNA, 22 nt, Human
gcacuggcaaacagggccucug

SEQ ID NO: 3755755 - RNA, 12 nt, Human
gcacuggcccag

SEQ ID NO: 3755756 - RNA, 15 nt, Human
gcacuggccccaccc

SEQ ID NO: 3755757 - RNA, 15 nt, Human
gcacuggccugcacg

SEQ ID NO: 3755758 - RNA, 16 nt, Human
gcacuggccuucugau

SEQ ID NO: 3755759 - RNA, 17 nt, Human
gcacuggccuucugaug

SEQ ID NO: 3755760 - RNA, 17 nt, Human
gcacuggcucucuccag

SEQ ID NO: 3755761 - RNA, 18 nt, Human
gcacuggcucucuccagg

SEQ ID NO: 3755762 - RNA, 18 nt, Human
gcacugggcucccgggcc

SEQ ID NO: 3755763 - RNA, 15 nt, Human
gcacugggcuccgga

SEQ ID NO: 3755764 - RNA, 12 nt, Human
gcacugggcugu

SEQ ID NO: 3755765 - RNA, 14 nt, Human
gcacugggcuuggg

SEQ ID NO: 3755766 - RNA, 19 nt, Human
gcacuggggagcccgucuc

SEQ ID NO: 3755767 - RNA, 18 nt, Human
gcacuggggcaggggccg

SEQ ID NO: 3755768 - RNA, 16 nt, Human
gcacugggggcagcgg

SEQ ID NO: 3755769 - RNA, 21 nt, Human
gcacuggguugcaggggauug

SEQ ID NO: 3755770 - RNA, 22 nt, Human
gcacugguagguugggacacca

SEQ ID NO: 3755771 - RNA, 14 nt, Human
gcacugguggcccg

SEQ ID NO: 3755772 - RNA, 19 nt, Human
gcacugguggcccgacagc

SEQ ID NO: 3755773 - RNA, 23 nt, Human
gcacugguggcccgacagccugg

SEQ ID NO: 3755774 - RNA, 19 nt, Human
gcacugguuuguucccugu

SEQ ID NO: 3755775 - RNA, 12 nt, Human
gcacuguaaaau

SEQ ID NO: 3755776 - RNA, 14 nt, Human
gcacuguaaaaugu

SEQ ID NO: 3755777 - RNA, 16 nt, Human
gcacuguaguucuaag

SEQ ID NO: 3755778 - RNA, 16 nt, Human
gcacuguaugcuggac

SEQ ID NO: 3755779 - RNA, 18 nt, Human
gcacugucacuuugcucu

SEQ ID NO: 3755780 - RNA, 12 nt, Human
gcacuguccugc

SEQ ID NO: 3755781 - RNA, 18 nt, Human
gcacugugaaggacccuu

SEQ ID NO: 3755782 - RNA, 13 nt, Human
gcacugugcucag

SEQ ID NO: 3755783 - RNA, 16 nt, Human
gcacugugcucagggc

SEQ ID NO: 3755784 - RNA, 19 nt, Human
gcacuguucccccugugca

SEQ ID NO: 3755785 - RNA, 20 nt, Human
gcacuguucccccugugcag

SEQ ID NO: 3755786 - RNA, 19 nt, Human
gcacuguuuuauuuuaauu

SEQ ID NO: 3755787 - RNA, 20 nt, Human
gcacuguuuucuaguguauc

SEQ ID NO: 3755788 - RNA, 21 nt, Human
gcacuguuuucuaguguauca

SEQ ID NO: 3755789 - RNA, 14 nt, Human
gcacuuaaagaagu

SEQ ID NO: 3755790 - RNA, 18 nt, Human
gcacuuaagagaauauuu

SEQ ID NO: 3755791 - RNA, 17 nt, Human
gcacuuagcuaucagaa

SEQ ID NO: 3755792 - RNA, 17 nt, Human
gcacuuauugaauauau

SEQ ID NO: 3755793 - RNA, 19 nt, Human
gcacuuauugaccauuuuu

SEQ ID NO: 3755794 - RNA, 14 nt, Human
gcacuuauuguaaa

SEQ ID NO: 3755795 - RNA, 18 nt, Human
gcacuucaaauucaaaua

SEQ ID NO: 3755796 - RNA, 14 nt, Human
gcacuucacagagu

SEQ ID NO: 3755797 - RNA, 23 nt, Human
gcacuucaucuggcugccuuugc

SEQ ID NO: 3755798 - RNA, 23 nt, Human
gcacuucauugagaguuuugucu

SEQ ID NO: 3755799 - RNA, 11 nt, Human
gcacuuccaaa

SEQ ID NO: 3755800 - RNA, 18 nt, Human
gcacuuccaaaauucuua

SEQ ID NO: 3755801 - RNA, 13 nt, Human
gcacuucccugcu

SEQ ID NO: 3755802 - RNA, 22 nt, Human
gcacuuccuguuuuauaaugaa

SEQ ID NO: 3755803 - RNA, 16 nt, Human
gcacuugcagacucua

SEQ ID NO: 3755804 - RNA, 16 nt, Human
gcacuuggagaggcug

SEQ ID NO: 3755805 - RNA, 14 nt, Human
gcacuuggccucug

SEQ ID NO: 3755806 - RNA, 17 nt, Human
gcacuuggggcaccuug

SEQ ID NO: 3755807 - RNA, 18 nt, Human
gcacuugggggcucagca

SEQ ID NO: 3755808 - RNA, 23 nt, Human
gcacuugggggcucagcaaggcc

SEQ ID NO: 3755809 - RNA, 16 nt, Human
gcacuuguccagcuga

SEQ ID NO: 3755810 - RNA, 17 nt, Human
gcacuugugauuauuua

SEQ ID NO: 3755811 - RNA, 20 nt, Human
gcacuuuagaauaugccuug

SEQ ID NO: 3755812 - RNA, 18 nt, Human
gcacuuucuucuucccau

SEQ ID NO: 3755813 - RNA, 22 nt, Human
gcacuuugaaauaccucauguu

SEQ ID NO: 3755814 - RNA, 23 nt, Human
gcacuuugaaauaccucauguuu

SEQ ID NO: 3755815 - RNA, 15 nt, Human
gcacuuugaugucau

SEQ ID NO: 3755816 - RNA, 19 nt, Human
gcacuuugcuuuaauauaa

SEQ ID NO: 3755817 - RNA, 20 nt, Human
gcacuuugcuuuaauauaaa

SEQ ID NO: 3755818 - RNA, 21 nt, Human
gcacuuuggcuuauaauucuu

SEQ ID NO: 3755819 - RNA, 20 nt, Human
gcacuuugggaggccgaggc

SEQ ID NO: 3755820 - RNA, 17 nt, Human
gcacuuuguaguguuug

SEQ ID NO: 3755821 - RNA, 22 nt, Human
gcagaaaaaccaacaucuacaa

SEQ ID NO: 3755822 - RNA, 18 nt, Human
gcagaaaaaugucauuga

SEQ ID NO: 3755823 - RNA, 17 nt, Human
gcagaaaacccuugggc

SEQ ID NO: 3755824 - RNA, 10 nt, Human
gcagaaacag

SEQ ID NO: 3755825 - RNA, 17 nt, Human
gcagaaacgaagccauc

SEQ ID NO: 3755826 - RNA, 18 nt, Human
gcagaaagcagaggcugg

SEQ ID NO: 3755827 - RNA, 21 nt, Human
gcagaaaggaaaaccugaaga

SEQ ID NO: 3755828 - RNA, 14 nt, Human
gcagaaagugccuu

SEQ ID NO: 3755829 - RNA, 16 nt, Human
gcagaaauccaagcac

SEQ ID NO: 3755830 - RNA, 14 nt, Human
gcagaaauucuguu

SEQ ID NO: 3755831 - RNA, 21 nt, Human
gcagaaauucuguuuuuaaaa

SEQ ID NO: 3755832 - RNA, 14 nt, Human
gcagaacaaaugaa

SEQ ID NO: 3755833 - RNA, 15 nt, Human
gcagaacaaaugaag

SEQ ID NO: 3755834 - RNA, 14 nt, Human
gcagaacacuaacc

SEQ ID NO: 3755835 - RNA, 18 nt, Human
gcagaacagccgcuccug

SEQ ID NO: 3755836 - RNA, 23 nt, Human
gcagaacagccgcuccugucugc

SEQ ID NO: 3755837 - RNA, 20 nt, Human
gcagaacaguuaagcagccg

SEQ ID NO: 3755838 - RNA, 14 nt, Human
gcagaacccuggug

SEQ ID NO: 3755839 - RNA, 14 nt, Human
gcagaacugagcuc

SEQ ID NO: 3755840 - RNA, 15 nt, Human
gcagaagaaaggaac

SEQ ID NO: 3755841 - RNA, 14 nt, Human
gcagaagacaccag

SEQ ID NO: 3755842 - RNA, 20 nt, Human
gcagaagacaccagagcaga

SEQ ID NO: 3755843 - RNA, 16 nt, Human
gcagaagagggugugu

SEQ ID NO: 3755844 - RNA, 21 nt, Human
gcagaagcaagggggugaugu

SEQ ID NO: 3755845 - RNA, 13 nt, Human
gcagaagcagcaa

SEQ ID NO: 3755846 - RNA, 23 nt, Human
gcagaagcucucgauggacaaug

SEQ ID NO: 3755847 - RNA, 13 nt, Human
gcagaaggaaaaa

SEQ ID NO: 3755848 - RNA, 13 nt, Human
gcagaagggagaa

SEQ ID NO: 3755849 - RNA, 18 nt, Human
gcagaagggagcuggcuc

SEQ ID NO: 3755850 - RNA, 23 nt, Human
gcagaagggggucucuucuucca

SEQ ID NO: 3755851 - RNA, 15 nt, Human
gcagaaguaagccuc

SEQ ID NO: 3755852 - RNA, 20 nt, Human
gcagaaguaggggaagaaua

SEQ ID NO: 3755853 - RNA, 14 nt, Human
gcagaauaaagcaa

SEQ ID NO: 3755854 - RNA, 16 nt, Human
gcagaauaaagcaauu

SEQ ID NO: 3755855 - RNA, 18 nt, Human
gcagaauaaucuuugggu

SEQ ID NO: 3755856 - RNA, 17 nt, Human
gcagaauagcaaggugc

SEQ ID NO: 3755857 - RNA, 23 nt, Human
gcagaauccuaggcuccacccca

SEQ ID NO: 3755858 - RNA, 18 nt, Human
gcagaauguaagugggcc

SEQ ID NO: 3755859 - RNA, 22 nt, Human
gcagaauguaagugggcccacc

SEQ ID NO: 3755860 - RNA, 17 nt, Human
gcagaauguuuuuaaaa

SEQ ID NO: 3755861 - RNA, 19 nt, Human
gcagacaauaaacccucag

SEQ ID NO: 3755862 - RNA, 20 nt, Human
gcagacacgccuuccccuca

SEQ ID NO: 3755863 - RNA, 23 nt, Human
gcagacacggaucugagaaucuu

SEQ ID NO: 3755864 - RNA, 13 nt, Human
gcagacagagcca

SEQ ID NO: 3755865 - RNA, 21 nt, Human
gcagacagagccaggagaagc

SEQ ID NO: 3755866 - RNA, 14 nt, Human
gcagacagcagcuc

SEQ ID NO: 3755867 - RNA, 16 nt, Human
gcagacagcagcucag

SEQ ID NO: 3755868 - RNA, 19 nt, Human
gcagacagcagcucaggca

SEQ ID NO: 3755869 - RNA, 20 nt, Human
gcagacagcaggcagcgcca

SEQ ID NO: 3755870 - RNA, 15 nt, Human
gcagacaggaccagg

SEQ ID NO: 3755871 - RNA, 17 nt, Human
gcagacaggaggaauca

SEQ ID NO: 3755872 - RNA, 13 nt, Human
gcagaccucccca

SEQ ID NO: 3755873 - RNA, 16 nt, Human
gcagaccuccccagcc

SEQ ID NO: 3755874 - RNA, 22 nt, Human
gcagaccuccccagccccuagc

SEQ ID NO: 3755875 - RNA, 20 nt, Human
gcacaauaguaaccugggua

SEQ ID NO: 3755876 - RNA, 20 nt, Human
gcacaauauugaacuuuuuu

SEQ ID NO: 3755877 - RNA, 21 nt, Human
gcacaaucucggcucacugca

SEQ ID NO: 3755878 - RNA, 20 nt, Human
gcacacaaggggcccuugga

SEQ ID NO: 3755879 - RNA, 10 nt, Human
gcacacacac

SEQ ID NO: 3755880 - RNA, 17 nt, Human
gcacacacacacacagg

SEQ ID NO: 3755881 - RNA, 21 nt, Human
gcacacacacacacaugcaca

SEQ ID NO: 3755882 - RNA, 12 nt, Human
gcacacaccaga

SEQ ID NO: 3755883 - RNA, 11 nt, Human
gcacacacugu

SEQ ID NO: 3755884 - RNA, 13 nt, Human
gcacacagaaaua

SEQ ID NO: 3755885 - RNA, 14 nt, Human
gcacacagaaauau

SEQ ID NO: 3755886 - RNA, 17 nt, Human
gcacacagaaauauaua

SEQ ID NO: 3755887 - RNA, 22 nt, Human
gcacacagaaauauauauacau

SEQ ID NO: 3755888 - RNA, 18 nt, Human
gcacacagaggggaguca

SEQ ID NO: 3755889 - RNA, 18 nt, Human
gcacacagcacgggggcc

SEQ ID NO: 3755890 - RNA, 13 nt, Human
gcacacagcuacu

SEQ ID NO: 3755891 - RNA, 21 nt, Human
gcacacagcuuuuaguaccca

SEQ ID NO: 3755892 - RNA, 11 nt, Human
gcacacauuuu

SEQ ID NO: 3755893 - RNA, 20 nt, Human
gcacaccaaucuuacuuugu

SEQ ID NO: 3755894 - RNA, 21 nt, Human
gcacaccaaucuuacuuugua

SEQ ID NO: 3755895 - RNA, 22 nt, Human
gcacaccaaucuuacuuuguaa

SEQ ID NO: 3755896 - RNA, 19 nt, Human
gcacacccucacucugcca

SEQ ID NO: 3755897 - RNA, 21 nt, Human
gcacacccucacucugccagg

SEQ ID NO: 3755898 - RNA, 19 nt, Human
gcacaccuccucccacugc

SEQ ID NO: 3755899 - RNA, 20 nt, Human
gcacacgcguuauaguaacu

SEQ ID NO: 3755900 - RNA, 21 nt, Human
gcacacgcugcucugccccag

SEQ ID NO: 3755901 - RNA, 20 nt, Human
gcacacucauccccucacuu

SEQ ID NO: 3755902 - RNA, 20 nt, Human
gcacacuccccugcacugga

SEQ ID NO: 3755903 - RNA, 13 nt, Human
gcacacucugcca

SEQ ID NO: 3755904 - RNA, 14 nt, Human
gcacacuuccagac

SEQ ID NO: 3755905 - RNA, 15 nt, Human
gcacagaaaacuaga

SEQ ID NO: 3755906 - RNA, 20 nt, Human
gcacagaaacacaauauuuu

SEQ ID NO: 3755907 - RNA, 17 nt, Human
gcacagaagcacaugca

SEQ ID NO: 3755908 - RNA, 13 nt, Human
gcacagaaguccu

SEQ ID NO: 3755909 - RNA, 19 nt, Human
gcacagaaguccuguaugu

SEQ ID NO: 3755910 - RNA, 15 nt, Human
gcacagacccugccc

SEQ ID NO: 3755911 - RNA, 16 nt, Human
gcacagacccugcccu

SEQ ID NO: 3755912 - RNA, 21 nt, Human
gcacagacccugcccuguggg

SEQ ID NO: 3755913 - RNA, 18 nt, Human
gcacagacgucccuccac

SEQ ID NO: 3755914 - RNA, 14 nt, Human
gcacagagaagcug

SEQ ID NO: 3755915 - RNA, 19 nt, Human
gcacagagagggggccacc

SEQ ID NO: 3755916 - RNA, 16 nt, Human
gcacagagagucugga

SEQ ID NO: 3755917 - RNA, 19 nt, Human
gcacagagcucuccagcuc

SEQ ID NO: 3755918 - RNA, 16 nt, Human
gcacagaguuguuaca

SEQ ID NO: 3755919 - RNA, 18 nt, Human
gcacagaguuguuacauu

SEQ ID NO: 3755920 - RNA, 20 nt, Human
gcacagauaaaaaguggaau

SEQ ID NO: 3755921 - RNA, 21 nt, Human
gcacagauuuuaauugucaug

SEQ ID NO: 3755922 - RNA, 13 nt, Human
gcacagcaaacug

SEQ ID NO: 3755923 - RNA, 17 nt, Human
gcacagcaaggaggcug

SEQ ID NO: 3755924 - RNA, 13 nt, Human
gcacagcagccug

SEQ ID NO: 3755925 - RNA, 17 nt, Human
gcacagcaggcugccag

SEQ ID NO: 3755926 - RNA, 22 nt, Human
gcacagcaggcugccagugccu

SEQ ID NO: 3755927 - RNA, 11 nt, Human
gcacagcccuc

SEQ ID NO: 3755928 - RNA, 16 nt, Human
gcacagcccucccgcc

SEQ ID NO: 3755929 - RNA, 17 nt, Human
gcacagcccucccgccc

SEQ ID NO: 3755930 - RNA, 21 nt, Human
gcacagcccucccgccccuuc

SEQ ID NO: 3755931 - RNA, 16 nt, Human
gcacagccggggccug

SEQ ID NO: 3755932 - RNA, 21 nt, Human
gcacagcggggccccagggcu

SEQ ID NO: 3755933 - RNA, 19 nt, Human
gcacagcguuaugugucug

SEQ ID NO: 3755934 - RNA, 19 nt, Human
gcacagcuaacauggaagu

SEQ ID NO: 3755935 - RNA, 12 nt, Human
gcacagcucagg

SEQ ID NO: 3755936 - RNA, 14 nt, Human
gcacagcucccugc

SEQ ID NO: 3755937 - RNA, 17 nt, Human
gcacagcucccugccaa

SEQ ID NO: 3755938 - RNA, 12 nt, Human
gcacagcuggcc

SEQ ID NO: 3755939 - RNA, 16 nt, Human
gcacagcuguaguggg

SEQ ID NO: 3755940 - RNA, 12 nt, Human
gcacagcugugg

SEQ ID NO: 3755941 - RNA, 16 nt, Human
gcacagcuuagauuuc

SEQ ID NO: 3755942 - RNA, 23 nt, Human
gcacagcuucauuuccugugucu

SEQ ID NO: 3755943 - RNA, 14 nt, Human
gcacagcuugaccu

SEQ ID NO: 3755944 - RNA, 19 nt, Human
gcacagcuugaccugaggc

SEQ ID NO: 3755945 - RNA, 21 nt, Human
gcacagcuugaccugaggcug

SEQ ID NO: 3755946 - RNA, 21 nt, Human
gcacaggagcuaccugugugg

SEQ ID NO: 3755947 - RNA, 23 nt, Human
gcacaggagggggucguggagag

SEQ ID NO: 3755948 - RNA, 12 nt, Human
gcacaggcagcu

SEQ ID NO: 3755949 - RNA, 14 nt, Human
gcacaggcagggca

SEQ ID NO: 3755950 - RNA, 15 nt, Human
gcacaggcagggcag

SEQ ID NO: 3755951 - RNA, 12 nt, Human
gcacagggagaa

SEQ ID NO: 3755952 - RNA, 17 nt, Human
gcacagggcagcugggc

SEQ ID NO: 3755953 - RNA, 18 nt, Human
gcacagggcagcugggcc

SEQ ID NO: 3755954 - RNA, 18 nt, Human
gcacagggcaugaaauga

SEQ ID NO: 3755955 - RNA, 22 nt, Human
gcacagggcaugaaaugaacac

SEQ ID NO: 3755956 - RNA, 16 nt, Human
gcacagggccuggccc

SEQ ID NO: 3755957 - RNA, 12 nt, Human
gcacagggucug

SEQ ID NO: 3755958 - RNA, 18 nt, Human
gcacagggucugcucuuu

SEQ ID NO: 3755959 - RNA, 13 nt, Human
gcacaggucccac

SEQ ID NO: 3755960 - RNA, 19 nt, Human
gcacaggucccaccuccag

SEQ ID NO: 3755961 - RNA, 20 nt, Human
gcacaggugggcuucccagu

SEQ ID NO: 3755962 - RNA, 16 nt, Human
gcacaguccaggaaca

SEQ ID NO: 3755963 - RNA, 16 nt, Human
gcacagugaagugcug

SEQ ID NO: 3755964 - RNA, 17 nt, Human
gcacagugacuucugag

SEQ ID NO: 3755965 - RNA, 18 nt, Human
gcacagugacuucugaga

SEQ ID NO: 3755966 - RNA, 21 nt, Human
gcacagugcaucucagcccac

SEQ ID NO: 3755967 - RNA, 14 nt, Human
gcacagugccugca

SEQ ID NO: 3755968 - RNA, 15 nt, Human
gcacagugucugggc

SEQ ID NO: 3755969 - RNA, 19 nt, Human
gcacagugucugggcugac

SEQ ID NO: 3755970 - RNA, 21 nt, Human
gcacagugucugggcugacug

SEQ ID NO: 3755971 - RNA, 20 nt, Human
gcacaguguuaaaugaaauu

SEQ ID NO: 3755972 - RNA, 20 nt, Human
gcacaguuuucugagaaaga

SEQ ID NO: 3755973 - RNA, 23 nt, Human
gcacaguuuucugagaaagacua

SEQ ID NO: 3755974 - RNA, 17 nt, Human
gcacauauacacacaca

SEQ ID NO: 3755975 - RNA, 23 nt, Human
gcacauauggaauuuugcaaaga

SEQ ID NO: 3755976 - RNA, 18 nt, Human
gcacauauggacucugca

SEQ ID NO: 3755977 - RNA, 19 nt, Human
gcacauauuagugcagcca

SEQ ID NO: 3755978 - RNA, 15 nt, Human
gcacaucagaaagga

SEQ ID NO: 3755979 - RNA, 20 nt, Human
gcacaucagcacgauuucug

SEQ ID NO: 3755980 - RNA, 13 nt, Human
gcacaucauuuca

SEQ ID NO: 3755981 - RNA, 19 nt, Human
gcacauccaggcaauggcc

SEQ ID NO: 3755982 - RNA, 20 nt, Human
gcacauccgcgugugccugu

SEQ ID NO: 3755983 - RNA, 23 nt, Human
gcacauccgcgugugccugugug

SEQ ID NO: 3755984 - RNA, 18 nt, Human
gcacaucucaacaggccu

SEQ ID NO: 3755985 - RNA, 22 nt, Human
gcacaucucaacaggccucagg

SEQ ID NO: 3755986 - RNA, 21 nt, Human
gcacaucugcauuuucacccc

SEQ ID NO: 3755987 - RNA, 17 nt, Human
gcacaucugugucuugu

SEQ ID NO: 3755988 - RNA, 15 nt, Human
gcacaucuguuuugu

SEQ ID NO: 3755989 - RNA, 16 nt, Human
gcacaugaagaaauac

SEQ ID NO: 3755990 - RNA, 13 nt, Human
gcacaugacucgg

SEQ ID NO: 3755991 - RNA, 12 nt, Human
gcacaugauuuc

SEQ ID NO: 3755992 - RNA, 22 nt, Human
gcacaugauuucacaaauauua

SEQ ID NO: 3755993 - RNA, 18 nt, Human
gcacaugccucucucagg

SEQ ID NO: 3755994 - RNA, 20 nt, Human
gcacaugccucucucaggcc

SEQ ID NO: 3755995 - RNA, 22 nt, Human
gcacaugccucucucaggccaa

SEQ ID NO: 3755996 - RNA, 22 nt, Human
gcacaugcugagucucccaagg

SEQ ID NO: 3755997 - RNA, 17 nt, Human
gcacaugucuuaaugaa

SEQ ID NO: 3755998 - RNA, 22 nt, Human
gcacaugucuuaaugaaguuug

SEQ ID NO: 3755999 - RNA, 13 nt, Human
gcacaugucuugu

SEQ ID NO: 3756000 - RNA, 21 nt, Human
gcacaugucuuguacaugugu

SEQ ID NO: 3756001 - RNA, 17 nt, Human
gcacauucuuagaguua

SEQ ID NO: 3756002 - RNA, 23 nt, Human
gcacauuuaagagacagucaccc

SEQ ID NO: 3756003 - RNA, 22 nt, Human
gcacauuuuuuuuuuuaauuuu

SEQ ID NO: 3756004 - RNA, 14 nt, Human
gcaccaaaagaagu

SEQ ID NO: 3756005 - RNA, 16 nt, Human
gcaccaaaagaaguaa

SEQ ID NO: 3756006 - RNA, 23 nt, Human
gcaccaaagaugcagccgccuuc

SEQ ID NO: 3756007 - RNA, 21 nt, Human
gcaccaaaucaaaaucucucc

SEQ ID NO: 3756008 - RNA, 17 nt, Human
gcaccaacccagccgcu

SEQ ID NO: 3756009 - RNA, 18 nt, Human
gcaccaacccagccgcug

SEQ ID NO: 3756010 - RNA, 20 nt, Human
gcaccaacccagccgcugcc

SEQ ID NO: 3756011 - RNA, 17 nt, Human
gcaccaagagccaaugg

SEQ ID NO: 3756012 - RNA, 15 nt, Human
gcaccaagcaggaaa

SEQ ID NO: 3756013 - RNA, 17 nt, Human
gcaccacacucagcccu

SEQ ID NO: 3756014 - RNA, 14 nt, Human
gcaccaccaagcca

SEQ ID NO: 3756015 - RNA, 17 nt, Human
gcaccaccaagccaagg

SEQ ID NO: 3756016 - RNA, 18 nt, Human
gcaccaccaagccaaggg

SEQ ID NO: 3756017 - RNA, 14 nt, Human
gcaccaccaggucu

SEQ ID NO: 3756018 - RNA, 15 nt, Human
gcaccaccaggucuc

SEQ ID NO: 3756019 - RNA, 11 nt, Human
gcaccacccua

SEQ ID NO: 3756020 - RNA, 23 nt, Human
gcaccacccuagucccuuccccu

SEQ ID NO: 3756021 - RNA, 13 nt, Human
gcaccacccuccu

SEQ ID NO: 3756022 - RNA, 16 nt, Human
gcaccacccuccuucc

SEQ ID NO: 3756023 - RNA, 17 nt, Human
gcaccacccuccuuccc

SEQ ID NO: 3756024 - RNA, 12 nt, Human
cugcauuuuuca

SEQ ID NO: 3756025 - RNA, 15 nt, Human
cugccaaaaugcucu

SEQ ID NO: 3756026 - RNA, 20 nt, Human
cugccaaauuuuggccaaag

SEQ ID NO: 3756027 - RNA, 17 nt, Human
cugccaaccucgcucca

SEQ ID NO: 3756028 - RNA, 21 nt, Human
cugccaaccucgcuccaacuc

SEQ ID NO: 3756029 - RNA, 21 nt, Human
cugccaagacugcuguggcca

SEQ ID NO: 3756030 - RNA, 13 nt, Human
cugccaagccaug

SEQ ID NO: 3756031 - RNA, 21 nt, Human
cugccaagccccauccugccg

SEQ ID NO: 3756032 - RNA, 15 nt, Human
cugccaaggccagag

SEQ ID NO: 3756033 - RNA, 21 nt, Human
cugccaaggccagaguggccu

SEQ ID NO: 3756034 - RNA, 20 nt, Human
cugccacaaccagccaggca

SEQ ID NO: 3756035 - RNA, 18 nt, Human
cugccacaaggaagaaau

SEQ ID NO: 3756036 - RNA, 12 nt, Human
cugccacacagg

SEQ ID NO: 3756037 - RNA, 24 nt, Human
cugccacacgucugacccucucca

SEQ ID NO: 3756038 - RNA, 17 nt, Human
cugccacacuucaggcu

SEQ ID NO: 3756039 - RNA, 22 nt, Human
cugccacagccuccccugccag

SEQ ID NO: 3756040 - RNA, 23 nt, Human
cugccacagccuccccugccagg

SEQ ID NO: 3756041 - RNA, 14 nt, Human
cugccaccagagac

SEQ ID NO: 3756042 - RNA, 21 nt, Human
cugccaccagagaccguccuc

SEQ ID NO: 3756043 - RNA, 13 nt, Human
cugccaccaggcc

SEQ ID NO: 3756044 - RNA, 17 nt, Human
cugccaccagucacugu

SEQ ID NO: 3756045 - RNA, 14 nt, Human
cugccacccaccuc

SEQ ID NO: 3756046 - RNA, 17 nt, Human
cugccacccagccccag

SEQ ID NO: 3756047 - RNA, 18 nt, Human
cugccacccagccccagc

SEQ ID NO: 3756048 - RNA, 12 nt, Human
cugccacccugg

SEQ ID NO: 3756049 - RNA, 16 nt, Human
cugccacccugggccu

SEQ ID NO: 3756050 - RNA, 23 nt, Human
cugccacccugggccuggcagcu

SEQ ID NO: 3756051 - RNA, 15 nt, Human
cugccacccugggga

SEQ ID NO: 3756052 - RNA, 14 nt, Human
cugccacccuugac

SEQ ID NO: 3756053 - RNA, 12 nt, Human
cugccaccuccc

SEQ ID NO: 3756054 - RNA, 21 nt, Human
cugccaccuccccccacaagu

SEQ ID NO: 3756055 - RNA, 17 nt, Human
cugccaccuccccuugc

SEQ ID NO: 3756056 - RNA, 20 nt, Human
cugccaccuccccuugccag

SEQ ID NO: 3756057 - RNA, 22 nt, Human
cugccaccuccccuugccagcu

SEQ ID NO: 3756058 - RNA, 15 nt, Human
cugccaccucccuga

SEQ ID NO: 3756059 - RNA, 17 nt, Human
cugccaccucccugacc

SEQ ID NO: 3756060 - RNA, 18 nt, Human
cugccaccucccugaccc

SEQ ID NO: 3756061 - RNA, 19 nt, Human
cugccaccuccugccucag

SEQ ID NO: 3756062 - RNA, 17 nt, Human
cugccaccucuccaucc

SEQ ID NO: 3756063 - RNA, 20 nt, Human
cugccaccuggaccccugca

SEQ ID NO: 3756064 - RNA, 21 nt, Human
cugccaccuggaccccugcau

SEQ ID NO: 3756065 - RNA, 14 nt, Human
cugccaccuggggc

SEQ ID NO: 3756066 - RNA, 11 nt, Human
cugccaccugu

SEQ ID NO: 3756067 - RNA, 14 nt, Human
cugccaccugucug

SEQ ID NO: 3756068 - RNA, 15 nt, Human
cugccaccugucugu

SEQ ID NO: 3756069 - RNA, 18 nt, Human
cugccaccugucugucug

SEQ ID NO: 3756070 - RNA, 12 nt, Human
cugccacucaca

SEQ ID NO: 3756071 - RNA, 19 nt, Human
cugccacucacuaggcccc

SEQ ID NO: 3756072 - RNA, 20 nt, Human
cugccacugacugcagggac

SEQ ID NO: 3756073 - RNA, 21 nt, Human
cugccacugacugcagggaca

SEQ ID NO: 3756074 - RNA, 14 nt, Human
cugccacuuugcac

SEQ ID NO: 3756075 - RNA, 20 nt, Human
cugccacuuugcacauuuug

SEQ ID NO: 3756076 - RNA, 22 nt, Human
cugccagacggcacccacccag

SEQ ID NO: 3756077 - RNA, 14 nt, Human
cugccagaugcuga

SEQ ID NO: 3756078 - RNA, 12 nt, Human
cugccagcagca

SEQ ID NO: 3756079 - RNA, 13 nt, Human
cugccagcagcag

SEQ ID NO: 3756080 - RNA, 17 nt, Human
cugccagcagcagcagg

SEQ ID NO: 3756081 - RNA, 20 nt, Human
cugccagcauuucccuuccu

SEQ ID NO: 3756082 - RNA, 14 nt, Human
cugccagccagcag

SEQ ID NO: 3756083 - RNA, 19 nt, Human
cugccagccagcagccagc

SEQ ID NO: 3756084 - RNA, 20 nt, Human
cugccagccagcagccagcu

SEQ ID NO: 3756085 - RNA, 17 nt, Human
cugccagccccacacag

SEQ ID NO: 3756086 - RNA, 14 nt, Human
cugccagccccugc

SEQ ID NO: 3756087 - RNA, 19 nt, Human
cugccagccgagauagcca

SEQ ID NO: 3756088 - RNA, 14 nt, Human
cugccagccuggcu

SEQ ID NO: 3756089 - RNA, 22 nt, Human
cugccagccuggcuucuggagc

SEQ ID NO: 3756090 - RNA, 21 nt, Human
cugccagccuugagcccuggc

SEQ ID NO: 3756091 - RNA, 15 nt, Human
cugccagcucuuccu

SEQ ID NO: 3756092 - RNA, 17 nt, Human
cugccagcucuuccuag

SEQ ID NO: 3756093 - RNA, 21 nt, Human
cugccagcucuuccuagcugg

SEQ ID NO: 3756094 - RNA, 14 nt, Human
cugccaggaagcca

SEQ ID NO: 3756095 - RNA, 16 nt, Human
cugccaggagacaggu

SEQ ID NO: 3756096 - RNA, 16 nt, Human
cugccaggaggaccca

SEQ ID NO: 3756097 - RNA, 19 nt, Human
cugccaggaggacccaggg

SEQ ID NO: 3756098 - RNA, 22 nt, Human
cugccaggaggacccagggcuc

SEQ ID NO: 3756099 - RNA, 13 nt, Human
cugccaggcacag

SEQ ID NO: 3756100 - RNA, 15 nt, Human
cugccaggcacaggc

SEQ ID NO: 3756101 - RNA, 16 nt, Human
cugccaggcacaggca

SEQ ID NO: 3756102 - RNA, 21 nt, Human
cugccaggcacaggcagggca

SEQ ID NO: 3756103 - RNA, 15 nt, Human
cugccaggcaggggu

SEQ ID NO: 3756104 - RNA, 20 nt, Human
cugccaggccagccuccgag

SEQ ID NO: 3756105 - RNA, 23 nt, Human
cugccaggcccccaccacacauc

SEQ ID NO: 3756106 - RNA, 11 nt, Human
cugccagggac

SEQ ID NO: 3756107 - RNA, 15 nt, Human
cugccagggacagag

SEQ ID NO: 3756108 - RNA, 18 nt, Human
cugccagggagacagagc

SEQ ID NO: 3756109 - RNA, 19 nt, Human
cugccagggagacagagcu

SEQ ID NO: 3756110 - RNA, 12 nt, Human
cugccagggcag

SEQ ID NO: 3756111 - RNA, 15 nt, Human
cugccagggcagggc

SEQ ID NO: 3756112 - RNA, 16 nt, Human
cugccagggcagggcc

SEQ ID NO: 3756113 - RNA, 15 nt, Human
cugccagggcagugc

SEQ ID NO: 3756114 - RNA, 21 nt, Human
cugccagggccccucucccca

SEQ ID NO: 3756115 - RNA, 18 nt, Human
cugccaggugagaaacug

SEQ ID NO: 3756116 - RNA, 17 nt, Human
cugccagucccccugcc

SEQ ID NO: 3756117 - RNA, 22 nt, Human
cugccagucccccugccccagg

SEQ ID NO: 3756118 - RNA, 23 nt, Human
cugccagugacagacaggcucuu

SEQ ID NO: 3756119 - RNA, 20 nt, Human
cugccagugccuuaccuccu

SEQ ID NO: 3756120 - RNA, 23 nt, Human
cugccagugccuuaccuccugcc

SEQ ID NO: 3756121 - RNA, 22 nt, Human
cugccaguggggccugaggcuc

SEQ ID NO: 3756122 - RNA, 12 nt, Human
cugccaguuuug

SEQ ID NO: 3756123 - RNA, 13 nt, Human
cugccaguuuugu

SEQ ID NO: 3756124 - RNA, 23 nt, Human
cugccauaaaacauuaagaaaau

SEQ ID NO: 3756125 - RNA, 17 nt, Human
cugccaucauguuuaca

SEQ ID NO: 3756126 - RNA, 23 nt, Human
cugccaucauguuuacagaggac

SEQ ID NO: 3756127 - RNA, 20 nt, Human
cugccauccuggcccagggc

SEQ ID NO: 3756128 - RNA, 17 nt, Human
cugccaucuagccagcc

SEQ ID NO: 3756129 - RNA, 20 nt, Human
cugccaucuagccagccccu

SEQ ID NO: 3756130 - RNA, 20 nt, Human
cugccaucucaccuccugcu

SEQ ID NO: 3756131 - RNA, 14 nt, Human
cugccaucuuccca

SEQ ID NO: 3756132 - RNA, 17 nt, Human
cugccaucuucccagca

SEQ ID NO: 3756133 - RNA, 18 nt, Human
cugccaugaacuggaggc

SEQ ID NO: 3756134 - RNA, 16 nt, Human
cugccaugccaggaac

SEQ ID NO: 3756135 - RNA, 18 nt, Human
cugccauggaacuguuuc

SEQ ID NO: 3756136 - RNA, 20 nt, Human
cugccauggaggcacacagc

SEQ ID NO: 3756137 - RNA, 17 nt, Human
cugccauguaccucccc

SEQ ID NO: 3756138 - RNA, 17 nt, Human
cugccauucacuucaua

SEQ ID NO: 3756139 - RNA, 20 nt, Human
cugccauuugcacccuccgc

SEQ ID NO: 3756140 - RNA, 17 nt, Human
cugcccaaaaauauggu

SEQ ID NO: 3756141 - RNA, 22 nt, Human
cugcccaaagugcuuccaaggc

SEQ ID NO: 3756142 - RNA, 20 nt, Human
cugcccaacccuucccucac

SEQ ID NO: 3756143 - RNA, 14 nt, Human
cugcccaacugugu

SEQ ID NO: 3756144 - RNA, 18 nt, Human
cugcccaagcccaggcca

SEQ ID NO: 3756145 - RNA, 21 nt, Human
cugcccaauaugcaguucugc

SEQ ID NO: 3756146 - RNA, 12 nt, Human
cugcccaccccc

SEQ ID NO: 3756147 - RNA, 14 nt, Human
cugcccacccccuc

SEQ ID NO: 3756148 - RNA, 12 nt, Human
cugcccacccgu

SEQ ID NO: 3756149 - RNA, 12 nt, Human
cugcccaccugc

SEQ ID NO: 3756150 - RNA, 13 nt, Human
cugcccaccugcc

SEQ ID NO: 3756151 - RNA, 21 nt, Human
cugcccaccugccuggccggc

SEQ ID NO: 3756152 - RNA, 12 nt, Human
cugcccaccugg

SEQ ID NO: 3756153 - RNA, 16 nt, Human
cugcccaccuggccuc

SEQ ID NO: 3756154 - RNA, 20 nt, Human
cugcccaccuggccucugca

SEQ ID NO: 3756155 - RNA, 12 nt, Human
cugcccaccugu

SEQ ID NO: 3756156 - RNA, 16 nt, Human
cugcccacugcugcag

SEQ ID NO: 3756157 - RNA, 13 nt, Human
cugcccagagcug

SEQ ID NO: 3756158 - RNA, 14 nt, Human
cugcccagagcugg

SEQ ID NO: 3756159 - RNA, 15 nt, Human
cugcccagagcuggg

SEQ ID NO: 3756160 - RNA, 17 nt, Human
cugcccagagcugggug

SEQ ID NO: 3756161 - RNA, 22 nt, Human
cugcccagaguugcugggagcu

SEQ ID NO: 3756162 - RNA, 18 nt, Human
cugcccagaucagccaga

SEQ ID NO: 3756163 - RNA, 22 nt, Human
cugcccagaucagccagaagcc

SEQ ID NO: 3756164 - RNA, 18 nt, Human
cugcccagaucccagaag

SEQ ID NO: 3756165 - RNA, 16 nt, Human
cugcccagcuugggcc

SEQ ID NO: 3756166 - RNA, 20 nt, Human
cugcccagcuugggcccagc

SEQ ID NO: 3756167 - RNA, 17 nt, Human
cugcccaggagagccag

SEQ ID NO: 3756168 - RNA, 22 nt, Human
cugcccaggagagccagcccuc

SEQ ID NO: 3756169 - RNA, 23 nt, Human
cugcccaggagagccagcccucc

SEQ ID NO: 3756170 - RNA, 15 nt, Human
cugcccaggcacugc

SEQ ID NO: 3756171 - RNA, 20 nt, Human
cugcccaggcacugcuaggc

SEQ ID NO: 3756172 - RNA, 17 nt, Human
cugcccaggccugccug

SEQ ID NO: 3756173 - RNA, 18 nt, Human
cugcccaggggagcccuc

SEQ ID NO: 3756174 - RNA, 23 nt, Human
gcagaccuccccagccccuagcc

SEQ ID NO: 3756175 - RNA, 19 nt, Human
gcagaccuguccuccuggu

SEQ ID NO: 3756176 - RNA, 14 nt, Human
gcagacguccauca

SEQ ID NO: 3756177 - RNA, 16 nt, Human
gcagacuacacaggau

SEQ ID NO: 3756178 - RNA, 20 nt, Human
gcagacucaauaaaaucaug

SEQ ID NO: 3756179 - RNA, 15 nt, Human
gcagacucagcucug

SEQ ID NO: 3756180 - RNA, 17 nt, Human
gcagacucaguuuguca

SEQ ID NO: 3756181 - RNA, 17 nt, Human
gcagacucuacagaggc

SEQ ID NO: 3756182 - RNA, 18 nt, Human
gcagacucuacagaggcc

SEQ ID NO: 3756183 - RNA, 22 nt, Human
gcagacucuacagaggccaugg

SEQ ID NO: 3756184 - RNA, 12 nt, Human
gcagacuggagg

SEQ ID NO: 3756185 - RNA, 14 nt, Human
gcagacuggagggg

SEQ ID NO: 3756186 - RNA, 17 nt, Human
gcagacuggugagcaga

SEQ ID NO: 3756187 - RNA, 16 nt, Human
gcagacuugaccccga

SEQ ID NO: 3756188 - RNA, 20 nt, Human
gcagagaaacuuaagcaaag

SEQ ID NO: 3756189 - RNA, 14 nt, Human
gcagagaagccuug

SEQ ID NO: 3756190 - RNA, 22 nt, Human
gcagagaagggcauaaaacagc

SEQ ID NO: 3756191 - RNA, 20 nt, Human
gcagagaagugacgguuccu

SEQ ID NO: 3756192 - RNA, 19 nt, Human
gcagagaaugaaagggccc

SEQ ID NO: 3756193 - RNA, 21 nt, Human
gcagagaauucucuuauccaa

SEQ ID NO: 3756194 - RNA, 15 nt, Human
gcagagacagagagg

SEQ ID NO: 3756195 - RNA, 17 nt, Human
gcagagacaggaccuga

SEQ ID NO: 3756196 - RNA, 15 nt, Human
gcagagagccauuuu

SEQ ID NO: 3756197 - RNA, 15 nt, Human
gcagagaugccuccc

SEQ ID NO: 3756198 - RNA, 22 nt, Human
gcagagauuggaaugggcagcu

SEQ ID NO: 3756199 - RNA, 16 nt, Human
gcagagauuucucauu

SEQ ID NO: 3756200 - RNA, 17 nt, Human
gcagagcaagucugcag

SEQ ID NO: 3756201 - RNA, 22 nt, Human
gcagagcaccuuagacaguccc

SEQ ID NO: 3756202 - RNA, 23 nt, Human
gcagagcaccuuagacagucccu

SEQ ID NO: 3756203 - RNA, 24 nt, Human
gcagagcaccuuagacagucccug

SEQ ID NO: 3756204 - RNA, 22 nt, Human
gcagagcaccuuugcacaggau

SEQ ID NO: 3756205 - RNA, 19 nt, Human
gcagagcagagaccauccc

SEQ ID NO: 3756206 - RNA, 14 nt, Human
gcagagccaggaag

SEQ ID NO: 3756207 - RNA, 15 nt, Human
gcagagccaggaaga

SEQ ID NO: 3756208 - RNA, 13 nt, Human
gcagagcccugcu

SEQ ID NO: 3756209 - RNA, 20 nt, Human
gcagagccucccaaggagaa

SEQ ID NO: 3756210 - RNA, 19 nt, Human
gcagagccuucucagaagc

SEQ ID NO: 3756211 - RNA, 23 nt, Human
gcagagccuucucagaagcacag

SEQ ID NO: 3756212 - RNA, 18 nt, Human
gcagagcgcgccccuagc

SEQ ID NO: 3756213 - RNA, 14 nt, Human
gcagagcucugccg

SEQ ID NO: 3756214 - RNA, 19 nt, Human
gcagagcugauggagaagg

SEQ ID NO: 3756215 - RNA, 22 nt, Human
gcagagcugauggagaaggaag

SEQ ID NO: 3756216 - RNA, 15 nt, Human
gcagagcuggcucug

SEQ ID NO: 3756217 - RNA, 23 nt, Human
gcagagcuggcucugagcgccuc

SEQ ID NO: 3756218 - RNA, 14 nt, Human
gcagagcuggugcg

SEQ ID NO: 3756219 - RNA, 21 nt, Human
gcagagcuggugcggcuggcc

SEQ ID NO: 3756220 - RNA, 16 nt, Human
gcagagcuucuuccag

SEQ ID NO: 3756221 - RNA, 13 nt, Human
gcagaggaaagca

SEQ ID NO: 3756222 - RNA, 20 nt, Human
gcagaggaaagcaaaggaga

SEQ ID NO: 3756223 - RNA, 21 nt, Human
gcagaggaaagcaaaggagau

SEQ ID NO: 3756224 - RNA, 11 nt, Human
gcagaggacag

SEQ ID NO: 3756225 - RNA, 15 nt, Human
gcagaggaggggccg

SEQ ID NO: 3756226 - RNA, 21 nt, Human
gcagaggaggggccgcugcca

SEQ ID NO: 3756227 - RNA, 12 nt, Human
gcagaggcagcg

SEQ ID NO: 3756228 - RNA, 18 nt, Human
gcagaggcaguaccuggg

SEQ ID NO: 3756229 - RNA, 11 nt, Human
gcagaggcugu

SEQ ID NO: 3756230 - RNA, 18 nt, Human
gcagagggcagaggcugg

SEQ ID NO: 3756231 - RNA, 12 nt, Human
gcagagggcugg

SEQ ID NO: 3756232 - RNA, 19 nt, Human
gcagagggcuggaggccca

SEQ ID NO: 3756233 - RNA, 14 nt, Human
gcagaggggcagag

SEQ ID NO: 3756234 - RNA, 19 nt, Human
gcagaggggcaggcccugc

SEQ ID NO: 3756235 - RNA, 20 nt, Human
gcagaggggcaggcccugca

SEQ ID NO: 3756236 - RNA, 12 nt, Human
gcagaggggcuu

SEQ ID NO: 3756237 - RNA, 19 nt, Human
gcagaggggcuuucuggag

SEQ ID NO: 3756238 - RNA, 19 nt, Human
gcagagggguaagagagga

SEQ ID NO: 3756239 - RNA, 23 nt, Human
gcagagguaaaagugugagcagu

SEQ ID NO: 3756240 - RNA, 15 nt, Human
gcagagguacccugg

SEQ ID NO: 3756241 - RNA, 17 nt, Human
gcagagguacccugggu

SEQ ID NO: 3756242 - RNA, 22 nt, Human
gcagaguaggggucugucuuuu

SEQ ID NO: 3756243 - RNA, 14 nt, Human
gcagaguauuuuug

SEQ ID NO: 3756244 - RNA, 18 nt, Human
gcagagucacaagccucg

SEQ ID NO: 3756245 - RNA, 14 nt, Human
gcagagucacacgg

SEQ ID NO: 3756246 - RNA, 14 nt, Human
gcagaguccuggag

SEQ ID NO: 3756247 - RNA, 15 nt, Human
gcagagugcacagcu

SEQ ID NO: 3756248 - RNA, 18 nt, Human
gcagagugcacagcuguc

SEQ ID NO: 3756249 - RNA, 21 nt, Human
gcagaguuaaaucucaaauag

SEQ ID NO: 3756250 - RNA, 13 nt, Human
gcagaguuacuug

SEQ ID NO: 3756251 - RNA, 15 nt, Human
gcagaguugaagaca

SEQ ID NO: 3756252 - RNA, 19 nt, Human
gcagaguugaagacagagc

SEQ ID NO: 3756253 - RNA, 17 nt, Human
gcagaguuguaaauaua

SEQ ID NO: 3756254 - RNA, 21 nt, Human
gcagaguuguaaauauauaaa

SEQ ID NO: 3756255 - RNA, 23 nt, Human
gcagaguuguaaauauauaaaua

SEQ ID NO: 3756256 - RNA, 18 nt, Human
gcagaguuuccaaaacca

SEQ ID NO: 3756257 - RNA, 13 nt, Human
gcagaguuugccu

SEQ ID NO: 3756258 - RNA, 18 nt, Human
gcagauaaacaguaguga

SEQ ID NO: 3756259 - RNA, 21 nt, Human
gcagauaacaaugcagcaagg

SEQ ID NO: 3756260 - RNA, 20 nt, Human
gcagauaacauuuguguguu

SEQ ID NO: 3756261 - RNA, 14 nt, Human
gcagaucaccugag

SEQ ID NO: 3756262 - RNA, 12 nt, Human
gcagaucccagc

SEQ ID NO: 3756263 - RNA, 22 nt, Human
gcagaucucccacaugccaggg

SEQ ID NO: 3756264 - RNA, 14 nt, Human
gcagaucugugccc

SEQ ID NO: 3756265 - RNA, 16 nt, Human
gcagaucuuggacuca

SEQ ID NO: 3756266 - RNA, 13 nt, Human
gcagaugacaaaa

SEQ ID NO: 3756267 - RNA, 12 nt, Human
gcagaugacaag

SEQ ID NO: 3756268 - RNA, 15 nt, Human
gcagaugaccccucc

SEQ ID NO: 3756269 - RNA, 16 nt, Human
gcagaugaccccuccc

SEQ ID NO: 3756270 - RNA, 23 nt, Human
gcagaugaggugaaaaggccaag

SEQ ID NO: 3756271 - RNA, 14 nt, Human
gcagaugagguugc

SEQ ID NO: 3756272 - RNA, 15 nt, Human
gcagaugcaaagagg

SEQ ID NO: 3756273 - RNA, 16 nt, Human
gcagaugcaaagaggc

SEQ ID NO: 3756274 - RNA, 17 nt, Human
gcagaugcaaagaggca

SEQ ID NO: 3756275 - RNA, 19 nt, Human
gcagaugcaaagaggcaag

SEQ ID NO: 3756276 - RNA, 17 nt, Human
gcagaugcagagagcca

SEQ ID NO: 3756277 - RNA, 14 nt, Human
gcagaugcagcucu

SEQ ID NO: 3756278 - RNA, 15 nt, Human
gcagaugcagcucuu

SEQ ID NO: 3756279 - RNA, 17 nt, Human
gcagaugccacccuagc

SEQ ID NO: 3756280 - RNA, 14 nt, Human
gcagaugccagagc

SEQ ID NO: 3756281 - RNA, 13 nt, Human
gcagaugccuggg

SEQ ID NO: 3756282 - RNA, 23 nt, Human
gcagaugcuagcgcguugccugu

SEQ ID NO: 3756283 - RNA, 15 nt, Human
gcagaugcuggucau

SEQ ID NO: 3756284 - RNA, 18 nt, Human
gcagauggagaccccuug

SEQ ID NO: 3756285 - RNA, 15 nt, Human
gcagauguaggaggg

SEQ ID NO: 3756286 - RNA, 17 nt, Human
gcagaugugcagcagau

SEQ ID NO: 3756287 - RNA, 18 nt, Human
gcagauguuagauauuuu

SEQ ID NO: 3756288 - RNA, 17 nt, Human
gcagauucagaaaugag

SEQ ID NO: 3756289 - RNA, 20 nt, Human
gcagauucauuuuucuuucu

SEQ ID NO: 3756290 - RNA, 21 nt, Human
gcagauucuaggaccuguguc

SEQ ID NO: 3756291 - RNA, 19 nt, Human
gcagauucucccuugcucu

SEQ ID NO: 3756292 - RNA, 17 nt, Human
gcagauugagaccuaca

SEQ ID NO: 3756293 - RNA, 14 nt, Human
gcagauuggaagga

SEQ ID NO: 3756294 - RNA, 20 nt, Human
gcagauuguguaacaauuuu

SEQ ID NO: 3756295 - RNA, 17 nt, Human
gcagauuuuacaaaaga

SEQ ID NO: 3756296 - RNA, 20 nt, Human
gcagauuuuaggaaaugaau

SEQ ID NO: 3756297 - RNA, 19 nt, Human
gcagauuuugcccuugaca

SEQ ID NO: 3756298 - RNA, 23 nt, Human
gcagauuuuuauauuaguugcuu

SEQ ID NO: 3756299 - RNA, 14 nt, Human
gcagcaaaaauaua

SEQ ID NO: 3756300 - RNA, 18 nt, Human
gcagcaaaaauauaaaau

SEQ ID NO: 3756301 - RNA, 16 nt, Human
gcagcaaacacuccac

SEQ ID NO: 3756302 - RNA, 16 nt, Human
gcagcaacaauaaaua

SEQ ID NO: 3756303 - RNA, 19 nt, Human
gcagcaacacaauguuauu

SEQ ID NO: 3756304 - RNA, 20 nt, Human
gcagcaaccagagcacugua

SEQ ID NO: 3756305 - RNA, 22 nt, Human
gcagcaacuuguccuagcacag

SEQ ID NO: 3756306 - RNA, 20 nt, Human
gcagcaagaaaaaaaaaugc

SEQ ID NO: 3756307 - RNA, 22 nt, Human
gcagcaaggcccgagcagcuga

SEQ ID NO: 3756308 - RNA, 19 nt, Human
gcagcaaggcccugcugcc

SEQ ID NO: 3756309 - RNA, 23 nt, Human
gcagcaauauauuaccagcaaga

SEQ ID NO: 3756310 - RNA, 15 nt, Human
gcagcaauuuaaaug

SEQ ID NO: 3756311 - RNA, 16 nt, Human
gcagcaauuuaaaugu

SEQ ID NO: 3756312 - RNA, 18 nt, Human
gcagcacaaguguaauga

SEQ ID NO: 3756313 - RNA, 15 nt, Human
gcagcacaggagggc

SEQ ID NO: 3756314 - RNA, 21 nt, Human
gcagcacccagguuuugcacu

SEQ ID NO: 3756315 - RNA, 19 nt, Human
gcagcacccuauaaaucaa

SEQ ID NO: 3756316 - RNA, 16 nt, Human
gcagcaccgaggggcc

SEQ ID NO: 3756317 - RNA, 18 nt, Human
gcagcaccguucugugca

SEQ ID NO: 3756318 - RNA, 16 nt, Human
gcagcaccuccaggcc

SEQ ID NO: 3756319 - RNA, 17 nt, Human
gcagcaccuccaggccu

SEQ ID NO: 3756320 - RNA, 19 nt, Human
gcagcaccuccaggccugu

SEQ ID NO: 3756321 - RNA, 19 nt, Human
gcagcaccuccucagccug

SEQ ID NO: 3756322 - RNA, 13 nt, Human
gcagcaccugccc

SEQ ID NO: 3756323 - RNA, 23 nt, Human
gcaccacgggacaucacagggug

SEQ ID NO: 3756324 - RNA, 13 nt, Human
gcaccacucaaga

SEQ ID NO: 3756325 - RNA, 17 nt, Human
gcaccacucaagaccaa

SEQ ID NO: 3756326 - RNA, 14 nt, Human
gcaccacucuccuu

SEQ ID NO: 3756327 - RNA, 19 nt, Human
gcaccacugcacuccagcc

SEQ ID NO: 3756328 - RNA, 18 nt, Human
gcaccacuguguauuuaa

SEQ ID NO: 3756329 - RNA, 14 nt, Human
gcaccagacaccca

SEQ ID NO: 3756330 - RNA, 15 nt, Human
gcaccagacacccag

SEQ ID NO: 3756331 - RNA, 19 nt, Human
gcaccagagcaaccucuca

SEQ ID NO: 3756332 - RNA, 19 nt, Human
gcaccagcccagaagugca

SEQ ID NO: 3756333 - RNA, 17 nt, Human
gcaccagcuucuccagg

SEQ ID NO: 3756334 - RNA, 20 nt, Human
gcaccaggcacgaacccacc

SEQ ID NO: 3756335 - RNA, 21 nt, Human
gcaccaggcacgaacccaccu

SEQ ID NO: 3756336 - RNA, 13 nt, Human
gcaccagggaaga

SEQ ID NO: 3756337 - RNA, 19 nt, Human
gcaccagggguuucucgca

SEQ ID NO: 3756338 - RNA, 12 nt, Human
gcaccauaacuu

SEQ ID NO: 3756339 - RNA, 20 nt, Human
gcaccaucacaauacagaua

SEQ ID NO: 3756340 - RNA, 17 nt, Human
gcaccauccccuccggc

SEQ ID NO: 3756341 - RNA, 19 nt, Human
gcaccauccgccagggccc

SEQ ID NO: 3756342 - RNA, 20 nt, Human
gcaccaugcugcuggggaag

SEQ ID NO: 3756343 - RNA, 19 nt, Human
gcaccauuuuaagucccug

SEQ ID NO: 3756344 - RNA, 21 nt, Human
gcacccaagaccucagggcac

SEQ ID NO: 3756345 - RNA, 22 nt, Human
gcacccaccaucaugucuggcu

SEQ ID NO: 3756346 - RNA, 19 nt, Human
gcacccacccagcacccag

SEQ ID NO: 3756347 - RNA, 17 nt, Human
gcacccacccugggacc

SEQ ID NO: 3756348 - RNA, 14 nt, Human
gcacccacucugcu

SEQ ID NO: 3756349 - RNA, 13 nt, Human
gcacccagcccug

SEQ ID NO: 3756350 - RNA, 22 nt, Human
gcacccauccaccguccccucc

SEQ ID NO: 3756351 - RNA, 17 nt, Human
gcaccccaugcuguuga

SEQ ID NO: 3756352 - RNA, 15 nt, Human
gcacccccacgcccu

SEQ ID NO: 3756353 - RNA, 12 nt, Human
gcacccccagcc

SEQ ID NO: 3756354 - RNA, 21 nt, Human
gcacccccagccugggccuau

SEQ ID NO: 3756355 - RNA, 18 nt, Human
gcaccccccuguucuaag

SEQ ID NO: 3756356 - RNA, 16 nt, Human
gcacccccgucaagag

SEQ ID NO: 3756357 - RNA, 12 nt, Human
gcacccccuccu

SEQ ID NO: 3756358 - RNA, 16 nt, Human
gcacccccuccugcug

SEQ ID NO: 3756359 - RNA, 13 nt, Human
gcacccccugcag

SEQ ID NO: 3756360 - RNA, 18 nt, Human
gcaccccgauguggaccu

SEQ ID NO: 3756361 - RNA, 16 nt, Human
gcaccccuacucacau

SEQ ID NO: 3756362 - RNA, 13 nt, Human
gcaccccucccau

SEQ ID NO: 3756363 - RNA, 13 nt, Human
gcaccccuuccau

SEQ ID NO: 3756364 - RNA, 14 nt, Human
gcaccccuuccugg

SEQ ID NO: 3756365 - RNA, 12 nt, Human
gcaccccuucuc

SEQ ID NO: 3756366 - RNA, 18 nt, Human
gcaccccuucucuccucc

SEQ ID NO: 3756367 - RNA, 22 nt, Human
gcacccgggcucagggaccaca

SEQ ID NO: 3756368 - RNA, 23 nt, Human
gcacccguguuuguaaaaaugua

SEQ ID NO: 3756369 - RNA, 21 nt, Human
gcacccuaguucuaccucagg

SEQ ID NO: 3756370 - RNA, 13 nt, Human
gcacccuccaccc

SEQ ID NO: 3756371 - RNA, 16 nt, Human
gcacccuccacccugu

SEQ ID NO: 3756372 - RNA, 17 nt, Human
gcacccuccacccuguc

SEQ ID NO: 3756373 - RNA, 13 nt, Human
gcacccuccccuc

SEQ ID NO: 3756374 - RNA, 15 nt, Human
gcacccuccuagggc

SEQ ID NO: 3756375 - RNA, 15 nt, Human
gcacccucuauccca

SEQ ID NO: 3756376 - RNA, 12 nt, Human
gcacccugaggg

SEQ ID NO: 3756377 - RNA, 14 nt, Human
gcacccuggggccu

SEQ ID NO: 3756378 - RNA, 15 nt, Human
gcacccuggggccug

SEQ ID NO: 3756379 - RNA, 20 nt, Human
gcacccuuccaucugauucc

SEQ ID NO: 3756380 - RNA, 17 nt, Human
gcacccuucuuuccucu

SEQ ID NO: 3756381 - RNA, 15 nt, Human
gcaccgaagcccaga

SEQ ID NO: 3756382 - RNA, 23 nt, Human
gcaccgaagcccagagggucugg

SEQ ID NO: 3756383 - RNA, 19 nt, Human
gcaccgccggccagcuggg

SEQ ID NO: 3756384 - RNA, 14 nt, Human
gcaccgccucuucc

SEQ ID NO: 3756385 - RNA, 17 nt, Human
gcaccgccucuucccgc

SEQ ID NO: 3756386 - RNA, 14 nt, Human
gcaccggaccagcc

SEQ ID NO: 3756387 - RNA, 18 nt, Human
gcaccggcuggccuggcc

SEQ ID NO: 3756388 - RNA, 17 nt, Human
gcaccgucauggcuuaa

SEQ ID NO: 3756389 - RNA, 21 nt, Human
gcaccgucauggcuuaauguu

SEQ ID NO: 3756390 - RNA, 21 nt, Human
gcaccgugucaagcugcucug

SEQ ID NO: 3756391 - RNA, 18 nt, Human
gcaccuaaagcagccagc

SEQ ID NO: 3756392 - RNA, 22 nt, Human
gcaccuaauccaggcagaucca

SEQ ID NO: 3756393 - RNA, 19 nt, Human
gcaccuacaguguacaguc

SEQ ID NO: 3756394 - RNA, 21 nt, Human
gcaccuaccaccacgcccggc

SEQ ID NO: 3756395 - RNA, 17 nt, Human
gcaccuaccaucaggga

SEQ ID NO: 3756396 - RNA, 21 nt, Human
gcaccuacuacaucgcccucc

SEQ ID NO: 3756397 - RNA, 16 nt, Human
gcaccuaguccaguga

SEQ ID NO: 3756398 - RNA, 21 nt, Human
gcaccucacagaaaugagauc

SEQ ID NO: 3756399 - RNA, 18 nt, Human
gcaccuccccccacugca

SEQ ID NO: 3756400 - RNA, 23 nt, Human
gcaccuccccccacugcaggccc

SEQ ID NO: 3756401 - RNA, 14 nt, Human
gcaccuccucagcc

SEQ ID NO: 3756402 - RNA, 21 nt, Human
gcaccuccucggcuggcuguc

SEQ ID NO: 3756403 - RNA, 14 nt, Human
gcaccuccugccuc

SEQ ID NO: 3756404 - RNA, 14 nt, Human
gcaccucuuccuug

SEQ ID NO: 3756405 - RNA, 23 nt, Human
gcaccugcauccguaguucccug

SEQ ID NO: 3756406 - RNA, 15 nt, Human
gcaccugcccccugg

SEQ ID NO: 3756407 - RNA, 21 nt, Human
gcaccugcccuaccugcccca

SEQ ID NO: 3756408 - RNA, 21 nt, Human
gcaccugccgaccucguccuc

SEQ ID NO: 3756409 - RNA, 21 nt, Human
gcaccuggcugagccuggcug

SEQ ID NO: 3756410 - RNA, 15 nt, Human
gcaccugggcccugg

SEQ ID NO: 3756411 - RNA, 16 nt, Human
gcaccugggcccuggg

SEQ ID NO: 3756412 - RNA, 13 nt, Human
gcaccuguacagu

SEQ ID NO: 3756413 - RNA, 17 nt, Human
gcaccuguagucccagc

SEQ ID NO: 3756414 - RNA, 18 nt, Human
gcaccuguccccacccuc

SEQ ID NO: 3756415 - RNA, 18 nt, Human
gcaccugucugcuccagc

SEQ ID NO: 3756416 - RNA, 18 nt, Human
gcaccuuaccaacuuucu

SEQ ID NO: 3756417 - RNA, 19 nt, Human
gcaccuuagacagucccug

SEQ ID NO: 3756418 - RNA, 14 nt, Human
gcaccuucagacuu

SEQ ID NO: 3756419 - RNA, 15 nt, Human
gcaccuuccucacuu

SEQ ID NO: 3756420 - RNA, 15 nt, Human
gcaccuugugccugg

SEQ ID NO: 3756421 - RNA, 14 nt, Human
gcaccuugugucug

SEQ ID NO: 3756422 - RNA, 18 nt, Human
gcaccuuucuaguugaaa

SEQ ID NO: 3756423 - RNA, 15 nt, Human
gcaccuuuuacugug

SEQ ID NO: 3756424 - RNA, 16 nt, Human
gcacgaacccaccugc

SEQ ID NO: 3756425 - RNA, 16 nt, Human
gcacgacgcccucucc

SEQ ID NO: 3756426 - RNA, 19 nt, Human
gcacgacgcccucucccca

SEQ ID NO: 3756427 - RNA, 20 nt, Human
gcacgacgcccucuccccac

SEQ ID NO: 3756428 - RNA, 12 nt, Human
gcacgauuucug

SEQ ID NO: 3756429 - RNA, 13 nt, Human
gcacgcacacaca

SEQ ID NO: 3756430 - RNA, 16 nt, Human
gcacgcacacacacaa

SEQ ID NO: 3756431 - RNA, 15 nt, Human
gcacgcccaugugug

SEQ ID NO: 3756432 - RNA, 18 nt, Human
gcacgcccaugugugagu

SEQ ID NO: 3756433 - RNA, 22 nt, Human
gcacgcccaugugugagugugu

SEQ ID NO: 3756434 - RNA, 18 nt, Human
gcacgcgcccuuucuacc

SEQ ID NO: 3756435 - RNA, 15 nt, Human
gcacgcgugugcagg

SEQ ID NO: 3756436 - RNA, 20 nt, Human
gcacgcugugggcagguggg

SEQ ID NO: 3756437 - RNA, 21 nt, Human
gcacgcuugcguaugucuguu

SEQ ID NO: 3756438 - RNA, 16 nt, Human
gcacggacaauaaacc

SEQ ID NO: 3756439 - RNA, 12 nt, Human
gcacggacucuu

SEQ ID NO: 3756440 - RNA, 23 nt, Human
gcacggccccgaagggcccccac

SEQ ID NO: 3756441 - RNA, 14 nt, Human
gcacggcucugucc

SEQ ID NO: 3756442 - RNA, 18 nt, Human
gcacggcucuguccccag

SEQ ID NO: 3756443 - RNA, 14 nt, Human
gcacgggugguccc

SEQ ID NO: 3756444 - RNA, 16 nt, Human
gcacgggugguccccg

SEQ ID NO: 3756445 - RNA, 16 nt, Human
gcacggugggccuugc

SEQ ID NO: 3756446 - RNA, 18 nt, Human
gcacgguggugaggcagu

SEQ ID NO: 3756447 - RNA, 23 nt, Human
gcacguggcauguggccuguggc

SEQ ID NO: 3756448 - RNA, 13 nt, Human
gcacguggccucu

SEQ ID NO: 3756449 - RNA, 23 nt, Human
gcacguggcuucugaugaaucuu

SEQ ID NO: 3756450 - RNA, 23 nt, Human
gcacgugggucuucagggggcca

SEQ ID NO: 3756451 - RNA, 14 nt, Human
gcacgugugugcac

SEQ ID NO: 3756452 - RNA, 16 nt, Human
gcacguguguuuuucu

SEQ ID NO: 3756453 - RNA, 15 nt, Human
gcacguugcuucagg

SEQ ID NO: 3756454 - RNA, 17 nt, Human
gcacguuuaaaguucug

SEQ ID NO: 3756455 - RNA, 18 nt, Human
gcacuaaagccagccuga

SEQ ID NO: 3756456 - RNA, 19 nt, Human
gcacuaaagccagccugac

SEQ ID NO: 3756457 - RNA, 20 nt, Human
gcacuaaaguauguaaagua

SEQ ID NO: 3756458 - RNA, 22 nt, Human
gcacuaaaguauguaaaguaug

SEQ ID NO: 3756459 - RNA, 17 nt, Human
gcacuaaaucagagaca

SEQ ID NO: 3756460 - RNA, 17 nt, Human
gcacuaaggugugcucu

SEQ ID NO: 3756461 - RNA, 18 nt, Human
gcacuaaggugugcucug

SEQ ID NO: 3756462 - RNA, 22 nt, Human
gcacuaagucucuuuuuuacaa

SEQ ID NO: 3756463 - RNA, 16 nt, Human
gcacuacauaaacuga

SEQ ID NO: 3756464 - RNA, 12 nt, Human
gcacuacauuca

SEQ ID NO: 3756465 - RNA, 16 nt, Human
gcacuacauucauuua

SEQ ID NO: 3756466 - RNA, 21 nt, Human
gcacuacucccucaaagcaca

SEQ ID NO: 3756467 - RNA, 17 nt, Human
gcacuacuccucugcag

SEQ ID NO: 3756468 - RNA, 17 nt, Human
gcacuacucugugccag

SEQ ID NO: 3756469 - RNA, 17 nt, Human
gcacuacugacaugugg

SEQ ID NO: 3756470 - RNA, 18 nt, Human
gcacuacugacauguggg

SEQ ID NO: 3756471 - RNA, 14 nt, Human
gcacuacugggugu

SEQ ID NO: 3756472 - RNA, 19 nt, Human
gcacuacugggugucauuu

SEQ ID NO: 3756473 - RNA, 14 nt, Human
aaccacuuuuugca

SEQ ID NO: 3756474 - RNA, 15 nt, Human
aaccacuuuuugcag

SEQ ID NO: 3756475 - RNA, 17 nt, Human
aaccacuuuuugcagcu

SEQ ID NO: 3756476 - RNA, 13 nt, Human
aaccagacagagg

SEQ ID NO: 3756477 - RNA, 15 nt, Human
aaccagaccuggaag

SEQ ID NO: 3756478 - RNA, 14 nt, Human
aaccagacucuugc

SEQ ID NO: 3756479 - RNA, 23 nt, Human
aaccagaucuagucaaucaaguc

SEQ ID NO: 3756480 - RNA, 21 nt, Human
aaccagcaucccuugaccagg

SEQ ID NO: 3756481 - RNA, 14 nt, Human
aaccagcuaagaaa

SEQ ID NO: 3756482 - RNA, 14 nt, Human
aaccagcucagcac

SEQ ID NO: 3756483 - RNA, 17 nt, Human
aaccagcucagcacugc

SEQ ID NO: 3756484 - RNA, 22 nt, Human
aaccagcucagcacugccugcu

SEQ ID NO: 3756485 - RNA, 21 nt, Human
aaccagcuuccuucagagagc

SEQ ID NO: 3756486 - RNA, 15 nt, Human
aaccaggaaauggaa

SEQ ID NO: 3756487 - RNA, 17 nt, Human
aaccaggagcugcucac

SEQ ID NO: 3756488 - RNA, 14 nt, Human
aaccaggcuuucua

SEQ ID NO: 3756489 - RNA, 19 nt, Human
aaccagggaagcugucccu

SEQ ID NO: 3756490 - RNA, 16 nt, Human
aaccagggagacugca

SEQ ID NO: 3756491 - RNA, 21 nt, Human
aaccagggagccccuuugaug

SEQ ID NO: 3756492 - RNA, 17 nt, Human
aaccagggcaccaagcc

SEQ ID NO: 3756493 - RNA, 16 nt, Human
aaccagguccaaugag

SEQ ID NO: 3756494 - RNA, 15 nt, Human
aaccaguauuguaca

SEQ ID NO: 3756495 - RNA, 22 nt, Human
aaccaguauuguacaaaguauu

SEQ ID NO: 3756496 - RNA, 18 nt, Human
aaccaguccccccacccu

SEQ ID NO: 3756497 - RNA, 14 nt, Human
aaccagucugaagu

SEQ ID NO: 3756498 - RNA, 21 nt, Human
aaccagucugaaguuucauuu

SEQ ID NO: 3756499 - RNA, 23 nt, Human
aaccagucugaaguuucauuuau

SEQ ID NO: 3756500 - RNA, 19 nt, Human
aaccaguguuguggauuua

SEQ ID NO: 3756501 - RNA, 13 nt, Human
aaccaguuggcua

SEQ ID NO: 3756502 - RNA, 18 nt, Human
aaccauaaaauguccagu

SEQ ID NO: 3756503 - RNA, 14 nt, Human
aaccauaaauucaa

SEQ ID NO: 3756504 - RNA, 18 nt, Human
aaccauaacaacuucaua

SEQ ID NO: 3756505 - RNA, 13 nt, Human
aaccauacugaaa

SEQ ID NO: 3756506 - RNA, 15 nt, Human
aaccauaguuacugu

SEQ ID NO: 3756507 - RNA, 20 nt, Human
aaccauaguuacuguaaaau

SEQ ID NO: 3756508 - RNA, 14 nt, Human
aaccauaugauacu

SEQ ID NO: 3756509 - RNA, 12 nt, Human
aaccauaugccc

SEQ ID NO: 3756510 - RNA, 16 nt, Human
aaccaucauuauaaac

SEQ ID NO: 3756511 - RNA, 12 nt, Human
aaccaucauuga

SEQ ID NO: 3756512 - RNA, 17 nt, Human
aaccaucauugaaaucu

SEQ ID NO: 3756513 - RNA, 21 nt, Human
aaccaucauugaaaucuuuuu

SEQ ID NO: 3756514 - RNA, 18 nt, Human
aaccaucucccuggugcu

SEQ ID NO: 3756515 - RNA, 19 nt, Human
aaccaucucccuggugcuu

SEQ ID NO: 3756516 - RNA, 13 nt, Human
aaccaucuggccu

SEQ ID NO: 3756517 - RNA, 19 nt, Human
aaccaucuugugucuuugg

SEQ ID NO: 3756518 - RNA, 16 nt, Human
aaccaugaagacagga

SEQ ID NO: 3756519 - RNA, 20 nt, Human
aaccaugaagucucuaacaa

SEQ ID NO: 3756520 - RNA, 13 nt, Human
aaccauggacuuu

SEQ ID NO: 3756521 - RNA, 18 nt, Human
aaccaugggauaaaugcc

SEQ ID NO: 3756522 - RNA, 21 nt, Human
aaccaugggauaaaugccauc

SEQ ID NO: 3756523 - RNA, 17 nt, Human
aaccauguagaaaauuu

SEQ ID NO: 3756524 - RNA, 17 nt, Human
aaccaugucauuucaga

SEQ ID NO: 3756525 - RNA, 23 nt, Human
aaccauuaaaacugaagucugaa

SEQ ID NO: 3756526 - RNA, 19 nt, Human
aaccauuauaaccuuaauu

SEQ ID NO: 3756527 - RNA, 19 nt, Human
aaccauucaaaaauuucac

SEQ ID NO: 3756528 - RNA, 16 nt, Human
aaccauugugcauucu

SEQ ID NO: 3756529 - RNA, 13 nt, Human
aaccauuuaucuu

SEQ ID NO: 3756530 - RNA, 15 nt, Human
aaccauuuccucaga

SEQ ID NO: 3756531 - RNA, 16 nt, Human
aaccauuuccucagac

SEQ ID NO: 3756532 - RNA, 14 nt, Human
aaccauuuuauaaa

SEQ ID NO: 3756533 - RNA, 17 nt, Human
aaccauuuuauaaagug

SEQ ID NO: 3756534 - RNA, 22 nt, Human
aaccauuuuuguuacucucuuc

SEQ ID NO: 3756535 - RNA, 20 nt, Human
aaccauuuuuuuucagcaga

SEQ ID NO: 3756536 - RNA, 13 nt, Human
aacccaaaccugg

SEQ ID NO: 3756537 - RNA, 16 nt, Human
aacccaaaccuggaga

SEQ ID NO: 3756538 - RNA, 18 nt, Human
aacccaaauguucaucaa

SEQ ID NO: 3756539 - RNA, 14 nt, Human
aacccaacaugacu

SEQ ID NO: 3756540 - RNA, 13 nt, Human
aacccaagcuccu

SEQ ID NO: 3756541 - RNA, 16 nt, Human
aacccaaggagcacag

SEQ ID NO: 3756542 - RNA, 17 nt, Human
aacccaaggagcacagg

SEQ ID NO: 3756543 - RNA, 16 nt, Human
aacccaagugggggca

SEQ ID NO: 3756544 - RNA, 15 nt, Human
aacccagacucagac

SEQ ID NO: 3756545 - RNA, 18 nt, Human
aacccagacucagacauu

SEQ ID NO: 3756546 - RNA, 11 nt, Human
aacccagagag

SEQ ID NO: 3756547 - RNA, 10 nt, Human
aacccagccg

SEQ ID NO: 3756548 - RNA, 14 nt, Human
aacccagccgcugc

SEQ ID NO: 3756549 - RNA, 13 nt, Human
aacccagcucugg

SEQ ID NO: 3756550 - RNA, 14 nt, Human
aacccagcucuggu

SEQ ID NO: 3756551 - RNA, 11 nt, Human
aacccagcugc

SEQ ID NO: 3756552 - RNA, 15 nt, Human
aacccagcuuacauu

SEQ ID NO: 3756553 - RNA, 17 nt, Human
aacccaggacgcuucug

SEQ ID NO: 3756554 - RNA, 18 nt, Human
aacccaggacgcuucuga

SEQ ID NO: 3756555 - RNA, 19 nt, Human
aacccaggacgcuucugaa

SEQ ID NO: 3756556 - RNA, 22 nt, Human
aacccaggagcauccaccuccu

SEQ ID NO: 3756557 - RNA, 20 nt, Human
aacccagggcucugccccag

SEQ ID NO: 3756558 - RNA, 21 nt, Human
aacccagggcucugccccagu

SEQ ID NO: 3756559 - RNA, 15 nt, Human
aacccaguugccauc

SEQ ID NO: 3756560 - RNA, 16 nt, Human
aacccaguuucccguc

SEQ ID NO: 3756561 - RNA, 21 nt, Human
aacccauaggcccacacacag

SEQ ID NO: 3756562 - RNA, 22 nt, Human
aacccauaggcccacacacagg

SEQ ID NO: 3756563 - RNA, 20 nt, Human
aacccauauuuguacaccaa

SEQ ID NO: 3756564 - RNA, 20 nt, Human
aacccaucaacaaaaauugu

SEQ ID NO: 3756565 - RNA, 19 nt, Human
aacccaucagaaggagaag

SEQ ID NO: 3756566 - RNA, 20 nt, Human
aacccaucuaccccuggaug

SEQ ID NO: 3756567 - RNA, 16 nt, Human
aaccccaacuccagua

SEQ ID NO: 3756568 - RNA, 13 nt, Human
aaccccaggcccc

SEQ ID NO: 3756569 - RNA, 18 nt, Human
aaccccauguccucagca

SEQ ID NO: 3756570 - RNA, 12 nt, Human
aacccccacaca

SEQ ID NO: 3756571 - RNA, 15 nt, Human
aacccccacacacac

SEQ ID NO: 3756572 - RNA, 19 nt, Human
aacccccaccccacacuug

SEQ ID NO: 3756573 - RNA, 15 nt, Human
aacccccagccugcu

SEQ ID NO: 3756574 - RNA, 12 nt, Human
aacccccagcuc

SEQ ID NO: 3756575 - RNA, 11 nt, Human
aaccccccagc

SEQ ID NO: 3756576 - RNA, 19 nt, Human
aaccccccagcacugagga

SEQ ID NO: 3756577 - RNA, 15 nt, Human
aaccccccuguacac

SEQ ID NO: 3756578 - RNA, 15 nt, Human
aaccccgucaacaaa

SEQ ID NO: 3756579 - RNA, 18 nt, Human
aaccccgucaacaaaucu

SEQ ID NO: 3756580 - RNA, 15 nt, Human
aaccccucgcccagu

SEQ ID NO: 3756581 - RNA, 17 nt, Human
aaccccuguaggccuca

SEQ ID NO: 3756582 - RNA, 15 nt, Human
aaccccuucucugug

SEQ ID NO: 3756583 - RNA, 16 nt, Human
aaccccuucucuguga

SEQ ID NO: 3756584 - RNA, 20 nt, Human
aacccgacagagggaagaaa

SEQ ID NO: 3756585 - RNA, 22 nt, Human
aacccgaggcugagaaucagac

SEQ ID NO: 3756586 - RNA, 23 nt, Human
aacccgagucauucguucugugg

SEQ ID NO: 3756587 - RNA, 17 nt, Human
aacccguggaggcugcu

SEQ ID NO: 3756588 - RNA, 18 nt, Human
aacccguggaggcugcuc

SEQ ID NO: 3756589 - RNA, 18 nt, Human
aacccuagccuugcuugu

SEQ ID NO: 3756590 - RNA, 23 nt, Human
aacccuaucuccugacagaaggu

SEQ ID NO: 3756591 - RNA, 15 nt, Human
aacccuauugguaaa

SEQ ID NO: 3756592 - RNA, 20 nt, Human
aacccucacaucagagugac

SEQ ID NO: 3756593 - RNA, 19 nt, Human
aacccucagagccaccccu

SEQ ID NO: 3756594 - RNA, 17 nt, Human
aacccucaggggaaaac

SEQ ID NO: 3756595 - RNA, 22 nt, Human
aacccucaggggaaaacuguua

SEQ ID NO: 3756596 - RNA, 14 nt, Human
aacccucccucagc

SEQ ID NO: 3756597 - RNA, 15 nt, Human
aacccucccucagcc

SEQ ID NO: 3756598 - RNA, 18 nt, Human
aacccucuguuccuuccc

SEQ ID NO: 3756599 - RNA, 21 nt, Human
aacccugacaaauuuuaauua

SEQ ID NO: 3756600 - RNA, 19 nt, Human
aacccugccccugccccgu

SEQ ID NO: 3756601 - RNA, 18 nt, Human
aacccugccgucaccacc

SEQ ID NO: 3756602 - RNA, 17 nt, Human
aacccugcguggggaca

SEQ ID NO: 3756603 - RNA, 19 nt, Human
aacccuggggaaggagcca

SEQ ID NO: 3756604 - RNA, 18 nt, Human
aacccuggggccugacug

SEQ ID NO: 3756605 - RNA, 17 nt, Human
aacccugucaaacauua

SEQ ID NO: 3756606 - RNA, 21 nt, Human
aacccugugcugguguccuga

SEQ ID NO: 3756607 - RNA, 13 nt, Human
aacccuguuuccu

SEQ ID NO: 3756608 - RNA, 20 nt, Human
aacccuguuuuauacuguac

SEQ ID NO: 3756609 - RNA, 22 nt, Human
aacccuguuuuauacuguacuu

SEQ ID NO: 3756610 - RNA, 16 nt, Human
aacccuucaucuuccu

SEQ ID NO: 3756611 - RNA, 20 nt, Human
aacccuugggccagaaguac

SEQ ID NO: 3756612 - RNA, 16 nt, Human
aacccuuuuggccccc

SEQ ID NO: 3756613 - RNA, 19 nt, Human
aacccuuuugucugccucu

SEQ ID NO: 3756614 - RNA, 17 nt, Human
aaccgagcaaagaucaa

SEQ ID NO: 3756615 - RNA, 13 nt, Human
aaccgcacagcuc

SEQ ID NO: 3756616 - RNA, 15 nt, Human
aaccgcacagcucag

SEQ ID NO: 3756617 - RNA, 18 nt, Human
aaccgcacucacccaugu

SEQ ID NO: 3756618 - RNA, 15 nt, Human
aaccgcaggaagcug

SEQ ID NO: 3756619 - RNA, 22 nt, Human
aaccgccagcucuguucuuccu

SEQ ID NO: 3756620 - RNA, 16 nt, Human
aaccgcucaccuagag

SEQ ID NO: 3756621 - RNA, 21 nt, Human
aaccggauggcggacaccugg

SEQ ID NO: 3756622 - RNA, 15 nt, Human
aaccgucaauaggca

SEQ ID NO: 3756623 - RNA, 13 nt, Human
aaccguccucuuu

SEQ ID NO: 3756624 - RNA, 21 nt, Human
gcacuagccaaaccucaccaa

SEQ ID NO: 3756625 - RNA, 18 nt, Human
gcacuagccuuuggcucu

SEQ ID NO: 3756626 - RNA, 19 nt, Human
gcacuagguucaauucccu

SEQ ID NO: 3756627 - RNA, 15 nt, Human
gcacuauaauguaag

SEQ ID NO: 3756628 - RNA, 15 nt, Human
gcacuauaugcaaac

SEQ ID NO: 3756629 - RNA, 18 nt, Human
gcacuauaugcaaacagg

SEQ ID NO: 3756630 - RNA, 19 nt, Human
gcacuaucuuuaaacgaaa

SEQ ID NO: 3756631 - RNA, 17 nt, Human
gcacuaugcuuuccuuc

SEQ ID NO: 3756632 - RNA, 18 nt, Human
gcacucaaaucuuaagaa

SEQ ID NO: 3756633 - RNA, 20 nt, Human
gcacucaaaucuuaagaaau

SEQ ID NO: 3756634 - RNA, 13 nt, Human
gcacucaacauga

SEQ ID NO: 3756635 - RNA, 14 nt, Human
gcacucacaugcug

SEQ ID NO: 3756636 - RNA, 23 nt, Human
gcacucacccaugugccaaggug

SEQ ID NO: 3756637 - RNA, 17 nt, Human
gcacucaggcucuccau

SEQ ID NO: 3756638 - RNA, 19 nt, Human
gcacucaggugacauccuc

SEQ ID NO: 3756639 - RNA, 18 nt, Human
gcacuccaaccuaaccug

SEQ ID NO: 3756640 - RNA, 15 nt, Human
gcacuccagccuggg

SEQ ID NO: 3756641 - RNA, 17 nt, Human
gcacuccagccuggggg

SEQ ID NO: 3756642 - RNA, 19 nt, Human
gcacuccagccugggggac

SEQ ID NO: 3756643 - RNA, 16 nt, Human
gcacuccaugagcacc

SEQ ID NO: 3756644 - RNA, 18 nt, Human
gcacucccaccugacaca

SEQ ID NO: 3756645 - RNA, 22 nt, Human
gcacucccaccugacacaccag

SEQ ID NO: 3756646 - RNA, 16 nt, Human
gcacuccccugcuggg

SEQ ID NO: 3756647 - RNA, 18 nt, Human
gcacucccuccagcacaa

SEQ ID NO: 3756648 - RNA, 20 nt, Human
gcacucgcuagcaguggcag

SEQ ID NO: 3756649 - RNA, 17 nt, Human
gcacucuaaaagguuca

SEQ ID NO: 3756650 - RNA, 21 nt, Human
gcacucuaaaagguucaggga

SEQ ID NO: 3756651 - RNA, 17 nt, Human
gcacucuguauauuuga

SEQ ID NO: 3756652 - RNA, 11 nt, Human
gcacucugugc

SEQ ID NO: 3756653 - RNA, 13 nt, Human
gcacucugugccc

SEQ ID NO: 3756654 - RNA, 14 nt, Human
gcacucugugccca

SEQ ID NO: 3756655 - RNA, 21 nt, Human
gcacucugugcccaugggcac

SEQ ID NO: 3756656 - RNA, 14 nt, Human
gcacucuguuauuu

SEQ ID NO: 3756657 - RNA, 13 nt, Human
gcacucuucaugg

SEQ ID NO: 3756658 - RNA, 15 nt, Human
gcacucuucauggug

SEQ ID NO: 3756659 - RNA, 18 nt, Human
gcacucuuguucccacac

SEQ ID NO: 3756660 - RNA, 20 nt, Human
gcacucuuuaagggagugua

SEQ ID NO: 3756661 - RNA, 22 nt, Human
gcacugaaagucacggcugcgc

SEQ ID NO: 3756662 - RNA, 22 nt, Human
gcacugaaggcuuucagggccu

SEQ ID NO: 3756663 - RNA, 22 nt, Human
gcacugaagggauaugugaaac

SEQ ID NO: 3756664 - RNA, 17 nt, Human
gcacugaagugcuuagu

SEQ ID NO: 3756665 - RNA, 22 nt, Human
gcacugaauaaauuguacagcc

SEQ ID NO: 3756666 - RNA, 17 nt, Human
gcacugacagauuucca

SEQ ID NO: 3756667 - RNA, 20 nt, Human
gcacugacccacagccucug

SEQ ID NO: 3756668 - RNA, 19 nt, Human
gcacugacggacucaugau

SEQ ID NO: 3756669 - RNA, 13 nt, Human
gcacugacucugg

SEQ ID NO: 3756670 - RNA, 16 nt, Human
gcacugacucuggaaa

SEQ ID NO: 3756671 - RNA, 17 nt, Human
gcacugacucuggaaaa

SEQ ID NO: 3756672 - RNA, 18 nt, Human
gcacugacucuggaaaag

SEQ ID NO: 3756673 - RNA, 17 nt, Human
gcacugacugggcauag

SEQ ID NO: 3756674 - RNA, 13 nt, Human
gcacugagccccc

SEQ ID NO: 3756675 - RNA, 14 nt, Human
gcacugagggccac

SEQ ID NO: 3756676 - RNA, 16 nt, Human
gcacugagggccacac

SEQ ID NO: 3756677 - RNA, 20 nt, Human
gcacugagggccacacuauu

SEQ ID NO: 3756678 - RNA, 18 nt, Human
gcacugaugcugccccuc

SEQ ID NO: 3756679 - RNA, 17 nt, Human
gcacugauguuguguuu

SEQ ID NO: 3756680 - RNA, 15 nt, Human
gcacugauuucacaa

SEQ ID NO: 3756681 - RNA, 13 nt, Human
gcacugcaggggc

SEQ ID NO: 3756682 - RNA, 13 nt, Human
gcacugccacugg

SEQ ID NO: 3756683 - RNA, 18 nt, Human
gcacugccaggagggaca

SEQ ID NO: 3756684 - RNA, 23 nt, Human
gcacugccaggagggacaaagga

SEQ ID NO: 3756685 - RNA, 21 nt, Human
gcacugcccauggacaggcug

SEQ ID NO: 3756686 - RNA, 12 nt, Human
gcacugcccugg

SEQ ID NO: 3756687 - RNA, 16 nt, Human
gcacugccucucacag

SEQ ID NO: 3756688 - RNA, 20 nt, Human
gcacugcuaggcgagugcca

SEQ ID NO: 3756689 - RNA, 13 nt, Human
gcacugcucucac

SEQ ID NO: 3756690 - RNA, 17 nt, Human
gcacugcuggguggccc

SEQ ID NO: 3756691 - RNA, 18 nt, Human
gcacugcuggguggccca

SEQ ID NO: 3756692 - RNA, 19 nt, Human
gcacugcuggguggcccau

SEQ ID NO: 3756693 - RNA, 15 nt, Human
gcacugcugugcugu

SEQ ID NO: 3756694 - RNA, 12 nt, Human
gcacugcuucca

SEQ ID NO: 3756695 - RNA, 18 nt, Human
gcacugcuuccagugagg

SEQ ID NO: 3756696 - RNA, 20 nt, Human
gcacugcuuccagugaggcu

SEQ ID NO: 3756697 - RNA, 22 nt, Human
gcacugcuuccagugaggcucu

SEQ ID NO: 3756698 - RNA, 11 nt, Human
gcacuggccug

SEQ ID NO: 3756699 - RNA, 21 nt, Human
gcacuggccuucugaugaaau

SEQ ID NO: 3756700 - RNA, 15 nt, Human
gcacuggcucucucc

SEQ ID NO: 3756701 - RNA, 16 nt, Human
gcacuggcucucucca

SEQ ID NO: 3756702 - RNA, 19 nt, Human
gcacuggcucucuccagga

SEQ ID NO: 3756703 - RNA, 20 nt, Human
gcacugggaggcuccccuuc

SEQ ID NO: 3756704 - RNA, 23 nt, Human
gcacugggaugagccgcugugag

SEQ ID NO: 3756705 - RNA, 13 nt, Human
gcacugggcauga

SEQ ID NO: 3756706 - RNA, 12 nt, Human
gcacugggcuug

SEQ ID NO: 3756707 - RNA, 15 nt, Human
gcacuggggcagggg

SEQ ID NO: 3756708 - RNA, 18 nt, Human
gcacuggguugcagggga

SEQ ID NO: 3756709 - RNA, 19 nt, Human
gcacugguagguugggaca

SEQ ID NO: 3756710 - RNA, 22 nt, Human
gcacugguggcccgacagccug

SEQ ID NO: 3756711 - RNA, 16 nt, Human
gcacugucacuuugcu

SEQ ID NO: 3756712 - RNA, 16 nt, Human
gcacuguccugcucca

SEQ ID NO: 3756713 - RNA, 17 nt, Human
gcacuguccugcuccac

SEQ ID NO: 3756714 - RNA, 20 nt, Human
gcacugucucaguuucacuu

SEQ ID NO: 3756715 - RNA, 11 nt, Human
gcacugugaag

SEQ ID NO: 3756716 - RNA, 14 nt, Human
gcacugugaaggac

SEQ ID NO: 3756717 - RNA, 19 nt, Human
gcacugugacccccagcuc

SEQ ID NO: 3756718 - RNA, 14 nt, Human
gcacugugcucagg

SEQ ID NO: 3756719 - RNA, 14 nt, Human
gcacuguggccuug

SEQ ID NO: 3756720 - RNA, 15 nt, Human
gcacuguucccccug

SEQ ID NO: 3756721 - RNA, 14 nt, Human
gcacuguugagaag

SEQ ID NO: 3756722 - RNA, 18 nt, Human
gcacuguugagaaggaga

SEQ ID NO: 3756723 - RNA, 18 nt, Human
gcacuguugauguaucug

SEQ ID NO: 3756724 - RNA, 19 nt, Human
gcacuguugauguaucuga

SEQ ID NO: 3756725 - RNA, 20 nt, Human
gcacuguugcaaacucagug

SEQ ID NO: 3756726 - RNA, 21 nt, Human
gcacuuaaauaucaaucauuu

SEQ ID NO: 3756727 - RNA, 15 nt, Human
gcacuuacaauccca

SEQ ID NO: 3756728 - RNA, 22 nt, Human
gcacuuacugguaggaccaagc

SEQ ID NO: 3756729 - RNA, 19 nt, Human
gcacuuagcuaucagaaga

SEQ ID NO: 3756730 - RNA, 16 nt, Human
gcacuuaugauuucau

SEQ ID NO: 3756731 - RNA, 18 nt, Human
gcacuuauugaauauaug

SEQ ID NO: 3756732 - RNA, 20 nt, Human
gcacuuauugaauauaugau

SEQ ID NO: 3756733 - RNA, 18 nt, Human
gcacuuauugaccauuuu

SEQ ID NO: 3756734 - RNA, 16 nt, Human
gcacuuauuguaaauu

SEQ ID NO: 3756735 - RNA, 17 nt, Human
gcacuucagaauuccau

SEQ ID NO: 3756736 - RNA, 11 nt, Human
gcacuucccug

SEQ ID NO: 3756737 - RNA, 20 nt, Human
gcacuuccucucgcggcccu

SEQ ID NO: 3756738 - RNA, 21 nt, Human
gcacuugcacgcccaugugug

SEQ ID NO: 3756739 - RNA, 13 nt, Human
gcacuugccuggg

SEQ ID NO: 3756740 - RNA, 18 nt, Human
gcacuugccugggucaca

SEQ ID NO: 3756741 - RNA, 22 nt, Human
gcacuugcgguuccggcaugga

SEQ ID NO: 3756742 - RNA, 18 nt, Human
gcacuuggacucuugcuc

SEQ ID NO: 3756743 - RNA, 16 nt, Human
gcacuuggagccaagg

SEQ ID NO: 3756744 - RNA, 16 nt, Human
gcacuuggcagccuug

SEQ ID NO: 3756745 - RNA, 21 nt, Human
gcacuugggggcucagcaagg

SEQ ID NO: 3756746 - RNA, 15 nt, Human
gcacuuguauauacg

SEQ ID NO: 3756747 - RNA, 20 nt, Human
gcacuugugauuauuuauua

SEQ ID NO: 3756748 - RNA, 21 nt, Human
gcacuugugauuauuuauuau

SEQ ID NO: 3756749 - RNA, 18 nt, Human
gcacuuuaaaugaagcua

SEQ ID NO: 3756750 - RNA, 18 nt, Human
gcacuuuagaauaugccu

SEQ ID NO: 3756751 - RNA, 13 nt, Human
gcacuuucauugc

SEQ ID NO: 3756752 - RNA, 21 nt, Human
gcacuuucauugccagugucu

SEQ ID NO: 3756753 - RNA, 19 nt, Human
gcacuuuccacuucuuccu

SEQ ID NO: 3756754 - RNA, 20 nt, Human
gcacuuuccacuucuuccuu

SEQ ID NO: 3756755 - RNA, 22 nt, Human
gcacuuucuacaaugugaacuu

SEQ ID NO: 3756756 - RNA, 16 nt, Human
gcacuuugaaauaccu

SEQ ID NO: 3756757 - RNA, 19 nt, Human
gcacuuugaaauaccucau

SEQ ID NO: 3756758 - RNA, 21 nt, Human
gcacuuugaaauaccucaugu

SEQ ID NO: 3756759 - RNA, 20 nt, Human
gcacuuuggcuuauaauucu

SEQ ID NO: 3756760 - RNA, 19 nt, Human
gcacuuugggaggccaagg

SEQ ID NO: 3756761 - RNA, 16 nt, Human
gcacuuugggaggccu

SEQ ID NO: 3756762 - RNA, 18 nt, Human
gcacuuugggaggcugag

SEQ ID NO: 3756763 - RNA, 13 nt, Human
gcacuuuguaaau

SEQ ID NO: 3756764 - RNA, 11 nt, Human
gcacuuuguag

SEQ ID NO: 3756765 - RNA, 16 nt, Human
gcacuuuguucuggcu

SEQ ID NO: 3756766 - RNA, 16 nt, Human
gcacuuuuuaauucac

SEQ ID NO: 3756767 - RNA, 20 nt, Human
gcacuuuuuaauucaccaaa

SEQ ID NO: 3756768 - RNA, 14 nt, Human
gcacuuuuucauuu

SEQ ID NO: 3756769 - RNA, 22 nt, Human
gcacuuuuucuuaaucauuuuu

SEQ ID NO: 3756770 - RNA, 17 nt, Human
gcagaaaaaggcugugc

SEQ ID NO: 3756771 - RNA, 14 nt, Human
gcagaaaacauugu

SEQ ID NO: 3756772 - RNA, 15 nt, Human
gcagaaaacauuguu

SEQ ID NO: 3756773 - RNA, 16 nt, Human
gcagaaaagcaccugc

SEQ ID NO: 3756774 - RNA, 15 nt, Human
cugcccaggggugcc

SEQ ID NO: 3756775 - RNA, 20 nt, Human
cugcccaggggugcccccuc

SEQ ID NO: 3756776 - RNA, 18 nt, Human
cugcccagucccccaacc

SEQ ID NO: 3756777 - RNA, 19 nt, Human
cugcccagugcacuugcug

SEQ ID NO: 3756778 - RNA, 21 nt, Human
cugcccagugcacuugcugga

SEQ ID NO: 3756779 - RNA, 12 nt, Human
cugcccaguguu

SEQ ID NO: 3756780 - RNA, 20 nt, Human
cugcccaguguuguuuguaa

SEQ ID NO: 3756781 - RNA, 13 nt, Human
cugcccaguugca

SEQ ID NO: 3756782 - RNA, 18 nt, Human
cugcccaucacaggguug

SEQ ID NO: 3756783 - RNA, 21 nt, Human
cugcccaucgugaagaagccu

SEQ ID NO: 3756784 - RNA, 21 nt, Human
cugcccauucaccaaaauuau

SEQ ID NO: 3756785 - RNA, 15 nt, Human
cugcccauuccccag

SEQ ID NO: 3756786 - RNA, 17 nt, Human
cugccccaaccugcuga

SEQ ID NO: 3756787 - RNA, 18 nt, Human
cugccccacuuguccuua

SEQ ID NO: 3756788 - RNA, 13 nt, Human
cugccccagccca

SEQ ID NO: 3756789 - RNA, 13 nt, Human
cugccccaggccu

SEQ ID NO: 3756790 - RNA, 19 nt, Human
cugccccagggcucccggc

SEQ ID NO: 3756791 - RNA, 16 nt, Human
cugccccauccuccag

SEQ ID NO: 3756792 - RNA, 13 nt, Human
cugccccaucucc

SEQ ID NO: 3756793 - RNA, 20 nt, Human
cugccccaucuccccucagc

SEQ ID NO: 3756794 - RNA, 14 nt, Human
cugcccccaaauaa

SEQ ID NO: 3756795 - RNA, 15 nt, Human
cugcccccaaauaag

SEQ ID NO: 3756796 - RNA, 20 nt, Human
cugcccccacaccuggcccu

SEQ ID NO: 3756797 - RNA, 15 nt, Human
cugcccccaccccgg

SEQ ID NO: 3756798 - RNA, 14 nt, Human
cugcccccacuucc

SEQ ID NO: 3756799 - RNA, 18 nt, Human
cugcccccagagccacag

SEQ ID NO: 3756800 - RNA, 19 nt, Human
cugcccccagagccacagu

SEQ ID NO: 3756801 - RNA, 20 nt, Human
cugcccccagagccacaguu

SEQ ID NO: 3756802 - RNA, 15 nt, Human
cugcccccagcccaa

SEQ ID NO: 3756803 - RNA, 16 nt, Human
cugcccccagccccgg

SEQ ID NO: 3756804 - RNA, 19 nt, Human
cugcccccaggacugggcc

SEQ ID NO: 3756805 - RNA, 13 nt, Human
cugccccccagcc

SEQ ID NO: 3756806 - RNA, 14 nt, Human
cugcccccgcaucc

SEQ ID NO: 3756807 - RNA, 16 nt, Human
cugcccccgcaucccc

SEQ ID NO: 3756808 - RNA, 17 nt, Human
cugcccccgcucauggg

SEQ ID NO: 3756809 - RNA, 18 nt, Human
cugcccccuccccuucac

SEQ ID NO: 3756810 - RNA, 13 nt, Human
cugcccccuccug

SEQ ID NO: 3756811 - RNA, 18 nt, Human
cugcccccucugcccugc

SEQ ID NO: 3756812 - RNA, 18 nt, Human
cugcccccugaaacuuau

SEQ ID NO: 3756813 - RNA, 20 nt, Human
cugcccccugaaacuuauuu

SEQ ID NO: 3756814 - RNA, 22 nt, Human
cugcccccugcaggaaggagcu

SEQ ID NO: 3756815 - RNA, 23 nt, Human
cugcccccugcaggaaggagcug

SEQ ID NO: 3756816 - RNA, 13 nt, Human
cugcccccuggug

SEQ ID NO: 3756817 - RNA, 14 nt, Human
cugcccccuucucc

SEQ ID NO: 3756818 - RNA, 16 nt, Human
cugcccccuucuccca

SEQ ID NO: 3756819 - RNA, 19 nt, Human
cugcccccuucucccacac

SEQ ID NO: 3756820 - RNA, 16 nt, Human
cugccccgcccagcug

SEQ ID NO: 3756821 - RNA, 16 nt, Human
cugccccgcccccagu

SEQ ID NO: 3756822 - RNA, 15 nt, Human
cugccccgcccucau

SEQ ID NO: 3756823 - RNA, 20 nt, Human
cugccccuaaucucuguagg

SEQ ID NO: 3756824 - RNA, 21 nt, Human
cugccccuacccuggacuugc

SEQ ID NO: 3756825 - RNA, 22 nt, Human
cugccccucaacucuccuccag

SEQ ID NO: 3756826 - RNA, 15 nt, Human
cugccccucagagac

SEQ ID NO: 3756827 - RNA, 13 nt, Human
cugccccucccag

SEQ ID NO: 3756828 - RNA, 15 nt, Human
cugccccucccagaa

SEQ ID NO: 3756829 - RNA, 22 nt, Human
cugccccucccccaacccccac

SEQ ID NO: 3756830 - RNA, 14 nt, Human
cugccccucccuuc

SEQ ID NO: 3756831 - RNA, 18 nt, Human
cugccccuccucucugcc

SEQ ID NO: 3756832 - RNA, 13 nt, Human
cugccccucucac

SEQ ID NO: 3756833 - RNA, 17 nt, Human
cugccccucucaccaaa

SEQ ID NO: 3756834 - RNA, 13 nt, Human
cugccccucuuuc

SEQ ID NO: 3756835 - RNA, 13 nt, Human
cugccccugcccc

SEQ ID NO: 3756836 - RNA, 12 nt, Human
cugccccugccu

SEQ ID NO: 3756837 - RNA, 22 nt, Human
cugccccuuccuuuaaaaaacu

SEQ ID NO: 3756838 - RNA, 19 nt, Human
cugccccuucuacacucuc

SEQ ID NO: 3756839 - RNA, 20 nt, Human
cugccccuucuacacucucc

SEQ ID NO: 3756840 - RNA, 22 nt, Human
cugccccuucuacacucuccug

SEQ ID NO: 3756841 - RNA, 17 nt, Human
cugcccgagcuggugca

SEQ ID NO: 3756842 - RNA, 17 nt, Human
cugcccgcacacccuca

SEQ ID NO: 3756843 - RNA, 15 nt, Human
cugcccgcacagcag

SEQ ID NO: 3756844 - RNA, 16 nt, Human
cugcccgcacagcagc

SEQ ID NO: 3756845 - RNA, 15 nt, Human
cugcccgccugccca

SEQ ID NO: 3756846 - RNA, 21 nt, Human
cugcccgccugcccaccugcc

SEQ ID NO: 3756847 - RNA, 22 nt, Human
cugcccgccugcccaccugccu

SEQ ID NO: 3756848 - RNA, 16 nt, Human
cugcccgcucccagug

SEQ ID NO: 3756849 - RNA, 17 nt, Human
cugcccgcucccagugu

SEQ ID NO: 3756850 - RNA, 20 nt, Human
cugcccggcaggguccuaga

SEQ ID NO: 3756851 - RNA, 17 nt, Human
cugcccggcgcccucug

SEQ ID NO: 3756852 - RNA, 22 nt, Human
cugcccggcgcccucuguccug

SEQ ID NO: 3756853 - RNA, 22 nt, Human
cugcccggggcagcugccagag

SEQ ID NO: 3756854 - RNA, 23 nt, Human
cugcccgucucucucccauggag

SEQ ID NO: 3756855 - RNA, 24 nt, Human
cugcccgucucucucccauggagc

SEQ ID NO: 3756856 - RNA, 15 nt, Human
cugcccgucuucagc

SEQ ID NO: 3756857 - RNA, 16 nt, Human
cugcccgucuucagcc

SEQ ID NO: 3756858 - RNA, 16 nt, Human
cugcccuacucacucu

SEQ ID NO: 3756859 - RNA, 15 nt, Human
cugcccuagagcaca

SEQ ID NO: 3756860 - RNA, 12 nt, Human
cugcccuaggcu

SEQ ID NO: 3756861 - RNA, 17 nt, Human
cugcccuaugggccugc

SEQ ID NO: 3756862 - RNA, 21 nt, Human
cugcccuaugggccugccggg

SEQ ID NO: 3756863 - RNA, 13 nt, Human
cugcccucaggga

SEQ ID NO: 3756864 - RNA, 12 nt, Human
cugcccucaugg

SEQ ID NO: 3756865 - RNA, 20 nt, Human
cugcccucauuacugggccu

SEQ ID NO: 3756866 - RNA, 21 nt, Human
cugcccucauuacugggccuu

SEQ ID NO: 3756867 - RNA, 15 nt, Human
cugcccuccaucccg

SEQ ID NO: 3756868 - RNA, 10 nt, Human
cugcccuccc

SEQ ID NO: 3756869 - RNA, 22 nt, Human
cugcccuccccuccggacuggu

SEQ ID NO: 3756870 - RNA, 19 nt, Human
cugcccuccugugcucagc

SEQ ID NO: 3756871 - RNA, 18 nt, Human
cugcccucguggccagcc

SEQ ID NO: 3756872 - RNA, 20 nt, Human
cugcccucuagagccuucag

SEQ ID NO: 3756873 - RNA, 12 nt, Human
cugcccucuccu

SEQ ID NO: 3756874 - RNA, 12 nt, Human
cugcccugagaa

SEQ ID NO: 3756875 - RNA, 19 nt, Human
cugcccugagaagcugcuc

SEQ ID NO: 3756876 - RNA, 21 nt, Human
cugcccugagaagcugcucca

SEQ ID NO: 3756877 - RNA, 11 nt, Human
cugcccugcca

SEQ ID NO: 3756878 - RNA, 15 nt, Human
cugcccugccaccug

SEQ ID NO: 3756879 - RNA, 17 nt, Human
cugcccugccaccuguc

SEQ ID NO: 3756880 - RNA, 18 nt, Human
cugcccugccaccugucu

SEQ ID NO: 3756881 - RNA, 17 nt, Human
cugcgaucuucagagca

SEQ ID NO: 3756882 - RNA, 19 nt, Human
cugcgaucuucagagcagg

SEQ ID NO: 3756883 - RNA, 17 nt, Human
cugcgauuuugccugug

SEQ ID NO: 3756884 - RNA, 20 nt, Human
cugcgccacugcuccgugga

SEQ ID NO: 3756885 - RNA, 16 nt, Human
cugcgccaguccugcu

SEQ ID NO: 3756886 - RNA, 15 nt, Human
cugcgcccaccccgc

SEQ ID NO: 3756887 - RNA, 17 nt, Human
cugcgcccaccccgcuc

SEQ ID NO: 3756888 - RNA, 17 nt, Human
cugcgcccuuaccuucc

SEQ ID NO: 3756889 - RNA, 14 nt, Human
cugcgcccuucccc

SEQ ID NO: 3756890 - RNA, 12 nt, Human
cugcgccucagg

SEQ ID NO: 3756891 - RNA, 17 nt, Human
cugcgcucucuuugcaa

SEQ ID NO: 3756892 - RNA, 18 nt, Human
cugcgcucucuuugcaac

SEQ ID NO: 3756893 - RNA, 20 nt, Human
cugcggaaugaaccacaucu

SEQ ID NO: 3756894 - RNA, 21 nt, Human
cugcggaaugaaccacaucuu

SEQ ID NO: 3756895 - RNA, 20 nt, Human
cugcggagagaggccuuguc

SEQ ID NO: 3756896 - RNA, 20 nt, Human
cugcggagugaagaggggca

SEQ ID NO: 3756897 - RNA, 21 nt, Human
cugcggagugaagaggggcag

SEQ ID NO: 3756898 - RNA, 22 nt, Human
cugcggagugaagaggggcagc

SEQ ID NO: 3756899 - RNA, 15 nt, Human
cugcggaucucagcu

SEQ ID NO: 3756900 - RNA, 21 nt, Human
cugcggcacccuugcgcuuuu

SEQ ID NO: 3756901 - RNA, 18 nt, Human
cugcggcccaauccaagg

SEQ ID NO: 3756902 - RNA, 15 nt, Human
cugcggccugcugga

SEQ ID NO: 3756903 - RNA, 17 nt, Human
cugcggcguacaggcug

SEQ ID NO: 3756904 - RNA, 17 nt, Human
cugcggcugcugugugc

SEQ ID NO: 3756905 - RNA, 18 nt, Human
cugcgggaugguccuggg

SEQ ID NO: 3756906 - RNA, 22 nt, Human
cugcgggcuggguguggucucc

SEQ ID NO: 3756907 - RNA, 15 nt, Human
cugcggggcuuggcu

SEQ ID NO: 3756908 - RNA, 18 nt, Human
cugcgggggcagugcuca

SEQ ID NO: 3756909 - RNA, 23 nt, Human
cugcgggucacaggagggagggg

SEQ ID NO: 3756910 - RNA, 22 nt, Human
cugcgggugaacaaagcagcca

SEQ ID NO: 3756911 - RNA, 13 nt, Human
cugcggguggggc

SEQ ID NO: 3756912 - RNA, 15 nt, Human
cugcggucaaggcca

SEQ ID NO: 3756913 - RNA, 18 nt, Human
cugcgguccacccaggag

SEQ ID NO: 3756914 - RNA, 19 nt, Human
cugcgguccacccaggagc

SEQ ID NO: 3756915 - RNA, 19 nt, Human
cugcggugcuaucuccccc

SEQ ID NO: 3756916 - RNA, 14 nt, Human
cugcguccuccuca

SEQ ID NO: 3756917 - RNA, 13 nt, Human
cugcgucuauccu

SEQ ID NO: 3756918 - RNA, 16 nt, Human
cugcgucuggaggggc

SEQ ID NO: 3756919 - RNA, 23 nt, Human
cugcgucuggaggggccccugcu

SEQ ID NO: 3756920 - RNA, 17 nt, Human
cugcgucuuccgccccu

SEQ ID NO: 3756921 - RNA, 20 nt, Human
cugcgugccagucaagaaga

SEQ ID NO: 3756922 - RNA, 15 nt, Human
cugcguggcugaccc

SEQ ID NO: 3756923 - RNA, 20 nt, Human
cugcguggcugaccccccuc

SEQ ID NO: 3756924 - RNA, 18 nt, Human
cugcguggggacagggcu

SEQ ID NO: 3756925 - RNA, 20 nt, Human
cugcguggggacagggcucg

SEQ ID NO: 3756926 - RNA, 14 nt, Human
cugcgugggucaga

SEQ ID NO: 3756927 - RNA, 17 nt, Human
cugcguguucucagagg

SEQ ID NO: 3756928 - RNA, 18 nt, Human
cugcguugguccagagcg

SEQ ID NO: 3756929 - RNA, 12 nt, Human
cugcuaaauaaa

SEQ ID NO: 3756930 - RNA, 17 nt, Human
cugcuaaaucuccuauu

SEQ ID NO: 3756931 - RNA, 19 nt, Human
cugcuaaauugauguugau

SEQ ID NO: 3756932 - RNA, 18 nt, Human
cugcuaacggugcucagg

SEQ ID NO: 3756933 - RNA, 16 nt, Human
cugcuaaggucuugga

SEQ ID NO: 3756934 - RNA, 18 nt, Human
cugcuaaguauuucccag

SEQ ID NO: 3756935 - RNA, 16 nt, Human
cugcuaauauuuuccu

SEQ ID NO: 3756936 - RNA, 14 nt, Human
cugcuaaucuucag

SEQ ID NO: 3756937 - RNA, 16 nt, Human
cugcuaauuccccaga

SEQ ID NO: 3756938 - RNA, 23 nt, Human
cugcuaauucuuugcaaaaaucc

SEQ ID NO: 3756939 - RNA, 12 nt, Human
cugcuacaaaga

SEQ ID NO: 3756940 - RNA, 23 nt, Human
cugcuacaccuauuaucccagcu

SEQ ID NO: 3756941 - RNA, 12 nt, Human
cugcuacagcaa

SEQ ID NO: 3756942 - RNA, 15 nt, Human
cugcuacccuagaug

SEQ ID NO: 3756943 - RNA, 16 nt, Human
cugcuacccucccugc

SEQ ID NO: 3756944 - RNA, 20 nt, Human
cugcuacccucccugcuguc

SEQ ID NO: 3756945 - RNA, 12 nt, Human
cugcuaccucac

SEQ ID NO: 3756946 - RNA, 15 nt, Human
cugcuaccucacugg

SEQ ID NO: 3756947 - RNA, 20 nt, Human
cugcuacguuccuauuguca

SEQ ID NO: 3756948 - RNA, 22 nt, Human
cugcuacucuguuccuucacau

SEQ ID NO: 3756949 - RNA, 12 nt, Human
cugcuacugcca

SEQ ID NO: 3756950 - RNA, 15 nt, Human
cugcuacugccaacc

SEQ ID NO: 3756951 - RNA, 17 nt, Human
cugcuacuggcaaaagg

SEQ ID NO: 3756952 - RNA, 15 nt, Human
cugcuagaacauggu

SEQ ID NO: 3756953 - RNA, 13 nt, Human
cugcuagaacuuu

SEQ ID NO: 3756954 - RNA, 16 nt, Human
cugcuagagccagcaa

SEQ ID NO: 3756955 - RNA, 18 nt, Human
cugcuagcuagcucaacu

SEQ ID NO: 3756956 - RNA, 20 nt, Human
cugcuaggccagagcccacu

SEQ ID NO: 3756957 - RNA, 21 nt, Human
cugcuaggccagagcccacuc

SEQ ID NO: 3756958 - RNA, 15 nt, Human
cugcuaggcgagugc

SEQ ID NO: 3756959 - RNA, 22 nt, Human
cugcuaggcgagugccaggacu

SEQ ID NO: 3756960 - RNA, 22 nt, Human
cugcuaggugggccagccccuc

SEQ ID NO: 3756961 - RNA, 15 nt, Human
cugcuauagccuggg

SEQ ID NO: 3756962 - RNA, 18 nt, Human
gcagugguguggagaagc

SEQ ID NO: 3756963 - RNA, 19 nt, Human
gcagugugaggccagggca

SEQ ID NO: 3756964 - RNA, 13 nt, Human
gcagugugccccc

SEQ ID NO: 3756965 - RNA, 16 nt, Human
gcagugugucuccugc

SEQ ID NO: 3756966 - RNA, 20 nt, Human
gcagugugucuccugcaugc

SEQ ID NO: 3756967 - RNA, 21 nt, Human
gcaguguuccccaucuggguc

SEQ ID NO: 3756968 - RNA, 22 nt, Human
gcaguguucgcuuggcuccaug

SEQ ID NO: 3756969 - RNA, 15 nt, Human
gcaguguuuccuuuu

SEQ ID NO: 3756970 - RNA, 15 nt, Human
gcaguguuuugcaag

SEQ ID NO: 3756971 - RNA, 13 nt, Human
gcaguuacaaauu

SEQ ID NO: 3756972 - RNA, 20 nt, Human
gcaguuacaaauuauaaugu

SEQ ID NO: 3756973 - RNA, 13 nt, Human
gcaguuacaugca

SEQ ID NO: 3756974 - RNA, 14 nt, Human
gcaguuauagaaaa

SEQ ID NO: 3756975 - RNA, 11 nt, Human
gcaguuauauu

SEQ ID NO: 3756976 - RNA, 17 nt, Human
gcaguuaugugaccuca

SEQ ID NO: 3756977 - RNA, 17 nt, Human
gcaguucagagcugccc

SEQ ID NO: 3756978 - RNA, 18 nt, Human
gcaguucagagcugcccu

SEQ ID NO: 3756979 - RNA, 20 nt, Human
gcaguucagagcugcccucu

SEQ ID NO: 3756980 - RNA, 17 nt, Human
gcaguucagcaccaccc

SEQ ID NO: 3756981 - RNA, 22 nt, Human
gcaguucgcagccacccugagg

SEQ ID NO: 3756982 - RNA, 21 nt, Human
gcaguucuaguuugcauuccu

SEQ ID NO: 3756983 - RNA, 17 nt, Human
gcaguucugaagaagau

SEQ ID NO: 3756984 - RNA, 15 nt, Human
gcaguucugcaaaua

SEQ ID NO: 3756985 - RNA, 19 nt, Human
gcaguucugggugcucccu

SEQ ID NO: 3756986 - RNA, 16 nt, Human
gcaguucuuaacccag

SEQ ID NO: 3756987 - RNA, 22 nt, Human
gcaguugaaaagacuccaaaga

SEQ ID NO: 3756988 - RNA, 17 nt, Human
gcaguugacagcaggug

SEQ ID NO: 3756989 - RNA, 17 nt, Human
gcaguugagacaagaaa

SEQ ID NO: 3756990 - RNA, 21 nt, Human
gcaguugagaggacacucccg

SEQ ID NO: 3756991 - RNA, 23 nt, Human
gcaguugcccagccucuuucccu

SEQ ID NO: 3756992 - RNA, 22 nt, Human
gcaguuggccagagagccuggu

SEQ ID NO: 3756993 - RNA, 14 nt, Human
gcaguugucucugu

SEQ ID NO: 3756994 - RNA, 16 nt, Human
gcaguugucucuguuu

SEQ ID NO: 3756995 - RNA, 13 nt, Human
gcaguugugucag

SEQ ID NO: 3756996 - RNA, 22 nt, Human
gcaguuguugcccacagcugua

SEQ ID NO: 3756997 - RNA, 20 nt, Human
gcaguuuaucauucaagugu

SEQ ID NO: 3756998 - RNA, 20 nt, Human
gcaguuucuguccugcuggu

SEQ ID NO: 3756999 - RNA, 17 nt, Human
gcaguuucuucaucuca

SEQ ID NO: 3757000 - RNA, 11 nt, Human
gcaguuugaaa

SEQ ID NO: 3757001 - RNA, 17 nt, Human
gcaguuugaaauucuga

SEQ ID NO: 3757002 - RNA, 19 nt, Human
gcaguuugaaauucugaau

SEQ ID NO: 3757003 - RNA, 20 nt, Human
gcaguuuugacaucagccag

SEQ ID NO: 3757004 - RNA, 21 nt, Human
gcaguuuugacaucagccagc

SEQ ID NO: 3757005 - RNA, 21 nt, Human
gcaguuuuguuuuaaaacugg

SEQ ID NO: 3757006 - RNA, 23 nt, Human
gcaguuuuucaggagcgcaagau

SEQ ID NO: 3757007 - RNA, 17 nt, Human
gcaguuuuuuuuuucuu

SEQ ID NO: 3757008 - RNA, 23 nt, Human
gcaguuuuuuuuuucuugucuau

SEQ ID NO: 3757009 - RNA, 15 nt, Human
gcauaaaaauuagcc

SEQ ID NO: 3757010 - RNA, 11 nt, Human
gcauaaaacag

SEQ ID NO: 3757011 - RNA, 21 nt, Human
gcauaaaauucuuaaaauaua

SEQ ID NO: 3757012 - RNA, 12 nt, Human
gcauaaacuguu

SEQ ID NO: 3757013 - RNA, 14 nt, Human
gcauaaaggccuuu

SEQ ID NO: 3757014 - RNA, 19 nt, Human
gcauaacugacaaaucaag

SEQ ID NO: 3757015 - RNA, 22 nt, Human
gcauaacugacaaaucaaguuu

SEQ ID NO: 3757016 - RNA, 23 nt, Human
gcauaauucugaaguuauauuuc

SEQ ID NO: 3757017 - RNA, 17 nt, Human
gcauaauuuaaaaauau

SEQ ID NO: 3757018 - RNA, 19 nt, Human
gcauaauuuaaaaauauau

SEQ ID NO: 3757019 - RNA, 18 nt, Human
gcauacaaacaagcauau

SEQ ID NO: 3757020 - RNA, 20 nt, Human
gcauacaaguuucauucucc

SEQ ID NO: 3757021 - RNA, 11 nt, Human
gcauacacaca

SEQ ID NO: 3757022 - RNA, 14 nt, Human
gcauacacacacac

SEQ ID NO: 3757023 - RNA, 21 nt, Human
gcauacagaaauauaauaaaa

SEQ ID NO: 3757024 - RNA, 20 nt, Human
gcauaccuuuauugugaucu

SEQ ID NO: 3757025 - RNA, 15 nt, Human
gcauacguacacauu

SEQ ID NO: 3757026 - RNA, 17 nt, Human
gcauacguacacauuuu

SEQ ID NO: 3757027 - RNA, 16 nt, Human
gcauacuaauaaagua

SEQ ID NO: 3757028 - RNA, 22 nt, Human
gcauacugagccaaguauaauu

SEQ ID NO: 3757029 - RNA, 16 nt, Human
gcauagaacuggguaa

SEQ ID NO: 3757030 - RNA, 17 nt, Human
gcauagaacuggguaaa

SEQ ID NO: 3757031 - RNA, 19 nt, Human
gcauagaugcaggugagcc

SEQ ID NO: 3757032 - RNA, 20 nt, Human
gcauagcaguauauguuaau

SEQ ID NO: 3757033 - RNA, 15 nt, Human
gcauagcucuggggu

SEQ ID NO: 3757034 - RNA, 19 nt, Human
gcauaggaccuuuccacca

SEQ ID NO: 3757035 - RNA, 22 nt, Human
gcauaggccugcuuugucuccu

SEQ ID NO: 3757036 - RNA, 12 nt, Human
gcauaggccugg

SEQ ID NO: 3757037 - RNA, 16 nt, Human
gcauaggccugggugc

SEQ ID NO: 3757038 - RNA, 22 nt, Human
gcauaggccugggugcuggcug

SEQ ID NO: 3757039 - RNA, 23 nt, Human
gcauaggccugggugcuggcugc

SEQ ID NO: 3757040 - RNA, 17 nt, Human
gcauagguuuaauaauu

SEQ ID NO: 3757041 - RNA, 18 nt, Human
gcauaguucccauguuaa

SEQ ID NO: 3757042 - RNA, 22 nt, Human
gcauauaaaauggcaacaaacu

SEQ ID NO: 3757043 - RNA, 15 nt, Human
gcauauaacuuauau

SEQ ID NO: 3757044 - RNA, 16 nt, Human
gcauauagauuguccu

SEQ ID NO: 3757045 - RNA, 21 nt, Human
gcauauauuaaagcaucagga

SEQ ID NO: 3757046 - RNA, 16 nt, Human
gcauauauuuuuauau

SEQ ID NO: 3757047 - RNA, 20 nt, Human
gcauauauuuuuauauuuac

SEQ ID NO: 3757048 - RNA, 21 nt, Human
gcauaucagucucugagggcu

SEQ ID NO: 3757049 - RNA, 14 nt, Human
gcauaucugccuuu

SEQ ID NO: 3757050 - RNA, 18 nt, Human
gcauaucugccuuuauug

SEQ ID NO: 3757051 - RNA, 21 nt, Human
gcauaucugccuuuauugugu

SEQ ID NO: 3757052 - RNA, 16 nt, Human
gcauaugaaaggagag

SEQ ID NO: 3757053 - RNA, 20 nt, Human
gcauaugaaaggagagcauc

SEQ ID NO: 3757054 - RNA, 23 nt, Human
gcauaugaguaagggcacugacg

SEQ ID NO: 3757055 - RNA, 15 nt, Human
gcauauguguuggcu

SEQ ID NO: 3757056 - RNA, 18 nt, Human
gcauauguguuggcuugu

SEQ ID NO: 3757057 - RNA, 12 nt, Human
gcauauguugaa

SEQ ID NO: 3757058 - RNA, 14 nt, Human
gcauauguugaaua

SEQ ID NO: 3757059 - RNA, 17 nt, Human
gcauauguugaauacuu

SEQ ID NO: 3757060 - RNA, 23 nt, Human
gcauauuauuuuauguugcauag

SEQ ID NO: 3757061 - RNA, 20 nt, Human
gcauauuccuuucuaucauu

SEQ ID NO: 3757062 - RNA, 22 nt, Human
gcauauucuuuucugcaaaaua

SEQ ID NO: 3757063 - RNA, 22 nt, Human
gcauauugcauacuauuaaaca

SEQ ID NO: 3757064 - RNA, 18 nt, Human
gcauauuguacacuuuuu

SEQ ID NO: 3757065 - RNA, 19 nt, Human
gcauauuguacacuuuuuu

SEQ ID NO: 3757066 - RNA, 21 nt, Human
gcauauuguauuacuagaaga

SEQ ID NO: 3757067 - RNA, 14 nt, Human
gcauauuuuguaac

SEQ ID NO: 3757068 - RNA, 14 nt, Human
gcauauuuuucaca

SEQ ID NO: 3757069 - RNA, 20 nt, Human
gcauauuuuucacauaucua

SEQ ID NO: 3757070 - RNA, 16 nt, Human
gcaucaaaagacaauu

SEQ ID NO: 3757071 - RNA, 18 nt, Human
gcaucaaaagacaauucu

SEQ ID NO: 3757072 - RNA, 15 nt, Human
gcaucacagggcaga

SEQ ID NO: 3757073 - RNA, 17 nt, Human
gcaucacagggcagagc

SEQ ID NO: 3757074 - RNA, 21 nt, Human
gcaucacagggcagagccggg

SEQ ID NO: 3757075 - RNA, 14 nt, Human
gcaucaccucaggc

SEQ ID NO: 3757076 - RNA, 15 nt, Human
gcaucaccucuguaa

SEQ ID NO: 3757077 - RNA, 18 nt, Human
gcaucaccuuaggcaggg

SEQ ID NO: 3757078 - RNA, 23 nt, Human
gcaucagaaagggagggcucuga

SEQ ID NO: 3757079 - RNA, 12 nt, Human
gcaucagaaaug

SEQ ID NO: 3757080 - RNA, 21 nt, Human
gcaucagcuggcgucaugcaa

SEQ ID NO: 3757081 - RNA, 24 nt, Human
gcaucagggggaagaagcagagag

SEQ ID NO: 3757082 - RNA, 12 nt, Human
gcaucaggguua

SEQ ID NO: 3757083 - RNA, 23 nt, Human
gcaucaucaauaaaacaguuggc

SEQ ID NO: 3757084 - RNA, 15 nt, Human
gcaucaucucagcuc

SEQ ID NO: 3757085 - RNA, 19 nt, Human
gcaucaucuugaacauuaa

SEQ ID NO: 3757086 - RNA, 21 nt, Human
gcaucaucuugaacauuaauc

SEQ ID NO: 3757087 - RNA, 15 nt, Human
gcaucaugccucuga

SEQ ID NO: 3757088 - RNA, 17 nt, Human
gcaucauuauuuaugua

SEQ ID NO: 3757089 - RNA, 19 nt, Human
gcaucauuauuuauguauu

SEQ ID NO: 3757090 - RNA, 22 nt, Human
gcaucauuauuugcagagacag

SEQ ID NO: 3757091 - RNA, 16 nt, Human
gcaucauucucuaaua

SEQ ID NO: 3757092 - RNA, 14 nt, Human
gcaucauugcagau

SEQ ID NO: 3757093 - RNA, 15 nt, Human
gcaucauugcagaug

SEQ ID NO: 3757094 - RNA, 18 nt, Human
gcauccaaucucaaggaa

SEQ ID NO: 3757095 - RNA, 22 nt, Human
gcauccagagucccugccugga

SEQ ID NO: 3757096 - RNA, 11 nt, Human
gcauccagccu

SEQ ID NO: 3757097 - RNA, 14 nt, Human
gcauccaguaucuu

SEQ ID NO: 3757098 - RNA, 12 nt, Human
gcauccauacca

SEQ ID NO: 3757099 - RNA, 19 nt, Human
gcauccauaccagcucgca

SEQ ID NO: 3757100 - RNA, 11 nt, Human
gcauccauggg

SEQ ID NO: 3757101 - RNA, 21 nt, Human
gcauccauuccucagggacag

SEQ ID NO: 3757102 - RNA, 22 nt, Human
gcaucccagcaccugccuccuc

SEQ ID NO: 3757103 - RNA, 16 nt, Human
gcaucccaguggccuc

SEQ ID NO: 3757104 - RNA, 14 nt, Human
gcauccccugccuc

SEQ ID NO: 3757105 - RNA, 17 nt, Human
gcauccccugccuccau

SEQ ID NO: 3757106 - RNA, 19 nt, Human
gcauccccuuggcugugag

SEQ ID NO: 3757107 - RNA, 19 nt, Human
gcaucccggaggaaaucug

SEQ ID NO: 3757108 - RNA, 17 nt, Human
gcaucccugggccuugg

SEQ ID NO: 3757109 - RNA, 19 nt, Human
gcaucccugggccuugggc

SEQ ID NO: 3757110 - RNA, 17 nt, Human
gcaggcucacugccagg

SEQ ID NO: 3757111 - RNA, 23 nt, Human
gcaggcucacugccaggccagcc

SEQ ID NO: 3757112 - RNA, 22 nt, Human
gcaggcucccagggacaccugg

SEQ ID NO: 3757113 - RNA, 16 nt, Human
gcaggcuccccugagg

SEQ ID NO: 3757114 - RNA, 22 nt, Human
gcaggcucgggcuccccagccc

SEQ ID NO: 3757115 - RNA, 16 nt, Human
gcaggcucucaggcca

SEQ ID NO: 3757116 - RNA, 20 nt, Human
gcaggcucucaggccagcug

SEQ ID NO: 3757117 - RNA, 22 nt, Human
gcaggcucucaggccagcugcu

SEQ ID NO: 3757118 - RNA, 17 nt, Human
gcaggcugauuucuagg

SEQ ID NO: 3757119 - RNA, 17 nt, Human
gcaggcuggcagcucuc

SEQ ID NO: 3757120 - RNA, 18 nt, Human
gcaggcuggcagcucucc

SEQ ID NO: 3757121 - RNA, 14 nt, Human
gcaggcuggcccug

SEQ ID NO: 3757122 - RNA, 17 nt, Human
gcaggcuggccuaugug

SEQ ID NO: 3757123 - RNA, 15 nt, Human
gcaggcuggcuggcc

SEQ ID NO: 3757124 - RNA, 10 nt, Human
gcaggcuggg

SEQ ID NO: 3757125 - RNA, 13 nt, Human
gcaggcugggcca

SEQ ID NO: 3757126 - RNA, 18 nt, Human
gcaggcuuaauaaaaaug

SEQ ID NO: 3757127 - RNA, 23 nt, Human
gcaggcuuugccauugugaacca

SEQ ID NO: 3757128 - RNA, 15 nt, Human
gcagggaaggccuga

SEQ ID NO: 3757129 - RNA, 16 nt, Human
gcagggaaggccugac

SEQ ID NO: 3757130 - RNA, 15 nt, Human
gcagggacaaagagg

SEQ ID NO: 3757131 - RNA, 18 nt, Human
gcagggacacgggcagcc

SEQ ID NO: 3757132 - RNA, 22 nt, Human
gcagggagccgagaucacgcca

SEQ ID NO: 3757133 - RNA, 16 nt, Human
gcagggagcugggccc

SEQ ID NO: 3757134 - RNA, 16 nt, Human
gcagggagcugggcuu

SEQ ID NO: 3757135 - RNA, 10 nt, Human
gcagggaggg

SEQ ID NO: 3757136 - RNA, 18 nt, Human
gcagggagggcaguuuuc

SEQ ID NO: 3757137 - RNA, 16 nt, Human
gcagggagggcuucug

SEQ ID NO: 3757138 - RNA, 12 nt, Human
gcagggagggga

SEQ ID NO: 3757139 - RNA, 22 nt, Human
gcagggauguggguuccacaga

SEQ ID NO: 3757140 - RNA, 19 nt, Human
gcagggauuaaccucugca

SEQ ID NO: 3757141 - RNA, 13 nt, Human
gcagggcacaggg

SEQ ID NO: 3757142 - RNA, 13 nt, Human
gcagggcagcccc

SEQ ID NO: 3757143 - RNA, 12 nt, Human
gcagggcagccg

SEQ ID NO: 3757144 - RNA, 14 nt, Human
gcagggcaggacca

SEQ ID NO: 3757145 - RNA, 19 nt, Human
gcagggcaggaccagccca

SEQ ID NO: 3757146 - RNA, 13 nt, Human
gcagggcagucau

SEQ ID NO: 3757147 - RNA, 19 nt, Human
gcagggccaacccuucucc

SEQ ID NO: 3757148 - RNA, 22 nt, Human
gcagggccgcccgggcccagag

SEQ ID NO: 3757149 - RNA, 23 nt, Human
gcagggccgcccgggcccagagg

SEQ ID NO: 3757150 - RNA, 14 nt, Human
gcagggccggggaa

SEQ ID NO: 3757151 - RNA, 23 nt, Human
gcagggccggggaacuggccaag

SEQ ID NO: 3757152 - RNA, 20 nt, Human
gcagggccuagcugcuacaa

SEQ ID NO: 3757153 - RNA, 22 nt, Human
gcagggcuacccugagcugagg

SEQ ID NO: 3757154 - RNA, 23 nt, Human
gcagggcuacccugagcugaggc

SEQ ID NO: 3757155 - RNA, 13 nt, Human
gcagggcucagga

SEQ ID NO: 3757156 - RNA, 16 nt, Human
gcagggcucugcccca

SEQ ID NO: 3757157 - RNA, 21 nt, Human
gcagggcucugccccagaggc

SEQ ID NO: 3757158 - RNA, 15 nt, Human
gcagggcugugcuug

SEQ ID NO: 3757159 - RNA, 23 nt, Human
gcagggcugugcuugaaggcccu

SEQ ID NO: 3757160 - RNA, 17 nt, Human
gcagggcuuuaaaauuc

SEQ ID NO: 3757161 - RNA, 15 nt, Human
gcaggggaggccauc

SEQ ID NO: 3757162 - RNA, 21 nt, Human
gcaggggaggccaucuggaga

SEQ ID NO: 3757163 - RNA, 20 nt, Human
gcaggggcaaacaccugcug

SEQ ID NO: 3757164 - RNA, 19 nt, Human
gcaggggccgggggcaguc

SEQ ID NO: 3757165 - RNA, 13 nt, Human
gcaggggccugga

SEQ ID NO: 3757166 - RNA, 16 nt, Human
gcaggggccuggagau

SEQ ID NO: 3757167 - RNA, 20 nt, Human
gcaggggccuggagauccuc

SEQ ID NO: 3757168 - RNA, 17 nt, Human
gcaggggcuacaagagg

SEQ ID NO: 3757169 - RNA, 12 nt, Human
gcaggggcucug

SEQ ID NO: 3757170 - RNA, 13 nt, Human
gcaggggcucugg

SEQ ID NO: 3757171 - RNA, 17 nt, Human
gcaggggcucuggagag

SEQ ID NO: 3757172 - RNA, 19 nt, Human
gcaggggcucuggagagaa

SEQ ID NO: 3757173 - RNA, 22 nt, Human
gcaggggcucuggagagaaaca

SEQ ID NO: 3757174 - RNA, 15 nt, Human
gcaggggcugcagua

SEQ ID NO: 3757175 - RNA, 13 nt, Human
gcaggggcuuccu

SEQ ID NO: 3757176 - RNA, 18 nt, Human
gcaggggcuuccuggugc

SEQ ID NO: 3757177 - RNA, 22 nt, Human
gcaggggcuuccuggugcugga

SEQ ID NO: 3757178 - RNA, 17 nt, Human
gcagggggcugcugcug

SEQ ID NO: 3757179 - RNA, 22 nt, Human
gcagggggcugcugcugggcuc

SEQ ID NO: 3757180 - RNA, 17 nt, Human
gcaggggugggggugga

SEQ ID NO: 3757181 - RNA, 21 nt, Human
gcagggguggggguggaggcu

SEQ ID NO: 3757182 - RNA, 19 nt, Human
gcagggguuggggaaacag

SEQ ID NO: 3757183 - RNA, 17 nt, Human
gcagggucaggagaggg

SEQ ID NO: 3757184 - RNA, 21 nt, Human
gcagggucccauuucucacug

SEQ ID NO: 3757185 - RNA, 17 nt, Human
gcagggucucacucugu

SEQ ID NO: 3757186 - RNA, 21 nt, Human
gcagggucuguuuggacugca

SEQ ID NO: 3757187 - RNA, 22 nt, Human
gcagggugggcuuguggggccu

SEQ ID NO: 3757188 - RNA, 17 nt, Human
gcaggguggugcuggga

SEQ ID NO: 3757189 - RNA, 18 nt, Human
gcaggguggugcugggac

SEQ ID NO: 3757190 - RNA, 15 nt, Human
gcagguaaacaguuc

SEQ ID NO: 3757191 - RNA, 17 nt, Human
gcagguagaccugucuc

SEQ ID NO: 3757192 - RNA, 19 nt, Human
gcagguagccagggggacu

SEQ ID NO: 3757193 - RNA, 17 nt, Human
gcagguagccugcuggu

SEQ ID NO: 3757194 - RNA, 16 nt, Human
gcagguaggaauauua

SEQ ID NO: 3757195 - RNA, 20 nt, Human
gcagguaggaauauuauauu

SEQ ID NO: 3757196 - RNA, 22 nt, Human
gcagguaugaucggcaggacac

SEQ ID NO: 3757197 - RNA, 21 nt, Human
gcaggucacugaaacuucaag

SEQ ID NO: 3757198 - RNA, 22 nt, Human
gcagguccaggguuugaguuca

SEQ ID NO: 3757199 - RNA, 14 nt, Human
gcagguccccagac

SEQ ID NO: 3757200 - RNA, 11 nt, Human
gcaggucccua

SEQ ID NO: 3757201 - RNA, 20 nt, Human
gcaggucccuaauaaagcug

SEQ ID NO: 3757202 - RNA, 23 nt, Human
gcaggucccuaauaaagcugugu

SEQ ID NO: 3757203 - RNA, 19 nt, Human
gcaggucuugaacuccugg

SEQ ID NO: 3757204 - RNA, 14 nt, Human
gcaggucuuuaaau

SEQ ID NO: 3757205 - RNA, 16 nt, Human
gcaggugccuccaggu

SEQ ID NO: 3757206 - RNA, 18 nt, Human
gcaggugccuccaggugu

SEQ ID NO: 3757207 - RNA, 15 nt, Human
gcaggugcugcuacc

SEQ ID NO: 3757208 - RNA, 20 nt, Human
gcaggugcugcuacccuccc

SEQ ID NO: 3757209 - RNA, 22 nt, Human
gcaggugcugcuacccucccug

SEQ ID NO: 3757210 - RNA, 17 nt, Human
gcaggugcuggucccgg

SEQ ID NO: 3757211 - RNA, 16 nt, Human
gcaggugggagcuuga

SEQ ID NO: 3757212 - RNA, 21 nt, Human
gcagguggggagacugggcug

SEQ ID NO: 3757213 - RNA, 16 nt, Human
gcaggugguccugaga

SEQ ID NO: 3757214 - RNA, 20 nt, Human
gcagguggugucgggcccuu

SEQ ID NO: 3757215 - RNA, 22 nt, Human
gcaggugucauauauggggggc

SEQ ID NO: 3757216 - RNA, 16 nt, Human
gcagguuagaaccuag

SEQ ID NO: 3757217 - RNA, 15 nt, Human
gcagguuagagaaaa

SEQ ID NO: 3757218 - RNA, 16 nt, Human
gcagguucccaagcuc

SEQ ID NO: 3757219 - RNA, 18 nt, Human
gcagguucccaagcucag

SEQ ID NO: 3757220 - RNA, 12 nt, Human
gcagguucccac

SEQ ID NO: 3757221 - RNA, 23 nt, Human
gcagguucccacuuaaaaauuaa

SEQ ID NO: 3757222 - RNA, 16 nt, Human
gcagguugaagccaug

SEQ ID NO: 3757223 - RNA, 21 nt, Human
gcagguugaggggcuccugga

SEQ ID NO: 3757224 - RNA, 22 nt, Human
gcagguugaggggcuccuggaa

SEQ ID NO: 3757225 - RNA, 16 nt, Human
gcagguugauaaauca

SEQ ID NO: 3757226 - RNA, 18 nt, Human
gcagguuggaccccagag

SEQ ID NO: 3757227 - RNA, 22 nt, Human
gcagguugggccauacuggccu

SEQ ID NO: 3757228 - RNA, 19 nt, Human
gcaguaaaaaaugguguuu

SEQ ID NO: 3757229 - RNA, 16 nt, Human
gcaguaaagagaaacu

SEQ ID NO: 3757230 - RNA, 17 nt, Human
gcaguaaagagaaacuu

SEQ ID NO: 3757231 - RNA, 15 nt, Human
gcaguaaauuugcua

SEQ ID NO: 3757232 - RNA, 13 nt, Human
gcaguaacuuggg

SEQ ID NO: 3757233 - RNA, 15 nt, Human
gcaguaagucuuuuu

SEQ ID NO: 3757234 - RNA, 13 nt, Human
gcaguaauaaaaa

SEQ ID NO: 3757235 - RNA, 23 nt, Human
gcaguaccuauaaaguaaagcua

SEQ ID NO: 3757236 - RNA, 21 nt, Human
gcaguacuaacauuuauuuga

SEQ ID NO: 3757237 - RNA, 20 nt, Human
gcaguagaaauaauaugcau

SEQ ID NO: 3757238 - RNA, 19 nt, Human
gcaguagacauuuuaacaa

SEQ ID NO: 3757239 - RNA, 20 nt, Human
gcaguauaaagaauaggacu

SEQ ID NO: 3757240 - RNA, 20 nt, Human
gcaguaucggcacuguacaa

SEQ ID NO: 3757241 - RNA, 23 nt, Human
gcaguauuuuguguccuccagga

SEQ ID NO: 3757242 - RNA, 17 nt, Human
gcagucacaucucuucc

SEQ ID NO: 3757243 - RNA, 24 nt, Human
gcagucacguggaggagcagugca

SEQ ID NO: 3757244 - RNA, 14 nt, Human
gcagucaucagaag

SEQ ID NO: 3757245 - RNA, 18 nt, Human
gcaguccacuucugacag

SEQ ID NO: 3757246 - RNA, 20 nt, Human
gcaguccacuucugacagcc

SEQ ID NO: 3757247 - RNA, 21 nt, Human
gcaguccacuucugacagccu

SEQ ID NO: 3757248 - RNA, 16 nt, Human
gcaguccaugcaugac

SEQ ID NO: 3757249 - RNA, 23 nt, Human
gcaguccccuucccuccaagaag

SEQ ID NO: 3757250 - RNA, 21 nt, Human
gcaguccguguggauccaaug

SEQ ID NO: 3757251 - RNA, 19 nt, Human
gcaguccugaucagagccg

SEQ ID NO: 3757252 - RNA, 15 nt, Human
gcaguccuuuguaaa

SEQ ID NO: 3757253 - RNA, 22 nt, Human
gcaguccuuuguaaacaguguu

SEQ ID NO: 3757254 - RNA, 21 nt, Human
gcagucgggggcuggccuagg

SEQ ID NO: 3757255 - RNA, 18 nt, Human
gcagucgucgcacagucu

SEQ ID NO: 3757256 - RNA, 22 nt, Human
gcagucgucgcacagucucucu

SEQ ID NO: 3757257 - RNA, 13 nt, Human
gcagucgugccug

SEQ ID NO: 3757258 - RNA, 15 nt, Human
gcauccgcaggugcu

SEQ ID NO: 3757259 - RNA, 16 nt, Human
gcauccgcaggugcug

SEQ ID NO: 3757260 - RNA, 20 nt, Human
gcauccgcaggugcuggucc

SEQ ID NO: 3757261 - RNA, 18 nt, Human
gcauccguaguucccuga

SEQ ID NO: 3757262 - RNA, 13 nt, Human
gcauccuaagaaa

SEQ ID NO: 3757263 - RNA, 20 nt, Human
gcauccucaguuccugcagc

SEQ ID NO: 3757264 - RNA, 14 nt, Human
gcauccuccaagaa

SEQ ID NO: 3757265 - RNA, 18 nt, Human
gcauccuccacaauagca

SEQ ID NO: 3757266 - RNA, 13 nt, Human
gcauccuccagcc

SEQ ID NO: 3757267 - RNA, 17 nt, Human
gcauccuccagccccug

SEQ ID NO: 3757268 - RNA, 17 nt, Human
gcauccuccgccucccg

SEQ ID NO: 3757269 - RNA, 20 nt, Human
gcauccucuggagccagccg

SEQ ID NO: 3757270 - RNA, 13 nt, Human
gcauccuggcacc

SEQ ID NO: 3757271 - RNA, 22 nt, Human
gcauccuggcacccggccccug

SEQ ID NO: 3757272 - RNA, 16 nt, Human
gcauccuuccuauaac

SEQ ID NO: 3757273 - RNA, 19 nt, Human
gcauccuuccuauaacuug

SEQ ID NO: 3757274 - RNA, 23 nt, Human
gcauccuuccuauaacuugaugc

SEQ ID NO: 3757275 - RNA, 18 nt, Human
gcaucgcaccauucugac

SEQ ID NO: 3757276 - RNA, 15 nt, Human
gcaucggccuagggc

SEQ ID NO: 3757277 - RNA, 16 nt, Human
gcaucggccuagggcc

SEQ ID NO: 3757278 - RNA, 23 nt, Human
gcaucgucaugcacaguauuugu

SEQ ID NO: 3757279 - RNA, 13 nt, Human
gcaucguggagac

SEQ ID NO: 3757280 - RNA, 14 nt, Human
gcaucuaucucauc

SEQ ID NO: 3757281 - RNA, 18 nt, Human
gcaucuaucuggugauuu

SEQ ID NO: 3757282 - RNA, 12 nt, Human
gcaucucagccc

SEQ ID NO: 3757283 - RNA, 22 nt, Human
gcaucucagcucaucuucacug

SEQ ID NO: 3757284 - RNA, 17 nt, Human
gcaucuccaagcagcuu

SEQ ID NO: 3757285 - RNA, 19 nt, Human
gcaucuccaagcagcuuag

SEQ ID NO: 3757286 - RNA, 17 nt, Human
gcaucuccaccugcucc

SEQ ID NO: 3757287 - RNA, 20 nt, Human
gcaucuccaccugcucccag

SEQ ID NO: 3757288 - RNA, 16 nt, Human
gcaucuccaggaaggc

SEQ ID NO: 3757289 - RNA, 12 nt, Human
gcaucucccaga

SEQ ID NO: 3757290 - RNA, 14 nt, Human
gcaucuccugagga

SEQ ID NO: 3757291 - RNA, 16 nt, Human
gcaucuccugugcaug

SEQ ID NO: 3757292 - RNA, 22 nt, Human
gcaucucuaccuucuccccagc

SEQ ID NO: 3757293 - RNA, 23 nt, Human
gcaucucugggcuggaugagcuc

SEQ ID NO: 3757294 - RNA, 21 nt, Human
gcaucucugucccauucccug

SEQ ID NO: 3757295 - RNA, 22 nt, Human
gcaucucugucccauucccugg

SEQ ID NO: 3757296 - RNA, 23 nt, Human
gcaucucugucccauucccuggg

SEQ ID NO: 3757297 - RNA, 14 nt, Human
gcaucucuugaggc

SEQ ID NO: 3757298 - RNA, 16 nt, Human
gcaucucuugaggcca

SEQ ID NO: 3757299 - RNA, 20 nt, Human
gcaucucuugaggccaggag

SEQ ID NO: 3757300 - RNA, 20 nt, Human
gcaucugaaauaggaaacaa

SEQ ID NO: 3757301 - RNA, 17 nt, Human
gcaucugacacaaaaaa

SEQ ID NO: 3757302 - RNA, 17 nt, Human
gcaucugaccagcagcg

SEQ ID NO: 3757303 - RNA, 15 nt, Human
gcaucugagggggag

SEQ ID NO: 3757304 - RNA, 14 nt, Human
gcaucugccccucc

SEQ ID NO: 3757305 - RNA, 15 nt, Human
gcaucugccccuccc

SEQ ID NO: 3757306 - RNA, 15 nt, Human
gcaucuggagagaac

SEQ ID NO: 3757307 - RNA, 11 nt, Human
gcaucuggccu

SEQ ID NO: 3757308 - RNA, 15 nt, Human
gcaucuggccuggcc

SEQ ID NO: 3757309 - RNA, 17 nt, Human
gcaucuggccuggccag

SEQ ID NO: 3757310 - RNA, 12 nt, Human
gcaucuggccuu

SEQ ID NO: 3757311 - RNA, 16 nt, Human
gcaucugggauuccca

SEQ ID NO: 3757312 - RNA, 20 nt, Human
gcaucuggggcccauacugg

SEQ ID NO: 3757313 - RNA, 16 nt, Human
gcaucuuacugaaggu

SEQ ID NO: 3757314 - RNA, 17 nt, Human
gcaucuucucacucccu

SEQ ID NO: 3757315 - RNA, 14 nt, Human
gcaucuucuccauc

SEQ ID NO: 3757316 - RNA, 20 nt, Human
gcaucuucuggagucuccag

SEQ ID NO: 3757317 - RNA, 23 nt, Human
gcaucuucuggagucuccagugg

SEQ ID NO: 3757318 - RNA, 16 nt, Human
gcaucuugccuccagg

SEQ ID NO: 3757319 - RNA, 19 nt, Human
gcaucuugccuccaggugc

SEQ ID NO: 3757320 - RNA, 20 nt, Human
gcaucuuuagugcuuucuug

SEQ ID NO: 3757321 - RNA, 20 nt, Human
gcaucuuugaauacaaagaa

SEQ ID NO: 3757322 - RNA, 15 nt, Human
gcaucuuugccuugg

SEQ ID NO: 3757323 - RNA, 22 nt, Human
gcaucuuugccuugggcugcuc

SEQ ID NO: 3757324 - RNA, 19 nt, Human
gcaucuuuuguauuaagaa

SEQ ID NO: 3757325 - RNA, 23 nt, Human
gcaucuuuuguauuaagaaagga

SEQ ID NO: 3757326 - RNA, 16 nt, Human
gcaugaaaauuguguu

SEQ ID NO: 3757327 - RNA, 16 nt, Human
gcaugaaaugaacaca

SEQ ID NO: 3757328 - RNA, 18 nt, Human
gcaugaaaugaacacaaa

SEQ ID NO: 3757329 - RNA, 19 nt, Human
gcaugaaaugaacacaaau

SEQ ID NO: 3757330 - RNA, 22 nt, Human
gcaugaaaugugaauuuuuauu

SEQ ID NO: 3757331 - RNA, 20 nt, Human
gcaugaacauguacuguucu

SEQ ID NO: 3757332 - RNA, 22 nt, Human
gcaugaagagaagcaauuuugg

SEQ ID NO: 3757333 - RNA, 21 nt, Human
gcaugaaguaauaugcacaca

SEQ ID NO: 3757334 - RNA, 17 nt, Human
gcaugaauuugugaagg

SEQ ID NO: 3757335 - RNA, 22 nt, Human
gcaugacacgaauauugcugau

SEQ ID NO: 3757336 - RNA, 17 nt, Human
gcaugacagaaaauaug

SEQ ID NO: 3757337 - RNA, 18 nt, Human
gcaugacagaaaauaugu

SEQ ID NO: 3757338 - RNA, 13 nt, Human
gcaugacagccuc

SEQ ID NO: 3757339 - RNA, 14 nt, Human
gcaugagaaauaca

SEQ ID NO: 3757340 - RNA, 17 nt, Human
gcaugagaaauacaaaa

SEQ ID NO: 3757341 - RNA, 21 nt, Human
gcaugagacucagugcagaug

SEQ ID NO: 3757342 - RNA, 20 nt, Human
gcaugagauagcugguguua

SEQ ID NO: 3757343 - RNA, 21 nt, Human
gcaugaggaacuagccaccaa

SEQ ID NO: 3757344 - RNA, 22 nt, Human
gcaugaggaacuagccaccaac

SEQ ID NO: 3757345 - RNA, 20 nt, Human
gcaugagggguuccuccccu

SEQ ID NO: 3757346 - RNA, 22 nt, Human
gcaugagggguuccuccccucc

SEQ ID NO: 3757347 - RNA, 23 nt, Human
gcaugagugcuggauauuuuacu

SEQ ID NO: 3757348 - RNA, 18 nt, Human
gcaugauccaagcaagac

SEQ ID NO: 3757349 - RNA, 20 nt, Human
gcaugauguuaaccagaaua

SEQ ID NO: 3757350 - RNA, 13 nt, Human
gcaugauguuugc

SEQ ID NO: 3757351 - RNA, 22 nt, Human
gcaugauguuugcccaaaauuu

SEQ ID NO: 3757352 - RNA, 16 nt, Human
gcaugcaaaugagcuc

SEQ ID NO: 3757353 - RNA, 14 nt, Human
gcaugcacagcugu

SEQ ID NO: 3757354 - RNA, 23 nt, Human
gcaugcacuguucccccugugca

SEQ ID NO: 3757355 - RNA, 15 nt, Human
gcaugcagcagcuug

SEQ ID NO: 3757356 - RNA, 17 nt, Human
gcaugcagcagcuugcu

SEQ ID NO: 3757357 - RNA, 12 nt, Human
gcaugcaguguu

SEQ ID NO: 3757358 - RNA, 15 nt, Human
gcaugcauuuugcag

SEQ ID NO: 3757359 - RNA, 20 nt, Human
gcaugccaacaagaaugcau

SEQ ID NO: 3757360 - RNA, 21 nt, Human
gcaugccaacaagaaugcauu

SEQ ID NO: 3757361 - RNA, 12 nt, Human
gcaugcccagag

SEQ ID NO: 3757362 - RNA, 19 nt, Human
gcaugcccagagacccagc

SEQ ID NO: 3757363 - RNA, 20 nt, Human
gcaugcccagagacccagcg

SEQ ID NO: 3757364 - RNA, 15 nt, Human
gcaugcccccucgug

SEQ ID NO: 3757365 - RNA, 17 nt, Human
gcaugccccggccaccu

SEQ ID NO: 3757366 - RNA, 22 nt, Human
gcaugccccggccaccucugcg

SEQ ID NO: 3757367 - RNA, 23 nt, Human
gcaugccccggccaccucugcgg

SEQ ID NO: 3757368 - RNA, 21 nt, Human
gcaugccucugauaugggacu

SEQ ID NO: 3757369 - RNA, 22 nt, Human
gcaugccugagagacauggcuu

SEQ ID NO: 3757370 - RNA, 13 nt, Human
gcaugccugugug

SEQ ID NO: 3757371 - RNA, 16 nt, Human
gcaugcggcccagccc

SEQ ID NO: 3757372 - RNA, 20 nt, Human
gcaugcggcccagcccggcu

SEQ ID NO: 3757373 - RNA, 15 nt, Human
gcaugcggcccagga

SEQ ID NO: 3757374 - RNA, 13 nt, Human
gcaugcucucugc

SEQ ID NO: 3757375 - RNA, 14 nt, Human
gcaugcucucugca

SEQ ID NO: 3757376 - RNA, 15 nt, Human
gcaugcugucccuua

SEQ ID NO: 3757377 - RNA, 16 nt, Human
gcaugcuucuucucaa

SEQ ID NO: 3757378 - RNA, 19 nt, Human
gcauggaaaucagccaagu

SEQ ID NO: 3757379 - RNA, 23 nt, Human
gcauggaaauucccuucaucugg

SEQ ID NO: 3757380 - RNA, 23 nt, Human
gcauggaaauuuaaagcagguuc

SEQ ID NO: 3757381 - RNA, 16 nt, Human
gcauggaacacuucga

SEQ ID NO: 3757382 - RNA, 21 nt, Human
gcauggacaauggaccggaga

SEQ ID NO: 3757383 - RNA, 18 nt, Human
gcauggagauagccccac

SEQ ID NO: 3757384 - RNA, 12 nt, Human
gcauggagcugg

SEQ ID NO: 3757385 - RNA, 20 nt, Human
gcauggaguguguauuguuc

SEQ ID NO: 3757386 - RNA, 24 nt, Human
gcauggaguguguauuguucccag

SEQ ID NO: 3757387 - RNA, 15 nt, Human
gcauggauuucuuug

SEQ ID NO: 3757388 - RNA, 18 nt, Human
gcauggauuucuuugaaa

SEQ ID NO: 3757389 - RNA, 21 nt, Human
gcauggcaccugucgcccagu

SEQ ID NO: 3757390 - RNA, 14 nt, Human
gcauggcagcccuc

SEQ ID NO: 3757391 - RNA, 18 nt, Human
gcauggcagggggcugcu

SEQ ID NO: 3757392 - RNA, 21 nt, Human
gcauggcauccuccagccccu

SEQ ID NO: 3757393 - RNA, 12 nt, Human
gcauggcccugg

SEQ ID NO: 3757394 - RNA, 15 nt, Human
gcauggcuauuuuau

SEQ ID NO: 3757395 - RNA, 14 nt, Human
gcauggcuccaguc

SEQ ID NO: 3757396 - RNA, 15 nt, Human
gcauggcuccagucu

SEQ ID NO: 3757397 - RNA, 15 nt, Human
gcaugggcacucccu

SEQ ID NO: 3757398 - RNA, 19 nt, Human
gcaugggcaguuucaguuu

SEQ ID NO: 3757399 - RNA, 14 nt, Human
gcaugggccaccac

SEQ ID NO: 3757400 - RNA, 17 nt, Human
gcaugggccagccccuc

SEQ ID NO: 3757401 - RNA, 15 nt, Human
gcauggggugggccu

SEQ ID NO: 3757402 - RNA, 19 nt, Human
gcauggggugggccucugg

SEQ ID NO: 3757403 - RNA, 21 nt, Human
gcaugggugaagggagagcca

SEQ ID NO: 3757404 - RNA, 15 nt, Human
gcauggguuuuguag

SEQ ID NO: 3757405 - RNA, 22 nt, Human
gcauggucaacccucaggggaa

SEQ ID NO: 3757406 - RNA, 15 nt, Human
gcauggucacacacu

SEQ ID NO: 3757407 - RNA, 18 nt, Human
cugcuauauauaaaacgg

SEQ ID NO: 3757408 - RNA, 19 nt, Human
cugcuauauuuucaugacu

SEQ ID NO: 3757409 - RNA, 17 nt, Human
cugcuaucaaagagguu

SEQ ID NO: 3757410 - RNA, 15 nt, Human
cugcuaucauuauuc

SEQ ID NO: 3757411 - RNA, 16 nt, Human
cugcuauccccaucuc

SEQ ID NO: 3757412 - RNA, 21 nt, Human
cugcuaugguuuucuccaaga

SEQ ID NO: 3757413 - RNA, 18 nt, Human
cugcuauuucccaagcug

SEQ ID NO: 3757414 - RNA, 19 nt, Human
cugcuauuucccaagcugg

SEQ ID NO: 3757415 - RNA, 21 nt, Human
cugcuauuucccaagcuggag

SEQ ID NO: 3757416 - RNA, 23 nt, Human
cugcuauuucccaagcuggagug

SEQ ID NO: 3757417 - RNA, 24 nt, Human
cugcuauuucccaagcuggagugc

SEQ ID NO: 3757418 - RNA, 14 nt, Human
cugcuauuugaagu

SEQ ID NO: 3757419 - RNA, 17 nt, Human
cugcuauuuuacugucu

SEQ ID NO: 3757420 - RNA, 19 nt, Human
cugcuauuuuccuguucua

SEQ ID NO: 3757421 - RNA, 17 nt, Human
cugcuauuuuucauccu

SEQ ID NO: 3757422 - RNA, 16 nt, Human
cugcucaacuugcaaa

SEQ ID NO: 3757423 - RNA, 16 nt, Human
cugcucacauaucugu

SEQ ID NO: 3757424 - RNA, 19 nt, Human
cugcucacuaccuccucag

SEQ ID NO: 3757425 - RNA, 20 nt, Human
cugcucacuaccuccucagg

SEQ ID NO: 3757426 - RNA, 18 nt, Human
cugcucacuuuaaaccug

SEQ ID NO: 3757427 - RNA, 22 nt, Human
cugcucagaacuugcugcuguc

SEQ ID NO: 3757428 - RNA, 21 nt, Human
cugcucagcccugcaccaugc

SEQ ID NO: 3757429 - RNA, 14 nt, Human
cugcucagcccugg

SEQ ID NO: 3757430 - RNA, 18 nt, Human
cugcucagcccuggaggu

SEQ ID NO: 3757431 - RNA, 21 nt, Human
cugcucagcccuggaggugcc

SEQ ID NO: 3757432 - RNA, 13 nt, Human
cugcucagcucug

SEQ ID NO: 3757433 - RNA, 16 nt, Human
cugcucagcucugggc

SEQ ID NO: 3757434 - RNA, 22 nt, Human
cugcucagcucugggccauucu

SEQ ID NO: 3757435 - RNA, 13 nt, Human
cugcucagcuucu

SEQ ID NO: 3757436 - RNA, 18 nt, Human
cugcucagcuucuccugu

SEQ ID NO: 3757437 - RNA, 17 nt, Human
cugcucaggaaacgaga

SEQ ID NO: 3757438 - RNA, 22 nt, Human
cugcucaggcugcagcuggaca

SEQ ID NO: 3757439 - RNA, 19 nt, Human
cugcucaguaaagcacuug

SEQ ID NO: 3757440 - RNA, 20 nt, Human
cugcucaguguuucauauuc

SEQ ID NO: 3757441 - RNA, 17 nt, Human
cugcucaucauucucug

SEQ ID NO: 3757442 - RNA, 19 nt, Human
cugcuccacagccauccca

SEQ ID NO: 3757443 - RNA, 14 nt, Human
cugcuccacagugu

SEQ ID NO: 3757444 - RNA, 11 nt, Human
cugcuccacca

SEQ ID NO: 3757445 - RNA, 11 nt, Human
cugcuccaccc

SEQ ID NO: 3757446 - RNA, 17 nt, Human
cugcuccacccuuggcc

SEQ ID NO: 3757447 - RNA, 19 nt, Human
cugcuccacccuuggccug

SEQ ID NO: 3757448 - RNA, 18 nt, Human
cugcuccagaauuuggaa

SEQ ID NO: 3757449 - RNA, 20 nt, Human
cugcuccagaauuuggaaau

SEQ ID NO: 3757450 - RNA, 14 nt, Human
cugcuccagacagg

SEQ ID NO: 3757451 - RNA, 21 nt, Human
cugcuccagaccugauccugg

SEQ ID NO: 3757452 - RNA, 22 nt, Human
cugcuccagaccugauccugga

SEQ ID NO: 3757453 - RNA, 19 nt, Human
cugcuccagcuguucagcu

SEQ ID NO: 3757454 - RNA, 20 nt, Human
cugcuccagcuguucagcug

SEQ ID NO: 3757455 - RNA, 12 nt, Human
cugcuccaggcc

SEQ ID NO: 3757456 - RNA, 15 nt, Human
cugcuccaggccugc

SEQ ID NO: 3757457 - RNA, 19 nt, Human
cugcuccaggccugcagca

SEQ ID NO: 3757458 - RNA, 22 nt, Human
cugcucccaaggggccugagca

SEQ ID NO: 3757459 - RNA, 15 nt, Human
cugcucccaccuggc

SEQ ID NO: 3757460 - RNA, 18 nt, Human
cugcucccaccuggcucu

SEQ ID NO: 3757461 - RNA, 14 nt, Human
cugcucccagcagc

SEQ ID NO: 3757462 - RNA, 15 nt, Human
cugcucccagcagcc

SEQ ID NO: 3757463 - RNA, 22 nt, Human
cugcucccagcagcccuaagga

SEQ ID NO: 3757464 - RNA, 16 nt, Human
cugcuccccagcccug

SEQ ID NO: 3757465 - RNA, 17 nt, Human
cugcuccccagcccugg

SEQ ID NO: 3757466 - RNA, 13 nt, Human
cugcuccccuccc

SEQ ID NO: 3757467 - RNA, 12 nt, Human
cugcucccucag

SEQ ID NO: 3757468 - RNA, 15 nt, Human
cugcucccugaagcc

SEQ ID NO: 3757469 - RNA, 16 nt, Human
cugcucccugaagcca

SEQ ID NO: 3757470 - RNA, 22 nt, Human
cugcucccugaagccagccuuc

SEQ ID NO: 3757471 - RNA, 14 nt, Human
cugcuccgcugcuc

SEQ ID NO: 3757472 - RNA, 21 nt, Human
cugcuccgcugcuccuuggcu

SEQ ID NO: 3757473 - RNA, 15 nt, Human
cugcuccuagaggga

SEQ ID NO: 3757474 - RNA, 14 nt, Human
cugcuccucauggu

SEQ ID NO: 3757475 - RNA, 12 nt, Human
cugcuccuccag

SEQ ID NO: 3757476 - RNA, 13 nt, Human
cugcuccuccagg

SEQ ID NO: 3757477 - RNA, 22 nt, Human
cugcuccuccagggccacgugc

SEQ ID NO: 3757478 - RNA, 24 nt, Human
cugcuccuccagggccacgugcca

SEQ ID NO: 3757479 - RNA, 15 nt, Human
cugcuccucccuggc

SEQ ID NO: 3757480 - RNA, 18 nt, Human
cugcuccucccuggcugc

SEQ ID NO: 3757481 - RNA, 19 nt, Human
cugcuccucccuggcugcc

SEQ ID NO: 3757482 - RNA, 21 nt, Human
cugcuccucccuggcugcccu

SEQ ID NO: 3757483 - RNA, 17 nt, Human
cugcuccucuccccagc

SEQ ID NO: 3757484 - RNA, 20 nt, Human
cugcuccucuccccagcaag

SEQ ID NO: 3757485 - RNA, 23 nt, Human
cugcuccucuccccagcaaguga

SEQ ID NO: 3757486 - RNA, 12 nt, Human
cugcuccugagc

SEQ ID NO: 3757487 - RNA, 13 nt, Human
cugcuccugagcc

SEQ ID NO: 3757488 - RNA, 20 nt, Human
cugcuccuggagccuuugaa

SEQ ID NO: 3757489 - RNA, 15 nt, Human
cugcuccuguggccu

SEQ ID NO: 3757490 - RNA, 18 nt, Human
cugcuccuuccuucaccu

SEQ ID NO: 3757491 - RNA, 13 nt, Human
cugcuccuuuccc

SEQ ID NO: 3757492 - RNA, 14 nt, Human
cugcuccuuucccc

SEQ ID NO: 3757493 - RNA, 15 nt, Human
cugcuccuuuccccu

SEQ ID NO: 3757494 - RNA, 19 nt, Human
cugcucgcccuccuuucug

SEQ ID NO: 3757495 - RNA, 16 nt, Human
cugcucgccuuagcac

SEQ ID NO: 3757496 - RNA, 17 nt, Human
cugcucgggcccaggcc

SEQ ID NO: 3757497 - RNA, 17 nt, Human
cugcucuaacagcccuc

SEQ ID NO: 3757498 - RNA, 17 nt, Human
cugcucuaagcacacgg

SEQ ID NO: 3757499 - RNA, 17 nt, Human
cugcucuagugggacag

SEQ ID NO: 3757500 - RNA, 23 nt, Human
cugcucuagugggacagcccaga

SEQ ID NO: 3757501 - RNA, 17 nt, Human
cugcucucauauaagac

SEQ ID NO: 3757502 - RNA, 19 nt, Human
cugcucuccgaccagacac

SEQ ID NO: 3757503 - RNA, 13 nt, Human
cugcucuccucuu

SEQ ID NO: 3757504 - RNA, 16 nt, Human
cugcucuccuuccugg

SEQ ID NO: 3757505 - RNA, 20 nt, Human
cugcucuccuuccuggagcc

SEQ ID NO: 3757506 - RNA, 14 nt, Human
cugcucucuaccca

SEQ ID NO: 3757507 - RNA, 22 nt, Human
cugcucugaauuaguccuugcu

SEQ ID NO: 3757508 - RNA, 13 nt, Human
cugcucugagaau

SEQ ID NO: 3757509 - RNA, 13 nt, Human
cugcucugcccag

SEQ ID NO: 3757510 - RNA, 17 nt, Human
cugcucugcccagagcu

SEQ ID NO: 3757511 - RNA, 18 nt, Human
cugcucugcccagagcug

SEQ ID NO: 3757512 - RNA, 21 nt, Human
cugcucugcccagagcugggu

SEQ ID NO: 3757513 - RNA, 17 nt, Human
cugcucugccccagcuu

SEQ ID NO: 3757514 - RNA, 22 nt, Human
cugcucugccccagcuugggca

SEQ ID NO: 3757515 - RNA, 22 nt, Human
cugcucugcgugucaccugugc

SEQ ID NO: 3757516 - RNA, 12 nt, Human
cugcucugcuga

SEQ ID NO: 3757517 - RNA, 18 nt, Human
cugcucuggaauuugcaa

SEQ ID NO: 3757518 - RNA, 16 nt, Human
cugcucuugaacuccu

SEQ ID NO: 3757519 - RNA, 19 nt, Human
cugcucuugaacuccugac

SEQ ID NO: 3757520 - RNA, 11 nt, Human
cugcucuugca

SEQ ID NO: 3757521 - RNA, 20 nt, Human
cugcucuuggcuggacccag

SEQ ID NO: 3757522 - RNA, 23 nt, Human
cugcucuuggcuggacccagcca

SEQ ID NO: 3757523 - RNA, 14 nt, Human
cugcucuuucucug

SEQ ID NO: 3757524 - RNA, 14 nt, Human
cugcucuuuggccu

SEQ ID NO: 3757525 - RNA, 23 nt, Human
cugcugaaaaccaucuggccugg

SEQ ID NO: 3757526 - RNA, 18 nt, Human
cugcugaaacaacaaaua

SEQ ID NO: 3757527 - RNA, 16 nt, Human
cugcugaagcugccug

SEQ ID NO: 3757528 - RNA, 17 nt, Human
cugcugaaggaauaaau

SEQ ID NO: 3757529 - RNA, 18 nt, Human
cugcugaaggaauaaauu

SEQ ID NO: 3757530 - RNA, 11 nt, Human
cugcugaaggc

SEQ ID NO: 3757531 - RNA, 12 nt, Human
cugcugaaggcu

SEQ ID NO: 3757532 - RNA, 14 nt, Human
cugcugaaggcucg

SEQ ID NO: 3757533 - RNA, 18 nt, Human
cugcugaaggcucgagca

SEQ ID NO: 3757534 - RNA, 14 nt, Human
cugcugaauuuuca

SEQ ID NO: 3757535 - RNA, 23 nt, Human
cugcugaauuuucacaugaacau

SEQ ID NO: 3757536 - RNA, 21 nt, Human
cugcugacagacacaggcccg

SEQ ID NO: 3757537 - RNA, 23 nt, Human
cugcugacagacacaggcccggc

SEQ ID NO: 3757538 - RNA, 13 nt, Human
cugcugacagugu

SEQ ID NO: 3757539 - RNA, 23 nt, Human
cugcugaccaauugugcugccau

SEQ ID NO: 3757540 - RNA, 15 nt, Human
cugcugaccugugca

SEQ ID NO: 3757541 - RNA, 16 nt, Human
cugcugaccugugcac

SEQ ID NO: 3757542 - RNA, 16 nt, Human
cugcugagaaccuggc

SEQ ID NO: 3757543 - RNA, 20 nt, Human
cugcugagacugcugaguga

SEQ ID NO: 3757544 - RNA, 21 nt, Human
cugcugagcucugagaggccc

SEQ ID NO: 3757545 - RNA, 22 nt, Human
cugcugagcucugagaggcccu

SEQ ID NO: 3757546 - RNA, 13 nt, Human
cugcugagggucc

SEQ ID NO: 3757547 - RNA, 19 nt, Human
cugcugagucccaggcuga

SEQ ID NO: 3757548 - RNA, 21 nt, Human
cugcugaguccgaccuggccu

SEQ ID NO: 3757549 - RNA, 20 nt, Human
cugcugauaauguauaugaa

SEQ ID NO: 3757550 - RNA, 17 nt, Human
cugcugaucgccuuccc

SEQ ID NO: 3757551 - RNA, 18 nt, Human
cugcugaucgccuucccc

SEQ ID NO: 3757552 - RNA, 19 nt, Human
cugcugaucgccuucccca

SEQ ID NO: 3757553 - RNA, 22 nt, Human
cugcugauuuaaacacauuaaa

SEQ ID NO: 3757554 - RNA, 16 nt, Human
cugcugcaaggccuuu

SEQ ID NO: 3757555 - RNA, 19 nt, Human
cugcugcaaggccuuucug

SEQ ID NO: 3757556 - RNA, 20 nt, Human
gcagucuauauguuuguaua

SEQ ID NO: 3757557 - RNA, 23 nt, Human
gcagucuccucuuuaaaacaaaa

SEQ ID NO: 3757558 - RNA, 21 nt, Human
gcagucucuauaccaauaaag

SEQ ID NO: 3757559 - RNA, 17 nt, Human
gcagucugauccaggag

SEQ ID NO: 3757560 - RNA, 14 nt, Human
gcagucuggagggg

SEQ ID NO: 3757561 - RNA, 15 nt, Human
gcagucuggaggggc

SEQ ID NO: 3757562 - RNA, 17 nt, Human
gcagucuuaugcuucca

SEQ ID NO: 3757563 - RNA, 14 nt, Human
gcagugaacuauuu

SEQ ID NO: 3757564 - RNA, 20 nt, Human
gcagugaaugauucaguguu

SEQ ID NO: 3757565 - RNA, 14 nt, Human
gcagugaauuguga

SEQ ID NO: 3757566 - RNA, 18 nt, Human
gcagugacgugcaccugu

SEQ ID NO: 3757567 - RNA, 18 nt, Human
gcagugacuguggccaug

SEQ ID NO: 3757568 - RNA, 22 nt, Human
gcagugacuguggccauggucc

SEQ ID NO: 3757569 - RNA, 21 nt, Human
gcagugagaaaaagcuccugu

SEQ ID NO: 3757570 - RNA, 13 nt, Human
gcagugagacugg

SEQ ID NO: 3757571 - RNA, 14 nt, Human
gcagugagacuggg

SEQ ID NO: 3757572 - RNA, 13 nt, Human
gcagugagcagag

SEQ ID NO: 3757573 - RNA, 14 nt, Human
gcagugagcggaga

SEQ ID NO: 3757574 - RNA, 14 nt, Human
gcagugagcugaga

SEQ ID NO: 3757575 - RNA, 14 nt, Human
gcagugagcugugu

SEQ ID NO: 3757576 - RNA, 17 nt, Human
gcagugagugagccugg

SEQ ID NO: 3757577 - RNA, 19 nt, Human
gcagugagugagccuggcu

SEQ ID NO: 3757578 - RNA, 20 nt, Human
gcagugagugagccuggcuc

SEQ ID NO: 3757579 - RNA, 18 nt, Human
gcagugauauucuuuguu

SEQ ID NO: 3757580 - RNA, 22 nt, Human
gcagugauuaaggucucucuuu

SEQ ID NO: 3757581 - RNA, 22 nt, Human
gcagugcaagagacucuggccu

SEQ ID NO: 3757582 - RNA, 16 nt, Human
gcagugcaaggaggga

SEQ ID NO: 3757583 - RNA, 16 nt, Human
gcagugcagcaaccag

SEQ ID NO: 3757584 - RNA, 21 nt, Human
gcagugcagcaaccagagcac

SEQ ID NO: 3757585 - RNA, 23 nt, Human
gcagugcagcaaccagagcacug

SEQ ID NO: 3757586 - RNA, 18 nt, Human
gcagugcaggcacaguau

SEQ ID NO: 3757587 - RNA, 14 nt, Human
gcagugcccaggug

SEQ ID NO: 3757588 - RNA, 13 nt, Human
gcagugccucugg

SEQ ID NO: 3757589 - RNA, 22 nt, Human
gcagugcgcgugcacguggaga

SEQ ID NO: 3757590 - RNA, 19 nt, Human
gcagugcuagugagcuggg

SEQ ID NO: 3757591 - RNA, 22 nt, Human
gcagugcuagugagcugggcau

SEQ ID NO: 3757592 - RNA, 16 nt, Human
gcagugcuucucuaca

SEQ ID NO: 3757593 - RNA, 16 nt, Human
gcagugcuuggcccag

SEQ ID NO: 3757594 - RNA, 19 nt, Human
gcagugcuuggcccaggag

SEQ ID NO: 3757595 - RNA, 13 nt, Human
gcagugcuuuugg

SEQ ID NO: 3757596 - RNA, 22 nt, Human
gcaguggacucagaaagccaac

SEQ ID NO: 3757597 - RNA, 16 nt, Human
gcaguggaggugcugc

SEQ ID NO: 3757598 - RNA, 23 nt, Human
gcaguggaggugggguguuuggg

SEQ ID NO: 3757599 - RNA, 22 nt, Human
gcaguggcaggcagaggcccag

SEQ ID NO: 3757600 - RNA, 18 nt, Human
gcaguggcgcgaucucag

SEQ ID NO: 3757601 - RNA, 22 nt, Human
gcaguggcgugaucucagcuca

SEQ ID NO: 3757602 - RNA, 14 nt, Human
gcaguggcuggucc

SEQ ID NO: 3757603 - RNA, 15 nt, Human
gcaguggcuggucca

SEQ ID NO: 3757604 - RNA, 11 nt, Human
gcagugggagc

SEQ ID NO: 3757605 - RNA, 13 nt, Human
gcagugggagcug

SEQ ID NO: 3757606 - RNA, 18 nt, Human
gcagugggaggguaccag

SEQ ID NO: 3757607 - RNA, 16 nt, Human
gcagugggccuggcca

SEQ ID NO: 3757608 - RNA, 17 nt, Human
gcagugggccuggccag

SEQ ID NO: 3757609 - RNA, 18 nt, Human
gcagugggcuccuggcag

SEQ ID NO: 3757610 - RNA, 18 nt, Human
gcagugggucccacuucc

SEQ ID NO: 3757611 - RNA, 23 nt, Human
gcagugggucccacuuccccucc

SEQ ID NO: 3757612 - RNA, 21 nt, Human
gcaguggugcgaucuggguuc

SEQ ID NO: 3757613 - RNA, 22 nt, Human
gcaguggugcgaucuggguuca

SEQ ID NO: 3757614 - RNA, 22 nt, Human
gcaguggugguuuucuguucuu

SEQ ID NO: 3757615 - RNA, 24 nt, Human
gcagugguuuuggcaaacgcuaaa

SEQ ID NO: 3757616 - RNA, 18 nt, Human
gcagugucaucagaagau

SEQ ID NO: 3757617 - RNA, 18 nt, Human
gcagugucuguguuuuga

SEQ ID NO: 3757618 - RNA, 16 nt, Human
gcagugucuuccauaa

SEQ ID NO: 3757619 - RNA, 17 nt, Human
gcaguguggccaggcug

SEQ ID NO: 3757620 - RNA, 14 nt, Human
gcaguguuuccuuu

SEQ ID NO: 3757621 - RNA, 22 nt, Human
gcaguguuuugcaagugcugga

SEQ ID NO: 3757622 - RNA, 13 nt, Human
gcaguucaccaug

SEQ ID NO: 3757623 - RNA, 20 nt, Human
gcaguucccccaaccucaga

SEQ ID NO: 3757624 - RNA, 23 nt, Human
gcaguucccccaaccucagacuu

SEQ ID NO: 3757625 - RNA, 17 nt, Human
gcaguuccccuggaagc

SEQ ID NO: 3757626 - RNA, 23 nt, Human
gcaguuccggauuggcuugugug

SEQ ID NO: 3757627 - RNA, 16 nt, Human
gcaguucgaccagcca

SEQ ID NO: 3757628 - RNA, 16 nt, Human
gcaguucgcagccacc

SEQ ID NO: 3757629 - RNA, 18 nt, Human
gcaguucuacucaggcug

SEQ ID NO: 3757630 - RNA, 20 nt, Human
gcaguucuacucaggcuggu

SEQ ID NO: 3757631 - RNA, 16 nt, Human
gcaguucuaguuugca

SEQ ID NO: 3757632 - RNA, 15 nt, Human
gcaguucugaagaag

SEQ ID NO: 3757633 - RNA, 11 nt, Human
gcaguucuguu

SEQ ID NO: 3757634 - RNA, 12 nt, Human
gcaguucuguua

SEQ ID NO: 3757635 - RNA, 15 nt, Human
gcaguugaaaagacu

SEQ ID NO: 3757636 - RNA, 22 nt, Human
gcaguugaaugacaacagaagc

SEQ ID NO: 3757637 - RNA, 18 nt, Human
gcaguugaauuuuuauau

SEQ ID NO: 3757638 - RNA, 16 nt, Human
gcaguugcccagccuc

SEQ ID NO: 3757639 - RNA, 15 nt, Human
gcaguugucucuguu

SEQ ID NO: 3757640 - RNA, 18 nt, Human
gcaguuuauauuuaacuc

SEQ ID NO: 3757641 - RNA, 14 nt, Human
gcaguuuaucauuc

SEQ ID NO: 3757642 - RNA, 16 nt, Human
gcaguuuaucauucaa

SEQ ID NO: 3757643 - RNA, 12 nt, Human
gcaguuucaaua

SEQ ID NO: 3757644 - RNA, 20 nt, Human
gcaguuucaauaaaguuuga

SEQ ID NO: 3757645 - RNA, 16 nt, Human
gcaguuucuguccugc

SEQ ID NO: 3757646 - RNA, 14 nt, Human
gcaguuugaaauuc

SEQ ID NO: 3757647 - RNA, 18 nt, Human
gcaguuugaaauucugaa

SEQ ID NO: 3757648 - RNA, 13 nt, Human
gcaguuugcaaaa

SEQ ID NO: 3757649 - RNA, 14 nt, Human
gcaguuugggaggu

SEQ ID NO: 3757650 - RNA, 17 nt, Human
gcaguuugguauuugcg

SEQ ID NO: 3757651 - RNA, 20 nt, Human
gcaguuuuuuuuuucuuguc

SEQ ID NO: 3757652 - RNA, 15 nt, Human
gcauaaaauuggauu

SEQ ID NO: 3757653 - RNA, 14 nt, Human
gcauaaauaugcag

SEQ ID NO: 3757654 - RNA, 15 nt, Human
gcauaaauaugcagu

SEQ ID NO: 3757655 - RNA, 16 nt, Human
gcauaacaauuccucu

SEQ ID NO: 3757656 - RNA, 17 nt, Human
gcauaacaauuccucua

SEQ ID NO: 3757657 - RNA, 13 nt, Human
gcauaacauaaau

SEQ ID NO: 3757658 - RNA, 21 nt, Human
gcauaacauaaaucugugaac

SEQ ID NO: 3757659 - RNA, 23 nt, Human
gcauaacauaaaucugugaacuu

SEQ ID NO: 3757660 - RNA, 22 nt, Human
gcauaacguauaaaagccuguu

SEQ ID NO: 3757661 - RNA, 15 nt, Human
gcauaaguccucuag

SEQ ID NO: 3757662 - RNA, 20 nt, Human
gcauaauaaaugcuucagug

SEQ ID NO: 3757663 - RNA, 18 nt, Human
gcauaauaagcuaaagag

SEQ ID NO: 3757664 - RNA, 12 nt, Human
gcauacaaacaa

SEQ ID NO: 3757665 - RNA, 16 nt, Human
gcauaccacuuuuguu

SEQ ID NO: 3757666 - RNA, 20 nt, Human
gcauaccacuuuuguucuug

SEQ ID NO: 3757667 - RNA, 20 nt, Human
gcauacccacacaaauaaca

SEQ ID NO: 3757668 - RNA, 13 nt, Human
gcauaccuuuauu

SEQ ID NO: 3757669 - RNA, 18 nt, Human
gcauacguacacauuuua

SEQ ID NO: 3757670 - RNA, 13 nt, Human
gcauacuauuaaa

SEQ ID NO: 3757671 - RNA, 14 nt, Human
gcauacuauuaaac

SEQ ID NO: 3757672 - RNA, 23 nt, Human
gcauacugagccaaguauaauuu

SEQ ID NO: 3757673 - RNA, 22 nt, Human
gcauacugccuuguuuaauggu

SEQ ID NO: 3757674 - RNA, 13 nt, Human
gcauacuucaaaa

SEQ ID NO: 3757675 - RNA, 17 nt, Human
gcauacuucaaaaguau

SEQ ID NO: 3757676 - RNA, 18 nt, Human
gcauacuucaaaaguauu

SEQ ID NO: 3757677 - RNA, 21 nt, Human
gcauacuucaaaaguauuuuc

SEQ ID NO: 3757678 - RNA, 14 nt, Human
gcauacuuuguauu

SEQ ID NO: 3757679 - RNA, 18 nt, Human
gcauacuuuguauuuuga

SEQ ID NO: 3757680 - RNA, 22 nt, Human
gcauagagguaccagcaauaug

SEQ ID NO: 3757681 - RNA, 19 nt, Human
gcauagauaauauuguuug

SEQ ID NO: 3757682 - RNA, 16 nt, Human
gcauagaugcagguga

SEQ ID NO: 3757683 - RNA, 23 nt, Human
gcauagauguuuugguagauuaa

SEQ ID NO: 3757684 - RNA, 18 nt, Human
gcauagcccauguuaagu

SEQ ID NO: 3757685 - RNA, 18 nt, Human
gcauaggaguuuggagga

SEQ ID NO: 3757686 - RNA, 23 nt, Human
gcauaggccugcuuugucuccuc

SEQ ID NO: 3757687 - RNA, 19 nt, Human
gcauaggugauccauguaa

SEQ ID NO: 3757688 - RNA, 21 nt, Human
gcauaggugaucucauuuaau

SEQ ID NO: 3757689 - RNA, 17 nt, Human
gcauaguaaauguaguu

SEQ ID NO: 3757690 - RNA, 20 nt, Human
gcauaguaccaaucauuuua

SEQ ID NO: 3757691 - RNA, 22 nt, Human
gcauagucuacuuguuauaaau

SEQ ID NO: 3757692 - RNA, 18 nt, Human
gcauaguuguagacaaag

SEQ ID NO: 3757693 - RNA, 13 nt, Human
gcauaguuucuuu

SEQ ID NO: 3757694 - RNA, 12 nt, Human
gcauauaaaauu

SEQ ID NO: 3757695 - RNA, 23 nt, Human
gcauauaacuuauauuguaagaa

SEQ ID NO: 3757696 - RNA, 17 nt, Human
gcauauaaugaauaaau

SEQ ID NO: 3757697 - RNA, 11 nt, Human
gcauauauuuu

SEQ ID NO: 3757698 - RNA, 14 nt, Human
gcauauauuuuuau

SEQ ID NO: 3757699 - RNA, 18 nt, Human
gcauaucaugcuuugaaa

SEQ ID NO: 3757700 - RNA, 22 nt, Human
gcauaucugccuuuauuguguu

SEQ ID NO: 3757701 - RNA, 14 nt, Human
gcauaugacaaaug

SEQ ID NO: 3757702 - RNA, 18 nt, Human
gcauauguugaauacuuu

SEQ ID NO: 3757703 - RNA, 19 nt, Human
gcauauguugaauacuuuu

SEQ ID NO: 3757704 - RNA, 20 nt, Human
gcauauguugaauacuuuuu

SEQ ID NO: 3757705 - RNA, 20 nt, Human
gcauggucccacaucccugg

SEQ ID NO: 3757706 - RNA, 18 nt, Human
gcauggugccccaggacc

SEQ ID NO: 3757707 - RNA, 19 nt, Human
gcauggugccccaggacca

SEQ ID NO: 3757708 - RNA, 20 nt, Human
gcauggugccccaggaccag

SEQ ID NO: 3757709 - RNA, 23 nt, Human
gcauggugccccaggaccagcuc

SEQ ID NO: 3757710 - RNA, 15 nt, Human
gcaugguggccagag

SEQ ID NO: 3757711 - RNA, 13 nt, Human
gcauggugguugg

SEQ ID NO: 3757712 - RNA, 16 nt, Human
gcaugguuucagcacu

SEQ ID NO: 3757713 - RNA, 17 nt, Human
gcaugguuucagcacua

SEQ ID NO: 3757714 - RNA, 19 nt, Human
gcaugguuuugugccaucu

SEQ ID NO: 3757715 - RNA, 15 nt, Human
gcauguaaacacgcc

SEQ ID NO: 3757716 - RNA, 15 nt, Human
gcauguaaauguaaa

SEQ ID NO: 3757717 - RNA, 17 nt, Human
gcauguaacgcaaguuc

SEQ ID NO: 3757718 - RNA, 13 nt, Human
gcauguacagugu

SEQ ID NO: 3757719 - RNA, 18 nt, Human
gcauguagaggcuuguuu

SEQ ID NO: 3757720 - RNA, 14 nt, Human
gcauguaggagaau

SEQ ID NO: 3757721 - RNA, 13 nt, Human
gcauguaguaaca

SEQ ID NO: 3757722 - RNA, 21 nt, Human
gcauguaguaacacuaauaua

SEQ ID NO: 3757723 - RNA, 24 nt, Human
gcauguaguaacacuaauauauuu

SEQ ID NO: 3757724 - RNA, 17 nt, Human
gcauguauuggccugga

SEQ ID NO: 3757725 - RNA, 18 nt, Human
gcauguauuggccuggag

SEQ ID NO: 3757726 - RNA, 20 nt, Human
gcauguauugugucuuuugc

SEQ ID NO: 3757727 - RNA, 14 nt, Human
gcaugucaaacaug

SEQ ID NO: 3757728 - RNA, 21 nt, Human
gcaugucaaacaugagaugug

SEQ ID NO: 3757729 - RNA, 22 nt, Human
gcaugucccaugugagcugcug

SEQ ID NO: 3757730 - RNA, 19 nt, Human
gcauguccuguaaagguua

SEQ ID NO: 3757731 - RNA, 23 nt, Human
gcaugucgugaccaacuagacau

SEQ ID NO: 3757732 - RNA, 15 nt, Human
gcaugucuuuuaaaa

SEQ ID NO: 3757733 - RNA, 16 nt, Human
gcaugucuuuuuuucu

SEQ ID NO: 3757734 - RNA, 12 nt, Human
gcauguggccug

SEQ ID NO: 3757735 - RNA, 15 nt, Human
gcaugugggcuucaa

SEQ ID NO: 3757736 - RNA, 21 nt, Human
gcauguguauuuccagugcaa

SEQ ID NO: 3757737 - RNA, 18 nt, Human
gcaugugucaugcaugaa

SEQ ID NO: 3757738 - RNA, 11 nt, Human
gcaugugugug

SEQ ID NO: 3757739 - RNA, 13 nt, Human
gcaugugugugug

SEQ ID NO: 3757740 - RNA, 14 nt, Human
gcaugugugugugu

SEQ ID NO: 3757741 - RNA, 22 nt, Human
gcauguguuaaucuuaauguau

SEQ ID NO: 3757742 - RNA, 22 nt, Human
gcauguguuugguucuggggcc

SEQ ID NO: 3757743 - RNA, 13 nt, Human
gcauguuauguuu

SEQ ID NO: 3757744 - RNA, 19 nt, Human
gcauguuauguuuaauaag

SEQ ID NO: 3757745 - RNA, 14 nt, Human
gcauguucucugag

SEQ ID NO: 3757746 - RNA, 22 nt, Human
gcauguucucugaggacacuaa

SEQ ID NO: 3757747 - RNA, 20 nt, Human
gcauguugaccaugucuaug

SEQ ID NO: 3757748 - RNA, 16 nt, Human
gcauguuuagacuuua

SEQ ID NO: 3757749 - RNA, 15 nt, Human
gcauguuuccagcag

SEQ ID NO: 3757750 - RNA, 14 nt, Human
gcauguuugaaaug

SEQ ID NO: 3757751 - RNA, 18 nt, Human
gcauguuuuccagcuccu

SEQ ID NO: 3757752 - RNA, 19 nt, Human
gcauguuuuccagcuccuc

SEQ ID NO: 3757753 - RNA, 18 nt, Human
gcauguuuuguauacaaa

SEQ ID NO: 3757754 - RNA, 19 nt, Human
gcauuaaauauaauaugca

SEQ ID NO: 3757755 - RNA, 22 nt, Human
gcauuaaauucacaaacuuuua

SEQ ID NO: 3757756 - RNA, 20 nt, Human
gcauuaaauuuuaagguaga

SEQ ID NO: 3757757 - RNA, 13 nt, Human
gcauuaacacaaa

SEQ ID NO: 3757758 - RNA, 16 nt, Human
gcauuaacuucucugg

SEQ ID NO: 3757759 - RNA, 19 nt, Human
gcauuacagagaggagaaa

SEQ ID NO: 3757760 - RNA, 13 nt, Human
gcauuacauuccu

SEQ ID NO: 3757761 - RNA, 20 nt, Human
gcauuaccgcguuguaaaau

SEQ ID NO: 3757762 - RNA, 18 nt, Human
gcauuaccucuuuggaaa

SEQ ID NO: 3757763 - RNA, 17 nt, Human
gcauuacgugagccagg

SEQ ID NO: 3757764 - RNA, 24 nt, Human
gcauuacucuuguaagauuuugaa

SEQ ID NO: 3757765 - RNA, 14 nt, Human
gcauuacugcaugc

SEQ ID NO: 3757766 - RNA, 15 nt, Human
gcauuagaauuauuu

SEQ ID NO: 3757767 - RNA, 17 nt, Human
gcauuagaauuauuuaa

SEQ ID NO: 3757768 - RNA, 17 nt, Human
gcauuagcacagauuuu

SEQ ID NO: 3757769 - RNA, 18 nt, Human
gcauuagggaugccuccu

SEQ ID NO: 3757770 - RNA, 19 nt, Human
gcauuaucuagauacugua

SEQ ID NO: 3757771 - RNA, 24 nt, Human
gcauuaucuagauacuguaucaug

SEQ ID NO: 3757772 - RNA, 18 nt, Human
gcauuaugcaauuuuuau

SEQ ID NO: 3757773 - RNA, 20 nt, Human
gcauuaugcaauuuuuauau

SEQ ID NO: 3757774 - RNA, 19 nt, Human
gcauuauguccacugugua

SEQ ID NO: 3757775 - RNA, 18 nt, Human
gcauuauucauuuaguga

SEQ ID NO: 3757776 - RNA, 22 nt, Human
gcauuauucucuuuuaucuguu

SEQ ID NO: 3757777 - RNA, 15 nt, Human
gcauucacccagaca

SEQ ID NO: 3757778 - RNA, 16 nt, Human
gcauucagaagaaaaa

SEQ ID NO: 3757779 - RNA, 18 nt, Human
gcauucagaagaaaaaga

SEQ ID NO: 3757780 - RNA, 22 nt, Human
gcauucauuuuuauagcaacaa

SEQ ID NO: 3757781 - RNA, 18 nt, Human
gcauuccaacaaaggguu

SEQ ID NO: 3757782 - RNA, 12 nt, Human
gcauuccagccc

SEQ ID NO: 3757783 - RNA, 15 nt, Human
gcauuccccaggagg

SEQ ID NO: 3757784 - RNA, 17 nt, Human
gcauuccccaggaggcc

SEQ ID NO: 3757785 - RNA, 21 nt, Human
gcauuccccaggaggccagcc

SEQ ID NO: 3757786 - RNA, 22 nt, Human
gcauuccccaggaggccagccu

SEQ ID NO: 3757787 - RNA, 16 nt, Human
gcauuccuacaaagau

SEQ ID NO: 3757788 - RNA, 19 nt, Human
gcauuccuacaaagauguu

SEQ ID NO: 3757789 - RNA, 19 nt, Human
gcauuccugauaugauuua

SEQ ID NO: 3757790 - RNA, 19 nt, Human
gcauuccuucuuugauaau

SEQ ID NO: 3757791 - RNA, 22 nt, Human
gcauuccuucuuugauaauguu

SEQ ID NO: 3757792 - RNA, 13 nt, Human
gcauucucacucc

SEQ ID NO: 3757793 - RNA, 18 nt, Human
gcauucucacuccuaccu

SEQ ID NO: 3757794 - RNA, 20 nt, Human
gcauucucauuggaaauuua

SEQ ID NO: 3757795 - RNA, 22 nt, Human
gcauucugccgugugcccucgg

SEQ ID NO: 3757796 - RNA, 19 nt, Human
gcauucuggaccucugggu

SEQ ID NO: 3757797 - RNA, 15 nt, Human
gcauucuuauucauc

SEQ ID NO: 3757798 - RNA, 13 nt, Human
gcauucuucucug

SEQ ID NO: 3757799 - RNA, 21 nt, Human
gcauucuucugaucacugaaa

SEQ ID NO: 3757800 - RNA, 12 nt, Human
gcauugaacaca

SEQ ID NO: 3757801 - RNA, 16 nt, Human
gcauugaacacaaacu

SEQ ID NO: 3757802 - RNA, 18 nt, Human
gcauugaacacaaacugu

SEQ ID NO: 3757803 - RNA, 22 nt, Human
gcauugaacacaaacuguaaau

SEQ ID NO: 3757804 - RNA, 16 nt, Human
gcauugacaaaucugu

SEQ ID NO: 3757805 - RNA, 23 nt, Human
gcauugaccgcgacuaauuucaa

SEQ ID NO: 3757806 - RNA, 15 nt, Human
gcauugacuuucccc

SEQ ID NO: 3757807 - RNA, 12 nt, Human
gcauugagaacu

SEQ ID NO: 3757808 - RNA, 21 nt, Human
gcauugagaacugcauauguu

SEQ ID NO: 3757809 - RNA, 18 nt, Human
gcauugaggaagagucuu

SEQ ID NO: 3757810 - RNA, 16 nt, Human
gcauugauggggaagg

SEQ ID NO: 3757811 - RNA, 12 nt, Human
gcauugcauuua

SEQ ID NO: 3757812 - RNA, 20 nt, Human
gcauugccuggccuuccugu

SEQ ID NO: 3757813 - RNA, 15 nt, Human
gcauugcuagauaaa

SEQ ID NO: 3757814 - RNA, 16 nt, Human
gcauugcuagauaaaa

SEQ ID NO: 3757815 - RNA, 16 nt, Human
gcauugcuggacucug

SEQ ID NO: 3757816 - RNA, 13 nt, Human
gcauugcugguuc

SEQ ID NO: 3757817 - RNA, 12 nt, Human
gcauugcuuucc

SEQ ID NO: 3757818 - RNA, 13 nt, Human
gcauugcuuucgu

SEQ ID NO: 3757819 - RNA, 19 nt, Human
gcauuggaacuggaggcag

SEQ ID NO: 3757820 - RNA, 18 nt, Human
gcauuggauacagcagua

SEQ ID NO: 3757821 - RNA, 20 nt, Human
gcauuggcagcaggugcugc

SEQ ID NO: 3757822 - RNA, 21 nt, Human
gcauuggcagcaggugcugcu

SEQ ID NO: 3757823 - RNA, 10 nt, Human
gcauuguaaa

SEQ ID NO: 3757824 - RNA, 11 nt, Human
gcauuguaaau

SEQ ID NO: 3757825 - RNA, 22 nt, Human
gcauuguaagcguauggcuuua

SEQ ID NO: 3757826 - RNA, 15 nt, Human
gcauuguaucgaugu

SEQ ID NO: 3757827 - RNA, 18 nt, Human
gcauuguaucugucuuuc

SEQ ID NO: 3757828 - RNA, 19 nt, Human
gcauuguaucugucuuucc

SEQ ID NO: 3757829 - RNA, 17 nt, Human
gcauugucuauuuuucu

SEQ ID NO: 3757830 - RNA, 18 nt, Human
gcauugugaacugacagg

SEQ ID NO: 3757831 - RNA, 23 nt, Human
gcauugugaguaaaucagauguu

SEQ ID NO: 3757832 - RNA, 22 nt, Human
gcauugugauuggccuguagag

SEQ ID NO: 3757833 - RNA, 16 nt, Human
gcauuguggcugucag

SEQ ID NO: 3757834 - RNA, 19 nt, Human
gcauuguggcugucagcag

SEQ ID NO: 3757835 - RNA, 18 nt, Human
gcauugugggaaggggag

SEQ ID NO: 3757836 - RNA, 15 nt, Human
gcauuguugaggugg

SEQ ID NO: 3757837 - RNA, 23 nt, Human
gcauuguugagguggucugaaug

SEQ ID NO: 3757838 - RNA, 14 nt, Human
gcauuguuucugug

SEQ ID NO: 3757839 - RNA, 17 nt, Human
gcauuguuucugugggc

SEQ ID NO: 3757840 - RNA, 22 nt, Human
gcauuguuugcuuauuguucca

SEQ ID NO: 3757841 - RNA, 13 nt, Human
gcauuuaaaaaaa

SEQ ID NO: 3757842 - RNA, 15 nt, Human
gcauuuaaaagauac

SEQ ID NO: 3757843 - RNA, 16 nt, Human
gcauuuaaaagauaca

SEQ ID NO: 3757844 - RNA, 17 nt, Human
gcauuuaaaagauacag

SEQ ID NO: 3757845 - RNA, 18 nt, Human
gcauuuaaaagauacagu

SEQ ID NO: 3757846 - RNA, 22 nt, Human
gcauuuaaaagauacaguuacu

SEQ ID NO: 3757847 - RNA, 18 nt, Human
gcauuuacuuuguguuca

SEQ ID NO: 3757848 - RNA, 12 nt, Human
gcauuuagaugu

SEQ ID NO: 3757849 - RNA, 23 nt, Human
gcauuuagggaguauucuaauaa

SEQ ID NO: 3757850 - RNA, 17 nt, Human
gcauuuaucauucuugu

SEQ ID NO: 3757851 - RNA, 19 nt, Human
gcauuuauggucaacacuu

SEQ ID NO: 3757852 - RNA, 19 nt, Human
gcauuucacuugaguggag

SEQ ID NO: 3757853 - RNA, 16 nt, Human
gcauuucauaaacuaa

SEQ ID NO: 3757854 - RNA, 18 nt, Human
gcauauuauuuuauguug

SEQ ID NO: 3757855 - RNA, 17 nt, Human
gcauauucaggaagcuc

SEQ ID NO: 3757856 - RNA, 16 nt, Human
gcauauuccuuucuau

SEQ ID NO: 3757857 - RNA, 14 nt, Human
gcauauugacuuuu

SEQ ID NO: 3757858 - RNA, 19 nt, Human
gcauauugcuuuuucuaau

SEQ ID NO: 3757859 - RNA, 12 nt, Human
gcauauuguaca

SEQ ID NO: 3757860 - RNA, 16 nt, Human
gcauauuguacacuuu

SEQ ID NO: 3757861 - RNA, 23 nt, Human
gcauauuuauagcaauccauguu

SEQ ID NO: 3757862 - RNA, 21 nt, Human
gcauauuuauccaaaaugugu

SEQ ID NO: 3757863 - RNA, 23 nt, Human
gcauauuuauccaaaauguguau

SEQ ID NO: 3757864 - RNA, 19 nt, Human
gcauauuugcaaaguguau

SEQ ID NO: 3757865 - RNA, 15 nt, Human
gcauauuuuucacau

SEQ ID NO: 3757866 - RNA, 19 nt, Human
gcauauuuuucacauaucu

SEQ ID NO: 3757867 - RNA, 13 nt, Human
gcaucaaaagaca

SEQ ID NO: 3757868 - RNA, 17 nt, Human
gcaucaaaagacaauuc

SEQ ID NO: 3757869 - RNA, 19 nt, Human
gcaucaaaagacaauucuu

SEQ ID NO: 3757870 - RNA, 22 nt, Human
gcaucaaaagacaauucuuuau

SEQ ID NO: 3757871 - RNA, 23 nt, Human
gcaucaagaggugggagggcccu

SEQ ID NO: 3757872 - RNA, 17 nt, Human
gcaucaagaugugacau

SEQ ID NO: 3757873 - RNA, 12 nt, Human
gcaucaagccac

SEQ ID NO: 3757874 - RNA, 17 nt, Human
gcaucaccucaggccag

SEQ ID NO: 3757875 - RNA, 14 nt, Human
gcaucaccugccug

SEQ ID NO: 3757876 - RNA, 15 nt, Human
gcaucaccugccugu

SEQ ID NO: 3757877 - RNA, 22 nt, Human
gcaucaccuuaggcagggaagu

SEQ ID NO: 3757878 - RNA, 18 nt, Human
gcaucagaaagggagggc

SEQ ID NO: 3757879 - RNA, 19 nt, Human
gcaucagcugcucagaucc

SEQ ID NO: 3757880 - RNA, 12 nt, Human
gcaucaggccag

SEQ ID NO: 3757881 - RNA, 16 nt, Human
gcaucaggccaggccc

SEQ ID NO: 3757882 - RNA, 17 nt, Human
gcaucaggccaggcccu

SEQ ID NO: 3757883 - RNA, 18 nt, Human
gcaucaggccaggcccuc

SEQ ID NO: 3757884 - RNA, 23 nt, Human
gcaucaggccaggcccucugccc

SEQ ID NO: 3757885 - RNA, 21 nt, Human
gcaucagggggaagaagcaga

SEQ ID NO: 3757886 - RNA, 17 nt, Human
gcaucauaguaguuuuu

SEQ ID NO: 3757887 - RNA, 20 nt, Human
gcaucaucuguagauacuag

SEQ ID NO: 3757888 - RNA, 13 nt, Human
gcaucaugcaugu

SEQ ID NO: 3757889 - RNA, 14 nt, Human
gcaucaugccucug

SEQ ID NO: 3757890 - RNA, 13 nt, Human
gcaucauggcuau

SEQ ID NO: 3757891 - RNA, 11 nt, Human
gcaucauugca

SEQ ID NO: 3757892 - RNA, 19 nt, Human
gcauccaaucucaaggaau

SEQ ID NO: 3757893 - RNA, 15 nt, Human
gcauccaccuccuuc

SEQ ID NO: 3757894 - RNA, 17 nt, Human
gcauccaccuccuucuc

SEQ ID NO: 3757895 - RNA, 23 nt, Human
gcauccagagucccugccuggac

SEQ ID NO: 3757896 - RNA, 12 nt, Human
gcauccaggcac

SEQ ID NO: 3757897 - RNA, 17 nt, Human
gcauccaguaucuugaa

SEQ ID NO: 3757898 - RNA, 18 nt, Human
gcauccaguaucuugaag

SEQ ID NO: 3757899 - RNA, 15 nt, Human
gcauccaguuaacca

SEQ ID NO: 3757900 - RNA, 17 nt, Human
gcauccauaccagcucg

SEQ ID NO: 3757901 - RNA, 21 nt, Human
gcauccauggggucucucaca

SEQ ID NO: 3757902 - RNA, 12 nt, Human
gcauccauuccu

SEQ ID NO: 3757903 - RNA, 14 nt, Human
gcauccauuccuca

SEQ ID NO: 3757904 - RNA, 18 nt, Human
gcauccauuccucaggga

SEQ ID NO: 3757905 - RNA, 15 nt, Human
gcaucccagcaccug

SEQ ID NO: 3757906 - RNA, 20 nt, Human
gcaucccaggaugcugggug

SEQ ID NO: 3757907 - RNA, 15 nt, Human
gcaucccaguggccu

SEQ ID NO: 3757908 - RNA, 23 nt, Human
gcaucccaguggccucaacccuc

SEQ ID NO: 3757909 - RNA, 20 nt, Human
gcauccccuuggcugugagg

SEQ ID NO: 3757910 - RNA, 16 nt, Human
gcaucccggaggaaau

SEQ ID NO: 3757911 - RNA, 22 nt, Human
gcaucccggaggaaaucugcag

SEQ ID NO: 3757912 - RNA, 17 nt, Human
gcaucccugaggcugga

SEQ ID NO: 3757913 - RNA, 20 nt, Human
gcaucccugaggcuggacuc

SEQ ID NO: 3757914 - RNA, 12 nt, Human
gcaucccugggc

SEQ ID NO: 3757915 - RNA, 18 nt, Human
gcaucccugggccuuggg

SEQ ID NO: 3757916 - RNA, 14 nt, Human
gcauccgaccaggu

SEQ ID NO: 3757917 - RNA, 16 nt, Human
gcauccgaccagguug

SEQ ID NO: 3757918 - RNA, 19 nt, Human
gcauccguaguucccugaa

SEQ ID NO: 3757919 - RNA, 14 nt, Human
gcauccuaagaaau

SEQ ID NO: 3757920 - RNA, 21 nt, Human
gcauccuaagaaauaugugag

SEQ ID NO: 3757921 - RNA, 24 nt, Human
gcauccuaagaaauaugugagauu

SEQ ID NO: 3757922 - RNA, 15 nt, Human
gcauccucaguuccu

SEQ ID NO: 3757923 - RNA, 15 nt, Human
gcauccuccaagaau

SEQ ID NO: 3757924 - RNA, 16 nt, Human
gcauccucuggagcca

SEQ ID NO: 3757925 - RNA, 18 nt, Human
gcauccucuggagccagc

SEQ ID NO: 3757926 - RNA, 14 nt, Human
gcauccugagcccc

SEQ ID NO: 3757927 - RNA, 23 nt, Human
gcauccugccuuagagccaggca

SEQ ID NO: 3757928 - RNA, 23 nt, Human
gcauccuggcacccggccccugc

SEQ ID NO: 3757929 - RNA, 14 nt, Human
gcauccugugaagu

SEQ ID NO: 3757930 - RNA, 14 nt, Human
gcauccuuccuaua

SEQ ID NO: 3757931 - RNA, 20 nt, Human
gcauccuuuucugcagaggg

SEQ ID NO: 3757932 - RNA, 20 nt, Human
gcaucgcaccauucugacuc

SEQ ID NO: 3757933 - RNA, 20 nt, Human
gcaucggccuagggccccca

SEQ ID NO: 3757934 - RNA, 17 nt, Human
gcaucguccccuccccc

SEQ ID NO: 3757935 - RNA, 15 nt, Human
gcaucuaaacuuuaa

SEQ ID NO: 3757936 - RNA, 21 nt, Human
gcaucuagaggcuuccuucau

SEQ ID NO: 3757937 - RNA, 20 nt, Human
gcaucuagcaugucgucaaa

SEQ ID NO: 3757938 - RNA, 15 nt, Human
gcaucuaucugugcu

SEQ ID NO: 3757939 - RNA, 21 nt, Human
gcaucucacagcuaugcaaaa

SEQ ID NO: 3757940 - RNA, 12 nt, Human
gcaucucacucc

SEQ ID NO: 3757941 - RNA, 15 nt, Human
gcaucucagcccaca

SEQ ID NO: 3757942 - RNA, 20 nt, Human
gcaucuccaagcagcuuaga

SEQ ID NO: 3757943 - RNA, 13 nt, Human
gcaucucccagau

SEQ ID NO: 3757944 - RNA, 21 nt, Human
gcaucucccagauaaugugaa

SEQ ID NO: 3757945 - RNA, 17 nt, Human
gcaucucccucacugaa

SEQ ID NO: 3757946 - RNA, 23 nt, Human
gcaucuccugaggaucagaaagu

SEQ ID NO: 3757947 - RNA, 18 nt, Human
gcaucucuaccuucuccc

SEQ ID NO: 3757948 - RNA, 17 nt, Human
gcaucucuguacuuugc

SEQ ID NO: 3757949 - RNA, 17 nt, Human
gcaucucuugaggccag

SEQ ID NO: 3757950 - RNA, 18 nt, Human
gcaucucuugaggccagg

SEQ ID NO: 3757951 - RNA, 15 nt, Human
gcaucugaccagcag

SEQ ID NO: 3757952 - RNA, 20 nt, Human
gcaucugaccagcagcgccu

SEQ ID NO: 3757953 - RNA, 20 nt, Human
gcaucugauuugcauauuca

SEQ ID NO: 3757954 - RNA, 16 nt, Human
gcaucuggagagaaca

SEQ ID NO: 3757955 - RNA, 16 nt, Human
gcaucuggccuggcca

SEQ ID NO: 3757956 - RNA, 23 nt, Human
gcaucugggauucccaccaaggu

SEQ ID NO: 3757957 - RNA, 17 nt, Human
gcaucuggguagcugua

SEQ ID NO: 3757958 - RNA, 12 nt, Human
gcaucuguacaa

SEQ ID NO: 3757959 - RNA, 15 nt, Human
gcaucuguacaaagg

SEQ ID NO: 3757960 - RNA, 21 nt, Human
gcaucuguauaaguaagaaaa

SEQ ID NO: 3757961 - RNA, 22 nt, Human
gcaucuguauaaguaagaaaau

SEQ ID NO: 3757962 - RNA, 23 nt, Human
gcaucuguauaaguaagaaaaua

SEQ ID NO: 3757963 - RNA, 16 nt, Human
gcaucugucccccuuu

SEQ ID NO: 3757964 - RNA, 15 nt, Human
gcaucugugauggga

SEQ ID NO: 3757965 - RNA, 18 nt, Human
gcaucugugaugggagcg

SEQ ID NO: 3757966 - RNA, 13 nt, Human
gcaucuguucugg

SEQ ID NO: 3757967 - RNA, 22 nt, Human
gcaucuuauagcacuuugaaau

SEQ ID NO: 3757968 - RNA, 13 nt, Human
gcaucuuccagaa

SEQ ID NO: 3757969 - RNA, 17 nt, Human
gcaucuuccagaagugu

SEQ ID NO: 3757970 - RNA, 20 nt, Human
gcaucuucgucuucacucuu

SEQ ID NO: 3757971 - RNA, 23 nt, Human
gcaucuucgucuucacucuuagg

SEQ ID NO: 3757972 - RNA, 13 nt, Human
gcaucuucuccau

SEQ ID NO: 3757973 - RNA, 19 nt, Human
gcaucuucuggagucucca

SEQ ID NO: 3757974 - RNA, 17 nt, Human
gcaucuugccuccaggu

SEQ ID NO: 3757975 - RNA, 15 nt, Human
gcaucuugcuggcua

SEQ ID NO: 3757976 - RNA, 11 nt, Human
gcaucuuugau

SEQ ID NO: 3757977 - RNA, 17 nt, Human
gcaucuuugauguguug

SEQ ID NO: 3757978 - RNA, 13 nt, Human
gcaucuuugccuu

SEQ ID NO: 3757979 - RNA, 23 nt, Human
gcaucuuugccuugggcugcucc

SEQ ID NO: 3757980 - RNA, 23 nt, Human
gcaucuuuggggagguguucacu

SEQ ID NO: 3757981 - RNA, 12 nt, Human
gcaucuuuugua

SEQ ID NO: 3757982 - RNA, 16 nt, Human
gcaucuuuuguauuaa

SEQ ID NO: 3757983 - RNA, 18 nt, Human
gcaugaaaggcuuuuaaa

SEQ ID NO: 3757984 - RNA, 15 nt, Human
gcaugaaauuuuuaa

SEQ ID NO: 3757985 - RNA, 20 nt, Human
gcaugaagagcaaaaauauc

SEQ ID NO: 3757986 - RNA, 13 nt, Human
gcaugaagguuuc

SEQ ID NO: 3757987 - RNA, 16 nt, Human
gcaugacaagccccag

SEQ ID NO: 3757988 - RNA, 17 nt, Human
gcaugacaagccccagg

SEQ ID NO: 3757989 - RNA, 21 nt, Human
gcaugacaagccccaggcagg

SEQ ID NO: 3757990 - RNA, 20 nt, Human
gcaugacacgaauauugcug

SEQ ID NO: 3757991 - RNA, 21 nt, Human
gcaugacacgaauauugcuga

SEQ ID NO: 3757992 - RNA, 15 nt, Human
gcaugacagaaaaua

SEQ ID NO: 3757993 - RNA, 19 nt, Human
gcaugacagaaaauaugua

SEQ ID NO: 3757994 - RNA, 21 nt, Human
gcaugacagaaaauauguauu

SEQ ID NO: 3757995 - RNA, 15 nt, Human
gcaugacagccucua

SEQ ID NO: 3757996 - RNA, 14 nt, Human
gcaugacauuucuu

SEQ ID NO: 3757997 - RNA, 15 nt, Human
gcaugaccagaugcg

SEQ ID NO: 3757998 - RNA, 18 nt, Human
gcaugagacucagugcag

SEQ ID NO: 3757999 - RNA, 17 nt, Human
gcaugagggguuccucc

SEQ ID NO: 3758000 - RNA, 23 nt, Human
gcaugauagacacauaugagggg

SEQ ID NO: 3758001 - RNA, 22 nt, Human
gcaugauccaagcaagacugag

SEQ ID NO: 3758002 - RNA, 16 nt, Human
gcaugaucugaaaaau

SEQ ID NO: 3758003 - RNA, 22 nt, Human
gcauuucauucuucucuagcug

SEQ ID NO: 3758004 - RNA, 22 nt, Human
gcauuuccaacaccacagacac

SEQ ID NO: 3758005 - RNA, 18 nt, Human
gcauuuccugcuggucaa

SEQ ID NO: 3758006 - RNA, 13 nt, Human
gcauuucucuggg

SEQ ID NO: 3758007 - RNA, 13 nt, Human
gcauuucugaagu

SEQ ID NO: 3758008 - RNA, 21 nt, Human
gcauuucuugauguugcuuag

SEQ ID NO: 3758009 - RNA, 14 nt, Human
gcauuugaaaauuu

SEQ ID NO: 3758010 - RNA, 16 nt, Human
gcauuugaaaauuuug

SEQ ID NO: 3758011 - RNA, 12 nt, Human
gcauuugaaugc

SEQ ID NO: 3758012 - RNA, 16 nt, Human
gcauuugaaugcauuu

SEQ ID NO: 3758013 - RNA, 13 nt, Human
gcauuugagaaau

SEQ ID NO: 3758014 - RNA, 18 nt, Human
gcauuugaggucuguucu

SEQ ID NO: 3758015 - RNA, 13 nt, Human
gcauuugcugaau

SEQ ID NO: 3758016 - RNA, 14 nt, Human
gcauuugcugaaua

SEQ ID NO: 3758017 - RNA, 23 nt, Human
gcauuugcugaauacagaggcaa

SEQ ID NO: 3758018 - RNA, 23 nt, Human
gcauuuggauuggggucccucua

SEQ ID NO: 3758019 - RNA, 20 nt, Human
gcauuuggguaauuuagauu

SEQ ID NO: 3758020 - RNA, 17 nt, Human
gcauuuggguccaggag

SEQ ID NO: 3758021 - RNA, 18 nt, Human
gcauuuggguccaggagg

SEQ ID NO: 3758022 - RNA, 13 nt, Human
gcauuuguaaaua

SEQ ID NO: 3758023 - RNA, 18 nt, Human
gcauuuguaaauauuaaa

SEQ ID NO: 3758024 - RNA, 21 nt, Human
gcauuuguaaauauuaaacca

SEQ ID NO: 3758025 - RNA, 16 nt, Human
gcauuuguauuuugug

SEQ ID NO: 3758026 - RNA, 19 nt, Human
gcauuuguauuuuguguga

SEQ ID NO: 3758027 - RNA, 18 nt, Human
gcauuugucaaugacagu

SEQ ID NO: 3758028 - RNA, 23 nt, Human
gcauuugucuauucuccagcuga

SEQ ID NO: 3758029 - RNA, 13 nt, Human
gcauuuguguguu

SEQ ID NO: 3758030 - RNA, 23 nt, Human
gcauuuuaaacaaaauagaaagu

SEQ ID NO: 3758031 - RNA, 22 nt, Human
cuggagggcuagaaccuggaga

SEQ ID NO: 3758032 - RNA, 21 nt, Human
cuggaggggacgcugguagag

SEQ ID NO: 3758033 - RNA, 21 nt, Human
cuggaggggagcucugucugu

SEQ ID NO: 3758034 - RNA, 13 nt, Human
cuggaggggaggg

SEQ ID NO: 3758035 - RNA, 14 nt, Human
cuggaggggcaugg

SEQ ID NO: 3758036 - RNA, 16 nt, Human
cuggaggggccccugc

SEQ ID NO: 3758037 - RNA, 15 nt, Human
cuggagggggaaugg

SEQ ID NO: 3758038 - RNA, 20 nt, Human
cuggagguaaggccuuugag

SEQ ID NO: 3758039 - RNA, 22 nt, Human
cuggagguacgaaaagagggga

SEQ ID NO: 3758040 - RNA, 21 nt, Human
cuggaggucacauucaggaag

SEQ ID NO: 3758041 - RNA, 13 nt, Human
cuggaggugccag

SEQ ID NO: 3758042 - RNA, 23 nt, Human
cuggaggugccagcaaagcccca

SEQ ID NO: 3758043 - RNA, 14 nt, Human
cuggaggugggagc

SEQ ID NO: 3758044 - RNA, 14 nt, Human
gccaaccccugugg

SEQ ID NO: 3758045 - RNA, 15 nt, Human
gccaaccccugugga

SEQ ID NO: 3758046 - RNA, 22 nt, Human
gccaacccuucuccucuuguaa

SEQ ID NO: 3758047 - RNA, 15 nt, Human
gccaaccuauuuuga

SEQ ID NO: 3758048 - RNA, 16 nt, Human
gccaaccuauuuugaa

SEQ ID NO: 3758049 - RNA, 18 nt, Human
gccaaccuguaauaaaua

SEQ ID NO: 3758050 - RNA, 14 nt, Human
gccaacgacaaagc

SEQ ID NO: 3758051 - RNA, 23 nt, Human
gccaacgacaaagccaaacucug

SEQ ID NO: 3758052 - RNA, 17 nt, Human
gccaacuagccccuggg

SEQ ID NO: 3758053 - RNA, 18 nt, Human
gccaacuaugauuauuaa

SEQ ID NO: 3758054 - RNA, 19 nt, Human
gccaacuauggccugugga

SEQ ID NO: 3758055 - RNA, 17 nt, Human
gccaacugaucuguuau

SEQ ID NO: 3758056 - RNA, 15 nt, Human
gccaacuugagggcc

SEQ ID NO: 3758057 - RNA, 23 nt, Human
gccaacuugagggcccagagcag

SEQ ID NO: 3758058 - RNA, 15 nt, Human
gccaacuuguaaaua

SEQ ID NO: 3758059 - RNA, 20 nt, Human
gccaacuuguaaauacacca

SEQ ID NO: 3758060 - RNA, 18 nt, Human
gccaagaauauugcaaaa

SEQ ID NO: 3758061 - RNA, 13 nt, Human
gccaagacaaauc

SEQ ID NO: 3758062 - RNA, 22 nt, Human
gccaagacaaaucaacagaagc

SEQ ID NO: 3758063 - RNA, 23 nt, Human
gccaagacaaaucaacagaagca

SEQ ID NO: 3758064 - RNA, 21 nt, Human
gccaagacugcuguggccagg

SEQ ID NO: 3758065 - RNA, 23 nt, Human
gccaagacugcuguggccaggag

SEQ ID NO: 3758066 - RNA, 12 nt, Human
gccaagacuugg

SEQ ID NO: 3758067 - RNA, 18 nt, Human
gccaagacuuggcaacag

SEQ ID NO: 3758068 - RNA, 18 nt, Human
gccaagagaaacuuccua

SEQ ID NO: 3758069 - RNA, 22 nt, Human
gccaagagaaaggccugcacac

SEQ ID NO: 3758070 - RNA, 23 nt, Human
gccaagagaaaggccugcacaca

SEQ ID NO: 3758071 - RNA, 16 nt, Human
gccaagaggcugcagc

SEQ ID NO: 3758072 - RNA, 17 nt, Human
gccaagaggcugcagcc

SEQ ID NO: 3758073 - RNA, 21 nt, Human
gccaagagguuuggcuccugc

SEQ ID NO: 3758074 - RNA, 20 nt, Human
gccaagaguggccccaccug

SEQ ID NO: 3758075 - RNA, 22 nt, Human
gccaagcaccuagccucgcucu

SEQ ID NO: 3758076 - RNA, 23 nt, Human
gccaagcacugugcucagggcua

SEQ ID NO: 3758077 - RNA, 12 nt, Human
gccaagcagcca

SEQ ID NO: 3758078 - RNA, 22 nt, Human
gccaagcauuuaauguagccau

SEQ ID NO: 3758079 - RNA, 20 nt, Human
gccaagcucaggaccaggca

SEQ ID NO: 3758080 - RNA, 16 nt, Human
gccaagcuccaagccc

SEQ ID NO: 3758081 - RNA, 22 nt, Human
gccaagcuuguuaucagcuuuc

SEQ ID NO: 3758082 - RNA, 15 nt, Human
gccaagcuuuaaauu

SEQ ID NO: 3758083 - RNA, 13 nt, Human
gccaaggagcugc

SEQ ID NO: 3758084 - RNA, 14 nt, Human
gccaaggagcugcu

SEQ ID NO: 3758085 - RNA, 21 nt, Human
gccaaggagggugagugcaag

SEQ ID NO: 3758086 - RNA, 23 nt, Human
gccaaggaggguggaucaccuga

SEQ ID NO: 3758087 - RNA, 21 nt, Human
gccaaggagucacugagacca

SEQ ID NO: 3758088 - RNA, 15 nt, Human
gccaaggcagaggcc

SEQ ID NO: 3758089 - RNA, 21 nt, Human
gccaaggcagaggccugggcu

SEQ ID NO: 3758090 - RNA, 19 nt, Human
gccaaggccaaaggaagca

SEQ ID NO: 3758091 - RNA, 20 nt, Human
gccaaggccaaaggaagcac

SEQ ID NO: 3758092 - RNA, 24 nt, Human
gccaaggccaaaggaagcacaugc

SEQ ID NO: 3758093 - RNA, 21 nt, Human
gccaaggccagaguggccugg

SEQ ID NO: 3758094 - RNA, 15 nt, Human
gccaaggccuucucc

SEQ ID NO: 3758095 - RNA, 19 nt, Human
gccaaggcuggagugcagu

SEQ ID NO: 3758096 - RNA, 19 nt, Human
gccaagggaaccugugucc

SEQ ID NO: 3758097 - RNA, 21 nt, Human
gccaagggaugaaagagaagg

SEQ ID NO: 3758098 - RNA, 21 nt, Human
gccaagggccgacuaagagaa

SEQ ID NO: 3758099 - RNA, 16 nt, Human
gccaaggucugagcca

SEQ ID NO: 3758100 - RNA, 23 nt, Human
gccaaggugggaggauugcuuga

SEQ ID NO: 3758101 - RNA, 22 nt, Human
gccaaggugggcugagcccugg

SEQ ID NO: 3758102 - RNA, 13 nt, Human
gccaagguguccu

SEQ ID NO: 3758103 - RNA, 18 nt, Human
gccaaguggggugcuggg

SEQ ID NO: 3758104 - RNA, 19 nt, Human
gccaaguggggugcuggga

SEQ ID NO: 3758105 - RNA, 20 nt, Human
gccaaguggggugcugggag

SEQ ID NO: 3758106 - RNA, 23 nt, Human
gccaaguggggugcugggaggag

SEQ ID NO: 3758107 - RNA, 16 nt, Human
gccaaguuccucuaac

SEQ ID NO: 3758108 - RNA, 15 nt, Human
gccaaguuccucuag

SEQ ID NO: 3758109 - RNA, 12 nt, Human
gccaaguucuua

SEQ ID NO: 3758110 - RNA, 19 nt, Human
gccaauaaaccaaugaacg

SEQ ID NO: 3758111 - RNA, 22 nt, Human
gccaauaaaccaaugaacgaag

SEQ ID NO: 3758112 - RNA, 14 nt, Human
gccaauauccuaau

SEQ ID NO: 3758113 - RNA, 18 nt, Human
gccaauauccuaauaaaa

SEQ ID NO: 3758114 - RNA, 19 nt, Human
gccaauauccuaauaaaaa

SEQ ID NO: 3758115 - RNA, 17 nt, Human
gccaauauguauuguaa

SEQ ID NO: 3758116 - RNA, 22 nt, Human
gccaauauuaguaggauuuuug

SEQ ID NO: 3758117 - RNA, 13 nt, Human
gccaauccccucc

SEQ ID NO: 3758118 - RNA, 19 nt, Human
gccaauccccuccuugggc

SEQ ID NO: 3758119 - RNA, 16 nt, Human
gccaaugcacggccuc

SEQ ID NO: 3758120 - RNA, 21 nt, Human
gccaaugcuacaguaauaaau

SEQ ID NO: 3758121 - RNA, 13 nt, Human
gccaauggaaccu

SEQ ID NO: 3758122 - RNA, 17 nt, Human
gccaauggaaccuccuu

SEQ ID NO: 3758123 - RNA, 18 nt, Human
gccaauggaaccuccuuu

SEQ ID NO: 3758124 - RNA, 20 nt, Human
gccaauggaaccuccuuucu

SEQ ID NO: 3758125 - RNA, 22 nt, Human
gccaauguauugauaagagggc

SEQ ID NO: 3758126 - RNA, 16 nt, Human
gccaaugucuccuccc

SEQ ID NO: 3758127 - RNA, 14 nt, Human
gccaauuauguuaa

SEQ ID NO: 3758128 - RNA, 19 nt, Human
gccaauuauguuaaacuag

SEQ ID NO: 3758129 - RNA, 18 nt, Human
gccaauucagacaggcaa

SEQ ID NO: 3758130 - RNA, 20 nt, Human
gccaauuucaaguuccaagu

SEQ ID NO: 3758131 - RNA, 20 nt, Human
gccaauuucucuuaaguacu

SEQ ID NO: 3758132 - RNA, 12 nt, Human
gccaauuugcac

SEQ ID NO: 3758133 - RNA, 22 nt, Human
gccaauuuuucugcacugagca

SEQ ID NO: 3758134 - RNA, 15 nt, Human
gccacaaaaacaggu

SEQ ID NO: 3758135 - RNA, 15 nt, Human
gccacaaauaaaaug

SEQ ID NO: 3758136 - RNA, 22 nt, Human
gccacaagacccuugugguccc

SEQ ID NO: 3758137 - RNA, 18 nt, Human
gccacaaggacuuccugu

SEQ ID NO: 3758138 - RNA, 19 nt, Human
gccacaaggacuuccuguc

SEQ ID NO: 3758139 - RNA, 10 nt, Human
gccacacaca

SEQ ID NO: 3758140 - RNA, 14 nt, Human
gccacacacacaga

SEQ ID NO: 3758141 - RNA, 13 nt, Human
gccacacagaaac

SEQ ID NO: 3758142 - RNA, 14 nt, Human
gccacacagaccac

SEQ ID NO: 3758143 - RNA, 14 nt, Human
gccacacagcugcc

SEQ ID NO: 3758144 - RNA, 15 nt, Human
gccacacagcugccg

SEQ ID NO: 3758145 - RNA, 13 nt, Human
gccacaccaagcu

SEQ ID NO: 3758146 - RNA, 14 nt, Human
gccacaccaagcug

SEQ ID NO: 3758147 - RNA, 16 nt, Human
gccacaccaagcugug

SEQ ID NO: 3758148 - RNA, 19 nt, Human
gccacaccaagcugugcca

SEQ ID NO: 3758149 - RNA, 16 nt, Human
gccacaccaggauaga

SEQ ID NO: 3758150 - RNA, 13 nt, Human
gccacacccuccc

SEQ ID NO: 3758151 - RNA, 21 nt, Human
gccacacuauuaccaugagaa

SEQ ID NO: 3758152 - RNA, 19 nt, Human
gccacacucagcacaaggc

SEQ ID NO: 3758153 - RNA, 18 nt, Human
gccacacucuccaucacc

SEQ ID NO: 3758154 - RNA, 21 nt, Human
gccacacucuuucuccugcuu

SEQ ID NO: 3758155 - RNA, 15 nt, Human
gccacacugugacac

SEQ ID NO: 3758156 - RNA, 17 nt, Human
gccacacugugacacac

SEQ ID NO: 3758157 - RNA, 18 nt, Human
gccacacugugacacacu

SEQ ID NO: 3758158 - RNA, 22 nt, Human
gccacacuucaggcucuucucc

SEQ ID NO: 3758159 - RNA, 16 nt, Human
gccacacuucucagga

SEQ ID NO: 3758160 - RNA, 17 nt, Human
gccacacuucucaggac

SEQ ID NO: 3758161 - RNA, 23 nt, Human
gccacacuucucaggacacaggc

SEQ ID NO: 3758162 - RNA, 18 nt, Human
gccacacuugaaccuaau

SEQ ID NO: 3758163 - RNA, 22 nt, Human
gccacagaaaauucuucuccac

SEQ ID NO: 3758164 - RNA, 19 nt, Human
gccacagaagccaggagca

SEQ ID NO: 3758165 - RNA, 22 nt, Human
gccacagaguguagccaggucc

SEQ ID NO: 3758166 - RNA, 23 nt, Human
gccacagaguguagccagguccc

SEQ ID NO: 3758167 - RNA, 15 nt, Human
gccacagcagcauuu

SEQ ID NO: 3758168 - RNA, 20 nt, Human
gccacagcagccucugaagu

SEQ ID NO: 3758169 - RNA, 21 nt, Human
gccacagcccauccauaguaa

SEQ ID NO: 3758170 - RNA, 15 nt, Human
gccacagcccuguca

SEQ ID NO: 3758171 - RNA, 15 nt, Human
gccacagcuugggug

SEQ ID NO: 3758172 - RNA, 12 nt, Human
gccacagcuuuu

SEQ ID NO: 3758173 - RNA, 12 nt, Human
gccacaggacac

SEQ ID NO: 3758174 - RNA, 11 nt, Human
gccacaggacc

SEQ ID NO: 3758175 - RNA, 12 nt, Human
gccacaggccuc

SEQ ID NO: 3758176 - RNA, 14 nt, Human
gccacaggccuccc

SEQ ID NO: 3758177 - RNA, 22 nt, Human
gccacaggccucccuguuugaa

SEQ ID NO: 3758178 - RNA, 22 nt, Human
gccacaggccugagauuucauc

SEQ ID NO: 3758179 - RNA, 23 nt, Human
gccacaggccugagauuucaucu

SEQ ID NO: 3758180 - RNA, 18 nt, Human
gccacaguagucuugaug

SEQ ID NO: 3758181 - RNA, 15 nt, Human
gccacagugggauga

SEQ ID NO: 3758182 - RNA, 14 nt, Human
gccacaguuccccu

SEQ ID NO: 3758183 - RNA, 15 nt, Human
gccacaguuccccua

SEQ ID NO: 3758184 - RNA, 23 nt, Human
gccacauccacagucucccccac

SEQ ID NO: 3758185 - RNA, 16 nt, Human
gccacaugagucccag

SEQ ID NO: 3758186 - RNA, 21 nt, Human
gccacauggcuuccuccugcg

SEQ ID NO: 3758187 - RNA, 22 nt, Human
gccacauggcuuccuccugcgc

SEQ ID NO: 3758188 - RNA, 17 nt, Human
gccacauggggcugggc

SEQ ID NO: 3758189 - RNA, 16 nt, Human
gccacauugggcagcg

SEQ ID NO: 3758190 - RNA, 16 nt, Human
gccacauuugguucua

SEQ ID NO: 3758191 - RNA, 16 nt, Human
gccacauuuucagcca

SEQ ID NO: 3758192 - RNA, 16 nt, Human
gccagcagacauuguc

SEQ ID NO: 3758193 - RNA, 17 nt, Human
gccagcagacauuguca

SEQ ID NO: 3758194 - RNA, 13 nt, Human
gccagcagcaccu

SEQ ID NO: 3758195 - RNA, 19 nt, Human
gccagcagccagcucucag

SEQ ID NO: 3758196 - RNA, 17 nt, Human
gccagcaggcucucagg

SEQ ID NO: 3758197 - RNA, 21 nt, Human
gccagcaggcucucaggccag

SEQ ID NO: 3758198 - RNA, 19 nt, Human
gccagcaguucagagcugc

SEQ ID NO: 3758199 - RNA, 21 nt, Human
gccagcaguucagagcugccc

SEQ ID NO: 3758200 - RNA, 23 nt, Human
gccagcaguucagagcugcccuc

SEQ ID NO: 3758201 - RNA, 14 nt, Human
gccagcaucugggc

SEQ ID NO: 3758202 - RNA, 22 nt, Human
gccagccaagcuuuaaauuaug

SEQ ID NO: 3758203 - RNA, 13 nt, Human
gccagccagcagc

SEQ ID NO: 3758204 - RNA, 14 nt, Human
gccagccagcagcc

SEQ ID NO: 3758205 - RNA, 19 nt, Human
gccagccagcagccagcuc

SEQ ID NO: 3758206 - RNA, 15 nt, Human
gccagccagccacuc

SEQ ID NO: 3758207 - RNA, 16 nt, Human
gccagccagccacucu

SEQ ID NO: 3758208 - RNA, 13 nt, Human
gccagccaggcgg

SEQ ID NO: 3758209 - RNA, 21 nt, Human
gccagccaggcgggcucaagg

SEQ ID NO: 3758210 - RNA, 13 nt, Human
gccagccaugucu

SEQ ID NO: 3758211 - RNA, 13 nt, Human
gccagcccagccc

SEQ ID NO: 3758212 - RNA, 18 nt, Human
gccagcccauuugggcag

SEQ ID NO: 3758213 - RNA, 19 nt, Human
gccagcccauuugggcaga

SEQ ID NO: 3758214 - RNA, 22 nt, Human
gccagcccauuugggcagagag

SEQ ID NO: 3758215 - RNA, 22 nt, Human
gccagccccacacagcuacagc

SEQ ID NO: 3758216 - RNA, 17 nt, Human
gccagccccacagccca

SEQ ID NO: 3758217 - RNA, 17 nt, Human
gccagccccacccagga

SEQ ID NO: 3758218 - RNA, 18 nt, Human
gccagccccacccaggag

SEQ ID NO: 3758219 - RNA, 19 nt, Human
gccagccccacccaggagg

SEQ ID NO: 3758220 - RNA, 21 nt, Human
gccagccccggcccugggcuc

SEQ ID NO: 3758221 - RNA, 13 nt, Human
gccagccccucca

SEQ ID NO: 3758222 - RNA, 20 nt, Human
gccagccccucccaccacag

SEQ ID NO: 3758223 - RNA, 21 nt, Human
gccagccccucccaccacagc

SEQ ID NO: 3758224 - RNA, 14 nt, Human
gccagccccugcca

SEQ ID NO: 3758225 - RNA, 19 nt, Human
gccagccccuggccccagg

SEQ ID NO: 3758226 - RNA, 21 nt, Human
gccagcccggccgcuccacca

SEQ ID NO: 3758227 - RNA, 21 nt, Human
gccagcccucccuguccuccu

SEQ ID NO: 3758228 - RNA, 10 nt, Human
gccagcccug

SEQ ID NO: 3758229 - RNA, 15 nt, Human
gccagcccugccugg

SEQ ID NO: 3758230 - RNA, 20 nt, Human
gccagccgagauagccaagg

SEQ ID NO: 3758231 - RNA, 21 nt, Human
gccagccgagauagccaaggc

SEQ ID NO: 3758232 - RNA, 22 nt, Human
gccagccgagauagccaaggcc

SEQ ID NO: 3758233 - RNA, 19 nt, Human
gccagccgcgcaucagacu

SEQ ID NO: 3758234 - RNA, 17 nt, Human
gccagccgcucuccugc

SEQ ID NO: 3758235 - RNA, 18 nt, Human
gccagccgcucuccugcc

SEQ ID NO: 3758236 - RNA, 20 nt, Human
gccagccuccgagagggaga

SEQ ID NO: 3758237 - RNA, 13 nt, Human
gccagccugaggc

SEQ ID NO: 3758238 - RNA, 12 nt, Human
gccagccuggcc

SEQ ID NO: 3758239 - RNA, 15 nt, Human
gccagccuggccucc

SEQ ID NO: 3758240 - RNA, 19 nt, Human
gccagccuggccuccugcc

SEQ ID NO: 3758241 - RNA, 13 nt, Human
gccagccuggcug

SEQ ID NO: 3758242 - RNA, 17 nt, Human
gccagccuggcugggac

SEQ ID NO: 3758243 - RNA, 16 nt, Human
gccagccuggcuucug

SEQ ID NO: 3758244 - RNA, 20 nt, Human
gccagccuggcuucuggagc

SEQ ID NO: 3758245 - RNA, 22 nt, Human
gccagccuggcuucuggagccc

SEQ ID NO: 3758246 - RNA, 16 nt, Human
gccagccuggggccug

SEQ ID NO: 3758247 - RNA, 14 nt, Human
gccagccuggucca

SEQ ID NO: 3758248 - RNA, 12 nt, Human
gccagccuucuu

SEQ ID NO: 3758249 - RNA, 19 nt, Human
gccagccuucuuccauccc

SEQ ID NO: 3758250 - RNA, 21 nt, Human
gccagccuucuuccaucccag

SEQ ID NO: 3758251 - RNA, 18 nt, Human
gccagccuugagcccugg

SEQ ID NO: 3758252 - RNA, 19 nt, Human
gccagccuugagcccuggc

SEQ ID NO: 3758253 - RNA, 22 nt, Human
gccagccuugagcccuggcugu

SEQ ID NO: 3758254 - RNA, 14 nt, Human
gccagcgccucccu

SEQ ID NO: 3758255 - RNA, 18 nt, Human
gccagcgccucccuccac

SEQ ID NO: 3758256 - RNA, 21 nt, Human
gccagcgccucccuccacccc

SEQ ID NO: 3758257 - RNA, 19 nt, Human
gccagcgggaauggcagcu

SEQ ID NO: 3758258 - RNA, 13 nt, Human
gccagcguccucc

SEQ ID NO: 3758259 - RNA, 19 nt, Human
gccagcguccuccucugug

SEQ ID NO: 3758260 - RNA, 22 nt, Human
gccagcguccuccucugugacc

SEQ ID NO: 3758261 - RNA, 14 nt, Human
gccagcguggcgca

SEQ ID NO: 3758262 - RNA, 16 nt, Human
gccagcguggcgcagu

SEQ ID NO: 3758263 - RNA, 15 nt, Human
gccagcuaaggggug

SEQ ID NO: 3758264 - RNA, 22 nt, Human
gccagcuaagggguggggcugc

SEQ ID NO: 3758265 - RNA, 19 nt, Human
gccagcucacagugcugug

SEQ ID NO: 3758266 - RNA, 15 nt, Human
gccagcucucagcca

SEQ ID NO: 3758267 - RNA, 12 nt, Human
gccagcucuguu

SEQ ID NO: 3758268 - RNA, 13 nt, Human
gccagcucuguuc

SEQ ID NO: 3758269 - RNA, 22 nt, Human
gccagcucuguucuuccucagc

SEQ ID NO: 3758270 - RNA, 23 nt, Human
gccagcucuguucuuccucagcc

SEQ ID NO: 3758271 - RNA, 21 nt, Human
gccagcucuuccuagcuggag

SEQ ID NO: 3758272 - RNA, 14 nt, Human
gccagcugaugacu

SEQ ID NO: 3758273 - RNA, 19 nt, Human
gccagcugaugacucaaga

SEQ ID NO: 3758274 - RNA, 20 nt, Human
gccagcugcacugaugcugc

SEQ ID NO: 3758275 - RNA, 20 nt, Human
gccagcugcagcugggcugu

SEQ ID NO: 3758276 - RNA, 14 nt, Human
gccagcugcaucua

SEQ ID NO: 3758277 - RNA, 12 nt, Human
gccagcugcccc

SEQ ID NO: 3758278 - RNA, 17 nt, Human
gccagcugccccagcca

SEQ ID NO: 3758279 - RNA, 20 nt, Human
gccagcugcccuaugggccu

SEQ ID NO: 3758280 - RNA, 21 nt, Human
gccagcugcccuaugggccug

SEQ ID NO: 3758281 - RNA, 14 nt, Human
gccagcugccuagg

SEQ ID NO: 3758282 - RNA, 13 nt, Human
gccagcugcuccc

SEQ ID NO: 3758283 - RNA, 14 nt, Human
gccagcugcucccc

SEQ ID NO: 3758284 - RNA, 15 nt, Human
gccagcugcucccca

SEQ ID NO: 3758285 - RNA, 19 nt, Human
gccagcugcugagccgcag

SEQ ID NO: 3758286 - RNA, 20 nt, Human
gccagcugcugagccgcaga

SEQ ID NO: 3758287 - RNA, 15 nt, Human
gccagcugcuugggc

SEQ ID NO: 3758288 - RNA, 13 nt, Human
gccagcuggagaa

SEQ ID NO: 3758289 - RNA, 14 nt, Human
gccagcuggaggca

SEQ ID NO: 3758290 - RNA, 15 nt, Human
gccagcuggaggcag

SEQ ID NO: 3758291 - RNA, 17 nt, Human
gccagcuggcagcagag

SEQ ID NO: 3758292 - RNA, 14 nt, Human
gccagcuuguuuac

SEQ ID NO: 3758293 - RNA, 15 nt, Human
gccaggaaccugucc

SEQ ID NO: 3758294 - RNA, 22 nt, Human
gccaggaaccuguccuaaggaa

SEQ ID NO: 3758295 - RNA, 19 nt, Human
gccaggaagaucccccaga

SEQ ID NO: 3758296 - RNA, 11 nt, Human
gccaggaagcc

SEQ ID NO: 3758297 - RNA, 14 nt, Human
gccaggaagccagc

SEQ ID NO: 3758298 - RNA, 18 nt, Human
gccaggaaguagcacagg

SEQ ID NO: 3758299 - RNA, 22 nt, Human
gccaggaaguagcacaggcuga

SEQ ID NO: 3758300 - RNA, 18 nt, Human
gccaggaauuucccagga

SEQ ID NO: 3758301 - RNA, 19 nt, Human
gccaggaauuucccaggac

SEQ ID NO: 3758302 - RNA, 23 nt, Human
gccaggaauuucccaggacccug

SEQ ID NO: 3758303 - RNA, 15 nt, Human
gccaggacaggcccg

SEQ ID NO: 3758304 - RNA, 16 nt, Human
gccaggacagucagcu

SEQ ID NO: 3758305 - RNA, 15 nt, Human
gccaggacuccccag

SEQ ID NO: 3758306 - RNA, 17 nt, Human
gccaggacuccccaggc

SEQ ID NO: 3758307 - RNA, 13 nt, Human
gccaggacucugc

SEQ ID NO: 3758308 - RNA, 16 nt, Human
gccaggacucugcagc

SEQ ID NO: 3758309 - RNA, 15 nt, Human
gccaggacugagccc

SEQ ID NO: 3758310 - RNA, 17 nt, Human
gccaggacugagccccg

SEQ ID NO: 3758311 - RNA, 13 nt, Human
gccaggagaagcu

SEQ ID NO: 3758312 - RNA, 22 nt, Human
gccaggagaagcucagcugcau

SEQ ID NO: 3758313 - RNA, 13 nt, Human
gccaggagagcuu

SEQ ID NO: 3758314 - RNA, 20 nt, Human
gccaggagagcuuagggucu

SEQ ID NO: 3758315 - RNA, 21 nt, Human
gccaggagagcuuagggucuc

SEQ ID NO: 3758316 - RNA, 19 nt, Human
gccaggagcacggcucugu

SEQ ID NO: 3758317 - RNA, 16 nt, Human
gccaggaggacccagg

SEQ ID NO: 3758318 - RNA, 17 nt, Human
gccaggaggacccaggg

SEQ ID NO: 3758319 - RNA, 22 nt, Human
gccaggagggacaaaggagccu

SEQ ID NO: 3758320 - RNA, 17 nt, Human
gccaggaggugccacug

SEQ ID NO: 3758321 - RNA, 19 nt, Human
gccaggaucaugguguaau

SEQ ID NO: 3758322 - RNA, 19 nt, Human
gccaggcaacuucaguccu

SEQ ID NO: 3758323 - RNA, 23 nt, Human
gccaggcacacacugugcuuucu

SEQ ID NO: 3758324 - RNA, 12 nt, Human
gccaggcacagg

SEQ ID NO: 3758325 - RNA, 13 nt, Human
gccaggcacaggc

SEQ ID NO: 3758326 - RNA, 15 nt, Human
gccaggcacaggcag

SEQ ID NO: 3758327 - RNA, 16 nt, Human
gccaggcacaggcagg

SEQ ID NO: 3758328 - RNA, 14 nt, Human
gccaggcagaucug

SEQ ID NO: 3758329 - RNA, 21 nt, Human
gccaggcagaucugugcccca

SEQ ID NO: 3758330 - RNA, 23 nt, Human
gccaggcagaucugugccccaug

SEQ ID NO: 3758331 - RNA, 18 nt, Human
gccaggccacaagacccu

SEQ ID NO: 3758332 - RNA, 21 nt, Human
gccaggccacaagacccuugu

SEQ ID NO: 3758333 - RNA, 12 nt, Human
gccaggccagag

SEQ ID NO: 3758334 - RNA, 13 nt, Human
gccaggccagagg

SEQ ID NO: 3758335 - RNA, 12 nt, Human
gccaggccagcc

SEQ ID NO: 3758336 - RNA, 14 nt, Human
gccaggccagccuc

SEQ ID NO: 3758337 - RNA, 13 nt, Human
gccaggccagcug

SEQ ID NO: 3758338 - RNA, 13 nt, Human
gccaggccccagg

SEQ ID NO: 3758339 - RNA, 19 nt, Human
gccaggcccccaagccugc

SEQ ID NO: 3758340 - RNA, 19 nt, Human
gccaggcccccaccacaca

SEQ ID NO: 3758341 - RNA, 23 nt, Human
gccaggcccccaccacacauccc

SEQ ID NO: 3758342 - RNA, 17 nt, Human
gccaccaaaggccaggg

SEQ ID NO: 3758343 - RNA, 20 nt, Human
gccaccaacauacucccauc

SEQ ID NO: 3758344 - RNA, 23 nt, Human
gccaccaagugaaaaauguuagg

SEQ ID NO: 3758345 - RNA, 16 nt, Human
gccaccaccucugugg

SEQ ID NO: 3758346 - RNA, 13 nt, Human
gccaccacgcccg

SEQ ID NO: 3758347 - RNA, 24 nt, Human
gccaccacgccuagccucacgcuc

SEQ ID NO: 3758348 - RNA, 14 nt, Human
gccaccacguccag

SEQ ID NO: 3758349 - RNA, 19 nt, Human
gccaccagagaccguccuc

SEQ ID NO: 3758350 - RNA, 22 nt, Human
gccaccagagaccguccucacc

SEQ ID NO: 3758351 - RNA, 10 nt, Human
gccaccagcg

SEQ ID NO: 3758352 - RNA, 17 nt, Human
gccaccagcucugccgu

SEQ ID NO: 3758353 - RNA, 15 nt, Human
gccaccaggccaccu

SEQ ID NO: 3758354 - RNA, 18 nt, Human
gccaccaggccaccuccc

SEQ ID NO: 3758355 - RNA, 12 nt, Human
gccaccaggcug

SEQ ID NO: 3758356 - RNA, 17 nt, Human
gccaccaggcuggcgca

SEQ ID NO: 3758357 - RNA, 18 nt, Human
gccaccaggcuggcgcag

SEQ ID NO: 3758358 - RNA, 20 nt, Human
gccaccaggcuggcgcagcc

SEQ ID NO: 3758359 - RNA, 16 nt, Human
gccaccagucacuguc

SEQ ID NO: 3758360 - RNA, 23 nt, Human
gccaccauauucagugcuguggc

SEQ ID NO: 3758361 - RNA, 17 nt, Human
gccaccauccugcagcc

SEQ ID NO: 3758362 - RNA, 14 nt, Human
gccaccauccugcu

SEQ ID NO: 3758363 - RNA, 13 nt, Human
gccaccaugcccg

SEQ ID NO: 3758364 - RNA, 17 nt, Human
gccaccauggccagcca

SEQ ID NO: 3758365 - RNA, 14 nt, Human
gccaccauuccugg

SEQ ID NO: 3758366 - RNA, 18 nt, Human
gccacccaccucccugcc

SEQ ID NO: 3758367 - RNA, 15 nt, Human
gccacccaggaggca

SEQ ID NO: 3758368 - RNA, 16 nt, Human
gccacccaggaggcag

SEQ ID NO: 3758369 - RNA, 12 nt, Human
gccaccccacuu

SEQ ID NO: 3758370 - RNA, 18 nt, Human
gccacccccgcuggagga

SEQ ID NO: 3758371 - RNA, 13 nt, Human
gccacccuaccug

SEQ ID NO: 3758372 - RNA, 16 nt, Human
gccacccucaugcugu

SEQ ID NO: 3758373 - RNA, 19 nt, Human
gccacccugaggagucuga

SEQ ID NO: 3758374 - RNA, 22 nt, Human
gccacccugaggagucugaggu

SEQ ID NO: 3758375 - RNA, 13 nt, Human
gccacccugggcu

SEQ ID NO: 3758376 - RNA, 13 nt, Human
gccacccugugca

SEQ ID NO: 3758377 - RNA, 15 nt, Human
gccacccuucuucag

SEQ ID NO: 3758378 - RNA, 13 nt, Human
gccaccgccuugc

SEQ ID NO: 3758379 - RNA, 23 nt, Human
gccaccgcuuccggcuccugugc

SEQ ID NO: 3758380 - RNA, 17 nt, Human
gccaccgugccuggcca

SEQ ID NO: 3758381 - RNA, 19 nt, Human
gccaccuaucucgugggag

SEQ ID NO: 3758382 - RNA, 22 nt, Human
gccaccuaucucgugggagagc

SEQ ID NO: 3758383 - RNA, 23 nt, Human
gccaccucagaccccggggugag

SEQ ID NO: 3758384 - RNA, 13 nt, Human
gccaccuccagaa

SEQ ID NO: 3758385 - RNA, 15 nt, Human
gccaccuccagaaac

SEQ ID NO: 3758386 - RNA, 15 nt, Human
gccaccuccccaggc

SEQ ID NO: 3758387 - RNA, 22 nt, Human
gccaccuccccuauccacccag

SEQ ID NO: 3758388 - RNA, 20 nt, Human
gccaccuccuaaaaggccca

SEQ ID NO: 3758389 - RNA, 23 nt, Human
gccaccuccuaaaaggcccagag

SEQ ID NO: 3758390 - RNA, 17 nt, Human
gccaccucuccaagggc

SEQ ID NO: 3758391 - RNA, 11 nt, Human
gccaccucugc

SEQ ID NO: 3758392 - RNA, 14 nt, Human
gccaccucugcgga

SEQ ID NO: 3758393 - RNA, 20 nt, Human
gccaccucugcggaccccag

SEQ ID NO: 3758394 - RNA, 22 nt, Human
gccaccucugcggaccccagcu

SEQ ID NO: 3758395 - RNA, 14 nt, Human
gccaccucuuccug

SEQ ID NO: 3758396 - RNA, 21 nt, Human
gccaccugaggugggcccagg

SEQ ID NO: 3758397 - RNA, 16 nt, Human
gccaccugaguuccug

SEQ ID NO: 3758398 - RNA, 11 nt, Human
gccaccugccc

SEQ ID NO: 3758399 - RNA, 12 nt, Human
gccaccugccug

SEQ ID NO: 3758400 - RNA, 13 nt, Human
gccaccugccugc

SEQ ID NO: 3758401 - RNA, 21 nt, Human
gccaccugccugcgucuuccg

SEQ ID NO: 3758402 - RNA, 17 nt, Human
gccaccugccuguuggg

SEQ ID NO: 3758403 - RNA, 20 nt, Human
gccaccugcggugcuaucuc

SEQ ID NO: 3758404 - RNA, 16 nt, Human
gccaccuggaccccug

SEQ ID NO: 3758405 - RNA, 20 nt, Human
gccaccuggcauuccuucug

SEQ ID NO: 3758406 - RNA, 14 nt, Human
gccaccuggggcag

SEQ ID NO: 3758407 - RNA, 11 nt, Human
gccaccugggu

SEQ ID NO: 3758408 - RNA, 10 nt, Human
gccaccuguc

SEQ ID NO: 3758409 - RNA, 15 nt, Human
gccacgauugcagga

SEQ ID NO: 3758410 - RNA, 16 nt, Human
gccacgcagccaggac

SEQ ID NO: 3758411 - RNA, 13 nt, Human
gccacgcuccagc

SEQ ID NO: 3758412 - RNA, 17 nt, Human
gccacgcuccagcugcc

SEQ ID NO: 3758413 - RNA, 13 nt, Human
gccacggcagccu

SEQ ID NO: 3758414 - RNA, 14 nt, Human
gccacggccaggcc

SEQ ID NO: 3758415 - RNA, 15 nt, Human
gccacggccaggcca

SEQ ID NO: 3758416 - RNA, 16 nt, Human
gccacggccaggccag

SEQ ID NO: 3758417 - RNA, 18 nt, Human
gccacggccaggccagag

SEQ ID NO: 3758418 - RNA, 13 nt, Human
gccacgugccagg

SEQ ID NO: 3758419 - RNA, 21 nt, Human
gccacguuccuuacugcagaa

SEQ ID NO: 3758420 - RNA, 22 nt, Human
gccacguuggagaagcccgugu

SEQ ID NO: 3758421 - RNA, 14 nt, Human
gccacguuuucacc

SEQ ID NO: 3758422 - RNA, 22 nt, Human
gccacuaaccuugccugguaca

SEQ ID NO: 3758423 - RNA, 15 nt, Human
gccacuaagcagagg

SEQ ID NO: 3758424 - RNA, 17 nt, Human
gccacuaagcagaggag

SEQ ID NO: 3758425 - RNA, 20 nt, Human
gccacuaagcagaggagggg

SEQ ID NO: 3758426 - RNA, 23 nt, Human
gccacuaauuuuaguauucauuc

SEQ ID NO: 3758427 - RNA, 22 nt, Human
gccacuacacuccagccugagc

SEQ ID NO: 3758428 - RNA, 22 nt, Human
gccacuaggcugggugcccaca

SEQ ID NO: 3758429 - RNA, 16 nt, Human
gccacuaguaaguaau

SEQ ID NO: 3758430 - RNA, 14 nt, Human
gccacucacacagc

SEQ ID NO: 3758431 - RNA, 18 nt, Human
gccacucacacagccagg

SEQ ID NO: 3758432 - RNA, 14 nt, Human
gccacucacuaggc

SEQ ID NO: 3758433 - RNA, 19 nt, Human
gccacucacuaggccccca

SEQ ID NO: 3758434 - RNA, 23 nt, Human
gccacucacuaggcccccacuug

SEQ ID NO: 3758435 - RNA, 13 nt, Human
gccacucagcuuc

SEQ ID NO: 3758436 - RNA, 21 nt, Human
gccacucaggaggcugaggca

SEQ ID NO: 3758437 - RNA, 14 nt, Human
gccacucaggccca

SEQ ID NO: 3758438 - RNA, 16 nt, Human
gccacucauuccugua

SEQ ID NO: 3758439 - RNA, 18 nt, Human
gccacucauuucaucuca

SEQ ID NO: 3758440 - RNA, 22 nt, Human
gccacuccccggcaugagacuc

SEQ ID NO: 3758441 - RNA, 12 nt, Human
gccacuccuccc

SEQ ID NO: 3758442 - RNA, 13 nt, Human
gccacuccuuccu

SEQ ID NO: 3758443 - RNA, 14 nt, Human
gccacuccuuccug

SEQ ID NO: 3758444 - RNA, 15 nt, Human
gccacuccuuccugc

SEQ ID NO: 3758445 - RNA, 20 nt, Human
gccacucuaccagugcaggc

SEQ ID NO: 3758446 - RNA, 19 nt, Human
gccacucucuucccuuucc

SEQ ID NO: 3758447 - RNA, 12 nt, Human
gccacucugccu

SEQ ID NO: 3758448 - RNA, 19 nt, Human
gccacucugccucugccug

SEQ ID NO: 3758449 - RNA, 23 nt, Human
gccacucuguuccuggcucagcc

SEQ ID NO: 3758450 - RNA, 15 nt, Human
gccacugaaaucugu

SEQ ID NO: 3758451 - RNA, 11 nt, Human
gccacugaaga

SEQ ID NO: 3758452 - RNA, 18 nt, Human
gccacugaagaggaggag

SEQ ID NO: 3758453 - RNA, 22 nt, Human
gccacugcacagagcucuccag

SEQ ID NO: 3758454 - RNA, 19 nt, Human
gccacugcacuccaaucug

SEQ ID NO: 3758455 - RNA, 12 nt, Human
gccacugccucu

SEQ ID NO: 3758456 - RNA, 13 nt, Human
gccacugcugcuu

SEQ ID NO: 3758457 - RNA, 17 nt, Human
gccacuggccaucucca

SEQ ID NO: 3758458 - RNA, 16 nt, Human
gccacuggggcucaga

SEQ ID NO: 3758459 - RNA, 18 nt, Human
gccacuggggcucagagc

SEQ ID NO: 3758460 - RNA, 19 nt, Human
gccacuggggcucagagcc

SEQ ID NO: 3758461 - RNA, 19 nt, Human
gccacugugcuccagccug

SEQ ID NO: 3758462 - RNA, 16 nt, Human
gccacuguguuccuuc

SEQ ID NO: 3758463 - RNA, 13 nt, Human
gccacuuaaugua

SEQ ID NO: 3758464 - RNA, 18 nt, Human
gccacuuaauguauguua

SEQ ID NO: 3758465 - RNA, 14 nt, Human
gccacuuaccuuca

SEQ ID NO: 3758466 - RNA, 13 nt, Human
gccacuucccagg

SEQ ID NO: 3758467 - RNA, 20 nt, Human
gccacuucuggguggggcag

SEQ ID NO: 3758468 - RNA, 15 nt, Human
gccacuugaaauguu

SEQ ID NO: 3758469 - RNA, 14 nt, Human
gccacuuuauuucu

SEQ ID NO: 3758470 - RNA, 21 nt, Human
gccacuuugcacgacgcccuc

SEQ ID NO: 3758471 - RNA, 12 nt, Human
gccagaaauaaa

SEQ ID NO: 3758472 - RNA, 20 nt, Human
gccagaaccccgagcccuac

SEQ ID NO: 3758473 - RNA, 18 nt, Human
gccagaacguggcucugc

SEQ ID NO: 3758474 - RNA, 20 nt, Human
gccagaacguggcucugcug

SEQ ID NO: 3758475 - RNA, 18 nt, Human
gccagaagauccccucag

SEQ ID NO: 3758476 - RNA, 18 nt, Human
gccagaaguaccagacua

SEQ ID NO: 3758477 - RNA, 21 nt, Human
gccagaaguuugucaagucaa

SEQ ID NO: 3758478 - RNA, 15 nt, Human
gccagaauuucaaac

SEQ ID NO: 3758479 - RNA, 15 nt, Human
gccagacacucugcu

SEQ ID NO: 3758480 - RNA, 14 nt, Human
gccagaccagagcu

SEQ ID NO: 3758481 - RNA, 13 nt, Human
gccagaccugcag

SEQ ID NO: 3758482 - RNA, 14 nt, Human
gccagaccugcaga

SEQ ID NO: 3758483 - RNA, 22 nt, Human
gccagacgcucauucagcaucu

SEQ ID NO: 3758484 - RNA, 15 nt, Human
gccagacuggcacag

SEQ ID NO: 3758485 - RNA, 13 nt, Human
gccagagaagcua

SEQ ID NO: 3758486 - RNA, 11 nt, Human
gccagagaagu

SEQ ID NO: 3758487 - RNA, 22 nt, Human
gccagagacacaagccuucggc

SEQ ID NO: 3758488 - RNA, 13 nt, Human
gccagagauccaa

SEQ ID NO: 3758489 - RNA, 16 nt, Human
gccagagauccaaaag

SEQ ID NO: 3758490 - RNA, 20 nt, Human
gccagagauccaaaagaagc

SEQ ID NO: 3758491 - RNA, 23 nt, Human
gccagagauccaaaagaagcccc

SEQ ID NO: 3758492 - RNA, 18 nt, Human
gccagagcaaagggccag

SEQ ID NO: 3758493 - RNA, 13 nt, Human
gccaggcccucug

SEQ ID NO: 3758494 - RNA, 15 nt, Human
gccaggcccucugcc

SEQ ID NO: 3758495 - RNA, 16 nt, Human
gccaggcccucugccc

SEQ ID NO: 3758496 - RNA, 15 nt, Human
gccaggccgggccug

SEQ ID NO: 3758497 - RNA, 21 nt, Human
gccaggccucuuggcagucac

SEQ ID NO: 3758498 - RNA, 14 nt, Human
gccaggccuggguc

SEQ ID NO: 3758499 - RNA, 16 nt, Human
gccaggcgagaugggg

SEQ ID NO: 3758500 - RNA, 17 nt, Human
gccaggcucacucacag

SEQ ID NO: 3758501 - RNA, 20 nt, Human
gccaggcuccuuccugucuu

SEQ ID NO: 3758502 - RNA, 16 nt, Human
gccaggcucugugcug

SEQ ID NO: 3758503 - RNA, 18 nt, Human
gccaggcugaccacagca

SEQ ID NO: 3758504 - RNA, 14 nt, Human
gccaggcugccugg

SEQ ID NO: 3758505 - RNA, 13 nt, Human
gccaggcugcucu

SEQ ID NO: 3758506 - RNA, 18 nt, Human
gccaggcuggagugcagu

SEQ ID NO: 3758507 - RNA, 23 nt, Human
gccaggcugggucgcccuggacu

SEQ ID NO: 3758508 - RNA, 19 nt, Human
gccagggaaagacuggcaa

SEQ ID NO: 3758509 - RNA, 18 nt, Human
gccagggacagagggggu

SEQ ID NO: 3758510 - RNA, 22 nt, Human
gccagggaccccagaaucaugu

SEQ ID NO: 3758511 - RNA, 16 nt, Human
gccagggagaagcucc

SEQ ID NO: 3758512 - RNA, 18 nt, Human
gccagggagaccuggaca

SEQ ID NO: 3758513 - RNA, 21 nt, Human
gccagggagaccuggacacag

SEQ ID NO: 3758514 - RNA, 19 nt, Human
gccagggagagcccaggag

SEQ ID NO: 3758515 - RNA, 22 nt, Human
gccagggagagcccaggagcuc

SEQ ID NO: 3758516 - RNA, 11 nt, Human
gccagggagcu

SEQ ID NO: 3758517 - RNA, 15 nt, Human
gccagggauggggcc

SEQ ID NO: 3758518 - RNA, 15 nt, Human
gccagggcagaguga

SEQ ID NO: 3758519 - RNA, 16 nt, Human
gccagggcagagugag

SEQ ID NO: 3758520 - RNA, 19 nt, Human
gccagggcagggccccagg

SEQ ID NO: 3758521 - RNA, 20 nt, Human
gccagggccacgcuccagcu

SEQ ID NO: 3758522 - RNA, 22 nt, Human
gccagggccacgcuccagcugc

SEQ ID NO: 3758523 - RNA, 21 nt, Human
gccagggccaugucagacaca

SEQ ID NO: 3758524 - RNA, 16 nt, Human
gccagggccccucucc

SEQ ID NO: 3758525 - RNA, 19 nt, Human
gccagggccccucucccca

SEQ ID NO: 3758526 - RNA, 13 nt, Human
gccagggcccgca

SEQ ID NO: 3758527 - RNA, 16 nt, Human
gccagggccuggaaga

SEQ ID NO: 3758528 - RNA, 22 nt, Human
gccagggccuggaagacagaga

SEQ ID NO: 3758529 - RNA, 14 nt, Human
gccagggcugcccc

SEQ ID NO: 3758530 - RNA, 17 nt, Human
gccagggcugcccugag

SEQ ID NO: 3758531 - RNA, 19 nt, Human
gccagggcugcccugagaa

SEQ ID NO: 3758532 - RNA, 21 nt, Human
gccaggggaaaaucagccugc

SEQ ID NO: 3758533 - RNA, 17 nt, Human
gccaggggaccuccugg

SEQ ID NO: 3758534 - RNA, 21 nt, Human
gccagggggacuagccccugu

SEQ ID NO: 3758535 - RNA, 15 nt, Human
gccagggggaugcca

SEQ ID NO: 3758536 - RNA, 19 nt, Human
gccaggggggugaggagcu

SEQ ID NO: 3758537 - RNA, 21 nt, Human
gccaggggucucccuggagug

SEQ ID NO: 3758538 - RNA, 15 nt, Human
gccagggucuccaga

SEQ ID NO: 3758539 - RNA, 22 nt, Human
gccagggucucucccucaggug

SEQ ID NO: 3758540 - RNA, 15 nt, Human
gccagggugagagcu

SEQ ID NO: 3758541 - RNA, 20 nt, Human
gccaggguguggcccugcca

SEQ ID NO: 3758542 - RNA, 15 nt, Human
gccaggucccccugc

SEQ ID NO: 3758543 - RNA, 16 nt, Human
gccaggucccccugca

SEQ ID NO: 3758544 - RNA, 17 nt, Human
gccaggucccccugcag

SEQ ID NO: 3758545 - RNA, 18 nt, Human
gccaggucccccugcagc

SEQ ID NO: 3758546 - RNA, 19 nt, Human
gccaggucccccugcagcu

SEQ ID NO: 3758547 - RNA, 16 nt, Human
gccaggugagaaacug

SEQ ID NO: 3758548 - RNA, 14 nt, Human
gccaggugcagugg

SEQ ID NO: 3758549 - RNA, 14 nt, Human
gccaggugccuugg

SEQ ID NO: 3758550 - RNA, 18 nt, Human
gccagguggccacuccag

SEQ ID NO: 3758551 - RNA, 18 nt, Human
gccagguucuauuuggaa

SEQ ID NO: 3758552 - RNA, 18 nt, Human
gccagguugcuaagaaac

SEQ ID NO: 3758553 - RNA, 13 nt, Human
gccagguuuucug

SEQ ID NO: 3758554 - RNA, 17 nt, Human
gccagguuuuuggucug

SEQ ID NO: 3758555 - RNA, 21 nt, Human
gccaguaagggaaauagaaaa

SEQ ID NO: 3758556 - RNA, 16 nt, Human
gccaguacuugucaua

SEQ ID NO: 3758557 - RNA, 23 nt, Human
gccaguauuagacuggaaguuca

SEQ ID NO: 3758558 - RNA, 13 nt, Human
gccagucaccccg

SEQ ID NO: 3758559 - RNA, 15 nt, Human
gccagucccccugcc

SEQ ID NO: 3758560 - RNA, 19 nt, Human
gccaguccuagcugcacag

SEQ ID NO: 3758561 - RNA, 22 nt, Human
gccaguccuagcugcacagggc

SEQ ID NO: 3758562 - RNA, 22 nt, Human
gccaguccugcuaccucccuug

SEQ ID NO: 3758563 - RNA, 17 nt, Human
gccagucgcgcugccug

SEQ ID NO: 3758564 - RNA, 20 nt, Human
gccagucgcgcugccugugu

SEQ ID NO: 3758565 - RNA, 17 nt, Human
gccagucugggcugccg

SEQ ID NO: 3758566 - RNA, 13 nt, Human
gccagucuugugu

SEQ ID NO: 3758567 - RNA, 14 nt, Human
gccagugacagaca

SEQ ID NO: 3758568 - RNA, 15 nt, Human
gccagugacuccagg

SEQ ID NO: 3758569 - RNA, 19 nt, Human
gccagugaugcuaaagguu

SEQ ID NO: 3758570 - RNA, 15 nt, Human
gccagugcccugagc

SEQ ID NO: 3758571 - RNA, 17 nt, Human
gccagugcccugagcca

SEQ ID NO: 3758572 - RNA, 18 nt, Human
gccagugcccugagccag

SEQ ID NO: 3758573 - RNA, 18 nt, Human
gccagugcccugauccca

SEQ ID NO: 3758574 - RNA, 10 nt, Human
gccagugccu

SEQ ID NO: 3758575 - RNA, 11 nt, Human
gccagugccuu

SEQ ID NO: 3758576 - RNA, 23 nt, Human
gccagugccuuaccuccugccca

SEQ ID NO: 3758577 - RNA, 16 nt, Human
gccagugcuccaggca

SEQ ID NO: 3758578 - RNA, 18 nt, Human
gccaguggaaauucaggu

SEQ ID NO: 3758579 - RNA, 15 nt, Human
gccaguggggccugu

SEQ ID NO: 3758580 - RNA, 18 nt, Human
gccaguggggccugugga

SEQ ID NO: 3758581 - RNA, 17 nt, Human
gccaguguaauccccca

SEQ ID NO: 3758582 - RNA, 21 nt, Human
gccagugucugucccgggguc

SEQ ID NO: 3758583 - RNA, 12 nt, Human
gccagugucuuu

SEQ ID NO: 3758584 - RNA, 13 nt, Human
gccagugugacaa

SEQ ID NO: 3758585 - RNA, 20 nt, Human
gccagugugaucccaagugc

SEQ ID NO: 3758586 - RNA, 15 nt, Human
gccaguguugccuaa

SEQ ID NO: 3758587 - RNA, 20 nt, Human
gccaguucaguaccuggagg

SEQ ID NO: 3758588 - RNA, 21 nt, Human
gccaguucaguaccuggagga

SEQ ID NO: 3758589 - RNA, 22 nt, Human
gccaguucaguaccuggaggag

SEQ ID NO: 3758590 - RNA, 21 nt, Human
gccaguuggucccccuuccau

SEQ ID NO: 3758591 - RNA, 22 nt, Human
gccauaaaacagguaauauaaa

SEQ ID NO: 3758592 - RNA, 13 nt, Human
gccauaaaacauu

SEQ ID NO: 3758593 - RNA, 14 nt, Human
gccauaaaacauua

SEQ ID NO: 3758594 - RNA, 19 nt, Human
gccauacauaaaagaaaua

SEQ ID NO: 3758595 - RNA, 13 nt, Human
gccauacuggccu

SEQ ID NO: 3758596 - RNA, 18 nt, Human
gccauacuggccucgccu

SEQ ID NO: 3758597 - RNA, 14 nt, Human
gccauacugugucc

SEQ ID NO: 3758598 - RNA, 16 nt, Human
gccauacuuugucuga

SEQ ID NO: 3758599 - RNA, 19 nt, Human
gccauagaguacacugccu

SEQ ID NO: 3758600 - RNA, 16 nt, Human
gccauagaguuuaaca

SEQ ID NO: 3758601 - RNA, 15 nt, Human
gccauagcuccugcu

SEQ ID NO: 3758602 - RNA, 23 nt, Human
gccauagcuccugcuccacagcc

SEQ ID NO: 3758603 - RNA, 15 nt, Human
gccauaggcccuuuc

SEQ ID NO: 3758604 - RNA, 16 nt, Human
gccauaggcccuuuca

SEQ ID NO: 3758605 - RNA, 23 nt, Human
gccauagucaaagagaguuuuua

SEQ ID NO: 3758606 - RNA, 16 nt, Human
gccauagucacauggc

SEQ ID NO: 3758607 - RNA, 19 nt, Human
gccauauaaguuugaagga

SEQ ID NO: 3758608 - RNA, 22 nt, Human
gccauauaaguuugaaggaaac

SEQ ID NO: 3758609 - RNA, 19 nt, Human
gccauauacucuucaagga

SEQ ID NO: 3758610 - RNA, 16 nt, Human
gccauauuaaauuuuu

SEQ ID NO: 3758611 - RNA, 19 nt, Human
gccauauucuguuggccag

SEQ ID NO: 3758612 - RNA, 20 nt, Human
gccauauucuguuggccagu

SEQ ID NO: 3758613 - RNA, 16 nt, Human
gccauauuuaccucag

SEQ ID NO: 3758614 - RNA, 14 nt, Human
gccauauuuacuac

SEQ ID NO: 3758615 - RNA, 14 nt, Human
gccauauuuguaaa

SEQ ID NO: 3758616 - RNA, 17 nt, Human
gccaucaacaagaguug

SEQ ID NO: 3758617 - RNA, 15 nt, Human
gccaucaagagacug

SEQ ID NO: 3758618 - RNA, 19 nt, Human
gccaucaucaguggagcca

SEQ ID NO: 3758619 - RNA, 21 nt, Human
gccaucauguaaauuaccagu

SEQ ID NO: 3758620 - RNA, 14 nt, Human
gccaucauugcugu

SEQ ID NO: 3758621 - RNA, 20 nt, Human
gccauccaaauaagaaaccu

SEQ ID NO: 3758622 - RNA, 20 nt, Human
gccauccagguucagcuugu

SEQ ID NO: 3758623 - RNA, 16 nt, Human
gccaucccagccuugg

SEQ ID NO: 3758624 - RNA, 18 nt, Human
gccauccccagggggcau

SEQ ID NO: 3758625 - RNA, 11 nt, Human
gccaucccucc

SEQ ID NO: 3758626 - RNA, 14 nt, Human
gccaucccucccuc

SEQ ID NO: 3758627 - RNA, 16 nt, Human
gccaucccucccucca

SEQ ID NO: 3758628 - RNA, 14 nt, Human
gccaucccugugag

SEQ ID NO: 3758629 - RNA, 19 nt, Human
gccauccggcccccagagc

SEQ ID NO: 3758630 - RNA, 22 nt, Human
gccauccggcccccagagcgcc

SEQ ID NO: 3758631 - RNA, 19 nt, Human
gccauccucuuucucuuuu

SEQ ID NO: 3758632 - RNA, 20 nt, Human
gccauccuggcccagggcau

SEQ ID NO: 3758633 - RNA, 23 nt, Human
gccauccuggcccagggcaucug

SEQ ID NO: 3758634 - RNA, 21 nt, Human
gccauccuugacuuugaacua

SEQ ID NO: 3758635 - RNA, 19 nt, Human
gccaucgccgggacuccag

SEQ ID NO: 3758636 - RNA, 14 nt, Human
gccaucuaaaguaa

SEQ ID NO: 3758637 - RNA, 15 nt, Human
gccaucuagccagcc

SEQ ID NO: 3758638 - RNA, 19 nt, Human
gccaucucaugaggggaga

SEQ ID NO: 3758639 - RNA, 21 nt, Human
gccaucucaugaggggagagg

SEQ ID NO: 3758640 - RNA, 13 nt, Human
gccaucucugcuc

SEQ ID NO: 3758641 - RNA, 15 nt, Human
gccaucucuggaugc

SEQ ID NO: 3758642 - RNA, 14 nt, Human
gccaucugcccagg

SEQ ID NO: 3758643 - RNA, 19 nt, Human
cuggaggugggagcaggag

SEQ ID NO: 3758644 - RNA, 21 nt, Human
cuggagguggggcgaggcagg

SEQ ID NO: 3758645 - RNA, 16 nt, Human
cuggagguugaagcca

SEQ ID NO: 3758646 - RNA, 17 nt, Human
cuggagguugauaacuu

SEQ ID NO: 3758647 - RNA, 18 nt, Human
cuggagguugauaacuuu

SEQ ID NO: 3758648 - RNA, 22 nt, Human
cuggagguugauaacuuugcuu

SEQ ID NO: 3758649 - RNA, 20 nt, Human
cuggagucaugccaagcauu

SEQ ID NO: 3758650 - RNA, 16 nt, Human
cuggaguccagucucu

SEQ ID NO: 3758651 - RNA, 14 nt, Human
cuggagucuccagu

SEQ ID NO: 3758652 - RNA, 15 nt, Human
cuggagucuccagug

SEQ ID NO: 3758653 - RNA, 13 nt, Human
cuggagucuccug

SEQ ID NO: 3758654 - RNA, 12 nt, Human
cuggagucugga

SEQ ID NO: 3758655 - RNA, 14 nt, Human
cuggagugaggggu

SEQ ID NO: 3758656 - RNA, 12 nt, Human
cuggagugcagg

SEQ ID NO: 3758657 - RNA, 16 nt, Human
cuggagugcagggagg

SEQ ID NO: 3758658 - RNA, 14 nt, Human
cuggagugcaguga

SEQ ID NO: 3758659 - RNA, 17 nt, Human
cuggagugcagugagcc

SEQ ID NO: 3758660 - RNA, 20 nt, Human
cuggagugcagugagccgag

SEQ ID NO: 3758661 - RNA, 13 nt, Human
cuggagugcaguu

SEQ ID NO: 3758662 - RNA, 22 nt, Human
cuggagugcccacccugggaga

SEQ ID NO: 3758663 - RNA, 13 nt, Human
cuggaguggccac

SEQ ID NO: 3758664 - RNA, 14 nt, Human
cuggaguggccacu

SEQ ID NO: 3758665 - RNA, 13 nt, Human
cuggagugggcag

SEQ ID NO: 3758666 - RNA, 19 nt, Human
cuggagugguguucagcca

SEQ ID NO: 3758667 - RNA, 20 nt, Human
cuggaguguggcugaggagg

SEQ ID NO: 3758668 - RNA, 22 nt, Human
cuggaguguggcugaggaggcc

SEQ ID NO: 3758669 - RNA, 22 nt, Human
cuggaguuacauuaauguuaau

SEQ ID NO: 3758670 - RNA, 17 nt, Human
cuggaguucugguuccu

SEQ ID NO: 3758671 - RNA, 16 nt, Human
cuggaguuggggcaga

SEQ ID NO: 3758672 - RNA, 13 nt, Human
cuggaguuucaug

SEQ ID NO: 3758673 - RNA, 18 nt, Human
cuggaguuucauguacaa

SEQ ID NO: 3758674 - RNA, 14 nt, Human
cuggauaacuuagg

SEQ ID NO: 3758675 - RNA, 18 nt, Human
cuggauaacuuccacagg

SEQ ID NO: 3758676 - RNA, 22 nt, Human
cuggauaacuuccacagggucc

SEQ ID NO: 3758677 - RNA, 15 nt, Human
cuggauaggagccug

SEQ ID NO: 3758678 - RNA, 22 nt, Human
cuggaucacagcugcuuucugu

SEQ ID NO: 3758679 - RNA, 20 nt, Human
cuggaucacgacgcugcaga

SEQ ID NO: 3758680 - RNA, 15 nt, Human
cuggaucagaacagg

SEQ ID NO: 3758681 - RNA, 16 nt, Human
cuggaucagcguggcc

SEQ ID NO: 3758682 - RNA, 19 nt, Human
cuggaucagcguggccuug

SEQ ID NO: 3758683 - RNA, 14 nt, Human
cuggaucaguaaaa

SEQ ID NO: 3758684 - RNA, 20 nt, Human
cuggaucaguccuuugauca

SEQ ID NO: 3758685 - RNA, 17 nt, Human
cuggauccaucaggcca

SEQ ID NO: 3758686 - RNA, 19 nt, Human
cuggauccaucaggccacu

SEQ ID NO: 3758687 - RNA, 19 nt, Human
cuggauccuagccuuaucc

SEQ ID NO: 3758688 - RNA, 23 nt, Human
cuggauccuagccuuauccucug

SEQ ID NO: 3758689 - RNA, 10 nt, Human
cuggaucuac

SEQ ID NO: 3758690 - RNA, 17 nt, Human
cuggaucuaccuggagg

SEQ ID NO: 3758691 - RNA, 18 nt, Human
cuggaucuaccuggaggg

SEQ ID NO: 3758692 - RNA, 16 nt, Human
cuggaucucccagggc

SEQ ID NO: 3758693 - RNA, 20 nt, Human
cuggaucucuuaagacagca

SEQ ID NO: 3758694 - RNA, 14 nt, Human
cuggaugagcuccc

SEQ ID NO: 3758695 - RNA, 15 nt, Human
cuggaugagcuccca

SEQ ID NO: 3758696 - RNA, 23 nt, Human
cuggaugauacuaauaaacuaau

SEQ ID NO: 3758697 - RNA, 17 nt, Human
cuggaugcagccucaca

SEQ ID NO: 3758698 - RNA, 22 nt, Human
cuggaugcagccucacaguccu

SEQ ID NO: 3758699 - RNA, 23 nt, Human
cuggaugcccauccacugggugu

SEQ ID NO: 3758700 - RNA, 17 nt, Human
cuggaugcccccugugg

SEQ ID NO: 3758701 - RNA, 19 nt, Human
cuggaugcccccuguggau

SEQ ID NO: 3758702 - RNA, 16 nt, Human
cuggaugcuccuucca

SEQ ID NO: 3758703 - RNA, 11 nt, Human
cuggauggagc

SEQ ID NO: 3758704 - RNA, 17 nt, Human
cuggauggagcccaggc

SEQ ID NO: 3758705 - RNA, 21 nt, Human
cuggauggauuugaagcaaag

SEQ ID NO: 3758706 - RNA, 15 nt, Human
cuggauggcaccaga

SEQ ID NO: 3758707 - RNA, 16 nt, Human
cuggauggcaccagag

SEQ ID NO: 3758708 - RNA, 21 nt, Human
cuggauggcggaagcugcuac

SEQ ID NO: 3758709 - RNA, 18 nt, Human
cuggaugggcugcagcag

SEQ ID NO: 3758710 - RNA, 20 nt, Human
cuggaugggcugcagcagag

SEQ ID NO: 3758711 - RNA, 13 nt, Human
cuggauggggcag

SEQ ID NO: 3758712 - RNA, 17 nt, Human
cuggauggggcaggcca

SEQ ID NO: 3758713 - RNA, 12 nt, Human
cuggaugucuga

SEQ ID NO: 3758714 - RNA, 13 nt, Human
cuggaugucugaa

SEQ ID NO: 3758715 - RNA, 15 nt, Human
cuggaugucugccaa

SEQ ID NO: 3758716 - RNA, 20 nt, Human
cuggauguuuuuucccuguu

SEQ ID NO: 3758717 - RNA, 17 nt, Human
cuggauucaaauuuauu

SEQ ID NO: 3758718 - RNA, 15 nt, Human
cuggauucagccuuc

SEQ ID NO: 3758719 - RNA, 17 nt, Human
cuggauucagccuucuu

SEQ ID NO: 3758720 - RNA, 17 nt, Human
cuggauucauugucucu

SEQ ID NO: 3758721 - RNA, 18 nt, Human
cuggauucauuuccugcc

SEQ ID NO: 3758722 - RNA, 13 nt, Human
cuggauuccagag

SEQ ID NO: 3758723 - RNA, 21 nt, Human
cuggauuccagagcacugcuc

SEQ ID NO: 3758724 - RNA, 13 nt, Human
cuggauucccagg

SEQ ID NO: 3758725 - RNA, 14 nt, Human
cuggauucccagga

SEQ ID NO: 3758726 - RNA, 19 nt, Human
cuggauuguacuuugugcu

SEQ ID NO: 3758727 - RNA, 20 nt, Human
cuggauuguacuuugugcug

SEQ ID NO: 3758728 - RNA, 12 nt, Human
cuggauuuucag

SEQ ID NO: 3758729 - RNA, 13 nt, Human
cuggauuuuguca

SEQ ID NO: 3758730 - RNA, 12 nt, Human
cuggcaaagcag

SEQ ID NO: 3758731 - RNA, 21 nt, Human
cuggcaaagcagaaaauugua

SEQ ID NO: 3758732 - RNA, 19 nt, Human
cuggcaaagggagcagaac

SEQ ID NO: 3758733 - RNA, 15 nt, Human
cuggcaacacagagg

SEQ ID NO: 3758734 - RNA, 21 nt, Human
cuggcaagcaagccugggagc

SEQ ID NO: 3758735 - RNA, 19 nt, Human
cuggcaagcuagaaccugg

SEQ ID NO: 3758736 - RNA, 17 nt, Human
cuggcaaggacacagau

SEQ ID NO: 3758737 - RNA, 18 nt, Human
cuggcaaggacacagaug

SEQ ID NO: 3758738 - RNA, 12 nt, Human
cuggcaaugcca

SEQ ID NO: 3758739 - RNA, 19 nt, Human
cuggcaaugccacagcccu

SEQ ID NO: 3758740 - RNA, 21 nt, Human
cuggcaaugguaguuucugug

SEQ ID NO: 3758741 - RNA, 15 nt, Human
cuggcaauugucuau

SEQ ID NO: 3758742 - RNA, 18 nt, Human
cuggcacaaacucuuggu

SEQ ID NO: 3758743 - RNA, 16 nt, Human
cuggcacagaaaccuc

SEQ ID NO: 3758744 - RNA, 13 nt, Human
cuggcacagccug

SEQ ID NO: 3758745 - RNA, 14 nt, Human
cuggcacagccugc

SEQ ID NO: 3758746 - RNA, 21 nt, Human
cuggcacagccuggcuguggc

SEQ ID NO: 3758747 - RNA, 15 nt, Human
cuggcacaggacuga

SEQ ID NO: 3758748 - RNA, 16 nt, Human
cuggcacagggcagug

SEQ ID NO: 3758749 - RNA, 17 nt, Human
cuggcacagggcagugg

SEQ ID NO: 3758750 - RNA, 21 nt, Human
cuggcacagugucugggcuga

SEQ ID NO: 3758751 - RNA, 20 nt, Human
cuggcacaguuuucugagaa

SEQ ID NO: 3758752 - RNA, 19 nt, Human
cuggcacaucagaaaggaa

SEQ ID NO: 3758753 - RNA, 19 nt, Human
cuggcacauuuccccagac

SEQ ID NO: 3758754 - RNA, 23 nt, Human
cuggcacauuuccccagaccuga

SEQ ID NO: 3758755 - RNA, 21 nt, Human
cuggcacgguggcucaggccu

SEQ ID NO: 3758756 - RNA, 19 nt, Human
cuggcacuaccaaaggaca

SEQ ID NO: 3758757 - RNA, 22 nt, Human
cuggcacuauaauguaagcucu

SEQ ID NO: 3758758 - RNA, 19 nt, Human
cuggcacucuuguucccac

SEQ ID NO: 3758759 - RNA, 13 nt, Human
cuggcacugcugu

SEQ ID NO: 3758760 - RNA, 14 nt, Human
cuggcacugcugug

SEQ ID NO: 3758761 - RNA, 13 nt, Human
cuggcacugcuuc

SEQ ID NO: 3758762 - RNA, 23 nt, Human
cuggcacugcuuccagugaggcu

SEQ ID NO: 3758763 - RNA, 21 nt, Human
cuggcacuggaugcagaaaca

SEQ ID NO: 3758764 - RNA, 21 nt, Human
cuggcagaaagcaaaugugac

SEQ ID NO: 3758765 - RNA, 23 nt, Human
cuggcagaaagggaacagaaagg

SEQ ID NO: 3758766 - RNA, 17 nt, Human
cuggcagaacugagcuc

SEQ ID NO: 3758767 - RNA, 20 nt, Human
cuggcagaacugagcuccuc

SEQ ID NO: 3758768 - RNA, 21 nt, Human
cuggcagaacugagcuccucu

SEQ ID NO: 3758769 - RNA, 16 nt, Human
cuggcagaagggagca

SEQ ID NO: 3758770 - RNA, 23 nt, Human
cuggcagacuguguaaaauguaa

SEQ ID NO: 3758771 - RNA, 17 nt, Human
cuggcagagaugccucc

SEQ ID NO: 3758772 - RNA, 18 nt, Human
cuggcagagaugccuccc

SEQ ID NO: 3758773 - RNA, 20 nt, Human
cuggcagaguugaagacaga

SEQ ID NO: 3758774 - RNA, 21 nt, Human
cuggcagaguugaagacagag

SEQ ID NO: 3758775 - RNA, 15 nt, Human
cuggcagauucaaau

SEQ ID NO: 3758776 - RNA, 15 nt, Human
cuggcagcaccgccu

SEQ ID NO: 3758777 - RNA, 20 nt, Human
cuggcagcaccgccucuucc

SEQ ID NO: 3758778 - RNA, 11 nt, Human
cuggcagccca

SEQ ID NO: 3758779 - RNA, 16 nt, Human
cuggcagccccagcac

SEQ ID NO: 3758780 - RNA, 12 nt, Human
cuggcagccccu

SEQ ID NO: 3758781 - RNA, 18 nt, Human
cuggcagccgugccuuca

SEQ ID NO: 3758782 - RNA, 19 nt, Human
cuggcagccgugccuucag

SEQ ID NO: 3758783 - RNA, 21 nt, Human
cuggcagccgugccuucagcu

SEQ ID NO: 3758784 - RNA, 20 nt, Human
cuggcagccucccauccagg

SEQ ID NO: 3758785 - RNA, 13 nt, Human
cuggcagcucaga

SEQ ID NO: 3758786 - RNA, 14 nt, Human
cuggcagcucagag

SEQ ID NO: 3758787 - RNA, 16 nt, Human
cuggcagcucagagag

SEQ ID NO: 3758788 - RNA, 14 nt, Human
cuggcagcucagcu

SEQ ID NO: 3758789 - RNA, 13 nt, Human
cuggcagcucucc

SEQ ID NO: 3758790 - RNA, 14 nt, Human
cuggcagcucucca

SEQ ID NO: 3758791 - RNA, 18 nt, Human
cuggcagcucuggacagc

SEQ ID NO: 3758792 - RNA, 17 nt, Human
cuggcagggaggucagg

SEQ ID NO: 3758793 - RNA, 19 nt, Human
gccaucugcccaggggugc

SEQ ID NO: 3758794 - RNA, 21 nt, Human
gccaucugcgugacaauaaaa

SEQ ID NO: 3758795 - RNA, 14 nt, Human
gccaucuggagagc

SEQ ID NO: 3758796 - RNA, 17 nt, Human
gccaucugugggcacgc

SEQ ID NO: 3758797 - RNA, 18 nt, Human
gccaucuguguccugguu

SEQ ID NO: 3758798 - RNA, 15 nt, Human
gccaugaaaccagag

SEQ ID NO: 3758799 - RNA, 15 nt, Human
gccaugaagggaccc

SEQ ID NO: 3758800 - RNA, 19 nt, Human
gccaugacaacuucuaauu

SEQ ID NO: 3758801 - RNA, 14 nt, Human
gccaugacccugcc

SEQ ID NO: 3758802 - RNA, 18 nt, Human
gccaugacccugccucuc

SEQ ID NO: 3758803 - RNA, 18 nt, Human
gccaugagccgcccaagg

SEQ ID NO: 3758804 - RNA, 23 nt, Human
gccaugauggcaacagaucugga

SEQ ID NO: 3758805 - RNA, 21 nt, Human
gccaugauggugcugaccucu

SEQ ID NO: 3758806 - RNA, 22 nt, Human
gccaugauggugcugaccucug

SEQ ID NO: 3758807 - RNA, 20 nt, Human
gccaugauucgcccaaagcc

SEQ ID NO: 3758808 - RNA, 14 nt, Human
gccaugccacccug

SEQ ID NO: 3758809 - RNA, 16 nt, Human
gccaugccagcuggcc

SEQ ID NO: 3758810 - RNA, 13 nt, Human
gccaugccagcuu

SEQ ID NO: 3758811 - RNA, 19 nt, Human
gccaugccagcuuaucuca

SEQ ID NO: 3758812 - RNA, 14 nt, Human
gccaugccucagcc

SEQ ID NO: 3758813 - RNA, 15 nt, Human
gccaugccuccucag

SEQ ID NO: 3758814 - RNA, 16 nt, Human
gccaugcuccucuucc

SEQ ID NO: 3758815 - RNA, 24 nt, Human
gccaugcuccuggcccacugcauc

SEQ ID NO: 3758816 - RNA, 18 nt, Human
gccaugcugaggccuggg

SEQ ID NO: 3758817 - RNA, 19 nt, Human
gccaugcugaggccugggc

SEQ ID NO: 3758818 - RNA, 20 nt, Human
gccaugcugaggccugggcc

SEQ ID NO: 3758819 - RNA, 20 nt, Human
gccauggacucuacacugug

SEQ ID NO: 3758820 - RNA, 17 nt, Human
gccauggacucuguccu

SEQ ID NO: 3758821 - RNA, 22 nt, Human
gccauggacucuguccugaagg

SEQ ID NO: 3758822 - RNA, 16 nt, Human
gccauggagaaagcug

SEQ ID NO: 3758823 - RNA, 20 nt, Human
gccauggagaaagcugacuu

SEQ ID NO: 3758824 - RNA, 18 nt, Human
gccauggagagcuggagc

SEQ ID NO: 3758825 - RNA, 22 nt, Human
gccauggagagcuggagccugg

SEQ ID NO: 3758826 - RNA, 23 nt, Human
gccauggccugcaaacugggaac

SEQ ID NO: 3758827 - RNA, 23 nt, Human
gccauggcucaggguggucucuu

SEQ ID NO: 3758828 - RNA, 24 nt, Human
gccauggcuuccaagguggucugc

SEQ ID NO: 3758829 - RNA, 23 nt, Human
gccaugggacagggaggacgcuc

SEQ ID NO: 3758830 - RNA, 14 nt, Human
gccaugggaggccu

SEQ ID NO: 3758831 - RNA, 15 nt, Human
gccaugggaggccuu

SEQ ID NO: 3758832 - RNA, 15 nt, Human
gccaugggccuccug

SEQ ID NO: 3758833 - RNA, 20 nt, Human
gccauggguagccugggugu

SEQ ID NO: 3758834 - RNA, 14 nt, Human
gccaugggugcuug

SEQ ID NO: 3758835 - RNA, 14 nt, Human
gccaugguaccccc

SEQ ID NO: 3758836 - RNA, 20 nt, Human
gccaugguacccccuucugg

SEQ ID NO: 3758837 - RNA, 21 nt, Human
gccaugguacccccuucuggg

SEQ ID NO: 3758838 - RNA, 22 nt, Human
gccauguaaauccccacuggga

SEQ ID NO: 3758839 - RNA, 15 nt, Human
gccauguaccucccc

SEQ ID NO: 3758840 - RNA, 16 nt, Human
gccauguagaagcugc

SEQ ID NO: 3758841 - RNA, 15 nt, Human
gccauguaugaagcc

SEQ ID NO: 3758842 - RNA, 14 nt, Human
gccaugucagacac

SEQ ID NO: 3758843 - RNA, 23 nt, Human
gccaugucugcagugugcccccc

SEQ ID NO: 3758844 - RNA, 15 nt, Human
gccaugugaagaggg

SEQ ID NO: 3758845 - RNA, 18 nt, Human
gccaugugacucuggcuu

SEQ ID NO: 3758846 - RNA, 12 nt, Human
gccaugugcaua

SEQ ID NO: 3758847 - RNA, 22 nt, Human
gccaugugcuaguaauuggaaa

SEQ ID NO: 3758848 - RNA, 23 nt, Human
gccauguggaaggcaagccaggc

SEQ ID NO: 3758849 - RNA, 14 nt, Human
gccauguuggccag

SEQ ID NO: 3758850 - RNA, 16 nt, Human
gccauguuuaagauuu

SEQ ID NO: 3758851 - RNA, 22 nt, Human
gccauguuuauuacaguauaau

SEQ ID NO: 3758852 - RNA, 21 nt, Human
gccauuaaaugaauauuuuga

SEQ ID NO: 3758853 - RNA, 13 nt, Human
gccauuaccaugg

SEQ ID NO: 3758854 - RNA, 14 nt, Human
gccauuagccaagg

SEQ ID NO: 3758855 - RNA, 20 nt, Human
gccauuagccagauuugucu

SEQ ID NO: 3758856 - RNA, 22 nt, Human
gccauuaucccugaaucccccu

SEQ ID NO: 3758857 - RNA, 21 nt, Human
gccauucacuucauaauccag

SEQ ID NO: 3758858 - RNA, 16 nt, Human
gccauuccaaaauauu

SEQ ID NO: 3758859 - RNA, 14 nt, Human
gccauuccaacagc

SEQ ID NO: 3758860 - RNA, 16 nt, Human
gccauucucaagcccu

SEQ ID NO: 3758861 - RNA, 20 nt, Human
gccauucuccugccucagcc

SEQ ID NO: 3758862 - RNA, 17 nt, Human
gccauucugacucauau

SEQ ID NO: 3758863 - RNA, 19 nt, Human
gccauucuuucccaacacc

SEQ ID NO: 3758864 - RNA, 20 nt, Human
gccauucuuuuuuucuuggc

SEQ ID NO: 3758865 - RNA, 19 nt, Human
gccauugaucauaaacuga

SEQ ID NO: 3758866 - RNA, 18 nt, Human
gccauugcacuccagccu

SEQ ID NO: 3758867 - RNA, 21 nt, Human
gccauugcacuccagccuggg

SEQ ID NO: 3758868 - RNA, 17 nt, Human
gccauugccaccaggag

SEQ ID NO: 3758869 - RNA, 23 nt, Human
gccauugucuucggaaaccuugg

SEQ ID NO: 3758870 - RNA, 11 nt, Human
gccauuuaaaa

SEQ ID NO: 3758871 - RNA, 21 nt, Human
gccauuuaugugagugugugu

SEQ ID NO: 3758872 - RNA, 17 nt, Human
gccauuugauuuuucua

SEQ ID NO: 3758873 - RNA, 12 nt, Human
gccauuugcaau

SEQ ID NO: 3758874 - RNA, 23 nt, Human
gccauuugcaauaacagcugcaa

SEQ ID NO: 3758875 - RNA, 13 nt, Human
gccauuuugugaa

SEQ ID NO: 3758876 - RNA, 13 nt, Human
gccauuuuuacau

SEQ ID NO: 3758877 - RNA, 15 nt, Human
gccauuuuuacaucu

SEQ ID NO: 3758878 - RNA, 18 nt, Human
gcccaaaaauaugguuga

SEQ ID NO: 3758879 - RNA, 15 nt, Human
gcccaaaauuuauuu

SEQ ID NO: 3758880 - RNA, 21 nt, Human
gcccaaaccaccagaagccca

SEQ ID NO: 3758881 - RNA, 22 nt, Human
gcccaaaccaccagaagcccag

SEQ ID NO: 3758882 - RNA, 23 nt, Human
gcccaaaccaccagaagcccaga

SEQ ID NO: 3758883 - RNA, 22 nt, Human
gcccaaagagcacaaacauuuu

SEQ ID NO: 3758884 - RNA, 15 nt, Human
gcccaaagaugcagc

SEQ ID NO: 3758885 - RNA, 17 nt, Human
gcccaaagccagacagc

SEQ ID NO: 3758886 - RNA, 17 nt, Human
gcccaaagucuguguga

SEQ ID NO: 3758887 - RNA, 19 nt, Human
gcccaaagugguauagaaa

SEQ ID NO: 3758888 - RNA, 15 nt, Human
gcccaaaugcuggcu

SEQ ID NO: 3758889 - RNA, 19 nt, Human
gcccaaauuaucaagcuaa

SEQ ID NO: 3758890 - RNA, 13 nt, Human
gcccaacaccagc

SEQ ID NO: 3758891 - RNA, 18 nt, Human
gcccaacaccagccccug

SEQ ID NO: 3758892 - RNA, 22 nt, Human
gcccaacaccagccccugcccc

SEQ ID NO: 3758893 - RNA, 13 nt, Human
gcccaacaggggc

SEQ ID NO: 3758894 - RNA, 21 nt, Human
gcccaacaggggcuccaugcc

SEQ ID NO: 3758895 - RNA, 13 nt, Human
gcccaacccuguc

SEQ ID NO: 3758896 - RNA, 14 nt, Human
gcccaacccugucu

SEQ ID NO: 3758897 - RNA, 17 nt, Human
gcccaaccucagcaacc

SEQ ID NO: 3758898 - RNA, 21 nt, Human
gcccaaccucuuccuccugac

SEQ ID NO: 3758899 - RNA, 14 nt, Human
gcccaaccugcucu

SEQ ID NO: 3758900 - RNA, 22 nt, Human
gcccaagaauagaugcugacug

SEQ ID NO: 3758901 - RNA, 16 nt, Human
gcccaagccagaggcu

SEQ ID NO: 3758902 - RNA, 13 nt, Human
gcccaagcccuga

SEQ ID NO: 3758903 - RNA, 20 nt, Human
gcccaagcucagaaggcucu

SEQ ID NO: 3758904 - RNA, 18 nt, Human
gcccaagcuucccuccau

SEQ ID NO: 3758905 - RNA, 13 nt, Human
gcccaaggccuuc

SEQ ID NO: 3758906 - RNA, 18 nt, Human
gcccaaggcggccccucc

SEQ ID NO: 3758907 - RNA, 18 nt, Human
gcccaagggaucuggucc

SEQ ID NO: 3758908 - RNA, 13 nt, Human
gcccaagucccug

SEQ ID NO: 3758909 - RNA, 14 nt, Human
gcccaagucccugu

SEQ ID NO: 3758910 - RNA, 12 nt, Human
gcccaauauuau

SEQ ID NO: 3758911 - RNA, 20 nt, Human
gcccaauuggaggaaagcaa

SEQ ID NO: 3758912 - RNA, 23 nt, Human
gcccacaaaggcaaaggguccag

SEQ ID NO: 3758913 - RNA, 15 nt, Human
gcccacacacaggug

SEQ ID NO: 3758914 - RNA, 18 nt, Human
gcccacaccuccuggggc

SEQ ID NO: 3758915 - RNA, 21 nt, Human
gcccacaccuccuucccucuc

SEQ ID NO: 3758916 - RNA, 20 nt, Human
gcccacagcacagcucccug

SEQ ID NO: 3758917 - RNA, 14 nt, Human
gcccacagcuccca

SEQ ID NO: 3758918 - RNA, 16 nt, Human
gcccacagcucccacc

SEQ ID NO: 3758919 - RNA, 19 nt, Human
gcccacagcucccacccca

SEQ ID NO: 3758920 - RNA, 17 nt, Human
gcccacaggaggcaagc

SEQ ID NO: 3758921 - RNA, 13 nt, Human
gcccacaggauca

SEQ ID NO: 3758922 - RNA, 18 nt, Human
gcccacaggaucagucug

SEQ ID NO: 3758923 - RNA, 19 nt, Human
gcccacaggaucagucuga

SEQ ID NO: 3758924 - RNA, 17 nt, Human
gcccacaggugucccca

SEQ ID NO: 3758925 - RNA, 23 nt, Human
gcccacagguguccccagcccac

SEQ ID NO: 3758926 - RNA, 22 nt, Human
gcccacauccggggccagcucc

SEQ ID NO: 3758927 - RNA, 20 nt, Human
gcccacauuuagucucuuua

SEQ ID NO: 3758928 - RNA, 13 nt, Human
gcccaccccccuc

SEQ ID NO: 3758929 - RNA, 16 nt, Human
gcccacccccggcagc

SEQ ID NO: 3758930 - RNA, 20 nt, Human
gcccacccccugcccugcac

SEQ ID NO: 3758931 - RNA, 22 nt, Human
gcccacccccugcccugcacgu

SEQ ID NO: 3758932 - RNA, 15 nt, Human
gcccaccccucaaca

SEQ ID NO: 3758933 - RNA, 20 nt, Human
gcccacccuccugucuuccc

SEQ ID NO: 3758934 - RNA, 16 nt, Human
gcccacccugcugcug

SEQ ID NO: 3758935 - RNA, 17 nt, Human
gcccacccugcugcugg

SEQ ID NO: 3758936 - RNA, 22 nt, Human
gcccacccugcugcuggugcac

SEQ ID NO: 3758937 - RNA, 21 nt, Human
gcccacccugcuuggcccagg

SEQ ID NO: 3758938 - RNA, 22 nt, Human
gcccacccugcuuggcccaggg

SEQ ID NO: 3758939 - RNA, 16 nt, Human
gcccaccgcaugcccc

SEQ ID NO: 3758940 - RNA, 15 nt, Human
gcccaccuccccacg

SEQ ID NO: 3758941 - RNA, 12 nt, Human
gccagagccagg

SEQ ID NO: 3758942 - RNA, 14 nt, Human
gccagagccagggg

SEQ ID NO: 3758943 - RNA, 16 nt, Human
gccagagcccacucca

SEQ ID NO: 3758944 - RNA, 12 nt, Human
gccagagccugg

SEQ ID NO: 3758945 - RNA, 18 nt, Human
gccagaggaacuguccag

SEQ ID NO: 3758946 - RNA, 19 nt, Human
gccagaggaauccuggcag

SEQ ID NO: 3758947 - RNA, 20 nt, Human
gccagaggaauccuggcagc

SEQ ID NO: 3758948 - RNA, 21 nt, Human
gccagaggaauccuggcagcc

SEQ ID NO: 3758949 - RNA, 24 nt, Human
gccagaggaauccuggcagcccag

SEQ ID NO: 3758950 - RNA, 13 nt, Human
gccagaggagaga

SEQ ID NO: 3758951 - RNA, 16 nt, Human
gccagaggcccccagc

SEQ ID NO: 3758952 - RNA, 19 nt, Human
gccagaggcccccagccca

SEQ ID NO: 3758953 - RNA, 23 nt, Human
gccagaggcccccagcccagggc

SEQ ID NO: 3758954 - RNA, 24 nt, Human
gccagaggcccccagcccagggcu

SEQ ID NO: 3758955 - RNA, 17 nt, Human
gccagagggagugacag

SEQ ID NO: 3758956 - RNA, 19 nt, Human
gccagagggagugacagag

SEQ ID NO: 3758957 - RNA, 22 nt, Human
gccagagggagugacagaggca

SEQ ID NO: 3758958 - RNA, 23 nt, Human
gccagagggagugacagaggcag

SEQ ID NO: 3758959 - RNA, 15 nt, Human
gccagagggcuugug

SEQ ID NO: 3758960 - RNA, 20 nt, Human
gccagaggugggcagguggu

SEQ ID NO: 3758961 - RNA, 14 nt, Human
gccagauccagccu

SEQ ID NO: 3758962 - RNA, 13 nt, Human
gccagaucuguua

SEQ ID NO: 3758963 - RNA, 16 nt, Human
gccagaugaucaacuc

SEQ ID NO: 3758964 - RNA, 16 nt, Human
gccagaugcaccagcc

SEQ ID NO: 3758965 - RNA, 17 nt, Human
gccagaugcaccagccc

SEQ ID NO: 3758966 - RNA, 18 nt, Human
gccagaugcaccagcccu

SEQ ID NO: 3758967 - RNA, 17 nt, Human
gccagaugcugauguuc

SEQ ID NO: 3758968 - RNA, 20 nt, Human
gccagaugcugauguucagu

SEQ ID NO: 3758969 - RNA, 21 nt, Human
gccagaugcugauguucagug

SEQ ID NO: 3758970 - RNA, 15 nt, Human
gccagauggcccgga

SEQ ID NO: 3758971 - RNA, 16 nt, Human
gccagauucuuuccug

SEQ ID NO: 3758972 - RNA, 20 nt, Human
gccagauucuuuccugaggc

SEQ ID NO: 3758973 - RNA, 16 nt, Human
gccagauuucacucuc

SEQ ID NO: 3758974 - RNA, 21 nt, Human
gccagauuucacucuccuugg

SEQ ID NO: 3758975 - RNA, 16 nt, Human
gccagauuugucuuuu

SEQ ID NO: 3758976 - RNA, 16 nt, Human
gccagauuuuuuaaaa

SEQ ID NO: 3758977 - RNA, 23 nt, Human
gccagauuuuuuaaaauuuauau

SEQ ID NO: 3758978 - RNA, 12 nt, Human
gccagcacacag

SEQ ID NO: 3758979 - RNA, 15 nt, Human
gccagcacacagggc

SEQ ID NO: 3758980 - RNA, 22 nt, Human
gccagcacagaaacagaggaga

SEQ ID NO: 3758981 - RNA, 21 nt, Human
gccagcaccggaccagccugg

SEQ ID NO: 3758982 - RNA, 22 nt, Human
gccagcaccggaccagccuggc

SEQ ID NO: 3758983 - RNA, 14 nt, Human
gccagcaccuggca

SEQ ID NO: 3758984 - RNA, 18 nt, Human
gccagcacucgcuagcag

SEQ ID NO: 3758985 - RNA, 23 nt, Human
gccagcacucgcuagcaguggca

SEQ ID NO: 3758986 - RNA, 14 nt, Human
gccagcacuugucc

SEQ ID NO: 3758987 - RNA, 13 nt, Human
gccagcagacauu

SEQ ID NO: 3758988 - RNA, 14 nt, Human
gccagcagacauug

SEQ ID NO: 3758989 - RNA, 16 nt, Human
gccagcagcagcaggu

SEQ ID NO: 3758990 - RNA, 19 nt, Human
gccagcagcagcaggugau

SEQ ID NO: 3758991 - RNA, 12 nt, Human
gccagcagccag

SEQ ID NO: 3758992 - RNA, 13 nt, Human
gccagcagccagc

SEQ ID NO: 3758993 - RNA, 16 nt, Human
gccagcagccagcucu

SEQ ID NO: 3758994 - RNA, 18 nt, Human
gccagcagccagcucuca

SEQ ID NO: 3758995 - RNA, 21 nt, Human
gccagcagccagcucucagcc

SEQ ID NO: 3758996 - RNA, 13 nt, Human
gccagcaggcucu

SEQ ID NO: 3758997 - RNA, 20 nt, Human
gccagcaggcucucaggcca

SEQ ID NO: 3758998 - RNA, 23 nt, Human
gccagcaggcucucaggccagcu

SEQ ID NO: 3758999 - RNA, 13 nt, Human
gccagcaguucag

SEQ ID NO: 3759000 - RNA, 14 nt, Human
gccagcaguucaga

SEQ ID NO: 3759001 - RNA, 20 nt, Human
gccagcaguucagagcugcc

SEQ ID NO: 3759002 - RNA, 22 nt, Human
gccagcaguucagagcugcccu

SEQ ID NO: 3759003 - RNA, 13 nt, Human
gccagcaucuggg

SEQ ID NO: 3759004 - RNA, 20 nt, Human
gccagccaaacacacagaag

SEQ ID NO: 3759005 - RNA, 21 nt, Human
gccagccaaacacacagaagg

SEQ ID NO: 3759006 - RNA, 22 nt, Human
gccagccaaacacacagaaggg

SEQ ID NO: 3759007 - RNA, 18 nt, Human
gccagccaacucugggaa

SEQ ID NO: 3759008 - RNA, 20 nt, Human
gccagccaagcucugcaguc

SEQ ID NO: 3759009 - RNA, 21 nt, Human
gccagccaagcucugcagucc

SEQ ID NO: 3759010 - RNA, 21 nt, Human
gccagccacggggacucagcc

SEQ ID NO: 3759011 - RNA, 21 nt, Human
gccagccacucuaccagugca

SEQ ID NO: 3759012 - RNA, 14 nt, Human
gccagccagccacu

SEQ ID NO: 3759013 - RNA, 11 nt, Human
gccagccaggc

SEQ ID NO: 3759014 - RNA, 19 nt, Human
gccagccagugaccugagg

SEQ ID NO: 3759015 - RNA, 16 nt, Human
gccagcccagaggccg

SEQ ID NO: 3759016 - RNA, 14 nt, Human
gccagcccagccca

SEQ ID NO: 3759017 - RNA, 17 nt, Human
gccagcccauuugggca

SEQ ID NO: 3759018 - RNA, 18 nt, Human
gccagccccacagcccac

SEQ ID NO: 3759019 - RNA, 13 nt, Human
gccagccccaccc

SEQ ID NO: 3759020 - RNA, 18 nt, Human
gccagccccggcccuggg

SEQ ID NO: 3759021 - RNA, 19 nt, Human
gccagccccggcccugggc

SEQ ID NO: 3759022 - RNA, 10 nt, Human
gccagccccu

SEQ ID NO: 3759023 - RNA, 12 nt, Human
gccagccccucc

SEQ ID NO: 3759024 - RNA, 17 nt, Human
gccagccccucccacca

SEQ ID NO: 3759025 - RNA, 14 nt, Human
gccagccccuggcc

SEQ ID NO: 3759026 - RNA, 19 nt, Human
gccagccccuuagacagag

SEQ ID NO: 3759027 - RNA, 22 nt, Human
gccagcccggccgcuccaccag

SEQ ID NO: 3759028 - RNA, 14 nt, Human
gccagcccucccug

SEQ ID NO: 3759029 - RNA, 15 nt, Human
gccagcccucccugu

SEQ ID NO: 3759030 - RNA, 20 nt, Human
gccagcccucccuguccucc

SEQ ID NO: 3759031 - RNA, 22 nt, Human
gccagcccucccuguccuccuc

SEQ ID NO: 3759032 - RNA, 13 nt, Human
gccagcccugccu

SEQ ID NO: 3759033 - RNA, 16 nt, Human
gccagcccugccugga

SEQ ID NO: 3759034 - RNA, 16 nt, Human
gccagccgcucuccug

SEQ ID NO: 3759035 - RNA, 18 nt, Human
gccagccgugaugcucag

SEQ ID NO: 3759036 - RNA, 21 nt, Human
gccagccgugaugcucaggcu

SEQ ID NO: 3759037 - RNA, 16 nt, Human
gccagccuccucugga

SEQ ID NO: 3759038 - RNA, 19 nt, Human
gccagccugcuccuuccca

SEQ ID NO: 3759039 - RNA, 13 nt, Human
gccagccuggccu

SEQ ID NO: 3759040 - RNA, 14 nt, Human
gccagccuggccuc

SEQ ID NO: 3759041 - RNA, 16 nt, Human
gccagccuggccuccu

SEQ ID NO: 3759042 - RNA, 12 nt, Human
gccagccuggcu

SEQ ID NO: 3759043 - RNA, 17 nt, Human
gccagccuggcuucugg

SEQ ID NO: 3759044 - RNA, 18 nt, Human
gccagccuggcuucugga

SEQ ID NO: 3759045 - RNA, 21 nt, Human
gccagccuggcuucuggagcc

SEQ ID NO: 3759046 - RNA, 15 nt, Human
gccagccuggggccu

SEQ ID NO: 3759047 - RNA, 17 nt, Human
gccagccuggggccugg

SEQ ID NO: 3759048 - RNA, 20 nt, Human
gccagccugucccauggaca

SEQ ID NO: 3759049 - RNA, 17 nt, Human
gccagccuuccucugca

SEQ ID NO: 3759050 - RNA, 19 nt, Human
gccagccuuccucugcagc

SEQ ID NO: 3759051 - RNA, 21 nt, Human
gccagccuuccucugcagcug

SEQ ID NO: 3759052 - RNA, 12 nt, Human
gccagccuugac

SEQ ID NO: 3759053 - RNA, 20 nt, Human
gccagccuugaccauucucc

SEQ ID NO: 3759054 - RNA, 16 nt, Human
gccagcgaacuugaca

SEQ ID NO: 3759055 - RNA, 20 nt, Human
gccagcgagcgcccagcucc

SEQ ID NO: 3759056 - RNA, 17 nt, Human
gccagcgccucccucca

SEQ ID NO: 3759057 - RNA, 22 nt, Human
gccagcgccucccuccacccca

SEQ ID NO: 3759058 - RNA, 12 nt, Human
gccagcguccuc

SEQ ID NO: 3759059 - RNA, 18 nt, Human
gccagcgucggucugugc

SEQ ID NO: 3759060 - RNA, 20 nt, Human
gccagcgucggucugugccc

SEQ ID NO: 3759061 - RNA, 21 nt, Human
gccagcgucggucugugcccc

SEQ ID NO: 3759062 - RNA, 22 nt, Human
gccagcgucggucugugccccu

SEQ ID NO: 3759063 - RNA, 16 nt, Human
gccagcuaaggggugg

SEQ ID NO: 3759064 - RNA, 14 nt, Human
gccagcucauuuca

SEQ ID NO: 3759065 - RNA, 13 nt, Human
gccagcucucagc

SEQ ID NO: 3759066 - RNA, 21 nt, Human
gccagcucuguucuuccucag

SEQ ID NO: 3759067 - RNA, 19 nt, Human
gccagcucuuccuagcugg

SEQ ID NO: 3759068 - RNA, 17 nt, Human
gccagcugaugacucaa

SEQ ID NO: 3759069 - RNA, 15 nt, Human
gccagcugccgacca

SEQ ID NO: 3759070 - RNA, 15 nt, Human
gccagcugcugagcc

SEQ ID NO: 3759071 - RNA, 18 nt, Human
gccagcugcugagccgca

SEQ ID NO: 3759072 - RNA, 17 nt, Human
gccagcugcuugggcuu

SEQ ID NO: 3759073 - RNA, 18 nt, Human
gccagcugcuugggcuuc

SEQ ID NO: 3759074 - RNA, 20 nt, Human
gccagcugcuugggcuucau

SEQ ID NO: 3759075 - RNA, 18 nt, Human
gccagcuggcagcagagu

SEQ ID NO: 3759076 - RNA, 18 nt, Human
gccagcuggccuuuguaa

SEQ ID NO: 3759077 - RNA, 22 nt, Human
gccagcuuggggccaccaaagc

SEQ ID NO: 3759078 - RNA, 15 nt, Human
gccagcuuguuuaca

SEQ ID NO: 3759079 - RNA, 17 nt, Human
gccagcuuguuuacaug

SEQ ID NO: 3759080 - RNA, 17 nt, Human
gccagcuuuuccucccu

SEQ ID NO: 3759081 - RNA, 22 nt, Human
gccaggaagcuuuggugagaac

SEQ ID NO: 3759082 - RNA, 17 nt, Human
gccaggaaguacuucca

SEQ ID NO: 3759083 - RNA, 21 nt, Human
gccaggaaguagcacaggcug

SEQ ID NO: 3759084 - RNA, 17 nt, Human
gccaggaauuucccagg

SEQ ID NO: 3759085 - RNA, 20 nt, Human
gccaggaauuucccaggacc

SEQ ID NO: 3759086 - RNA, 21 nt, Human
gccaggaauuucccaggaccc

SEQ ID NO: 3759087 - RNA, 22 nt, Human
gccaggaauuucccaggacccu

SEQ ID NO: 3759088 - RNA, 22 nt, Human
gccaggaccagucaaccugggc

SEQ ID NO: 3759089 - RNA, 19 nt, Human
gccaggacuccccaggcca

SEQ ID NO: 3759090 - RNA, 23 nt, Human
cuggcagggcuggccccagggca

SEQ ID NO: 3759091 - RNA, 18 nt, Human
cuggcagggugggaugga

SEQ ID NO: 3759092 - RNA, 19 nt, Human
cuggcaguccgugggacgg

SEQ ID NO: 3759093 - RNA, 22 nt, Human
cuggcaguccuggaagccagcu

SEQ ID NO: 3759094 - RNA, 19 nt, Human
cuggcaguggaacuaagaa

SEQ ID NO: 3759095 - RNA, 15 nt, Human
cuggcaguuuaaaaa

SEQ ID NO: 3759096 - RNA, 19 nt, Human
cuggcaguuuaaaaaaauu

SEQ ID NO: 3759097 - RNA, 15 nt, Human
cuggcauaguuucau

SEQ ID NO: 3759098 - RNA, 17 nt, Human
cuggcaucgcaccauuc

SEQ ID NO: 3759099 - RNA, 19 nt, Human
cuggcaucgcaccauucug

SEQ ID NO: 3759100 - RNA, 20 nt, Human
cuggcaucgcaccauucuga

SEQ ID NO: 3759101 - RNA, 23 nt, Human
cuggcaucgcaccauucugacuc

SEQ ID NO: 3759102 - RNA, 22 nt, Human
cuggcaucuuugcuauggggac

SEQ ID NO: 3759103 - RNA, 18 nt, Human
cuggcaugauccaagcaa

SEQ ID NO: 3759104 - RNA, 17 nt, Human
cuggcauggcaccuguc

SEQ ID NO: 3759105 - RNA, 18 nt, Human
cuggcaugggaaugaaug

SEQ ID NO: 3759106 - RNA, 24 nt, Human
cuggcaugggaaugaaugucagug

SEQ ID NO: 3759107 - RNA, 15 nt, Human
cuggcaugggagacc

SEQ ID NO: 3759108 - RNA, 18 nt, Human
cuggcaugucaacagcgu

SEQ ID NO: 3759109 - RNA, 15 nt, Human
cuggcauuacagcug

SEQ ID NO: 3759110 - RNA, 20 nt, Human
cuggcauuagaauuauuuaa

SEQ ID NO: 3759111 - RNA, 17 nt, Human
cuggcauugucccugug

SEQ ID NO: 3759112 - RNA, 17 nt, Human
cuggcauuuuauagaca

SEQ ID NO: 3759113 - RNA, 23 nt, Human
cuggcauuuuauagacacccugg

SEQ ID NO: 3759114 - RNA, 17 nt, Human
cuggccaaauagcaaag

SEQ ID NO: 3759115 - RNA, 23 nt, Human
cuggccaacaucgugaaacccug

SEQ ID NO: 3759116 - RNA, 18 nt, Human
cuggccaacauggcgaaa

SEQ ID NO: 3759117 - RNA, 15 nt, Human
cuggccaagcugagg

SEQ ID NO: 3759118 - RNA, 21 nt, Human
cuggccaagcugaggugccca

SEQ ID NO: 3759119 - RNA, 19 nt, Human
cuggccaccaccccccacu

SEQ ID NO: 3759120 - RNA, 20 nt, Human
cuggccaccaccccccacuc

SEQ ID NO: 3759121 - RNA, 21 nt, Human
cuggccaccaccccccacucu

SEQ ID NO: 3759122 - RNA, 16 nt, Human
cuggccaccaggcugg

SEQ ID NO: 3759123 - RNA, 19 nt, Human
cuggccaccaggcuggcgc

SEQ ID NO: 3759124 - RNA, 21 nt, Human
cuggccaccaggcuggcgcag

SEQ ID NO: 3759125 - RNA, 14 nt, Human
cuggccacgcagcc

SEQ ID NO: 3759126 - RNA, 21 nt, Human
cuggccacgcagccaggacac

SEQ ID NO: 3759127 - RNA, 20 nt, Human
cuggccacugcacagagcuc

SEQ ID NO: 3759128 - RNA, 17 nt, Human
cuggccagacacaggcc

SEQ ID NO: 3759129 - RNA, 19 nt, Human
cuggccagacacaggcccu

SEQ ID NO: 3759130 - RNA, 21 nt, Human
cuggccagacacaggcccucc

SEQ ID NO: 3759131 - RNA, 13 nt, Human
cuggccagaggcu

SEQ ID NO: 3759132 - RNA, 14 nt, Human
cuggccagaugcac

SEQ ID NO: 3759133 - RNA, 17 nt, Human
cuggccagaugcaccag

SEQ ID NO: 3759134 - RNA, 14 nt, Human
cuggccagccccac

SEQ ID NO: 3759135 - RNA, 16 nt, Human
cuggccagccccacag

SEQ ID NO: 3759136 - RNA, 18 nt, Human
cuggccagccccacagcc

SEQ ID NO: 3759137 - RNA, 19 nt, Human
cuggccagccgcucuccug

SEQ ID NO: 3759138 - RNA, 20 nt, Human
cuggccagccgcucuccugc

SEQ ID NO: 3759139 - RNA, 23 nt, Human
cuggccagccgcucuccugccac

SEQ ID NO: 3759140 - RNA, 15 nt, Human
cuggccagccugggg

SEQ ID NO: 3759141 - RNA, 19 nt, Human
cuggccagccuggggccug

SEQ ID NO: 3759142 - RNA, 20 nt, Human
cuggccagccuggggccugg

SEQ ID NO: 3759143 - RNA, 24 nt, Human
cuggccagccuggggccuggcagg

SEQ ID NO: 3759144 - RNA, 12 nt, Human
cuggccagcgag

SEQ ID NO: 3759145 - RNA, 13 nt, Human
cuggccaggagcu

SEQ ID NO: 3759146 - RNA, 17 nt, Human
cuggccaggagcucuuc

SEQ ID NO: 3759147 - RNA, 20 nt, Human
cuggccaggagcucuucagg

SEQ ID NO: 3759148 - RNA, 22 nt, Human
cuggccaggagcucuucaggcc

SEQ ID NO: 3759149 - RNA, 14 nt, Human
cuggccagggccac

SEQ ID NO: 3759150 - RNA, 22 nt, Human
cuggccaguccacccugccugc

SEQ ID NO: 3759151 - RNA, 15 nt, Human
cuggccaguccaggc

SEQ ID NO: 3759152 - RNA, 23 nt, Human
cuggccaguccaggcugccgugg

SEQ ID NO: 3759153 - RNA, 17 nt, Human
cuggccagugcccugau

SEQ ID NO: 3759154 - RNA, 21 nt, Human
cuggccagugcccugauccca

SEQ ID NO: 3759155 - RNA, 22 nt, Human
cuggccagugcccugaucccag

SEQ ID NO: 3759156 - RNA, 12 nt, Human
cuggccaucucu

SEQ ID NO: 3759157 - RNA, 20 nt, Human
cuggccauggagaaagcuga

SEQ ID NO: 3759158 - RNA, 16 nt, Human
cuggccauggccugca

SEQ ID NO: 3759159 - RNA, 10 nt, Human
cuggcccagc

SEQ ID NO: 3759160 - RNA, 11 nt, Human
cuggcccagcc

SEQ ID NO: 3759161 - RNA, 13 nt, Human
cuggcccagccaa

SEQ ID NO: 3759162 - RNA, 20 nt, Human
cuggcccagccaaacccugu

SEQ ID NO: 3759163 - RNA, 14 nt, Human
cuggcccagcccug

SEQ ID NO: 3759164 - RNA, 18 nt, Human
cuggcccagcccugcugg

SEQ ID NO: 3759165 - RNA, 19 nt, Human
cuggcccagcccugcuggc

SEQ ID NO: 3759166 - RNA, 20 nt, Human
cuggcccagcccugcuggcc

SEQ ID NO: 3759167 - RNA, 14 nt, Human
cuggcccagccggc

SEQ ID NO: 3759168 - RNA, 23 nt, Human
cuggcccagccggccucucuggc

SEQ ID NO: 3759169 - RNA, 15 nt, Human
cuggcccagccuuug

SEQ ID NO: 3759170 - RNA, 13 nt, Human
cuggcccagcggc

SEQ ID NO: 3759171 - RNA, 11 nt, Human
cuggcccaggg

SEQ ID NO: 3759172 - RNA, 17 nt, Human
cuggcccagggcaucug

SEQ ID NO: 3759173 - RNA, 19 nt, Human
cuggcccagggcccagagc

SEQ ID NO: 3759174 - RNA, 16 nt, Human
cuggcccauagaaaca

SEQ ID NO: 3759175 - RNA, 13 nt, Human
cuggcccaucaug

SEQ ID NO: 3759176 - RNA, 21 nt, Human
cuggcccauguauggccagga

SEQ ID NO: 3759177 - RNA, 12 nt, Human
cuggccccaccc

SEQ ID NO: 3759178 - RNA, 18 nt, Human
cuggccccagcccugcug

SEQ ID NO: 3759179 - RNA, 23 nt, Human
cuggccccagcccugcuggggau

SEQ ID NO: 3759180 - RNA, 16 nt, Human
cuggccccaggaccug

SEQ ID NO: 3759181 - RNA, 20 nt, Human
cuggccccaggaccuggcug

SEQ ID NO: 3759182 - RNA, 14 nt, Human
cuggccccagggca

SEQ ID NO: 3759183 - RNA, 15 nt, Human
cuggccccagggcac

SEQ ID NO: 3759184 - RNA, 16 nt, Human
cuggccccagggcacc

SEQ ID NO: 3759185 - RNA, 17 nt, Human
gcccaccaacaucccau

SEQ ID NO: 3759186 - RNA, 14 nt, Human
gcccaccagagcug

SEQ ID NO: 3759187 - RNA, 14 nt, Human
gcccaccagugacu

SEQ ID NO: 3759188 - RNA, 16 nt, Human
gcccaccccacccacu

SEQ ID NO: 3759189 - RNA, 21 nt, Human
gcccaccccacccacuucugc

SEQ ID NO: 3759190 - RNA, 22 nt, Human
gcccacccccucaagccaaucc

SEQ ID NO: 3759191 - RNA, 14 nt, Human
gcccacccccugcc

SEQ ID NO: 3759192 - RNA, 13 nt, Human
gcccaccccgcuc

SEQ ID NO: 3759193 - RNA, 17 nt, Human
gcccaccccgcucugca

SEQ ID NO: 3759194 - RNA, 18 nt, Human
gcccaccccgcucugcau

SEQ ID NO: 3759195 - RNA, 14 nt, Human
gcccacccuccugu

SEQ ID NO: 3759196 - RNA, 19 nt, Human
gcccacccuccugucuucc

SEQ ID NO: 3759197 - RNA, 22 nt, Human
gcccacccuccugucuucccag

SEQ ID NO: 3759198 - RNA, 18 nt, Human
gcccacccugcugcuggu

SEQ ID NO: 3759199 - RNA, 19 nt, Human
gcccacccugcugcuggug

SEQ ID NO: 3759200 - RNA, 19 nt, Human
gcccaccgcaugcccccuc

SEQ ID NO: 3759201 - RNA, 15 nt, Human
gcccaccuaccuuca

SEQ ID NO: 3759202 - RNA, 21 nt, Human
gcccaccuccccacgcccucc

SEQ ID NO: 3759203 - RNA, 13 nt, Human
gcccaccugccca

SEQ ID NO: 3759204 - RNA, 15 nt, Human
gcccaccugccggcc

SEQ ID NO: 3759205 - RNA, 14 nt, Human
gcccaccugccugg

SEQ ID NO: 3759206 - RNA, 21 nt, Human
gcccaccugccuggccggcca

SEQ ID NO: 3759207 - RNA, 19 nt, Human
gcccaccuggccaccugag

SEQ ID NO: 3759208 - RNA, 21 nt, Human
gcccaccuggccucugcacuc

SEQ ID NO: 3759209 - RNA, 13 nt, Human
gcccaccuuggcu

SEQ ID NO: 3759210 - RNA, 16 nt, Human
gcccaccuuggcucaa

SEQ ID NO: 3759211 - RNA, 19 nt, Human
gcccacgacacugcagccc

SEQ ID NO: 3759212 - RNA, 14 nt, Human
gcccacgcccccac

SEQ ID NO: 3759213 - RNA, 16 nt, Human
gcccacgcccccacug

SEQ ID NO: 3759214 - RNA, 15 nt, Human
gcccacgcuggagug

SEQ ID NO: 3759215 - RNA, 21 nt, Human
gcccacgcuggagugcaguga

SEQ ID NO: 3759216 - RNA, 23 nt, Human
gcccacgcuggagugcagugagc

SEQ ID NO: 3759217 - RNA, 19 nt, Human
gcccacggcuaagaggcug

SEQ ID NO: 3759218 - RNA, 20 nt, Human
gcccacggcuaagaggcugc

SEQ ID NO: 3759219 - RNA, 17 nt, Human
gcccacguagggcggca

SEQ ID NO: 3759220 - RNA, 15 nt, Human
gcccacguccuguca

SEQ ID NO: 3759221 - RNA, 14 nt, Human
gcccacucccugca

SEQ ID NO: 3759222 - RNA, 16 nt, Human
gcccacuccugcucug

SEQ ID NO: 3759223 - RNA, 17 nt, Human
gcccacuccugcucugc

SEQ ID NO: 3759224 - RNA, 18 nt, Human
gcccacuccugcucugcu

SEQ ID NO: 3759225 - RNA, 19 nt, Human
gcccacugcccacccccuc

SEQ ID NO: 3759226 - RNA, 11 nt, Human
gcccacuggcc

SEQ ID NO: 3759227 - RNA, 15 nt, Human
gcccacuguacuugc

SEQ ID NO: 3759228 - RNA, 20 nt, Human
gcccacuguacuugcucuug

SEQ ID NO: 3759229 - RNA, 22 nt, Human
gcccacuguacuugcucuugau

SEQ ID NO: 3759230 - RNA, 16 nt, Human
gcccacuguccugggc

SEQ ID NO: 3759231 - RNA, 21 nt, Human
gcccacuguccugggccugca

SEQ ID NO: 3759232 - RNA, 19 nt, Human
gcccacuguccugggcgcc

SEQ ID NO: 3759233 - RNA, 20 nt, Human
gcccacugugccucagagac

SEQ ID NO: 3759234 - RNA, 16 nt, Human
gcccacugugcguggg

SEQ ID NO: 3759235 - RNA, 14 nt, Human
gcccacuucugcca

SEQ ID NO: 3759236 - RNA, 18 nt, Human
gcccagaaaaggacagaa

SEQ ID NO: 3759237 - RNA, 19 nt, Human
gcccagaaaaggacagaaa

SEQ ID NO: 3759238 - RNA, 17 nt, Human
gcccagaacuucccuga

SEQ ID NO: 3759239 - RNA, 23 nt, Human
gcccagaauaaguuauugcaguu

SEQ ID NO: 3759240 - RNA, 17 nt, Human
gcccagaauacugaugg

SEQ ID NO: 3759241 - RNA, 16 nt, Human
gcccagaaugaggcug

SEQ ID NO: 3759242 - RNA, 17 nt, Human
gcccagaaugaggcugc

SEQ ID NO: 3759243 - RNA, 21 nt, Human
gcccagaccccucuggccagg

SEQ ID NO: 3759244 - RNA, 13 nt, Human
gcccagagaacag

SEQ ID NO: 3759245 - RNA, 20 nt, Human
gcccagagacauacuugaag

SEQ ID NO: 3759246 - RNA, 23 nt, Human
gcccagagacauacuugaagggc

SEQ ID NO: 3759247 - RNA, 23 nt, Human
gcccagagacccagcggacacac

SEQ ID NO: 3759248 - RNA, 12 nt, Human
gcccagagacuu

SEQ ID NO: 3759249 - RNA, 20 nt, Human
gcccagagagaagagcccca

SEQ ID NO: 3759250 - RNA, 23 nt, Human
gcccagagagaagagccccacuc

SEQ ID NO: 3759251 - RNA, 17 nt, Human
gcccagagaugccucca

SEQ ID NO: 3759252 - RNA, 20 nt, Human
gcccagagaugccuccaccg

SEQ ID NO: 3759253 - RNA, 21 nt, Human
gcccagagaugggacugggag

SEQ ID NO: 3759254 - RNA, 14 nt, Human
gcccagagcaggaa

SEQ ID NO: 3759255 - RNA, 16 nt, Human
gcccagagcaggaagc

SEQ ID NO: 3759256 - RNA, 14 nt, Human
gcccagagcccagc

SEQ ID NO: 3759257 - RNA, 16 nt, Human
gcccagagcccagcuc

SEQ ID NO: 3759258 - RNA, 19 nt, Human
gcccagagcugggugagug

SEQ ID NO: 3759259 - RNA, 20 nt, Human
gcccagaggacucccaaccc

SEQ ID NO: 3759260 - RNA, 14 nt, Human
gcccagaggagcug

SEQ ID NO: 3759261 - RNA, 23 nt, Human
gcccagaggagggcagcagaagg

SEQ ID NO: 3759262 - RNA, 14 nt, Human
gcccagaggcacag

SEQ ID NO: 3759263 - RNA, 19 nt, Human
gcccagaggcacagccggg

SEQ ID NO: 3759264 - RNA, 23 nt, Human
gcccagaggccaacacugugggu

SEQ ID NO: 3759265 - RNA, 22 nt, Human
gcccagagggccugcaagggag

SEQ ID NO: 3759266 - RNA, 18 nt, Human
gcccagagggucuggggg

SEQ ID NO: 3759267 - RNA, 18 nt, Human
gcccagagguaacagaac

SEQ ID NO: 3759268 - RNA, 20 nt, Human
gcccagagguaacagaacag

SEQ ID NO: 3759269 - RNA, 18 nt, Human
gcccagaguccccccacu

SEQ ID NO: 3759270 - RNA, 23 nt, Human
gcccagaguccccccacucccag

SEQ ID NO: 3759271 - RNA, 14 nt, Human
gcccagaguugcug

SEQ ID NO: 3759272 - RNA, 23 nt, Human
gcccagaguugcugggagcugaa

SEQ ID NO: 3759273 - RNA, 17 nt, Human
gcccagaucagcuccua

SEQ ID NO: 3759274 - RNA, 15 nt, Human
gcccagaucccagaa

SEQ ID NO: 3759275 - RNA, 22 nt, Human
gcccagauuaaagucuuuaucc

SEQ ID NO: 3759276 - RNA, 19 nt, Human
gcccagauuccccuguguc

SEQ ID NO: 3759277 - RNA, 18 nt, Human
gcccagauugugccacug

SEQ ID NO: 3759278 - RNA, 19 nt, Human
gcccagcacaugugcugcc

SEQ ID NO: 3759279 - RNA, 20 nt, Human
gcccagcacugcuugaggaa

SEQ ID NO: 3759280 - RNA, 19 nt, Human
gccccguguccugccuguc

SEQ ID NO: 3759281 - RNA, 15 nt, Human
gccccguucuguuug

SEQ ID NO: 3759282 - RNA, 15 nt, Human
gccccuaaucucugu

SEQ ID NO: 3759283 - RNA, 19 nt, Human
gccccuaaucucuguagga

SEQ ID NO: 3759284 - RNA, 16 nt, Human
gccccuaccccacacc

SEQ ID NO: 3759285 - RNA, 18 nt, Human
gccccuacccuggacuug

SEQ ID NO: 3759286 - RNA, 18 nt, Human
gccccuagaaacccaagc

SEQ ID NO: 3759287 - RNA, 15 nt, Human
gccccuagcccagga

SEQ ID NO: 3759288 - RNA, 18 nt, Human
gccccuagcccaggagag

SEQ ID NO: 3759289 - RNA, 19 nt, Human
gccccuagcccaggagaga

SEQ ID NO: 3759290 - RNA, 20 nt, Human
gccccuagccgguuccuguc

SEQ ID NO: 3759291 - RNA, 21 nt, Human
gccccuagcgcuaucucccug

SEQ ID NO: 3759292 - RNA, 20 nt, Human
gccccuauguaguccgugcu

SEQ ID NO: 3759293 - RNA, 16 nt, Human
gccccucaaccuccug

SEQ ID NO: 3759294 - RNA, 12 nt, Human
gccccuccagcu

SEQ ID NO: 3759295 - RNA, 15 nt, Human
gccccucccacacac

SEQ ID NO: 3759296 - RNA, 22 nt, Human
gccccucccacacccaaagcug

SEQ ID NO: 3759297 - RNA, 16 nt, Human
gccccucccaccacag

SEQ ID NO: 3759298 - RNA, 23 nt, Human
gccccucccccaacccccacccc

SEQ ID NO: 3759299 - RNA, 12 nt, Human
gccccucccccg

SEQ ID NO: 3759300 - RNA, 19 nt, Human
gccccucccccguccugga

SEQ ID NO: 3759301 - RNA, 22 nt, Human
gccccucccccguccuggaggu

SEQ ID NO: 3759302 - RNA, 16 nt, Human
gccccuccccuccaaa

SEQ ID NO: 3759303 - RNA, 17 nt, Human
gccccuccccuccaaaa

SEQ ID NO: 3759304 - RNA, 15 nt, Human
gccccucccuaccuc

SEQ ID NO: 3759305 - RNA, 17 nt, Human
gccccucccuaccucaa

SEQ ID NO: 3759306 - RNA, 18 nt, Human
gccccucccuaccucaac

SEQ ID NO: 3759307 - RNA, 21 nt, Human
gccccucccuaccucaaccug

SEQ ID NO: 3759308 - RNA, 15 nt, Human
gccccucccuccucu

SEQ ID NO: 3759309 - RNA, 20 nt, Human
gccccucccucuccagcagg

SEQ ID NO: 3759310 - RNA, 12 nt, Human
gccccucccuuc

SEQ ID NO: 3759311 - RNA, 15 nt, Human
gccccucccuucaac

SEQ ID NO: 3759312 - RNA, 18 nt, Human
gccccuccuccagccccu

SEQ ID NO: 3759313 - RNA, 17 nt, Human
gccccuccucugccacc

SEQ ID NO: 3759314 - RNA, 22 nt, Human
gccccuccucugccaccucccc

SEQ ID NO: 3759315 - RNA, 23 nt, Human
gccccuccucugccaccuccccu

SEQ ID NO: 3759316 - RNA, 23 nt, Human
gccccucgccuguggagcucagc

SEQ ID NO: 3759317 - RNA, 14 nt, Human
gccccucucaccaa

SEQ ID NO: 3759318 - RNA, 18 nt, Human
gccccucuccccagggaa

SEQ ID NO: 3759319 - RNA, 23 nt, Human
gccccucucccuugggcucugau

SEQ ID NO: 3759320 - RNA, 17 nt, Human
gccccucuccuucuuag

SEQ ID NO: 3759321 - RNA, 22 nt, Human
gccccucuggucgcuccugccc

SEQ ID NO: 3759322 - RNA, 18 nt, Human
gccccucuugccccccac

SEQ ID NO: 3759323 - RNA, 21 nt, Human
gccccucuugccccccacccc

SEQ ID NO: 3759324 - RNA, 22 nt, Human
gccccucuuggagaagucucag

SEQ ID NO: 3759325 - RNA, 23 nt, Human
gccccugcagcacggacaauaaa

SEQ ID NO: 3759326 - RNA, 14 nt, Human
gccccugcaucccc

SEQ ID NO: 3759327 - RNA, 20 nt, Human
gccccugcauccccuuggcu

SEQ ID NO: 3759328 - RNA, 11 nt, Human
gccccugccag

SEQ ID NO: 3759329 - RNA, 21 nt, Human
gccccugccauuguagcgucu

SEQ ID NO: 3759330 - RNA, 22 nt, Human
gccccugccccgucaccaucuc

SEQ ID NO: 3759331 - RNA, 13 nt, Human
gccccugcccggc

SEQ ID NO: 3759332 - RNA, 14 nt, Human
gccccugcccggcu

SEQ ID NO: 3759333 - RNA, 12 nt, Human
gccccugccucu

SEQ ID NO: 3759334 - RNA, 15 nt, Human
gccccugccucucug

SEQ ID NO: 3759335 - RNA, 16 nt, Human
gccccugccucucugc

SEQ ID NO: 3759336 - RNA, 20 nt, Human
gccccugccucucugcaggu

SEQ ID NO: 3759337 - RNA, 23 nt, Human
gccccugccucucugcagguccc

SEQ ID NO: 3759338 - RNA, 22 nt, Human
gccccugccugccauguaccuc

SEQ ID NO: 3759339 - RNA, 10 nt, Human
gccccugcug

SEQ ID NO: 3759340 - RNA, 16 nt, Human
gccccugcugccuccc

SEQ ID NO: 3759341 - RNA, 15 nt, Human
gccccugcugcuguc

SEQ ID NO: 3759342 - RNA, 18 nt, Human
gccccugcuucuccagcc

SEQ ID NO: 3759343 - RNA, 19 nt, Human
gccccugcuucuccagccu

SEQ ID NO: 3759344 - RNA, 11 nt, Human
gccccuggagg

SEQ ID NO: 3759345 - RNA, 16 nt, Human
gccccuggaugcagcc

SEQ ID NO: 3759346 - RNA, 13 nt, Human
gccccuggcacuc

SEQ ID NO: 3759347 - RNA, 13 nt, Human
gccccuggcagag

SEQ ID NO: 3759348 - RNA, 17 nt, Human
gccccuggcagagaugc

SEQ ID NO: 3759349 - RNA, 12 nt, Human
gccccuggcagc

SEQ ID NO: 3759350 - RNA, 19 nt, Human
gccccuggcccagcggccc

SEQ ID NO: 3759351 - RNA, 22 nt, Human
gccccuggcccagcggccccuc

SEQ ID NO: 3759352 - RNA, 13 nt, Human
gccccuggcccca

SEQ ID NO: 3759353 - RNA, 15 nt, Human
gccccuggccgcgcu

SEQ ID NO: 3759354 - RNA, 19 nt, Human
gccccugggcuuggccugc

SEQ ID NO: 3759355 - RNA, 16 nt, Human
gccccuggggccuaga

SEQ ID NO: 3759356 - RNA, 21 nt, Human
gccccugggucagucuggugg

SEQ ID NO: 3759357 - RNA, 16 nt, Human
gccccugguccugagg

SEQ ID NO: 3759358 - RNA, 22 nt, Human
gccccuuagacagaggcccuca

SEQ ID NO: 3759359 - RNA, 15 nt, Human
gccccuuaggccagu

SEQ ID NO: 3759360 - RNA, 21 nt, Human
gccccuucauugauuuccugu

SEQ ID NO: 3759361 - RNA, 15 nt, Human
gccccuucccaucuc

SEQ ID NO: 3759362 - RNA, 21 nt, Human
gccccuuccgccacuggggcu

SEQ ID NO: 3759363 - RNA, 20 nt, Human
gccccuuccuugcucugcac

SEQ ID NO: 3759364 - RNA, 14 nt, Human
gccccuuccuuuaa

SEQ ID NO: 3759365 - RNA, 21 nt, Human
gccccuucuacacucuccugg

SEQ ID NO: 3759366 - RNA, 23 nt, Human
gccccuucuagguggcaaggcug

SEQ ID NO: 3759367 - RNA, 18 nt, Human
gccccuucugcucagcuc

SEQ ID NO: 3759368 - RNA, 15 nt, Human
gccccuuuacggaca

SEQ ID NO: 3759369 - RNA, 22 nt, Human
gccccuuuacggacacccccuc

SEQ ID NO: 3759370 - RNA, 23 nt, Human
gccccuuucccuuguagcuccuc

SEQ ID NO: 3759371 - RNA, 17 nt, Human
gccccuuugcugacccu

SEQ ID NO: 3759372 - RNA, 20 nt, Human
gccccuuugcugacccuccc

SEQ ID NO: 3759373 - RNA, 16 nt, Human
gccccuuugggcccug

SEQ ID NO: 3759374 - RNA, 17 nt, Human
gccccuuugggcccugc

SEQ ID NO: 3759375 - RNA, 18 nt, Human
gccccuuugggcccugca

SEQ ID NO: 3759376 - RNA, 20 nt, Human
gccccuuugggcccugcaug

SEQ ID NO: 3759377 - RNA, 21 nt, Human
gccccuuugggcccugcaugu

SEQ ID NO: 3759378 - RNA, 21 nt, Human
gccccuuuucacucccuccau

SEQ ID NO: 3759379 - RNA, 15 nt, Human
gcccgacagccuggc

SEQ ID NO: 3759380 - RNA, 16 nt, Human
gcccgacagccuggca

SEQ ID NO: 3759381 - RNA, 19 nt, Human
gcccgacauggcuccggcc

SEQ ID NO: 3759382 - RNA, 24 nt, Human
gcccgacauggcuccggccucugc

SEQ ID NO: 3759383 - RNA, 13 nt, Human
gcccgacuugcug

SEQ ID NO: 3759384 - RNA, 12 nt, Human
gcccgagcagcu

SEQ ID NO: 3759385 - RNA, 20 nt, Human
gcccgagcagcugagcaggg

SEQ ID NO: 3759386 - RNA, 22 nt, Human
gcccgagcagcugagcagggcc

SEQ ID NO: 3759387 - RNA, 13 nt, Human
gcccgagcuggug

SEQ ID NO: 3759388 - RNA, 19 nt, Human
gcccgaggaggugucucag

SEQ ID NO: 3759389 - RNA, 16 nt, Human
gcccgagguggcugcc

SEQ ID NO: 3759390 - RNA, 17 nt, Human
gcccgagguggcugccu

SEQ ID NO: 3759391 - RNA, 19 nt, Human
gcccgagguggcugccugg

SEQ ID NO: 3759392 - RNA, 22 nt, Human
gcccgagguggcugccuggagc

SEQ ID NO: 3759393 - RNA, 17 nt, Human
gcccgauccuccccugg

SEQ ID NO: 3759394 - RNA, 21 nt, Human
gcccgauccuccccuggacuc

SEQ ID NO: 3759395 - RNA, 24 nt, Human
gcccgcacacccucacucugccag

SEQ ID NO: 3759396 - RNA, 17 nt, Human
gcccgcacagcagccug

SEQ ID NO: 3759397 - RNA, 18 nt, Human
gcccgcacagcagccugc

SEQ ID NO: 3759398 - RNA, 15 nt, Human
gcccgcacccccacc

SEQ ID NO: 3759399 - RNA, 17 nt, Human
gcccgcacccccacccu

SEQ ID NO: 3759400 - RNA, 22 nt, Human
gcccgcaugcagcagcuugcug

SEQ ID NO: 3759401 - RNA, 17 nt, Human
gcccgcccacuguccug

SEQ ID NO: 3759402 - RNA, 19 nt, Human
gcccgcccacuguccuggg

SEQ ID NO: 3759403 - RNA, 17 nt, Human
gcccgccugccaguccu

SEQ ID NO: 3759404 - RNA, 13 nt, Human
gcccgccuggcag

SEQ ID NO: 3759405 - RNA, 18 nt, Human
gcccgccuggcagaacug

SEQ ID NO: 3759406 - RNA, 17 nt, Human
gcccgcgccacaggacc

SEQ ID NO: 3759407 - RNA, 23 nt, Human
gcccgcgcccucgcccccgcccc

SEQ ID NO: 3759408 - RNA, 17 nt, Human
gcccgcugaguggacug

SEQ ID NO: 3759409 - RNA, 12 nt, Human
gcccgcugggcu

SEQ ID NO: 3759410 - RNA, 17 nt, Human
gcccgcugggcugagcc

SEQ ID NO: 3759411 - RNA, 12 nt, Human
gcccgcuugccu

SEQ ID NO: 3759412 - RNA, 18 nt, Human
gcccgcuugccucggcuc

SEQ ID NO: 3759413 - RNA, 23 nt, Human
gcccggagcugccccucucuggg

SEQ ID NO: 3759414 - RNA, 16 nt, Human
gcccggaugcugcuuc

SEQ ID NO: 3759415 - RNA, 15 nt, Human
gcccggauucuggga

SEQ ID NO: 3759416 - RNA, 18 nt, Human
gcccggccagccaugucu

SEQ ID NO: 3759417 - RNA, 20 nt, Human
gcccggccgcuccaccagca

SEQ ID NO: 3759418 - RNA, 15 nt, Human
gcccggccugcuccc

SEQ ID NO: 3759419 - RNA, 22 nt, Human
gcccggccugcucccagcagcc

SEQ ID NO: 3759420 - RNA, 15 nt, Human
gcccggcgcccucug

SEQ ID NO: 3759421 - RNA, 15 nt, Human
gcccggcgccuggcc

SEQ ID NO: 3759422 - RNA, 23 nt, Human
gcccggcgccuggccuccaggcc

SEQ ID NO: 3759423 - RNA, 18 nt, Human
gcccgggaaggucaccag

SEQ ID NO: 3759424 - RNA, 13 nt, Human
gcccgggagccua

SEQ ID NO: 3759425 - RNA, 12 nt, Human
gcccgggcucug

SEQ ID NO: 3759426 - RNA, 20 nt, Human
gcccgggcucugccucccau

SEQ ID NO: 3759427 - RNA, 13 nt, Human
gcccgggcugccu

SEQ ID NO: 3759428 - RNA, 17 nt, Human
gcccggggcagcugcca

SEQ ID NO: 3759429 - RNA, 17 nt, Human
cugggcacacucugcca

SEQ ID NO: 3759430 - RNA, 18 nt, Human
cugggcacacucugccag

SEQ ID NO: 3759431 - RNA, 21 nt, Human
cugggcacacucugccagcaa

SEQ ID NO: 3759432 - RNA, 20 nt, Human
cugggcaccacaaaauauac

SEQ ID NO: 3759433 - RNA, 19 nt, Human
cugggcacugcucucaccu

SEQ ID NO: 3759434 - RNA, 18 nt, Human
cugggcagaaggaagacu

SEQ ID NO: 3759435 - RNA, 16 nt, Human
cugggcagaaggccaa

SEQ ID NO: 3759436 - RNA, 13 nt, Human
cugggcagaccuu

SEQ ID NO: 3759437 - RNA, 16 nt, Human
cugggcagaggaaagc

SEQ ID NO: 3759438 - RNA, 20 nt, Human
cugggcagaggaaagcaaag

SEQ ID NO: 3759439 - RNA, 16 nt, Human
cugggcagccaggcug

SEQ ID NO: 3759440 - RNA, 17 nt, Human
cugggcagccaggcugc

SEQ ID NO: 3759441 - RNA, 13 nt, Human
cugggcagcccgc

SEQ ID NO: 3759442 - RNA, 20 nt, Human
cugggcagcccgcuaggcuc

SEQ ID NO: 3759443 - RNA, 13 nt, Human
cugggcagcugcc

SEQ ID NO: 3759444 - RNA, 14 nt, Human
cugggcagcugccu

SEQ ID NO: 3759445 - RNA, 12 nt, Human
cugggcagcugu

SEQ ID NO: 3759446 - RNA, 16 nt, Human
cugggcagcugucccu

SEQ ID NO: 3759447 - RNA, 17 nt, Human
cugggcaggacucagcu

SEQ ID NO: 3759448 - RNA, 20 nt, Human
cugggcaugguaccagcccu

SEQ ID NO: 3759449 - RNA, 19 nt, Human
cugggccaacucaccugag

SEQ ID NO: 3759450 - RNA, 18 nt, Human
cugggccaaguuccucua

SEQ ID NO: 3759451 - RNA, 18 nt, Human
cugggccacuucugggug

SEQ ID NO: 3759452 - RNA, 14 nt, Human
cugggcccagaagg

SEQ ID NO: 3759453 - RNA, 14 nt, Human
cugggcccagaggc

SEQ ID NO: 3759454 - RNA, 17 nt, Human
cugggcccaucucccug

SEQ ID NO: 3759455 - RNA, 19 nt, Human
cugggcccaucucccugcu

SEQ ID NO: 3759456 - RNA, 24 nt, Human
cugggccccaaacgggcugcccug

SEQ ID NO: 3759457 - RNA, 13 nt, Human
cugggccccacca

SEQ ID NO: 3759458 - RNA, 14 nt, Human
cugggccccaccac

SEQ ID NO: 3759459 - RNA, 16 nt, Human
cugggccccaccaccu

SEQ ID NO: 3759460 - RNA, 18 nt, Human
cugggccccaccaccuag

SEQ ID NO: 3759461 - RNA, 12 nt, Human
cugggccccagc

SEQ ID NO: 3759462 - RNA, 15 nt, Human
cugggccccagccca

SEQ ID NO: 3759463 - RNA, 17 nt, Human
cugggccccccagcuca

SEQ ID NO: 3759464 - RNA, 10 nt, Human
cugggccccu

SEQ ID NO: 3759465 - RNA, 19 nt, Human
cugggccccucccuaccuc

SEQ ID NO: 3759466 - RNA, 22 nt, Human
cugggccccucccuaccucaac

SEQ ID NO: 3759467 - RNA, 16 nt, Human
cugggccccugccucu

SEQ ID NO: 3759468 - RNA, 23 nt, Human
cugggccccugccucucugcagg

SEQ ID NO: 3759469 - RNA, 17 nt, Human
cugggcccgauuuggua

SEQ ID NO: 3759470 - RNA, 13 nt, Human
cugggcccugggg

SEQ ID NO: 3759471 - RNA, 14 nt, Human
cugggcccuggggc

SEQ ID NO: 3759472 - RNA, 15 nt, Human
cugggcccuggggcc

SEQ ID NO: 3759473 - RNA, 16 nt, Human
cugggccgcugccacg

SEQ ID NO: 3759474 - RNA, 24 nt, Human
cugggccguaucuccggcucccag

SEQ ID NO: 3759475 - RNA, 17 nt, Human
cugggccuauggagagc

SEQ ID NO: 3759476 - RNA, 21 nt, Human
cugggccuauggagagcccug

SEQ ID NO: 3759477 - RNA, 22 nt, Human
cugggccuauggagagcccugg

SEQ ID NO: 3759478 - RNA, 20 nt, Human
cugggccuccucacaacaug

SEQ ID NO: 3759479 - RNA, 23 nt, Human
cugggccuccucuaacaggggcu

SEQ ID NO: 3759480 - RNA, 17 nt, Human
cugggccucggacccca

SEQ ID NO: 3759481 - RNA, 12 nt, Human
cugggccugcug

SEQ ID NO: 3759482 - RNA, 15 nt, Human
cugggccugcugcug

SEQ ID NO: 3759483 - RNA, 16 nt, Human
cugggccugcugcuga

SEQ ID NO: 3759484 - RNA, 20 nt, Human
cugggccugcugcugagaac

SEQ ID NO: 3759485 - RNA, 15 nt, Human
cugggccuggucuca

SEQ ID NO: 3759486 - RNA, 11 nt, Human
cugggccuugg

SEQ ID NO: 3759487 - RNA, 18 nt, Human
cugggccuuggccuggag

SEQ ID NO: 3759488 - RNA, 14 nt, Human
cugggccuugggcu

SEQ ID NO: 3759489 - RNA, 17 nt, Human
cugggccuugggcuccg

SEQ ID NO: 3759490 - RNA, 16 nt, Human
cugggcgcccuggaag

SEQ ID NO: 3759491 - RNA, 18 nt, Human
cugggcgcccuggaagcc

SEQ ID NO: 3759492 - RNA, 22 nt, Human
cugggcggcgggcggcuggguc

SEQ ID NO: 3759493 - RNA, 18 nt, Human
cugggcuagguagaaaaa

SEQ ID NO: 3759494 - RNA, 18 nt, Human
cugggcuauggacacagg

SEQ ID NO: 3759495 - RNA, 19 nt, Human
cugggcuauggacacaggg

SEQ ID NO: 3759496 - RNA, 24 nt, Human
cugggcucaagcaauccuccugag

SEQ ID NO: 3759497 - RNA, 18 nt, Human
cugggcucccgggcccca

SEQ ID NO: 3759498 - RNA, 21 nt, Human
cugggcucccuucccaccucu

SEQ ID NO: 3759499 - RNA, 22 nt, Human
cugggcucccuucccaccucuc

SEQ ID NO: 3759500 - RNA, 22 nt, Human
cugggcuccggaggacucacca

SEQ ID NO: 3759501 - RNA, 14 nt, Human
cugggcuccuggac

SEQ ID NO: 3759502 - RNA, 21 nt, Human
cugggcucggaggcugccccc

SEQ ID NO: 3759503 - RNA, 14 nt, Human
cugggcucuccacc

SEQ ID NO: 3759504 - RNA, 15 nt, Human
cugggcucuccaccu

SEQ ID NO: 3759505 - RNA, 19 nt, Human
cugggcucuccaccucagc

SEQ ID NO: 3759506 - RNA, 20 nt, Human
cugggcucucgcggccucuu

SEQ ID NO: 3759507 - RNA, 13 nt, Human
cugggcucugagu

SEQ ID NO: 3759508 - RNA, 13 nt, Human
cugggcucugugg

SEQ ID NO: 3759509 - RNA, 15 nt, Human
cugggcucugugggc

SEQ ID NO: 3759510 - RNA, 20 nt, Human
cugggcucugugggcugcac

SEQ ID NO: 3759511 - RNA, 21 nt, Human
cugggcucugugggcugcacu

SEQ ID NO: 3759512 - RNA, 12 nt, Human
cugggcugacug

SEQ ID NO: 3759513 - RNA, 13 nt, Human
cugggcugagaga

SEQ ID NO: 3759514 - RNA, 15 nt, Human
cugggcugagccccu

SEQ ID NO: 3759515 - RNA, 12 nt, Human
cugggcugaggg

SEQ ID NO: 3759516 - RNA, 13 nt, Human
cugggcugaggga

SEQ ID NO: 3759517 - RNA, 16 nt, Human
cugggcugagggagcc

SEQ ID NO: 3759518 - RNA, 17 nt, Human
cugggcugccaugugaa

SEQ ID NO: 3759519 - RNA, 20 nt, Human
cugggcugccaugugaagag

SEQ ID NO: 3759520 - RNA, 16 nt, Human
cugggcuggaugagcu

SEQ ID NO: 3759521 - RNA, 22 nt, Human
cugggcuggccaguuggaacca

SEQ ID NO: 3759522 - RNA, 22 nt, Human
cugggcugggcacugcucucac

SEQ ID NO: 3759523 - RNA, 15 nt, Human
cugggcuggggccug

SEQ ID NO: 3759524 - RNA, 18 nt, Human
cugggcugggugcgaccc

SEQ ID NO: 3759525 - RNA, 23 nt, Human
cugggcuguaacguggcacuggu

SEQ ID NO: 3759526 - RNA, 12 nt, Human
cugggcugugcu

SEQ ID NO: 3759527 - RNA, 14 nt, Human
cugggcuguuggca

SEQ ID NO: 3759528 - RNA, 15 nt, Human
cugggcuguuggcac

SEQ ID NO: 3759529 - RNA, 19 nt, Human
cugggcuucaucuggcaac

SEQ ID NO: 3759530 - RNA, 13 nt, Human
cugggcuuccugg

SEQ ID NO: 3759531 - RNA, 14 nt, Human
cugggcuuccugga

SEQ ID NO: 3759532 - RNA, 15 nt, Human
cugggcuuccuggag

SEQ ID NO: 3759533 - RNA, 22 nt, Human
cugggcuuccuggagcagaagc

SEQ ID NO: 3759534 - RNA, 17 nt, Human
cugggcuuggccugcug

SEQ ID NO: 3759535 - RNA, 20 nt, Human
cugggcuuggccugcuguga

SEQ ID NO: 3759536 - RNA, 20 nt, Human
cugggcuuggggaccagagc

SEQ ID NO: 3759537 - RNA, 18 nt, Human
cugggcuugucuguagau

SEQ ID NO: 3759538 - RNA, 16 nt, Human
cuggggaaagacacug

SEQ ID NO: 3759539 - RNA, 19 nt, Human
cuggggaaagacacugccu

SEQ ID NO: 3759540 - RNA, 21 nt, Human
cuggggaaagacacugccugg

SEQ ID NO: 3759541 - RNA, 17 nt, Human
cuggggaaccugacccc

SEQ ID NO: 3759542 - RNA, 18 nt, Human
cuggggaagacaguggcc

SEQ ID NO: 3759543 - RNA, 15 nt, Human
cuggggaaggagcca

SEQ ID NO: 3759544 - RNA, 16 nt, Human
cuggggaaggagccag

SEQ ID NO: 3759545 - RNA, 18 nt, Human
cuggggaaggagccaguu

SEQ ID NO: 3759546 - RNA, 12 nt, Human
cuggggacccac

SEQ ID NO: 3759547 - RNA, 20 nt, Human
cuggggaccugguacccucc

SEQ ID NO: 3759548 - RNA, 17 nt, Human
cuggggacggggggccc

SEQ ID NO: 3759549 - RNA, 17 nt, Human
cuggggacuuggccucu

SEQ ID NO: 3759550 - RNA, 13 nt, Human
cuggggacuugug

SEQ ID NO: 3759551 - RNA, 13 nt, Human
cuggggagaaagu

SEQ ID NO: 3759552 - RNA, 14 nt, Human
cuggggagaaagua

SEQ ID NO: 3759553 - RNA, 16 nt, Human
cuggggagaggaaaga

SEQ ID NO: 3759554 - RNA, 12 nt, Human
cuggggagcccg

SEQ ID NO: 3759555 - RNA, 22 nt, Human
cuggggagcgggucugcuccca

SEQ ID NO: 3759556 - RNA, 14 nt, Human
cuggggaggaccug

SEQ ID NO: 3759557 - RNA, 17 nt, Human
cuggggagugggacaga

SEQ ID NO: 3759558 - RNA, 18 nt, Human
cuggggauacuggcaaag

SEQ ID NO: 3759559 - RNA, 16 nt, Human
cuggggaugucucuca

SEQ ID NO: 3759560 - RNA, 22 nt, Human
cuggggaugugggagggagcag

SEQ ID NO: 3759561 - RNA, 16 nt, Human
cuggggauugggcccc

SEQ ID NO: 3759562 - RNA, 21 nt, Human
cuggggcaagucccugacucu

SEQ ID NO: 3759563 - RNA, 12 nt, Human
cuggggcacagu

SEQ ID NO: 3759564 - RNA, 17 nt, Human
cuggggcacaguccagg

SEQ ID NO: 3759565 - RNA, 19 nt, Human
cuggggcagccucugggcc

SEQ ID NO: 3759566 - RNA, 19 nt, Human
cuggggcaggcugggccau

SEQ ID NO: 3759567 - RNA, 17 nt, Human
cuggggcauccaugggg

SEQ ID NO: 3759568 - RNA, 18 nt, Human
cuggggccaggcuggguc

SEQ ID NO: 3759569 - RNA, 23 nt, Human
cuggggccuagcgaucucuccug

SEQ ID NO: 3759570 - RNA, 15 nt, Human
cuggggccucagacg

SEQ ID NO: 3759571 - RNA, 11 nt, Human
cuggggccucc

SEQ ID NO: 3759572 - RNA, 12 nt, Human
cuggggccucca

SEQ ID NO: 3759573 - RNA, 17 nt, Human
cuggggccuccagaacu

SEQ ID NO: 3759574 - RNA, 15 nt, Human
cuggggccugacugc

SEQ ID NO: 3759575 - RNA, 12 nt, Human
cuggggccuggc

SEQ ID NO: 3759576 - RNA, 16 nt, Human
cuggggccuguacugc

SEQ ID NO: 3759577 - RNA, 18 nt, Human
cuggggccuguacugccu

SEQ ID NO: 3759578 - RNA, 22 nt, Human
cuggggccuguacugccugcuu

SEQ ID NO: 3759579 - RNA, 16 nt, Human
cuggggcguggggagg

SEQ ID NO: 3759580 - RNA, 17 nt, Human
gcccgguaagagcaaaa

SEQ ID NO: 3759581 - RNA, 17 nt, Human
gcccguaaacacgccug

SEQ ID NO: 3759582 - RNA, 18 nt, Human
gcccgucauguuccucaa

SEQ ID NO: 3759583 - RNA, 14 nt, Human
gcccguccugccug

SEQ ID NO: 3759584 - RNA, 15 nt, Human
gcccguccugccugu

SEQ ID NO: 3759585 - RNA, 14 nt, Human
gcccgucucagugu

SEQ ID NO: 3759586 - RNA, 18 nt, Human
gcccgucuguccaucugc

SEQ ID NO: 3759587 - RNA, 23 nt, Human
gcccgucugugugugaccccucc

SEQ ID NO: 3759588 - RNA, 18 nt, Human
gcccgucuucagccuagc

SEQ ID NO: 3759589 - RNA, 15 nt, Human
gcccguggggccggg

SEQ ID NO: 3759590 - RNA, 22 nt, Human
gcccguggggccggggcuucug

SEQ ID NO: 3759591 - RNA, 17 nt, Human
gcccguguggccccuuc

SEQ ID NO: 3759592 - RNA, 17 nt, Human
gcccguugaggaugagg

SEQ ID NO: 3759593 - RNA, 22 nt, Human
gcccguugucucccuggcccuc

SEQ ID NO: 3759594 - RNA, 18 nt, Human
gcccuaaacccuguuccu

SEQ ID NO: 3759595 - RNA, 15 nt, Human
gcccuaaggaucucu

SEQ ID NO: 3759596 - RNA, 14 nt, Human
gcccuaagggagug

SEQ ID NO: 3759597 - RNA, 16 nt, Human
gcccuaaugcgcaggc

SEQ ID NO: 3759598 - RNA, 23 nt, Human
gcccuaaugcgcaggcuggcccu

SEQ ID NO: 3759599 - RNA, 15 nt, Human
gcccuaaugucugua

SEQ ID NO: 3759600 - RNA, 23 nt, Human
gcccuaauucagccauguacaga

SEQ ID NO: 3759601 - RNA, 16 nt, Human
gcccuacagagcugug

SEQ ID NO: 3759602 - RNA, 20 nt, Human
gcccuacagagcuguggagg

SEQ ID NO: 3759603 - RNA, 16 nt, Human
gcccuacagaggucuc

SEQ ID NO: 3759604 - RNA, 20 nt, Human
gcccuaccagcgcccgcugg

SEQ ID NO: 3759605 - RNA, 12 nt, Human
gcccuacuggga

SEQ ID NO: 3759606 - RNA, 13 nt, Human
gcccuagagcaca

SEQ ID NO: 3759607 - RNA, 21 nt, Human
gcccuagagcacacuguagca

SEQ ID NO: 3759608 - RNA, 14 nt, Human
gcccuagagccugc

SEQ ID NO: 3759609 - RNA, 19 nt, Human
gcccuagagccugccugga

SEQ ID NO: 3759610 - RNA, 20 nt, Human
gcccuagagccugccuggag

SEQ ID NO: 3759611 - RNA, 23 nt, Human
gcccuagagccugccuggagcgu

SEQ ID NO: 3759612 - RNA, 19 nt, Human
gcccuagcccagcgcucug

SEQ ID NO: 3759613 - RNA, 14 nt, Human
gcccuaggccuggc

SEQ ID NO: 3759614 - RNA, 17 nt, Human
gcccuaggcuccgucag

SEQ ID NO: 3759615 - RNA, 14 nt, Human
gcccuauggaugug

SEQ ID NO: 3759616 - RNA, 17 nt, Human
gcccuauuucuugauaa

SEQ ID NO: 3759617 - RNA, 23 nt, Human
gcccucaagacccuuuuggguuu

SEQ ID NO: 3759618 - RNA, 19 nt, Human
gcccucaaggccucccaca

SEQ ID NO: 3759619 - RNA, 15 nt, Human
gcccucaaucccagc

SEQ ID NO: 3759620 - RNA, 16 nt, Human
gcccucacacacccug

SEQ ID NO: 3759621 - RNA, 18 nt, Human
gcccucaccccugguucu

SEQ ID NO: 3759622 - RNA, 14 nt, Human
gcccucacccgccc

SEQ ID NO: 3759623 - RNA, 17 nt, Human
gcccucagaacccuugg

SEQ ID NO: 3759624 - RNA, 15 nt, Human
gcccucagauguccc

SEQ ID NO: 3759625 - RNA, 19 nt, Human
gcccucaggggacuugaau

SEQ ID NO: 3759626 - RNA, 23 nt, Human
gcccucaggucagggugaggaug

SEQ ID NO: 3759627 - RNA, 21 nt, Human
gcccucaucuaugaggaaagg

SEQ ID NO: 3759628 - RNA, 16 nt, Human
gcccucauggccccuc

SEQ ID NO: 3759629 - RNA, 18 nt, Human
gcccucauggccccucug

SEQ ID NO: 3759630 - RNA, 22 nt, Human
gcccucauggccccucugaccu

SEQ ID NO: 3759631 - RNA, 17 nt, Human
gcccucauuacggcucc

SEQ ID NO: 3759632 - RNA, 18 nt, Human
gcccucauuacggcuccu

SEQ ID NO: 3759633 - RNA, 21 nt, Human
gcccucauuacggcuccucuc

SEQ ID NO: 3759634 - RNA, 22 nt, Human
gcccuccaagaccuucuccuuc

SEQ ID NO: 3759635 - RNA, 20 nt, Human
gcccuccacagccgcagccu

SEQ ID NO: 3759636 - RNA, 21 nt, Human
gcccuccacgccggcucuucc

SEQ ID NO: 3759637 - RNA, 15 nt, Human
gcccuccacugcccu

SEQ ID NO: 3759638 - RNA, 16 nt, Human
gcccuccacugcccuc

SEQ ID NO: 3759639 - RNA, 18 nt, Human
gcccuccacugcccucug

SEQ ID NO: 3759640 - RNA, 18 nt, Human
gcccuccagagccccaca

SEQ ID NO: 3759641 - RNA, 22 nt, Human
gcccuccagagccccacagccc

SEQ ID NO: 3759642 - RNA, 17 nt, Human
gcccuccagcucuuucc

SEQ ID NO: 3759643 - RNA, 21 nt, Human
gcccuccagcucuuuccuccu

SEQ ID NO: 3759644 - RNA, 14 nt, Human
gcccuccaggcuuu

SEQ ID NO: 3759645 - RNA, 16 nt, Human
gcccuccaucccgaca

SEQ ID NO: 3759646 - RNA, 14 nt, Human
gcccucccaucccg

SEQ ID NO: 3759647 - RNA, 13 nt, Human
gcccuccccagag

SEQ ID NO: 3759648 - RNA, 14 nt, Human
gcccuccccaggaa

SEQ ID NO: 3759649 - RNA, 17 nt, Human
gcccuccccaucccaug

SEQ ID NO: 3759650 - RNA, 19 nt, Human
gcccuccccauggagccag

SEQ ID NO: 3759651 - RNA, 12 nt, Human
gcccuccccucc

SEQ ID NO: 3759652 - RNA, 13 nt, Human
gcccuccccuccc

SEQ ID NO: 3759653 - RNA, 16 nt, Human
gcccuccccuccccug

SEQ ID NO: 3759654 - RNA, 18 nt, Human
gcccuccccuccccugcu

SEQ ID NO: 3759655 - RNA, 23 nt, Human
gcccuccccuccggacuggugcc

SEQ ID NO: 3759656 - RNA, 13 nt, Human
gcccucccgcccc

SEQ ID NO: 3759657 - RNA, 15 nt, Human
gcccucccgccccuu

SEQ ID NO: 3759658 - RNA, 19 nt, Human
gcccucccuccccagcucc

SEQ ID NO: 3759659 - RNA, 21 nt, Human
gcccucccuguccuccucgga

SEQ ID NO: 3759660 - RNA, 18 nt, Human
gcccucccuguuccccag

SEQ ID NO: 3759661 - RNA, 22 nt, Human
gcccucccuguuccccagagaa

SEQ ID NO: 3759662 - RNA, 20 nt, Human
gcccucccuucucccuggau

SEQ ID NO: 3759663 - RNA, 22 nt, Human
gcccuccgaccacuuccagggg

SEQ ID NO: 3759664 - RNA, 20 nt, Human
gcccuccucccucccagcuc

SEQ ID NO: 3759665 - RNA, 12 nt, Human
gcccuccucucc

SEQ ID NO: 3759666 - RNA, 21 nt, Human
gcccuccugugcucagcccug

SEQ ID NO: 3759667 - RNA, 17 nt, Human
gcccuccuuguccaccc

SEQ ID NO: 3759668 - RNA, 19 nt, Human
gcccuccuuguccacccac

SEQ ID NO: 3759669 - RNA, 13 nt, Human
gcccuccuuucug

SEQ ID NO: 3759670 - RNA, 20 nt, Human
gcccuccuuucugugcccua

SEQ ID NO: 3759671 - RNA, 14 nt, Human
gcccucgcugccag

SEQ ID NO: 3759672 - RNA, 15 nt, Human
gcccucguggccagc

SEQ ID NO: 3759673 - RNA, 17 nt, Human
gcccucguggccagccc

SEQ ID NO: 3759674 - RNA, 20 nt, Human
gcccucguggccagcccggc

SEQ ID NO: 3759675 - RNA, 13 nt, Human
gcccucucccacc

SEQ ID NO: 3759676 - RNA, 19 nt, Human
gcccucucccacccucuuc

SEQ ID NO: 3759677 - RNA, 11 nt, Human
gcccucucccc

SEQ ID NO: 3759678 - RNA, 14 nt, Human
gcccucuccccugc

SEQ ID NO: 3759679 - RNA, 16 nt, Human
gcccucuccccugccc

SEQ ID NO: 3759680 - RNA, 20 nt, Human
gcccucuccccugcccccug

SEQ ID NO: 3759681 - RNA, 22 nt, Human
gcccucuccccugcccccugca

SEQ ID NO: 3759682 - RNA, 17 nt, Human
gcccucucccucuaggc

SEQ ID NO: 3759683 - RNA, 21 nt, Human
gcccucucccuuacccuggga

SEQ ID NO: 3759684 - RNA, 22 nt, Human
gcccucucccuuacccugggaa

SEQ ID NO: 3759685 - RNA, 14 nt, Human
gcccucuccugggc

SEQ ID NO: 3759686 - RNA, 16 nt, Human
gcccucuccugggcag

SEQ ID NO: 3759687 - RNA, 16 nt, Human
gcccucuccuuccuua

SEQ ID NO: 3759688 - RNA, 20 nt, Human
gcccucucugaaggaggcca

SEQ ID NO: 3759689 - RNA, 23 nt, Human
gcccucucugaaggaggccaccu

SEQ ID NO: 3759690 - RNA, 17 nt, Human
gcccucugaacuugccu

SEQ ID NO: 3759691 - RNA, 22 nt, Human
gcccucugcauccucuggagcc

SEQ ID NO: 3759692 - RNA, 16 nt, Human
gcccucugcccacucc

SEQ ID NO: 3759693 - RNA, 18 nt, Human
gcccucugcccacucccu

SEQ ID NO: 3759694 - RNA, 22 nt, Human
gcccucugcccacucccugcaa

SEQ ID NO: 3759695 - RNA, 18 nt, Human
gcccucuggaguggccac

SEQ ID NO: 3759696 - RNA, 13 nt, Human
gcccucugggcuc

SEQ ID NO: 3759697 - RNA, 15 nt, Human
gcccucugggcucug

SEQ ID NO: 3759698 - RNA, 13 nt, Human
gcccucuguccug

SEQ ID NO: 3759699 - RNA, 12 nt, Human
gcccucuuccug

SEQ ID NO: 3759700 - RNA, 13 nt, Human
gcccucuucuuac

SEQ ID NO: 3759701 - RNA, 17 nt, Human
gcccugacauuggagcc

SEQ ID NO: 3759702 - RNA, 14 nt, Human
gcccugacccugug

SEQ ID NO: 3759703 - RNA, 13 nt, Human
gcccugaccuccc

SEQ ID NO: 3759704 - RNA, 16 nt, Human
gcccugaccucccagc

SEQ ID NO: 3759705 - RNA, 21 nt, Human
gcccugagccagggucuccag

SEQ ID NO: 3759706 - RNA, 13 nt, Human
gcccugagcucgg

SEQ ID NO: 3759707 - RNA, 16 nt, Human
gcccugaggaaggagg

SEQ ID NO: 3759708 - RNA, 14 nt, Human
gcccugaggugugg

SEQ ID NO: 3759709 - RNA, 24 nt, Human
gcccugaggugugggggcugcagc

SEQ ID NO: 3759710 - RNA, 21 nt, Human
gcccugaguggaucuccaagg

SEQ ID NO: 3759711 - RNA, 22 nt, Human
gcccugaguggaucuccaagga

SEQ ID NO: 3759712 - RNA, 16 nt, Human
gcccugaguuccuagc

SEQ ID NO: 3759713 - RNA, 22 nt, Human
gcccugauguguccucagggag

SEQ ID NO: 3759714 - RNA, 21 nt, Human
gcccugcaaaaggacucucag

SEQ ID NO: 3759715 - RNA, 23 nt, Human
gcccugcaauguaucccuucuca

SEQ ID NO: 3759716 - RNA, 17 nt, Human
gcccugcaccaugcugc

SEQ ID NO: 3759717 - RNA, 22 nt, Human
gcccugcaccaugcugcugggg

SEQ ID NO: 3759718 - RNA, 14 nt, Human
gcccugcacugucc

SEQ ID NO: 3759719 - RNA, 17 nt, Human
gcccugcacuguccugc

SEQ ID NO: 3759720 - RNA, 19 nt, Human
gcccugcacuguccugcuc

SEQ ID NO: 3759721 - RNA, 14 nt, Human
gcccugcagacccu

SEQ ID NO: 3759722 - RNA, 19 nt, Human
gcccugcagacccugcccu

SEQ ID NO: 3759723 - RNA, 15 nt, Human
gcccugcagagggca

SEQ ID NO: 3759724 - RNA, 15 nt, Human
gcccugcaugggcca

SEQ ID NO: 3759725 - RNA, 18 nt, Human
gcccugcaugggccagcc

SEQ ID NO: 3759726 - RNA, 11 nt, Human
gcccugcaugu

SEQ ID NO: 3759727 - RNA, 13 nt, Human
gcccugccaccug

SEQ ID NO: 3759728 - RNA, 14 nt, Human
gcccugccaccugu

SEQ ID NO: 3759729 - RNA, 11 nt, Human
gcccugccacu

SEQ ID NO: 3759730 - RNA, 16 nt, Human
aaccgucuguuaugcu

SEQ ID NO: 3759731 - RNA, 22 nt, Human
aaccgucuguuaugcugugaca

SEQ ID NO: 3759732 - RNA, 23 nt, Human
aaccgugagcaggaaggccuggg

SEQ ID NO: 3759733 - RNA, 18 nt, Human
aaccguggcccuuccugg

SEQ ID NO: 3759734 - RNA, 18 nt, Human
aaccgugguaugucugcc

SEQ ID NO: 3759735 - RNA, 20 nt, Human
aaccguguuugucucuucug

SEQ ID NO: 3759736 - RNA, 15 nt, Human
aaccguuauuauaau

SEQ ID NO: 3759737 - RNA, 13 nt, Human
aaccuaaaaaaga

SEQ ID NO: 3759738 - RNA, 14 nt, Human
aaccuaaaaaagau

SEQ ID NO: 3759739 - RNA, 16 nt, Human
aaccuaaccugugucu

SEQ ID NO: 3759740 - RNA, 18 nt, Human
aaccuaaccugugucugc

SEQ ID NO: 3759741 - RNA, 15 nt, Human
aaccuaacuguaucu

SEQ ID NO: 3759742 - RNA, 17 nt, Human
aaccuaacuguaucuug

SEQ ID NO: 3759743 - RNA, 21 nt, Human
aaccuaaucaccauguaagca

SEQ ID NO: 3759744 - RNA, 18 nt, Human
aaccuaccaccccuuccu

SEQ ID NO: 3759745 - RNA, 20 nt, Human
aaccuacuuucauacugaag

SEQ ID NO: 3759746 - RNA, 19 nt, Human
aaccuaggagugccccauu

SEQ ID NO: 3759747 - RNA, 21 nt, Human
aaccuaguuaaagaaaggaaa

SEQ ID NO: 3759748 - RNA, 15 nt, Human
aaccuauuucucuuu

SEQ ID NO: 3759749 - RNA, 15 nt, Human
aaccucaaagugacu

SEQ ID NO: 3759750 - RNA, 17 nt, Human
aaccucaacugccuacu

SEQ ID NO: 3759751 - RNA, 20 nt, Human
aaccucaaguaaacuccccu

SEQ ID NO: 3759752 - RNA, 13 nt, Human
aaccucacucuug

SEQ ID NO: 3759753 - RNA, 22 nt, Human
aaccucagacuuaccaggaagc

SEQ ID NO: 3759754 - RNA, 15 nt, Human
aaccucagcaaccug

SEQ ID NO: 3759755 - RNA, 13 nt, Human
aaccucagccugg

SEQ ID NO: 3759756 - RNA, 13 nt, Human
aaccucagcucug

SEQ ID NO: 3759757 - RNA, 18 nt, Human
aaccucagggcucccagg

SEQ ID NO: 3759758 - RNA, 18 nt, Human
aaccucaguaauuuagaa

SEQ ID NO: 3759759 - RNA, 18 nt, Human
aaccucagugucauuuau

SEQ ID NO: 3759760 - RNA, 14 nt, Human
aaccucauccucuc

SEQ ID NO: 3759761 - RNA, 16 nt, Human
aaccucaucuucuuca

SEQ ID NO: 3759762 - RNA, 14 nt, Human
aaccucauucccca

SEQ ID NO: 3759763 - RNA, 16 nt, Human
aaccucauugacaaga

SEQ ID NO: 3759764 - RNA, 17 nt, Human
aaccucccagaggucca

SEQ ID NO: 3759765 - RNA, 24 nt, Human
aaccucccagagguccagcccauc

SEQ ID NO: 3759766 - RNA, 19 nt, Human
aaccucccucuuguuuugu

SEQ ID NO: 3759767 - RNA, 20 nt, Human
aaccucccucuuguuuuguu

SEQ ID NO: 3759768 - RNA, 23 nt, Human
aaccucccucuuguuuuguuugu

SEQ ID NO: 3759769 - RNA, 19 nt, Human
aaccuccgccucccggguu

SEQ ID NO: 3759770 - RNA, 17 nt, Human
aaccuccgccucuuggg

SEQ ID NO: 3759771 - RNA, 14 nt, Human
aaccuccugggcua

SEQ ID NO: 3759772 - RNA, 15 nt, Human
aaccuccuguggaac

SEQ ID NO: 3759773 - RNA, 13 nt, Human
aaccuccuuucuc

SEQ ID NO: 3759774 - RNA, 17 nt, Human
aaccuccuuucucuucu

SEQ ID NO: 3759775 - RNA, 14 nt, Human
aaccucgaguacug

SEQ ID NO: 3759776 - RNA, 15 nt, Human
aaccucgaguacugu

SEQ ID NO: 3759777 - RNA, 14 nt, Human
aaccucgcccucuc

SEQ ID NO: 3759778 - RNA, 20 nt, Human
aaccucgcccucuccuuugu

SEQ ID NO: 3759779 - RNA, 19 nt, Human
aaccucgcuggacucucag

SEQ ID NO: 3759780 - RNA, 16 nt, Human
aaccucuacauauuua

SEQ ID NO: 3759781 - RNA, 21 nt, Human
aaccucuccucauguucugcu

SEQ ID NO: 3759782 - RNA, 20 nt, Human
aaccucugccuccuggguuc

SEQ ID NO: 3759783 - RNA, 18 nt, Human
aaccucugcuucccaggu

SEQ ID NO: 3759784 - RNA, 16 nt, Human
aaccucuguucagugu

SEQ ID NO: 3759785 - RNA, 16 nt, Human
aaccucuuugucuaca

SEQ ID NO: 3759786 - RNA, 19 nt, Human
aaccugacaaaaaaaaagu

SEQ ID NO: 3759787 - RNA, 20 nt, Human
aaccugacagaugucagccg

SEQ ID NO: 3759788 - RNA, 17 nt, Human
aaccugaccccugcuca

SEQ ID NO: 3759789 - RNA, 16 nt, Human
aaccugagauggcccu

SEQ ID NO: 3759790 - RNA, 18 nt, Human
aaccugagccccaaaagg

SEQ ID NO: 3759791 - RNA, 17 nt, Human
aaccugaggauucuauu

SEQ ID NO: 3759792 - RNA, 17 nt, Human
aaccugaugaaaauaaa

SEQ ID NO: 3759793 - RNA, 22 nt, Human
aaccugaugaaaauaaagaaug

SEQ ID NO: 3759794 - RNA, 15 nt, Human
aaccugauuguaaac

SEQ ID NO: 3759795 - RNA, 22 nt, Human
aaccugcaagggcuccccacug

SEQ ID NO: 3759796 - RNA, 18 nt, Human
aaccugcaggcguucucu

SEQ ID NO: 3759797 - RNA, 15 nt, Human
aaccugcaucuuuag

SEQ ID NO: 3759798 - RNA, 15 nt, Human
aaccugccagggaga

SEQ ID NO: 3759799 - RNA, 11 nt, Human
aaccugcccug

SEQ ID NO: 3759800 - RNA, 16 nt, Human
aaccugcccugccuga

SEQ ID NO: 3759801 - RNA, 17 nt, Human
aaccugcccugccugag

SEQ ID NO: 3759802 - RNA, 19 nt, Human
aaccugcccugccugaggg

SEQ ID NO: 3759803 - RNA, 13 nt, Human
aaccugcucuccu

SEQ ID NO: 3759804 - RNA, 19 nt, Human
aaccuggaaaaauuccaga

SEQ ID NO: 3759805 - RNA, 15 nt, Human
aaccuggagauggug

SEQ ID NO: 3759806 - RNA, 17 nt, Human
aaccuggagauggugga

SEQ ID NO: 3759807 - RNA, 19 nt, Human
aaccuggcaagcuagaacc

SEQ ID NO: 3759808 - RNA, 19 nt, Human
aaccuggccgcguuuagac

SEQ ID NO: 3759809 - RNA, 12 nt, Human
aaccuggccuuc

SEQ ID NO: 3759810 - RNA, 21 nt, Human
aaccugggaaagagauuuaaa

SEQ ID NO: 3759811 - RNA, 12 nt, Human
aaccuggggggc

SEQ ID NO: 3759812 - RNA, 19 nt, Human
aaccuggguccaaauaaaa

SEQ ID NO: 3759813 - RNA, 22 nt, Human
aaccuguauaacccuguuacaa

SEQ ID NO: 3759814 - RNA, 16 nt, Human
aaccuguaucuuucua

SEQ ID NO: 3759815 - RNA, 23 nt, Human
aaccuguccuaaggaaccuuccu

SEQ ID NO: 3759816 - RNA, 11 nt, Human
aaccuguccuu

SEQ ID NO: 3759817 - RNA, 15 nt, Human
aaccugucuccacug

SEQ ID NO: 3759818 - RNA, 22 nt, Human
aaccugucuccacugugccuuu

SEQ ID NO: 3759819 - RNA, 12 nt, Human
aaccugugucuc

SEQ ID NO: 3759820 - RNA, 17 nt, Human
aaccuuaaacaccccuc

SEQ ID NO: 3759821 - RNA, 13 nt, Human
aaccuuaagaccu

SEQ ID NO: 3759822 - RNA, 13 nt, Human
aaccuuaagauac

SEQ ID NO: 3759823 - RNA, 18 nt, Human
aaccuuaauauuucuuca

SEQ ID NO: 3759824 - RNA, 18 nt, Human
aaccuuaauuuauuauua

SEQ ID NO: 3759825 - RNA, 16 nt, Human
aaccuuacuuacagca

SEQ ID NO: 3759826 - RNA, 15 nt, Human
aaccuuauuguaccu

SEQ ID NO: 3759827 - RNA, 17 nt, Human
aaccuuauuguaccucu

SEQ ID NO: 3759828 - RNA, 19 nt, Human
aaccuucacacacagacug

SEQ ID NO: 3759829 - RNA, 17 nt, Human
aaccuuccaucucgcca

SEQ ID NO: 3759830 - RNA, 19 nt, Human
aaccuuccaucucgccacc

SEQ ID NO: 3759831 - RNA, 15 nt, Human
aaccuucguccuuuu

SEQ ID NO: 3759832 - RNA, 15 nt, Human
aaccuugagacagcu

SEQ ID NO: 3759833 - RNA, 19 nt, Human
aaccuuggcuuggcccugg

SEQ ID NO: 3759834 - RNA, 22 nt, Human
aaccuugguguaguugaacuga

SEQ ID NO: 3759835 - RNA, 13 nt, Human
aaccuuguauaaa

SEQ ID NO: 3759836 - RNA, 16 nt, Human
aaccuuguauaaauua

SEQ ID NO: 3759837 - RNA, 15 nt, Human
aaccuugugccuggc

SEQ ID NO: 3759838 - RNA, 18 nt, Human
aaccuuguuuauuaaauu

SEQ ID NO: 3759839 - RNA, 20 nt, Human
aaccuuguuuauuaaauugc

SEQ ID NO: 3759840 - RNA, 13 nt, Human
aaccuuguuuugg

SEQ ID NO: 3759841 - RNA, 19 nt, Human
aaccuuuacaugaggacuc

SEQ ID NO: 3759842 - RNA, 18 nt, Human
aaccuuucaaauuucaca

SEQ ID NO: 3759843 - RNA, 14 nt, Human
aaccuuucccucac

SEQ ID NO: 3759844 - RNA, 17 nt, Human
aaccuuucccucacccc

SEQ ID NO: 3759845 - RNA, 16 nt, Human
aaccuuucuauaauuu

SEQ ID NO: 3759846 - RNA, 14 nt, Human
aaccuuugugcccu

SEQ ID NO: 3759847 - RNA, 19 nt, Human
aaccuuuuacugguugcau

SEQ ID NO: 3759848 - RNA, 21 nt, Human
aaccuuuuacugguugcaugg

SEQ ID NO: 3759849 - RNA, 13 nt, Human
aaccuuuucuugu

SEQ ID NO: 3759850 - RNA, 18 nt, Human
aaccuuuuuauuucaaac

SEQ ID NO: 3759851 - RNA, 15 nt, Human
aaccuuuuuuaagau

SEQ ID NO: 3759852 - RNA, 17 nt, Human
aaccuuuuuuaagauuu

SEQ ID NO: 3759853 - RNA, 21 nt, Human
aaccuuuuuuaagauuuuucu

SEQ ID NO: 3759854 - RNA, 16 nt, Human
aacgaaauaucaaagu

SEQ ID NO: 3759855 - RNA, 12 nt, Human
aacgaagaaaaa

SEQ ID NO: 3759856 - RNA, 23 nt, Human
aacgaagaguucccuugaaacuu

SEQ ID NO: 3759857 - RNA, 17 nt, Human
aacgacaaaucugucug

SEQ ID NO: 3759858 - RNA, 18 nt, Human
aacgacugggcacugcca

SEQ ID NO: 3759859 - RNA, 23 nt, Human
aacgagaggggaagaguguacug

SEQ ID NO: 3759860 - RNA, 12 nt, Human
aacgaggaagcc

SEQ ID NO: 3759861 - RNA, 22 nt, Human
aacgaucacaaaugacuuuauu

SEQ ID NO: 3759862 - RNA, 16 nt, Human
aacgaugugucuguau

SEQ ID NO: 3759863 - RNA, 20 nt, Human
aacgaugugucuguauuuca

SEQ ID NO: 3759864 - RNA, 12 nt, Human
aacgauuuagaa

SEQ ID NO: 3759865 - RNA, 13 nt, Human
aacgauuuagaaa

SEQ ID NO: 3759866 - RNA, 15 nt, Human
aacgauuuuuaaaau

SEQ ID NO: 3759867 - RNA, 19 nt, Human
aacgcaaguucccaguugg

SEQ ID NO: 3759868 - RNA, 12 nt, Human
aacgcacaggaa

SEQ ID NO: 3759869 - RNA, 15 nt, Human
aacgcagacacugag

SEQ ID NO: 3759870 - RNA, 23 nt, Human
aacgcagcccuagagccugccug

SEQ ID NO: 3759871 - RNA, 13 nt, Human
aacgcauggagug

SEQ ID NO: 3759872 - RNA, 18 nt, Human
aacgccuccccugcccca

SEQ ID NO: 3759873 - RNA, 13 nt, Human
aacgcgcagaugu

SEQ ID NO: 3759874 - RNA, 13 nt, Human
aacgcguugaaau

SEQ ID NO: 3759875 - RNA, 15 nt, Human
aacgcguugaaauug

SEQ ID NO: 3759876 - RNA, 22 nt, Human
aacgcuaaagagcccuugccuc

SEQ ID NO: 3759877 - RNA, 16 nt, Human
aacgcuccaaagucau

SEQ ID NO: 3759878 - RNA, 19 nt, Human
aacgcucucuacucugcuu

SEQ ID NO: 3759879 - RNA, 15 nt, Human
aacgcugauuuaaag

SEQ ID NO: 3759880 - RNA, 11 nt, Human
aacgcugccug

SEQ ID NO: 3759881 - RNA, 16 nt, Human
gcccagcauugcuggu

SEQ ID NO: 3759882 - RNA, 17 nt, Human
gcccagccaaacccugu

SEQ ID NO: 3759883 - RNA, 23 nt, Human
gcccagccacggacgcuggcucc

SEQ ID NO: 3759884 - RNA, 14 nt, Human
gcccagccagcguc

SEQ ID NO: 3759885 - RNA, 14 nt, Human
gcccagccaggccc

SEQ ID NO: 3759886 - RNA, 17 nt, Human
gcccagccaggccccag

SEQ ID NO: 3759887 - RNA, 12 nt, Human
gcccagcccagc

SEQ ID NO: 3759888 - RNA, 14 nt, Human
gcccagcccagcug

SEQ ID NO: 3759889 - RNA, 16 nt, Human
gcccagcccagcugcu

SEQ ID NO: 3759890 - RNA, 17 nt, Human
gcccagccccacuccuc

SEQ ID NO: 3759891 - RNA, 12 nt, Human
gcccagccccua

SEQ ID NO: 3759892 - RNA, 17 nt, Human
gcccagccccuacugcu

SEQ ID NO: 3759893 - RNA, 20 nt, Human
gcccagccccuacugcugug

SEQ ID NO: 3759894 - RNA, 16 nt, Human
gcccagccccuucuga

SEQ ID NO: 3759895 - RNA, 17 nt, Human
gcccagccccuucugac

SEQ ID NO: 3759896 - RNA, 20 nt, Human
gcccagccccuucugaccca

SEQ ID NO: 3759897 - RNA, 13 nt, Human
gcccagcccggcu

SEQ ID NO: 3759898 - RNA, 16 nt, Human
gcccagcccuccccau

SEQ ID NO: 3759899 - RNA, 12 nt, Human
gcccagcccugc

SEQ ID NO: 3759900 - RNA, 15 nt, Human
gcccagcccugcugg

SEQ ID NO: 3759901 - RNA, 16 nt, Human
gcccagcccugcuggc

SEQ ID NO: 3759902 - RNA, 15 nt, Human
gcccagcccuguucu

SEQ ID NO: 3759903 - RNA, 13 nt, Human
gcccagccgaccc

SEQ ID NO: 3759904 - RNA, 22 nt, Human
gcccagccggccucucuggccu

SEQ ID NO: 3759905 - RNA, 14 nt, Human
gcccagccuggaug

SEQ ID NO: 3759906 - RNA, 17 nt, Human
gcccagccuuuguuccc

SEQ ID NO: 3759907 - RNA, 20 nt, Human
gcccagcggccccucccaca

SEQ ID NO: 3759908 - RNA, 23 nt, Human
gcccagcggccccucccacacac

SEQ ID NO: 3759909 - RNA, 21 nt, Human
gcccagcggcuugccugccug

SEQ ID NO: 3759910 - RNA, 12 nt, Human
gcccagcucagu

SEQ ID NO: 3759911 - RNA, 16 nt, Human
gcccagcuccagggcc

SEQ ID NO: 3759912 - RNA, 13 nt, Human
gcccagcucugaa

SEQ ID NO: 3759913 - RNA, 13 nt, Human
gcccagcugcacc

SEQ ID NO: 3759914 - RNA, 14 nt, Human
gcccagcugcaccu

SEQ ID NO: 3759915 - RNA, 23 nt, Human
gcccagcugcaccugccagccug

SEQ ID NO: 3759916 - RNA, 11 nt, Human
gcccagcugcu

SEQ ID NO: 3759917 - RNA, 13 nt, Human
gcccagcugcucu

SEQ ID NO: 3759918 - RNA, 15 nt, Human
gcccagcugcucugc

SEQ ID NO: 3759919 - RNA, 16 nt, Human
gcccagcugcucugcc

SEQ ID NO: 3759920 - RNA, 22 nt, Human
gcccagcugcucugcccagagc

SEQ ID NO: 3759921 - RNA, 18 nt, Human
gcccagcugggcucugcc

SEQ ID NO: 3759922 - RNA, 18 nt, Human
gcccagcugggucaggca

SEQ ID NO: 3759923 - RNA, 16 nt, Human
gcccagcuugggccca

SEQ ID NO: 3759924 - RNA, 17 nt, Human
gcccagcuugggcccag

SEQ ID NO: 3759925 - RNA, 12 nt, Human
gcccaggaaagg

SEQ ID NO: 3759926 - RNA, 18 nt, Human
gcccaggaaaggcuccag

SEQ ID NO: 3759927 - RNA, 19 nt, Human
gcccaggaaaggcuccagg

SEQ ID NO: 3759928 - RNA, 21 nt, Human
gcccaggaaaggcuccaggag

SEQ ID NO: 3759929 - RNA, 23 nt, Human
gcccaggaaaggcuccaggagca

SEQ ID NO: 3759930 - RNA, 11 nt, Human
gcccaggaagu

SEQ ID NO: 3759931 - RNA, 18 nt, Human
gcccaggaagucucaucu

SEQ ID NO: 3759932 - RNA, 13 nt, Human
gcccaggaccagc

SEQ ID NO: 3759933 - RNA, 18 nt, Human
gcccaggaccagcugggg

SEQ ID NO: 3759934 - RNA, 19 nt, Human
gcccaggacggggccggcc

SEQ ID NO: 3759935 - RNA, 21 nt, Human
gcccaggacggggccggccag

SEQ ID NO: 3759936 - RNA, 17 nt, Human
gcccaggagaaugcugc

SEQ ID NO: 3759937 - RNA, 11 nt, Human
gcccaggagac

SEQ ID NO: 3759938 - RNA, 22 nt, Human
gcccaggagagagaaagccagg

SEQ ID NO: 3759939 - RNA, 15 nt, Human
gcccaggagagccag

SEQ ID NO: 3759940 - RNA, 18 nt, Human
gcccaggagagccagccc

SEQ ID NO: 3759941 - RNA, 20 nt, Human
gcccaggagagccagcccuc

SEQ ID NO: 3759942 - RNA, 21 nt, Human
gcccaggagagccagcccucc

SEQ ID NO: 3759943 - RNA, 14 nt, Human
gcccaggagccuca

SEQ ID NO: 3759944 - RNA, 11 nt, Human
gcccaggagcu

SEQ ID NO: 3759945 - RNA, 14 nt, Human
gcccaggagcuccc

SEQ ID NO: 3759946 - RNA, 17 nt, Human
gcccaggagcuccccuc

SEQ ID NO: 3759947 - RNA, 24 nt, Human
gcccaggagcuccccuccccaacu

SEQ ID NO: 3759948 - RNA, 13 nt, Human
gcccaggagggag

SEQ ID NO: 3759949 - RNA, 16 nt, Human
gcccaggaguuuggcc

SEQ ID NO: 3759950 - RNA, 20 nt, Human
gcccaggaguuuggccagaa

SEQ ID NO: 3759951 - RNA, 17 nt, Human
gcccaggauacuggcac

SEQ ID NO: 3759952 - RNA, 15 nt, Human
gcccaggauggcuuu

SEQ ID NO: 3759953 - RNA, 11 nt, Human
gcccaggcagg

SEQ ID NO: 3759954 - RNA, 16 nt, Human
gcccaggcaggucuug

SEQ ID NO: 3759955 - RNA, 16 nt, Human
gcccaggccaggacuc

SEQ ID NO: 3759956 - RNA, 22 nt, Human
gcccaggccaggacucugcagc

SEQ ID NO: 3759957 - RNA, 23 nt, Human
gcccaggccaggacucugcagcc

SEQ ID NO: 3759958 - RNA, 13 nt, Human
gcccaggccaucu

SEQ ID NO: 3759959 - RNA, 18 nt, Human
gcccaggccaucuuccag

SEQ ID NO: 3759960 - RNA, 23 nt, Human
gcccaggccaucuuccagguggg

SEQ ID NO: 3759961 - RNA, 11 nt, Human
gcccaggcccc

SEQ ID NO: 3759962 - RNA, 13 nt, Human
gcccaggccggcc

SEQ ID NO: 3759963 - RNA, 12 nt, Human
gcccaggccuca

SEQ ID NO: 3759964 - RNA, 17 nt, Human
gcccaggccuccagcuc

SEQ ID NO: 3759965 - RNA, 18 nt, Human
gcccaggccuccuacagc

SEQ ID NO: 3759966 - RNA, 12 nt, Human
gcccaggcggga

SEQ ID NO: 3759967 - RNA, 18 nt, Human
gcccaggcugccgucccc

SEQ ID NO: 3759968 - RNA, 12 nt, Human
gcccaggcugga

SEQ ID NO: 3759969 - RNA, 15 nt, Human
gcccaggcuggagug

SEQ ID NO: 3759970 - RNA, 20 nt, Human
gcccaggcuggagugcaaug

SEQ ID NO: 3759971 - RNA, 19 nt, Human
gcccaggcuggagugcagu

SEQ ID NO: 3759972 - RNA, 20 nt, Human
gcccaggcuggagugcagug

SEQ ID NO: 3759973 - RNA, 16 nt, Human
gcccaggcuggccagc

SEQ ID NO: 3759974 - RNA, 19 nt, Human
gcccaggcuggccagcccc

SEQ ID NO: 3759975 - RNA, 20 nt, Human
gcccaggcuggccagcccca

SEQ ID NO: 3759976 - RNA, 22 nt, Human
gcccaggcuggccagccccaca

SEQ ID NO: 3759977 - RNA, 23 nt, Human
gcccaggcuggccagccccacag

SEQ ID NO: 3759978 - RNA, 14 nt, Human
gcccaggcuggcgu

SEQ ID NO: 3759979 - RNA, 15 nt, Human
gcccaggcuggcgug

SEQ ID NO: 3759980 - RNA, 19 nt, Human
gcccaggcuggcgugcagu

SEQ ID NO: 3759981 - RNA, 24 nt, Human
gcccaggcuggucuugaaguccug

SEQ ID NO: 3759982 - RNA, 22 nt, Human
gcccaggcugugcagcgcagcu

SEQ ID NO: 3759983 - RNA, 17 nt, Human
gcccagggacaccagcc

SEQ ID NO: 3759984 - RNA, 17 nt, Human
gcccagggagcggaaag

SEQ ID NO: 3759985 - RNA, 20 nt, Human
gcccagggagcggaaagcag

SEQ ID NO: 3759986 - RNA, 21 nt, Human
gcccagggagcggaaagcagc

SEQ ID NO: 3759987 - RNA, 15 nt, Human
gcccagggcaucugg

SEQ ID NO: 3759988 - RNA, 18 nt, Human
gcccagggcaucuugcug

SEQ ID NO: 3759989 - RNA, 23 nt, Human
gcccagggcaucuugcuggcuac

SEQ ID NO: 3759990 - RNA, 15 nt, Human
gcccagggccacucu

SEQ ID NO: 3759991 - RNA, 16 nt, Human
gcccagggcccagagc

SEQ ID NO: 3759992 - RNA, 18 nt, Human
gcccagggcccagagccc

SEQ ID NO: 3759993 - RNA, 19 nt, Human
gcccagggcccagagccca

SEQ ID NO: 3759994 - RNA, 20 nt, Human
gcccagggcccagagcccag

SEQ ID NO: 3759995 - RNA, 15 nt, Human
gcccagggcugggag

SEQ ID NO: 3759996 - RNA, 17 nt, Human
gcccagggcugggagga

SEQ ID NO: 3759997 - RNA, 21 nt, Human
gcccagggcugggaggaagga

SEQ ID NO: 3759998 - RNA, 21 nt, Human
gcccagggcuuuaaaaagaau

SEQ ID NO: 3759999 - RNA, 22 nt, Human
gcccaggggaggcggcacucca

SEQ ID NO: 3760000 - RNA, 19 nt, Human
gcccaggggcccacaggga

SEQ ID NO: 3760001 - RNA, 20 nt, Human
gcccaggggcccacagggaa

SEQ ID NO: 3760002 - RNA, 15 nt, Human
gcccaggggugcccc

SEQ ID NO: 3760003 - RNA, 23 nt, Human
gcccaggguggacuuagaaagca

SEQ ID NO: 3760004 - RNA, 23 nt, Human
gcccaggguucccccagcccugu

SEQ ID NO: 3760005 - RNA, 13 nt, Human
gcccagucccagc

SEQ ID NO: 3760006 - RNA, 17 nt, Human
gcccagucccagcagcc

SEQ ID NO: 3760007 - RNA, 18 nt, Human
gcccagucccagcagcca

SEQ ID NO: 3760008 - RNA, 13 nt, Human
gcccaguccccca

SEQ ID NO: 3760009 - RNA, 21 nt, Human
gcccagucccccaaccccagc

SEQ ID NO: 3760010 - RNA, 13 nt, Human
gcccaguccuggc

SEQ ID NO: 3760011 - RNA, 15 nt, Human
gcccaguccuggccu

SEQ ID NO: 3760012 - RNA, 17 nt, Human
gcccaguccuuccaccu

SEQ ID NO: 3760013 - RNA, 19 nt, Human
gcccagucuggaaugcagu

SEQ ID NO: 3760014 - RNA, 20 nt, Human
gcccagucuggaaugcagug

SEQ ID NO: 3760015 - RNA, 15 nt, Human
gcccagugcacugaa

SEQ ID NO: 3760016 - RNA, 11 nt, Human
gcccagugcau

SEQ ID NO: 3760017 - RNA, 12 nt, Human
gcccagugcaug

SEQ ID NO: 3760018 - RNA, 20 nt, Human
gcccagugcaugguggccag

SEQ ID NO: 3760019 - RNA, 17 nt, Human
gcccagugcccuggggc

SEQ ID NO: 3760020 - RNA, 18 nt, Human
gcccagugcccuggggcu

SEQ ID NO: 3760021 - RNA, 13 nt, Human
gcccaguggcugc

SEQ ID NO: 3760022 - RNA, 14 nt, Human
gcccaguuaaucuu

SEQ ID NO: 3760023 - RNA, 19 nt, Human
gcccaguucacccugauuu

SEQ ID NO: 3760024 - RNA, 22 nt, Human
gcccaguuggguggaugccugg

SEQ ID NO: 3760025 - RNA, 16 nt, Human
gcccauacucagccug

SEQ ID NO: 3760026 - RNA, 19 nt, Human
gcccauacucagccugcug

SEQ ID NO: 3760027 - RNA, 21 nt, Human
gcccauacucagccugcugcc

SEQ ID NO: 3760028 - RNA, 18 nt, Human
gcccauagaaacaugaca

SEQ ID NO: 3760029 - RNA, 17 nt, Human
gcccaucaauuauagaa

SEQ ID NO: 3760030 - RNA, 22 nt, Human
gcccaucaguguacccccgccc

SEQ ID NO: 3760031 - RNA, 19 nt, Human
gcccauccauuaggccagc

SEQ ID NO: 3760032 - RNA, 14 nt, Human
gcccauccccccuc

SEQ ID NO: 3760033 - RNA, 20 nt, Human
gcccauccccccucaccagg

SEQ ID NO: 3760034 - RNA, 22 nt, Human
gcccauccccuugaggucucag

SEQ ID NO: 3760035 - RNA, 12 nt, Human
gcccaucccugc

SEQ ID NO: 3760036 - RNA, 14 nt, Human
gcccauccugacca

SEQ ID NO: 3760037 - RNA, 15 nt, Human
gcccauccugaccag

SEQ ID NO: 3760038 - RNA, 18 nt, Human
gcccaucgccacaaacuc

SEQ ID NO: 3760039 - RNA, 13 nt, Human
gcccaucucccug

SEQ ID NO: 3760040 - RNA, 14 nt, Human
gcccaucucggagc

SEQ ID NO: 3760041 - RNA, 20 nt, Human
gcccaucucggagcaucccg

SEQ ID NO: 3760042 - RNA, 22 nt, Human
gcccaucugggggccucuucug

SEQ ID NO: 3760043 - RNA, 20 nt, Human
gcccaugagagcgcagcccg

SEQ ID NO: 3760044 - RNA, 23 nt, Human
gcccauggacaggcuggcuccag

SEQ ID NO: 3760045 - RNA, 23 nt, Human
gcccauggagauugaccuggaug

SEQ ID NO: 3760046 - RNA, 20 nt, Human
gcccaugggcacugcugggu

SEQ ID NO: 3760047 - RNA, 21 nt, Human
gcccaugggcacugcugggug

SEQ ID NO: 3760048 - RNA, 15 nt, Human
gcccauguauggcca

SEQ ID NO: 3760049 - RNA, 20 nt, Human
gcccauguauggccaggaag

SEQ ID NO: 3760050 - RNA, 21 nt, Human
gcccauguauggccaggaagu

SEQ ID NO: 3760051 - RNA, 19 nt, Human
gcccaugucgcgcucagca

SEQ ID NO: 3760052 - RNA, 21 nt, Human
gcccaugucgcgcucagcaug

SEQ ID NO: 3760053 - RNA, 15 nt, Human
gcccaugugugagug

SEQ ID NO: 3760054 - RNA, 22 nt, Human
gcccauguuaaguccucccuga

SEQ ID NO: 3760055 - RNA, 14 nt, Human
gcccauucuacuug

SEQ ID NO: 3760056 - RNA, 15 nt, Human
gcccauucuacuugc

SEQ ID NO: 3760057 - RNA, 17 nt, Human
gcccauucucucuccug

SEQ ID NO: 3760058 - RNA, 20 nt, Human
gcccauucugcccuguggga

SEQ ID NO: 3760059 - RNA, 22 nt, Human
gcccauuucgugagccccaucu

SEQ ID NO: 3760060 - RNA, 17 nt, Human
gcccauuuggagggccu

SEQ ID NO: 3760061 - RNA, 19 nt, Human
gccccaaaaccacagcccu

SEQ ID NO: 3760062 - RNA, 18 nt, Human
gccccaaaacucuccucu

SEQ ID NO: 3760063 - RNA, 19 nt, Human
gccccaaaacucuccucug

SEQ ID NO: 3760064 - RNA, 11 nt, Human
gccccaaaagg

SEQ ID NO: 3760065 - RNA, 14 nt, Human
gccccaaaggaaaa

SEQ ID NO: 3760066 - RNA, 21 nt, Human
gccccaaauauagcguuccca

SEQ ID NO: 3760067 - RNA, 18 nt, Human
gccccaacccaaaccugg

SEQ ID NO: 3760068 - RNA, 21 nt, Human
gccccaacccaaaccuggaga

SEQ ID NO: 3760069 - RNA, 14 nt, Human
gccccaacccccag

SEQ ID NO: 3760070 - RNA, 19 nt, Human
gccccaacccccagcaccc

SEQ ID NO: 3760071 - RNA, 21 nt, Human
gccccaacccguggaggcugc

SEQ ID NO: 3760072 - RNA, 22 nt, Human
gccccaacccguggaggcugcu

SEQ ID NO: 3760073 - RNA, 14 nt, Human
gccccaacccuucu

SEQ ID NO: 3760074 - RNA, 15 nt, Human
gccccaaccugcuga

SEQ ID NO: 3760075 - RNA, 15 nt, Human
gccccaacuccugga

SEQ ID NO: 3760076 - RNA, 17 nt, Human
gccccaacuccuggaag

SEQ ID NO: 3760077 - RNA, 20 nt, Human
gccccaacuccuuccagcua

SEQ ID NO: 3760078 - RNA, 21 nt, Human
gccccaacuccuuccagcuag

SEQ ID NO: 3760079 - RNA, 21 nt, Human
gccccaacucgggcucccggg

SEQ ID NO: 3760080 - RNA, 21 nt, Human
gccccaagaaggcuggggcua

SEQ ID NO: 3760081 - RNA, 19 nt, Human
gccccaaguccugaagagg

SEQ ID NO: 3760082 - RNA, 13 nt, Human
gccccaaguuggg

SEQ ID NO: 3760083 - RNA, 19 nt, Human
gccccaaucccuuuauuac

SEQ ID NO: 3760084 - RNA, 16 nt, Human
gccccacacuggggug

SEQ ID NO: 3760085 - RNA, 22 nt, Human
gccccacacuggggugccgccu

SEQ ID NO: 3760086 - RNA, 23 nt, Human
gccccacacuggggugccgccug

SEQ ID NO: 3760087 - RNA, 17 nt, Human
gccccacagcccacguc

SEQ ID NO: 3760088 - RNA, 23 nt, Human
gccccaccaccuaggccacuccu

SEQ ID NO: 3760089 - RNA, 13 nt, Human
gccccaccagugc

SEQ ID NO: 3760090 - RNA, 16 nt, Human
gccccaccagugccuc

SEQ ID NO: 3760091 - RNA, 12 nt, Human
gccccacccagg

SEQ ID NO: 3760092 - RNA, 17 nt, Human
gccccaccccagggcag

SEQ ID NO: 3760093 - RNA, 18 nt, Human
gccccaccccagggcagc

SEQ ID NO: 3760094 - RNA, 12 nt, Human
gccccacccucg

SEQ ID NO: 3760095 - RNA, 13 nt, Human
gccccacccucgg

SEQ ID NO: 3760096 - RNA, 16 nt, Human
gccccacccucgggga

SEQ ID NO: 3760097 - RNA, 22 nt, Human
gccccacccucggggauguguc

SEQ ID NO: 3760098 - RNA, 21 nt, Human
gccccacccucguggacaccu

SEQ ID NO: 3760099 - RNA, 12 nt, Human
gccccacccugg

SEQ ID NO: 3760100 - RNA, 14 nt, Human
gccccacccugggc

SEQ ID NO: 3760101 - RNA, 16 nt, Human
gccccacccugggccc

SEQ ID NO: 3760102 - RNA, 20 nt, Human
gccccacccugggcccuggg

SEQ ID NO: 3760103 - RNA, 24 nt, Human
gccccacccugggcccugggcugg

SEQ ID NO: 3760104 - RNA, 18 nt, Human
gccccaccugcagcuccc

SEQ ID NO: 3760105 - RNA, 14 nt, Human
gccccaccugccac

SEQ ID NO: 3760106 - RNA, 15 nt, Human
gccccaccugccacu

SEQ ID NO: 3760107 - RNA, 23 nt, Human
gccccaccugccacuaggcuggg

SEQ ID NO: 3760108 - RNA, 14 nt, Human
gccccaccuggccc

SEQ ID NO: 3760109 - RNA, 14 nt, Human
gccccacucucaga

SEQ ID NO: 3760110 - RNA, 18 nt, Human
gccccacucucagaggcc

SEQ ID NO: 3760111 - RNA, 22 nt, Human
gccccacucucagaggccccaa

SEQ ID NO: 3760112 - RNA, 12 nt, Human
gccccacugcca

SEQ ID NO: 3760113 - RNA, 16 nt, Human
gccccacugccagcag

SEQ ID NO: 3760114 - RNA, 17 nt, Human
gccccacugccagcagc

SEQ ID NO: 3760115 - RNA, 18 nt, Human
gccccacugcccuucuca

SEQ ID NO: 3760116 - RNA, 13 nt, Human
gccccacugggga

SEQ ID NO: 3760117 - RNA, 14 nt, Human
gccccacuuguccu

SEQ ID NO: 3760118 - RNA, 16 nt, Human
gccccacuuguccuua

SEQ ID NO: 3760119 - RNA, 15 nt, Human
gccccagagacucag

SEQ ID NO: 3760120 - RNA, 12 nt, Human
gccccagaggcc

SEQ ID NO: 3760121 - RNA, 17 nt, Human
gccccagauaccagccc

SEQ ID NO: 3760122 - RNA, 13 nt, Human
gccccagcacagc

SEQ ID NO: 3760123 - RNA, 19 nt, Human
gccccagcacuaaagcagu

SEQ ID NO: 3760124 - RNA, 12 nt, Human
gccccagccaga

SEQ ID NO: 3760125 - RNA, 19 nt, Human
gccccagccagaguuccug

SEQ ID NO: 3760126 - RNA, 12 nt, Human
gccccagcccaa

SEQ ID NO: 3760127 - RNA, 14 nt, Human
gccccagcccaagu

SEQ ID NO: 3760128 - RNA, 16 nt, Human
gccccagcccacccuc

SEQ ID NO: 3760129 - RNA, 13 nt, Human
gccccagcccaga

SEQ ID NO: 3760130 - RNA, 14 nt, Human
gccccagcccagcc

SEQ ID NO: 3760131 - RNA, 23 nt, Human
gccccagcccagccccacuccuc

SEQ ID NO: 3760132 - RNA, 18 nt, Human
gccccagcccugcugggg

SEQ ID NO: 3760133 - RNA, 10 nt, Human
gccccagccu

SEQ ID NO: 3760134 - RNA, 18 nt, Human
gccccagccucccugaag

SEQ ID NO: 3760135 - RNA, 14 nt, Human
gccccagccuggcc

SEQ ID NO: 3760136 - RNA, 17 nt, Human
gccccagccuggcccag

SEQ ID NO: 3760137 - RNA, 17 nt, Human
gccccagcuugggcaga

SEQ ID NO: 3760138 - RNA, 22 nt, Human
gccccaggaaaggcccagccac

SEQ ID NO: 3760139 - RNA, 14 nt, Human
gccccaggaccagc

SEQ ID NO: 3760140 - RNA, 15 nt, Human
gccccaggaccagcu

SEQ ID NO: 3760141 - RNA, 17 nt, Human
gccccaggaccagcuca

SEQ ID NO: 3760142 - RNA, 22 nt, Human
gccccaggaccagcucaggaca

SEQ ID NO: 3760143 - RNA, 22 nt, Human
gccccaggaccuggcugccaua

SEQ ID NO: 3760144 - RNA, 22 nt, Human
gccccaggcagggccaacccuu

SEQ ID NO: 3760145 - RNA, 14 nt, Human
gccccaggccucug

SEQ ID NO: 3760146 - RNA, 15 nt, Human
gccccaggccugaaa

SEQ ID NO: 3760147 - RNA, 12 nt, Human
gccccaggcugc

SEQ ID NO: 3760148 - RNA, 19 nt, Human
gccccaggggaacacuggg

SEQ ID NO: 3760149 - RNA, 16 nt, Human
gccccagggugcccag

SEQ ID NO: 3760150 - RNA, 15 nt, Human
gccccagucagccuc

SEQ ID NO: 3760151 - RNA, 16 nt, Human
gccccagucagccucu

SEQ ID NO: 3760152 - RNA, 18 nt, Human
gccccagucagccucucu

SEQ ID NO: 3760153 - RNA, 22 nt, Human
gccccagucagccucucuccca

SEQ ID NO: 3760154 - RNA, 23 nt, Human
gccccagucagccucucucccag

SEQ ID NO: 3760155 - RNA, 14 nt, Human
gccccagugacagc

SEQ ID NO: 3760156 - RNA, 12 nt, Human
gccccagugccc

SEQ ID NO: 3760157 - RNA, 16 nt, Human
gccccagugcccacag

SEQ ID NO: 3760158 - RNA, 17 nt, Human
gccccagugcccacagg

SEQ ID NO: 3760159 - RNA, 13 nt, Human
gccccaucacugc

SEQ ID NO: 3760160 - RNA, 15 nt, Human
gccccaucagcucca

SEQ ID NO: 3760161 - RNA, 16 nt, Human
gccccauccuccagca

SEQ ID NO: 3760162 - RNA, 18 nt, Human
gccccauccuccagcagg

SEQ ID NO: 3760163 - RNA, 13 nt, Human
gccccauccucug

SEQ ID NO: 3760164 - RNA, 16 nt, Human
gccccaucuucaccca

SEQ ID NO: 3760165 - RNA, 14 nt, Human
gccccaugaccucc

SEQ ID NO: 3760166 - RNA, 16 nt, Human
gccccaugaccuccag

SEQ ID NO: 3760167 - RNA, 18 nt, Human
gccccauucugccugccc

SEQ ID NO: 3760168 - RNA, 22 nt, Human
gccccauucuuuuguaauuuaa

SEQ ID NO: 3760169 - RNA, 20 nt, Human
gccccauuuauccaccucca

SEQ ID NO: 3760170 - RNA, 15 nt, Human
gcccccaaauaagaa

SEQ ID NO: 3760171 - RNA, 21 nt, Human
gcccccaaccauuuccucaga

SEQ ID NO: 3760172 - RNA, 18 nt, Human
gcccccacaccuggcccu

SEQ ID NO: 3760173 - RNA, 16 nt, Human
gcccccaccacacauc

SEQ ID NO: 3760174 - RNA, 20 nt, Human
gcccccaccacacaucccag

SEQ ID NO: 3760175 - RNA, 23 nt, Human
gcccccaccacacaucccagccc

SEQ ID NO: 3760176 - RNA, 21 nt, Human
gcccccaccacuaggacucug

SEQ ID NO: 3760177 - RNA, 17 nt, Human
gcccccacccacuuccc

SEQ ID NO: 3760178 - RNA, 14 nt, Human
gcccccacccuguu

SEQ ID NO: 3760179 - RNA, 18 nt, Human
gcccccacccuguuccug

SEQ ID NO: 3760180 - RNA, 23 nt, Human
gcccccacccuguuccugcugcu

SEQ ID NO: 3760181 - RNA, 22 nt, Human
cuggggcucccuucaucuccag

SEQ ID NO: 3760182 - RNA, 19 nt, Human
cuggggcuccuuucuccag

SEQ ID NO: 3760183 - RNA, 20 nt, Human
cuggggcuccuuucuccagc

SEQ ID NO: 3760184 - RNA, 17 nt, Human
cuggggcucugugcagg

SEQ ID NO: 3760185 - RNA, 13 nt, Human
cuggggcugaagg

SEQ ID NO: 3760186 - RNA, 17 nt, Human
cuggggcugaucucagg

SEQ ID NO: 3760187 - RNA, 20 nt, Human
cuggggcugaucucagggaa

SEQ ID NO: 3760188 - RNA, 23 nt, Human
cuggggcugaucucagggaagcc

SEQ ID NO: 3760189 - RNA, 15 nt, Human
cuggggcugcuggcc

SEQ ID NO: 3760190 - RNA, 16 nt, Human
cuggggcugcuggccu

SEQ ID NO: 3760191 - RNA, 15 nt, Human
cuggggcugcuguga

SEQ ID NO: 3760192 - RNA, 13 nt, Human
cuggggcuggcuu

SEQ ID NO: 3760193 - RNA, 14 nt, Human
cuggggcuggcuuu

SEQ ID NO: 3760194 - RNA, 16 nt, Human
cuggggcuucuccuga

SEQ ID NO: 3760195 - RNA, 19 nt, Human
cuggggcuucuccugaccc

SEQ ID NO: 3760196 - RNA, 16 nt, Human
cugggggaagcccugg

SEQ ID NO: 3760197 - RNA, 20 nt, Human
cugggggaaugagcccagag

SEQ ID NO: 3760198 - RNA, 14 nt, Human
cugggggagagccg

SEQ ID NO: 3760199 - RNA, 13 nt, Human
cugggggagugga

SEQ ID NO: 3760200 - RNA, 14 nt, Human
cugggggcacagga

SEQ ID NO: 3760201 - RNA, 23 nt, Human
cugggggcagccugcguggcuga

SEQ ID NO: 3760202 - RNA, 14 nt, Human
cugggggccaugag

SEQ ID NO: 3760203 - RNA, 23 nt, Human
cugggggccaugagcuccagacc

SEQ ID NO: 3760204 - RNA, 13 nt, Human
cugggggccuggc

SEQ ID NO: 3760205 - RNA, 16 nt, Human
cugggggccuggcugg

SEQ ID NO: 3760206 - RNA, 14 nt, Human
cuggggggacccag

SEQ ID NO: 3760207 - RNA, 21 nt, Human
cuggggggacccagugcagaa

SEQ ID NO: 3760208 - RNA, 13 nt, Human
cuggggggcagug

SEQ ID NO: 3760209 - RNA, 12 nt, Human
cugggggguggc

SEQ ID NO: 3760210 - RNA, 15 nt, Human
cugggggguggccag

SEQ ID NO: 3760211 - RNA, 16 nt, Human
cugggggucaggaggc

SEQ ID NO: 3760212 - RNA, 19 nt, Human
cuggggguggggagguguc

SEQ ID NO: 3760213 - RNA, 16 nt, Human
cuggggguugcggggg

SEQ ID NO: 3760214 - RNA, 19 nt, Human
cugggguaaguggucuaag

SEQ ID NO: 3760215 - RNA, 19 nt, Human
cuggggucacccucuccag

SEQ ID NO: 3760216 - RNA, 15 nt, Human
cugggguccagggag

SEQ ID NO: 3760217 - RNA, 14 nt, Human
cuggggucccagca

SEQ ID NO: 3760218 - RNA, 16 nt, Human
cuggggucccagcagc

SEQ ID NO: 3760219 - RNA, 15 nt, Human
cuggggugcagggau

SEQ ID NO: 3760220 - RNA, 14 nt, Human
cuggggugcccucc

SEQ ID NO: 3760221 - RNA, 19 nt, Human
cuggggugcccuccacugc

SEQ ID NO: 3760222 - RNA, 23 nt, Human
cuggggugcccuccacugcccuc

SEQ ID NO: 3760223 - RNA, 13 nt, Human
cugggguggccug

SEQ ID NO: 3760224 - RNA, 18 nt, Human
cugggguggccugugugg

SEQ ID NO: 3760225 - RNA, 20 nt, Human
cuggggugggaggucuugcu

SEQ ID NO: 3760226 - RNA, 21 nt, Human
cuggggugggaggucuugcua

SEQ ID NO: 3760227 - RNA, 22 nt, Human
cugggguggggaccucaggccu

SEQ ID NO: 3760228 - RNA, 23 nt, Human
cugggguggggaccucaggccug

SEQ ID NO: 3760229 - RNA, 24 nt, Human
cuggggugggggugggaggccagc

SEQ ID NO: 3760230 - RNA, 14 nt, Human
cuggggugggguca

SEQ ID NO: 3760231 - RNA, 20 nt, Human
cugggguggggucaugcccu

SEQ ID NO: 3760232 - RNA, 23 nt, Human
cugggguggguggggcagugcuu

SEQ ID NO: 3760233 - RNA, 16 nt, Human
cuggggugugggaggc

SEQ ID NO: 3760234 - RNA, 19 nt, Human
cuggggugugggaggcccg

SEQ ID NO: 3760235 - RNA, 13 nt, Human
cugggguucagcc

SEQ ID NO: 3760236 - RNA, 17 nt, Human
cugggguucagccccuc

SEQ ID NO: 3760237 - RNA, 23 nt, Human
cugggguucagccccuccucugc

SEQ ID NO: 3760238 - RNA, 14 nt, Human
cugggguugagggc

SEQ ID NO: 3760239 - RNA, 15 nt, Human
cugggguugucagcu

SEQ ID NO: 3760240 - RNA, 16 nt, Human
cuggguaauaaaagug

SEQ ID NO: 3760241 - RNA, 18 nt, Human
cuggguaaugaaacaaag

SEQ ID NO: 3760242 - RNA, 23 nt, Human
cuggguacuuguggacacagcuc

SEQ ID NO: 3760243 - RNA, 17 nt, Human
cuggguagcgggggagg

SEQ ID NO: 3760244 - RNA, 15 nt, Human
cuggguauuggaaau

SEQ ID NO: 3760245 - RNA, 21 nt, Human
cugggucagucuggugggagg

SEQ ID NO: 3760246 - RNA, 12 nt, Human
cugggucagugg

SEQ ID NO: 3760247 - RNA, 13 nt, Human
cuggguccaaaua

SEQ ID NO: 3760248 - RNA, 14 nt, Human
cuggguccaaauaa

SEQ ID NO: 3760249 - RNA, 16 nt, Human
cuggguccaaauaaaa

SEQ ID NO: 3760250 - RNA, 23 nt, Human
cuggguccaaauaaaaacuaaau

SEQ ID NO: 3760251 - RNA, 13 nt, Human
cugggucgcccug

SEQ ID NO: 3760252 - RNA, 22 nt, Human
cugggucgcccuggacugugug

SEQ ID NO: 3760253 - RNA, 19 nt, Human
cugggucucaccggcucuc

SEQ ID NO: 3760254 - RNA, 15 nt, Human
cugggucugugucuc

SEQ ID NO: 3760255 - RNA, 16 nt, Human
cugggucugugucucu

SEQ ID NO: 3760256 - RNA, 21 nt, Human
cugggucuucagcauucccuc

SEQ ID NO: 3760257 - RNA, 16 nt, Human
cugggucuuucauggg

SEQ ID NO: 3760258 - RNA, 13 nt, Human
cugggugacagag

SEQ ID NO: 3760259 - RNA, 23 nt, Human
cugggugacagagcaagacucug

SEQ ID NO: 3760260 - RNA, 14 nt, Human
cugggugcagcuga

SEQ ID NO: 3760261 - RNA, 13 nt, Human
cugggugcaggag

SEQ ID NO: 3760262 - RNA, 20 nt, Human
cugggugcaugaucuugagc

SEQ ID NO: 3760263 - RNA, 19 nt, Human
cugggugcccacagcccgc

SEQ ID NO: 3760264 - RNA, 23 nt, Human
cugggugcccacagcccgcaugc

SEQ ID NO: 3760265 - RNA, 21 nt, Human
cugggugcgaccccaucugcc

SEQ ID NO: 3760266 - RNA, 18 nt, Human
cugggugcuacuggggaa

SEQ ID NO: 3760267 - RNA, 14 nt, Human
cugggugcucccua

SEQ ID NO: 3760268 - RNA, 23 nt, Human
cuggguggacauggccccuguga

SEQ ID NO: 3760269 - RNA, 16 nt, Human
cuggguggaugggcca

SEQ ID NO: 3760270 - RNA, 18 nt, Human
cuggguggcaccagcagc

SEQ ID NO: 3760271 - RNA, 21 nt, Human
cuggguggcaccagcagccug

SEQ ID NO: 3760272 - RNA, 22 nt, Human
cuggguggcaccagcagccugg

SEQ ID NO: 3760273 - RNA, 20 nt, Human
cuggguggcacugccaugca

SEQ ID NO: 3760274 - RNA, 21 nt, Human
cuggguggcacugccaugcag

SEQ ID NO: 3760275 - RNA, 20 nt, Human
cuggguggcccauccccccu

SEQ ID NO: 3760276 - RNA, 23 nt, Human
cuggguggccucgggacaccugc

SEQ ID NO: 3760277 - RNA, 15 nt, Human
cuggguggcuacucu

SEQ ID NO: 3760278 - RNA, 21 nt, Human
cuggguggcuacucugugcca

SEQ ID NO: 3760279 - RNA, 13 nt, Human
cuggguggggcug

SEQ ID NO: 3760280 - RNA, 18 nt, Human
cuggguggggcugcuccu

SEQ ID NO: 3760281 - RNA, 17 nt, Human
cuggguggguggugggg

SEQ ID NO: 3760282 - RNA, 19 nt, Human
cugggugggugguggggag

SEQ ID NO: 3760283 - RNA, 19 nt, Human
cugggugguacccucugga

SEQ ID NO: 3760284 - RNA, 21 nt, Human
cuggguggucugcaggcaggg

SEQ ID NO: 3760285 - RNA, 19 nt, Human
cuggguguaaaaccuggag

SEQ ID NO: 3760286 - RNA, 21 nt, Human
cuggguguaaaaccuggagau

SEQ ID NO: 3760287 - RNA, 16 nt, Human
cuggguguaaacacau

SEQ ID NO: 3760288 - RNA, 13 nt, Human
cugggugucauuu

SEQ ID NO: 3760289 - RNA, 21 nt, Human
cugggugucauuucauuccau

SEQ ID NO: 3760290 - RNA, 14 nt, Human
cuggguguggcgca

SEQ ID NO: 3760291 - RNA, 15 nt, Human
cuggguguggcgcag

SEQ ID NO: 3760292 - RNA, 21 nt, Human
cuggguuagacugccagcucu

SEQ ID NO: 3760293 - RNA, 23 nt, Human
cuggguuagacugccagcucuuc

SEQ ID NO: 3760294 - RNA, 14 nt, Human
cuggguucacugca

SEQ ID NO: 3760295 - RNA, 18 nt, Human
cuggguucacugcaaccu

SEQ ID NO: 3760296 - RNA, 20 nt, Human
cuggguucacugcaaccucc

SEQ ID NO: 3760297 - RNA, 21 nt, Human
cuggguucagaaaugcugccu

SEQ ID NO: 3760298 - RNA, 15 nt, Human
cuggguucuacccag

SEQ ID NO: 3760299 - RNA, 15 nt, Human
cuggguucugggugg

SEQ ID NO: 3760300 - RNA, 16 nt, Human
cuggguucuggguggu

SEQ ID NO: 3760301 - RNA, 18 nt, Human
cuggguugcagacaggaa

SEQ ID NO: 3760302 - RNA, 13 nt, Human
cuggguuggaaaa

SEQ ID NO: 3760303 - RNA, 18 nt, Human
cuggguuggaaaacagua

SEQ ID NO: 3760304 - RNA, 16 nt, Human
cuggguuggcgcaccc

SEQ ID NO: 3760305 - RNA, 16 nt, Human
cuggguugggaucagg

SEQ ID NO: 3760306 - RNA, 13 nt, Human
cuggguugggggc

SEQ ID NO: 3760307 - RNA, 14 nt, Human
cuggguuggugcac

SEQ ID NO: 3760308 - RNA, 15 nt, Human
cuggguuggugcaca

SEQ ID NO: 3760309 - RNA, 18 nt, Human
cuggguuucucuguauag

SEQ ID NO: 3760310 - RNA, 19 nt, Human
cuggguuuggaccccagcu

SEQ ID NO: 3760311 - RNA, 21 nt, Human
cuggguuuggaccccagcugg

SEQ ID NO: 3760312 - RNA, 13 nt, Human
cugguaaaaugaa

SEQ ID NO: 3760313 - RNA, 22 nt, Human
cugguaaaaugaagaauuuaaa

SEQ ID NO: 3760314 - RNA, 18 nt, Human
cugguaacaguucauguu

SEQ ID NO: 3760315 - RNA, 19 nt, Human
cugguaauauugacuugua

SEQ ID NO: 3760316 - RNA, 23 nt, Human
cugguacaguauggggguuguaa

SEQ ID NO: 3760317 - RNA, 16 nt, Human
cugguaccaguugaaa

SEQ ID NO: 3760318 - RNA, 17 nt, Human
cugguaccaguugaaau

SEQ ID NO: 3760319 - RNA, 17 nt, Human
cugguacccagccaucu

SEQ ID NO: 3760320 - RNA, 19 nt, Human
cugguacccagccaucugc

SEQ ID NO: 3760321 - RNA, 22 nt, Human
cugguacccagccaucugccca

SEQ ID NO: 3760322 - RNA, 16 nt, Human
cugguacucuccuaga

SEQ ID NO: 3760323 - RNA, 19 nt, Human
cugguacuuagaguuucug

SEQ ID NO: 3760324 - RNA, 20 nt, Human
cugguacuuagaguuucugu

SEQ ID NO: 3760325 - RNA, 21 nt, Human
cugguagaagggaaagcccau

SEQ ID NO: 3760326 - RNA, 13 nt, Human
cugguagagcagg

SEQ ID NO: 3760327 - RNA, 23 nt, Human
cugguagauagaaauaaauagcu

SEQ ID NO: 3760328 - RNA, 14 nt, Human
cugguagcucaggu

SEQ ID NO: 3760329 - RNA, 23 nt, Human
cugguaggaaagggcaagucuuu

SEQ ID NO: 3760330 - RNA, 20 nt, Human
gcccugccacucacuaggcc

SEQ ID NO: 3760331 - RNA, 21 nt, Human
gcccugccacucacuaggccc

SEQ ID NO: 3760332 - RNA, 18 nt, Human
gcccugccaucuucccag

SEQ ID NO: 3760333 - RNA, 22 nt, Human
gcccugcccaccuggccucugc

SEQ ID NO: 3760334 - RNA, 13 nt, Human
gcccugcccugag

SEQ ID NO: 3760335 - RNA, 22 nt, Human
gcccugccuccuuugugaggaa

SEQ ID NO: 3760336 - RNA, 15 nt, Human
gcccugccucuccgc

SEQ ID NO: 3760337 - RNA, 18 nt, Human
gcccugccucuccgcccc

SEQ ID NO: 3760338 - RNA, 21 nt, Human
gcccugccucuccgccccuga

SEQ ID NO: 3760339 - RNA, 15 nt, Human
gcccugccugagggc

SEQ ID NO: 3760340 - RNA, 14 nt, Human
gcccugccuggagg

SEQ ID NO: 3760341 - RNA, 20 nt, Human
gcccugcucccucucccccu

SEQ ID NO: 3760342 - RNA, 18 nt, Human
gcccugccuggaggaccu

SEQ ID NO: 3760343 - RNA, 23 nt, Human
gcccugccuggaggaccugagcc

SEQ ID NO: 3760344 - RNA, 20 nt, Human
gcccugcgggucacaggagg

SEQ ID NO: 3760345 - RNA, 18 nt, Human
gcccugcgguagauggga

SEQ ID NO: 3760346 - RNA, 15 nt, Human
gcccugcuccucccu

SEQ ID NO: 3760347 - RNA, 23 nt, Human
gcccugcuccucccuggcugccc

SEQ ID NO: 3760348 - RNA, 14 nt, Human
gcccugcuccugca

SEQ ID NO: 3760349 - RNA, 16 nt, Human
gcccugcuccugcagc

SEQ ID NO: 3760350 - RNA, 22 nt, Human
gcccugcugagucccaggcuga

SEQ ID NO: 3760351 - RNA, 12 nt, Human
gcccugcugccc

SEQ ID NO: 3760352 - RNA, 15 nt, Human
gcccugcugcccucc

SEQ ID NO: 3760353 - RNA, 22 nt, Human
gcccugcugccgccucccagcc

SEQ ID NO: 3760354 - RNA, 11 nt, Human
gcccugcuggc

SEQ ID NO: 3760355 - RNA, 14 nt, Human
gcccugcuggccgc

SEQ ID NO: 3760356 - RNA, 21 nt, Human
gcccugcuggccgccucaccc

SEQ ID NO: 3760357 - RNA, 21 nt, Human
gcccugcuggggauccccgcc

SEQ ID NO: 3760358 - RNA, 16 nt, Human
gcccugcuuccugcuu

SEQ ID NO: 3760359 - RNA, 22 nt, Human
gcccugcuuccugcuugccaag

SEQ ID NO: 3760360 - RNA, 16 nt, Human
gcccugcuuugggcug

SEQ ID NO: 3760361 - RNA, 18 nt, Human
gcccugcuuugggcugcc

SEQ ID NO: 3760362 - RNA, 21 nt, Human
gcccugcuuugggcugcccug

SEQ ID NO: 3760363 - RNA, 23 nt, Human
gcccugcuuugggcugcccuggu

SEQ ID NO: 3760364 - RNA, 20 nt, Human
gcccuggaagccggcggccc

SEQ ID NO: 3760365 - RNA, 12 nt, Human
gcccuggacugu

SEQ ID NO: 3760366 - RNA, 16 nt, Human
gcccuggacugugugc

SEQ ID NO: 3760367 - RNA, 18 nt, Human
gcccuggagguggcugag

SEQ ID NO: 3760368 - RNA, 19 nt, Human
gcccuggagucaugccaag

SEQ ID NO: 3760369 - RNA, 20 nt, Human
gcccuggagucaugccaagc

SEQ ID NO: 3760370 - RNA, 20 nt, Human
cuguaggaagguacuguaug

SEQ ID NO: 3760371 - RNA, 19 nt, Human
cuguaggacucgcagucag

SEQ ID NO: 3760372 - RNA, 22 nt, Human
cuguaggagcuacccuuuuccu

SEQ ID NO: 3760373 - RNA, 14 nt, Human
cuguagggaacucu

SEQ ID NO: 3760374 - RNA, 20 nt, Human
cuguagggagggcggcaggg

SEQ ID NO: 3760375 - RNA, 16 nt, Human
cuguagggcuggaccu

SEQ ID NO: 3760376 - RNA, 15 nt, Human
cuguaggugguaugu

SEQ ID NO: 3760377 - RNA, 16 nt, Human
cuguagguugcacacu

SEQ ID NO: 3760378 - RNA, 19 nt, Human
cuguaguaaacuauuuauc

SEQ ID NO: 3760379 - RNA, 20 nt, Human
cuguaguaaacuauuuaucu

SEQ ID NO: 3760380 - RNA, 18 nt, Human
cuguaguaaauaaugcuu

SEQ ID NO: 3760381 - RNA, 19 nt, Human
cuguaguaaauaaugcuuu

SEQ ID NO: 3760382 - RNA, 18 nt, Human
cuguaguacuccuuaaga

SEQ ID NO: 3760383 - RNA, 23 nt, Human
cuguaguacuccuuaagaacaca

SEQ ID NO: 3760384 - RNA, 19 nt, Human
cuguaguagcccuuucugu

SEQ ID NO: 3760385 - RNA, 18 nt, Human
cuguaguaggcauuuuua

SEQ ID NO: 3760386 - RNA, 22 nt, Human
cuguaguaggcauuuuuaccau

SEQ ID NO: 3760387 - RNA, 14 nt, Human
cuguagucagccga

SEQ ID NO: 3760388 - RNA, 17 nt, Human
cuguagucauuuacuaa

SEQ ID NO: 3760389 - RNA, 23 nt, Human
cuguagucauuuacuaaacauau

SEQ ID NO: 3760390 - RNA, 12 nt, Human
cuguagucccag

SEQ ID NO: 3760391 - RNA, 18 nt, Human
cuguagucccagccacuc

SEQ ID NO: 3760392 - RNA, 20 nt, Human
cuguaguccuagccacucag

SEQ ID NO: 3760393 - RNA, 14 nt, Human
cuguagucucagga

SEQ ID NO: 3760394 - RNA, 22 nt, Human
cuguagugagauagcauuguga

SEQ ID NO: 3760395 - RNA, 20 nt, Human
cuguagugcuacagggucca

SEQ ID NO: 3760396 - RNA, 14 nt, Human
cuguaguucuaaga

SEQ ID NO: 3760397 - RNA, 19 nt, Human
cuguaguucuaagacucaa

SEQ ID NO: 3760398 - RNA, 18 nt, Human
cuguauaaacauuaaaug

SEQ ID NO: 3760399 - RNA, 19 nt, Human
cuguauaaacauuaaaugu

SEQ ID NO: 3760400 - RNA, 14 nt, Human
cuguauaaauagga

SEQ ID NO: 3760401 - RNA, 16 nt, Human
cuguauaaauaggaga

SEQ ID NO: 3760402 - RNA, 17 nt, Human
cuguauaacccuguuac

SEQ ID NO: 3760403 - RNA, 12 nt, Human
cuguauaaguaa

SEQ ID NO: 3760404 - RNA, 16 nt, Human
cuguauaaguaagaaa

SEQ ID NO: 3760405 - RNA, 22 nt, Human
cuguauacagugcagagccuuc

SEQ ID NO: 3760406 - RNA, 16 nt, Human
cuguauacguuucaaa

SEQ ID NO: 3760407 - RNA, 21 nt, Human
cuguauagacaguuuguaaau

SEQ ID NO: 3760408 - RNA, 18 nt, Human
cuguauauaaaugggaac

SEQ ID NO: 3760409 - RNA, 19 nt, Human
cuguauauaaaugggaaca

SEQ ID NO: 3760410 - RNA, 15 nt, Human
cuguauauacaauaa

SEQ ID NO: 3760411 - RNA, 14 nt, Human
cuguauauacuuuu

SEQ ID NO: 3760412 - RNA, 15 nt, Human
cuguauauacuuuuu

SEQ ID NO: 3760413 - RNA, 19 nt, Human
cuguauauuuguaaagcua

SEQ ID NO: 3760414 - RNA, 15 nt, Human
cuguauauuuguaug

SEQ ID NO: 3760415 - RNA, 17 nt, Human
cuguauauuuuaagaag

SEQ ID NO: 3760416 - RNA, 17 nt, Human
cuguaucaagucauggc

SEQ ID NO: 3760417 - RNA, 22 nt, Human
cuguaucaggacccagaggaag

SEQ ID NO: 3760418 - RNA, 16 nt, Human
cuguaucauuuucuuu

SEQ ID NO: 3760419 - RNA, 18 nt, Human
cuguaucccaugagccuc

SEQ ID NO: 3760420 - RNA, 18 nt, Human
cuguaucuguguagacua

SEQ ID NO: 3760421 - RNA, 15 nt, Human
cuguaucuuucuaug

SEQ ID NO: 3760422 - RNA, 21 nt, Human
cuguaugaaaaauuggggagg

SEQ ID NO: 3760423 - RNA, 15 nt, Human
cuguaugaucaaaug

SEQ ID NO: 3760424 - RNA, 18 nt, Human
cuguaugaucaaauguuu

SEQ ID NO: 3760425 - RNA, 23 nt, Human
cuguaugaucaaauguuuaauca

SEQ ID NO: 3760426 - RNA, 12 nt, Human
cuguaugauuua

SEQ ID NO: 3760427 - RNA, 22 nt, Human
cuguaugcugaucaucgccaga

SEQ ID NO: 3760428 - RNA, 15 nt, Human
cuguaugucugucau

SEQ ID NO: 3760429 - RNA, 19 nt, Human
cuguauguuauagaacuuc

SEQ ID NO: 3760430 - RNA, 15 nt, Human
cuguauuaagccacu

SEQ ID NO: 3760431 - RNA, 17 nt, Human
cuguauuagucacagag

SEQ ID NO: 3760432 - RNA, 15 nt, Human
cuguauucagacaga

SEQ ID NO: 3760433 - RNA, 18 nt, Human
cuguauucucaaacacag

SEQ ID NO: 3760434 - RNA, 21 nt, Human
cuguauugaaucauguaguau

SEQ ID NO: 3760435 - RNA, 19 nt, Human
cuguauuuaaaaauagaaa

SEQ ID NO: 3760436 - RNA, 14 nt, Human
cuguauuuaagcaa

SEQ ID NO: 3760437 - RNA, 17 nt, Human
cuguauuucauguggcu

SEQ ID NO: 3760438 - RNA, 19 nt, Human
cuguauuucauguggcugu

SEQ ID NO: 3760439 - RNA, 19 nt, Human
cuguauuugaaagugccuu

SEQ ID NO: 3760440 - RNA, 22 nt, Human
cuguauuugaaauaagaauuca

SEQ ID NO: 3760441 - RNA, 23 nt, Human
cuguauuuguaucucugaagcau

SEQ ID NO: 3760442 - RNA, 13 nt, Human
cuguauuugugac

SEQ ID NO: 3760443 - RNA, 14 nt, Human
cuguauuugugacu

SEQ ID NO: 3760444 - RNA, 19 nt, Human
cuguauuuguucccaagag

SEQ ID NO: 3760445 - RNA, 18 nt, Human
cuguauuuuuaaagcaug

SEQ ID NO: 3760446 - RNA, 21 nt, Human
cuguauuuuuucuugcauuga

SEQ ID NO: 3760447 - RNA, 21 nt, Human
cuguauuuuuuuuucuaagag

SEQ ID NO: 3760448 - RNA, 22 nt, Human
cuguauuuuuuuuucuaagaga

SEQ ID NO: 3760449 - RNA, 15 nt, Human
cugucaaaacacugu

SEQ ID NO: 3760450 - RNA, 18 nt, Human
cugucaaacaaagccaga

SEQ ID NO: 3760451 - RNA, 19 nt, Human
cugucaaacaaagccagaa

SEQ ID NO: 3760452 - RNA, 22 nt, Human
cugucaaacaaagccagaagcu

SEQ ID NO: 3760453 - RNA, 12 nt, Human
cugucaaacauu

SEQ ID NO: 3760454 - RNA, 13 nt, Human
cugucaaacauua

SEQ ID NO: 3760455 - RNA, 14 nt, Human
cugucaaaugaugu

SEQ ID NO: 3760456 - RNA, 18 nt, Human
cugucaagccauuuuuac

SEQ ID NO: 3760457 - RNA, 17 nt, Human
cugucaaggcugcuuag

SEQ ID NO: 3760458 - RNA, 19 nt, Human
cugucaaguuccuuugggu

SEQ ID NO: 3760459 - RNA, 12 nt, Human
cugucaauaaac

SEQ ID NO: 3760460 - RNA, 13 nt, Human
cugucaauaaaca

SEQ ID NO: 3760461 - RNA, 20 nt, Human
cugucaaugauuauuuucau

SEQ ID NO: 3760462 - RNA, 13 nt, Human
cugucaauuacag

SEQ ID NO: 3760463 - RNA, 15 nt, Human
cugucaauuacagga

SEQ ID NO: 3760464 - RNA, 18 nt, Human
cugucaauuacaggaagu

SEQ ID NO: 3760465 - RNA, 19 nt, Human
cugucaauuacaggaagua

SEQ ID NO: 3760466 - RNA, 16 nt, Human
cugucacaccagccau

SEQ ID NO: 3760467 - RNA, 21 nt, Human
cugucacaguaaaaauaaaau

SEQ ID NO: 3760468 - RNA, 14 nt, Human
cugucacauugcau

SEQ ID NO: 3760469 - RNA, 22 nt, Human
cugucacccagguuggagugca

SEQ ID NO: 3760470 - RNA, 16 nt, Human
cugucaccucucccac

SEQ ID NO: 3760471 - RNA, 16 nt, Human
cugucacugcaggcac

SEQ ID NO: 3760472 - RNA, 17 nt, Human
cugucacugcucuggac

SEQ ID NO: 3760473 - RNA, 24 nt, Human
cugucacugcucuggacugugugg

SEQ ID NO: 3760474 - RNA, 20 nt, Human
cugucacuguuucucugcug

SEQ ID NO: 3760475 - RNA, 15 nt, Human
cugucacuuugcucu

SEQ ID NO: 3760476 - RNA, 13 nt, Human
cugucagauccag

SEQ ID NO: 3760477 - RNA, 17 nt, Human
cugucagaugagaacaa

SEQ ID NO: 3760478 - RNA, 19 nt, Human
cugucagaugagaacaaag

SEQ ID NO: 3760479 - RNA, 20 nt, Human
cugucagaugagaacaaagc

SEQ ID NO: 3760480 - RNA, 22 nt, Human
cugucagaugagaacaaagcug

SEQ ID NO: 3760481 - RNA, 23 nt, Human
cugucagaugagaacaaagcugu

SEQ ID NO: 3760482 - RNA, 16 nt, Human
cugucagcaugaauuu

SEQ ID NO: 3760483 - RNA, 22 nt, Human
cugucagcaugaauuuguaaug

SEQ ID NO: 3760484 - RNA, 21 nt, Human
cugucagcuccccucggagaa

SEQ ID NO: 3760485 - RNA, 14 nt, Human
cugucaggaagaaa

SEQ ID NO: 3760486 - RNA, 17 nt, Human
cugucaggaagaaauca

SEQ ID NO: 3760487 - RNA, 17 nt, Human
cugucaggauugcgaga

SEQ ID NO: 3760488 - RNA, 19 nt, Human
cugucaggauugcgagaga

SEQ ID NO: 3760489 - RNA, 21 nt, Human
cugucaggauugcgagagaug

SEQ ID NO: 3760490 - RNA, 22 nt, Human
cugucaggauugcgagagaugu

SEQ ID NO: 3760491 - RNA, 18 nt, Human
cugucaggcugaaaacaa

SEQ ID NO: 3760492 - RNA, 14 nt, Human
cugucagucacagc

SEQ ID NO: 3760493 - RNA, 14 nt, Human
cugucagucugcuu

SEQ ID NO: 3760494 - RNA, 18 nt, Human
cugucagugcagcccgug

SEQ ID NO: 3760495 - RNA, 17 nt, Human
cugucagugccgccgcc

SEQ ID NO: 3760496 - RNA, 22 nt, Human
cugucagugccgccgccucgcc

SEQ ID NO: 3760497 - RNA, 22 nt, Human
cugucaguuaugacauccacaa

SEQ ID NO: 3760498 - RNA, 19 nt, Human
cugucaguucuaaccuccu

SEQ ID NO: 3760499 - RNA, 17 nt, Human
cugucauccagcucacu

SEQ ID NO: 3760500 - RNA, 22 nt, Human
cugucauccucaaagaaagugu

SEQ ID NO: 3760501 - RNA, 18 nt, Human
cugucaucuaccuuuucu

SEQ ID NO: 3760502 - RNA, 17 nt, Human
cugucaucugagaauga

SEQ ID NO: 3760503 - RNA, 14 nt, Human
cugucaucuuucuu

SEQ ID NO: 3760504 - RNA, 18 nt, Human
cugucaugaaaucagcaa

SEQ ID NO: 3760505 - RNA, 19 nt, Human
cugucaugaacauguuccu

SEQ ID NO: 3760506 - RNA, 18 nt, Human
cugucaugccccccucaa

SEQ ID NO: 3760507 - RNA, 23 nt, Human
cugucauucccaccacccugagg

SEQ ID NO: 3760508 - RNA, 19 nt, Human
cugucauugcuucuucuga

SEQ ID NO: 3760509 - RNA, 17 nt, Human
cugucauuugagcaggg

SEQ ID NO: 3760510 - RNA, 20 nt, Human
cugucauuugagcagggcuc

SEQ ID NO: 3760511 - RNA, 22 nt, Human
cugucauuugagcagggcucag

SEQ ID NO: 3760512 - RNA, 16 nt, Human
cugucauuuguuguga

SEQ ID NO: 3760513 - RNA, 22 nt, Human
cuguccaaaggaggcuggcagg

SEQ ID NO: 3760514 - RNA, 20 nt, Human
cuguccaaccuaaccccuuu

SEQ ID NO: 3760515 - RNA, 23 nt, Human
cuguccaaccuaaccccuuuccu

SEQ ID NO: 3760516 - RNA, 22 nt, Human
cuguccacaggcuucugagcag

SEQ ID NO: 3760517 - RNA, 16 nt, Human
cuguccaccagcccau

SEQ ID NO: 3760518 - RNA, 24 nt, Human
gccuccagggcuggacugaggccu

SEQ ID NO: 3760519 - RNA, 15 nt, Human
gccuccaggugcaga

SEQ ID NO: 3760520 - RNA, 14 nt, Human
gccuccaggugugc

SEQ ID NO: 3760521 - RNA, 23 nt, Human
gccuccauccuacccccugugcc

SEQ ID NO: 3760522 - RNA, 12 nt, Human
gccuccauccug

SEQ ID NO: 3760523 - RNA, 13 nt, Human
gccuccauccuga

SEQ ID NO: 3760524 - RNA, 14 nt, Human
gccuccauccugag

SEQ ID NO: 3760525 - RNA, 11 nt, Human
gccuccaucuc

SEQ ID NO: 3760526 - RNA, 13 nt, Human
gccuccaugggcc

SEQ ID NO: 3760527 - RNA, 14 nt, Human
gccuccauggugcc

SEQ ID NO: 3760528 - RNA, 17 nt, Human
gccucccaaagugcugg

SEQ ID NO: 3760529 - RNA, 18 nt, Human
gccucccaaagugcuggg

SEQ ID NO: 3760530 - RNA, 17 nt, Human
gccucccaacucacccc

SEQ ID NO: 3760531 - RNA, 19 nt, Human
gccucccaacucaccccag

SEQ ID NO: 3760532 - RNA, 21 nt, Human
gccucccaacucaccccagcc

SEQ ID NO: 3760533 - RNA, 23 nt, Human
gccucccaacucaccccagcccc

SEQ ID NO: 3760534 - RNA, 14 nt, Human
gccucccacaguga

SEQ ID NO: 3760535 - RNA, 12 nt, Human
gccucccacccg

SEQ ID NO: 3760536 - RNA, 20 nt, Human
gccucccacccgaugcugcu

SEQ ID NO: 3760537 - RNA, 16 nt, Human
gccucccaucacccgc

SEQ ID NO: 3760538 - RNA, 17 nt, Human
gccucccaucacccgcu

SEQ ID NO: 3760539 - RNA, 15 nt, Human
gccucccauccaggg

SEQ ID NO: 3760540 - RNA, 14 nt, Human
gccucccauguuca

SEQ ID NO: 3760541 - RNA, 20 nt, Human
gccuccccaacccugccccu

SEQ ID NO: 3760542 - RNA, 22 nt, Human
gccuccccaacccugccccugc

SEQ ID NO: 3760543 - RNA, 17 nt, Human
gccuccccaccuccagg

SEQ ID NO: 3760544 - RNA, 22 nt, Human
gccuccccauuucccaucugca

SEQ ID NO: 3760545 - RNA, 23 nt, Human
gccuccccauuucccaucugcac

SEQ ID NO: 3760546 - RNA, 20 nt, Human
gccucccccacuuucuuucu

SEQ ID NO: 3760547 - RNA, 18 nt, Human
gccucccccuagccauuu

SEQ ID NO: 3760548 - RNA, 12 nt, Human
gccuccccuccu

SEQ ID NO: 3760549 - RNA, 16 nt, Human
gccuccccuccucugc

SEQ ID NO: 3760550 - RNA, 19 nt, Human
gccuccccuccucugcuug

SEQ ID NO: 3760551 - RNA, 20 nt, Human
gccuccccuccucugcuugc

SEQ ID NO: 3760552 - RNA, 23 nt, Human
gccuccccuccucugcuugccau

SEQ ID NO: 3760553 - RNA, 14 nt, Human
gccuccccugccac

SEQ ID NO: 3760554 - RNA, 19 nt, Human
gccuccccugccaccaggc

SEQ ID NO: 3760555 - RNA, 15 nt, Human
gccuccccugcugaa

SEQ ID NO: 3760556 - RNA, 16 nt, Human
gccuccccugugcagu

SEQ ID NO: 3760557 - RNA, 19 nt, Human
gccuccccuuaaaggggag

SEQ ID NO: 3760558 - RNA, 20 nt, Human
gccuccccuuaaaggggaga

SEQ ID NO: 3760559 - RNA, 21 nt, Human
gccuccccuuaaaggggagac

SEQ ID NO: 3760560 - RNA, 20 nt, Human
gccucccgaauagcugggac

SEQ ID NO: 3760561 - RNA, 19 nt, Human
gccucccgcguugggcaac

SEQ ID NO: 3760562 - RNA, 13 nt, Human
gccucccucaacc

SEQ ID NO: 3760563 - RNA, 18 nt, Human
gccucccucacccugagc

SEQ ID NO: 3760564 - RNA, 20 nt, Human
gccucccucacccugagccc

SEQ ID NO: 3760565 - RNA, 16 nt, Human
gccucccuccacccca

SEQ ID NO: 3760566 - RNA, 18 nt, Human
gccucccuccaccccagg

SEQ ID NO: 3760567 - RNA, 20 nt, Human
gccucccuccaccccaggac

SEQ ID NO: 3760568 - RNA, 16 nt, Human
gccucccucucucuuc

SEQ ID NO: 3760569 - RNA, 23 nt, Human
gccucccucucucuucugcucca

SEQ ID NO: 3760570 - RNA, 12 nt, Human
gccucccugagc

SEQ ID NO: 3760571 - RNA, 13 nt, Human
gccucccugagcu

SEQ ID NO: 3760572 - RNA, 16 nt, Human
gccucccuggucccuu

SEQ ID NO: 3760573 - RNA, 15 nt, Human
gccucccuggugaga

SEQ ID NO: 3760574 - RNA, 14 nt, Human
gccucccuguccac

SEQ ID NO: 3760575 - RNA, 23 nt, Human
gccucccuucaugcauggaaauu

SEQ ID NO: 3760576 - RNA, 13 nt, Human
gccucccuugacu

SEQ ID NO: 3760577 - RNA, 18 nt, Human
gccuccggcgucagccuc

SEQ ID NO: 3760578 - RNA, 21 nt, Human
gccuccggcgucagccuccag

SEQ ID NO: 3760579 - RNA, 23 nt, Human
gccuccggcgucagccuccagcc

SEQ ID NO: 3760580 - RNA, 19 nt, Human
gccuccgggacccccagga

SEQ ID NO: 3760581 - RNA, 21 nt, Human
gccuccgucacuaccuggcug

SEQ ID NO: 3760582 - RNA, 16 nt, Human
gccuccucacccccag

SEQ ID NO: 3760583 - RNA, 18 nt, Human
gccuccucacccccagcu

SEQ ID NO: 3760584 - RNA, 19 nt, Human
gccuccucacccccagcuu

SEQ ID NO: 3760585 - RNA, 12 nt, Human
gccuccucccuc

SEQ ID NO: 3760586 - RNA, 16 nt, Human
gccuccucccuuagcu

SEQ ID NO: 3760587 - RNA, 17 nt, Human
gccuccucccuuagcuc

SEQ ID NO: 3760588 - RNA, 20 nt, Human
gccuccucuaacaggggcug

SEQ ID NO: 3760589 - RNA, 21 nt, Human
gccuccucugucugcccuuca

SEQ ID NO: 3760590 - RNA, 17 nt, Human
gccuccucuucaccccg

SEQ ID NO: 3760591 - RNA, 23 nt, Human
gccuccugaguagcugggacuac

SEQ ID NO: 3760592 - RNA, 15 nt, Human
gccuccugcccaguc

SEQ ID NO: 3760593 - RNA, 17 nt, Human
gccuccugcccaguccc

SEQ ID NO: 3760594 - RNA, 20 nt, Human
gccuccugcccaguccccca

SEQ ID NO: 3760595 - RNA, 13 nt, Human
gccuccugccggc

SEQ ID NO: 3760596 - RNA, 20 nt, Human
gccuccugccggcuccuugg

SEQ ID NO: 3760597 - RNA, 23 nt, Human
gccuccugccugccccucucccg

SEQ ID NO: 3760598 - RNA, 14 nt, Human
gccuccuguggccu

SEQ ID NO: 3760599 - RNA, 19 nt, Human
gccuccuguguacuguguc

SEQ ID NO: 3760600 - RNA, 19 nt, Human
gccuccugugugugcgccu

SEQ ID NO: 3760601 - RNA, 19 nt, Human
gccuccuuccaccucccuc

SEQ ID NO: 3760602 - RNA, 14 nt, Human
gccuccuuccucuu

SEQ ID NO: 3760603 - RNA, 24 nt, Human
gccuccuuccucuuuuccuuccca

SEQ ID NO: 3760604 - RNA, 12 nt, Human
gccuccuucuga

SEQ ID NO: 3760605 - RNA, 22 nt, Human
gccuccuucugagcuccugucc

SEQ ID NO: 3760606 - RNA, 16 nt, Human
gccucgaacuccuggg

SEQ ID NO: 3760607 - RNA, 20 nt, Human
gccucgaacuggcugcaaag

SEQ ID NO: 3760608 - RNA, 17 nt, Human
gccucgacacagagugg

SEQ ID NO: 3760609 - RNA, 20 nt, Human
gccucgcaacccgugccaag

SEQ ID NO: 3760610 - RNA, 14 nt, Human
gccucgcccaccgc

SEQ ID NO: 3760611 - RNA, 16 nt, Human
gccucgcccauccccu

SEQ ID NO: 3760612 - RNA, 16 nt, Human
gccucgccccuggcag

SEQ ID NO: 3760613 - RNA, 17 nt, Human
gccucgccccuggcaga

SEQ ID NO: 3760614 - RNA, 18 nt, Human
gccucgccccuggcagag

SEQ ID NO: 3760615 - RNA, 13 nt, Human
gccucgccuggcc

SEQ ID NO: 3760616 - RNA, 14 nt, Human
gccucgcuccccac

SEQ ID NO: 3760617 - RNA, 18 nt, Human
gccucgcuccccacucug

SEQ ID NO: 3760618 - RNA, 24 nt, Human
gccucgcuccccacucugcucuga

SEQ ID NO: 3760619 - RNA, 23 nt, Human
gccucgcucuguuacccagggug

SEQ ID NO: 3760620 - RNA, 13 nt, Human
gccucggacuuag

SEQ ID NO: 3760621 - RNA, 18 nt, Human
gccucggauccccuuccu

SEQ ID NO: 3760622 - RNA, 22 nt, Human
gccucggauccccuuccuacca

SEQ ID NO: 3760623 - RNA, 13 nt, Human
gccucggccccuc

SEQ ID NO: 3760624 - RNA, 17 nt, Human
gccucggcuccugcugc

SEQ ID NO: 3760625 - RNA, 19 nt, Human
gccucggcuggcuccccug

SEQ ID NO: 3760626 - RNA, 20 nt, Human
gccucggcuggcuccccugc

SEQ ID NO: 3760627 - RNA, 19 nt, Human
gccucggcuuuucucagcu

SEQ ID NO: 3760628 - RNA, 23 nt, Human
gccucgggaaccucacucuugcc

SEQ ID NO: 3760629 - RNA, 20 nt, Human
gccucguuggaagaggaaca

SEQ ID NO: 3760630 - RNA, 16 nt, Human
gccucuaaccccaggc

SEQ ID NO: 3760631 - RNA, 16 nt, Human
gccucuacugggaagg

SEQ ID NO: 3760632 - RNA, 13 nt, Human
gccucuagggacc

SEQ ID NO: 3760633 - RNA, 17 nt, Human
gccucuagggaccccuc

SEQ ID NO: 3760634 - RNA, 18 nt, Human
gccucuagggaccccucc

SEQ ID NO: 3760635 - RNA, 23 nt, Human
gccucuagggaccccuccucccu

SEQ ID NO: 3760636 - RNA, 18 nt, Human
gccucucaucaacugaau

SEQ ID NO: 3760637 - RNA, 20 nt, Human
gccucucauuccagaggaag

SEQ ID NO: 3760638 - RNA, 21 nt, Human
gccucuccacucaugugacuc

SEQ ID NO: 3760639 - RNA, 24 nt, Human
gccucuccacucaugugacucuuu

SEQ ID NO: 3760640 - RNA, 21 nt, Human
gccucuccaguuugcaccugu

SEQ ID NO: 3760641 - RNA, 16 nt, Human
gccucuccauuugcuc

SEQ ID NO: 3760642 - RNA, 22 nt, Human
gccucuccccagguccagcucu

SEQ ID NO: 3760643 - RNA, 23 nt, Human
gccucuccccagguccagcucug

SEQ ID NO: 3760644 - RNA, 17 nt, Human
gccucuccccugccugc

SEQ ID NO: 3760645 - RNA, 18 nt, Human
gccucuccccugccugcc

SEQ ID NO: 3760646 - RNA, 23 nt, Human
gccucucccgucagggcccaagu

SEQ ID NO: 3760647 - RNA, 18 nt, Human
gccucucccucugguccc

SEQ ID NO: 3760648 - RNA, 17 nt, Human
gccucucccugcugcuc

SEQ ID NO: 3760649 - RNA, 20 nt, Human
gccucucccugcugcuccua

SEQ ID NO: 3760650 - RNA, 22 nt, Human
gccucucccugcugcuccuagg

SEQ ID NO: 3760651 - RNA, 21 nt, Human
gccucuccgccccugagccca

SEQ ID NO: 3760652 - RNA, 23 nt, Human
gccucuccgccccugagcccacu

SEQ ID NO: 3760653 - RNA, 14 nt, Human
gccucuccuuaaau

SEQ ID NO: 3760654 - RNA, 19 nt, Human
gccucucgguggccagcag

SEQ ID NO: 3760655 - RNA, 14 nt, Human
gccucucuacaguc

SEQ ID NO: 3760656 - RNA, 13 nt, Human
gccucucuagcac

SEQ ID NO: 3760657 - RNA, 21 nt, Human
gccucucuauccucucuuccu

SEQ ID NO: 3760658 - RNA, 23 nt, Human
gccucucuauccucucuuccucu

SEQ ID NO: 3760659 - RNA, 14 nt, Human
gccucucucaggcc

SEQ ID NO: 3760660 - RNA, 16 nt, Human
gccucucucaggccaa

SEQ ID NO: 3760661 - RNA, 12 nt, Human
gccucucuccca

SEQ ID NO: 3760662 - RNA, 13 nt, Human
gccucucucccag

SEQ ID NO: 3760663 - RNA, 17 nt, Human
gccucucucccagucua

SEQ ID NO: 3760664 - RNA, 16 nt, Human
gccucucugcaggucc

SEQ ID NO: 3760665 - RNA, 20 nt, Human
gccucucugcaggucccuaa

SEQ ID NO: 3760666 - RNA, 17 nt, Human
gcccuggaucagcgugg

SEQ ID NO: 3760667 - RNA, 19 nt, Human
gcccuggaucagcguggcc

SEQ ID NO: 3760668 - RNA, 20 nt, Human
gcccuggaucagcguggccu

SEQ ID NO: 3760669 - RNA, 23 nt, Human
gcccuggaucagcguggccuugu

SEQ ID NO: 3760670 - RNA, 19 nt, Human
gcccuggcaggaugacccu

SEQ ID NO: 3760671 - RNA, 14 nt, Human
gcccuggcaggcag

SEQ ID NO: 3760672 - RNA, 17 nt, Human
gcccuggcagggggcau

SEQ ID NO: 3760673 - RNA, 14 nt, Human
gcccuggccagagg

SEQ ID NO: 3760674 - RNA, 16 nt, Human
gcccuggcccaucaug

SEQ ID NO: 3760675 - RNA, 17 nt, Human
gcccuggcccccacaug

SEQ ID NO: 3760676 - RNA, 12 nt, Human
gcccuggcccug

SEQ ID NO: 3760677 - RNA, 12 nt, Human
gcccuggccucc

SEQ ID NO: 3760678 - RNA, 20 nt, Human
gcccuggccuugggcccucu

SEQ ID NO: 3760679 - RNA, 19 nt, Human
gcccuggcuccagugaaac

SEQ ID NO: 3760680 - RNA, 19 nt, Human
gcccuggcucccacaggcc

SEQ ID NO: 3760681 - RNA, 12 nt, Human
gcccuggcugcu

SEQ ID NO: 3760682 - RNA, 18 nt, Human
gcccugggaaaccccuuc

SEQ ID NO: 3760683 - RNA, 20 nt, Human
gcccugggaccgcuacacca

SEQ ID NO: 3760684 - RNA, 17 nt, Human
gcccugggaggcucugg

SEQ ID NO: 3760685 - RNA, 17 nt, Human
gcccugggccacacuga

SEQ ID NO: 3760686 - RNA, 18 nt, Human
gcccugggccccaccacc

SEQ ID NO: 3760687 - RNA, 19 nt, Human
gcccugggccccaccaccu

SEQ ID NO: 3760688 - RNA, 20 nt, Human
gcccugggccccaccaccua

SEQ ID NO: 3760689 - RNA, 16 nt, Human
gcccugggcucggagg

SEQ ID NO: 3760690 - RNA, 18 nt, Human
gcccugggcuggaaucag

SEQ ID NO: 3760691 - RNA, 12 nt, Human
gcccuggggccu

SEQ ID NO: 3760692 - RNA, 13 nt, Human
gcccuggggccug

SEQ ID NO: 3760693 - RNA, 15 nt, Human
gcccuggggccugua

SEQ ID NO: 3760694 - RNA, 20 nt, Human
gcccuggggcugaucucagg

SEQ ID NO: 3760695 - RNA, 15 nt, Human
gcccuggggcugggc

SEQ ID NO: 3760696 - RNA, 16 nt, Human
gcccugguccagggaa

SEQ ID NO: 3760697 - RNA, 20 nt, Human
gcccugguccagggaagcug

SEQ ID NO: 3760698 - RNA, 16 nt, Human
gcccuggucucagcag

SEQ ID NO: 3760699 - RNA, 17 nt, Human
gcccuggucucagcagc

SEQ ID NO: 3760700 - RNA, 17 nt, Human
gcccuggugcugccaca

SEQ ID NO: 3760701 - RNA, 14 nt, Human
gcccugguggagaa

SEQ ID NO: 3760702 - RNA, 18 nt, Human
gcccugguggagaaagca

SEQ ID NO: 3760703 - RNA, 17 nt, Human
gcccugguggcaguggg

SEQ ID NO: 3760704 - RNA, 18 nt, Human
gcccugguggcaguggga

SEQ ID NO: 3760705 - RNA, 23 nt, Human
gcccugguggcagugggagcugc

SEQ ID NO: 3760706 - RNA, 13 nt, Human
gcccugguggccc

SEQ ID NO: 3760707 - RNA, 14 nt, Human
gcccugguggcccu

SEQ ID NO: 3760708 - RNA, 15 nt, Human
gcccugguggcccuc

SEQ ID NO: 3760709 - RNA, 18 nt, Human
gcccugguggcccucucc

SEQ ID NO: 3760710 - RNA, 22 nt, Human
gcccugucagcaugaauuugua

SEQ ID NO: 3760711 - RNA, 15 nt, Human
gcccugucaggaggc

SEQ ID NO: 3760712 - RNA, 18 nt, Human
gcccugucaggaggcaga

SEQ ID NO: 3760713 - RNA, 15 nt, Human
gcccugucccuccca

SEQ ID NO: 3760714 - RNA, 16 nt, Human
gcccugucccucccac

SEQ ID NO: 3760715 - RNA, 18 nt, Human
gcccugucccucccaccu

SEQ ID NO: 3760716 - RNA, 22 nt, Human
gcccugucccucccaccucugu

SEQ ID NO: 3760717 - RNA, 15 nt, Human
gcccuguccugccau

SEQ ID NO: 3760718 - RNA, 16 nt, Human
gcccugucgagacacu

SEQ ID NO: 3760719 - RNA, 17 nt, Human
gcccugucgagacacuu

SEQ ID NO: 3760720 - RNA, 16 nt, Human
gcccugucgggcuuug

SEQ ID NO: 3760721 - RNA, 17 nt, Human
gcccugucgggcuuugu

SEQ ID NO: 3760722 - RNA, 19 nt, Human
gcccugucgggcuuugugu

SEQ ID NO: 3760723 - RNA, 21 nt, Human
gcccuguggaugagcccucag

SEQ ID NO: 3760724 - RNA, 16 nt, Human
gcccugugggccccca

SEQ ID NO: 3760725 - RNA, 13 nt, Human
gcccuguguacuu

SEQ ID NO: 3760726 - RNA, 17 nt, Human
gcccuguucagcuacuc

SEQ ID NO: 3760727 - RNA, 17 nt, Human
gcccuguugugccacag

SEQ ID NO: 3760728 - RNA, 16 nt, Human
gcccuuacacuuacug

SEQ ID NO: 3760729 - RNA, 19 nt, Human
gcccuuagcagggaaacag

SEQ ID NO: 3760730 - RNA, 16 nt, Human
gcccuuagucccccaa

SEQ ID NO: 3760731 - RNA, 20 nt, Human
gcccuuagucccccaacucu

SEQ ID NO: 3760732 - RNA, 16 nt, Human
gcccuuaucugugcuc

SEQ ID NO: 3760733 - RNA, 19 nt, Human
gcccuuaugacugccaaga

SEQ ID NO: 3760734 - RNA, 22 nt, Human
gcccuucacauuuuuuaugggc

SEQ ID NO: 3760735 - RNA, 21 nt, Human
gcccuucagcauccucaguuc

SEQ ID NO: 3760736 - RNA, 23 nt, Human
gcccuuccgcaguguggccaggc

SEQ ID NO: 3760737 - RNA, 15 nt, Human
gcccuuccucuccac

SEQ ID NO: 3760738 - RNA, 22 nt, Human
gcccuuccucuccacccuccca

SEQ ID NO: 3760739 - RNA, 17 nt, Human
gcccuuccucuccacug

SEQ ID NO: 3760740 - RNA, 17 nt, Human
gcccuuccugcugcgca

SEQ ID NO: 3760741 - RNA, 13 nt, Human
gcccuuccuggac

SEQ ID NO: 3760742 - RNA, 15 nt, Human
gcccuuccuggacag

SEQ ID NO: 3760743 - RNA, 17 nt, Human
gcccuuccuggacagcu

SEQ ID NO: 3760744 - RNA, 18 nt, Human
gcccuuccuggacagcug

SEQ ID NO: 3760745 - RNA, 21 nt, Human
gcccuucuauacccacccaga

SEQ ID NO: 3760746 - RNA, 16 nt, Human
gcccuucucuccagcc

SEQ ID NO: 3760747 - RNA, 21 nt, Human
gcccuucucuccagccccugg

SEQ ID NO: 3760748 - RNA, 22 nt, Human
gcccuucucuccagccccugga

SEQ ID NO: 3760749 - RNA, 16 nt, Human
gcccuucuuccccuuc

SEQ ID NO: 3760750 - RNA, 15 nt, Human
gcccuucuugcugcc

SEQ ID NO: 3760751 - RNA, 12 nt, Human
gcccuucuuucu

SEQ ID NO: 3760752 - RNA, 13 nt, Human
gcccuucuuucua

SEQ ID NO: 3760753 - RNA, 18 nt, Human
gcccuugagcuccccaaa

SEQ ID NO: 3760754 - RNA, 15 nt, Human
gcccuugcccaugcu

SEQ ID NO: 3760755 - RNA, 21 nt, Human
gcccuugcccugaccucccag

SEQ ID NO: 3760756 - RNA, 15 nt, Human
gcccuuggagcgugg

SEQ ID NO: 3760757 - RNA, 20 nt, Human
gcccuuggggguccuccucc

SEQ ID NO: 3760758 - RNA, 21 nt, Human
gcccuugucccacucaagcca

SEQ ID NO: 3760759 - RNA, 21 nt, Human
gcccuugucggccccaccagu

SEQ ID NO: 3760760 - RNA, 23 nt, Human
gcccuugugaaucaagggucagg

SEQ ID NO: 3760761 - RNA, 17 nt, Human
gcccuuguuuggggcag

SEQ ID NO: 3760762 - RNA, 19 nt, Human
gcccuuguuuggggcagga

SEQ ID NO: 3760763 - RNA, 20 nt, Human
gcccuuguuuggggcaggag

SEQ ID NO: 3760764 - RNA, 16 nt, Human
gcccuuuccuccucag

SEQ ID NO: 3760765 - RNA, 16 nt, Human
gcccuuucuguaccau

SEQ ID NO: 3760766 - RNA, 13 nt, Human
gcccuuucugugu

SEQ ID NO: 3760767 - RNA, 16 nt, Human
gcccuuugaagccuca

SEQ ID NO: 3760768 - RNA, 13 nt, Human
gcccuuugcuguc

SEQ ID NO: 3760769 - RNA, 14 nt, Human
gcccuuuugucucu

SEQ ID NO: 3760770 - RNA, 14 nt, Human
gcccuuuuucaaua

SEQ ID NO: 3760771 - RNA, 20 nt, Human
gcccuuuuuucugccuccuu

SEQ ID NO: 3760772 - RNA, 13 nt, Human
gccgaaacuggaa

SEQ ID NO: 3760773 - RNA, 22 nt, Human
gccgaagaaggguccuucccuc

SEQ ID NO: 3760774 - RNA, 19 nt, Human
gccgaagcuaacagggaag

SEQ ID NO: 3760775 - RNA, 14 nt, Human
gccgaaugugcagg

SEQ ID NO: 3760776 - RNA, 15 nt, Human
gccgacauugucucc

SEQ ID NO: 3760777 - RNA, 14 nt, Human
gccgaccagagccc

SEQ ID NO: 3760778 - RNA, 12 nt, Human
gccgaccucagc

SEQ ID NO: 3760779 - RNA, 15 nt, Human
gccgaccucagccuu

SEQ ID NO: 3760780 - RNA, 18 nt, Human
gccgacgcuugcacgacc

SEQ ID NO: 3760781 - RNA, 14 nt, Human
gccgacucuggccc

SEQ ID NO: 3760782 - RNA, 16 nt, Human
gccgacucuggcccug

SEQ ID NO: 3760783 - RNA, 17 nt, Human
gccgacucuggcccugg

SEQ ID NO: 3760784 - RNA, 18 nt, Human
gccgacucuggcccuggc

SEQ ID NO: 3760785 - RNA, 20 nt, Human
gccgagaagccagugcggca

SEQ ID NO: 3760786 - RNA, 22 nt, Human
gccgagacauggcuugccacag

SEQ ID NO: 3760787 - RNA, 21 nt, Human
gccgagacucgacucugugcc

SEQ ID NO: 3760788 - RNA, 15 nt, Human
gccgagagccugcuc

SEQ ID NO: 3760789 - RNA, 19 nt, Human
gccgagagccugcuccccc

SEQ ID NO: 3760790 - RNA, 21 nt, Human
gccgagaguccaucagccucc

SEQ ID NO: 3760791 - RNA, 21 nt, Human
gccgagaucacgccacugcac

SEQ ID NO: 3760792 - RNA, 18 nt, Human
gccgagauugcaccacug

SEQ ID NO: 3760793 - RNA, 20 nt, Human
gccgagcaaccguggcccuu

SEQ ID NO: 3760794 - RNA, 15 nt, Human
gccgagccgggccug

SEQ ID NO: 3760795 - RNA, 16 nt, Human
gccgagccgggccugg

SEQ ID NO: 3760796 - RNA, 17 nt, Human
gccgagccgggccuggg

SEQ ID NO: 3760797 - RNA, 19 nt, Human
gccgagccgggccuggggc

SEQ ID NO: 3760798 - RNA, 18 nt, Human
gccgaggagccaggcaac

SEQ ID NO: 3760799 - RNA, 18 nt, Human
gccgaggaggugccugga

SEQ ID NO: 3760800 - RNA, 20 nt, Human
gccgaggguccuggcuccug

SEQ ID NO: 3760801 - RNA, 14 nt, Human
gccgaguccaagcu

SEQ ID NO: 3760802 - RNA, 18 nt, Human
gccgaguccaagcuggga

SEQ ID NO: 3760803 - RNA, 22 nt, Human
gccgauagagggacggccaaga

SEQ ID NO: 3760804 - RNA, 21 nt, Human
gccgauggagacaccaaccga

SEQ ID NO: 3760805 - RNA, 16 nt, Human
gccgcaauacaggaac

SEQ ID NO: 3760806 - RNA, 19 nt, Human
gccgcaccauugaacugua

SEQ ID NO: 3760807 - RNA, 15 nt, Human
gccgcaccccagagu

SEQ ID NO: 3760808 - RNA, 16 nt, Human
gccgcaccccagagug

SEQ ID NO: 3760809 - RNA, 11 nt, Human
gccgcagcccu

SEQ ID NO: 3760810 - RNA, 12 nt, Human
gccgcagcccug

SEQ ID NO: 3760811 - RNA, 15 nt, Human
gccgcagcccugcag

SEQ ID NO: 3760812 - RNA, 17 nt, Human
gccgcagcccugcagag

SEQ ID NO: 3760813 - RNA, 20 nt, Human
gccgcagcccugcagagggc

SEQ ID NO: 3760814 - RNA, 17 nt, Human
gccgcagccucccucug

SEQ ID NO: 3760815 - RNA, 15 nt, Human
gccgcaucucacagc

SEQ ID NO: 3760816 - RNA, 23 nt, Human
gccucucugcaggucccuaauaa

SEQ ID NO: 3760817 - RNA, 17 nt, Human
gccucucuggccuccca

SEQ ID NO: 3760818 - RNA, 15 nt, Human
gccucucuuccuauc

SEQ ID NO: 3760819 - RNA, 17 nt, Human
gccucucuuccuauccc

SEQ ID NO: 3760820 - RNA, 22 nt, Human
gccucucuuccuaucccauccc

SEQ ID NO: 3760821 - RNA, 16 nt, Human
gccucugaaaagugug

SEQ ID NO: 3760822 - RNA, 16 nt, Human
gccucugacacacagc

SEQ ID NO: 3760823 - RNA, 17 nt, Human
gccucugacacacagcu

SEQ ID NO: 3760824 - RNA, 19 nt, Human
gccucugacacacagcucu

SEQ ID NO: 3760825 - RNA, 21 nt, Human
gccucugaccccuccucacug

SEQ ID NO: 3760826 - RNA, 14 nt, Human
gccucugaggccag

SEQ ID NO: 3760827 - RNA, 15 nt, Human
gccucugaggccagc

SEQ ID NO: 3760828 - RNA, 17 nt, Human
gccucugaggccagccu

SEQ ID NO: 3760829 - RNA, 19 nt, Human
gccucugaggccagccugg

SEQ ID NO: 3760830 - RNA, 23 nt, Human
gccucugaggccagccuggccuc

SEQ ID NO: 3760831 - RNA, 20 nt, Human
gccucugagggaaagcccag

SEQ ID NO: 3760832 - RNA, 13 nt, Human
gccucugauaugg

SEQ ID NO: 3760833 - RNA, 16 nt, Human
gccucugccacugacu

SEQ ID NO: 3760834 - RNA, 15 nt, Human
gccucuggaaagcaa

SEQ ID NO: 3760835 - RNA, 17 nt, Human
gccucuggaggccucug

SEQ ID NO: 3760836 - RNA, 19 nt, Human
gccucuggaggccucuggg

SEQ ID NO: 3760837 - RNA, 13 nt, Human
gccucuggcuaga

SEQ ID NO: 3760838 - RNA, 18 nt, Human
gccucuggcuagaggcca

SEQ ID NO: 3760839 - RNA, 21 nt, Human
gccucuggcuagaggccagcc

SEQ ID NO: 3760840 - RNA, 17 nt, Human
gccucugggggguggcc

SEQ ID NO: 3760841 - RNA, 20 nt, Human
gccucugggggguggccagg

SEQ ID NO: 3760842 - RNA, 21 nt, Human
gccucugggggguggccaggc

SEQ ID NO: 3760843 - RNA, 13 nt, Human
gccucugggucag

SEQ ID NO: 3760844 - RNA, 21 nt, Human
gccucugucauaucuucacaa

SEQ ID NO: 3760845 - RNA, 15 nt, Human
gccucuguccccuuc

SEQ ID NO: 3760846 - RNA, 19 nt, Human
gccucuguccccuucucuc

SEQ ID NO: 3760847 - RNA, 16 nt, Human
gccucugucuagcaug

SEQ ID NO: 3760848 - RNA, 12 nt, Human
gccucugugccu

SEQ ID NO: 3760849 - RNA, 11 nt, Human
gccucugugcu

SEQ ID NO: 3760850 - RNA, 14 nt, Human
gccucugugcugug

SEQ ID NO: 3760851 - RNA, 21 nt, Human
gccucuguggagccccagcau

SEQ ID NO: 3760852 - RNA, 15 nt, Human
gccucugugucacug

SEQ ID NO: 3760853 - RNA, 20 nt, Human
gccucugugucacuggcugc

SEQ ID NO: 3760854 - RNA, 21 nt, Human
gccucuguguccuucccugca

SEQ ID NO: 3760855 - RNA, 19 nt, Human
gccucuuaaauaaaccuuu

SEQ ID NO: 3760856 - RNA, 15 nt, Human
gccucuuagaugcag

SEQ ID NO: 3760857 - RNA, 18 nt, Human
gccucuuaugggcugggu

SEQ ID NO: 3760858 - RNA, 21 nt, Human
gccucuuaugggcuggguucu

SEQ ID NO: 3760859 - RNA, 16 nt, Human
gccucuucccccugcu

SEQ ID NO: 3760860 - RNA, 13 nt, Human
gccucuucccucu

SEQ ID NO: 3760861 - RNA, 17 nt, Human
gccucuucuagagccgu

SEQ ID NO: 3760862 - RNA, 15 nt, Human
gccucuucugagcuu

SEQ ID NO: 3760863 - RNA, 16 nt, Human
gccucuucugucccug

SEQ ID NO: 3760864 - RNA, 13 nt, Human
gccucuugaccag

SEQ ID NO: 3760865 - RNA, 14 nt, Human
gccucuugaccagg

SEQ ID NO: 3760866 - RNA, 16 nt, Human
gccucuugaccaggcu

SEQ ID NO: 3760867 - RNA, 17 nt, Human
gccucuugaccaggcug

SEQ ID NO: 3760868 - RNA, 19 nt, Human
gccucuugagcaguggcug

SEQ ID NO: 3760869 - RNA, 21 nt, Human
gccucuugagcaguggcuggu

SEQ ID NO: 3760870 - RNA, 20 nt, Human
gccucuugcggucccuucuu

SEQ ID NO: 3760871 - RNA, 17 nt, Human
gccucuuggaccucugc

SEQ ID NO: 3760872 - RNA, 18 nt, Human
gccucuuggaccucugcu

SEQ ID NO: 3760873 - RNA, 14 nt, Human
gccucuuggguuca

SEQ ID NO: 3760874 - RNA, 16 nt, Human
gccucuuguaaagacu

SEQ ID NO: 3760875 - RNA, 23 nt, Human
gccucuugucuuccuauuucaga

SEQ ID NO: 3760876 - RNA, 23 nt, Human
gccucuuucaagcagucgugccu

SEQ ID NO: 3760877 - RNA, 23 nt, Human
gccucuuucauccacuagugcaa

SEQ ID NO: 3760878 - RNA, 23 nt, Human
gccucuuugucuaaaacaauaaa

SEQ ID NO: 3760879 - RNA, 16 nt, Human
gccucuuuuaccugcu

SEQ ID NO: 3760880 - RNA, 19 nt, Human
gccucuuuuaccugcugcu

SEQ ID NO: 3760881 - RNA, 18 nt, Human
gccucuuuucucugugcu

SEQ ID NO: 3760882 - RNA, 14 nt, Human
gccugaaaggagcc

SEQ ID NO: 3760883 - RNA, 19 nt, Human
gccugaaccccagggcugu

SEQ ID NO: 3760884 - RNA, 21 nt, Human
gccugaaggaggugagagaag

SEQ ID NO: 3760885 - RNA, 11 nt, Human
gccugaauaaa

SEQ ID NO: 3760886 - RNA, 17 nt, Human
gccugaaucaugagccu

SEQ ID NO: 3760887 - RNA, 19 nt, Human
gccugaaucaugagccugc

SEQ ID NO: 3760888 - RNA, 23 nt, Human
gccugaaucaugagccugcugga

SEQ ID NO: 3760889 - RNA, 20 nt, Human
gccugacaaccacuggucug

SEQ ID NO: 3760890 - RNA, 15 nt, Human
gccugacacacuaac

SEQ ID NO: 3760891 - RNA, 15 nt, Human
gccugaccaaacagc

SEQ ID NO: 3760892 - RNA, 23 nt, Human
gccugacccuacuucuuuugcuc

SEQ ID NO: 3760893 - RNA, 15 nt, Human
gccugaccucccccu

SEQ ID NO: 3760894 - RNA, 20 nt, Human
gccugaccucccccuccuuc

SEQ ID NO: 3760895 - RNA, 15 nt, Human
gccugaccuuccuuc

SEQ ID NO: 3760896 - RNA, 20 nt, Human
gccugacuagggagccaugu

SEQ ID NO: 3760897 - RNA, 15 nt, Human
gccugacucccccag

SEQ ID NO: 3760898 - RNA, 21 nt, Human
gccugacucccccaguccccu

SEQ ID NO: 3760899 - RNA, 20 nt, Human
gccugacugccaagccaugg

SEQ ID NO: 3760900 - RNA, 20 nt, Human
gccugagagaauuggcucaa

SEQ ID NO: 3760901 - RNA, 16 nt, Human
gccugagaggcaggca

SEQ ID NO: 3760902 - RNA, 20 nt, Human
gccugagagucagcucucug

SEQ ID NO: 3760903 - RNA, 18 nt, Human
gccugagcaacucuugau

SEQ ID NO: 3760904 - RNA, 23 nt, Human
gccugagcaccucccagccccug

SEQ ID NO: 3760905 - RNA, 19 nt, Human
gccugagcaguccuuggcc

SEQ ID NO: 3760906 - RNA, 13 nt, Human
gccugagcccagg

SEQ ID NO: 3760907 - RNA, 15 nt, Human
gccugagcccaggga

SEQ ID NO: 3760908 - RNA, 17 nt, Human
gccugagcccagggagg

SEQ ID NO: 3760909 - RNA, 19 nt, Human
gccugagcccagggaggcc

SEQ ID NO: 3760910 - RNA, 20 nt, Human
gccugagcccagggaggccg

SEQ ID NO: 3760911 - RNA, 22 nt, Human
gccugagcccuacucccugcag

SEQ ID NO: 3760912 - RNA, 23 nt, Human
gccugagcgcuccugccgcagag

SEQ ID NO: 3760913 - RNA, 17 nt, Human
gccugagcucacucggc

SEQ ID NO: 3760914 - RNA, 21 nt, Human
gccugaggagcccagcgucca

SEQ ID NO: 3760915 - RNA, 14 nt, Human
gccugaggcugaga

SEQ ID NO: 3760916 - RNA, 14 nt, Human
gccugaggcuggga

SEQ ID NO: 3760917 - RNA, 10 nt, Human
gccugaggga

SEQ ID NO: 3760918 - RNA, 15 nt, Human
gccugagggccccuc

SEQ ID NO: 3760919 - RNA, 18 nt, Human
gccugagggccccucugc

SEQ ID NO: 3760920 - RNA, 12 nt, Human
gccugagggugg

SEQ ID NO: 3760921 - RNA, 16 nt, Human
gccugagguuacugga

SEQ ID NO: 3760922 - RNA, 16 nt, Human
gccugaguagaaaggc

SEQ ID NO: 3760923 - RNA, 20 nt, Human
gccugagucgugaccugcua

SEQ ID NO: 3760924 - RNA, 23 nt, Human
gccugagucgugaccugcuaggc

SEQ ID NO: 3760925 - RNA, 22 nt, Human
gccugagugagaggggaggcca

SEQ ID NO: 3760926 - RNA, 15 nt, Human
gccugagugccuggc

SEQ ID NO: 3760927 - RNA, 14 nt, Human
gccugauauaaaug

SEQ ID NO: 3760928 - RNA, 20 nt, Human
gccugaucagaccacggcuc

SEQ ID NO: 3760929 - RNA, 16 nt, Human
gccugaucucuuccug

SEQ ID NO: 3760930 - RNA, 13 nt, Human
gccugaucugccc

SEQ ID NO: 3760931 - RNA, 19 nt, Human
gccugaugacaauaaagcu

SEQ ID NO: 3760932 - RNA, 17 nt, Human
gccugaugacagagcga

SEQ ID NO: 3760933 - RNA, 19 nt, Human
gccugaugagauuuuuaaa

SEQ ID NO: 3760934 - RNA, 17 nt, Human
gccugaugcucccuccc

SEQ ID NO: 3760935 - RNA, 16 nt, Human
gccugauuaaagaaug

SEQ ID NO: 3760936 - RNA, 20 nt, Human
gccugauucggcugucucag

SEQ ID NO: 3760937 - RNA, 16 nt, Human
gccugauuuguuccuu

SEQ ID NO: 3760938 - RNA, 21 nt, Human
gccugcaaacucacugcucaa

SEQ ID NO: 3760939 - RNA, 18 nt, Human
gccugcaaucugagccag

SEQ ID NO: 3760940 - RNA, 11 nt, Human
gccugcacaca

SEQ ID NO: 3760941 - RNA, 17 nt, Human
gccugcacuccucaggg

SEQ ID NO: 3760942 - RNA, 19 nt, Human
gccugcacuugggggcuca

SEQ ID NO: 3760943 - RNA, 21 nt, Human
gccugcagaaguaagccucau

SEQ ID NO: 3760944 - RNA, 20 nt, Human
gccugcagagcugcgggcug

SEQ ID NO: 3760945 - RNA, 20 nt, Human
gccugcagaggucugugcug

SEQ ID NO: 3760946 - RNA, 13 nt, Human
gccugcaggaccu

SEQ ID NO: 3760947 - RNA, 17 nt, Human
gccugcaggaccucgug

SEQ ID NO: 3760948 - RNA, 18 nt, Human
gccugcaggaccucgugc

SEQ ID NO: 3760949 - RNA, 20 nt, Human
gccugcaggaccugccugua

SEQ ID NO: 3760950 - RNA, 16 nt, Human
gccugcaggaucucac

SEQ ID NO: 3760951 - RNA, 23 nt, Human
gccugcaggaucucaccaggcag

SEQ ID NO: 3760952 - RNA, 24 nt, Human
gccugcaggaucucaccaggcagc

SEQ ID NO: 3760953 - RNA, 14 nt, Human
gccugcagggccau

SEQ ID NO: 3760954 - RNA, 18 nt, Human
gccugcagggccauggcu

SEQ ID NO: 3760955 - RNA, 22 nt, Human
gccugcaggguggugcugggac

SEQ ID NO: 3760956 - RNA, 24 nt, Human
gccugcaguuaauuagcauucugg

SEQ ID NO: 3760957 - RNA, 16 nt, Human
gccugcauugagcuug

SEQ ID NO: 3760958 - RNA, 21 nt, Human
gccugcauuuccucgcagccu

SEQ ID NO: 3760959 - RNA, 15 nt, Human
gccugccaccuggac

SEQ ID NO: 3760960 - RNA, 18 nt, Human
gccugccaccuggacccc

SEQ ID NO: 3760961 - RNA, 14 nt, Human
gccugccagcugca

SEQ ID NO: 3760962 - RNA, 18 nt, Human
gccugccagcugcacuga

SEQ ID NO: 3760963 - RNA, 18 nt, Human
gccugccaggaggaccca

SEQ ID NO: 3760964 - RNA, 23 nt, Human
gccugccaggaggacccagggcu

SEQ ID NO: 3760965 - RNA, 22 nt, Human
cuguccacccgccccugccccu

SEQ ID NO: 3760966 - RNA, 15 nt, Human
cuguccagacagccu

SEQ ID NO: 3760967 - RNA, 11 nt, Human
cuguccagaga

SEQ ID NO: 3760968 - RNA, 17 nt, Human
cuguccagcagucacuu

SEQ ID NO: 3760969 - RNA, 15 nt, Human
cuguccagccugggc

SEQ ID NO: 3760970 - RNA, 18 nt, Human
cuguccagccugggcagc

SEQ ID NO: 3760971 - RNA, 14 nt, Human
cuguccagcuccaa

SEQ ID NO: 3760972 - RNA, 17 nt, Human
cuguccagcuccaaccu

SEQ ID NO: 3760973 - RNA, 18 nt, Human
cuguccagcuccaaccug

SEQ ID NO: 3760974 - RNA, 18 nt, Human
cuguccaggcacugcugc

SEQ ID NO: 3760975 - RNA, 20 nt, Human
cuguccaggcacugcugccc

SEQ ID NO: 3760976 - RNA, 12 nt, Human
cuguccaggcuc

SEQ ID NO: 3760977 - RNA, 20 nt, Human
cuguccagggcccugagcuc

SEQ ID NO: 3760978 - RNA, 16 nt, Human
cuguccaguucccaga

SEQ ID NO: 3760979 - RNA, 18 nt, Human
cuguccaguucccagaag

SEQ ID NO: 3760980 - RNA, 20 nt, Human
cuguccaguucccagaaggc

SEQ ID NO: 3760981 - RNA, 22 nt, Human
cuguccauauuuauagguaccc

SEQ ID NO: 3760982 - RNA, 18 nt, Human
cuguccaucagccaggac

SEQ ID NO: 3760983 - RNA, 23 nt, Human
cuguccaucugcccgccugccca

SEQ ID NO: 3760984 - RNA, 16 nt, Human
cuguccaugcuucuca

SEQ ID NO: 3760985 - RNA, 21 nt, Human
cuguccauuuauccacaggaa

SEQ ID NO: 3760986 - RNA, 19 nt, Human
cugucccaccaugcagugc

SEQ ID NO: 3760987 - RNA, 14 nt, Human
cugucccaccccca

SEQ ID NO: 3760988 - RNA, 16 nt, Human
cugucccacccccacc

SEQ ID NO: 3760989 - RNA, 15 nt, Human
cugucccaccucuuc

SEQ ID NO: 3760990 - RNA, 18 nt, Human
cugucccauagucccugc

SEQ ID NO: 3760991 - RNA, 19 nt, Human
cugucccauagucccugcc

SEQ ID NO: 3760992 - RNA, 21 nt, Human
cugucccaucuggucauuugg

SEQ ID NO: 3760993 - RNA, 18 nt, Human
cugucccauggacacucc

SEQ ID NO: 3760994 - RNA, 13 nt, Human
cugucccauuccc

SEQ ID NO: 3760995 - RNA, 16 nt, Human
cugucccauucccugg

SEQ ID NO: 3760996 - RNA, 23 nt, Human
cugucccauucccugggaucugg

SEQ ID NO: 3760997 - RNA, 12 nt, Human
cuguccccaccc

SEQ ID NO: 3760998 - RNA, 18 nt, Human
cuguccccacccuccacu

SEQ ID NO: 3760999 - RNA, 13 nt, Human
cugucccccagcu

SEQ ID NO: 3761000 - RNA, 15 nt, Human
cugucccccagcucu

SEQ ID NO: 3761001 - RNA, 17 nt, Human
cugucccccagcucugg

SEQ ID NO: 3761002 - RNA, 19 nt, Human
cuguccccgcacugggcuu

SEQ ID NO: 3761003 - RNA, 14 nt, Human
cuguccccucagcu

SEQ ID NO: 3761004 - RNA, 15 nt, Human
cuguccccucagcuc

SEQ ID NO: 3761005 - RNA, 16 nt, Human
cuguccccucuugccc

SEQ ID NO: 3761006 - RNA, 18 nt, Human
cuguccccucuugcccca

SEQ ID NO: 3761007 - RNA, 19 nt, Human
cuguccccucuugccccaa

SEQ ID NO: 3761008 - RNA, 20 nt, Human
cuguccccucuugccccaac

SEQ ID NO: 3761009 - RNA, 14 nt, Human
cuguccccuucucu

SEQ ID NO: 3761010 - RNA, 20 nt, Human
cuguccccuucucucaucuc

SEQ ID NO: 3761011 - RNA, 21 nt, Human
cuguccccuucucucaucucu

SEQ ID NO: 3761012 - RNA, 22 nt, Human
cuguccccuucucucaucucuu

SEQ ID NO: 3761013 - RNA, 17 nt, Human
cugucccgggguccugu

SEQ ID NO: 3761014 - RNA, 21 nt, Human
cugucccgggguccuguggca

SEQ ID NO: 3761015 - RNA, 13 nt, Human
cugucccucacag

SEQ ID NO: 3761016 - RNA, 13 nt, Human
cugucccucccac

SEQ ID NO: 3761017 - RNA, 17 nt, Human
cugucccucccaccucu

SEQ ID NO: 3761018 - RNA, 15 nt, Human
cugucccucccccuu

SEQ ID NO: 3761019 - RNA, 16 nt, Human
cugucccugcccuucu

SEQ ID NO: 3761020 - RNA, 17 nt, Human
cugucccuggccaucuc

SEQ ID NO: 3761021 - RNA, 18 nt, Human
cugucccuugccccccug

SEQ ID NO: 3761022 - RNA, 21 nt, Human
cugucccuugccccccuggcc

SEQ ID NO: 3761023 - RNA, 16 nt, Human
cugucccuugccucaa

SEQ ID NO: 3761024 - RNA, 19 nt, Human
cugucccuuggaacucuug

SEQ ID NO: 3761025 - RNA, 13 nt, Human
cugucccuuggag

SEQ ID NO: 3761026 - RNA, 15 nt, Human
cuguccgagcuuuga

SEQ ID NO: 3761027 - RNA, 20 nt, Human
cuguccuaaggaaccuuccu

SEQ ID NO: 3761028 - RNA, 16 nt, Human
cuguccuacucugugu

SEQ ID NO: 3761029 - RNA, 20 nt, Human
cuguccuacucugugucagg

SEQ ID NO: 3761030 - RNA, 16 nt, Human
cuguccuaugaaugcu

SEQ ID NO: 3761031 - RNA, 16 nt, Human
cuguccucacugcucc

SEQ ID NO: 3761032 - RNA, 21 nt, Human
cuguccucacugcucccugaa

SEQ ID NO: 3761033 - RNA, 14 nt, Human
cuguccucagccuu

SEQ ID NO: 3761034 - RNA, 19 nt, Human
cuguccucccgagcuccuc

SEQ ID NO: 3761035 - RNA, 14 nt, Human
cuguccucccucug

SEQ ID NO: 3761036 - RNA, 18 nt, Human
cuguccucuccccuccag

SEQ ID NO: 3761037 - RNA, 20 nt, Human
cuguccucucuggcugggga

SEQ ID NO: 3761038 - RNA, 21 nt, Human
cuguccucuuucagaaaacag

SEQ ID NO: 3761039 - RNA, 16 nt, Human
cuguccucuuucagcu

SEQ ID NO: 3761040 - RNA, 17 nt, Human
cuguccucuuucagcuc

SEQ ID NO: 3761041 - RNA, 18 nt, Human
cuguccugaccugucuca

SEQ ID NO: 3761042 - RNA, 23 nt, Human
cuguccugcagcaaacacuccac

SEQ ID NO: 3761043 - RNA, 11 nt, Human
cuguccugccu

SEQ ID NO: 3761044 - RNA, 13 nt, Human
cuguccugcucca

SEQ ID NO: 3761045 - RNA, 14 nt, Human
cuguccugcuccac

SEQ ID NO: 3761046 - RNA, 15 nt, Human
cuguccugcuccaca

SEQ ID NO: 3761047 - RNA, 13 nt, Human
cuguccugcuucu

SEQ ID NO: 3761048 - RNA, 22 nt, Human
cuguccugggcgcccuggaagc

SEQ ID NO: 3761049 - RNA, 14 nt, Human
cuguccugguggua

SEQ ID NO: 3761050 - RNA, 20 nt, Human
cuguccuggugguauuuuca

SEQ ID NO: 3761051 - RNA, 22 nt, Human
cuguccuguacauugugggaug

SEQ ID NO: 3761052 - RNA, 23 nt, Human
cuguccugucaucaucauggcca

SEQ ID NO: 3761053 - RNA, 16 nt, Human
cuguccuguccugcuc

SEQ ID NO: 3761054 - RNA, 20 nt, Human
cuguccugugagguuuccca

SEQ ID NO: 3761055 - RNA, 18 nt, Human
cuguccuguguagugauu

SEQ ID NO: 3761056 - RNA, 20 nt, Human
cuguccuguugauuaauuuc

SEQ ID NO: 3761057 - RNA, 12 nt, Human
cuguccuuaccc

SEQ ID NO: 3761058 - RNA, 14 nt, Human
cuguccuucagaug

SEQ ID NO: 3761059 - RNA, 15 nt, Human
cuguccuucucucac

SEQ ID NO: 3761060 - RNA, 20 nt, Human
cuguccuucucucaccuccu

SEQ ID NO: 3761061 - RNA, 20 nt, Human
cuguccuugaaggacuaaua

SEQ ID NO: 3761062 - RNA, 16 nt, Human
cuguccuugcacacuc

SEQ ID NO: 3761063 - RNA, 13 nt, Human
cuguccuugcccu

SEQ ID NO: 3761064 - RNA, 23 nt, Human
cuguccuuucuagagcacugcca

SEQ ID NO: 3761065 - RNA, 18 nt, Human
cuguccuuuuuccucucc

SEQ ID NO: 3761066 - RNA, 19 nt, Human
cugucgagaaacagccugu

SEQ ID NO: 3761067 - RNA, 23 nt, Human
cugucgagccugggggcuggagc

SEQ ID NO: 3761068 - RNA, 17 nt, Human
cugucgauuagacugga

SEQ ID NO: 3761069 - RNA, 19 nt, Human
cugucgauuagacuggaca

SEQ ID NO: 3761070 - RNA, 20 nt, Human
cugucgauuagacuggacag

SEQ ID NO: 3761071 - RNA, 15 nt, Human
cugucgcccagucug

SEQ ID NO: 3761072 - RNA, 16 nt, Human
cugucgcccagucugg

SEQ ID NO: 3761073 - RNA, 17 nt, Human
cugucgccuuagcaugu

SEQ ID NO: 3761074 - RNA, 18 nt, Human
cugucgccuuagcauguu

SEQ ID NO: 3761075 - RNA, 16 nt, Human
cugucgcucucaguuc

SEQ ID NO: 3761076 - RNA, 14 nt, Human
cugucgcugcuucg

SEQ ID NO: 3761077 - RNA, 17 nt, Human
cugucgcugcuucgugg

SEQ ID NO: 3761078 - RNA, 23 nt, Human
cugucggagcccugucuccucuc

SEQ ID NO: 3761079 - RNA, 13 nt, Human
cugucggaggaaa

SEQ ID NO: 3761080 - RNA, 17 nt, Human
cugucggaggaaagaca

SEQ ID NO: 3761081 - RNA, 15 nt, Human
cugucggugggaccu

SEQ ID NO: 3761082 - RNA, 16 nt, Human
cugucuaaaaaccaga

SEQ ID NO: 3761083 - RNA, 13 nt, Human
cugucuaacugcu

SEQ ID NO: 3761084 - RNA, 22 nt, Human
cugucuaaugaaaccugugucu

SEQ ID NO: 3761085 - RNA, 15 nt, Human
cugucuaccaucucc

SEQ ID NO: 3761086 - RNA, 18 nt, Human
cugucuacuugcucaggu

SEQ ID NO: 3761087 - RNA, 20 nt, Human
cugucuacuugcucagguac

SEQ ID NO: 3761088 - RNA, 13 nt, Human
cugucuagagagg

SEQ ID NO: 3761089 - RNA, 16 nt, Human
cugucuagagagggag

SEQ ID NO: 3761090 - RNA, 14 nt, Human
cugucuagcaugcc

SEQ ID NO: 3761091 - RNA, 23 nt, Human
cugucuaggucaguacccaccug

SEQ ID NO: 3761092 - RNA, 13 nt, Human
cugucucaaaaaa

SEQ ID NO: 3761093 - RNA, 21 nt, Human
cugucucaagagggcacuggu

SEQ ID NO: 3761094 - RNA, 22 nt, Human
cugucucaagagggcacuggug

SEQ ID NO: 3761095 - RNA, 23 nt, Human
cugucucaagagggcacuggugg

SEQ ID NO: 3761096 - RNA, 12 nt, Human
cugucucaccug

SEQ ID NO: 3761097 - RNA, 12 nt, Human
cugucucagccu

SEQ ID NO: 3761098 - RNA, 14 nt, Human
cugucucagccucc

SEQ ID NO: 3761099 - RNA, 15 nt, Human
cugucucagccuccc

SEQ ID NO: 3761100 - RNA, 14 nt, Human
cugucucaucccca

SEQ ID NO: 3761101 - RNA, 17 nt, Human
cugucucauccuccugg

SEQ ID NO: 3761102 - RNA, 15 nt, Human
cugucuccacugugc

SEQ ID NO: 3761103 - RNA, 12 nt, Human
cugucuccagac

SEQ ID NO: 3761104 - RNA, 15 nt, Human
cugucuccagacccc

SEQ ID NO: 3761105 - RNA, 16 nt, Human
cugucuccagaccccc

SEQ ID NO: 3761106 - RNA, 19 nt, Human
cugucuccuaccucugcuc

SEQ ID NO: 3761107 - RNA, 17 nt, Human
cugucuccucucucugu

SEQ ID NO: 3761108 - RNA, 12 nt, Human
cugucuccuggc

SEQ ID NO: 3761109 - RNA, 18 nt, Human
cugucucgagcgcccugc

SEQ ID NO: 3761110 - RNA, 20 nt, Human
cugucucgagcgcccugcag

SEQ ID NO: 3761111 - RNA, 21 nt, Human
cugucucgagcgcccugcaga

SEQ ID NO: 3761112 - RNA, 17 nt, Human
cugucucuagccacuuu

SEQ ID NO: 3761113 - RNA, 11 nt, Human
cugucucucuc

SEQ ID NO: 3761114 - RNA, 21 nt, Human
cugucucuuaaaaaaauaaaa

SEQ ID NO: 3761115 - RNA, 15 nt, Human
gccgcaucuucucca

SEQ ID NO: 3761116 - RNA, 20 nt, Human
gccgccaggaccgccaaaga

SEQ ID NO: 3761117 - RNA, 23 nt, Human
gccgcccaaggccuuccccuggc

SEQ ID NO: 3761118 - RNA, 16 nt, Human
gccgcccccuccugaa

SEQ ID NO: 3761119 - RNA, 17 nt, Human
gccgcccccugcccccc

SEQ ID NO: 3761120 - RNA, 16 nt, Human
gccgcccgggcccaga

SEQ ID NO: 3761121 - RNA, 18 nt, Human
gccgcccgggcccagagg

SEQ ID NO: 3761122 - RNA, 24 nt, Human
gccgccgccucgcccaccgcaugc

SEQ ID NO: 3761123 - RNA, 23 nt, Human
gccgccgcuagguagagucugag

SEQ ID NO: 3761124 - RNA, 22 nt, Human
gccgccggcaauaaaagcccag

SEQ ID NO: 3761125 - RNA, 14 nt, Human
gccgccucaccccc

SEQ ID NO: 3761126 - RNA, 16 nt, Human
gccgccucacccccuc

SEQ ID NO: 3761127 - RNA, 13 nt, Human
gccgccucccagc

SEQ ID NO: 3761128 - RNA, 14 nt, Human
gccgccucccagcc

SEQ ID NO: 3761129 - RNA, 16 nt, Human
gccgccucccagccug

SEQ ID NO: 3761130 - RNA, 19 nt, Human
gccgccuccgggaccccca

SEQ ID NO: 3761131 - RNA, 23 nt, Human
gccgccuccgggacccccaggac

SEQ ID NO: 3761132 - RNA, 15 nt, Human
gccgccugguacuca

SEQ ID NO: 3761133 - RNA, 18 nt, Human
gccgccugguacucaagc

SEQ ID NO: 3761134 - RNA, 15 nt, Human
gccgccuuaagcuga

SEQ ID NO: 3761135 - RNA, 17 nt, Human
gccgccuuaagcugauc

SEQ ID NO: 3761136 - RNA, 15 nt, Human
gccgccuucacagca

SEQ ID NO: 3761137 - RNA, 22 nt, Human
gccgccuuccuugaccuuccuc

SEQ ID NO: 3761138 - RNA, 18 nt, Human
gccgcgcguccagcugcc

SEQ ID NO: 3761139 - RNA, 17 nt, Human
gccgcguuuagaccaag

SEQ ID NO: 3761140 - RNA, 19 nt, Human
gccgcguuuagaccaagga

SEQ ID NO: 3761141 - RNA, 15 nt, Human
gccgcuaccucccuc

SEQ ID NO: 3761142 - RNA, 23 nt, Human
gccgcuagaugggcauggggugg

SEQ ID NO: 3761143 - RNA, 23 nt, Human
gccgcuagguagagucugagggc

SEQ ID NO: 3761144 - RNA, 15 nt, Human
gccgcuccugucugc

SEQ ID NO: 3761145 - RNA, 20 nt, Human
gccgcuccugucugccagcc

SEQ ID NO: 3761146 - RNA, 21 nt, Human
gccgcucggaggccccaaagg

SEQ ID NO: 3761147 - RNA, 16 nt, Human
gccgcucuccugccac

SEQ ID NO: 3761148 - RNA, 15 nt, Human
gccgcugagcgagga

SEQ ID NO: 3761149 - RNA, 23 nt, Human
gccgcugugagccccugguccug

SEQ ID NO: 3761150 - RNA, 17 nt, Human
gccgcuguucacccaca

SEQ ID NO: 3761151 - RNA, 15 nt, Human
gccggagucagugcc

SEQ ID NO: 3761152 - RNA, 16 nt, Human
gccggaguccacuccc

SEQ ID NO: 3761153 - RNA, 21 nt, Human
gccggcaaaacuuuggcacug

SEQ ID NO: 3761154 - RNA, 18 nt, Human
gccggcaaccccaguucu

SEQ ID NO: 3761155 - RNA, 23 nt, Human
gccggcaaccccaguucugcucc

SEQ ID NO: 3761156 - RNA, 20 nt, Human
gccggcaauaaaagcccagg

SEQ ID NO: 3761157 - RNA, 23 nt, Human
gccggcaauaaaagcccaggagc

SEQ ID NO: 3761158 - RNA, 22 nt, Human
gccggcacccacaagugccacu

SEQ ID NO: 3761159 - RNA, 14 nt, Human
gccggcagccccag

SEQ ID NO: 3761160 - RNA, 18 nt, Human
gccggcagccccagccug

SEQ ID NO: 3761161 - RNA, 12 nt, Human
gccggccagcca

SEQ ID NO: 3761162 - RNA, 15 nt, Human
gccggccagccagcc

SEQ ID NO: 3761163 - RNA, 14 nt, Human
gccggccccaggcu

SEQ ID NO: 3761164 - RNA, 20 nt, Human
gccggcccuggggcuaggcu

SEQ ID NO: 3761165 - RNA, 13 nt, Human
gccggcccugugu

SEQ ID NO: 3761166 - RNA, 14 nt, Human
gccggcccugugug

SEQ ID NO: 3761167 - RNA, 18 nt, Human
gccggcccugugugcagg

SEQ ID NO: 3761168 - RNA, 15 nt, Human
gccggccucucuggc

SEQ ID NO: 3761169 - RNA, 16 nt, Human
gccggccucucuggcc

SEQ ID NO: 3761170 - RNA, 19 nt, Human
gccggccucucuggccucc

SEQ ID NO: 3761171 - RNA, 23 nt, Human
gccggccucucuggccucccacc

SEQ ID NO: 3761172 - RNA, 18 nt, Human
gccggcgagcccugugga

SEQ ID NO: 3761173 - RNA, 13 nt, Human
gccggcuccuugg

SEQ ID NO: 3761174 - RNA, 16 nt, Human
gccggcugugcucaga

SEQ ID NO: 3761175 - RNA, 17 nt, Human
gccggcugugcucagag

SEQ ID NO: 3761176 - RNA, 16 nt, Human
gccgggacccagggcc

SEQ ID NO: 3761177 - RNA, 19 nt, Human
gccgggaccccgagccugg

SEQ ID NO: 3761178 - RNA, 13 nt, Human
gccgggcacagcu

SEQ ID NO: 3761179 - RNA, 16 nt, Human
gccgggcacagcugug

SEQ ID NO: 3761180 - RNA, 14 nt, Human
gccgggcagagcac

SEQ ID NO: 3761181 - RNA, 13 nt, Human
gccgggcagaggg

SEQ ID NO: 3761182 - RNA, 12 nt, Human
gccgggccccug

SEQ ID NO: 3761183 - RNA, 17 nt, Human
gccgggccccugggcuu

SEQ ID NO: 3761184 - RNA, 16 nt, Human
gccgggcgcgguggcu

SEQ ID NO: 3761185 - RNA, 21 nt, Human
gccgggcgcgguggcucacgc

SEQ ID NO: 3761186 - RNA, 19 nt, Human
gccgggcgugguggcgggc

SEQ ID NO: 3761187 - RNA, 22 nt, Human
gccggggguucauaggucacug

SEQ ID NO: 3761188 - RNA, 19 nt, Human
gccggggugggguggcugc

SEQ ID NO: 3761189 - RNA, 14 nt, Human
gccgguaccuggga

SEQ ID NO: 3761190 - RNA, 21 nt, Human
gccggucgcccuuugcugcau

SEQ ID NO: 3761191 - RNA, 17 nt, Human
gccgguuccugucccug

SEQ ID NO: 3761192 - RNA, 14 nt, Human
gccgguuugaguga

SEQ ID NO: 3761193 - RNA, 22 nt, Human
gccguaccccacccucagcacc

SEQ ID NO: 3761194 - RNA, 23 nt, Human
gccguaucuccggcucccagccu

SEQ ID NO: 3761195 - RNA, 13 nt, Human
gccgucaccacca

SEQ ID NO: 3761196 - RNA, 16 nt, Human
gccgucaccccugccu

SEQ ID NO: 3761197 - RNA, 20 nt, Human
gccguccccuagagucccag

SEQ ID NO: 3761198 - RNA, 14 nt, Human
gccguccucccggg

SEQ ID NO: 3761199 - RNA, 19 nt, Human
gccguccucccgggcccuc

SEQ ID NO: 3761200 - RNA, 17 nt, Human
gccguccuugucucugg

SEQ ID NO: 3761201 - RNA, 15 nt, Human
gccgucuaccugagg

SEQ ID NO: 3761202 - RNA, 14 nt, Human
gccgucuccagggg

SEQ ID NO: 3761203 - RNA, 19 nt, Human
gccgucuucacucgccccc

SEQ ID NO: 3761204 - RNA, 20 nt, Human
gccgucuucacucgcccccg

SEQ ID NO: 3761205 - RNA, 21 nt, Human
gccgucuucacucgcccccgg

SEQ ID NO: 3761206 - RNA, 16 nt, Human
gccgugaacugugcau

SEQ ID NO: 3761207 - RNA, 17 nt, Human
gccgugaccccugcaga

SEQ ID NO: 3761208 - RNA, 14 nt, Human
gccgugacgucugg

SEQ ID NO: 3761209 - RNA, 22 nt, Human
gccgugacgucuggguggcccu

SEQ ID NO: 3761210 - RNA, 17 nt, Human
gccgugaugcucaggcu

SEQ ID NO: 3761211 - RNA, 19 nt, Human
gccgugcauuagcacagau

SEQ ID NO: 3761212 - RNA, 15 nt, Human
gccgugcccaggggc

SEQ ID NO: 3761213 - RNA, 15 nt, Human
gccgugccuucagcu

SEQ ID NO: 3761214 - RNA, 21 nt, Human
gccgugcucgccccagcaggu

SEQ ID NO: 3761215 - RNA, 18 nt, Human
gccguggauggccgugga

SEQ ID NO: 3761216 - RNA, 21 nt, Human
gccguggauugcacguggccu

SEQ ID NO: 3761217 - RNA, 22 nt, Human
gccguggauugcacguggccuc

SEQ ID NO: 3761218 - RNA, 23 nt, Human
gccgugggcaauugucugaaaag

SEQ ID NO: 3761219 - RNA, 20 nt, Human
gccguggggccgccgccucu

SEQ ID NO: 3761220 - RNA, 23 nt, Human
gccguggggccgccgccucuuuc

SEQ ID NO: 3761221 - RNA, 14 nt, Human
gccguggucccuga

SEQ ID NO: 3761222 - RNA, 15 nt, Human
gccguggucccugag

SEQ ID NO: 3761223 - RNA, 20 nt, Human
gccguuacucuccaaccugg

SEQ ID NO: 3761224 - RNA, 19 nt, Human
gccguugauguuggcuggg

SEQ ID NO: 3761225 - RNA, 19 nt, Human
gccguugauucacuucacg

SEQ ID NO: 3761226 - RNA, 13 nt, Human
gccguuguuuacu

SEQ ID NO: 3761227 - RNA, 20 nt, Human
gccuaaaggauagaucaaag

SEQ ID NO: 3761228 - RNA, 20 nt, Human
gccuaaauuuaaugcugccu

SEQ ID NO: 3761229 - RNA, 17 nt, Human
gccuaaauuuauuaaau

SEQ ID NO: 3761230 - RNA, 18 nt, Human
gccuaaauuuauuaaaua

SEQ ID NO: 3761231 - RNA, 15 nt, Human
gccuaaccgagauca

SEQ ID NO: 3761232 - RNA, 18 nt, Human
gccuaagcauugccuggc

SEQ ID NO: 3761233 - RNA, 13 nt, Human
gccuaaggacuuc

SEQ ID NO: 3761234 - RNA, 18 nt, Human
gccuaaggacuucuuuaa

SEQ ID NO: 3761235 - RNA, 16 nt, Human
gccuaaggcugaacuu

SEQ ID NO: 3761236 - RNA, 23 nt, Human
gccuaagggauccugccugcccc

SEQ ID NO: 3761237 - RNA, 12 nt, Human
gccuaaguauua

SEQ ID NO: 3761238 - RNA, 16 nt, Human
gccuaaguggcugcug

SEQ ID NO: 3761239 - RNA, 15 nt, Human
gccuaauaaaacuga

SEQ ID NO: 3761240 - RNA, 18 nt, Human
gccuaauaaaacugaugu

SEQ ID NO: 3761241 - RNA, 22 nt, Human
gccuaauaaaacugaugugaaa

SEQ ID NO: 3761242 - RNA, 15 nt, Human
gccuaauaaacaauu

SEQ ID NO: 3761243 - RNA, 16 nt, Human
gccuaauacauuaaag

SEQ ID NO: 3761244 - RNA, 16 nt, Human
gccuaaucccugggca

SEQ ID NO: 3761245 - RNA, 23 nt, Human
gccuaaucccugggcauugcuuu

SEQ ID NO: 3761246 - RNA, 23 nt, Human
gccuaauuacgauaaggaagaaa

SEQ ID NO: 3761247 - RNA, 22 nt, Human
gccuacagcuuugaucccugac

SEQ ID NO: 3761248 - RNA, 23 nt, Human
gccuacagcuuugaucccugaca

SEQ ID NO: 3761249 - RNA, 21 nt, Human
gccuaccccgcagacaccuug

SEQ ID NO: 3761250 - RNA, 13 nt, Human
gccuaccugcucu

SEQ ID NO: 3761251 - RNA, 14 nt, Human
gccuaccuguaugu

SEQ ID NO: 3761252 - RNA, 19 nt, Human
gccuacuagggaccugggg

SEQ ID NO: 3761253 - RNA, 12 nt, Human
gccuacucacga

SEQ ID NO: 3761254 - RNA, 17 nt, Human
gccuacuccaaaauguu

SEQ ID NO: 3761255 - RNA, 16 nt, Human
gccuagaaacaacacu

SEQ ID NO: 3761256 - RNA, 22 nt, Human
gccuagaccagcagacagagcc

SEQ ID NO: 3761257 - RNA, 13 nt, Human
gccuagacucugu

SEQ ID NO: 3761258 - RNA, 12 nt, Human
gccuagcaagcu

SEQ ID NO: 3761259 - RNA, 18 nt, Human
gccuagcaagcuggccuc

SEQ ID NO: 3761260 - RNA, 14 nt, Human
gccuagcacagcag

SEQ ID NO: 3761261 - RNA, 18 nt, Human
gccuagcacucacaugcu

SEQ ID NO: 3761262 - RNA, 23 nt, Human
gccuagcacucacaugcuggaca

SEQ ID NO: 3761263 - RNA, 19 nt, Human
gccuagcauacguacacau

SEQ ID NO: 3761264 - RNA, 15 nt, Human
gccugccaguccuag

SEQ ID NO: 3761265 - RNA, 20 nt, Human
gccugccaguccuagcugca

SEQ ID NO: 3761266 - RNA, 20 nt, Human
gccugccauguaccuccccu

SEQ ID NO: 3761267 - RNA, 17 nt, Human
gccugcccaagcccagg

SEQ ID NO: 3761268 - RNA, 13 nt, Human
gccugcccacccg

SEQ ID NO: 3761269 - RNA, 14 nt, Human
gccugcccaccugc

SEQ ID NO: 3761270 - RNA, 20 nt, Human
gccugcccaccugccuggcc

SEQ ID NO: 3761271 - RNA, 14 nt, Human
gccugcccagacaa

SEQ ID NO: 3761272 - RNA, 15 nt, Human
gccugcccagacaag

SEQ ID NO: 3761273 - RNA, 12 nt, Human
gccugcccaggc

SEQ ID NO: 3761274 - RNA, 14 nt, Human
gccugcccaggccc

SEQ ID NO: 3761275 - RNA, 17 nt, Human
gccugcccaggccccug

SEQ ID NO: 3761276 - RNA, 18 nt, Human
gccugcccaggccccugc

SEQ ID NO: 3761277 - RNA, 22 nt, Human
gccugcccaggccccugccacc

SEQ ID NO: 3761278 - RNA, 17 nt, Human
gccugccccaaacaaau

SEQ ID NO: 3761279 - RNA, 16 nt, Human
gccugccccccucauc

SEQ ID NO: 3761280 - RNA, 21 nt, Human
gccugccccgcccccaguccc

SEQ ID NO: 3761281 - RNA, 14 nt, Human
gccugccccucucc

SEQ ID NO: 3761282 - RNA, 17 nt, Human
gccugccccucucccgc

SEQ ID NO: 3761283 - RNA, 21 nt, Human
gccugcccucauggccccucu

SEQ ID NO: 3761284 - RNA, 17 nt, Human
gccugcccuccccagag

SEQ ID NO: 3761285 - RNA, 14 nt, Human
gccugcccuugucu

SEQ ID NO: 3761286 - RNA, 21 nt, Human
gccugcccuugucugagaugc

SEQ ID NO: 3761287 - RNA, 16 nt, Human
gccugcccuuuguccu

SEQ ID NO: 3761288 - RNA, 19 nt, Human
gccugcccuuuguccuccu

SEQ ID NO: 3761289 - RNA, 16 nt, Human
gccugccgagcaaccg

SEQ ID NO: 3761290 - RNA, 21 nt, Human
gccugccgguaaacacgccug

SEQ ID NO: 3761291 - RNA, 17 nt, Human
gccugccuagcacucac

SEQ ID NO: 3761292 - RNA, 11 nt, Human
gccugccucca

SEQ ID NO: 3761293 - RNA, 18 nt, Human
gccugccuccagggcugg

SEQ ID NO: 3761294 - RNA, 22 nt, Human
gccugccuccagggcuggacug

SEQ ID NO: 3761295 - RNA, 13 nt, Human
gccugccuggcag

SEQ ID NO: 3761296 - RNA, 15 nt, Human
gccugccuggcaggc

SEQ ID NO: 3761297 - RNA, 17 nt, Human
gccugccuggcaggcug

SEQ ID NO: 3761298 - RNA, 16 nt, Human
gccugccuggccccuc

SEQ ID NO: 3761299 - RNA, 13 nt, Human
gccugccugucug

SEQ ID NO: 3761300 - RNA, 14 nt, Human
gccugccugucugu

SEQ ID NO: 3761301 - RNA, 16 nt, Human
gccugccugucugucu

SEQ ID NO: 3761302 - RNA, 23 nt, Human
gccugccuugaagccacugaagc

SEQ ID NO: 3761303 - RNA, 14 nt, Human
gccugcgacccugg

SEQ ID NO: 3761304 - RNA, 18 nt, Human
gccugcgcccaccccgcu

SEQ ID NO: 3761305 - RNA, 23 nt, Human
gccugcgcccaccccgcucugca

SEQ ID NO: 3761306 - RNA, 14 nt, Human
gccugcgccugcug

SEQ ID NO: 3761307 - RNA, 17 nt, Human
gccugcggccugcugga

SEQ ID NO: 3761308 - RNA, 14 nt, Human
gccugcguggcuga

SEQ ID NO: 3761309 - RNA, 20 nt, Human
gccugcguugguccagagcg

SEQ ID NO: 3761310 - RNA, 20 nt, Human
gccugcguuuuggaagcucu

SEQ ID NO: 3761311 - RNA, 20 nt, Human
gccugcuaaggucuuggaac

SEQ ID NO: 3761312 - RNA, 23 nt, Human
gccugcuagcuagcucaacuagu

SEQ ID NO: 3761313 - RNA, 20 nt, Human
gccugcuauuugaaguguaa

SEQ ID NO: 3761314 - RNA, 13 nt, Human
gccugcuccagac

SEQ ID NO: 3761315 - RNA, 14 nt, Human
gccugcuccagacc

SEQ ID NO: 3761316 - RNA, 15 nt, Human
gccugcuccagaccu

SEQ ID NO: 3761317 - RNA, 17 nt, Human
gccugcuccagaccuga

SEQ ID NO: 3761318 - RNA, 21 nt, Human
gccugcuccagaccugauccu

SEQ ID NO: 3761319 - RNA, 13 nt, Human
gccugcuccagcu

SEQ ID NO: 3761320 - RNA, 15 nt, Human
gccugcucccagcag

SEQ ID NO: 3761321 - RNA, 20 nt, Human
gccugcucccagcagcccua

SEQ ID NO: 3761322 - RNA, 21 nt, Human
gccugcucccauccugugugu

SEQ ID NO: 3761323 - RNA, 15 nt, Human
gccugcucccccacc

SEQ ID NO: 3761324 - RNA, 19 nt, Human
gccugcucccccacccccu

SEQ ID NO: 3761325 - RNA, 22 nt, Human
gccugcugcaugcccucucagg

SEQ ID NO: 3761326 - RNA, 13 nt, Human
gccugcugcccag

SEQ ID NO: 3761327 - RNA, 13 nt, Human
gccugcugcugag

SEQ ID NO: 3761328 - RNA, 15 nt, Human
gccugcugcugagaa

SEQ ID NO: 3761329 - RNA, 22 nt, Human
gccugcugcugagaaccuggcc

SEQ ID NO: 3761330 - RNA, 23 nt, Human
gccugcuggaggccucaggugcu

SEQ ID NO: 3761331 - RNA, 19 nt, Human
gccugcuggcacccaccgu

SEQ ID NO: 3761332 - RNA, 22 nt, Human
gccugcugggcucuccaccuca

SEQ ID NO: 3761333 - RNA, 18 nt, Human
gccugcuggucacagccu

SEQ ID NO: 3761334 - RNA, 21 nt, Human
gccugcuggucacagccuccu

SEQ ID NO: 3761335 - RNA, 22 nt, Human
gccugcuucccaccucccugcc

SEQ ID NO: 3761336 - RNA, 23 nt, Human
gccugcuucccaccucccugccc

SEQ ID NO: 3761337 - RNA, 19 nt, Human
gccugcuuuuuauggccug

SEQ ID NO: 3761338 - RNA, 21 nt, Human
gccugcuuuuuggaaagucag

SEQ ID NO: 3761339 - RNA, 14 nt, Human
gccuggaagacaga

SEQ ID NO: 3761340 - RNA, 15 nt, Human
gccuggaagagcagc

SEQ ID NO: 3761341 - RNA, 17 nt, Human
gccuggaagagcagccc

SEQ ID NO: 3761342 - RNA, 20 nt, Human
gccuggacauuugccuugcu

SEQ ID NO: 3761343 - RNA, 15 nt, Human
gccuggacccccagc

SEQ ID NO: 3761344 - RNA, 17 nt, Human
gccuggacccccagcuu

SEQ ID NO: 3761345 - RNA, 15 nt, Human
gccuggaccucugac

SEQ ID NO: 3761346 - RNA, 20 nt, Human
gccuggaccucugacagcag

SEQ ID NO: 3761347 - RNA, 21 nt, Human
gccuggaccucugacagcagc

SEQ ID NO: 3761348 - RNA, 23 nt, Human
gccuggaccucugacagcagcau

SEQ ID NO: 3761349 - RNA, 11 nt, Human
gccuggaccug

SEQ ID NO: 3761350 - RNA, 13 nt, Human
gccuggacugcua

SEQ ID NO: 3761351 - RNA, 16 nt, Human
gccuggacuuuccugc

SEQ ID NO: 3761352 - RNA, 15 nt, Human
gccuggagaagcuga

SEQ ID NO: 3761353 - RNA, 15 nt, Human
gccuggagacccacc

SEQ ID NO: 3761354 - RNA, 17 nt, Human
gccuggagacuuagggc

SEQ ID NO: 3761355 - RNA, 17 nt, Human
gccuggagauccuccug

SEQ ID NO: 3761356 - RNA, 22 nt, Human
gccuggagauccuccugcagac

SEQ ID NO: 3761357 - RNA, 14 nt, Human
gccuggagaugacu

SEQ ID NO: 3761358 - RNA, 13 nt, Human
gccuggagcccca

SEQ ID NO: 3761359 - RNA, 14 nt, Human
gccuggagccccac

SEQ ID NO: 3761360 - RNA, 16 nt, Human
gccuggagcuccuggg

SEQ ID NO: 3761361 - RNA, 16 nt, Human
gccuggaggaccugag

SEQ ID NO: 3761362 - RNA, 17 nt, Human
gccuggaggaccugagc

SEQ ID NO: 3761363 - RNA, 18 nt, Human
gccuggaggaccugagcc

SEQ ID NO: 3761364 - RNA, 24 nt, Human
gccuggaguguaugacugcacaug

SEQ ID NO: 3761365 - RNA, 20 nt, Human
gccuggauggggcugcaccg

SEQ ID NO: 3761366 - RNA, 20 nt, Human
gccuggauguugcugugcac

SEQ ID NO: 3761367 - RNA, 19 nt, Human
gccuggauucauuuccugc

SEQ ID NO: 3761368 - RNA, 16 nt, Human
gccuggauuucugguu

SEQ ID NO: 3761369 - RNA, 22 nt, Human
gccuggauuucugguucugaug

SEQ ID NO: 3761370 - RNA, 23 nt, Human
gccuggauuucugguucugaugc

SEQ ID NO: 3761371 - RNA, 14 nt, Human
gccuggcacacauc

SEQ ID NO: 3761372 - RNA, 14 nt, Human
gccuggcacagggc

SEQ ID NO: 3761373 - RNA, 21 nt, Human
gccuggcacagugucugggcu

SEQ ID NO: 3761374 - RNA, 23 nt, Human
gccuggcacagugucugggcuga

SEQ ID NO: 3761375 - RNA, 18 nt, Human
gccuggcagaacugagcu

SEQ ID NO: 3761376 - RNA, 19 nt, Human
gccuggcagaacugagcuc

SEQ ID NO: 3761377 - RNA, 12 nt, Human
gccuggcagccg

SEQ ID NO: 3761378 - RNA, 21 nt, Human
gccuggcagccgugccuucag

SEQ ID NO: 3761379 - RNA, 15 nt, Human
gccuggcagccuggc

SEQ ID NO: 3761380 - RNA, 23 nt, Human
gccuggcagggaggucaggcccu

SEQ ID NO: 3761381 - RNA, 20 nt, Human
gccuggcaguccgugggacg

SEQ ID NO: 3761382 - RNA, 22 nt, Human
gccuggcauucuuguacagugu

SEQ ID NO: 3761383 - RNA, 15 nt, Human
gccuggccaaaggga

SEQ ID NO: 3761384 - RNA, 14 nt, Human
gccuggccaccucu

SEQ ID NO: 3761385 - RNA, 18 nt, Human
gccuggccaccucucucc

SEQ ID NO: 3761386 - RNA, 18 nt, Human
gccuggccacgcagccag

SEQ ID NO: 3761387 - RNA, 19 nt, Human
gccuggccacgcagccagg

SEQ ID NO: 3761388 - RNA, 20 nt, Human
gccuggccacgcagccagga

SEQ ID NO: 3761389 - RNA, 22 nt, Human
gccuggccacgcagccaggaca

SEQ ID NO: 3761390 - RNA, 20 nt, Human
gccuggccagacacaggccc

SEQ ID NO: 3761391 - RNA, 15 nt, Human
gccuggccagaugca

SEQ ID NO: 3761392 - RNA, 19 nt, Human
gccuggccaggagcucuuc

SEQ ID NO: 3761393 - RNA, 13 nt, Human
gccuggccaggca

SEQ ID NO: 3761394 - RNA, 15 nt, Human
gccuggccaggcacc

SEQ ID NO: 3761395 - RNA, 17 nt, Human
gccuggccaggcagauc

SEQ ID NO: 3761396 - RNA, 18 nt, Human
gccuggccauacuguguc

SEQ ID NO: 3761397 - RNA, 21 nt, Human
gccuggcccacagcaggugcu

SEQ ID NO: 3761398 - RNA, 14 nt, Human
gccuggcccacccc

SEQ ID NO: 3761399 - RNA, 16 nt, Human
gccuggcccagcuccc

SEQ ID NO: 3761400 - RNA, 15 nt, Human
gccuggcccccagcu

SEQ ID NO: 3761401 - RNA, 18 nt, Human
gccuggcccccagcugug

SEQ ID NO: 3761402 - RNA, 17 nt, Human
gccuggcccccuguccu

SEQ ID NO: 3761403 - RNA, 15 nt, Human
gccuggccccucagg

SEQ ID NO: 3761404 - RNA, 20 nt, Human
gccuggccccucaggguccc

SEQ ID NO: 3761405 - RNA, 17 nt, Human
gccuggccggccagcca

SEQ ID NO: 3761406 - RNA, 20 nt, Human
gccuggccggccagccagcc

SEQ ID NO: 3761407 - RNA, 13 nt, Human
gccuggccuccag

SEQ ID NO: 3761408 - RNA, 17 nt, Human
gccuggccuccaggccc

SEQ ID NO: 3761409 - RNA, 14 nt, Human
gccuggccuccugc

SEQ ID NO: 3761410 - RNA, 18 nt, Human
gccuggccugagcuggga

SEQ ID NO: 3761411 - RNA, 14 nt, Human
gccuggccugaggu

SEQ ID NO: 3761412 - RNA, 14 nt, Human
gccuggccuggccc

SEQ ID NO: 3761413 - RNA, 17 nt, Human
gccuggccuggcccugc

SEQ ID NO: 3761414 - RNA, 19 nt, Human
cugucucuuuaagggcaug

SEQ ID NO: 3761415 - RNA, 20 nt, Human
cugucugaaggacacuuccu

SEQ ID NO: 3761416 - RNA, 22 nt, Human
cugucugagacucacaggaagg

SEQ ID NO: 3761417 - RNA, 18 nt, Human
cugucugagguugggaga

SEQ ID NO: 3761418 - RNA, 13 nt, Human
cugucugcagccu

SEQ ID NO: 3761419 - RNA, 17 nt, Human
cugucugccaaccuaaa

SEQ ID NO: 3761420 - RNA, 17 nt, Human
cugucugccagccagca

SEQ ID NO: 3761421 - RNA, 18 nt, Human
cugucugccccagcccag

SEQ ID NO: 3761422 - RNA, 19 nt, Human
cugucugccccgcccucau

SEQ ID NO: 3761423 - RNA, 15 nt, Human
cugucugcucagaca

SEQ ID NO: 3761424 - RNA, 16 nt, Human
cugucuggcaaugcca

SEQ ID NO: 3761425 - RNA, 17 nt, Human
cugucuggcaaugccac

SEQ ID NO: 3761426 - RNA, 23 nt, Human
cugucuggcaaugccacagcccu

SEQ ID NO: 3761427 - RNA, 19 nt, Human
cugucugggugcuacuggg

SEQ ID NO: 3761428 - RNA, 15 nt, Human
cugucugguggcccc

SEQ ID NO: 3761429 - RNA, 22 nt, Human
cugucuguagagggcccuggug

SEQ ID NO: 3761430 - RNA, 19 nt, Human
cugucugucccaguuaacu

SEQ ID NO: 3761431 - RNA, 16 nt, Human
cugucugucuggucca

SEQ ID NO: 3761432 - RNA, 16 nt, Human
cugucugucuguccca

SEQ ID NO: 3761433 - RNA, 14 nt, Human
cugucugucugucu

SEQ ID NO: 3761434 - RNA, 14 nt, Human
cugucugugaacag

SEQ ID NO: 3761435 - RNA, 13 nt, Human
cugucugugaccu

SEQ ID NO: 3761436 - RNA, 14 nt, Human
cugucugugaccug

SEQ ID NO: 3761437 - RNA, 15 nt, Human
cugucuuaauuaagu

SEQ ID NO: 3761438 - RNA, 17 nt, Human
cugucuucaacagcucc

SEQ ID NO: 3761439 - RNA, 22 nt, Human
cugucuucauagcagauuuuaa

SEQ ID NO: 3761440 - RNA, 20 nt, Human
cugucuucauccccucagaa

SEQ ID NO: 3761441 - RNA, 17 nt, Human
cugucuucauccuuagc

SEQ ID NO: 3761442 - RNA, 11 nt, Human
cugucuuccca

SEQ ID NO: 3761443 - RNA, 23 nt, Human
cugucuucccaggguagcccgcc

SEQ ID NO: 3761444 - RNA, 13 nt, Human
cugucuuccucaa

SEQ ID NO: 3761445 - RNA, 18 nt, Human
cugucuuccugcauucac

SEQ ID NO: 3761446 - RNA, 16 nt, Human
cugucuuccuuugcuu

SEQ ID NO: 3761447 - RNA, 19 nt, Human
cugucuuccuuugcuuccc

SEQ ID NO: 3761448 - RNA, 17 nt, Human
cugucuucucaggcucu

SEQ ID NO: 3761449 - RNA, 15 nt, Human
cugucuucugcuuug

SEQ ID NO: 3761450 - RNA, 15 nt, Human
cugucuucuggacug

SEQ ID NO: 3761451 - RNA, 13 nt, Human
cugucuucuguau

SEQ ID NO: 3761452 - RNA, 16 nt, Human
cugucuuuaaaagaga

SEQ ID NO: 3761453 - RNA, 16 nt, Human
cugucuuuaaggaaaa

SEQ ID NO: 3761454 - RNA, 15 nt, Human
cugucuuuccacucu

SEQ ID NO: 3761455 - RNA, 16 nt, Human
cugucuuuccacucug

SEQ ID NO: 3761456 - RNA, 18 nt, Human
cugucuuuccacucugga

SEQ ID NO: 3761457 - RNA, 19 nt, Human
cugucuuuccuaagaccug

SEQ ID NO: 3761458 - RNA, 22 nt, Human
cugucuuuggaaaaauguuugu

SEQ ID NO: 3761459 - RNA, 15 nt, Human
cugucuuuuaaacuc

SEQ ID NO: 3761460 - RNA, 21 nt, Human
cugucuuuuuucuaaaguaaa

SEQ ID NO: 3761461 - RNA, 12 nt, Human
cugugaaauagu

SEQ ID NO: 3761462 - RNA, 15 nt, Human
cugugaaauaucauc

SEQ ID NO: 3761463 - RNA, 15 nt, Human
cugugaacccaggac

SEQ ID NO: 3761464 - RNA, 19 nt, Human
cugugaacccaggacaagc

SEQ ID NO: 3761465 - RNA, 20 nt, Human
cugugaacccuggggccuga

SEQ ID NO: 3761466 - RNA, 22 nt, Human
cugugaacugaaauuaaaacua

SEQ ID NO: 3761467 - RNA, 13 nt, Human
cugugaacugaac

SEQ ID NO: 3761468 - RNA, 16 nt, Human
cugugaacugaacucu

SEQ ID NO: 3761469 - RNA, 16 nt, Human
cugugaacuugaaauu

SEQ ID NO: 3761470 - RNA, 17 nt, Human
cugugaacuugaaauuu

SEQ ID NO: 3761471 - RNA, 22 nt, Human
cugugaacuuggggaacaaggg

SEQ ID NO: 3761472 - RNA, 14 nt, Human
cugugaagaucuca

SEQ ID NO: 3761473 - RNA, 21 nt, Human
cugugaagcauucgagacaga

SEQ ID NO: 3761474 - RNA, 23 nt, Human
cugugaagcauucgagacagaac

SEQ ID NO: 3761475 - RNA, 14 nt, Human
cugugaaguaagga

SEQ ID NO: 3761476 - RNA, 16 nt, Human
cugugaaguccuucac

SEQ ID NO: 3761477 - RNA, 24 nt, Human
cugugaaguccuucaccucacuga

SEQ ID NO: 3761478 - RNA, 22 nt, Human
cugugaagugagaccuuccuuu

SEQ ID NO: 3761479 - RNA, 18 nt, Human
cugugaaguuuacauugu

SEQ ID NO: 3761480 - RNA, 16 nt, Human
cugugaaugccacugc

SEQ ID NO: 3761481 - RNA, 19 nt, Human
cugugaauuuguguaagga

SEQ ID NO: 3761482 - RNA, 17 nt, Human
cugugacacacuacacc

SEQ ID NO: 3761483 - RNA, 16 nt, Human
cugugacaggcagcag

SEQ ID NO: 3761484 - RNA, 17 nt, Human
cugugacauggugccug

SEQ ID NO: 3761485 - RNA, 21 nt, Human
cugugacauggugccugagag

SEQ ID NO: 3761486 - RNA, 22 nt, Human
cugugacauggugccugagagg

SEQ ID NO: 3761487 - RNA, 23 nt, Human
cugugacauggugccugagaggc

SEQ ID NO: 3761488 - RNA, 24 nt, Human
cugugacauggugccugagaggca

SEQ ID NO: 3761489 - RNA, 17 nt, Human
cugugaccaaugucuug

SEQ ID NO: 3761490 - RNA, 14 nt, Human
cugugaccagcacu

SEQ ID NO: 3761491 - RNA, 18 nt, Human
cugugaccaggaaggaag

SEQ ID NO: 3761492 - RNA, 23 nt, Human
cugugaccagucugacccuuaca

SEQ ID NO: 3761493 - RNA, 22 nt, Human
cugugacccacuucucaucaca

SEQ ID NO: 3761494 - RNA, 19 nt, Human
cugugugacaucaguggca

SEQ ID NO: 3761495 - RNA, 18 nt, Human
cugugugacucaaaccaa

SEQ ID NO: 3761496 - RNA, 15 nt, Human
cugugugaugaacuu

SEQ ID NO: 3761497 - RNA, 16 nt, Human
cugugugaugaacuuu

SEQ ID NO: 3761498 - RNA, 18 nt, Human
cugugugaugaacuuucu

SEQ ID NO: 3761499 - RNA, 19 nt, Human
cugugugaugaacuuucuc

SEQ ID NO: 3761500 - RNA, 22 nt, Human
cugugugauugacagcuuugcu

SEQ ID NO: 3761501 - RNA, 23 nt, Human
cugugugauugacagcuuugcug

SEQ ID NO: 3761502 - RNA, 9 nt, Human
cugugugca

SEQ ID NO: 3761503 - RNA, 16 nt, Human
cugugugcacaaauau

SEQ ID NO: 3761504 - RNA, 21 nt, Human
cugugugcaccuuaccaacuu

SEQ ID NO: 3761505 - RNA, 18 nt, Human
cugugugccugggggagu

SEQ ID NO: 3761506 - RNA, 19 nt, Human
cugugugcucaggagcccu

SEQ ID NO: 3761507 - RNA, 16 nt, Human
cuguguggacugugau

SEQ ID NO: 3761508 - RNA, 15 nt, Human
cuguguggagaggga

SEQ ID NO: 3761509 - RNA, 21 nt, Human
cuguguggccacuucugucca

SEQ ID NO: 3761510 - RNA, 12 nt, Human
cugugugguuug

SEQ ID NO: 3761511 - RNA, 21 nt, Human
cuguguguccaaaacugccuc

SEQ ID NO: 3761512 - RNA, 16 nt, Human
cugugugucccaggca

SEQ ID NO: 3761513 - RNA, 16 nt, Human
cugugugugaguguga

SEQ ID NO: 3761514 - RNA, 16 nt, Human
cugugugugcccucug

SEQ ID NO: 3761515 - RNA, 19 nt, Human
cugugugugcccucugggc

SEQ ID NO: 3761516 - RNA, 16 nt, Human
cugugugugugaauga

SEQ ID NO: 3761517 - RNA, 18 nt, Human
cugugugugugaaugaac

SEQ ID NO: 3761518 - RNA, 16 nt, Human
cuguguguguguaugu

SEQ ID NO: 3761519 - RNA, 20 nt, Human
cuguguguguguaugugggg

SEQ ID NO: 3761520 - RNA, 17 nt, Human
cuguguguuaagcucug

SEQ ID NO: 3761521 - RNA, 14 nt, Human
cuguguguuccugg

SEQ ID NO: 3761522 - RNA, 19 nt, Human
cuguguguugccacaggac

SEQ ID NO: 3761523 - RNA, 21 nt, Human
cuguguguugccacaggacac

SEQ ID NO: 3761524 - RNA, 18 nt, Human
cuguguguuuaugugugu

SEQ ID NO: 3761525 - RNA, 18 nt, Human
cuguguguuuucauaaua

SEQ ID NO: 3761526 - RNA, 21 nt, Human
cuguguuccuuccgcuuggag

SEQ ID NO: 3761527 - RNA, 14 nt, Human
cuguguugccaagc

SEQ ID NO: 3761528 - RNA, 16 nt, Human
cuguguugccaagcuc

SEQ ID NO: 3761529 - RNA, 19 nt, Human
cuguguugccaagcuccaa

SEQ ID NO: 3761530 - RNA, 21 nt, Human
cuguguuguaccaaaauucau

SEQ ID NO: 3761531 - RNA, 15 nt, Human
cuguguuguauuaac

SEQ ID NO: 3761532 - RNA, 18 nt, Human
cuguguuguauuaacaaa

SEQ ID NO: 3761533 - RNA, 19 nt, Human
cuguguuguugcuucuugu

SEQ ID NO: 3761534 - RNA, 18 nt, Human
cuguguuuaauuucuuca

SEQ ID NO: 3761535 - RNA, 16 nt, Human
cuguguuuauauggaa

SEQ ID NO: 3761536 - RNA, 19 nt, Human
cuguguuucaaguggggcu

SEQ ID NO: 3761537 - RNA, 17 nt, Human
cuguguuucuugccuca

SEQ ID NO: 3761538 - RNA, 20 nt, Human
cuguguuugcagccugcucu

SEQ ID NO: 3761539 - RNA, 22 nt, Human
cuguguuugcuccccuuccccu

SEQ ID NO: 3761540 - RNA, 17 nt, Human
cuguguuuggcuuucag

SEQ ID NO: 3761541 - RNA, 18 nt, Human
cuguguuuuauaaaauag

SEQ ID NO: 3761542 - RNA, 18 nt, Human
cuguguuuugaaagaaua

SEQ ID NO: 3761543 - RNA, 22 nt, Human
cuguguuuugaaagaauagaac

SEQ ID NO: 3761544 - RNA, 21 nt, Human
cuguuaaaagaugaaaauauu

SEQ ID NO: 3761545 - RNA, 11 nt, Human
cuguuaaaaug

SEQ ID NO: 3761546 - RNA, 11 nt, Human
cuguuaaacug

SEQ ID NO: 3761547 - RNA, 12 nt, Human
cuguuaaacugu

SEQ ID NO: 3761548 - RNA, 13 nt, Human
cuguuaaacuguu

SEQ ID NO: 3761549 - RNA, 21 nt, Human
cuguuaaacuguuagcacugu

SEQ ID NO: 3761550 - RNA, 23 nt, Human
cuguuaaacuguuagcacuguug

SEQ ID NO: 3761551 - RNA, 11 nt, Human
cuguuaaauac

SEQ ID NO: 3761552 - RNA, 23 nt, Human
cuguuaaauacaggaaacaguug

SEQ ID NO: 3761553 - RNA, 18 nt, Human
cuguuaaauugcugugua

SEQ ID NO: 3761554 - RNA, 19 nt, Human
cuguuaaauugcuguguau

SEQ ID NO: 3761555 - RNA, 12 nt, Human
cuguuaaccauu

SEQ ID NO: 3761556 - RNA, 15 nt, Human
cuguuaacugaauac

SEQ ID NO: 3761557 - RNA, 17 nt, Human
cuguuaacugaauacca

SEQ ID NO: 3761558 - RNA, 22 nt, Human
cuguuaacugaauaccacucug

SEQ ID NO: 3761559 - RNA, 14 nt, Human
cuguuaauguauuu

SEQ ID NO: 3761560 - RNA, 22 nt, Human
cuguuacaaaauguaacuguua

SEQ ID NO: 3761561 - RNA, 19 nt, Human
cuguuacacuuuuuggaag

SEQ ID NO: 3761562 - RNA, 20 nt, Human
cuguuacauaacaagaaaau

SEQ ID NO: 3761563 - RNA, 23 nt, Human
cuguuacauaacaagaaaaucaa

SEQ ID NO: 3761564 - RNA, 20 nt, Human
cuguuaccaugucacugugg

SEQ ID NO: 3761565 - RNA, 15 nt, Human
cuguuaccauucaca

SEQ ID NO: 3761566 - RNA, 19 nt, Human
cuguuaccauuggaaauuu

SEQ ID NO: 3761567 - RNA, 16 nt, Human
cuguuaccgccugucu

SEQ ID NO: 3761568 - RNA, 21 nt, Human
cuguuaccugaucaaugacag

SEQ ID NO: 3761569 - RNA, 16 nt, Human
cuguuacugggcccug

SEQ ID NO: 3761570 - RNA, 18 nt, Human
cuguuagaacacuauuuu

SEQ ID NO: 3761571 - RNA, 21 nt, Human
cuguuagaacacuauuuucag

SEQ ID NO: 3761572 - RNA, 16 nt, Human
cuguuagcacuguuga

SEQ ID NO: 3761573 - RNA, 15 nt, Human
cuguuagcagacagg

SEQ ID NO: 3761574 - RNA, 18 nt, Human
cuguuaggagaagcugca

SEQ ID NO: 3761575 - RNA, 17 nt, Human
cuguuagugcacugauu

SEQ ID NO: 3761576 - RNA, 13 nt, Human
cuguuauaaucuu

SEQ ID NO: 3761577 - RNA, 19 nt, Human
cuguuauaaucuuucacag

SEQ ID NO: 3761578 - RNA, 23 nt, Human
cuguuaucaaacaccaacauaaa

SEQ ID NO: 3761579 - RNA, 14 nt, Human
cuguuaugcuguga

SEQ ID NO: 3761580 - RNA, 16 nt, Human
cuguuaugucuguuua

SEQ ID NO: 3761581 - RNA, 22 nt, Human
cuguuaugucuguuuaagaaaa

SEQ ID NO: 3761582 - RNA, 20 nt, Human
cuguuauuuauaaucacuuu

SEQ ID NO: 3761583 - RNA, 16 nt, Human
cuguuauuuucagcau

SEQ ID NO: 3761584 - RNA, 16 nt, Human
cuguucaacaucacug

SEQ ID NO: 3761585 - RNA, 12 nt, Human
cuguucacagcc

SEQ ID NO: 3761586 - RNA, 22 nt, Human
cuguucacagccagacuggcac

SEQ ID NO: 3761587 - RNA, 13 nt, Human
cuguucacucuac

SEQ ID NO: 3761588 - RNA, 15 nt, Human
cuguucacucuacuu

SEQ ID NO: 3761589 - RNA, 18 nt, Human
cuguucacuuuuccuccc

SEQ ID NO: 3761590 - RNA, 16 nt, Human
cuguucagauuggaca

SEQ ID NO: 3761591 - RNA, 14 nt, Human
cuguucagcauucu

SEQ ID NO: 3761592 - RNA, 18 nt, Human
cuguucagcuccagcuca

SEQ ID NO: 3761593 - RNA, 19 nt, Human
cuguucagcuccagcucac

SEQ ID NO: 3761594 - RNA, 18 nt, Human
cuguucagcugguugagg

SEQ ID NO: 3761595 - RNA, 13 nt, Human
cuguucagcuuuu

SEQ ID NO: 3761596 - RNA, 17 nt, Human
cuguucagcuuuuauuc

SEQ ID NO: 3761597 - RNA, 13 nt, Human
cuguucaguuaca

SEQ ID NO: 3761598 - RNA, 14 nt, Human
cuguucaguuacag

SEQ ID NO: 3761599 - RNA, 18 nt, Human
cuguucaguuacagaaag

SEQ ID NO: 3761600 - RNA, 15 nt, Human
cuguucauuccucca

SEQ ID NO: 3761601 - RNA, 14 nt, Human
cuguucauuuguua

SEQ ID NO: 3761602 - RNA, 18 nt, Human
cuguuccaaauucaguuu

SEQ ID NO: 3761603 - RNA, 17 nt, Human
cuguuccagccugcccu

SEQ ID NO: 3761604 - RNA, 23 nt, Human
cuguucccccgccgcuuuucucc

SEQ ID NO: 3761605 - RNA, 12 nt, Human
gcgcucaguaaa

SEQ ID NO: 3761606 - RNA, 15 nt, Human
gcgcucaguaaacgg

SEQ ID NO: 3761607 - RNA, 17 nt, Human
gcgcucaguaaacggga

SEQ ID NO: 3761608 - RNA, 19 nt, Human
gcgcuccugccgcagagcu

SEQ ID NO: 3761609 - RNA, 19 nt, Human
gcgcucucuuugcaacugu

SEQ ID NO: 3761610 - RNA, 19 nt, Human
gcgcugacaaccaccgcuc

SEQ ID NO: 3761611 - RNA, 21 nt, Human
gcgcugccccuggcagccccu

SEQ ID NO: 3761612 - RNA, 19 nt, Human
gcgcugccgcaccccagag

SEQ ID NO: 3761613 - RNA, 21 nt, Human
gcgcugccgcaccccagagug

SEQ ID NO: 3761614 - RNA, 12 nt, Human
gcgcuggcccag

SEQ ID NO: 3761615 - RNA, 17 nt, Human
gcgcuggcccagccggc

SEQ ID NO: 3761616 - RNA, 20 nt, Human
gcgcugggcacuucccugcu

SEQ ID NO: 3761617 - RNA, 17 nt, Human
gcgcugguccuuucuuc

SEQ ID NO: 3761618 - RNA, 10 nt, Human
gcgcuucacu

SEQ ID NO: 3761619 - RNA, 21 nt, Human
gcgcuugggcgccgugcuggg

SEQ ID NO: 3761620 - RNA, 22 nt, Human
gcgcuugggcgccgugcugggc

SEQ ID NO: 3761621 - RNA, 15 nt, Human
gcggaaagcagcuca

SEQ ID NO: 3761622 - RNA, 10 nt, Human
gcggacacac

SEQ ID NO: 3761623 - RNA, 16 nt, Human
gcggacagccacggcc

SEQ ID NO: 3761624 - RNA, 23 nt, Human
gcggacagccacggccaggccag

SEQ ID NO: 3761625 - RNA, 14 nt, Human
gcggacaguggcag

SEQ ID NO: 3761626 - RNA, 15 nt, Human
gcggacaguggcagg

SEQ ID NO: 3761627 - RNA, 16 nt, Human
gcggacaucagcuggu

SEQ ID NO: 3761628 - RNA, 20 nt, Human
gcggaccccagcugugagcc

SEQ ID NO: 3761629 - RNA, 21 nt, Human
gcggaccccagcugugagccu

SEQ ID NO: 3761630 - RNA, 16 nt, Human
gcggacguuccagccg

SEQ ID NO: 3761631 - RNA, 19 nt, Human
gcggagacggagucccacc

SEQ ID NO: 3761632 - RNA, 23 nt, Human
gcggaggaaggaggacccaggac

SEQ ID NO: 3761633 - RNA, 14 nt, Human
gcggaggcugugug

SEQ ID NO: 3761634 - RNA, 16 nt, Human
gcggaggcugugugcc

SEQ ID NO: 3761635 - RNA, 18 nt, Human
gcggaggcugugugccug

SEQ ID NO: 3761636 - RNA, 20 nt, Human
gcggagugaagaggggcagc

SEQ ID NO: 3761637 - RNA, 22 nt, Human
gcggagugaagaggggcagccc

SEQ ID NO: 3761638 - RNA, 13 nt, Human
gcggauggccgga

SEQ ID NO: 3761639 - RNA, 18 nt, Human
gcggauuaauuugcaucu

SEQ ID NO: 3761640 - RNA, 22 nt, Human
gcggcaaucaauaaacagcagg

SEQ ID NO: 3761641 - RNA, 12 nt, Human
gcggcagagagg

SEQ ID NO: 3761642 - RNA, 22 nt, Human
gcggcaggagggagguuuguga

SEQ ID NO: 3761643 - RNA, 19 nt, Human
gcggcaggggccuggagau

SEQ ID NO: 3761644 - RNA, 16 nt, Human
gcggcauuaaagccau

SEQ ID NO: 3761645 - RNA, 23 nt, Human
gcggcccaagcccgacuugcugu

SEQ ID NO: 3761646 - RNA, 18 nt, Human
gcggcccagcccggcucc

SEQ ID NO: 3761647 - RNA, 21 nt, Human
gcggcccagcccggcucccac

SEQ ID NO: 3761648 - RNA, 13 nt, Human
gcggccccucccg

SEQ ID NO: 3761649 - RNA, 16 nt, Human
gcggccccucccgccc

SEQ ID NO: 3761650 - RNA, 13 nt, Human
gcggcccugucau

SEQ ID NO: 3761651 - RNA, 19 nt, Human
gcggccuaugacuugggca

SEQ ID NO: 3761652 - RNA, 18 nt, Human
gcggccucuucucucaga

SEQ ID NO: 3761653 - RNA, 16 nt, Human
gcggccuuuggcuuca

SEQ ID NO: 3761654 - RNA, 14 nt, Human
gcggcgggcggcug

SEQ ID NO: 3761655 - RNA, 14 nt, Human
gcggcggucccagc

SEQ ID NO: 3761656 - RNA, 17 nt, Human
gcggcggucccagcucc

SEQ ID NO: 3761657 - RNA, 13 nt, Human
gcggcuacucagc

SEQ ID NO: 3761658 - RNA, 21 nt, Human
gcggcuacucagcagcccucc

SEQ ID NO: 3761659 - RNA, 22 nt, Human
gcggcuacucagcagcccuccu

SEQ ID NO: 3761660 - RNA, 18 nt, Human
gcggcucaagcccaggag

SEQ ID NO: 3761661 - RNA, 12 nt, Human
gcggcugagagc

SEQ ID NO: 3761662 - RNA, 16 nt, Human
gcggcugagagcccca

SEQ ID NO: 3761663 - RNA, 18 nt, Human
gcggcugagagccccagc

SEQ ID NO: 3761664 - RNA, 23 nt, Human
gcggcugagucaugaucucccug

SEQ ID NO: 3761665 - RNA, 15 nt, Human
gcggcuggacuugga

SEQ ID NO: 3761666 - RNA, 15 nt, Human
gcggcuggcagccca

SEQ ID NO: 3761667 - RNA, 18 nt, Human
gcggcuggccauggagaa

SEQ ID NO: 3761668 - RNA, 22 nt, Human
gcggcugugcagccuguccugg

SEQ ID NO: 3761669 - RNA, 12 nt, Human
gcggcugugugu

SEQ ID NO: 3761670 - RNA, 19 nt, Human
gcgggaauauuguuucuuu

SEQ ID NO: 3761671 - RNA, 14 nt, Human
gcgggaccuguggc

SEQ ID NO: 3761672 - RNA, 14 nt, Human
gcgggagccucccu

SEQ ID NO: 3761673 - RNA, 18 nt, Human
gcgggagcgguggcccug

SEQ ID NO: 3761674 - RNA, 18 nt, Human
gcgggcagagggcuggag

SEQ ID NO: 3761675 - RNA, 19 nt, Human
gcgggcagagggcuggagg

SEQ ID NO: 3761676 - RNA, 14 nt, Human
gcgggcagcacagc

SEQ ID NO: 3761677 - RNA, 15 nt, Human
gcgggcagcacagca

SEQ ID NO: 3761678 - RNA, 19 nt, Human
gcgggccagccaggcgggc

SEQ ID NO: 3761679 - RNA, 19 nt, Human
gcgggcgaaucacgagguc

SEQ ID NO: 3761680 - RNA, 20 nt, Human
gcgggcgccuguagucccag

SEQ ID NO: 3761681 - RNA, 19 nt, Human
gcgggcggcugggucugug

SEQ ID NO: 3761682 - RNA, 14 nt, Human
gcgggcucaaggaa

SEQ ID NO: 3761683 - RNA, 14 nt, Human
gcgggcugggcagc

SEQ ID NO: 3761684 - RNA, 19 nt, Human
gcgggcuuauuuauuaaca

SEQ ID NO: 3761685 - RNA, 15 nt, Human
gcgggcuuccuccug

SEQ ID NO: 3761686 - RNA, 15 nt, Human
gcggggacagcuccu

SEQ ID NO: 3761687 - RNA, 18 nt, Human
gcggggacagcuccuucu

SEQ ID NO: 3761688 - RNA, 19 nt, Human
gcggggacucgguaagcac

SEQ ID NO: 3761689 - RNA, 12 nt, Human
gcggggccuugc

SEQ ID NO: 3761690 - RNA, 22 nt, Human
gcggggcugucggcgcugcccc

SEQ ID NO: 3761691 - RNA, 15 nt, Human
gcgggggccagggaa

SEQ ID NO: 3761692 - RNA, 13 nt, Human
gcggggggaggga

SEQ ID NO: 3761693 - RNA, 19 nt, Human
gcgggucacaggagggagg

SEQ ID NO: 3761694 - RNA, 15 nt, Human
gcgggucugcuccca

SEQ ID NO: 3761695 - RNA, 14 nt, Human
gcgguccacccagg

SEQ ID NO: 3761696 - RNA, 19 nt, Human
gcgguccacccaggagccc

SEQ ID NO: 3761697 - RNA, 22 nt, Human
gcgguccccuccgccaggcgag

SEQ ID NO: 3761698 - RNA, 20 nt, Human
gcggucucaggcugguggga

SEQ ID NO: 3761699 - RNA, 19 nt, Human
gcggucuucaacauccugc

SEQ ID NO: 3761700 - RNA, 19 nt, Human
gcggugagaggggaacaga

SEQ ID NO: 3761701 - RNA, 18 nt, Human
gcggugcccaaccacacu

SEQ ID NO: 3761702 - RNA, 19 nt, Human
gcggugcuaucucccccag

SEQ ID NO: 3761703 - RNA, 18 nt, Human
gcggugcuguccucaggu

SEQ ID NO: 3761704 - RNA, 20 nt, Human
gcggugggaccuagggaggc

SEQ ID NO: 3761705 - RNA, 21 nt, Human
gcggugucucuccugccccuu

SEQ ID NO: 3761706 - RNA, 19 nt, Human
gcgguuauaaaaaaugguu

SEQ ID NO: 3761707 - RNA, 18 nt, Human
gcgguuuaucgcccuggc

SEQ ID NO: 3761708 - RNA, 17 nt, Human
gcguaggcuacagagaa

SEQ ID NO: 3761709 - RNA, 20 nt, Human
gcguaggcuacagagaagcc

SEQ ID NO: 3761710 - RNA, 19 nt, Human
gcguagugcagcagggcag

SEQ ID NO: 3761711 - RNA, 19 nt, Human
gcguaugcaguguagauuu

SEQ ID NO: 3761712 - RNA, 18 nt, Human
gcguauggcuuuauuuuu

SEQ ID NO: 3761713 - RNA, 17 nt, Human
gcgucacaacaaccugg

SEQ ID NO: 3761714 - RNA, 15 nt, Human
gcgucagccuccagc

SEQ ID NO: 3761715 - RNA, 20 nt, Human
gcgucagccuccagccucug

SEQ ID NO: 3761716 - RNA, 21 nt, Human
gcgucagccuccagccucugu

SEQ ID NO: 3761717 - RNA, 17 nt, Human
gcgucagcugcucccug

SEQ ID NO: 3761718 - RNA, 21 nt, Human
gcgucaggguuggugugcuga

SEQ ID NO: 3761719 - RNA, 16 nt, Human
gcgucaguauuuuccc

SEQ ID NO: 3761720 - RNA, 14 nt, Human
gcgucagucuuuuu

SEQ ID NO: 3761721 - RNA, 15 nt, Human
gcgucaucugguccu

SEQ ID NO: 3761722 - RNA, 15 nt, Human
gcgucccgcaccugu

SEQ ID NO: 3761723 - RNA, 16 nt, Human
gcgucccuagcaguga

SEQ ID NO: 3761724 - RNA, 11 nt, Human
gcgucccuggc

SEQ ID NO: 3761725 - RNA, 16 nt, Human
gcguccuccucuguga

SEQ ID NO: 3761726 - RNA, 13 nt, Human
gcguccuguccac

SEQ ID NO: 3761727 - RNA, 15 nt, Human
gcgucgguccuggug

SEQ ID NO: 3761728 - RNA, 23 nt, Human
gcgucucccaucuuaacucuuug

SEQ ID NO: 3761729 - RNA, 18 nt, Human
gcgucugucuucaagggc

SEQ ID NO: 3761730 - RNA, 13 nt, Human
gcgucugugugcg

SEQ ID NO: 3761731 - RNA, 17 nt, Human
gcgucuguucccccuuc

SEQ ID NO: 3761732 - RNA, 12 nt, Human
gcgucuuccuga

SEQ ID NO: 3761733 - RNA, 14 nt, Human
gcgucuuccugagu

SEQ ID NO: 3761734 - RNA, 12 nt, Human
gcgugaaacaca

SEQ ID NO: 3761735 - RNA, 16 nt, Human
gcgugaaggccgagaa

SEQ ID NO: 3761736 - RNA, 16 nt, Human
gcgugacucacccaag

SEQ ID NO: 3761737 - RNA, 15 nt, Human
gcgugagaccugccc

SEQ ID NO: 3761738 - RNA, 11 nt, Human
gcgugagacgc

SEQ ID NO: 3761739 - RNA, 18 nt, Human
gcgugagccacugcaccg

SEQ ID NO: 3761740 - RNA, 14 nt, Human
gcgugagcugagca

SEQ ID NO: 3761741 - RNA, 12 nt, Human
gcgugagcuuaa

SEQ ID NO: 3761742 - RNA, 16 nt, Human
gcgugaggucccagga

SEQ ID NO: 3761743 - RNA, 20 nt, Human
gcgugaucaaagccacacuc

SEQ ID NO: 3761744 - RNA, 15 nt, Human
gcgugaucucagcuc

SEQ ID NO: 3761745 - RNA, 23 nt, Human
gcgugaucucggcucacugcaac

SEQ ID NO: 3761746 - RNA, 14 nt, Human
gcgugcacacacca

SEQ ID NO: 3761747 - RNA, 18 nt, Human
gcgugcacacaccagagc

SEQ ID NO: 3761748 - RNA, 14 nt, Human
gcgugcccggggca

SEQ ID NO: 3761749 - RNA, 17 nt, Human
gcgugcccggggcagca

SEQ ID NO: 3761750 - RNA, 20 nt, Human
gcgugccgugugagugugac

SEQ ID NO: 3761751 - RNA, 21 nt, Human
gcgugcgcaucuugccuccag

SEQ ID NO: 3761752 - RNA, 23 nt, Human
gcgugcgcaucuugccuccaggu

SEQ ID NO: 3761753 - RNA, 13 nt, Human
gcguggacucugc

SEQ ID NO: 3761754 - RNA, 14 nt, Human
gcguggacucugca

SEQ ID NO: 3761755 - RNA, 20 nt, Human
gcguggagggaggccccagg

SEQ ID NO: 3761756 - RNA, 19 nt, Human
gccugcguugguccagagc

SEQ ID NO: 3761757 - RNA, 20 nt, Human
gccugcuagcuagcucaacu

SEQ ID NO: 3761758 - RNA, 22 nt, Human
gccugcuagcuagcucaacuag

SEQ ID NO: 3761759 - RNA, 16 nt, Human
gccugcucccagcagc

SEQ ID NO: 3761760 - RNA, 17 nt, Human
gccugcucccagcagcc

SEQ ID NO: 3761761 - RNA, 22 nt, Human
gccugcucccagcagcccuaag

SEQ ID NO: 3761762 - RNA, 13 nt, Human
gccugcuccccca

SEQ ID NO: 3761763 - RNA, 12 nt, Human
gccugcuccuuc

SEQ ID NO: 3761764 - RNA, 15 nt, Human
gccugcuccuucccu

SEQ ID NO: 3761765 - RNA, 20 nt, Human
gccugcuccuucccuugcua

SEQ ID NO: 3761766 - RNA, 18 nt, Human
gccugcucuuuggccuga

SEQ ID NO: 3761767 - RNA, 23 nt, Human
gccugcugaaugauuuccaaaga

SEQ ID NO: 3761768 - RNA, 11 nt, Human
gccugcugcau

SEQ ID NO: 3761769 - RNA, 12 nt, Human
gccugcugcuga

SEQ ID NO: 3761770 - RNA, 18 nt, Human
gccugcuggaagcccagc

SEQ ID NO: 3761771 - RNA, 19 nt, Human
gccugcuggaggccucagg

SEQ ID NO: 3761772 - RNA, 13 nt, Human
gccugcuggaucu

SEQ ID NO: 3761773 - RNA, 22 nt, Human
gccugcuggcacccaccgugga

SEQ ID NO: 3761774 - RNA, 19 nt, Human
gccugcugggcucuccacc

SEQ ID NO: 3761775 - RNA, 20 nt, Human
gccugcugggcucuccaccu

SEQ ID NO: 3761776 - RNA, 23 nt, Human
gccugcugggcucuccaccucag

SEQ ID NO: 3761777 - RNA, 22 nt, Human
gccugcuggucacagccuccuc

SEQ ID NO: 3761778 - RNA, 22 nt, Human
gccugcugugauuccacuacac

SEQ ID NO: 3761779 - RNA, 16 nt, Human
gccugcuuccugucuu

SEQ ID NO: 3761780 - RNA, 22 nt, Human
gccugcuuuucacugcugcaag

SEQ ID NO: 3761781 - RNA, 23 nt, Human
gccuggaagacagagaccuccug

SEQ ID NO: 3761782 - RNA, 23 nt, Human
gccuggacccguucaugggggag

SEQ ID NO: 3761783 - RNA, 13 nt, Human
gccuggaccucug

SEQ ID NO: 3761784 - RNA, 14 nt, Human
gccuggaccugccu

SEQ ID NO: 3761785 - RNA, 15 nt, Human
gccuggaccugccuc

SEQ ID NO: 3761786 - RNA, 16 nt, Human
gccuggaccugccucc

SEQ ID NO: 3761787 - RNA, 17 nt, Human
gccuggaccugccuccu

SEQ ID NO: 3761788 - RNA, 23 nt, Human
gccuggaccugccuccugccugc

SEQ ID NO: 3761789 - RNA, 24 nt, Human
gccuggagacccaccccaccugca

SEQ ID NO: 3761790 - RNA, 23 nt, Human
gccuggagacuuagggcaccagg

SEQ ID NO: 3761791 - RNA, 18 nt, Human
gccuggagauccuccugc

SEQ ID NO: 3761792 - RNA, 20 nt, Human
gccuggagauccuccugcag

SEQ ID NO: 3761793 - RNA, 18 nt, Human
gccuggagccccacugcc

SEQ ID NO: 3761794 - RNA, 13 nt, Human
gccuggagcccuc

SEQ ID NO: 3761795 - RNA, 14 nt, Human
gccuggagcccucc

SEQ ID NO: 3761796 - RNA, 15 nt, Human
gccuggagcuccugg

SEQ ID NO: 3761797 - RNA, 21 nt, Human
gccuggaggaccugagccugc

SEQ ID NO: 3761798 - RNA, 22 nt, Human
gccuggaggaccugagccugcc

SEQ ID NO: 3761799 - RNA, 22 nt, Human
gccuggauacaguauaaaaaua

SEQ ID NO: 3761800 - RNA, 20 nt, Human
gccuggaugcggauggccgg

SEQ ID NO: 3761801 - RNA, 21 nt, Human
gccuggauucauuuccugccc

SEQ ID NO: 3761802 - RNA, 13 nt, Human
gccuggcagaacu

SEQ ID NO: 3761803 - RNA, 13 nt, Human
gccuggcagcuca

SEQ ID NO: 3761804 - RNA, 20 nt, Human
gccuggcagcucagcuuccc

SEQ ID NO: 3761805 - RNA, 17 nt, Human
gccuggcauggcaccug

SEQ ID NO: 3761806 - RNA, 17 nt, Human
gccuggccaccucucuc

SEQ ID NO: 3761807 - RNA, 15 nt, Human
gccuggccacgcagc

SEQ ID NO: 3761808 - RNA, 13 nt, Human
gccuggccagaca

SEQ ID NO: 3761809 - RNA, 20 nt, Human
gccuggccagaugcaccagc

SEQ ID NO: 3761810 - RNA, 21 nt, Human
gccuggccagaugcaccagcc

SEQ ID NO: 3761811 - RNA, 16 nt, Human
gccuggccagccuaca

SEQ ID NO: 3761812 - RNA, 21 nt, Human
gccuggccagccuacaauggg

SEQ ID NO: 3761813 - RNA, 14 nt, Human
gccuggccaggagc

SEQ ID NO: 3761814 - RNA, 17 nt, Human
gccuggccaggagcagg

SEQ ID NO: 3761815 - RNA, 15 nt, Human
gccuggccaggagcu

SEQ ID NO: 3761816 - RNA, 14 nt, Human
gccuggccaggcag

SEQ ID NO: 3761817 - RNA, 19 nt, Human
gccuggccagggccuggaa

SEQ ID NO: 3761818 - RNA, 17 nt, Human
gccuggccagugcccug

SEQ ID NO: 3761819 - RNA, 22 nt, Human
gccuggcccacagcaggugcug

SEQ ID NO: 3761820 - RNA, 13 nt, Human
gccuggcccagcu

SEQ ID NO: 3761821 - RNA, 19 nt, Human
gccuggcccauagaaacau

SEQ ID NO: 3761822 - RNA, 13 nt, Human
gccuggccccuca

SEQ ID NO: 3761823 - RNA, 22 nt, Human
gccuggccccucagggucccug

SEQ ID NO: 3761824 - RNA, 15 nt, Human
gccuggcccugcccu

SEQ ID NO: 3761825 - RNA, 18 nt, Human
gccuggccggcaacccca

SEQ ID NO: 3761826 - RNA, 16 nt, Human
gccuggccggccagcc

SEQ ID NO: 3761827 - RNA, 18 nt, Human
gccuggccggccagccag

SEQ ID NO: 3761828 - RNA, 23 nt, Human
gccuggccggccagccagccacu

SEQ ID NO: 3761829 - RNA, 12 nt, Human
gccuggccucca

SEQ ID NO: 3761830 - RNA, 14 nt, Human
gccuggccuccagg

SEQ ID NO: 3761831 - RNA, 16 nt, Human
gccuggccuccaggcc

SEQ ID NO: 3761832 - RNA, 16 nt, Human
gccuggccuccugccu

SEQ ID NO: 3761833 - RNA, 19 nt, Human
gccuggccuccugccucua

SEQ ID NO: 3761834 - RNA, 22 nt, Human
gccuggccuccugccucuacug

SEQ ID NO: 3761835 - RNA, 10 nt, Human
gccuggccug

SEQ ID NO: 3761836 - RNA, 15 nt, Human
gccuggccugagcug

SEQ ID NO: 3761837 - RNA, 13 nt, Human
gccuggccuggca

SEQ ID NO: 3761838 - RNA, 16 nt, Human
gccuggccuggcacac

SEQ ID NO: 3761839 - RNA, 13 nt, Human
gccuggccuggcc

SEQ ID NO: 3761840 - RNA, 22 nt, Human
gccuggccuuguccucagccag

SEQ ID NO: 3761841 - RNA, 17 nt, Human
gccuggcucagagccag

SEQ ID NO: 3761842 - RNA, 20 nt, Human
gccuggcuccaaacccucga

SEQ ID NO: 3761843 - RNA, 17 nt, Human
gccuggcucccaggaca

SEQ ID NO: 3761844 - RNA, 18 nt, Human
gccuggcucccaggacac

SEQ ID NO: 3761845 - RNA, 16 nt, Human
gccuggcuccccuggg

SEQ ID NO: 3761846 - RNA, 16 nt, Human
gccuggcucccucacu

SEQ ID NO: 3761847 - RNA, 21 nt, Human
gccuggcucccucacucucag

SEQ ID NO: 3761848 - RNA, 19 nt, Human
gccuggcuccgcugugugg

SEQ ID NO: 3761849 - RNA, 21 nt, Human
gccuggcugcagccugcgcca

SEQ ID NO: 3761850 - RNA, 16 nt, Human
gccuggcuggcugagg

SEQ ID NO: 3761851 - RNA, 16 nt, Human
gccuggcuucuccuuu

SEQ ID NO: 3761852 - RNA, 15 nt, Human
gccuggcuucuggag

SEQ ID NO: 3761853 - RNA, 16 nt, Human
gccuggcuucuggagc

SEQ ID NO: 3761854 - RNA, 20 nt, Human
gccuggcuucuuucucucag

SEQ ID NO: 3761855 - RNA, 18 nt, Human
gccugggaaauaagcccc

SEQ ID NO: 3761856 - RNA, 21 nt, Human
gccugggaaccuuccugucuu

SEQ ID NO: 3761857 - RNA, 23 nt, Human
gccugggaauguauuauucugca

SEQ ID NO: 3761858 - RNA, 22 nt, Human
gccugggacaacugcucccacc

SEQ ID NO: 3761859 - RNA, 21 nt, Human
gccugggacuuccaugccuua

SEQ ID NO: 3761860 - RNA, 21 nt, Human
gccugggaggucaaggcugca

SEQ ID NO: 3761861 - RNA, 22 nt, Human
gccugggaggucaaggcugcag

SEQ ID NO: 3761862 - RNA, 16 nt, Human
gccugggcaacagagc

SEQ ID NO: 3761863 - RNA, 22 nt, Human
gccugggcaacauagugagacc

SEQ ID NO: 3761864 - RNA, 17 nt, Human
gccugggcagccaggcu

SEQ ID NO: 3761865 - RNA, 13 nt, Human
gccugggcagugg

SEQ ID NO: 3761866 - RNA, 14 nt, Human
gccugggcagugga

SEQ ID NO: 3761867 - RNA, 20 nt, Human
gccugggccacagggcgaga

SEQ ID NO: 3761868 - RNA, 21 nt, Human
gccugggcccaucucccugcu

SEQ ID NO: 3761869 - RNA, 20 nt, Human
gccugggccccagcucgcgg

SEQ ID NO: 3761870 - RNA, 20 nt, Human
gccugggccuauggagagcc

SEQ ID NO: 3761871 - RNA, 21 nt, Human
gccugggccuauggagagccc

SEQ ID NO: 3761872 - RNA, 22 nt, Human
gccugggccuauggagagcccu

SEQ ID NO: 3761873 - RNA, 21 nt, Human
gccugggccuccucacaacau

SEQ ID NO: 3761874 - RNA, 13 nt, Human
gccugggccuggc

SEQ ID NO: 3761875 - RNA, 14 nt, Human
gccugggccuggcu

SEQ ID NO: 3761876 - RNA, 15 nt, Human
gccugggccuggcuc

SEQ ID NO: 3761877 - RNA, 17 nt, Human
gccugggcgcugguccu

SEQ ID NO: 3761878 - RNA, 18 nt, Human
gccugggcuguuggcacu

SEQ ID NO: 3761879 - RNA, 13 nt, Human
gccuggggccuga

SEQ ID NO: 3761880 - RNA, 14 nt, Human
gccuggggccugag

SEQ ID NO: 3761881 - RNA, 17 nt, Human
gccuggggccuggcagg

SEQ ID NO: 3761882 - RNA, 20 nt, Human
gccuggggcucuaacgccug

SEQ ID NO: 3761883 - RNA, 22 nt, Human
gccuggggcucuaacgccugag

SEQ ID NO: 3761884 - RNA, 14 nt, Human
gccuggggcuggcc

SEQ ID NO: 3761885 - RNA, 17 nt, Human
gccuggggcuggccucc

SEQ ID NO: 3761886 - RNA, 19 nt, Human
gccugggggaguuuuccuc

SEQ ID NO: 3761887 - RNA, 13 nt, Human
gccugggggccug

SEQ ID NO: 3761888 - RNA, 16 nt, Human
gccugggggccuggcu

SEQ ID NO: 3761889 - RNA, 20 nt, Human
gccugggggccuggcuggcu

SEQ ID NO: 3761890 - RNA, 17 nt, Human
gccugggggugccagga

SEQ ID NO: 3761891 - RNA, 21 nt, Human
gccugggggugccaggaccag

SEQ ID NO: 3761892 - RNA, 22 nt, Human
gccugggguaccaagagacucc

SEQ ID NO: 3761893 - RNA, 14 nt, Human
gccuggggucaggc

SEQ ID NO: 3761894 - RNA, 15 nt, Human
gccugggucuccuaa

SEQ ID NO: 3761895 - RNA, 13 nt, Human
gccugggugacag

SEQ ID NO: 3761896 - RNA, 20 nt, Human
gccugggugacagagcaaga

SEQ ID NO: 3761897 - RNA, 14 nt, Human
gccugggugcuggc

SEQ ID NO: 3761898 - RNA, 15 nt, Human
gccugggugcuggcu

SEQ ID NO: 3761899 - RNA, 22 nt, Human
gccuggguggggcugcuccucc

SEQ ID NO: 3761900 - RNA, 22 nt, Human
gccuggguguaaaaccuggaga

SEQ ID NO: 3761901 - RNA, 20 nt, Human
gccuggguuugguguauggu

SEQ ID NO: 3761902 - RNA, 22 nt, Human
gccuggguuuuguucccuauuu

SEQ ID NO: 3761903 - RNA, 17 nt, Human
gccugguauggcugcag

SEQ ID NO: 3761904 - RNA, 22 nt, Human
gcguggagggguaggggcuggg

SEQ ID NO: 3761905 - RNA, 13 nt, Human
gcguggauuaaac

SEQ ID NO: 3761906 - RNA, 15 nt, Human
gcguggcccaaggcu

SEQ ID NO: 3761907 - RNA, 20 nt, Human
gcguggcccaaggcuggcag

SEQ ID NO: 3761908 - RNA, 20 nt, Human
gcguggcgcaguggcccuga

SEQ ID NO: 3761909 - RNA, 23 nt, Human
gcguggcucuaaaagguaaugug

SEQ ID NO: 3761910 - RNA, 16 nt, Human
gcgugggagccagccu

SEQ ID NO: 3761911 - RNA, 13 nt, Human
gcgugggucagaa

SEQ ID NO: 3761912 - RNA, 13 nt, Human
gcguggugccauc

SEQ ID NO: 3761913 - RNA, 14 nt, Human
gcguggugccaucc

SEQ ID NO: 3761914 - RNA, 13 nt, Human
gcguggugcgagu

SEQ ID NO: 3761915 - RNA, 22 nt, Human
gcgugguguggagugugugucu

SEQ ID NO: 3761916 - RNA, 15 nt, Human
gcgugugcaggagcg

SEQ ID NO: 3761917 - RNA, 14 nt, Human
gcguguggcucacg

SEQ ID NO: 3761918 - RNA, 18 nt, Human
gcguguguccaugugugu

SEQ ID NO: 3761919 - RNA, 23 nt, Human
gcguguguccaugugugugcaag

SEQ ID NO: 3761920 - RNA, 15 nt, Human
gcguguucucagagg

SEQ ID NO: 3761921 - RNA, 14 nt, Human
gcguguuugcacgu

SEQ ID NO: 3761922 - RNA, 15 nt, Human
gcguguuugcacguu

SEQ ID NO: 3761923 - RNA, 16 nt, Human
gcguuccuuucuuuuc

SEQ ID NO: 3761924 - RNA, 23 nt, Human
gcguucuuaggcugcugggaugg

SEQ ID NO: 3761925 - RNA, 11 nt, Human
gcguucuugua

SEQ ID NO: 3761926 - RNA, 16 nt, Human
gcguucuuguaauuuu

SEQ ID NO: 3761927 - RNA, 17 nt, Human
gcguucuuguaauuuua

SEQ ID NO: 3761928 - RNA, 15 nt, Human
gcguugcaugucgug

SEQ ID NO: 3761929 - RNA, 17 nt, Human
gcguuggaauuaaaaca

SEQ ID NO: 3761930 - RNA, 22 nt, Human
gcguugguccagagcggaggcu

SEQ ID NO: 3761931 - RNA, 19 nt, Human
gcguuguaaaauauagcug

SEQ ID NO: 3761932 - RNA, 16 nt, Human
gcguuguuacaggaag

SEQ ID NO: 3761933 - RNA, 14 nt, Human
gcguuuagaccaag

SEQ ID NO: 3761934 - RNA, 19 nt, Human
gcguuugcccaaaucugcc

SEQ ID NO: 3761935 - RNA, 18 nt, Human
gcuaaaaaagcugaauca

SEQ ID NO: 3761936 - RNA, 22 nt, Human
gcuaaaaaugagcuugauuaaa

SEQ ID NO: 3761937 - RNA, 17 nt, Human
gcuaaaacaaugaauaa

SEQ ID NO: 3761938 - RNA, 16 nt, Human
gcuaaaaccugagcua

SEQ ID NO: 3761939 - RNA, 23 nt, Human
gcuaaaauaaagaaauagaacaa

SEQ ID NO: 3761940 - RNA, 17 nt, Human
gcuaaaauguuuucagc

SEQ ID NO: 3761941 - RNA, 20 nt, Human
gcuaaacacugcgcuuuauu

SEQ ID NO: 3761942 - RNA, 22 nt, Human
gcuaaacacugcgcuuuauuuu

SEQ ID NO: 3761943 - RNA, 23 nt, Human
gcuaaacuccuuccuggccugag

SEQ ID NO: 3761944 - RNA, 15 nt, Human
gcuaaacuuuucuga

SEQ ID NO: 3761945 - RNA, 17 nt, Human
gcuaaacuuuucugaua

SEQ ID NO: 3761946 - RNA, 13 nt, Human
gcuaaagaaaaag

SEQ ID NO: 3761947 - RNA, 19 nt, Human
gcuaaagaaguuugaacau

SEQ ID NO: 3761948 - RNA, 15 nt, Human
gcuaaagacaugaag

SEQ ID NO: 3761949 - RNA, 20 nt, Human
gcuaaagacugaucucaggg

SEQ ID NO: 3761950 - RNA, 18 nt, Human
gcuaaagagcccuugccu

SEQ ID NO: 3761951 - RNA, 15 nt, Human
gcuaaagcccagaga

SEQ ID NO: 3761952 - RNA, 16 nt, Human
gcuaaagcccagagac

SEQ ID NO: 3761953 - RNA, 20 nt, Human
gcuaaauaaaauuuguugca

SEQ ID NO: 3761954 - RNA, 19 nt, Human
gcuaaauccuuuacuguua

SEQ ID NO: 3761955 - RNA, 16 nt, Human
gcuaaaucuccuauuu

SEQ ID NO: 3761956 - RNA, 13 nt, Human
gcuaaaugugaau

SEQ ID NO: 3761957 - RNA, 16 nt, Human
gcuaaaugugaaugau

SEQ ID NO: 3761958 - RNA, 20 nt, Human
gcuaaauucuccacauuuug

SEQ ID NO: 3761959 - RNA, 18 nt, Human
gcuaaauugauguugaug

SEQ ID NO: 3761960 - RNA, 20 nt, Human
gcuaacaaggcgaaauccug

SEQ ID NO: 3761961 - RNA, 19 nt, Human
gcuaacacggugaaacccg

SEQ ID NO: 3761962 - RNA, 17 nt, Human
gcuaacacuggccccua

SEQ ID NO: 3761963 - RNA, 13 nt, Human
gcuaacaugaaga

SEQ ID NO: 3761964 - RNA, 14 nt, Human
gcuaacauggaagu

SEQ ID NO: 3761965 - RNA, 17 nt, Human
gcuaacauggaaguacu

SEQ ID NO: 3761966 - RNA, 20 nt, Human
gcuaacauggugaaaccccg

SEQ ID NO: 3761967 - RNA, 20 nt, Human
gcuaaccuuauccugcauug

SEQ ID NO: 3761968 - RNA, 15 nt, Human
gcuaacugaacuuug

SEQ ID NO: 3761969 - RNA, 13 nt, Human
gcuaacuggaagc

SEQ ID NO: 3761970 - RNA, 14 nt, Human
gcuaacuguaaauc

SEQ ID NO: 3761971 - RNA, 23 nt, Human
gcuaagaaaccaggaguaaaaga

SEQ ID NO: 3761972 - RNA, 19 nt, Human
gcuaagaagggaaaauauc

SEQ ID NO: 3761973 - RNA, 17 nt, Human
gcuaagaauauuugaau

SEQ ID NO: 3761974 - RNA, 20 nt, Human
gcuaagagcuagcgcugccg

SEQ ID NO: 3761975 - RNA, 13 nt, Human
gcuaagagggagg

SEQ ID NO: 3761976 - RNA, 21 nt, Human
gcuaagagggagggagggcuc

SEQ ID NO: 3761977 - RNA, 12 nt, Human
gcuaagaugcuc

SEQ ID NO: 3761978 - RNA, 19 nt, Human
gcuaagcaagcuaaccuua

SEQ ID NO: 3761979 - RNA, 22 nt, Human
gcuaagcucacguccugagaaa

SEQ ID NO: 3761980 - RNA, 20 nt, Human
gcuaaggacauuucccaggg

SEQ ID NO: 3761981 - RNA, 11 nt, Human
gcuaaggacuu

SEQ ID NO: 3761982 - RNA, 22 nt, Human
gcuaaggaggggaaaaaaaugu

SEQ ID NO: 3761983 - RNA, 15 nt, Human
gcuaaggcaccagcc

SEQ ID NO: 3761984 - RNA, 18 nt, Human
gcuaaggcguggagcugc

SEQ ID NO: 3761985 - RNA, 20 nt, Human
gcuaagggaagacauuucuu

SEQ ID NO: 3761986 - RNA, 22 nt, Human
gcuaagggaagacauuucuuuu

SEQ ID NO: 3761987 - RNA, 19 nt, Human
gcuaagggugggugcucag

SEQ ID NO: 3761988 - RNA, 21 nt, Human
gcuaagggugggugcucagaa

SEQ ID NO: 3761989 - RNA, 18 nt, Human
gcuaagugaaaaggucau

SEQ ID NO: 3761990 - RNA, 23 nt, Human
gcuaagugauccucccaccucag

SEQ ID NO: 3761991 - RNA, 13 nt, Human
gcuaagugugaac

SEQ ID NO: 3761992 - RNA, 21 nt, Human
gcuaauaaaaagcuuuugucu

SEQ ID NO: 3761993 - RNA, 17 nt, Human
gcuaauaaaauaucauu

SEQ ID NO: 3761994 - RNA, 18 nt, Human
gcuaauaaaauaucauuc

SEQ ID NO: 3761995 - RNA, 21 nt, Human
gcuaauaaaauaucauucagc

SEQ ID NO: 3761996 - RNA, 17 nt, Human
gcuaauaauguuaacca

SEQ ID NO: 3761997 - RNA, 20 nt, Human
gcuaauaucaauagaaggau

SEQ ID NO: 3761998 - RNA, 16 nt, Human
gcuaaucagcauucuc

SEQ ID NO: 3761999 - RNA, 22 nt, Human
gcuaaucagcauucucacuccu

SEQ ID NO: 3762000 - RNA, 19 nt, Human
gcuaaucagugucucacac

SEQ ID NO: 3762001 - RNA, 17 nt, Human
gcuaaucuguagggcug

SEQ ID NO: 3762002 - RNA, 18 nt, Human
gcuaaucuguagggcugg

SEQ ID NO: 3762003 - RNA, 20 nt, Human
gcuaaucuguagggcuggac

SEQ ID NO: 3762004 - RNA, 21 nt, Human
gcuaaucuguagggcuggacc

SEQ ID NO: 3762005 - RNA, 22 nt, Human
gcuaaucuguagggcuggaccu

SEQ ID NO: 3762006 - RNA, 17 nt, Human
gcuaaucuugugaaaau

SEQ ID NO: 3762007 - RNA, 21 nt, Human
gcuaaugaagggaaaggauau

SEQ ID NO: 3762008 - RNA, 13 nt, Human
gcuaaugggacac

SEQ ID NO: 3762009 - RNA, 14 nt, Human
gcuaauuauuuuaa

SEQ ID NO: 3762010 - RNA, 17 nt, Human
gcuaauuauuuuaauua

SEQ ID NO: 3762011 - RNA, 22 nt, Human
gcuaauucaaggaauuucuuaa

SEQ ID NO: 3762012 - RNA, 16 nt, Human
gcuaauucuacucaca

SEQ ID NO: 3762013 - RNA, 15 nt, Human
gcuaauucuuugcaa

SEQ ID NO: 3762014 - RNA, 21 nt, Human
gcuaauugcuguugaaagcaa

SEQ ID NO: 3762015 - RNA, 19 nt, Human
gcuaauugggaguccaggc

SEQ ID NO: 3762016 - RNA, 14 nt, Human
gcuaauuuucucaa

SEQ ID NO: 3762017 - RNA, 17 nt, Human
gcuaauuuucucaaaag

SEQ ID NO: 3762018 - RNA, 19 nt, Human
gcuaauuuucucaaaagca

SEQ ID NO: 3762019 - RNA, 17 nt, Human
gcuaauuuuuacuuuuu

SEQ ID NO: 3762020 - RNA, 18 nt, Human
gcuaauuuuuauuaauuu

SEQ ID NO: 3762021 - RNA, 21 nt, Human
gcuaauuuuuuuguauuuuag

SEQ ID NO: 3762022 - RNA, 18 nt, Human
gcuacaaaaacacagcaa

SEQ ID NO: 3762023 - RNA, 16 nt, Human
gcuacaaagaagacau

SEQ ID NO: 3762024 - RNA, 14 nt, Human
gcuacaacagccuc

SEQ ID NO: 3762025 - RNA, 15 nt, Human
gcuacaacuucagca

SEQ ID NO: 3762026 - RNA, 15 nt, Human
gcuacaauuuucucc

SEQ ID NO: 3762027 - RNA, 22 nt, Human
gcuacaauuuucucccaggaag

SEQ ID NO: 3762028 - RNA, 19 nt, Human
gcuacaccacucuggcagc

SEQ ID NO: 3762029 - RNA, 20 nt, Human
gcuacaccacucuggcagcc

SEQ ID NO: 3762030 - RNA, 16 nt, Human
gcuacagagaaaccag

SEQ ID NO: 3762031 - RNA, 19 nt, Human
gcuacagagaaaccagcuu

SEQ ID NO: 3762032 - RNA, 13 nt, Human
gcuacagagaagc

SEQ ID NO: 3762033 - RNA, 16 nt, Human
gcuacagagaagccuu

SEQ ID NO: 3762034 - RNA, 17 nt, Human
gcuacagagaagccuuc

SEQ ID NO: 3762035 - RNA, 12 nt, Human
gcuacagagccg

SEQ ID NO: 3762036 - RNA, 22 nt, Human
gcuacagagccgagcaauauuu

SEQ ID NO: 3762037 - RNA, 23 nt, Human
gcuacaggaagcaccccaugcca

SEQ ID NO: 3762038 - RNA, 18 nt, Human
gcuacagguuacaacaga

SEQ ID NO: 3762039 - RNA, 19 nt, Human
gcuacagguuacaacagau

SEQ ID NO: 3762040 - RNA, 20 nt, Human
gcuacagguuacaacagauu

SEQ ID NO: 3762041 - RNA, 23 nt, Human
gcuacaugacgacaaagcugcua

SEQ ID NO: 3762042 - RNA, 20 nt, Human
gcuacauggggucugggugg

SEQ ID NO: 3762043 - RNA, 15 nt, Human
gcuaccaccagcugu

SEQ ID NO: 3762044 - RNA, 14 nt, Human
gcuaccaguauuua

SEQ ID NO: 3762045 - RNA, 15 nt, Human
gcuaccaguauuuag

SEQ ID NO: 3762046 - RNA, 19 nt, Human
gcuaccaguauuuagaagc

SEQ ID NO: 3762047 - RNA, 21 nt, Human
gcuaccaguauuuagaagcca

SEQ ID NO: 3762048 - RNA, 21 nt, Human
gcuacccgggaagggggcugg

SEQ ID NO: 3762049 - RNA, 16 nt, Human
gcuacccuuuuucucc

SEQ ID NO: 3762050 - RNA, 19 nt, Human
gcuacccuuuuucuccagc

SEQ ID NO: 3762051 - RNA, 21 nt, Human
gcuacccuuuuucuccagcug

SEQ ID NO: 3762052 - RNA, 17 nt, Human
gcuaccucaagggggac

SEQ ID NO: 3762053 - RNA, 15 nt, Human
cuguucccccugugc

SEQ ID NO: 3762054 - RNA, 16 nt, Human
cuguucccccugugca

SEQ ID NO: 3762055 - RNA, 17 nt, Human
cuguucccccugugcag

SEQ ID NO: 3762056 - RNA, 17 nt, Human
cuguucccccuucacaa

SEQ ID NO: 3762057 - RNA, 14 nt, Human
cuguuccccucacu

SEQ ID NO: 3762058 - RNA, 15 nt, Human
cuguuccccucuccc

SEQ ID NO: 3762059 - RNA, 21 nt, Human
cuguuccccucucccuucccu

SEQ ID NO: 3762060 - RNA, 17 nt, Human
cuguucccucugcuccu

SEQ ID NO: 3762061 - RNA, 21 nt, Human
cuguuccugcugcugucuggg

SEQ ID NO: 3762062 - RNA, 16 nt, Human
cuguuccuguucagua

SEQ ID NO: 3762063 - RNA, 14 nt, Human
cuguuccuuuuaua

SEQ ID NO: 3762064 - RNA, 13 nt, Human
cuguucggaaggg

SEQ ID NO: 3762065 - RNA, 23 nt, Human
cuguucggaagggguuccucaaa

SEQ ID NO: 3762066 - RNA, 12 nt, Human
cuguucuaaagc

SEQ ID NO: 3762067 - RNA, 19 nt, Human
cuguucuacauagaugcuu

SEQ ID NO: 3762068 - RNA, 15 nt, Human
cuguucucuugggaa

SEQ ID NO: 3762069 - RNA, 21 nt, Human
cuguucucuugggaacugaac

SEQ ID NO: 3762070 - RNA, 16 nt, Human
cuguucugcacacagc

SEQ ID NO: 3762071 - RNA, 15 nt, Human
cuguucugcacugaa

SEQ ID NO: 3762072 - RNA, 16 nt, Human
cuguucugcacugaaa

SEQ ID NO: 3762073 - RNA, 14 nt, Human
cuguucugcagaca

SEQ ID NO: 3762074 - RNA, 14 nt, Human
cuguucugggcucu

SEQ ID NO: 3762075 - RNA, 14 nt, Human
cuguucuguggaaa

SEQ ID NO: 3762076 - RNA, 21 nt, Human
cuguucuguggaaaguguaaa

SEQ ID NO: 3762077 - RNA, 22 nt, Human
cuguucuguggaaaguguaaag

SEQ ID NO: 3762078 - RNA, 21 nt, Human
cuguucugugguuccucugcu

SEQ ID NO: 3762079 - RNA, 16 nt, Human
cuguucuuagcucaau

SEQ ID NO: 3762080 - RNA, 19 nt, Human
cuguucuuagcucaaugag

SEQ ID NO: 3762081 - RNA, 15 nt, Human
cuguucuuccuccag

SEQ ID NO: 3762082 - RNA, 20 nt, Human
cuguucuuccuccagcugca

SEQ ID NO: 3762083 - RNA, 22 nt, Human
cuguucuuccuccagcugcacc

SEQ ID NO: 3762084 - RNA, 12 nt, Human
cuguucuuccug

SEQ ID NO: 3762085 - RNA, 22 nt, Human
cuguucuugcugcuagaacuuu

SEQ ID NO: 3762086 - RNA, 16 nt, Human
cuguucuuuaauuuau

SEQ ID NO: 3762087 - RNA, 15 nt, Human
cuguucuuuccaaag

SEQ ID NO: 3762088 - RNA, 19 nt, Human
cuguucuuuccaaaguaca

SEQ ID NO: 3762089 - RNA, 21 nt, Human
cuguugaaaauuauuuuaaac

SEQ ID NO: 3762090 - RNA, 15 nt, Human
cuguugaaagcaaaa

SEQ ID NO: 3762091 - RNA, 18 nt, Human
cuguugaaagcaaaaaug

SEQ ID NO: 3762092 - RNA, 18 nt, Human
cuguugaagucaccuugu

SEQ ID NO: 3762093 - RNA, 22 nt, Human
cuguugaauuuuguucucuggg

SEQ ID NO: 3762094 - RNA, 21 nt, Human
cuguugacauauuuaauguuu

SEQ ID NO: 3762095 - RNA, 23 nt, Human
cuguugacauauuuaauguuuua

SEQ ID NO: 3762096 - RNA, 20 nt, Human
cuguugacauccaagcuucc

SEQ ID NO: 3762097 - RNA, 23 nt, Human
cuguugacauccaagcuuccuuu

SEQ ID NO: 3762098 - RNA, 17 nt, Human
cuguugacgaagucucu

SEQ ID NO: 3762099 - RNA, 19 nt, Human
cuguugacucuaguacugu

SEQ ID NO: 3762100 - RNA, 22 nt, Human
cuguugacucuaguacugugaa

SEQ ID NO: 3762101 - RNA, 22 nt, Human
cuguugacuggcugugugaccu

SEQ ID NO: 3762102 - RNA, 18 nt, Human
cuguugauaaaaacucag

SEQ ID NO: 3762103 - RNA, 18 nt, Human
cuguugauaaauccauca

SEQ ID NO: 3762104 - RNA, 21 nt, Human
cuguugaugaggccucuugga

SEQ ID NO: 3762105 - RNA, 16 nt, Human
cuguugauguaucuga

SEQ ID NO: 3762106 - RNA, 23 nt, Human
cuguugauguaucugaguugcca

SEQ ID NO: 3762107 - RNA, 15 nt, Human
cuguugauugcagga

SEQ ID NO: 3762108 - RNA, 17 nt, Human
cuguugauuucuuucca

SEQ ID NO: 3762109 - RNA, 19 nt, Human
cuguugcaaacucagccuc

SEQ ID NO: 3762110 - RNA, 17 nt, Human
cuguugcacccagcccu

SEQ ID NO: 3762111 - RNA, 13 nt, Human
cuguugccacaac

SEQ ID NO: 3762112 - RNA, 14 nt, Human
cuguugcccaggcu

SEQ ID NO: 3762113 - RNA, 16 nt, Human
cuguugcccaggcugg

SEQ ID NO: 3762114 - RNA, 20 nt, Human
cuguugcccuuucuguacca

SEQ ID NO: 3762115 - RNA, 12 nt, Human
cuguugccucau

SEQ ID NO: 3762116 - RNA, 23 nt, Human
cuguugcguaacuggcuguguuc

SEQ ID NO: 3762117 - RNA, 18 nt, Human
cuguugcgugacacucuc

SEQ ID NO: 3762118 - RNA, 22 nt, Human
cuguugcuaagccccagcaagc

SEQ ID NO: 3762119 - RNA, 11 nt, Human
cuguugcucaa

SEQ ID NO: 3762120 - RNA, 16 nt, Human
cuguugcugaauaggc

SEQ ID NO: 3762121 - RNA, 22 nt, Human
cuguugcugauuuuauucuuga

SEQ ID NO: 3762122 - RNA, 16 nt, Human
cuguugcuuacaauuu

SEQ ID NO: 3762123 - RNA, 11 nt, Human
cuguugcuuga

SEQ ID NO: 3762124 - RNA, 15 nt, Human
cuguugcuugaauag

SEQ ID NO: 3762125 - RNA, 12 nt, Human
cuguugcuuuuu

SEQ ID NO: 3762126 - RNA, 22 nt, Human
cuguuggacccgcucuggacca

SEQ ID NO: 3762127 - RNA, 18 nt, Human
cuguuggcaggcuggcca

SEQ ID NO: 3762128 - RNA, 19 nt, Human
cuguuggcaggcuggccag

SEQ ID NO: 3762129 - RNA, 12 nt, Human
cuguugggagag

SEQ ID NO: 3762130 - RNA, 17 nt, Human
cuguugggccaggagcc

SEQ ID NO: 3762131 - RNA, 17 nt, Human
cuguugggguggguaua

SEQ ID NO: 3762132 - RNA, 20 nt, Human
cuguugggguggguauaaaa

SEQ ID NO: 3762133 - RNA, 22 nt, Human
cuguugggguggguauaaaaga

SEQ ID NO: 3762134 - RNA, 20 nt, Human
cuguugguuccaagcccugg

SEQ ID NO: 3762135 - RNA, 16 nt, Human
cuguuguaacuaggcu

SEQ ID NO: 3762136 - RNA, 15 nt, Human
cuguuguaacuuaug

SEQ ID NO: 3762137 - RNA, 17 nt, Human
cuguuguaacuuaugua

SEQ ID NO: 3762138 - RNA, 20 nt, Human
cuguuguaacuuauguagau

SEQ ID NO: 3762139 - RNA, 15 nt, Human
cuguuguacauuuau

SEQ ID NO: 3762140 - RNA, 17 nt, Human
cuguuguacauuuauga

SEQ ID NO: 3762141 - RNA, 17 nt, Human
cuguugucauugcuuua

SEQ ID NO: 3762142 - RNA, 18 nt, Human
cuguugucauugcuuuac

SEQ ID NO: 3762143 - RNA, 17 nt, Human
cuguugucccucugcua

SEQ ID NO: 3762144 - RNA, 22 nt, Human
cuguuguguacguggagaggga

SEQ ID NO: 3762145 - RNA, 15 nt, Human
cuguuguguucguuc

SEQ ID NO: 3762146 - RNA, 23 nt, Human
cuguuguuaugaugugcuuaaca

SEQ ID NO: 3762147 - RNA, 17 nt, Human
cuguuguuguuaaugaa

SEQ ID NO: 3762148 - RNA, 16 nt, Human
cuguuguuuuguuuua

SEQ ID NO: 3762149 - RNA, 16 nt, Human
cuguuuaaaaaaccac

SEQ ID NO: 3762150 - RNA, 18 nt, Human
cuguuuaaaaaaccacau

SEQ ID NO: 3762151 - RNA, 22 nt, Human
cuguuuaaauauuucaagacau

SEQ ID NO: 3762152 - RNA, 12 nt, Human
cuguuuaagaga

SEQ ID NO: 3762153 - RNA, 14 nt, Human
cuguuuaagagaca

SEQ ID NO: 3762154 - RNA, 21 nt, Human
cuguuuaauauuuaaacagca

SEQ ID NO: 3762155 - RNA, 22 nt, Human
cuguuuaaucauaguuacugug

SEQ ID NO: 3762156 - RNA, 15 nt, Human
cuguuuaauguucug

SEQ ID NO: 3762157 - RNA, 17 nt, Human
cuguuuaccauuuuuca

SEQ ID NO: 3762158 - RNA, 19 nt, Human
cuguuuacuugaauaguau

SEQ ID NO: 3762159 - RNA, 14 nt, Human
cuguuuagaacaca

SEQ ID NO: 3762160 - RNA, 12 nt, Human
cuguuuagauaa

SEQ ID NO: 3762161 - RNA, 18 nt, Human
cuguuuagauaauacacc

SEQ ID NO: 3762162 - RNA, 21 nt, Human
cuguuuagauuugccauagag

SEQ ID NO: 3762163 - RNA, 16 nt, Human
cuguuuauggccucag

SEQ ID NO: 3762164 - RNA, 19 nt, Human
cuguuuauggccucagcug

SEQ ID NO: 3762165 - RNA, 14 nt, Human
cuguuuauuaaucu

SEQ ID NO: 3762166 - RNA, 18 nt, Human
cuguuuauuacuuccaug

SEQ ID NO: 3762167 - RNA, 17 nt, Human
cuguuuauucauaugca

SEQ ID NO: 3762168 - RNA, 20 nt, Human
cuguuuauucauaugcauau

SEQ ID NO: 3762169 - RNA, 15 nt, Human
cuguuuauucccauc

SEQ ID NO: 3762170 - RNA, 23 nt, Human
cuguuuauugaaagaauuauccu

SEQ ID NO: 3762171 - RNA, 12 nt, Human
cuguuucaaaca

SEQ ID NO: 3762172 - RNA, 12 nt, Human
cuguuucaaagu

SEQ ID NO: 3762173 - RNA, 11 nt, Human
cuguuucaagg

SEQ ID NO: 3762174 - RNA, 21 nt, Human
cuguuucaaggcacucuagau

SEQ ID NO: 3762175 - RNA, 22 nt, Human
cuguuucaaggcacucuagauu

SEQ ID NO: 3762176 - RNA, 21 nt, Human
cuguuucaaguucacaccugc

SEQ ID NO: 3762177 - RNA, 16 nt, Human
cuguuucccaggccca

SEQ ID NO: 3762178 - RNA, 17 nt, Human
cuguuuccuagcugugu

SEQ ID NO: 3762179 - RNA, 20 nt, Human
cuguuuccugacauugucuc

SEQ ID NO: 3762180 - RNA, 13 nt, Human
cuguuuccugggc

SEQ ID NO: 3762181 - RNA, 15 nt, Human
cuguuuccuuuuaug

SEQ ID NO: 3762182 - RNA, 20 nt, Human
cuguuucuauucucuccuca

SEQ ID NO: 3762183 - RNA, 18 nt, Human
cuguuucucagucucaca

SEQ ID NO: 3762184 - RNA, 11 nt, Human
cuguuucucau

SEQ ID NO: 3762185 - RNA, 21 nt, Human
cuguuucucugccgcuaccuc

SEQ ID NO: 3762186 - RNA, 19 nt, Human
cuguuucugaaaagaaaua

SEQ ID NO: 3762187 - RNA, 17 nt, Human
cuguuucugauuugcug

SEQ ID NO: 3762188 - RNA, 16 nt, Human
cuguuucugucaggag

SEQ ID NO: 3762189 - RNA, 13 nt, Human
cuguuucuugcuu

SEQ ID NO: 3762190 - RNA, 16 nt, Human
cuguuucuugcuugua

SEQ ID NO: 3762191 - RNA, 13 nt, Human
cuguuugagaaag

SEQ ID NO: 3762192 - RNA, 21 nt, Human
cuguuugaggaaagcaagaau

SEQ ID NO: 3762193 - RNA, 22 nt, Human
cuguuugaggauauauuuucac

SEQ ID NO: 3762194 - RNA, 18 nt, Human
cuguuugauauaccaaau

SEQ ID NO: 3762195 - RNA, 18 nt, Human
cuguuugcauuugauaca

SEQ ID NO: 3762196 - RNA, 19 nt, Human
cuguuugcuaagugaggau

SEQ ID NO: 3762197 - RNA, 14 nt, Human
cuguuugcugaugg

SEQ ID NO: 3762198 - RNA, 11 nt, Human
cuguuuggaaa

SEQ ID NO: 3762199 - RNA, 17 nt, Human
cuguuuggaaaagacag

SEQ ID NO: 3762200 - RNA, 23 nt, Human
cuguuuggaaauugauuuugaac

SEQ ID NO: 3762201 - RNA, 23 nt, Human
cuguuuggaggagcaaaggcuga

SEQ ID NO: 3762202 - RNA, 15 nt, Human
gcuaccucucugucc

SEQ ID NO: 3762203 - RNA, 22 nt, Human
gcuaccucucugucccuugcug

SEQ ID NO: 3762204 - RNA, 19 nt, Human
gcuaccugaucccacuccu

SEQ ID NO: 3762205 - RNA, 14 nt, Human
gcuaccugugugga

SEQ ID NO: 3762206 - RNA, 17 nt, Human
gcuaccuguguggacag

SEQ ID NO: 3762207 - RNA, 13 nt, Human
gcuaccuugcccc

SEQ ID NO: 3762208 - RNA, 20 nt, Human
gcuaccuugccccaacccuu

SEQ ID NO: 3762209 - RNA, 16 nt, Human
gcuaccuuucaaagcu

SEQ ID NO: 3762210 - RNA, 16 nt, Human
gcuaccuuuguauucu

SEQ ID NO: 3762211 - RNA, 15 nt, Human
gcuacgaaucuuccg

SEQ ID NO: 3762212 - RNA, 15 nt, Human
gcuacgccucuucug

SEQ ID NO: 3762213 - RNA, 17 nt, Human
gcuacgccucuucuguc

SEQ ID NO: 3762214 - RNA, 20 nt, Human
gcuacgugugauuuuucugg

SEQ ID NO: 3762215 - RNA, 19 nt, Human
gcuacguuccuauugucau

SEQ ID NO: 3762216 - RNA, 14 nt, Human
gcuacuaaugaugu

SEQ ID NO: 3762217 - RNA, 16 nt, Human
gcuacuaaugauguuu

SEQ ID NO: 3762218 - RNA, 14 nt, Human
gcuacuagcaaaau

SEQ ID NO: 3762219 - RNA, 16 nt, Human
gcuacuagcaaaauaa

SEQ ID NO: 3762220 - RNA, 16 nt, Human
gcuacuauaaagagaa

SEQ ID NO: 3762221 - RNA, 20 nt, Human
gcuacuaugauuuaauuuga

SEQ ID NO: 3762222 - RNA, 17 nt, Human
gcuacucaagaggcuga

SEQ ID NO: 3762223 - RNA, 21 nt, Human
gcuacucaagaggcugaggca

SEQ ID NO: 3762224 - RNA, 20 nt, Human
gcuacucacucaaguucaag

SEQ ID NO: 3762225 - RNA, 17 nt, Human
gcuacucagaagccuga

SEQ ID NO: 3762226 - RNA, 18 nt, Human
gcuacucagaagccugag

SEQ ID NO: 3762227 - RNA, 16 nt, Human
gcuacucagcagcccu

SEQ ID NO: 3762228 - RNA, 19 nt, Human
gcuacucagcagcccuccu

SEQ ID NO: 3762229 - RNA, 16 nt, Human
gcuacucaggaggcug

SEQ ID NO: 3762230 - RNA, 18 nt, Human
gcuacucgggaggcugag

SEQ ID NO: 3762231 - RNA, 22 nt, Human
gcuacucgggaggcugaggcac

SEQ ID NO: 3762232 - RNA, 20 nt, Human
gcuacucuaguauuccagac

SEQ ID NO: 3762233 - RNA, 17 nt, Human
gcuacucugugccagag

SEQ ID NO: 3762234 - RNA, 18 nt, Human
gcuacucugugccagagc

SEQ ID NO: 3762235 - RNA, 17 nt, Human
gcuacugauuuccuuug

SEQ ID NO: 3762236 - RNA, 20 nt, Human
gcuacugauuuccuuuggag

SEQ ID NO: 3762237 - RNA, 18 nt, Human
gcuacugcacuccagccu

SEQ ID NO: 3762238 - RNA, 17 nt, Human
gcuacugccauccuggc

SEQ ID NO: 3762239 - RNA, 18 nt, Human
gcuacugccauccuggcc

SEQ ID NO: 3762240 - RNA, 21 nt, Human
gcuacugccauccuggcccag

SEQ ID NO: 3762241 - RNA, 23 nt, Human
gcuacuggcaaaaggaucuuugu

SEQ ID NO: 3762242 - RNA, 17 nt, Human
gcuacuggggaaacugg

SEQ ID NO: 3762243 - RNA, 18 nt, Human
gcuacuguaauuuuauau

SEQ ID NO: 3762244 - RNA, 15 nt, Human
gcuacugucagcucc

SEQ ID NO: 3762245 - RNA, 21 nt, Human
gcuacugucucacugaaacau

SEQ ID NO: 3762246 - RNA, 16 nt, Human
gcuacugucuuuggaa

SEQ ID NO: 3762247 - RNA, 18 nt, Human
gcuacuguuguaagaauu

SEQ ID NO: 3762248 - RNA, 13 nt, Human
gcuacuuaagaga

SEQ ID NO: 3762249 - RNA, 16 nt, Human
gcuacuuaagagaaau

SEQ ID NO: 3762250 - RNA, 21 nt, Human
gcuacuuaagagaaauggcaa

SEQ ID NO: 3762251 - RNA, 17 nt, Human
gcuacuugggaggcuga

SEQ ID NO: 3762252 - RNA, 18 nt, Human
gcuacuugggccauagcu

SEQ ID NO: 3762253 - RNA, 15 nt, Human
gcuacuugguuugug

SEQ ID NO: 3762254 - RNA, 21 nt, Human
gcuacuuuauuuauacacugu

SEQ ID NO: 3762255 - RNA, 22 nt, Human
gcuacuuugguuucugucugua

SEQ ID NO: 3762256 - RNA, 11 nt, Human
gcuagaaauga

SEQ ID NO: 3762257 - RNA, 18 nt, Human
gcuagaaccuagaagggc

SEQ ID NO: 3762258 - RNA, 19 nt, Human
gcuagaaccuggaagggcu

SEQ ID NO: 3762259 - RNA, 20 nt, Human
gcuagaaccuggaagggcua

SEQ ID NO: 3762260 - RNA, 19 nt, Human
gcuagaaccuggagggcug

SEQ ID NO: 3762261 - RNA, 14 nt, Human
gcuagaacucccuu

SEQ ID NO: 3762262 - RNA, 15 nt, Human
gcuagaacucccuuu

SEQ ID NO: 3762263 - RNA, 18 nt, Human
gcuagaacucccuuucaa

SEQ ID NO: 3762264 - RNA, 12 nt, Human
gcuagaacuuuu

SEQ ID NO: 3762265 - RNA, 17 nt, Human
gcuagaacuuuuuuaaa

SEQ ID NO: 3762266 - RNA, 14 nt, Human
gcuagaagaaaaca

SEQ ID NO: 3762267 - RNA, 17 nt, Human
gcuagaaggccacaugu

SEQ ID NO: 3762268 - RNA, 20 nt, Human
gcuagaagugggccaggaca

SEQ ID NO: 3762269 - RNA, 13 nt, Human
gcuagaauacuuu

SEQ ID NO: 3762270 - RNA, 16 nt, Human
gcuagacacaugaagg

SEQ ID NO: 3762271 - RNA, 22 nt, Human
gcuagacacaugaagguaaaua

SEQ ID NO: 3762272 - RNA, 15 nt, Human
gcuagacacccauuu

SEQ ID NO: 3762273 - RNA, 22 nt, Human
gcuagacgagcaggcuucuucc

SEQ ID NO: 3762274 - RNA, 22 nt, Human
gcuagacuggugacugauucuu

SEQ ID NO: 3762275 - RNA, 23 nt, Human
gcuagagcagcccaaauuuuucu

SEQ ID NO: 3762276 - RNA, 18 nt, Human
gcuagaggaagcagccaa

SEQ ID NO: 3762277 - RNA, 21 nt, Human
gcuagaggccagccccaccca

SEQ ID NO: 3762278 - RNA, 24 nt, Human
gcuagaggccauggaggcaguagg

SEQ ID NO: 3762279 - RNA, 13 nt, Human
gcuagaggccuga

SEQ ID NO: 3762280 - RNA, 18 nt, Human
gcuagagguucaaagaua

SEQ ID NO: 3762281 - RNA, 20 nt, Human
gcuagaguccucacucccag

SEQ ID NO: 3762282 - RNA, 13 nt, Human
gcuagauaaaagc

SEQ ID NO: 3762283 - RNA, 22 nt, Human
gcuagaugagaauucagcugcc

SEQ ID NO: 3762284 - RNA, 16 nt, Human
gcuagcaaauaguaau

SEQ ID NO: 3762285 - RNA, 19 nt, Human
gcuagcaaauggcagaacc

SEQ ID NO: 3762286 - RNA, 15 nt, Human
gcuagcacagcuccc

SEQ ID NO: 3762287 - RNA, 16 nt, Human
gcuagcacaugcccua

SEQ ID NO: 3762288 - RNA, 17 nt, Human
gcuagcacuuggagcca

SEQ ID NO: 3762289 - RNA, 19 nt, Human
gcuagcuaagccaagaggc

SEQ ID NO: 3762290 - RNA, 18 nt, Human
gcuagcuccccuccucuc

SEQ ID NO: 3762291 - RNA, 22 nt, Human
gcuagcuccccuccucuccccu

SEQ ID NO: 3762292 - RNA, 15 nt, Human
gcuagcuggagccug

SEQ ID NO: 3762293 - RNA, 18 nt, Human
gcuagcuucugcuuuucu

SEQ ID NO: 3762294 - RNA, 22 nt, Human
gcuaggaaauccaggguggugg

SEQ ID NO: 3762295 - RNA, 18 nt, Human
gcuaggaacacuccuuca

SEQ ID NO: 3762296 - RNA, 21 nt, Human
gcuaggaacacuccuucacag

SEQ ID NO: 3762297 - RNA, 20 nt, Human
gcuaggaagagcaggacucc

SEQ ID NO: 3762298 - RNA, 17 nt, Human
gcuaggaagaggagugg

SEQ ID NO: 3762299 - RNA, 21 nt, Human
gcuaggaagagucuacccgac

SEQ ID NO: 3762300 - RNA, 18 nt, Human
gcuaggaauauagauuaa

SEQ ID NO: 3762301 - RNA, 12 nt, Human
gcuaggaaugaa

SEQ ID NO: 3762302 - RNA, 18 nt, Human
gcuaggaaugaaauccug

SEQ ID NO: 3762303 - RNA, 20 nt, Human
gcuaggaccccuccaugugg

SEQ ID NO: 3762304 - RNA, 17 nt, Human
gcuaggagcaaagccug

SEQ ID NO: 3762305 - RNA, 20 nt, Human
gcuaggcagggugucugccc

SEQ ID NO: 3762306 - RNA, 18 nt, Human
gcuaggcauacaaguagg

SEQ ID NO: 3762307 - RNA, 19 nt, Human
gcuaggcgagugccaggac

SEQ ID NO: 3762308 - RNA, 14 nt, Human
gcuaggugggccag

SEQ ID NO: 3762309 - RNA, 21 nt, Human
gcuaguaauuggaaaggcagc

SEQ ID NO: 3762310 - RNA, 16 nt, Human
gcuaguaucaaaagaa

SEQ ID NO: 3762311 - RNA, 11 nt, Human
gcuaguauuug

SEQ ID NO: 3762312 - RNA, 14 nt, Human
gcuaguauuugaau

SEQ ID NO: 3762313 - RNA, 16 nt, Human
gcuaguauuugaauua

SEQ ID NO: 3762314 - RNA, 18 nt, Human
gcuagucaagcuccuccu

SEQ ID NO: 3762315 - RNA, 21 nt, Human
gcuagucaagcuccuccuccc

SEQ ID NO: 3762316 - RNA, 22 nt, Human
gcuaguccggacccaccucacc

SEQ ID NO: 3762317 - RNA, 15 nt, Human
gcuagucuuucacag

SEQ ID NO: 3762318 - RNA, 22 nt, Human
gcuagucuuuugcuuuugccca

SEQ ID NO: 3762319 - RNA, 15 nt, Human
gcuagugagcugggc

SEQ ID NO: 3762320 - RNA, 17 nt, Human
gcuagugauguuuuuau

SEQ ID NO: 3762321 - RNA, 22 nt, Human
gcuaguguaccuccucucagug

SEQ ID NO: 3762322 - RNA, 21 nt, Human
gcuagugugguguuuccuggc

SEQ ID NO: 3762323 - RNA, 22 nt, Human
gcuagugugguguuuccuggca

SEQ ID NO: 3762324 - RNA, 14 nt, Human
gcuaguguucuguc

SEQ ID NO: 3762325 - RNA, 15 nt, Human
gcuaguguucugucu

SEQ ID NO: 3762326 - RNA, 22 nt, Human
gcuaguuauacuuauuuguaua

SEQ ID NO: 3762327 - RNA, 16 nt, Human
gcuaguugaauacuug

SEQ ID NO: 3762328 - RNA, 22 nt, Human
gcuaguugaauacuugaaccau

SEQ ID NO: 3762329 - RNA, 14 nt, Human
gcuaguugaaucua

SEQ ID NO: 3762330 - RNA, 14 nt, Human
gcuaguugggcuuc

SEQ ID NO: 3762331 - RNA, 19 nt, Human
gcuauaaagcaguauuuuu

SEQ ID NO: 3762332 - RNA, 17 nt, Human
gcuauaaauuauauucc

SEQ ID NO: 3762333 - RNA, 18 nt, Human
gcuauaaauuccucuuug

SEQ ID NO: 3762334 - RNA, 20 nt, Human
gcuauaacuauguugauaaa

SEQ ID NO: 3762335 - RNA, 23 nt, Human
gcuauaccugggcauacuaauaa

SEQ ID NO: 3762336 - RNA, 15 nt, Human
gcuauaccugugccu

SEQ ID NO: 3762337 - RNA, 19 nt, Human
gcuauagacccgaggaaac

SEQ ID NO: 3762338 - RNA, 14 nt, Human
gcuauagccuggac

SEQ ID NO: 3762339 - RNA, 16 nt, Human
gcuauagcucaggacc

SEQ ID NO: 3762340 - RNA, 16 nt, Human
gcuauaggcuggagaa

SEQ ID NO: 3762341 - RNA, 18 nt, Human
gcuauaggugcuacaaaa

SEQ ID NO: 3762342 - RNA, 19 nt, Human
gcuauaggugcuacaaaaa

SEQ ID NO: 3762343 - RNA, 13 nt, Human
gcuauaguauuug

SEQ ID NO: 3762344 - RNA, 16 nt, Human
gcuauaguauuugauu

SEQ ID NO: 3762345 - RNA, 23 nt, Human
gcuauaguuacuguccuguugau

SEQ ID NO: 3762346 - RNA, 14 nt, Human
gcuauauccaugua

SEQ ID NO: 3762347 - RNA, 15 nt, Human
gcuauauccauguac

SEQ ID NO: 3762348 - RNA, 23 nt, Human
gcuauauccauguacuguaguuu

SEQ ID NO: 3762349 - RNA, 19 nt, Human
gcuauaucuauauauaauu

SEQ ID NO: 3762350 - RNA, 22 nt, Human
gcuauauuuucaugacuuuucc

SEQ ID NO: 3762351 - RNA, 17 nt, Human
gccuggucacagggcau

SEQ ID NO: 3762352 - RNA, 13 nt, Human
gccuggucagccc

SEQ ID NO: 3762353 - RNA, 22 nt, Human
gccugguccaugauggagucag

SEQ ID NO: 3762354 - RNA, 13 nt, Human
gccugguccaugc

SEQ ID NO: 3762355 - RNA, 17 nt, Human
gccugguccucacacuc

SEQ ID NO: 3762356 - RNA, 18 nt, Human
gccuggucgccuuccacc

SEQ ID NO: 3762357 - RNA, 13 nt, Human
gccuggugcagug

SEQ ID NO: 3762358 - RNA, 15 nt, Human
gccugguggcagcug

SEQ ID NO: 3762359 - RNA, 17 nt, Human
gccugguggcagcugcg

SEQ ID NO: 3762360 - RNA, 19 nt, Human
gccugguggcagcugcggu

SEQ ID NO: 3762361 - RNA, 21 nt, Human
gccugguggcagcugcggucc

SEQ ID NO: 3762362 - RNA, 14 nt, Human
gccuggugguuuuc

SEQ ID NO: 3762363 - RNA, 13 nt, Human
gccugguugaaga

SEQ ID NO: 3762364 - RNA, 13 nt, Human
gccuguaaacuuu

SEQ ID NO: 3762365 - RNA, 18 nt, Human
gccuguaaucacagcuac

SEQ ID NO: 3762366 - RNA, 14 nt, Human
gccuguaaucccag

SEQ ID NO: 3762367 - RNA, 16 nt, Human
gccuguaaucccagca

SEQ ID NO: 3762368 - RNA, 20 nt, Human
gccuguaaucccagcacuuu

SEQ ID NO: 3762369 - RNA, 13 nt, Human
gccuguacagucu

SEQ ID NO: 3762370 - RNA, 22 nt, Human
gccuguacagucugucuucugu

SEQ ID NO: 3762371 - RNA, 11 nt, Human
gccuguacugc

SEQ ID NO: 3762372 - RNA, 14 nt, Human
gccuguacugccug

SEQ ID NO: 3762373 - RNA, 17 nt, Human
gccuguacugccugcuu

SEQ ID NO: 3762374 - RNA, 18 nt, Human
gccuguacugccugcuug

SEQ ID NO: 3762375 - RNA, 19 nt, Human
gccuguagaauagccugug

SEQ ID NO: 3762376 - RNA, 22 nt, Human
gccuguagaauagccuguggcc

SEQ ID NO: 3762377 - RNA, 14 nt, Human
gccuguagcaguga

SEQ ID NO: 3762378 - RNA, 13 nt, Human
gccuguagcccac

SEQ ID NO: 3762379 - RNA, 20 nt, Human
gccuguagccccagugacag

SEQ ID NO: 3762380 - RNA, 19 nt, Human
gccuguagucccagccacu

SEQ ID NO: 3762381 - RNA, 17 nt, Human
gccuguaguuaggaaau

SEQ ID NO: 3762382 - RNA, 22 nt, Human
gccuguaguuaggaaauaaaac

SEQ ID NO: 3762383 - RNA, 13 nt, Human
gccuguauacuuu

SEQ ID NO: 3762384 - RNA, 15 nt, Human
gccuguauacuuuag

SEQ ID NO: 3762385 - RNA, 17 nt, Human
gccuguauacuuuagua

SEQ ID NO: 3762386 - RNA, 18 nt, Human
gccugucagauccaggag

SEQ ID NO: 3762387 - RNA, 20 nt, Human
gccugucccacccccacccc

SEQ ID NO: 3762388 - RNA, 21 nt, Human
gccugucccauggacacucca

SEQ ID NO: 3762389 - RNA, 22 nt, Human
gccugucccauggacacuccag

SEQ ID NO: 3762390 - RNA, 20 nt, Human
gccugucccuggccaucucu

SEQ ID NO: 3762391 - RNA, 12 nt, Human
gccuguccugcc

SEQ ID NO: 3762392 - RNA, 13 nt, Human
gccuguccugggc

SEQ ID NO: 3762393 - RNA, 13 nt, Human
gccugucuccuuu

SEQ ID NO: 3762394 - RNA, 22 nt, Human
gccugucuccuuugcaggcuca

SEQ ID NO: 3762395 - RNA, 13 nt, Human
gccugucucuucc

SEQ ID NO: 3762396 - RNA, 23 nt, Human
gccugucugagacucacaggaag

SEQ ID NO: 3762397 - RNA, 21 nt, Human
gccugucugccccagcccaga

SEQ ID NO: 3762398 - RNA, 17 nt, Human
gccugucugucucucca

SEQ ID NO: 3762399 - RNA, 17 nt, Human
gccugucuuaauuuucu

SEQ ID NO: 3762400 - RNA, 14 nt, Human
gccugugaacccag

SEQ ID NO: 3762401 - RNA, 15 nt, Human
gccugugaacccagg

SEQ ID NO: 3762402 - RNA, 18 nt, Human
gccugugaacccaggaca

SEQ ID NO: 3762403 - RNA, 16 nt, Human
gccugugagccagucu

SEQ ID NO: 3762404 - RNA, 14 nt, Human
gccugugaggcagg

SEQ ID NO: 3762405 - RNA, 23 nt, Human
gccugugaggugcagagugccca

SEQ ID NO: 3762406 - RNA, 13 nt, Human
gccugugcacaca

SEQ ID NO: 3762407 - RNA, 15 nt, Human
gccugugcacacaca

SEQ ID NO: 3762408 - RNA, 12 nt, Human
gccugugcagug

SEQ ID NO: 3762409 - RNA, 19 nt, Human
gccugugcauguaugucuu

SEQ ID NO: 3762410 - RNA, 19 nt, Human
gccugugccacccaccagg

SEQ ID NO: 3762411 - RNA, 15 nt, Human
gccugugccagguga

SEQ ID NO: 3762412 - RNA, 19 nt, Human
gccugugccaggugagguc

SEQ ID NO: 3762413 - RNA, 22 nt, Human
gccugugccaggugaggucagc

SEQ ID NO: 3762414 - RNA, 19 nt, Human
gccugugccuccucacccc

SEQ ID NO: 3762415 - RNA, 14 nt, Human
gccugugcugcccg

SEQ ID NO: 3762416 - RNA, 14 nt, Human
gccugugcugugac

SEQ ID NO: 3762417 - RNA, 16 nt, Human
gccuguggaaugagug

SEQ ID NO: 3762418 - RNA, 18 nt, Human
gccuguggaaugagugug

SEQ ID NO: 3762419 - RNA, 19 nt, Human
gccuguggaaugagugugc

SEQ ID NO: 3762420 - RNA, 18 nt, Human
gccuguggagcucagccc

SEQ ID NO: 3762421 - RNA, 22 nt, Human
gccuguggaugaucaauccuuu

SEQ ID NO: 3762422 - RNA, 22 nt, Human
gccuguggcaguaaagagaaac

SEQ ID NO: 3762423 - RNA, 22 nt, Human
gccuguggcaucuuugccuugg

SEQ ID NO: 3762424 - RNA, 10 nt, Human
gccuguggcc

SEQ ID NO: 3762425 - RNA, 23 nt, Human
gccuguggccaugacccugccuc

SEQ ID NO: 3762426 - RNA, 17 nt, Human
gccuguggcccuguccu

SEQ ID NO: 3762427 - RNA, 14 nt, Human
gccuguggccugug

SEQ ID NO: 3762428 - RNA, 16 nt, Human
gccuguggccuguguc

SEQ ID NO: 3762429 - RNA, 17 nt, Human
gccuguggccugugucc

SEQ ID NO: 3762430 - RNA, 19 nt, Human
gccuguggcgccgucucca

SEQ ID NO: 3762431 - RNA, 16 nt, Human
gccuguggcggugccu

SEQ ID NO: 3762432 - RNA, 19 nt, Human
gccuguggcggugccuggg

SEQ ID NO: 3762433 - RNA, 13 nt, Human
gccuguggcugcg

SEQ ID NO: 3762434 - RNA, 12 nt, Human
gccuguggcugu

SEQ ID NO: 3762435 - RNA, 21 nt, Human
gccugugguucugagauggcu

SEQ ID NO: 3762436 - RNA, 19 nt, Human
gccuguguaacagcuccuu

SEQ ID NO: 3762437 - RNA, 20 nt, Human
gccuguguagcugugaccug

SEQ ID NO: 3762438 - RNA, 19 nt, Human
gccugugucccaugaccca

SEQ ID NO: 3762439 - RNA, 23 nt, Human
gccugugucccaugacccacccc

SEQ ID NO: 3762440 - RNA, 14 nt, Human
gccugugucuuuaa

SEQ ID NO: 3762441 - RNA, 22 nt, Human
gccugugucuuuaaaugcugcu

SEQ ID NO: 3762442 - RNA, 17 nt, Human
gccuguguucuuccugg

SEQ ID NO: 3762443 - RNA, 20 nt, Human
gccuguguucuuccuggccg

SEQ ID NO: 3762444 - RNA, 20 nt, Human
gccuguuaggagaagcugca

SEQ ID NO: 3762445 - RNA, 14 nt, Human
gccuguucccccgc

SEQ ID NO: 3762446 - RNA, 17 nt, Human
gccuguuccccucacug

SEQ ID NO: 3762447 - RNA, 14 nt, Human
gccuguugcccuuu

SEQ ID NO: 3762448 - RNA, 21 nt, Human
gccuguuggacccgcucugga

SEQ ID NO: 3762449 - RNA, 15 nt, Human
gccuguugggccagg

SEQ ID NO: 3762450 - RNA, 13 nt, Human
gccuguuuaagag

SEQ ID NO: 3762451 - RNA, 19 nt, Human
gccuguuucugauuugcug

SEQ ID NO: 3762452 - RNA, 16 nt, Human
gccuguuucuuccugu

SEQ ID NO: 3762453 - RNA, 21 nt, Human
gccuguuuggccucucuaucc

SEQ ID NO: 3762454 - RNA, 22 nt, Human
gccuguuuggcguuucccagag

SEQ ID NO: 3762455 - RNA, 20 nt, Human
gccuguuuuagaagguucuc

SEQ ID NO: 3762456 - RNA, 12 nt, Human
gccuuaaaacuu

SEQ ID NO: 3762457 - RNA, 16 nt, Human
gccuuaaaacuuuaau

SEQ ID NO: 3762458 - RNA, 20 nt, Human
gccuuaaaccuaccucccac

SEQ ID NO: 3762459 - RNA, 16 nt, Human
gccuuaagcugauccu

SEQ ID NO: 3762460 - RNA, 18 nt, Human
gccuuaagcugauccugc

SEQ ID NO: 3762461 - RNA, 22 nt, Human
gccuuaagugaggaaaucaaag

SEQ ID NO: 3762462 - RNA, 14 nt, Human
gccuuaauuuccuu

SEQ ID NO: 3762463 - RNA, 21 nt, Human
gccuuaauuuccuuuuugaca

SEQ ID NO: 3762464 - RNA, 21 nt, Human
gccuuacacaaugguuuucuu

SEQ ID NO: 3762465 - RNA, 12 nt, Human
gccuuaccuccu

SEQ ID NO: 3762466 - RNA, 13 nt, Human
gccuuaccuccug

SEQ ID NO: 3762467 - RNA, 14 nt, Human
gccuuaccuccugc

SEQ ID NO: 3762468 - RNA, 15 nt, Human
gccuuaccuccugcc

SEQ ID NO: 3762469 - RNA, 15 nt, Human
gccuuacuuuguaug

SEQ ID NO: 3762470 - RNA, 14 nt, Human
gccuuagagccagg

SEQ ID NO: 3762471 - RNA, 15 nt, Human
gccuuagaggagccc

SEQ ID NO: 3762472 - RNA, 14 nt, Human
gccuuagcuucagg

SEQ ID NO: 3762473 - RNA, 19 nt, Human
gccuuaggaagagccuucc

SEQ ID NO: 3762474 - RNA, 15 nt, Human
gccuuagggaagcug

SEQ ID NO: 3762475 - RNA, 22 nt, Human
gccuuagggaagcuggccugag

SEQ ID NO: 3762476 - RNA, 22 nt, Human
gccuuagucucaguuugugugu

SEQ ID NO: 3762477 - RNA, 16 nt, Human
gccuuagugggccagg

SEQ ID NO: 3762478 - RNA, 23 nt, Human
gccuuaucgggcuccagccaucu

SEQ ID NO: 3762479 - RNA, 16 nt, Human
gccuuauggaacacuc

SEQ ID NO: 3762480 - RNA, 12 nt, Human
gccuuauuaaag

SEQ ID NO: 3762481 - RNA, 19 nt, Human
gccuuauuagagugucuuu

SEQ ID NO: 3762482 - RNA, 17 nt, Human
gccuucacaaucuguca

SEQ ID NO: 3762483 - RNA, 22 nt, Human
gccuucacacagauagaccuuu

SEQ ID NO: 3762484 - RNA, 18 nt, Human
gccuucacauuccccugg

SEQ ID NO: 3762485 - RNA, 14 nt, Human
gccuucagcuccag

SEQ ID NO: 3762486 - RNA, 13 nt, Human
gccuucagcucua

SEQ ID NO: 3762487 - RNA, 23 nt, Human
gccuucaggguucagcaguacag

SEQ ID NO: 3762488 - RNA, 16 nt, Human
gccuucauucugcaag

SEQ ID NO: 3762489 - RNA, 17 nt, Human
gccuuccacccaggggc

SEQ ID NO: 3762490 - RNA, 13 nt, Human
gccuuccaccucu

SEQ ID NO: 3762491 - RNA, 22 nt, Human
gccuuccacuuggcuacacagg

SEQ ID NO: 3762492 - RNA, 22 nt, Human
gccuuccagauccucucugggg

SEQ ID NO: 3762493 - RNA, 23 nt, Human
gccuuccagauccucucuggggc

SEQ ID NO: 3762494 - RNA, 14 nt, Human
gccuuccagcugcu

SEQ ID NO: 3762495 - RNA, 13 nt, Human
gccuuccauaauu

SEQ ID NO: 3762496 - RNA, 15 nt, Human
gccuuccauaauuau

SEQ ID NO: 3762497 - RNA, 21 nt, Human
gccuucccaaguugugcuuga

SEQ ID NO: 3762498 - RNA, 14 nt, Human
gccuuccccagccu

SEQ ID NO: 3762499 - RNA, 16 nt, Human
gccuuccccagccucu

SEQ ID NO: 3762500 - RNA, 17 nt, Human
gccuuccccagccucuu

SEQ ID NO: 3762501 - RNA, 20 nt, Human
cuguuugggaagagcuuaga

SEQ ID NO: 3762502 - RNA, 22 nt, Human
cuguuugggaagagcuuagaaa

SEQ ID NO: 3762503 - RNA, 16 nt, Human
cuguuuguccugagau

SEQ ID NO: 3762504 - RNA, 18 nt, Human
cuguuugucuucucccca

SEQ ID NO: 3762505 - RNA, 18 nt, Human
cuguuuguggggugacgg

SEQ ID NO: 3762506 - RNA, 23 nt, Human
cuguuuguuucugaaagggacgc

SEQ ID NO: 3762507 - RNA, 20 nt, Human
cuguuuguuugacaaagaaa

SEQ ID NO: 3762508 - RNA, 23 nt, Human
cuguuuuaauuuauacuggcaug

SEQ ID NO: 3762509 - RNA, 21 nt, Human
cuguuuuacaaguuggaguca

SEQ ID NO: 3762510 - RNA, 12 nt, Human
cuguuuuacugc

SEQ ID NO: 3762511 - RNA, 19 nt, Human
cuguuuuauaauuuuguga

SEQ ID NO: 3762512 - RNA, 12 nt, Human
cuguuuuaugac

SEQ ID NO: 3762513 - RNA, 14 nt, Human
cuguuuuaugacuu

SEQ ID NO: 3762514 - RNA, 13 nt, Human
cuguuuucccuga

SEQ ID NO: 3762515 - RNA, 15 nt, Human
cuguuuuccucccuu

SEQ ID NO: 3762516 - RNA, 16 nt, Human
cuguuuuccucccuuc

SEQ ID NO: 3762517 - RNA, 23 nt, Human
cuguuuuccuuucucaccgcagu

SEQ ID NO: 3762518 - RNA, 21 nt, Human
cuguuuucucucggcucccca

SEQ ID NO: 3762519 - RNA, 17 nt, Human
cuguuuucucuugagag

SEQ ID NO: 3762520 - RNA, 14 nt, Human
cuguuuucuguuuc

SEQ ID NO: 3762521 - RNA, 14 nt, Human
cuguuuuguaaagu

SEQ ID NO: 3762522 - RNA, 16 nt, Human
cuguuuuguaaagucc

SEQ ID NO: 3762523 - RNA, 17 nt, Human
cuguuuuguaaaguccc

SEQ ID NO: 3762524 - RNA, 18 nt, Human
cuguuuugugguuuggaa

SEQ ID NO: 3762525 - RNA, 14 nt, Human
cuguuuuguucugu

SEQ ID NO: 3762526 - RNA, 16 nt, Human
cuguuuuguugacauu

SEQ ID NO: 3762527 - RNA, 17 nt, Human
cuguuuuguugacauuc

SEQ ID NO: 3762528 - RNA, 17 nt, Human
cuguuuuguuuggcaag

SEQ ID NO: 3762529 - RNA, 21 nt, Human
cuguuuuguuuggcaaggaaa

SEQ ID NO: 3762530 - RNA, 22 nt, Human
cuguuuuguuuggcaaggaaag

SEQ ID NO: 3762531 - RNA, 18 nt, Human
cuguuuuuaagcuguuuc

SEQ ID NO: 3762532 - RNA, 15 nt, Human
cuguuuuuagacacc

SEQ ID NO: 3762533 - RNA, 18 nt, Human
cuguuuuuauuauuaaca

SEQ ID NO: 3762534 - RNA, 20 nt, Human
cuguuuuuauuauuaacaaa

SEQ ID NO: 3762535 - RNA, 14 nt, Human
cuguuuuuguagug

SEQ ID NO: 3762536 - RNA, 14 nt, Human
cuguuuuuguugug

SEQ ID NO: 3762537 - RNA, 20 nt, Human
cuguuuuuguuuauuucauu

SEQ ID NO: 3762538 - RNA, 13 nt, Human
cuguuuuuuaguu

SEQ ID NO: 3762539 - RNA, 15 nt, Human
cuguuuuuuuuucau

SEQ ID NO: 3762540 - RNA, 21 nt, Human
cuuaaaaaaaaaaaaaagcuu

SEQ ID NO: 3762541 - RNA, 22 nt, Human
cuuaaaaaaaaaaaaaagcuuu

SEQ ID NO: 3762542 - RNA, 19 nt, Human
cuuaaaaaaaacucuuuaa

SEQ ID NO: 3762543 - RNA, 17 nt, Human
cuuaaaaaaaugacaga

SEQ ID NO: 3762544 - RNA, 15 nt, Human
cuuaaaaacugaaaa

SEQ ID NO: 3762545 - RNA, 16 nt, Human
cuuaaaaaguggaaaa

SEQ ID NO: 3762546 - RNA, 17 nt, Human
cuuaaaaaguggaaaaa

SEQ ID NO: 3762547 - RNA, 12 nt, Human
cuuaaaaaguua

SEQ ID NO: 3762548 - RNA, 22 nt, Human
cuuaaaaaucacacuguaaaua

SEQ ID NO: 3762549 - RNA, 21 nt, Human
cuuaaaaaugguuuaaauggu

SEQ ID NO: 3762550 - RNA, 17 nt, Human
cuuaaaaauguaaauau

SEQ ID NO: 3762551 - RNA, 14 nt, Human
cuuaaaacaacacu

SEQ ID NO: 3762552 - RNA, 14 nt, Human
cuuaaaaccaaaga

SEQ ID NO: 3762553 - RNA, 15 nt, Human
cuuaaaaccaaagag

SEQ ID NO: 3762554 - RNA, 21 nt, Human
cuuaaaaccaaagagggcuuc

SEQ ID NO: 3762555 - RNA, 23 nt, Human
cuuaaaaccugcuuuucaaugug

SEQ ID NO: 3762556 - RNA, 12 nt, Human
cuuaaaacuagg

SEQ ID NO: 3762557 - RNA, 12 nt, Human
cuuaaaacuuug

SEQ ID NO: 3762558 - RNA, 23 nt, Human
cuuaaaauaaaacacuguuuccc

SEQ ID NO: 3762559 - RNA, 17 nt, Human
cuuaaaauaaacaguug

SEQ ID NO: 3762560 - RNA, 21 nt, Human
cuuaaaauaaacaguugugaa

SEQ ID NO: 3762561 - RNA, 12 nt, Human
cuuaaaauaagc

SEQ ID NO: 3762562 - RNA, 22 nt, Human
cuuaaaauaaugaauacauuuc

SEQ ID NO: 3762563 - RNA, 12 nt, Human
cuuaaaauacaa

SEQ ID NO: 3762564 - RNA, 16 nt, Human
cuuaaaauacaagacu

SEQ ID NO: 3762565 - RNA, 18 nt, Human
cuuaaaauacaagacugc

SEQ ID NO: 3762566 - RNA, 19 nt, Human
cuuaaaauacaagacugcc

SEQ ID NO: 3762567 - RNA, 17 nt, Human
cuuaaaauauauuucag

SEQ ID NO: 3762568 - RNA, 18 nt, Human
cuuaaaauauuccugcau

SEQ ID NO: 3762569 - RNA, 13 nt, Human
cuuaaaauauuuu

SEQ ID NO: 3762570 - RNA, 11 nt, Human
cuuaaaaugau

SEQ ID NO: 3762571 - RNA, 15 nt, Human
cuuaaaaugcaauau

SEQ ID NO: 3762572 - RNA, 19 nt, Human
cuuaaaaugcaauauuugu

SEQ ID NO: 3762573 - RNA, 20 nt, Human
cuuaaaaugcaauauuugua

SEQ ID NO: 3762574 - RNA, 21 nt, Human
cuuaaaaugcaauauuuguaa

SEQ ID NO: 3762575 - RNA, 22 nt, Human
cuuaaaaugcaauauuuguaag

SEQ ID NO: 3762576 - RNA, 19 nt, Human
cuuaaacacucaccuucua

SEQ ID NO: 3762577 - RNA, 23 nt, Human
cuuaaaccuucaguuaugauuuu

SEQ ID NO: 3762578 - RNA, 19 nt, Human
cuuaaacgaagaguucccu

SEQ ID NO: 3762579 - RNA, 14 nt, Human
cuuaaacuaaaugu

SEQ ID NO: 3762580 - RNA, 23 nt, Human
cuuaaacuguguggacugugaug

SEQ ID NO: 3762581 - RNA, 15 nt, Human
cuuaaacuugugaau

SEQ ID NO: 3762582 - RNA, 16 nt, Human
cuuaaagaaacagcuu

SEQ ID NO: 3762583 - RNA, 17 nt, Human
cuuaaagaaacagcuuu

SEQ ID NO: 3762584 - RNA, 19 nt, Human
cuuaaagauuuaucaaauc

SEQ ID NO: 3762585 - RNA, 20 nt, Human
cuuaaagauuuaucaaauca

SEQ ID NO: 3762586 - RNA, 23 nt, Human
cuuaaagcugccuguaguuagga

SEQ ID NO: 3762587 - RNA, 21 nt, Human
cuuaaaggcugugguaguacu

SEQ ID NO: 3762588 - RNA, 23 nt, Human
cuuaaaggcugugguaguacucc

SEQ ID NO: 3762589 - RNA, 22 nt, Human
cuuaaagggcccaaugaauuau

SEQ ID NO: 3762590 - RNA, 13 nt, Human
cuuaaaggggaga

SEQ ID NO: 3762591 - RNA, 21 nt, Human
cuuaaaggugucuuccuccca

SEQ ID NO: 3762592 - RNA, 16 nt, Human
cuuaaagugccaguau

SEQ ID NO: 3762593 - RNA, 18 nt, Human
cuuaaaguugaauuuauu

SEQ ID NO: 3762594 - RNA, 22 nt, Human
cuuaaauaaaagaaaugcacaa

SEQ ID NO: 3762595 - RNA, 16 nt, Human
cuuaaauaagaaacuu

SEQ ID NO: 3762596 - RNA, 13 nt, Human
cuuaaauaauaaa

SEQ ID NO: 3762597 - RNA, 16 nt, Human
cuuaaauaaugugaaa

SEQ ID NO: 3762598 - RNA, 19 nt, Human
cuuaaauaaugugaaacug

SEQ ID NO: 3762599 - RNA, 16 nt, Human
cuuaaauacagcuuuu

SEQ ID NO: 3762600 - RNA, 13 nt, Human
cuuaaauaucaau

SEQ ID NO: 3762601 - RNA, 21 nt, Human
cuuaaauguagcaauggcacu

SEQ ID NO: 3762602 - RNA, 14 nt, Human
cuuaaaugugaauu

SEQ ID NO: 3762603 - RNA, 19 nt, Human
cuuaaaugugaauuacuaa

SEQ ID NO: 3762604 - RNA, 12 nt, Human
cuuaaauuaaac

SEQ ID NO: 3762605 - RNA, 17 nt, Human
cuuaaauuaaacaauuu

SEQ ID NO: 3762606 - RNA, 22 nt, Human
cuuaaauuaaacaauuuauuuu

SEQ ID NO: 3762607 - RNA, 19 nt, Human
cuuaaauuaguacagcacu

SEQ ID NO: 3762608 - RNA, 15 nt, Human
cuuaaauucauuuua

SEQ ID NO: 3762609 - RNA, 23 nt, Human
cuuaaauuggguucaugaugcag

SEQ ID NO: 3762610 - RNA, 13 nt, Human
cuuaaauuucuua

SEQ ID NO: 3762611 - RNA, 14 nt, Human
cuuaaauuucuuau

SEQ ID NO: 3762612 - RNA, 13 nt, Human
cuuaaauuuuaac

SEQ ID NO: 3762613 - RNA, 23 nt, Human
cuuaacaaacccucguuucugau

SEQ ID NO: 3762614 - RNA, 17 nt, Human
cuuaacaguuguauuua

SEQ ID NO: 3762615 - RNA, 15 nt, Human
cuuaacauagccaaa

SEQ ID NO: 3762616 - RNA, 19 nt, Human
cuuaacauagccaaaaugu

SEQ ID NO: 3762617 - RNA, 13 nt, Human
cuuaacauauuua

SEQ ID NO: 3762618 - RNA, 13 nt, Human
cuuaacaugcugu

SEQ ID NO: 3762619 - RNA, 16 nt, Human
cuuaacccaaggagca

SEQ ID NO: 3762620 - RNA, 20 nt, Human
cuuaaccccaguaagccacu

SEQ ID NO: 3762621 - RNA, 19 nt, Human
cuuaacugcauuuuuagac

SEQ ID NO: 3762622 - RNA, 16 nt, Human
cuuaacuggagcccca

SEQ ID NO: 3762623 - RNA, 22 nt, Human
cuuaacugugguguugaggcuu

SEQ ID NO: 3762624 - RNA, 15 nt, Human
cuuaacuucacauau

SEQ ID NO: 3762625 - RNA, 16 nt, Human
cuuaacuucacauauu

SEQ ID NO: 3762626 - RNA, 22 nt, Human
cuuaacuucuugcuucuuucua

SEQ ID NO: 3762627 - RNA, 17 nt, Human
cuuaagaaauguauaaa

SEQ ID NO: 3762628 - RNA, 20 nt, Human
cuuaagaaauguauaaacuu

SEQ ID NO: 3762629 - RNA, 18 nt, Human
cuuaagaaauuuguggaa

SEQ ID NO: 3762630 - RNA, 21 nt, Human
cuuaagaagacugcauuauau

SEQ ID NO: 3762631 - RNA, 22 nt, Human
cuuaagaaugaguuucuuagac

SEQ ID NO: 3762632 - RNA, 23 nt, Human
cuuaagaccaccucaaauuuaaa

SEQ ID NO: 3762633 - RNA, 20 nt, Human
cuuaagaccuacuguucuaa

SEQ ID NO: 3762634 - RNA, 22 nt, Human
cuuaagaccuacuguucuaaag

SEQ ID NO: 3762635 - RNA, 15 nt, Human
cuuaagcaaaagaaa

SEQ ID NO: 3762636 - RNA, 22 nt, Human
cuuaagcaaaggggacagcugu

SEQ ID NO: 3762637 - RNA, 11 nt, Human
cuuaagcacaa

SEQ ID NO: 3762638 - RNA, 14 nt, Human
cuuaagcagaagca

SEQ ID NO: 3762639 - RNA, 18 nt, Human
cuuaagcaucuggcucua

SEQ ID NO: 3762640 - RNA, 15 nt, Human
cuuaagccaucuugg

SEQ ID NO: 3762641 - RNA, 16 nt, Human
cuuaagccaucuuggu

SEQ ID NO: 3762642 - RNA, 19 nt, Human
cuuaagccaucuugguaaa

SEQ ID NO: 3762643 - RNA, 13 nt, Human
cuuaagcccuggc

SEQ ID NO: 3762644 - RNA, 12 nt, Human
cuuaagcugcag

SEQ ID NO: 3762645 - RNA, 15 nt, Human
cuuaagcugcaggau

SEQ ID NO: 3762646 - RNA, 16 nt, Human
cuuaguucucacuguu

SEQ ID NO: 3762647 - RNA, 13 nt, Human
cuuaguuugugaa

SEQ ID NO: 3762648 - RNA, 22 nt, Human
cuuaguuugugaauugauuuug

SEQ ID NO: 3762649 - RNA, 17 nt, Human
cuuaguuuguguguugu

SEQ ID NO: 3762650 - RNA, 15 nt, Human
cuuauaaaacagagu

SEQ ID NO: 3762651 - RNA, 18 nt, Human
cuuauaaaauccugugca

SEQ ID NO: 3762652 - RNA, 18 nt, Human
cuuauaaaguggaaguau

SEQ ID NO: 3762653 - RNA, 20 nt, Human
cuuauaaaguggaaguaugu

SEQ ID NO: 3762654 - RNA, 13 nt, Human
cuuauaaaucaua

SEQ ID NO: 3762655 - RNA, 22 nt, Human
cuuauaaaucauauugaugaaa

SEQ ID NO: 3762656 - RNA, 17 nt, Human
cuuauaaccuaguuaaa

SEQ ID NO: 3762657 - RNA, 19 nt, Human
cuuauaaccuaguuaaaga

SEQ ID NO: 3762658 - RNA, 20 nt, Human
cuuauaagguguuuucugug

SEQ ID NO: 3762659 - RNA, 21 nt, Human
cuuauaagguguuuucugugu

SEQ ID NO: 3762660 - RNA, 22 nt, Human
cuuauaagguguuuucugugua

SEQ ID NO: 3762661 - RNA, 20 nt, Human
cuuauaagugaagugauacu

SEQ ID NO: 3762662 - RNA, 19 nt, Human
cuuauaauacucuguugua

SEQ ID NO: 3762663 - RNA, 14 nt, Human
cuuauaauuguucu

SEQ ID NO: 3762664 - RNA, 15 nt, Human
cuuauacauuugaua

SEQ ID NO: 3762665 - RNA, 16 nt, Human
cuuauacgaguaauau

SEQ ID NO: 3762666 - RNA, 13 nt, Human
cuuauagaauauu

SEQ ID NO: 3762667 - RNA, 17 nt, Human
cuuauagcacuuugaaa

SEQ ID NO: 3762668 - RNA, 20 nt, Human
cuuauagcacuuugaaauac

SEQ ID NO: 3762669 - RNA, 17 nt, Human
cuuauaggaaagcuuga

SEQ ID NO: 3762670 - RNA, 21 nt, Human
cuuauaggaaagcuugaguaa

SEQ ID NO: 3762671 - RNA, 19 nt, Human
cuuauaggaauugacccac

SEQ ID NO: 3762672 - RNA, 19 nt, Human
cuuauaguacaugauaaau

SEQ ID NO: 3762673 - RNA, 21 nt, Human
cuuauagucuaagacuauaua

SEQ ID NO: 3762674 - RNA, 16 nt, Human
cuuauaguuacugugu

SEQ ID NO: 3762675 - RNA, 15 nt, Human
cuuauauaauugcca

SEQ ID NO: 3762676 - RNA, 17 nt, Human
cuuauauaugugaacau

SEQ ID NO: 3762677 - RNA, 21 nt, Human
cuuauaucaucagcauaccuu

SEQ ID NO: 3762678 - RNA, 13 nt, Human
cuuauauuaugga

SEQ ID NO: 3762679 - RNA, 20 nt, Human
cuuauauuuacaacacuuua

SEQ ID NO: 3762680 - RNA, 19 nt, Human
cuuauauuucccuaaaaua

SEQ ID NO: 3762681 - RNA, 14 nt, Human
cuuauauuugugua

SEQ ID NO: 3762682 - RNA, 20 nt, Human
cuuauauuuucguaugaaaa

SEQ ID NO: 3762683 - RNA, 21 nt, Human
cuuaucaaggacucugguuuc

SEQ ID NO: 3762684 - RNA, 12 nt, Human
cuuaucaagugu

SEQ ID NO: 3762685 - RNA, 14 nt, Human
cuuaucaagugucu

SEQ ID NO: 3762686 - RNA, 15 nt, Human
cuuaucaauuuguca

SEQ ID NO: 3762687 - RNA, 16 nt, Human
cuuaucaccagcugcc

SEQ ID NO: 3762688 - RNA, 21 nt, Human
cuuaucacugcauuauucucu

SEQ ID NO: 3762689 - RNA, 13 nt, Human
cuuaucagagcua

SEQ ID NO: 3762690 - RNA, 23 nt, Human
cuuaucagcuacuuaagagaaau

SEQ ID NO: 3762691 - RNA, 19 nt, Human
cuuaucauccacauuguuu

SEQ ID NO: 3762692 - RNA, 14 nt, Human
cuuaucauggucuc

SEQ ID NO: 3762693 - RNA, 15 nt, Human
cuuaucauggucuca

SEQ ID NO: 3762694 - RNA, 19 nt, Human
cuuauccaggacucuguca

SEQ ID NO: 3762695 - RNA, 15 nt, Human
cuuauccauaaaaaa

SEQ ID NO: 3762696 - RNA, 15 nt, Human
cuuaucccugcccau

SEQ ID NO: 3762697 - RNA, 15 nt, Human
cuuauccuccaccgu

SEQ ID NO: 3762698 - RNA, 14 nt, Human
cuuauccucccugu

SEQ ID NO: 3762699 - RNA, 13 nt, Human
cuuauccucugau

SEQ ID NO: 3762700 - RNA, 14 nt, Human
cuuauccucugauc

SEQ ID NO: 3762701 - RNA, 18 nt, Human
cuuaucgggcuccagcca

SEQ ID NO: 3762702 - RNA, 16 nt, Human
cuuaucuccaagacca

SEQ ID NO: 3762703 - RNA, 20 nt, Human
cuuaucugagcugagccagg

SEQ ID NO: 3762704 - RNA, 20 nt, Human
cuuaucuuacaauauugauu

SEQ ID NO: 3762705 - RNA, 17 nt, Human
cuuaucuuacgaaaaaa

SEQ ID NO: 3762706 - RNA, 13 nt, Human
cuuaugaaaagaa

SEQ ID NO: 3762707 - RNA, 13 nt, Human
cuuaugaaaugug

SEQ ID NO: 3762708 - RNA, 15 nt, Human
cuuaugaauauauuu

SEQ ID NO: 3762709 - RNA, 19 nt, Human
cuuaugaaugauuugcaua

SEQ ID NO: 3762710 - RNA, 18 nt, Human
cuuaugacuugcuacuuu

SEQ ID NO: 3762711 - RNA, 14 nt, Human
cuuaugaggagggg

SEQ ID NO: 3762712 - RNA, 20 nt, Human
cuuaugauuaaacuuccuuc

SEQ ID NO: 3762713 - RNA, 23 nt, Human
cuuaugauucagauuguuaucua

SEQ ID NO: 3762714 - RNA, 17 nt, Human
cuuaugccauuuguuua

SEQ ID NO: 3762715 - RNA, 16 nt, Human
cuuaugcgguuaauuu

SEQ ID NO: 3762716 - RNA, 18 nt, Human
cuuaugcuguacccaguu

SEQ ID NO: 3762717 - RNA, 13 nt, Human
cuuaugcuuccag

SEQ ID NO: 3762718 - RNA, 13 nt, Human
cuuauggaacacu

SEQ ID NO: 3762719 - RNA, 19 nt, Human
cuuauggaacacucugaga

SEQ ID NO: 3762720 - RNA, 14 nt, Human
cuuauggaauugau

SEQ ID NO: 3762721 - RNA, 20 nt, Human
cuuauggauguccccagcag

SEQ ID NO: 3762722 - RNA, 15 nt, Human
cuuauggccacagcc

SEQ ID NO: 3762723 - RNA, 15 nt, Human
cuuauguagauauuu

SEQ ID NO: 3762724 - RNA, 19 nt, Human
cuuauguagcaggaaauaa

SEQ ID NO: 3762725 - RNA, 14 nt, Human
cuuauuaaaguucu

SEQ ID NO: 3762726 - RNA, 18 nt, Human
cuuauuaaaguuucaaaa

SEQ ID NO: 3762727 - RNA, 20 nt, Human
cuuauuaaaguuucaaaaau

SEQ ID NO: 3762728 - RNA, 21 nt, Human
cuuauuaacaauuaggcagac

SEQ ID NO: 3762729 - RNA, 19 nt, Human
cuuauuaaugcuaagggca

SEQ ID NO: 3762730 - RNA, 20 nt, Human
cuuauuagaaaaauauuaua

SEQ ID NO: 3762731 - RNA, 11 nt, Human
cuuauuagaac

SEQ ID NO: 3762732 - RNA, 21 nt, Human
cuuauuagagugucuuuccac

SEQ ID NO: 3762733 - RNA, 17 nt, Human
cuuauucaaagagaaaa

SEQ ID NO: 3762734 - RNA, 19 nt, Human
cuuauucauugugguuauu

SEQ ID NO: 3762735 - RNA, 17 nt, Human
cuuauucauuuucucua

SEQ ID NO: 3762736 - RNA, 19 nt, Human
cuuauugauauucuaagaa

SEQ ID NO: 3762737 - RNA, 13 nt, Human
cuuauugccucac

SEQ ID NO: 3762738 - RNA, 14 nt, Human
cuuauugcgcugcu

SEQ ID NO: 3762739 - RNA, 16 nt, Human
cuuauugcugauuuua

SEQ ID NO: 3762740 - RNA, 19 nt, Human
cuuauugcugauuuuaaug

SEQ ID NO: 3762741 - RNA, 14 nt, Human
cuuauugcuuagua

SEQ ID NO: 3762742 - RNA, 16 nt, Human
cuuauugcuuaguaaa

SEQ ID NO: 3762743 - RNA, 20 nt, Human
cuuauuguggauaacaaaga

SEQ ID NO: 3762744 - RNA, 15 nt, Human
cuuauuguuccaaga

SEQ ID NO: 3762745 - RNA, 19 nt, Human
cuuauuguuccaagacauu

SEQ ID NO: 3762746 - RNA, 18 nt, Human
cuuauuguuucucugaaa

SEQ ID NO: 3762747 - RNA, 18 nt, Human
cuuauuuaaauagaugac

SEQ ID NO: 3762748 - RNA, 22 nt, Human
cuuauuuaaucuuuucuuauuu

SEQ ID NO: 3762749 - RNA, 15 nt, Human
cuuauuuaaugaaag

SEQ ID NO: 3762750 - RNA, 19 nt, Human
cuuauuuauguuaaaagau

SEQ ID NO: 3762751 - RNA, 23 nt, Human
cuuauuucacuuuaguuuuugaa

SEQ ID NO: 3762752 - RNA, 17 nt, Human
cuuauuucaugaaaauu

SEQ ID NO: 3762753 - RNA, 15 nt, Human
cuuauuuuauuucca

SEQ ID NO: 3762754 - RNA, 15 nt, Human
cuuauuuucaagaaa

SEQ ID NO: 3762755 - RNA, 18 nt, Human
cuuauuuucaagaaacug

SEQ ID NO: 3762756 - RNA, 19 nt, Human
cuuauuuucaagaaacuga

SEQ ID NO: 3762757 - RNA, 21 nt, Human
cuuauuuuuaaaauuuuaaua

SEQ ID NO: 3762758 - RNA, 16 nt, Human
cuuauuuuuagauggu

SEQ ID NO: 3762759 - RNA, 22 nt, Human
cuuauuuuuagaugguuacacu

SEQ ID NO: 3762760 - RNA, 23 nt, Human
cuuauuuuuagaugguuacacug

SEQ ID NO: 3762761 - RNA, 23 nt, Human
cuuauuuuuauaacaucuuuauu

SEQ ID NO: 3762762 - RNA, 21 nt, Human
cuucaaaaacugucaaagaau

SEQ ID NO: 3762763 - RNA, 15 nt, Human
cuucaaaaacuguuu

SEQ ID NO: 3762764 - RNA, 19 nt, Human
cuucaaaacaaacagaugc

SEQ ID NO: 3762765 - RNA, 21 nt, Human
cuucaaaaguaaugccucugu

SEQ ID NO: 3762766 - RNA, 15 nt, Human
cuucaaaaguauuuu

SEQ ID NO: 3762767 - RNA, 21 nt, Human
cuucaaaaguauuuuccugua

SEQ ID NO: 3762768 - RNA, 21 nt, Human
cuucaaaauauaaaaugccaa

SEQ ID NO: 3762769 - RNA, 22 nt, Human
cuucaaaauguuaucuucucaa

SEQ ID NO: 3762770 - RNA, 23 nt, Human
cuucaaaauguuaucuucucaag

SEQ ID NO: 3762771 - RNA, 23 nt, Human
cuucaaacuagggccaagcccag

SEQ ID NO: 3762772 - RNA, 16 nt, Human
cuucaaagcuugaaga

SEQ ID NO: 3762773 - RNA, 22 nt, Human
cuucaaagucucaaugaaauag

SEQ ID NO: 3762774 - RNA, 15 nt, Human
cuucaaaguuuaaua

SEQ ID NO: 3762775 - RNA, 19 nt, Human
cuucaaauauuaugcaggg

SEQ ID NO: 3762776 - RNA, 17 nt, Human
cuucaaauccauccaga

SEQ ID NO: 3762777 - RNA, 16 nt, Human
cuucaaaugccugacu

SEQ ID NO: 3762778 - RNA, 12 nt, Human
cuucaacaaggc

SEQ ID NO: 3762779 - RNA, 19 nt, Human
cuucaacaaggcuugcugc

SEQ ID NO: 3762780 - RNA, 21 nt, Human
cuucaacaaggcuugcugcag

SEQ ID NO: 3762781 - RNA, 22 nt, Human
cuucaacaaggcuugcugcaga

SEQ ID NO: 3762782 - RNA, 20 nt, Human
cuucaacaauucuaaaauga

SEQ ID NO: 3762783 - RNA, 16 nt, Human
cuucaacaucaauguu

SEQ ID NO: 3762784 - RNA, 18 nt, Human
cuucaacaucaauguuca

SEQ ID NO: 3762785 - RNA, 18 nt, Human
cuucaacauccugccagc

SEQ ID NO: 3762786 - RNA, 21 nt, Human
cuucaacauccugccagcccc

SEQ ID NO: 3762787 - RNA, 16 nt, Human
cuucaaccauucccca

SEQ ID NO: 3762788 - RNA, 17 nt, Human
cuucaaccuugagacag

SEQ ID NO: 3762789 - RNA, 17 nt, Human
cuucaacguuucuucac

SEQ ID NO: 3762790 - RNA, 21 nt, Human
cuucaacguuucuucacuuuu

SEQ ID NO: 3762791 - RNA, 17 nt, Human
cuucaagaccuucacca

SEQ ID NO: 3762792 - RNA, 18 nt, Human
cuucaagaucauguaccc

SEQ ID NO: 3762793 - RNA, 18 nt, Human
cuucaagaucccauuuga

SEQ ID NO: 3762794 - RNA, 12 nt, Human
cuucaagcucug

SEQ ID NO: 3762795 - RNA, 17 nt, Human
cuucaagcucugaggga

SEQ ID NO: 3762796 - RNA, 17 nt, Human
cuucaaggauccugagc

SEQ ID NO: 3762797 - RNA, 23 nt, Human
cuucaaggauccugagccagauu

SEQ ID NO: 3762798 - RNA, 15 nt, Human
cuucaaggcuucagu

SEQ ID NO: 3762799 - RNA, 16 nt, Human
cuucaagggcugcuuc

SEQ ID NO: 3762800 - RNA, 23 nt, Human
cuucaaggugacagaaggaccag

SEQ ID NO: 3762801 - RNA, 18 nt, Human
cuucaaguuaaagugaau

SEQ ID NO: 3762802 - RNA, 20 nt, Human
cuucaaguuagcucaggagg

SEQ ID NO: 3762803 - RNA, 20 nt, Human
cuucaauaaaucuuuggaaa

SEQ ID NO: 3762804 - RNA, 17 nt, Human
cuucaauccuugaaggu

SEQ ID NO: 3762805 - RNA, 18 nt, Human
cuucaaugggcucuucca

SEQ ID NO: 3762806 - RNA, 19 nt, Human
cuucaaugggcucuuccaa

SEQ ID NO: 3762807 - RNA, 15 nt, Human
cuucaauuuauaccu

SEQ ID NO: 3762808 - RNA, 15 nt, Human
cuucacaaauucuca

SEQ ID NO: 3762809 - RNA, 17 nt, Human
cuucacacacaggcaac

SEQ ID NO: 3762810 - RNA, 21 nt, Human
cuucacacacaggcaacugag

SEQ ID NO: 3762811 - RNA, 19 nt, Human
cuucacaccuacccuccuu

SEQ ID NO: 3762812 - RNA, 15 nt, Human
cuucacacugcaaga

SEQ ID NO: 3762813 - RNA, 17 nt, Human
cuucacagagugugcug

SEQ ID NO: 3762814 - RNA, 20 nt, Human
cuucacagagugugcuggag

SEQ ID NO: 3762815 - RNA, 23 nt, Human
cuucacagagugugcuggaggac

SEQ ID NO: 3762816 - RNA, 15 nt, Human
cuucacaguagagcc

SEQ ID NO: 3762817 - RNA, 17 nt, Human
cuucacaguagagccag

SEQ ID NO: 3762818 - RNA, 14 nt, Human
cuucacaguguuuc

SEQ ID NO: 3762819 - RNA, 20 nt, Human
cuucacauaagcucagaauc

SEQ ID NO: 3762820 - RNA, 22 nt, Human
cuucacauaagcucagaaucca

SEQ ID NO: 3762821 - RNA, 17 nt, Human
cuucacauacccucccc

SEQ ID NO: 3762822 - RNA, 13 nt, Human
cuucacauaguuu

SEQ ID NO: 3762823 - RNA, 14 nt, Human
cuucacauauugau

SEQ ID NO: 3762824 - RNA, 20 nt, Human
cuucacauccuguguuucua

SEQ ID NO: 3762825 - RNA, 14 nt, Human
cuucacauuaaaaa

SEQ ID NO: 3762826 - RNA, 21 nt, Human
cuucacauuccccuggggacc

SEQ ID NO: 3762827 - RNA, 16 nt, Human
cuucaccaucaauccu

SEQ ID NO: 3762828 - RNA, 17 nt, Human
cuucaccaucaauccug

SEQ ID NO: 3762829 - RNA, 19 nt, Human
cuucaccauggccuuauga

SEQ ID NO: 3762830 - RNA, 21 nt, Human
cuucaccauuuggcaaugcca

SEQ ID NO: 3762831 - RNA, 24 nt, Human
cuucacccagcuaaucuguagggc

SEQ ID NO: 3762832 - RNA, 21 nt, Human
cuucacccaggccuauguuga

SEQ ID NO: 3762833 - RNA, 18 nt, Human
cuucaccccaaucccagc

SEQ ID NO: 3762834 - RNA, 19 nt, Human
cuucaccccaguggccacu

SEQ ID NO: 3762835 - RNA, 14 nt, Human
cuucaccccggcag

SEQ ID NO: 3762836 - RNA, 21 nt, Human
cuucaccccggcaggcccugc

SEQ ID NO: 3762837 - RNA, 23 nt, Human
cuucaccccggcaggcccugcag

SEQ ID NO: 3762838 - RNA, 14 nt, Human
cuucaccuccugcc

SEQ ID NO: 3762839 - RNA, 16 nt, Human
cuucaccuccuuucaa

SEQ ID NO: 3762840 - RNA, 18 nt, Human
cuucaccugauucaacua

SEQ ID NO: 3762841 - RNA, 19 nt, Human
gcucucaggccagcugcuu

SEQ ID NO: 3762842 - RNA, 17 nt, Human
gcucucaucugaggcau

SEQ ID NO: 3762843 - RNA, 17 nt, Human
gcucucaugcugccccu

SEQ ID NO: 3762844 - RNA, 16 nt, Human
gcucuccaaaccacuu

SEQ ID NO: 3762845 - RNA, 22 nt, Human
gcucuccaaaccacuuuuugca

SEQ ID NO: 3762846 - RNA, 15 nt, Human
gcucuccaagcccag

SEQ ID NO: 3762847 - RNA, 16 nt, Human
gcucuccaagugccag

SEQ ID NO: 3762848 - RNA, 18 nt, Human
gcucuccaagugccagag

SEQ ID NO: 3762849 - RNA, 14 nt, Human
gcucuccaccucag

SEQ ID NO: 3762850 - RNA, 18 nt, Human
gcucuccagccugggagg

SEQ ID NO: 3762851 - RNA, 14 nt, Human
gcucuccauucugc

SEQ ID NO: 3762852 - RNA, 17 nt, Human
gcucuccauucugcucc

SEQ ID NO: 3762853 - RNA, 19 nt, Human
gcucucccgguucuuccag

SEQ ID NO: 3762854 - RNA, 14 nt, Human
gcucucccucuggc

SEQ ID NO: 3762855 - RNA, 15 nt, Human
gcucucccucuggcc

SEQ ID NO: 3762856 - RNA, 17 nt, Human
gcucucccucuggcccu

SEQ ID NO: 3762857 - RNA, 18 nt, Human
gcucucccucuggcccug

SEQ ID NO: 3762858 - RNA, 16 nt, Human
gcucucccucuucuca

SEQ ID NO: 3762859 - RNA, 19 nt, Human
gcucuccgaccagacaccu

SEQ ID NO: 3762860 - RNA, 21 nt, Human
gcucuccggggccauuugcaa

SEQ ID NO: 3762861 - RNA, 12 nt, Human
gcucuccuggcu

SEQ ID NO: 3762862 - RNA, 14 nt, Human
gcucuccuggcuuc

SEQ ID NO: 3762863 - RNA, 23 nt, Human
gcucuccuggcuucccaucccca

SEQ ID NO: 3762864 - RNA, 22 nt, Human
gcucuccuuccuggagcccaga

SEQ ID NO: 3762865 - RNA, 16 nt, Human
gcucuccuuucuuucu

SEQ ID NO: 3762866 - RNA, 19 nt, Human
gcucucgcacaccucugca

SEQ ID NO: 3762867 - RNA, 19 nt, Human
gcucucggguugugugucu

SEQ ID NO: 3762868 - RNA, 21 nt, Human
gcucucuacccagcccaucuu

SEQ ID NO: 3762869 - RNA, 20 nt, Human
gcucucuccaggcaggucug

SEQ ID NO: 3762870 - RNA, 18 nt, Human
gcucucugaguccuggcc

SEQ ID NO: 3762871 - RNA, 17 nt, Human
gcucucugcagccagcc

SEQ ID NO: 3762872 - RNA, 12 nt, Human
gcucucugcccu

SEQ ID NO: 3762873 - RNA, 11 nt, Human
gcucucugcug

SEQ ID NO: 3762874 - RNA, 19 nt, Human
gcucucuggccuuuuccua

SEQ ID NO: 3762875 - RNA, 11 nt, Human
gcucucuguau

SEQ ID NO: 3762876 - RNA, 18 nt, Human
gcucucuuccugccccuc

SEQ ID NO: 3762877 - RNA, 21 nt, Human
gcucucuuccugccccucuuu

SEQ ID NO: 3762878 - RNA, 16 nt, Human
gcucugaaaccagugu

SEQ ID NO: 3762879 - RNA, 22 nt, Human
gcucugaagucacaucacagga

SEQ ID NO: 3762880 - RNA, 21 nt, Human
gcucugaauuaguccuugcuu

SEQ ID NO: 3762881 - RNA, 16 nt, Human
gcucugacagaaagca

SEQ ID NO: 3762882 - RNA, 14 nt, Human
gcucugaccacuug

SEQ ID NO: 3762883 - RNA, 22 nt, Human
gcucugagaagaggagcccuca

SEQ ID NO: 3762884 - RNA, 22 nt, Human
gcucugagagcaaacuggcuug

SEQ ID NO: 3762885 - RNA, 18 nt, Human
gcucugagaggcccugga

SEQ ID NO: 3762886 - RNA, 13 nt, Human
gcucugagagucu

SEQ ID NO: 3762887 - RNA, 14 nt, Human
gcucugagagucua

SEQ ID NO: 3762888 - RNA, 18 nt, Human
gcucugagagucuagauu

SEQ ID NO: 3762889 - RNA, 20 nt, Human
gcucugagagucuagauucu

SEQ ID NO: 3762890 - RNA, 20 nt, Human
gcucugagcaaauguggcuc

SEQ ID NO: 3762891 - RNA, 18 nt, Human
gcucugagcgccuccauc

SEQ ID NO: 3762892 - RNA, 12 nt, Human
gcucugagcugu

SEQ ID NO: 3762893 - RNA, 13 nt, Human
gcucugagcuguc

SEQ ID NO: 3762894 - RNA, 23 nt, Human
gcucugaggcgccccaacccgug

SEQ ID NO: 3762895 - RNA, 16 nt, Human
gcucugaggcuuccag

SEQ ID NO: 3762896 - RNA, 13 nt, Human
gcucugagggaaa

SEQ ID NO: 3762897 - RNA, 16 nt, Human
gcucugauaggccaag

SEQ ID NO: 3762898 - RNA, 17 nt, Human
gcucugaucauccacug

SEQ ID NO: 3762899 - RNA, 17 nt, Human
gcucugcaauuccccuc

SEQ ID NO: 3762900 - RNA, 12 nt, Human
gcucugcacaga

SEQ ID NO: 3762901 - RNA, 15 nt, Human
gcucugcacagaugg

SEQ ID NO: 3762902 - RNA, 13 nt, Human
gcucugcagccca

SEQ ID NO: 3762903 - RNA, 20 nt, Human
gcucugcaggcuuaauaaaa

SEQ ID NO: 3762904 - RNA, 21 nt, Human
gcucugcaguccuacucaagc

SEQ ID NO: 3762905 - RNA, 11 nt, Human
gcucugcaugc

SEQ ID NO: 3762906 - RNA, 15 nt, Human
gcucugcaugcggcc

SEQ ID NO: 3762907 - RNA, 18 nt, Human
gcucugcaugcggcccag

SEQ ID NO: 3762908 - RNA, 15 nt, Human
gcucugcauuugucu

SEQ ID NO: 3762909 - RNA, 18 nt, Human
gcucugccacccuaccug

SEQ ID NO: 3762910 - RNA, 16 nt, Human
gcucugccaguccugu

SEQ ID NO: 3762911 - RNA, 18 nt, Human
gcucugccaguccugucc

SEQ ID NO: 3762912 - RNA, 13 nt, Human
gcucugcccagag

SEQ ID NO: 3762913 - RNA, 14 nt, Human
gcucugcccagagc

SEQ ID NO: 3762914 - RNA, 17 nt, Human
gcucugcccagagcugg

SEQ ID NO: 3762915 - RNA, 20 nt, Human
gcucugcccagagcugggug

SEQ ID NO: 3762916 - RNA, 21 nt, Human
gcucugcccagagcuggguga

SEQ ID NO: 3762917 - RNA, 15 nt, Human
gcucugcccauccug

SEQ ID NO: 3762918 - RNA, 15 nt, Human
gcucugccccagagg

SEQ ID NO: 3762919 - RNA, 16 nt, Human
gcucugccccagaggc

SEQ ID NO: 3762920 - RNA, 13 nt, Human
gcucugccccagc

SEQ ID NO: 3762921 - RNA, 18 nt, Human
gcucugccccagcucugg

SEQ ID NO: 3762922 - RNA, 19 nt, Human
gcucugccccagcucuggc

SEQ ID NO: 3762923 - RNA, 13 nt, Human
gcucugccuccca

SEQ ID NO: 3762924 - RNA, 13 nt, Human
gcucugccugugg

SEQ ID NO: 3762925 - RNA, 22 nt, Human
gcucugcuauuaggccagcaag

SEQ ID NO: 3762926 - RNA, 13 nt, Human
gcucugcuccucu

SEQ ID NO: 3762927 - RNA, 13 nt, Human
gcucugcuggccu

SEQ ID NO: 3762928 - RNA, 21 nt, Human
gcucugcuggccuggccggca

SEQ ID NO: 3762929 - RNA, 14 nt, Human
gcucugcuugacaa

SEQ ID NO: 3762930 - RNA, 21 nt, Human
gcucuggaaaaugugacccag

SEQ ID NO: 3762931 - RNA, 16 nt, Human
gcucuggacagcccca

SEQ ID NO: 3762932 - RNA, 19 nt, Human
gcucuggacagccccaccc

SEQ ID NO: 3762933 - RNA, 14 nt, Human
gcucuggacaggca

SEQ ID NO: 3762934 - RNA, 21 nt, Human
gcucuggacaggcauguucuc

SEQ ID NO: 3762935 - RNA, 14 nt, Human
gcucuggaccugcc

SEQ ID NO: 3762936 - RNA, 15 nt, Human
gcucuggaccugccc

SEQ ID NO: 3762937 - RNA, 15 nt, Human
gcucuggagagaaac

SEQ ID NO: 3762938 - RNA, 15 nt, Human
gcucuggagccaccu

SEQ ID NO: 3762939 - RNA, 20 nt, Human
gcucuggagccaccuguccc

SEQ ID NO: 3762940 - RNA, 15 nt, Human
gcucuggagcccacu

SEQ ID NO: 3762941 - RNA, 13 nt, Human
gcucuggagggga

SEQ ID NO: 3762942 - RNA, 15 nt, Human
gcucuggccuccaag

SEQ ID NO: 3762943 - RNA, 14 nt, Human
gcucuggcucacag

SEQ ID NO: 3762944 - RNA, 18 nt, Human
gcucuggcucacagacug

SEQ ID NO: 3762945 - RNA, 22 nt, Human
gcucuggcucacagacuggaga

SEQ ID NO: 3762946 - RNA, 15 nt, Human
gcucuggcugaaccc

SEQ ID NO: 3762947 - RNA, 21 nt, Human
gcucuggcugaacccugugcu

SEQ ID NO: 3762948 - RNA, 14 nt, Human
gcucugggccauuc

SEQ ID NO: 3762949 - RNA, 21 nt, Human
gcucuggggugggcaguuuuu

SEQ ID NO: 3762950 - RNA, 23 nt, Human
gcucugguccauagagagcaaga

SEQ ID NO: 3762951 - RNA, 18 nt, Human
gcucuggugacaccagcc

SEQ ID NO: 3762952 - RNA, 19 nt, Human
gcucuggugacaccagccu

SEQ ID NO: 3762953 - RNA, 22 nt, Human
gcucugguuguuucuguuccaa

SEQ ID NO: 3762954 - RNA, 17 nt, Human
gcucuguagugcuacag

SEQ ID NO: 3762955 - RNA, 23 nt, Human
gcucuguagugcuacagggucca

SEQ ID NO: 3762956 - RNA, 16 nt, Human
gcucugucacccaggc

SEQ ID NO: 3762957 - RNA, 14 nt, Human
gcucuguccuggga

SEQ ID NO: 3762958 - RNA, 19 nt, Human
gcucugucgcccaggcugg

SEQ ID NO: 3762959 - RNA, 14 nt, Human
gcucugugcaguca

SEQ ID NO: 3762960 - RNA, 21 nt, Human
gcucugugcagucacuggagg

SEQ ID NO: 3762961 - RNA, 14 nt, Human
gcucugugcugacc

SEQ ID NO: 3762962 - RNA, 15 nt, Human
gcucugugcugaccc

SEQ ID NO: 3762963 - RNA, 18 nt, Human
gcucugugcugacccucc

SEQ ID NO: 3762964 - RNA, 16 nt, Human
gcucuguggccacauu

SEQ ID NO: 3762965 - RNA, 23 nt, Human
gcucugugggcugcacucugugc

SEQ ID NO: 3762966 - RNA, 17 nt, Human
gcucuguguugccaugu

SEQ ID NO: 3762967 - RNA, 23 nt, Human
gcucuguuacccaggguggagug

SEQ ID NO: 3762968 - RNA, 23 nt, Human
gcucuguucuuccucagccagcc

SEQ ID NO: 3762969 - RNA, 22 nt, Human
gcucuguugcccaggcuggagu

SEQ ID NO: 3762970 - RNA, 15 nt, Human
gcucuguuugugggg

SEQ ID NO: 3762971 - RNA, 18 nt, Human
gcucuguuugugggguga

SEQ ID NO: 3762972 - RNA, 17 nt, Human
gcucuuagcagcuucca

SEQ ID NO: 3762973 - RNA, 15 nt, Human
gcucuucagaugcca

SEQ ID NO: 3762974 - RNA, 15 nt, Human
gcucuucaggccucc

SEQ ID NO: 3762975 - RNA, 19 nt, Human
gcucuucagugggagaaaa

SEQ ID NO: 3762976 - RNA, 19 nt, Human
gcucuucaucccauuccag

SEQ ID NO: 3762977 - RNA, 15 nt, Human
gcucuuccaggcugg

SEQ ID NO: 3762978 - RNA, 16 nt, Human
gcucuuccaggcuggg

SEQ ID NO: 3762979 - RNA, 22 nt, Human
gcucuuccaggcugggagagcc

SEQ ID NO: 3762980 - RNA, 15 nt, Human
gcucuucucauuuca

SEQ ID NO: 3762981 - RNA, 13 nt, Human
gcucuucugacua

SEQ ID NO: 3762982 - RNA, 21 nt, Human
gcucuucugccggcccugggg

SEQ ID NO: 3762983 - RNA, 14 nt, Human
gcucuucuucuuuc

SEQ ID NO: 3762984 - RNA, 17 nt, Human
gcucuugauaccccccu

SEQ ID NO: 3762985 - RNA, 20 nt, Human
gcucuugauaccccccucug

SEQ ID NO: 3762986 - RNA, 15 nt, Human
gcucuugaugccugg

SEQ ID NO: 3762987 - RNA, 16 nt, Human
gcucuugaugccuggc

SEQ ID NO: 3762988 - RNA, 18 nt, Human
gcucuugcccuucccugu

SEQ ID NO: 3762989 - RNA, 19 nt, Human
gcucuugcccuucccuguc

SEQ ID NO: 3762990 - RNA, 17 nt, Human
gcucuuggagcugugag

SEQ ID NO: 3762991 - RNA, 16 nt, Human
gcuaaaagaaacuuuc

SEQ ID NO: 3762992 - RNA, 19 nt, Human
gcuaaacguguauguuuuu

SEQ ID NO: 3762993 - RNA, 23 nt, Human
gcuaaacguguauguuuuucagu

SEQ ID NO: 3762994 - RNA, 17 nt, Human
gcuaaacguuggugacg

SEQ ID NO: 3762995 - RNA, 17 nt, Human
gcuaaacuccuuccugg

SEQ ID NO: 3762996 - RNA, 22 nt, Human
gcuaaacuccuuccuggccuga

SEQ ID NO: 3762997 - RNA, 14 nt, Human
gcuaaagagcccuu

SEQ ID NO: 3762998 - RNA, 22 nt, Human
gcuaaagagcccuugccucccc

SEQ ID NO: 3762999 - RNA, 17 nt, Human
gcuaaagcaauaugcau

SEQ ID NO: 3763000 - RNA, 19 nt, Human
gcuaaagcaauaugcauuu

SEQ ID NO: 3763001 - RNA, 21 nt, Human
gcuaaaguaaacaacucaagg

SEQ ID NO: 3763002 - RNA, 18 nt, Human
gcuaaauaaucuuacucu

SEQ ID NO: 3763003 - RNA, 18 nt, Human
gcuaaaugccuaauaaac

SEQ ID NO: 3763004 - RNA, 19 nt, Human
gcuaaaugccuaauaaaca

SEQ ID NO: 3763005 - RNA, 17 nt, Human
gcuaaauguaacagucu

SEQ ID NO: 3763006 - RNA, 18 nt, Human
gcuaaauguaagaaucau

SEQ ID NO: 3763007 - RNA, 20 nt, Human
gcuaaauugauguugaugca

SEQ ID NO: 3763008 - RNA, 16 nt, Human
gcuaacacuggccccu

SEQ ID NO: 3763009 - RNA, 15 nt, Human
gcuaacagggaaggc

SEQ ID NO: 3763010 - RNA, 18 nt, Human
gcuaacagggaaggcagg

SEQ ID NO: 3763011 - RNA, 14 nt, Human
gcuaacauuuuaaa

SEQ ID NO: 3763012 - RNA, 21 nt, Human
gcuaacauuuuaaauaaaaga

SEQ ID NO: 3763013 - RNA, 23 nt, Human
gcuaacauuuuaaauaaaagaaa

SEQ ID NO: 3763014 - RNA, 22 nt, Human
gcuaacccagguccccucauuc

SEQ ID NO: 3763015 - RNA, 19 nt, Human
gcuaaccuuauccugcauu

SEQ ID NO: 3763016 - RNA, 22 nt, Human
gcuaaccuuauccugcauuguu

SEQ ID NO: 3763017 - RNA, 21 nt, Human
gcuaacuagcuuggaaacugg

SEQ ID NO: 3763018 - RNA, 17 nt, Human
gcuaacugaacuuugaa

SEQ ID NO: 3763019 - RNA, 18 nt, Human
gcuaacugaacuuugaag

SEQ ID NO: 3763020 - RNA, 12 nt, Human
gcuaacuggaag

SEQ ID NO: 3763021 - RNA, 16 nt, Human
gcuaacuguaaaucau

SEQ ID NO: 3763022 - RNA, 18 nt, Human
gcuaacuugcuuaaaugu

SEQ ID NO: 3763023 - RNA, 20 nt, Human
gcuaacuugcuuaaauguga

SEQ ID NO: 3763024 - RNA, 20 nt, Human
gcuaacuuggagccccagug

SEQ ID NO: 3763025 - RNA, 14 nt, Human
gcuaagaaaagauu

SEQ ID NO: 3763026 - RNA, 16 nt, Human
gcuaagaaccuggaac

SEQ ID NO: 3763027 - RNA, 14 nt, Human
gcuaagaauauuug

SEQ ID NO: 3763028 - RNA, 13 nt, Human
gcuaagaggcugc

SEQ ID NO: 3763029 - RNA, 14 nt, Human
gcuaagaggcugcu

SEQ ID NO: 3763030 - RNA, 23 nt, Human
gcuaagagggagggagggcucca

SEQ ID NO: 3763031 - RNA, 17 nt, Human
gcuaagcaaaaugugau

SEQ ID NO: 3763032 - RNA, 14 nt, Human
gcuaagcauuccaa

SEQ ID NO: 3763033 - RNA, 17 nt, Human
gcuaagccccagcaagc

SEQ ID NO: 3763034 - RNA, 15 nt, Human
gcuaagcuaggaaug

SEQ ID NO: 3763035 - RNA, 19 nt, Human
gcuaagcuaggaaugaaau

SEQ ID NO: 3763036 - RNA, 18 nt, Human
gcuaagcuuaaaaaaaac

SEQ ID NO: 3763037 - RNA, 23 nt, Human
gcuaaggacuuguuagaucuagu

SEQ ID NO: 3763038 - RNA, 14 nt, Human
gcuaaggcaccagc

SEQ ID NO: 3763039 - RNA, 16 nt, Human
gcuaagggaagacauu

SEQ ID NO: 3763040 - RNA, 19 nt, Human
gcuaagggaagacauuucu

SEQ ID NO: 3763041 - RNA, 15 nt, Human
gcuaagggguggggc

SEQ ID NO: 3763042 - RNA, 20 nt, Human
gcuaagggugggugcucaga

SEQ ID NO: 3763043 - RNA, 20 nt, Human
gcuaagguguauuugguccu

SEQ ID NO: 3763044 - RNA, 15 nt, Human
gcuaagguucuaagg

SEQ ID NO: 3763045 - RNA, 20 nt, Human
gcuaaguacacaauaagcaa

SEQ ID NO: 3763046 - RNA, 18 nt, Human
gcuaagugauccucccac

SEQ ID NO: 3763047 - RNA, 22 nt, Human
gcuaagugauccucccaccuca

SEQ ID NO: 3763048 - RNA, 20 nt, Human
gcuaauaaaauaucauucag

SEQ ID NO: 3763049 - RNA, 15 nt, Human
gcuaauaacugaucu

SEQ ID NO: 3763050 - RNA, 21 nt, Human
gcuaauaaugagcuauuaaaa

SEQ ID NO: 3763051 - RNA, 21 nt, Human
gcuaaucaaagccagggucuc

SEQ ID NO: 3763052 - RNA, 19 nt, Human
gcuaaucuguagggcugga

SEQ ID NO: 3763053 - RNA, 15 nt, Human
gcuaaugggacacua

SEQ ID NO: 3763054 - RNA, 22 nt, Human
gcuaauguugcuggaucaggaa

SEQ ID NO: 3763055 - RNA, 15 nt, Human
gcuaauuaaaaaguu

SEQ ID NO: 3763056 - RNA, 15 nt, Human
gcuaauuauuuuaau

SEQ ID NO: 3763057 - RNA, 23 nt, Human
gcuaauuauuuuaauuagguuaa

SEQ ID NO: 3763058 - RNA, 13 nt, Human
gcuaauucuuugc

SEQ ID NO: 3763059 - RNA, 23 nt, Human
gcuaauugcuguugaaagcaaaa

SEQ ID NO: 3763060 - RNA, 12 nt, Human
gcuaauuugcau

SEQ ID NO: 3763061 - RNA, 20 nt, Human
gcuaauuuguuuuggauaua

SEQ ID NO: 3763062 - RNA, 12 nt, Human
gcuaauuuuuau

SEQ ID NO: 3763063 - RNA, 20 nt, Human
gcuaauuuuucauuuuuagu

SEQ ID NO: 3763064 - RNA, 16 nt, Human
gcuaauuuuuguaauu

SEQ ID NO: 3763065 - RNA, 17 nt, Human
gcuacaaaaacacagca

SEQ ID NO: 3763066 - RNA, 22 nt, Human
gcuacaaaacgcgcagaugugc

SEQ ID NO: 3763067 - RNA, 15 nt, Human
gcuacaaagaagaca

SEQ ID NO: 3763068 - RNA, 17 nt, Human
gcuacaaagaagacaug

SEQ ID NO: 3763069 - RNA, 15 nt, Human
gcuacaacagccuca

SEQ ID NO: 3763070 - RNA, 17 nt, Human
gcuacaacagccucacu

SEQ ID NO: 3763071 - RNA, 17 nt, Human
gcuacaacuucagcagu

SEQ ID NO: 3763072 - RNA, 20 nt, Human
gcuacaauuuucucccagga

SEQ ID NO: 3763073 - RNA, 13 nt, Human
gcuacacaccuaa

SEQ ID NO: 3763074 - RNA, 16 nt, Human
gcuacacagaucacag

SEQ ID NO: 3763075 - RNA, 22 nt, Human
gcuacacaggggaaaagaggag

SEQ ID NO: 3763076 - RNA, 19 nt, Human
gcuacacccuuuuccagcu

SEQ ID NO: 3763077 - RNA, 20 nt, Human
gcuacaccuuucuccuuugu

SEQ ID NO: 3763078 - RNA, 15 nt, Human
gcuacagagaaacca

SEQ ID NO: 3763079 - RNA, 17 nt, Human
gcuacagagaaaccagc

SEQ ID NO: 3763080 - RNA, 20 nt, Human
gcuacagagaaaccagcuuc

SEQ ID NO: 3763081 - RNA, 22 nt, Human
gcuacagagaaaccagcuuccu

SEQ ID NO: 3763082 - RNA, 14 nt, Human
gcuacagagaagcc

SEQ ID NO: 3763083 - RNA, 18 nt, Human
gcuacagagaagccuuca

SEQ ID NO: 3763084 - RNA, 17 nt, Human
gcuacagcaauuucuaa

SEQ ID NO: 3763085 - RNA, 21 nt, Human
gcuacagcuuucuugcucccu

SEQ ID NO: 3763086 - RNA, 21 nt, Human
gcuacaggaagcaccccaugc

SEQ ID NO: 3763087 - RNA, 22 nt, Human
gcuacaggaagcaccccaugcc

SEQ ID NO: 3763088 - RNA, 15 nt, Human
gcuacaggggccaga

SEQ ID NO: 3763089 - RNA, 15 nt, Human
gcuacagguuacaac

SEQ ID NO: 3763090 - RNA, 14 nt, Human
gcuacaguaauaaa

SEQ ID NO: 3763091 - RNA, 13 nt, Human
gcuacauaauuua

SEQ ID NO: 3763092 - RNA, 16 nt, Human
gcuacaugcugggguc

SEQ ID NO: 3763093 - RNA, 19 nt, Human
gcuacauggggcucacuca

SEQ ID NO: 3763094 - RNA, 11 nt, Human
gcuacauuaua

SEQ ID NO: 3763095 - RNA, 13 nt, Human
gcuacauuauaaa

SEQ ID NO: 3763096 - RNA, 17 nt, Human
gcuacauuauaaacgcu

SEQ ID NO: 3763097 - RNA, 14 nt, Human
gcuaccaccagcug

SEQ ID NO: 3763098 - RNA, 20 nt, Human
gcuaccaccagcugugucca

SEQ ID NO: 3763099 - RNA, 18 nt, Human
gcuaccaguauuuagaag

SEQ ID NO: 3763100 - RNA, 20 nt, Human
gcuacccccaugcuggaggu

SEQ ID NO: 3763101 - RNA, 14 nt, Human
gcuacccgggaagg

SEQ ID NO: 3763102 - RNA, 15 nt, Human
gcuacccgggaaggg

SEQ ID NO: 3763103 - RNA, 19 nt, Human
gcuacccucccugcugucc

SEQ ID NO: 3763104 - RNA, 14 nt, Human
gcuacccugagcug

SEQ ID NO: 3763105 - RNA, 20 nt, Human
gcuacccuuuuccuuugugg

SEQ ID NO: 3763106 - RNA, 13 nt, Human
gcuaccucaaggg

SEQ ID NO: 3763107 - RNA, 14 nt, Human
gcuaccucacuggg

SEQ ID NO: 3763108 - RNA, 12 nt, Human
gcuaccucccuc

SEQ ID NO: 3763109 - RNA, 14 nt, Human
gcuaccucccuccc

SEQ ID NO: 3763110 - RNA, 21 nt, Human
gcuaccucucugucccuugcu

SEQ ID NO: 3763111 - RNA, 20 nt, Human
gcuaccuguguggacaggac

SEQ ID NO: 3763112 - RNA, 14 nt, Human
gcuaccuugcccca

SEQ ID NO: 3763113 - RNA, 22 nt, Human
gcuaccuugccccaacccuucu

SEQ ID NO: 3763114 - RNA, 12 nt, Human
gcuacgccugca

SEQ ID NO: 3763115 - RNA, 14 nt, Human
gcuacguauuuaau

SEQ ID NO: 3763116 - RNA, 17 nt, Human
gcuacgugugauuuuuc

SEQ ID NO: 3763117 - RNA, 18 nt, Human
gcuacuagaauucuguau

SEQ ID NO: 3763118 - RNA, 22 nt, Human
gcuacuaugauuuaauuugaaa

SEQ ID NO: 3763119 - RNA, 16 nt, Human
gcuacucaagaggcug

SEQ ID NO: 3763120 - RNA, 20 nt, Human
gcuacucaagaggcugaggc

SEQ ID NO: 3763121 - RNA, 23 nt, Human
gcuacucacucaaguucaaggac

SEQ ID NO: 3763122 - RNA, 17 nt, Human
gcuacucagcagcccuc

SEQ ID NO: 3763123 - RNA, 24 nt, Human
gcuacucagcagcccuccucaccc

SEQ ID NO: 3763124 - RNA, 14 nt, Human
gcuacucaggaggc

SEQ ID NO: 3763125 - RNA, 15 nt, Human
gcuacucaggaggcu

SEQ ID NO: 3763126 - RNA, 19 nt, Human
gcuacucgggaggcugagg

SEQ ID NO: 3763127 - RNA, 21 nt, Human
gcuacucgggaggcugaggca

SEQ ID NO: 3763128 - RNA, 23 nt, Human
gcuacucgggaggcugaggcaca

SEQ ID NO: 3763129 - RNA, 23 nt, Human
gcuacucgggaggcugaggcagg

SEQ ID NO: 3763130 - RNA, 19 nt, Human
gcuacucgugagcgccagu

SEQ ID NO: 3763131 - RNA, 19 nt, Human
gcuacucuaguauuccaga

SEQ ID NO: 3763132 - RNA, 22 nt, Human
gcuacucuccccacgagggcug

SEQ ID NO: 3763133 - RNA, 13 nt, Human
gcuacucugugcc

SEQ ID NO: 3763134 - RNA, 14 nt, Human
gcuacucugugcca

SEQ ID NO: 3763135 - RNA, 16 nt, Human
gcuacucugugccaga

SEQ ID NO: 3763136 - RNA, 19 nt, Human
gcuacucugugccagagcc

SEQ ID NO: 3763137 - RNA, 22 nt, Human
gcuacucugugccagagccugg

SEQ ID NO: 3763138 - RNA, 17 nt, Human
gcuacucuguuccuuca

SEQ ID NO: 3763139 - RNA, 18 nt, Human
gcuacugaugagaauuua

SEQ ID NO: 3763140 - RNA, 19 nt, Human
gcucuuggcagguacucag

SEQ ID NO: 3763141 - RNA, 13 nt, Human
gcucuuggcugga

SEQ ID NO: 3763142 - RNA, 21 nt, Human
gcucuuguagcccaggcugga

SEQ ID NO: 3763143 - RNA, 22 nt, Human
gcucuugugcuggauggagccc

SEQ ID NO: 3763144 - RNA, 14 nt, Human
gcucuuuccuccuu

SEQ ID NO: 3763145 - RNA, 15 nt, Human
gcucuuuccuccuuc

SEQ ID NO: 3763146 - RNA, 17 nt, Human
gcucuuuccuccuucca

SEQ ID NO: 3763147 - RNA, 14 nt, Human
gcucuuucucugcc

SEQ ID NO: 3763148 - RNA, 15 nt, Human
gcucuuucucugcca

SEQ ID NO: 3763149 - RNA, 21 nt, Human
gcucuuucucugccagugaca

SEQ ID NO: 3763150 - RNA, 17 nt, Human
gcucuuugaaacaacuu

SEQ ID NO: 3763151 - RNA, 21 nt, Human
gcucuuugaaauagucugugu

SEQ ID NO: 3763152 - RNA, 13 nt, Human
gcucuuugagaaa

SEQ ID NO: 3763153 - RNA, 12 nt, Human
gcucuuugcacu

SEQ ID NO: 3763154 - RNA, 13 nt, Human
gcucuuugcacua

SEQ ID NO: 3763155 - RNA, 20 nt, Human
gcucuuuggggucagccagg

SEQ ID NO: 3763156 - RNA, 18 nt, Human
gcucuuugguagaaaagg

SEQ ID NO: 3763157 - RNA, 15 nt, Human
gcucuuugucaggga

SEQ ID NO: 3763158 - RNA, 22 nt, Human
gcucuuuuuuacucauugaaau

SEQ ID NO: 3763159 - RNA, 21 nt, Human
gcucuuuuuuguuuguuucuu

SEQ ID NO: 3763160 - RNA, 19 nt, Human
gcugaaaaaucacauccug

SEQ ID NO: 3763161 - RNA, 20 nt, Human
gcugaaaaccuaaguccuuu

SEQ ID NO: 3763162 - RNA, 11 nt, Human
gcugaaaauau

SEQ ID NO: 3763163 - RNA, 15 nt, Human
gcugaaaauauaaaa

SEQ ID NO: 3763164 - RNA, 16 nt, Human
gcugaaacaggagaga

SEQ ID NO: 3763165 - RNA, 17 nt, Human
gcugaaacaggagagaa

SEQ ID NO: 3763166 - RNA, 18 nt, Human
gcugaaacgcaucuaguu

SEQ ID NO: 3763167 - RNA, 15 nt, Human
gcugaaaugcugcau

SEQ ID NO: 3763168 - RNA, 16 nt, Human
gcugaaauucuccugg

SEQ ID NO: 3763169 - RNA, 16 nt, Human
gcugaaauuuuagaaa

SEQ ID NO: 3763170 - RNA, 18 nt, Human
gcugaacacauuucuuuu

SEQ ID NO: 3763171 - RNA, 20 nt, Human
gcugaacacuccaauuaagg

SEQ ID NO: 3763172 - RNA, 15 nt, Human
gcugaagagugagga

SEQ ID NO: 3763173 - RNA, 15 nt, Human
gcugaagcugccugc

SEQ ID NO: 3763174 - RNA, 21 nt, Human
gcugaagcuuauuaaugcuaa

SEQ ID NO: 3763175 - RNA, 13 nt, Human
gcugaaggacugu

SEQ ID NO: 3763176 - RNA, 14 nt, Human
gcugaaggacugug

SEQ ID NO: 3763177 - RNA, 12 nt, Human
gcugaaggcucg

SEQ ID NO: 3763178 - RNA, 23 nt, Human
gcugaaggcucgagcaugccugg

SEQ ID NO: 3763179 - RNA, 15 nt, Human
gcugaagguugaaga

SEQ ID NO: 3763180 - RNA, 17 nt, Human
gcugaagguuguggccu

SEQ ID NO: 3763181 - RNA, 20 nt, Human
gcugaagguuguggccuuug

SEQ ID NO: 3763182 - RNA, 12 nt, Human
gcugaauaaaug

SEQ ID NO: 3763183 - RNA, 16 nt, Human
gcugaauaaaugucuu

SEQ ID NO: 3763184 - RNA, 16 nt, Human
gcugaauagcuucucc

SEQ ID NO: 3763185 - RNA, 19 nt, Human
gcugaauaggcgaucacaa

SEQ ID NO: 3763186 - RNA, 15 nt, Human
gcugaauccagauca

SEQ ID NO: 3763187 - RNA, 22 nt, Human
gcugaauugagccuaaaaauaa

SEQ ID NO: 3763188 - RNA, 12 nt, Human
gcugaauuuuca

SEQ ID NO: 3763189 - RNA, 18 nt, Human
gcugacacaaaccugccu

SEQ ID NO: 3763190 - RNA, 19 nt, Human
gcugacacaaaccugccug

SEQ ID NO: 3763191 - RNA, 17 nt, Human
gcugacaccuaacucuu

SEQ ID NO: 3763192 - RNA, 13 nt, Human
gcugacagacaca

SEQ ID NO: 3763193 - RNA, 16 nt, Human
gcugacagacacaggc

SEQ ID NO: 3763194 - RNA, 19 nt, Human
gcugacagacacaggcccg

SEQ ID NO: 3763195 - RNA, 16 nt, Human
gcugacaguccucucc

SEQ ID NO: 3763196 - RNA, 13 nt, Human
gcugacaucugug

SEQ ID NO: 3763197 - RNA, 19 nt, Human
gcugacaucuguguuucaa

SEQ ID NO: 3763198 - RNA, 17 nt, Human
gcugacaugaagcuguu

SEQ ID NO: 3763199 - RNA, 22 nt, Human
gcugacauuguggcacauucuu

SEQ ID NO: 3763200 - RNA, 20 nt, Human
gcugaccaagagagaaagaa

SEQ ID NO: 3763201 - RNA, 15 nt, Human
gcugaccaauugugc

SEQ ID NO: 3763202 - RNA, 21 nt, Human
gcugaccaauugugcugccau

SEQ ID NO: 3763203 - RNA, 13 nt, Human
gcugaccacagca

SEQ ID NO: 3763204 - RNA, 14 nt, Human
gcugaccacagcac

SEQ ID NO: 3763205 - RNA, 17 nt, Human
gcugaccacagcacagc

SEQ ID NO: 3763206 - RNA, 12 nt, Human
gcugaccagaca

SEQ ID NO: 3763207 - RNA, 22 nt, Human
gcugaccaugcucaucugcugg

SEQ ID NO: 3763208 - RNA, 13 nt, Human
gcugacccagccu

SEQ ID NO: 3763209 - RNA, 14 nt, Human
gcugacccaugggc

SEQ ID NO: 3763210 - RNA, 19 nt, Human
gcugaccccaaagagccug

SEQ ID NO: 3763211 - RNA, 21 nt, Human
gcugaccccccucaggacccu

SEQ ID NO: 3763212 - RNA, 14 nt, Human
gcugacccuccugu

SEQ ID NO: 3763213 - RNA, 22 nt, Human
gcugacccuccuguugcaccca

SEQ ID NO: 3763214 - RNA, 18 nt, Human
gcugaccucccagugacc

SEQ ID NO: 3763215 - RNA, 14 nt, Human
gcugaccucuguug

SEQ ID NO: 3763216 - RNA, 16 nt, Human
gcugaccugccucuca

SEQ ID NO: 3763217 - RNA, 12 nt, Human
gcugaccugcug

SEQ ID NO: 3763218 - RNA, 17 nt, Human
gcugaccuuccucgcag

SEQ ID NO: 3763219 - RNA, 19 nt, Human
gcugaccuuccucgcagag

SEQ ID NO: 3763220 - RNA, 20 nt, Human
gcugaccuuccucgcagaga

SEQ ID NO: 3763221 - RNA, 22 nt, Human
gcugaccuuccucgcagagagg

SEQ ID NO: 3763222 - RNA, 20 nt, Human
gcugaccuugaacuccuggg

SEQ ID NO: 3763223 - RNA, 21 nt, Human
gcugaccuugaacuccugggc

SEQ ID NO: 3763224 - RNA, 19 nt, Human
gcugacgggacccacaugc

SEQ ID NO: 3763225 - RNA, 14 nt, Human
gcugacuaaauuug

SEQ ID NO: 3763226 - RNA, 20 nt, Human
gcugacuaaauuuggggaca

SEQ ID NO: 3763227 - RNA, 23 nt, Human
gcugacuagaagggccaguccug

SEQ ID NO: 3763228 - RNA, 20 nt, Human
gcugacugauguugagggaa

SEQ ID NO: 3763229 - RNA, 16 nt, Human
gcugacugggccaggg

SEQ ID NO: 3763230 - RNA, 21 nt, Human
gcugacuguacuccucccagg

SEQ ID NO: 3763231 - RNA, 14 nt, Human
gcugacuguagcuu

SEQ ID NO: 3763232 - RNA, 18 nt, Human
gcugacuguccucucccc

SEQ ID NO: 3763233 - RNA, 23 nt, Human
gcugacuguccucuccccuccag

SEQ ID NO: 3763234 - RNA, 22 nt, Human
gcugacuguuuucucuugagag

SEQ ID NO: 3763235 - RNA, 13 nt, Human
gcugacuuagaau

SEQ ID NO: 3763236 - RNA, 13 nt, Human
gcugacuucacuu

SEQ ID NO: 3763237 - RNA, 19 nt, Human
gcugacuucaucucccacc

SEQ ID NO: 3763238 - RNA, 15 nt, Human
gcugacuuggcuggu

SEQ ID NO: 3763239 - RNA, 18 nt, Human
gcugacuuggcuggugug

SEQ ID NO: 3763240 - RNA, 23 nt, Human
gcugacuuggcuggugugguaca

SEQ ID NO: 3763241 - RNA, 18 nt, Human
gcugacuuugcucuuucu

SEQ ID NO: 3763242 - RNA, 15 nt, Human
gcugagaaccuggcc

SEQ ID NO: 3763243 - RNA, 18 nt, Human
gcugagaaccuggccuuc

SEQ ID NO: 3763244 - RNA, 17 nt, Human
gcugagaacuccugacu

SEQ ID NO: 3763245 - RNA, 18 nt, Human
gcugagaagcuuuugaau

SEQ ID NO: 3763246 - RNA, 13 nt, Human
gcugagaauagaa

SEQ ID NO: 3763247 - RNA, 17 nt, Human
gcugagaauagaaggaa

SEQ ID NO: 3763248 - RNA, 18 nt, Human
gcugagaauagaaggaaa

SEQ ID NO: 3763249 - RNA, 16 nt, Human
gcugagaauguggaau

SEQ ID NO: 3763250 - RNA, 14 nt, Human
gcugagacaggaga

SEQ ID NO: 3763251 - RNA, 19 nt, Human
gcugagacaggagaaacac

SEQ ID NO: 3763252 - RNA, 9 nt, Human
gcugagacu

SEQ ID NO: 3763253 - RNA, 14 nt, Human
gcugagacugcggg

SEQ ID NO: 3763254 - RNA, 15 nt, Human
gcugagagaaaauaa

SEQ ID NO: 3763255 - RNA, 15 nt, Human
gcugagagacccaag

SEQ ID NO: 3763256 - RNA, 20 nt, Human
gcugagagccccagcugaca

SEQ ID NO: 3763257 - RNA, 16 nt, Human
gcugagaggagagaga

SEQ ID NO: 3763258 - RNA, 22 nt, Human
gcugagauccuggacugagggg

SEQ ID NO: 3763259 - RNA, 20 nt, Human
gcugagaucgugccacugca

SEQ ID NO: 3763260 - RNA, 21 nt, Human
gcugagcacccagcucugucu

SEQ ID NO: 3763261 - RNA, 12 nt, Human
gcugagcaggcc

SEQ ID NO: 3763262 - RNA, 14 nt, Human
gcugagcagggccg

SEQ ID NO: 3763263 - RNA, 16 nt, Human
gcugagcagggccggg

SEQ ID NO: 3763264 - RNA, 13 nt, Human
gcugagccaccug

SEQ ID NO: 3763265 - RNA, 15 nt, Human
gcugagccaccugcc

SEQ ID NO: 3763266 - RNA, 20 nt, Human
gcugagccccuaccccacac

SEQ ID NO: 3763267 - RNA, 21 nt, Human
gcugagccccuaccccacacc

SEQ ID NO: 3763268 - RNA, 13 nt, Human
gcugagccccugu

SEQ ID NO: 3763269 - RNA, 23 nt, Human
gcugagccccugucuagagaggg

SEQ ID NO: 3763270 - RNA, 17 nt, Human
gcugagccucacagcag

SEQ ID NO: 3763271 - RNA, 14 nt, Human
gcugagccuggcug

SEQ ID NO: 3763272 - RNA, 15 nt, Human
gcugagccuggcugg

SEQ ID NO: 3763273 - RNA, 16 nt, Human
gcugagccuucugagc

SEQ ID NO: 3763274 - RNA, 23 nt, Human
gcugagcgaggagaugcuccuug

SEQ ID NO: 3763275 - RNA, 23 nt, Human
gcugagcucacaaggcagcaagg

SEQ ID NO: 3763276 - RNA, 13 nt, Human
gcugagcucugag

SEQ ID NO: 3763277 - RNA, 21 nt, Human
gcugagcucugagaggcccug

SEQ ID NO: 3763278 - RNA, 22 nt, Human
gcugagcucugagaggcccugg

SEQ ID NO: 3763279 - RNA, 22 nt, Human
gcugaggaaaggccagcuggca

SEQ ID NO: 3763280 - RNA, 23 nt, Human
gcugaggaaaggccagcuggcag

SEQ ID NO: 3763281 - RNA, 16 nt, Human
gcugaggagcagcagg

SEQ ID NO: 3763282 - RNA, 16 nt, Human
gcugaggagugaggaa

SEQ ID NO: 3763283 - RNA, 20 nt, Human
gcugaggauuucaagccugc

SEQ ID NO: 3763284 - RNA, 15 nt, Human
gcugaggcaauucua

SEQ ID NO: 3763285 - RNA, 12 nt, Human
gcugaggcacaa

SEQ ID NO: 3763286 - RNA, 13 nt, Human
gcugaggcagaag

SEQ ID NO: 3763287 - RNA, 15 nt, Human
gcugaggcagaagaa

SEQ ID NO: 3763288 - RNA, 13 nt, Human
gcugaggcaggag

SEQ ID NO: 3763289 - RNA, 16 nt, Human
gcugaggcaggagacu

SEQ ID NO: 3763290 - RNA, 19 nt, Human
gcugaggccacacucagca

SEQ ID NO: 3763291 - RNA, 22 nt, Human
gcugaggccccuucuagguggc

SEQ ID NO: 3763292 - RNA, 14 nt, Human
gcugaggccucuca

SEQ ID NO: 3763293 - RNA, 15 nt, Human
gcugaggccugggcc

SEQ ID NO: 3763294 - RNA, 15 nt, Human
gcugaggcgggagaa

SEQ ID NO: 3763295 - RNA, 23 nt, Human
gcugaggcucugacccagugaga

SEQ ID NO: 3763296 - RNA, 15 nt, Human
gcugaggcuggcaca

SEQ ID NO: 3763297 - RNA, 21 nt, Human
gcugagggauggacugaugcu

SEQ ID NO: 3763298 - RNA, 23 nt, Human
gcugagggauggacugaugcuuu

SEQ ID NO: 3763299 - RNA, 21 nt, Human
gcugagggcaguucgcagcca

SEQ ID NO: 3763300 - RNA, 22 nt, Human
gcugagggcaguucgcagccac

SEQ ID NO: 3763301 - RNA, 15 nt, Human
gcugagggccugcug

SEQ ID NO: 3763302 - RNA, 18 nt, Human
gcugagggccugcuggag

SEQ ID NO: 3763303 - RNA, 23 nt, Human
gcugagggccugcuggaggccuc

SEQ ID NO: 3763304 - RNA, 22 nt, Human
gcugaggggaggaucacuggag

SEQ ID NO: 3763305 - RNA, 11 nt, Human
gcugaggggca

SEQ ID NO: 3763306 - RNA, 23 nt, Human
gcugaggggcaacgaagaaaaaa

SEQ ID NO: 3763307 - RNA, 15 nt, Human
gcugaggguccagaa

SEQ ID NO: 3763308 - RNA, 18 nt, Human
gcugagggugagugggug

SEQ ID NO: 3763309 - RNA, 19 nt, Human
gcugaggugagaggaucag

SEQ ID NO: 3763310 - RNA, 20 nt, Human
gcugagguuccucugccugc

SEQ ID NO: 3763311 - RNA, 21 nt, Human
gcugagguuccucugccugcc

SEQ ID NO: 3763312 - RNA, 21 nt, Human
gcugagguugcgccacuacac

SEQ ID NO: 3763313 - RNA, 18 nt, Human
gcugaguagcucugccuu

SEQ ID NO: 3763314 - RNA, 23 nt, Human
gcugaguauggagcagccuggag

SEQ ID NO: 3763315 - RNA, 23 nt, Human
gcugagucaugaucucccugccg

SEQ ID NO: 3763316 - RNA, 17 nt, Human
gcugagucccaggcuga

SEQ ID NO: 3763317 - RNA, 22 nt, Human
gcugagucccaggcugagccuc

SEQ ID NO: 3763318 - RNA, 15 nt, Human
gcugaguccgaccug

SEQ ID NO: 3763319 - RNA, 22 nt, Human
gcugagugaggaauggcaguga

SEQ ID NO: 3763320 - RNA, 22 nt, Human
gcugagugcaggcccacccugc

SEQ ID NO: 3763321 - RNA, 19 nt, Human
gcugaguggcaggggacag

SEQ ID NO: 3763322 - RNA, 23 nt, Human
gcugagugggggaucacagccuc

SEQ ID NO: 3763323 - RNA, 21 nt, Human
gcugaguuguugagucuguuu

SEQ ID NO: 3763324 - RNA, 15 nt, Human
gcugaguuuccuaug

SEQ ID NO: 3763325 - RNA, 22 nt, Human
gcugauaauguauaugaacuua

SEQ ID NO: 3763326 - RNA, 12 nt, Human
gcugauaauuuu

SEQ ID NO: 3763327 - RNA, 19 nt, Human
gcugauacauaacuaaauu

SEQ ID NO: 3763328 - RNA, 23 nt, Human
gcugauacauaacuaaauuugau

SEQ ID NO: 3763329 - RNA, 14 nt, Human
gcugauacuucauu

SEQ ID NO: 3763330 - RNA, 13 nt, Human
gcugauauaaauu

SEQ ID NO: 3763331 - RNA, 16 nt, Human
gcugaucagugggccu

SEQ ID NO: 3763332 - RNA, 18 nt, Human
gcugaucaucgccagagg

SEQ ID NO: 3763333 - RNA, 20 nt, Human
gcugaucaucgccagaggug

SEQ ID NO: 3763334 - RNA, 15 nt, Human
gcugaucgccuuccc

SEQ ID NO: 3763335 - RNA, 17 nt, Human
gcugaucgccuucccca

SEQ ID NO: 3763336 - RNA, 14 nt, Human
gcugaucuaaaaau

SEQ ID NO: 3763337 - RNA, 13 nt, Human
gcugaucucaggg

SEQ ID NO: 3763338 - RNA, 18 nt, Human
gcugaugaaucacuguuu

SEQ ID NO: 3763339 - RNA, 23 nt, Human
gcugaugacucaagauucccagg

SEQ ID NO: 3763340 - RNA, 20 nt, Human
gcugaugauuuguuuuugua

SEQ ID NO: 3763341 - RNA, 15 nt, Human
gcugaugcaggauuu

SEQ ID NO: 3763342 - RNA, 15 nt, Human
gcugaugcugggcug

SEQ ID NO: 3763343 - RNA, 23 nt, Human
gcugauggauaaccuauaugauu

SEQ ID NO: 3763344 - RNA, 17 nt, Human
gcugaugucaauuucug

SEQ ID NO: 3763345 - RNA, 20 nt, Human
gcugaugucaauuucugugu

SEQ ID NO: 3763346 - RNA, 15 nt, Human
gcugauguucagugu

SEQ ID NO: 3763347 - RNA, 16 nt, Human
gcugauguucagugua

SEQ ID NO: 3763348 - RNA, 20 nt, Human
gcugauguuggaagagaaag

SEQ ID NO: 3763349 - RNA, 20 nt, Human
gcugauuacugucaauaaac

SEQ ID NO: 3763350 - RNA, 13 nt, Human
gcugauuucuagg

SEQ ID NO: 3763351 - RNA, 15 nt, Human
gcugauuuuaacaau

SEQ ID NO: 3763352 - RNA, 12 nt, Human
gcugauuuuauu

SEQ ID NO: 3763353 - RNA, 16 nt, Human
gcugauuuuauucuug

SEQ ID NO: 3763354 - RNA, 20 nt, Human
gcugauuuuauucuugauca

SEQ ID NO: 3763355 - RNA, 21 nt, Human
gcugcaaaguguuuuguacca

SEQ ID NO: 3763356 - RNA, 20 nt, Human
gcugcaagguacucugguga

SEQ ID NO: 3763357 - RNA, 22 nt, Human
gcugcaagguggcuccagcacc

SEQ ID NO: 3763358 - RNA, 21 nt, Human
gcugcaagguuuaggcuggug

SEQ ID NO: 3763359 - RNA, 15 nt, Human
gcugcaauucccugg

SEQ ID NO: 3763360 - RNA, 16 nt, Human
gcugcaauucccugga

SEQ ID NO: 3763361 - RNA, 17 nt, Human
gcugcacagggcagcug

SEQ ID NO: 3763362 - RNA, 20 nt, Human
gcugcacagggcagcugggc

SEQ ID NO: 3763363 - RNA, 16 nt, Human
gcugcaccaacccagc

SEQ ID NO: 3763364 - RNA, 21 nt, Human
gcugcaccaacccagccgcug

SEQ ID NO: 3763365 - RNA, 14 nt, Human
gcugcaccagagca

SEQ ID NO: 3763366 - RNA, 22 nt, Human
gcugcaccagagcaaccucuca

SEQ ID NO: 3763367 - RNA, 14 nt, Human
gcugcaccccuucc

SEQ ID NO: 3763368 - RNA, 16 nt, Human
gcugcaccccuuccug

SEQ ID NO: 3763369 - RNA, 20 nt, Human
gcugcaccccuuccugggca

SEQ ID NO: 3763370 - RNA, 13 nt, Human
gcugcaccggcug

SEQ ID NO: 3763371 - RNA, 16 nt, Human
gcugcaccggcuggcc

SEQ ID NO: 3763372 - RNA, 18 nt, Human
gcugcaccggcuggccug

SEQ ID NO: 3763373 - RNA, 17 nt, Human
gcugcaccugccagccu

SEQ ID NO: 3763374 - RNA, 17 nt, Human
gcugcacucugugccca

SEQ ID NO: 3763375 - RNA, 19 nt, Human
gcugcacucugugcccaug

SEQ ID NO: 3763376 - RNA, 20 nt, Human
gcugcacucugugcccaugg

SEQ ID NO: 3763377 - RNA, 19 nt, Human
gcugcagaaggccaagaau

SEQ ID NO: 3763378 - RNA, 13 nt, Human
gcugcagagaaac

SEQ ID NO: 3763379 - RNA, 20 nt, Human
gcugcagagaaacuuaagca

SEQ ID NO: 3763380 - RNA, 12 nt, Human
gcugcagagggg

SEQ ID NO: 3763381 - RNA, 20 nt, Human
gcugcagaggggcaggcccu

SEQ ID NO: 3763382 - RNA, 20 nt, Human
gcugcagauaaguggccuug

SEQ ID NO: 3763383 - RNA, 17 nt, Human
gcugcagauuugggcug

SEQ ID NO: 3763384 - RNA, 14 nt, Human
gcugcagcagaggc

SEQ ID NO: 3763385 - RNA, 22 nt, Human
gcugcagcauguugcugaggag

SEQ ID NO: 3763386 - RNA, 16 nt, Human
gcugcagccucaggac

SEQ ID NO: 3763387 - RNA, 14 nt, Human
gcugcagcucccug

SEQ ID NO: 3763388 - RNA, 13 nt, Human
gcugcagcuuccu

SEQ ID NO: 3763389 - RNA, 14 nt, Human
gcugcagcuuccug

SEQ ID NO: 3763390 - RNA, 14 nt, Human
gcugcagcuuggga

SEQ ID NO: 3763391 - RNA, 22 nt, Human
gcugcagcuugggagagccccu

SEQ ID NO: 3763392 - RNA, 23 nt, Human
gcugcagcuugggagagccccug

SEQ ID NO: 3763393 - RNA, 11 nt, Human
gcugcaggggc

SEQ ID NO: 3763394 - RNA, 17 nt, Human
gcugcaggggcauggga

SEQ ID NO: 3763395 - RNA, 15 nt, Human
gcugcaggggcucug

SEQ ID NO: 3763396 - RNA, 17 nt, Human
gcugcaggggcucugga

SEQ ID NO: 3763397 - RNA, 22 nt, Human
gcugcaggggcucuggagagaa

SEQ ID NO: 3763398 - RNA, 20 nt, Human
gcugcaguaggggaggagca

SEQ ID NO: 3763399 - RNA, 18 nt, Human
gcugcaguaugaaaauaa

SEQ ID NO: 3763400 - RNA, 18 nt, Human
gcugcaguucgacucugu

SEQ ID NO: 3763401 - RNA, 13 nt, Human
gcugcaguuuuuu

SEQ ID NO: 3763402 - RNA, 14 nt, Human
gcugcauagaagga

SEQ ID NO: 3763403 - RNA, 15 nt, Human
gcugcauagaaggag

SEQ ID NO: 3763404 - RNA, 22 nt, Human
gcugcaucugggauucccacca

SEQ ID NO: 3763405 - RNA, 15 nt, Human
gcugcaugcccucuc

SEQ ID NO: 3763406 - RNA, 18 nt, Human
gcugcaugcccucucagg

SEQ ID NO: 3763407 - RNA, 22 nt, Human
gcugcaugcccucucaggccgg

SEQ ID NO: 3763408 - RNA, 20 nt, Human
gcugcaugccuggucuuucc

SEQ ID NO: 3763409 - RNA, 17 nt, Human
gcugcauggcagggggc

SEQ ID NO: 3763410 - RNA, 21 nt, Human
gcugcauugccugcggucaag

SEQ ID NO: 3763411 - RNA, 20 nt, Human
gcugccaagagugaagggaa

SEQ ID NO: 3763412 - RNA, 15 nt, Human
gcugccaaggccaga

SEQ ID NO: 3763413 - RNA, 18 nt, Human
gcugccaauauccuaaua

SEQ ID NO: 3763414 - RNA, 19 nt, Human
gcugccaauauccuaauaa

SEQ ID NO: 3763415 - RNA, 21 nt, Human
gcugccaauauccuaauaaaa

SEQ ID NO: 3763416 - RNA, 23 nt, Human
gcugccaauauccuaauaaaaag

SEQ ID NO: 3763417 - RNA, 19 nt, Human
gcugccaaugggagcucau

SEQ ID NO: 3763418 - RNA, 22 nt, Human
gcugccacacuucaggcucuuc

SEQ ID NO: 3763419 - RNA, 17 nt, Human
gcugccacccaccuccc

SEQ ID NO: 3763420 - RNA, 19 nt, Human
gcugccacccaccucccug

SEQ ID NO: 3763421 - RNA, 13 nt, Human
gcugccacugagg

SEQ ID NO: 3763422 - RNA, 19 nt, Human
gcugccagccuugagcccu

SEQ ID NO: 3763423 - RNA, 21 nt, Human
gcugccagccuugagcccugg

SEQ ID NO: 3763424 - RNA, 22 nt, Human
gcugccagccuugagcccuggc

SEQ ID NO: 3763425 - RNA, 18 nt, Human
gcugccagcucuguauca

SEQ ID NO: 3763426 - RNA, 13 nt, Human
gcugccaggagca

SEQ ID NO: 3763427 - RNA, 22 nt, Human
gcugccaucucaccuccugcug

SEQ ID NO: 3763428 - RNA, 22 nt, Human
gcugccauggcgugucccucuc

SEQ ID NO: 3763429 - RNA, 13 nt, Human
gcugccaugugaa

SEQ ID NO: 3763430 - RNA, 21 nt, Human
gcugccaugugaagagggaga

SEQ ID NO: 3763431 - RNA, 17 nt, Human
gcugcccaaucuccauc

SEQ ID NO: 3763432 - RNA, 12 nt, Human
gcugcccaggcc

SEQ ID NO: 3763433 - RNA, 14 nt, Human
gcugcccaggccca

SEQ ID NO: 3763434 - RNA, 21 nt, Human
gcugcccauuucgugagcccc

SEQ ID NO: 3763435 - RNA, 14 nt, Human
gcugccccaaccug

SEQ ID NO: 3763436 - RNA, 20 nt, Human
gcugccccaaccugcugaag

SEQ ID NO: 3763437 - RNA, 12 nt, Human
gcugccccagcc

SEQ ID NO: 3763438 - RNA, 14 nt, Human
gcugccccagccag

SEQ ID NO: 3763439 - RNA, 18 nt, Human
gcuacugcagcuuuacau

SEQ ID NO: 3763440 - RNA, 19 nt, Human
gcuacugcagcuuuacaug

SEQ ID NO: 3763441 - RNA, 11 nt, Human
gcuacugccau

SEQ ID NO: 3763442 - RNA, 13 nt, Human
gcuacugccaucc

SEQ ID NO: 3763443 - RNA, 20 nt, Human
gcuacugccauccuggccca

SEQ ID NO: 3763444 - RNA, 22 nt, Human
gcuacugccgucagugcugugc

SEQ ID NO: 3763445 - RNA, 18 nt, Human
gcuacuggcauaguuuca

SEQ ID NO: 3763446 - RNA, 19 nt, Human
gcuacuguaaggcaaucau

SEQ ID NO: 3763447 - RNA, 19 nt, Human
gcuacuguccuacccaccc

SEQ ID NO: 3763448 - RNA, 20 nt, Human
gcuacuguccuacccacccu

SEQ ID NO: 3763449 - RNA, 15 nt, Human
gcuacugugugugug

SEQ ID NO: 3763450 - RNA, 19 nt, Human
gcuacuguuguaagaauuc

SEQ ID NO: 3763451 - RNA, 20 nt, Human
gcuacuuccugccuggucuc

SEQ ID NO: 3763452 - RNA, 21 nt, Human
gcuacuuccugccuggucucc

SEQ ID NO: 3763453 - RNA, 13 nt, Human
gcuacuugggagg

SEQ ID NO: 3763454 - RNA, 16 nt, Human
gcuacuugguggguuu

SEQ ID NO: 3763455 - RNA, 16 nt, Human
gcuacuuugcugcuau

SEQ ID NO: 3763456 - RNA, 23 nt, Human
gcuacuuugcugcuaugguuuuc

SEQ ID NO: 3763457 - RNA, 19 nt, Human
gcuagaaaaauuguuaagg

SEQ ID NO: 3763458 - RNA, 14 nt, Human
gcuagaacaugguu

SEQ ID NO: 3763459 - RNA, 14 nt, Human
gcuagaacccucug

SEQ ID NO: 3763460 - RNA, 15 nt, Human
gcuagaacccucugu

SEQ ID NO: 3763461 - RNA, 15 nt, Human
gcuagaaccuggaga

SEQ ID NO: 3763462 - RNA, 20 nt, Human
gcuagaaccuggagagcuag

SEQ ID NO: 3763463 - RNA, 13 nt, Human
gcuagaacucccu

SEQ ID NO: 3763464 - RNA, 20 nt, Human
gcuagaacucccuuucaaca

SEQ ID NO: 3763465 - RNA, 11 nt, Human
gcuagaacuuu

SEQ ID NO: 3763466 - RNA, 20 nt, Human
gcuagaacuuuuuuaaauaa

SEQ ID NO: 3763467 - RNA, 22 nt, Human
gcuagaacuuuuuuaaauaaac

SEQ ID NO: 3763468 - RNA, 23 nt, Human
gcuagaagaaaacaaacugucac

SEQ ID NO: 3763469 - RNA, 13 nt, Human
gcuagaaggccac

SEQ ID NO: 3763470 - RNA, 15 nt, Human
gcuagaaggccacau

SEQ ID NO: 3763471 - RNA, 21 nt, Human
gcuagaagugggccaggacag

SEQ ID NO: 3763472 - RNA, 17 nt, Human
gcuagaauauccuacuu

SEQ ID NO: 3763473 - RNA, 22 nt, Human
gcuagaauucccucucucugac

SEQ ID NO: 3763474 - RNA, 21 nt, Human
gcuagaauugaguguuuaaag

SEQ ID NO: 3763475 - RNA, 23 nt, Human
gcuagacacaugaagguaaauaa

SEQ ID NO: 3763476 - RNA, 15 nt, Human
gcuagacuggugacu

SEQ ID NO: 3763477 - RNA, 16 nt, Human
gcuagacuggugacug

SEQ ID NO: 3763478 - RNA, 19 nt, Human
gcuagacuggugacugauu

SEQ ID NO: 3763479 - RNA, 21 nt, Human
gcuagagauauggcagcgaaa

SEQ ID NO: 3763480 - RNA, 15 nt, Human
gcuagagcuccuccc

SEQ ID NO: 3763481 - RNA, 17 nt, Human
gcuagagcuccucccuc

SEQ ID NO: 3763482 - RNA, 22 nt, Human
gcuagagcuucaagucugugcc

SEQ ID NO: 3763483 - RNA, 18 nt, Human
gcuagaggccagccccac

SEQ ID NO: 3763484 - RNA, 19 nt, Human
gcuagaggccagccccacc

SEQ ID NO: 3763485 - RNA, 13 nt, Human
gcuagaguccuca

SEQ ID NO: 3763486 - RNA, 19 nt, Human
gcuagaucauuuguucugg

SEQ ID NO: 3763487 - RNA, 23 nt, Human
gcuagaugagaauucagcugccc

SEQ ID NO: 3763488 - RNA, 17 nt, Human
gcuagcaaaagaaguaa

SEQ ID NO: 3763489 - RNA, 22 nt, Human
gcuagcaaaagaaguaacaaga

SEQ ID NO: 3763490 - RNA, 12 nt, Human
gcuagcaaauag

SEQ ID NO: 3763491 - RNA, 14 nt, Human
gcuagcacagcucc

SEQ ID NO: 3763492 - RNA, 16 nt, Human
gcuagcaguggcaggc

SEQ ID NO: 3763493 - RNA, 18 nt, Human
gcuagcaguggcaggcag

SEQ ID NO: 3763494 - RNA, 20 nt, Human
gcuagcaguggcaggcagag

SEQ ID NO: 3763495 - RNA, 14 nt, Human
gcuagcaucccuga

SEQ ID NO: 3763496 - RNA, 13 nt, Human
gcuagccagagga

SEQ ID NO: 3763497 - RNA, 21 nt, Human
gcuagcgcugccgcaccccag

SEQ ID NO: 3763498 - RNA, 12 nt, Human
gcuagcucaacu

SEQ ID NO: 3763499 - RNA, 16 nt, Human
gcuagcugcagagcca

SEQ ID NO: 3763500 - RNA, 15 nt, Human
gcuagcuucugcuuu

SEQ ID NO: 3763501 - RNA, 17 nt, Human
gcuagcuucugcuuuuc

SEQ ID NO: 3763502 - RNA, 23 nt, Human
gcuagcuucugcuuuucugcccu

SEQ ID NO: 3763503 - RNA, 12 nt, Human
gcuaggaagagg

SEQ ID NO: 3763504 - RNA, 13 nt, Human
gcuaggaaugaaa

SEQ ID NO: 3763505 - RNA, 21 nt, Human
gcuaggaauuguguuuauaau

SEQ ID NO: 3763506 - RNA, 22 nt, Human
gcuaggaccccuccaugugggc

SEQ ID NO: 3763507 - RNA, 19 nt, Human
gcuaggagcaaagccuguu

SEQ ID NO: 3763508 - RNA, 22 nt, Human
gcuaggcagggugucugccccc

SEQ ID NO: 3763509 - RNA, 14 nt, Human
gcuaggccuggcca

SEQ ID NO: 3763510 - RNA, 16 nt, Human
gcuaggccuggccaga

SEQ ID NO: 3763511 - RNA, 23 nt, Human
gcuaggccuggccagaugcacca

SEQ ID NO: 3763512 - RNA, 20 nt, Human
gcuaggcgagugccaggacu

SEQ ID NO: 3763513 - RNA, 17 nt, Human
gcuaggggacaucagag

SEQ ID NO: 3763514 - RNA, 20 nt, Human
gcuagguagaaaaaggguca

SEQ ID NO: 3763515 - RNA, 18 nt, Human
gcuaggugggccagcccc

SEQ ID NO: 3763516 - RNA, 20 nt, Human
gcuaggugggccagccccuc

SEQ ID NO: 3763517 - RNA, 21 nt, Human
gcuaggugggccagccccucc

SEQ ID NO: 3763518 - RNA, 18 nt, Human
gcuaguauuugaauuaaa

SEQ ID NO: 3763519 - RNA, 16 nt, Human
gcuagucaagcuccuc

SEQ ID NO: 3763520 - RNA, 19 nt, Human
gcuagucaagcuccuccuc

SEQ ID NO: 3763521 - RNA, 20 nt, Human
gcuaguccggacccaccuca

SEQ ID NO: 3763522 - RNA, 19 nt, Human
gcuaguccuagugaaccuc

SEQ ID NO: 3763523 - RNA, 12 nt, Human
gcuagucuuuug

SEQ ID NO: 3763524 - RNA, 19 nt, Human
gcuaguguucuuucucuuu

SEQ ID NO: 3763525 - RNA, 13 nt, Human
gcuaguugaauac

SEQ ID NO: 3763526 - RNA, 18 nt, Human
gcuaguugaauacuugaa

SEQ ID NO: 3763527 - RNA, 19 nt, Human
gcuaguugaauacuugaac

SEQ ID NO: 3763528 - RNA, 16 nt, Human
gcuaguugggcuuccu

SEQ ID NO: 3763529 - RNA, 21 nt, Human
gcuauaaagcaguauuuuucu

SEQ ID NO: 3763530 - RNA, 13 nt, Human
gcuauaaauauau

SEQ ID NO: 3763531 - RNA, 15 nt, Human
gcuauaacuaagcau

SEQ ID NO: 3763532 - RNA, 16 nt, Human
gcuauaauaaagaagu

SEQ ID NO: 3763533 - RNA, 23 nt, Human
gcuauagacccgaggaaacucag

SEQ ID NO: 3763534 - RNA, 16 nt, Human
gcuauagaugucuuuu

SEQ ID NO: 3763535 - RNA, 20 nt, Human
gcuauagaugucuuuuccca

SEQ ID NO: 3763536 - RNA, 21 nt, Human
gcuauagaugucuuuucccau

SEQ ID NO: 3763537 - RNA, 17 nt, Human
gcuauagccuggggugg

SEQ ID NO: 3763538 - RNA, 21 nt, Human
gcuauaggugcuacaaaaaca

SEQ ID NO: 3763539 - RNA, 11 nt, Human
gcuauauauau

SEQ ID NO: 3763540 - RNA, 13 nt, Human
gcuauauauauaa

SEQ ID NO: 3763541 - RNA, 17 nt, Human
gcuauauccauguacug

SEQ ID NO: 3763542 - RNA, 18 nt, Human
gcuauauccauguacugu

SEQ ID NO: 3763543 - RNA, 21 nt, Human
gcuauauccauguacuguagu

SEQ ID NO: 3763544 - RNA, 15 nt, Human
gcuauauuuaaguau

SEQ ID NO: 3763545 - RNA, 21 nt, Human
gcuauauuuaaguauucaaga

SEQ ID NO: 3763546 - RNA, 22 nt, Human
gcuauauuuaaguauucaagaa

SEQ ID NO: 3763547 - RNA, 14 nt, Human
gcuauauuuucaug

SEQ ID NO: 3763548 - RNA, 19 nt, Human
gcuaucaagaggcugagac

SEQ ID NO: 3763549 - RNA, 16 nt, Human
gcuaucaggagaaagc

SEQ ID NO: 3763550 - RNA, 19 nt, Human
gcuauccagcuauuuuuau

SEQ ID NO: 3763551 - RNA, 19 nt, Human
gcuauccccaucucccugc

SEQ ID NO: 3763552 - RNA, 17 nt, Human
gcuaucguaaaauuaag

SEQ ID NO: 3763553 - RNA, 15 nt, Human
gcuaucucccccagc

SEQ ID NO: 3763554 - RNA, 17 nt, Human
gcuaucucccccagccc

SEQ ID NO: 3763555 - RNA, 22 nt, Human
gcuaucucccccagccccaucc

SEQ ID NO: 3763556 - RNA, 23 nt, Human
gcuaucucccccagccccauccu

SEQ ID NO: 3763557 - RNA, 13 nt, Human
gcuaucucugugu

SEQ ID NO: 3763558 - RNA, 21 nt, Human
gcuaucuggaggccuuccagc

SEQ ID NO: 3763559 - RNA, 16 nt, Human
gcuaugcucaggggcc

SEQ ID NO: 3763560 - RNA, 20 nt, Human
gcuaugcucaggggcccugg

SEQ ID NO: 3763561 - RNA, 14 nt, Human
gcuauggacacagg

SEQ ID NO: 3763562 - RNA, 13 nt, Human
gcuaugggagccc

SEQ ID NO: 3763563 - RNA, 19 nt, Human
gcuauggggauagaugugu

SEQ ID NO: 3763564 - RNA, 22 nt, Human
gcuauggugagaugcagcugga

SEQ ID NO: 3763565 - RNA, 22 nt, Human
gcuauguauggaauacaguguu

SEQ ID NO: 3763566 - RNA, 17 nt, Human
gcuaugucauuucaugu

SEQ ID NO: 3763567 - RNA, 18 nt, Human
gcuauguuuuuaauguau

SEQ ID NO: 3763568 - RNA, 15 nt, Human
gcuauuaaaaaaguc

SEQ ID NO: 3763569 - RNA, 16 nt, Human
gcuauuaaaacucagc

SEQ ID NO: 3763570 - RNA, 19 nt, Human
gcuauuaaaacucuuuuaa

SEQ ID NO: 3763571 - RNA, 23 nt, Human
gcuauuacgaaguucaagaucaa

SEQ ID NO: 3763572 - RNA, 17 nt, Human
gcuauuauuuucacugu

SEQ ID NO: 3763573 - RNA, 19 nt, Human
gcuauucaguaauaacucu

SEQ ID NO: 3763574 - RNA, 21 nt, Human
gcuauuccuuucccuuccucu

SEQ ID NO: 3763575 - RNA, 14 nt, Human
gcuauucugucccu

SEQ ID NO: 3763576 - RNA, 16 nt, Human
gcuauucugucccuag

SEQ ID NO: 3763577 - RNA, 19 nt, Human
gcuauucugucccuaggug

SEQ ID NO: 3763578 - RNA, 16 nt, Human
gcuauugacaagucau

SEQ ID NO: 3763579 - RNA, 14 nt, Human
gcuauugacaauaa

SEQ ID NO: 3763580 - RNA, 19 nt, Human
gcuauuggaggaucaguuu

SEQ ID NO: 3763581 - RNA, 21 nt, Human
gcuauuucccaagcuggagug

SEQ ID NO: 3763582 - RNA, 16 nt, Human
gcuauuucuauauuuu

SEQ ID NO: 3763583 - RNA, 19 nt, Human
gcuauuucuauauuuucau

SEQ ID NO: 3763584 - RNA, 14 nt, Human
gcuauuugaagugu

SEQ ID NO: 3763585 - RNA, 15 nt, Human
gcuauuugauguaau

SEQ ID NO: 3763586 - RNA, 23 nt, Human
gcuauuuuauauuacacuacaca

SEQ ID NO: 3763587 - RNA, 17 nt, Human
gcuauuuucuaaagacu

SEQ ID NO: 3763588 - RNA, 14 nt, Human
cuucaccuuugucc

SEQ ID NO: 3763589 - RNA, 17 nt, Human
cuucaccuuugucccca

SEQ ID NO: 3763590 - RNA, 21 nt, Human
cuucaccuuuguccccaccgc

SEQ ID NO: 3763591 - RNA, 22 nt, Human
cuucaccuuuguccccaccgca

SEQ ID NO: 3763592 - RNA, 19 nt, Human
cuucacgaaguguugcaug

SEQ ID NO: 3763593 - RNA, 17 nt, Human
cuucacgcccuuggcca

SEQ ID NO: 3763594 - RNA, 13 nt, Human
cuucacggcagga

SEQ ID NO: 3763595 - RNA, 17 nt, Human
cuucacggcaggacaac

SEQ ID NO: 3763596 - RNA, 23 nt, Human
cuucacuaagaacaaaagaagca

SEQ ID NO: 3763597 - RNA, 17 nt, Human
cuucacucaaauuuugg

SEQ ID NO: 3763598 - RNA, 19 nt, Human
cuucacuccggugugccug

SEQ ID NO: 3763599 - RNA, 23 nt, Human
cuucacuccggugugccugcagc

SEQ ID NO: 3763600 - RNA, 13 nt, Human
cuucacuccugcu

SEQ ID NO: 3763601 - RNA, 20 nt, Human
cuucacucugggcacacucu

SEQ ID NO: 3763602 - RNA, 19 nt, Human
cuucacucuucaaaugccu

SEQ ID NO: 3763603 - RNA, 15 nt, Human
cuucacugccuuugc

SEQ ID NO: 3763604 - RNA, 15 nt, Human
cuucacuguaaaaua

SEQ ID NO: 3763605 - RNA, 16 nt, Human
cuucacuguauaaaua

SEQ ID NO: 3763606 - RNA, 23 nt, Human
cuucacuguauaaauaggagagg

SEQ ID NO: 3763607 - RNA, 17 nt, Human
cuucacuguccuccaag

SEQ ID NO: 3763608 - RNA, 18 nt, Human
cuucacuguccuccaagc

SEQ ID NO: 3763609 - RNA, 19 nt, Human
cuucacugugaccuugaga

SEQ ID NO: 3763610 - RNA, 19 nt, Human
cuucacuguugaaaauuau

SEQ ID NO: 3763611 - RNA, 17 nt, Human
cuucacuucugaccaca

SEQ ID NO: 3763612 - RNA, 19 nt, Human
cuucacuucugaccacacu

SEQ ID NO: 3763613 - RNA, 21 nt, Human
cuucacuucugaccacacuuc

SEQ ID NO: 3763614 - RNA, 14 nt, Human
cuucacuucugacu

SEQ ID NO: 3763615 - RNA, 15 nt, Human
cuucacuuuaauucu

SEQ ID NO: 3763616 - RNA, 16 nt, Human
cuucacuuuaauucuc

SEQ ID NO: 3763617 - RNA, 21 nt, Human
cuucacuuuugcaagguucca

SEQ ID NO: 3763618 - RNA, 16 nt, Human
cuucagaaugugauuu

SEQ ID NO: 3763619 - RNA, 20 nt, Human
cuucagaauuccauaucuug

SEQ ID NO: 3763620 - RNA, 20 nt, Human
cuucagacagagaggacugu

SEQ ID NO: 3763621 - RNA, 14 nt, Human
cuucagacucucag

SEQ ID NO: 3763622 - RNA, 19 nt, Human
cuucagacuuugcuuccca

SEQ ID NO: 3763623 - RNA, 19 nt, Human
cuucagagacuccugcagg

SEQ ID NO: 3763624 - RNA, 21 nt, Human
cuucagagacuccugcaggca

SEQ ID NO: 3763625 - RNA, 14 nt, Human
cuucagagagcagu

SEQ ID NO: 3763626 - RNA, 17 nt, Human
cuucagagagcagugcu

SEQ ID NO: 3763627 - RNA, 22 nt, Human
cuucagagagcugguaguuagu

SEQ ID NO: 3763628 - RNA, 12 nt, Human
cuucagagcagg

SEQ ID NO: 3763629 - RNA, 10 nt, Human
cuucagaggc

SEQ ID NO: 3763630 - RNA, 23 nt, Human
cuucagaggcccucgcugccagc

SEQ ID NO: 3763631 - RNA, 19 nt, Human
cuucagagggaaaguaaau

SEQ ID NO: 3763632 - RNA, 21 nt, Human
cuucagagguggcucuggaau

SEQ ID NO: 3763633 - RNA, 19 nt, Human
cuucagauauuauugcuuu

SEQ ID NO: 3763634 - RNA, 15 nt, Human
cuucagaucagugcu

SEQ ID NO: 3763635 - RNA, 17 nt, Human
cuucagaugccacuucu

SEQ ID NO: 3763636 - RNA, 18 nt, Human
cuucagauggaaacucuu

SEQ ID NO: 3763637 - RNA, 19 nt, Human
cuucagauguggagccagg

SEQ ID NO: 3763638 - RNA, 20 nt, Human
cuucagauguggagccaggc

SEQ ID NO: 3763639 - RNA, 16 nt, Human
cuucagcacuuuagaa

SEQ ID NO: 3763640 - RNA, 18 nt, Human
cuucagcauauuuauagc

SEQ ID NO: 3763641 - RNA, 13 nt, Human
cuucagcauuccc

SEQ ID NO: 3763642 - RNA, 21 nt, Human
cuucagcauucccucccauca

SEQ ID NO: 3763643 - RNA, 19 nt, Human
cuucagccaggagcugggc

SEQ ID NO: 3763644 - RNA, 14 nt, Human
cuucagccaucaac

SEQ ID NO: 3763645 - RNA, 16 nt, Human
cuucagcccucacccc

SEQ ID NO: 3763646 - RNA, 21 nt, Human
cuucagccuagccgaccucag

SEQ ID NO: 3763647 - RNA, 16 nt, Human
cuucagccuaguggcu

SEQ ID NO: 3763648 - RNA, 16 nt, Human
cuucagccucccgagu

SEQ ID NO: 3763649 - RNA, 15 nt, Human
cuucagccugaaaga

SEQ ID NO: 3763650 - RNA, 15 nt, Human
cuucagccugaggcu

SEQ ID NO: 3763651 - RNA, 13 nt, Human
cuucagccuuaau

SEQ ID NO: 3763652 - RNA, 16 nt, Human
cuucagcguaaaaugg

SEQ ID NO: 3763653 - RNA, 21 nt, Human
cuucagcuagcuuuuaggaaa

SEQ ID NO: 3763654 - RNA, 11 nt, Human
cuucagcucca

SEQ ID NO: 3763655 - RNA, 16 nt, Human
cuucagcuccagcccc

SEQ ID NO: 3763656 - RNA, 11 nt, Human
cuucagcugac

SEQ ID NO: 3763657 - RNA, 19 nt, Human
cuucagcuguacuucgucu

SEQ ID NO: 3763658 - RNA, 19 nt, Human
cuucaggacacucacuaca

SEQ ID NO: 3763659 - RNA, 18 nt, Human
cuucaggcaauucuccug

SEQ ID NO: 3763660 - RNA, 22 nt, Human
cuucaggcaauucuccugccuu

SEQ ID NO: 3763661 - RNA, 17 nt, Human
cuucaggcucuucuccu

SEQ ID NO: 3763662 - RNA, 19 nt, Human
cuucagggcacugcugcug

SEQ ID NO: 3763663 - RNA, 16 nt, Human
cuucagggcagauuuu

SEQ ID NO: 3763664 - RNA, 16 nt, Human
cuucagggcugcuggg

SEQ ID NO: 3763665 - RNA, 22 nt, Human
cuucaggggagucccgucagga

SEQ ID NO: 3763666 - RNA, 16 nt, Human
cuucaggggcugcccg

SEQ ID NO: 3763667 - RNA, 18 nt, Human
cuucaggggcugcccgcu

SEQ ID NO: 3763668 - RNA, 20 nt, Human
cuucaggggcugcccgcucc

SEQ ID NO: 3763669 - RNA, 23 nt, Human
cuucagggggccaggugcacaga

SEQ ID NO: 3763670 - RNA, 22 nt, Human
cuucagguaaagggcaaauaau

SEQ ID NO: 3763671 - RNA, 10 nt, Human
cuucaggucc

SEQ ID NO: 3763672 - RNA, 16 nt, Human
cuucagguggaaaaac

SEQ ID NO: 3763673 - RNA, 20 nt, Human
cuucagguuaucgaaauaac

SEQ ID NO: 3763674 - RNA, 22 nt, Human
cuucagguuaucgaaauaacaa

SEQ ID NO: 3763675 - RNA, 20 nt, Human
cuucaguaacccccacugga

SEQ ID NO: 3763676 - RNA, 22 nt, Human
cuucaguaacccccacuggacu

SEQ ID NO: 3763677 - RNA, 23 nt, Human
cuucaguaagccgugauuuucau

SEQ ID NO: 3763678 - RNA, 22 nt, Human
cuucaguacccucucagcucca

SEQ ID NO: 3763679 - RNA, 15 nt, Human
cuucaguauguuguc

SEQ ID NO: 3763680 - RNA, 22 nt, Human
cuucaguauguugucaaagaga

SEQ ID NO: 3763681 - RNA, 18 nt, Human
cuucaguccugcuccaga

SEQ ID NO: 3763682 - RNA, 23 nt, Human
cuucaguccugcuccagaauuug

SEQ ID NO: 3763683 - RNA, 13 nt, Human
cuucaguccuggg

SEQ ID NO: 3763684 - RNA, 18 nt, Human
cuucaguccugggagacc

SEQ ID NO: 3763685 - RNA, 19 nt, Human
cuucagugcaucugggaag

SEQ ID NO: 3763686 - RNA, 13 nt, Human
cuucagugcccac

SEQ ID NO: 3763687 - RNA, 22 nt, Human
cuucagugccuuauggaacacu

SEQ ID NO: 3763688 - RNA, 17 nt, Human
cuucaguggagaauuau

SEQ ID NO: 3763689 - RNA, 13 nt, Human
cuucaguggcagc

SEQ ID NO: 3763690 - RNA, 16 nt, Human
cuucaguggcagcugc

SEQ ID NO: 3763691 - RNA, 18 nt, Human
cuucaguuaagccuuugg

SEQ ID NO: 3763692 - RNA, 17 nt, Human
cuucaguugguguguuu

SEQ ID NO: 3763693 - RNA, 22 nt, Human
cuucaguugguguguuuuuggg

SEQ ID NO: 3763694 - RNA, 14 nt, Human
cuucaguugguugu

SEQ ID NO: 3763695 - RNA, 15 nt, Human
cuucaguugguugug

SEQ ID NO: 3763696 - RNA, 13 nt, Human
cuucaguugucuc

SEQ ID NO: 3763697 - RNA, 14 nt, Human
cuucaguugucucu

SEQ ID NO: 3763698 - RNA, 15 nt, Human
cuucaguuucacaga

SEQ ID NO: 3763699 - RNA, 17 nt, Human
cuucaguuucacagaaa

SEQ ID NO: 3763700 - RNA, 15 nt, Human
cuucauaacaauuuu

SEQ ID NO: 3763701 - RNA, 15 nt, Human
cuucauaauggccug

SEQ ID NO: 3763702 - RNA, 9 nt, Human
cuucauaca

SEQ ID NO: 3763703 - RNA, 20 nt, Human
cuucauaccuacauguauuu

SEQ ID NO: 3763704 - RNA, 21 nt, Human
cuucauacuuuuuuucacagu

SEQ ID NO: 3763705 - RNA, 16 nt, Human
cuucauaucauccaca

SEQ ID NO: 3763706 - RNA, 22 nt, Human
cuucauaugaaaggugccaugg

SEQ ID NO: 3763707 - RNA, 19 nt, Human
cuucaucccacuccaacuc

SEQ ID NO: 3763708 - RNA, 16 nt, Human
cuucaucccauuccag

SEQ ID NO: 3763709 - RNA, 13 nt, Human
cuucaucccuuuc

SEQ ID NO: 3763710 - RNA, 16 nt, Human
cuucaucccuuuccag

SEQ ID NO: 3763711 - RNA, 19 nt, Human
cuucauccggcagccugga

SEQ ID NO: 3763712 - RNA, 15 nt, Human
cuucauccuccucag

SEQ ID NO: 3763713 - RNA, 22 nt, Human
cuucaucucccaaagugcuggg

SEQ ID NO: 3763714 - RNA, 20 nt, Human
cuucaucucccaccuagcag

SEQ ID NO: 3763715 - RNA, 12 nt, Human
cuucaucugacu

SEQ ID NO: 3763716 - RNA, 21 nt, Human
cuucaucugacuaugacauaa

SEQ ID NO: 3763717 - RNA, 11 nt, Human
cuucaucugga

SEQ ID NO: 3763718 - RNA, 19 nt, Human
cuucaucuggauuccagag

SEQ ID NO: 3763719 - RNA, 19 nt, Human
cuucaucuggcaacaucuu

SEQ ID NO: 3763720 - RNA, 17 nt, Human
cuucaucuucccaggua

SEQ ID NO: 3763721 - RNA, 20 nt, Human
cuucaucuucucagcuccca

SEQ ID NO: 3763722 - RNA, 15 nt, Human
cuucaucuuuuaaag

SEQ ID NO: 3763723 - RNA, 16 nt, Human
cuucaugaaaauccua

SEQ ID NO: 3763724 - RNA, 17 nt, Human
cuucaugaaaauccuac

SEQ ID NO: 3763725 - RNA, 18 nt, Human
cuucaugaaaauccuacc

SEQ ID NO: 3763726 - RNA, 13 nt, Human
cuucaugaaaugc

SEQ ID NO: 3763727 - RNA, 23 nt, Human
cuucaugcugucuacacuaagag

SEQ ID NO: 3763728 - RNA, 18 nt, Human
cuucauggaauggacauc

SEQ ID NO: 3763729 - RNA, 20 nt, Human
cuucauggaauggacauccu

SEQ ID NO: 3763730 - RNA, 21 nt, Human
cuucauggaauucacaaagua

SEQ ID NO: 3763731 - RNA, 10 nt, Human
cuucauggau

SEQ ID NO: 3763732 - RNA, 13 nt, Human
cuucauggauggg

SEQ ID NO: 3763733 - RNA, 23 nt, Human
cuucauggaugggggaacucaga

SEQ ID NO: 3763734 - RNA, 21 nt, Human
cuucauggcagaaggcaaacc

SEQ ID NO: 3763735 - RNA, 15 nt, Human
cuucaugugucccag

SEQ ID NO: 3763736 - RNA, 20 nt, Human
cuucauguucccacuucaaa

SEQ ID NO: 3763737 - RNA, 20 nt, Human
gcugcccccaccccggggac

SEQ ID NO: 3763738 - RNA, 15 nt, Human
gcugcccccagagcc

SEQ ID NO: 3763739 - RNA, 14 nt, Human
gcugcccccggccc

SEQ ID NO: 3763740 - RNA, 23 nt, Human
gcugcccccggcccccuggucuc

SEQ ID NO: 3763741 - RNA, 22 nt, Human
gcugccccggccccucccccug

SEQ ID NO: 3763742 - RNA, 23 nt, Human
gcugccccggccccucccccuga

SEQ ID NO: 3763743 - RNA, 19 nt, Human
gcugccccuaaucucugua

SEQ ID NO: 3763744 - RNA, 22 nt, Human
gcugccccuaaucucuguagga

SEQ ID NO: 3763745 - RNA, 14 nt, Human
gcugccccucucug

SEQ ID NO: 3763746 - RNA, 15 nt, Human
gcugccccucucugg

SEQ ID NO: 3763747 - RNA, 17 nt, Human
gcugccccucucugggc

SEQ ID NO: 3763748 - RNA, 13 nt, Human
gcugccccuggca

SEQ ID NO: 3763749 - RNA, 16 nt, Human
gcugccccuggcagcc

SEQ ID NO: 3763750 - RNA, 20 nt, Human
gcugccccuggcagccccug

SEQ ID NO: 3763751 - RNA, 20 nt, Human
gcugccccuggugcacuggc

SEQ ID NO: 3763752 - RNA, 12 nt, Human
gcugcccgcucc

SEQ ID NO: 3763753 - RNA, 16 nt, Human
gcugcccgcucccagu

SEQ ID NO: 3763754 - RNA, 20 nt, Human
gcugcccgcucccagugucu

SEQ ID NO: 3763755 - RNA, 21 nt, Human
gcugcccuacagcacccugug

SEQ ID NO: 3763756 - RNA, 15 nt, Human
gcugcccuaggcucc

SEQ ID NO: 3763757 - RNA, 19 nt, Human
gcugcccuccaucccgaca

SEQ ID NO: 3763758 - RNA, 21 nt, Human
gcugcccuccugugcucagcc

SEQ ID NO: 3763759 - RNA, 23 nt, Human
gcugcccuccugugcucagcccu

SEQ ID NO: 3763760 - RNA, 20 nt, Human
gcugcccuccuuguccaccc

SEQ ID NO: 3763761 - RNA, 16 nt, Human
gcugcccucuccuggg

SEQ ID NO: 3763762 - RNA, 23 nt, Human
gcugcccucuccugggcagcugc

SEQ ID NO: 3763763 - RNA, 14 nt, Human
gcugcccugaagaa

SEQ ID NO: 3763764 - RNA, 18 nt, Human
gcugcccugagaagcugc

SEQ ID NO: 3763765 - RNA, 22 nt, Human
gcugcccugagcgccuggauuu

SEQ ID NO: 3763766 - RNA, 15 nt, Human
gcugcccugccacuu

SEQ ID NO: 3763767 - RNA, 12 nt, Human
gcugcccugccc

SEQ ID NO: 3763768 - RNA, 22 nt, Human
gcugcccugcccaccuggccuc

SEQ ID NO: 3763769 - RNA, 24 nt, Human
gcugcccugcccaccuggccucug

SEQ ID NO: 3763770 - RNA, 13 nt, Human
gcugcccuggccc

SEQ ID NO: 3763771 - RNA, 19 nt, Human
gcugcccuggcccugaggu

SEQ ID NO: 3763772 - RNA, 15 nt, Human
gcugcccuggugcug

SEQ ID NO: 3763773 - RNA, 17 nt, Human
gcugcccuggugcugcc

SEQ ID NO: 3763774 - RNA, 20 nt, Human
gcugcccuggugcugccaca

SEQ ID NO: 3763775 - RNA, 22 nt, Human
gcugcccuggugcugccacacu

SEQ ID NO: 3763776 - RNA, 23 nt, Human
gcugcccuggugcugccacacuu

SEQ ID NO: 3763777 - RNA, 14 nt, Human
gcugcccugugagu

SEQ ID NO: 3763778 - RNA, 20 nt, Human
gcugcccuugggccaccccu

SEQ ID NO: 3763779 - RNA, 17 nt, Human
gcugcccuuucugggca

SEQ ID NO: 3763780 - RNA, 16 nt, Human
gcugccgaccagagcc

SEQ ID NO: 3763781 - RNA, 13 nt, Human
gcugccgccuccc

SEQ ID NO: 3763782 - RNA, 15 nt, Human
gcugccgccucccag

SEQ ID NO: 3763783 - RNA, 16 nt, Human
gcugccgccucccagc

SEQ ID NO: 3763784 - RNA, 18 nt, Human
gcugccgccucccagccu

SEQ ID NO: 3763785 - RNA, 22 nt, Human
gcugccuaaauccacucugcag

SEQ ID NO: 3763786 - RNA, 15 nt, Human
gcugccuaagacaug

SEQ ID NO: 3763787 - RNA, 18 nt, Human
gcugccuaaguggcugcu

SEQ ID NO: 3763788 - RNA, 12 nt, Human
gcugccucacuu

SEQ ID NO: 3763789 - RNA, 14 nt, Human
gcugccucauuuag

SEQ ID NO: 3763790 - RNA, 14 nt, Human
gcugccuccacucc

SEQ ID NO: 3763791 - RNA, 16 nt, Human
gcugccuccacuccca

SEQ ID NO: 3763792 - RNA, 18 nt, Human
gcugccuccacucccacu

SEQ ID NO: 3763793 - RNA, 20 nt, Human
gcugccuccacucccacuuc

SEQ ID NO: 3763794 - RNA, 19 nt, Human
gcugccuccccaacccugc

SEQ ID NO: 3763795 - RNA, 14 nt, Human
gcugccuccccucc

SEQ ID NO: 3763796 - RNA, 14 nt, Human
gcugccucuucccu

SEQ ID NO: 3763797 - RNA, 18 nt, Human
gcugccucuucccucuuc

SEQ ID NO: 3763798 - RNA, 16 nt, Human
gcugccugaaaaucaa

SEQ ID NO: 3763799 - RNA, 16 nt, Human
gcuguuggcacucaca

SEQ ID NO: 3763800 - RNA, 21 nt, Human
gcuguuggcugggggccucag

SEQ ID NO: 3763801 - RNA, 14 nt, Human
gcuguuguacauuu

SEQ ID NO: 3763802 - RNA, 16 nt, Human
gcuguuguacauuuau

SEQ ID NO: 3763803 - RNA, 16 nt, Human
gcuguugucccucugc

SEQ ID NO: 3763804 - RNA, 17 nt, Human
gcuguugucccucugcu

SEQ ID NO: 3763805 - RNA, 15 nt, Human
gcuguugucucuucu

SEQ ID NO: 3763806 - RNA, 13 nt, Human
gcuguuguuauga

SEQ ID NO: 3763807 - RNA, 19 nt, Human
gcuguuguuaugaugugcu

SEQ ID NO: 3763808 - RNA, 18 nt, Human
gcuguuguuccauugaag

SEQ ID NO: 3763809 - RNA, 22 nt, Human
gcuguuuacuugaauaguauug

SEQ ID NO: 3763810 - RNA, 17 nt, Human
gcuguuuauggccucag

SEQ ID NO: 3763811 - RNA, 20 nt, Human
gcuguuugcuucaccgugga

SEQ ID NO: 3763812 - RNA, 18 nt, Human
gcuguuuguagugaaaua

SEQ ID NO: 3763813 - RNA, 16 nt, Human
gcuguuuuaaacauua

SEQ ID NO: 3763814 - RNA, 17 nt, Human
gcuguuuucccugaccu

SEQ ID NO: 3763815 - RNA, 16 nt, Human
gcuguuuuccucccuu

SEQ ID NO: 3763816 - RNA, 23 nt, Human
gcuguuuuguugacauucugaau

SEQ ID NO: 3763817 - RNA, 13 nt, Human
gcuuaaaaaaaac

SEQ ID NO: 3763818 - RNA, 15 nt, Human
gcuuaaaacuuuuca

SEQ ID NO: 3763819 - RNA, 21 nt, Human
gcuuaaaauaagcagguggau

SEQ ID NO: 3763820 - RNA, 12 nt, Human
gcuuaaaauaca

SEQ ID NO: 3763821 - RNA, 18 nt, Human
gcuuaaaauacaagacug

SEQ ID NO: 3763822 - RNA, 12 nt, Human
gcuuaaagaugu

SEQ ID NO: 3763823 - RNA, 17 nt, Human
gcuuaaaggugucuucc

SEQ ID NO: 3763824 - RNA, 12 nt, Human
gcuuaaauguga

SEQ ID NO: 3763825 - RNA, 21 nt, Human
gcuuaaauuucuuaugugaca

SEQ ID NO: 3763826 - RNA, 13 nt, Human
gcuuaaauuuuaa

SEQ ID NO: 3763827 - RNA, 15 nt, Human
gcuuaagcagaagca

SEQ ID NO: 3763828 - RNA, 15 nt, Human
gcuuaagccacugcc

SEQ ID NO: 3763829 - RNA, 11 nt, Human
gcuuaaguucc

SEQ ID NO: 3763830 - RNA, 22 nt, Human
gcuuaaucuucaaagccuucuc

SEQ ID NO: 3763831 - RNA, 18 nt, Human
gcuuaaugacacuagcua

SEQ ID NO: 3763832 - RNA, 18 nt, Human
gcuuaaugcuacauguga

SEQ ID NO: 3763833 - RNA, 15 nt, Human
gcuuaauucaaauaa

SEQ ID NO: 3763834 - RNA, 13 nt, Human
gcuuaauuucuaa

SEQ ID NO: 3763835 - RNA, 13 nt, Human
gcuuacaagccag

SEQ ID NO: 3763836 - RNA, 20 nt, Human
gcuuacaauucccugcuguc

SEQ ID NO: 3763837 - RNA, 15 nt, Human
gcuuacauaguuuua

SEQ ID NO: 3763838 - RNA, 22 nt, Human
gcuuacaugccuaccaauauuu

SEQ ID NO: 3763839 - RNA, 18 nt, Human
gcuuacauuuuuacaaua

SEQ ID NO: 3763840 - RNA, 15 nt, Human
gcuuaccucccaccu

SEQ ID NO: 3763841 - RNA, 14 nt, Human
gcuuaccugacaca

SEQ ID NO: 3763842 - RNA, 19 nt, Human
gcuuaccuugacuguugau

SEQ ID NO: 3763843 - RNA, 12 nt, Human
gcuuacggcccu

SEQ ID NO: 3763844 - RNA, 15 nt, Human
gcuuacguaguucua

SEQ ID NO: 3763845 - RNA, 23 nt, Human
gcuuacuaagcuuugccagcugc

SEQ ID NO: 3763846 - RNA, 14 nt, Human
gcuuacucauuaaa

SEQ ID NO: 3763847 - RNA, 15 nt, Human
gcuuagaaacuggaa

SEQ ID NO: 3763848 - RNA, 12 nt, Human
gcuuagaaauaa

SEQ ID NO: 3763849 - RNA, 16 nt, Human
gcuuagacccucaugc

SEQ ID NO: 3763850 - RNA, 13 nt, Human
gcuuagaccucag

SEQ ID NO: 3763851 - RNA, 17 nt, Human
gcuuagaccucagccug

SEQ ID NO: 3763852 - RNA, 16 nt, Human
gcuuagagccucccuc

SEQ ID NO: 3763853 - RNA, 16 nt, Human
gcuuagaguuggccau

SEQ ID NO: 3763854 - RNA, 18 nt, Human
gcuuagcaggagaggaga

SEQ ID NO: 3763855 - RNA, 23 nt, Human
gcuuagcaggagaggagagccag

SEQ ID NO: 3763856 - RNA, 19 nt, Human
gcuuagcaguccccuuccc

SEQ ID NO: 3763857 - RNA, 18 nt, Human
gcuuagcuuugcucugcc

SEQ ID NO: 3763858 - RNA, 21 nt, Human
gcuuaggagaagucuucuauu

SEQ ID NO: 3763859 - RNA, 13 nt, Human
gcuuaggcagggc

SEQ ID NO: 3763860 - RNA, 19 nt, Human
gcuuaguaaaauuuauuuc

SEQ ID NO: 3763861 - RNA, 22 nt, Human
gcuuaguaucucaucaacaaag

SEQ ID NO: 3763862 - RNA, 17 nt, Human
gcuuagucacugagaca

SEQ ID NO: 3763863 - RNA, 17 nt, Human
gcuuagucacugccugc

SEQ ID NO: 3763864 - RNA, 22 nt, Human
gcuuauaaaacagaguaaucuu

SEQ ID NO: 3763865 - RNA, 22 nt, Human
gcuuauaaccuaguuaaagaaa

SEQ ID NO: 3763866 - RNA, 17 nt, Human
gcuuauacgaaauaauu

SEQ ID NO: 3763867 - RNA, 11 nt, Human
gcuuauaucug

SEQ ID NO: 3763868 - RNA, 20 nt, Human
gcuuauauucaaccauggac

SEQ ID NO: 3763869 - RNA, 15 nt, Human
gcuuauauuguucac

SEQ ID NO: 3763870 - RNA, 16 nt, Human
gcuuaucaauuuguca

SEQ ID NO: 3763871 - RNA, 22 nt, Human
gcuuaucaauuugucauuuuga

SEQ ID NO: 3763872 - RNA, 23 nt, Human
gcuuaucaugcugucuuuacaug

SEQ ID NO: 3763873 - RNA, 16 nt, Human
gcuuauccauaaaaaa

SEQ ID NO: 3763874 - RNA, 17 nt, Human
gcuuauccuuccacgga

SEQ ID NO: 3763875 - RNA, 13 nt, Human
gcuuaucucaggg

SEQ ID NO: 3763876 - RNA, 19 nt, Human
gcuuaucucaggggugugc

SEQ ID NO: 3763877 - RNA, 21 nt, Human
gcuuaucucuuuuauauuugu

SEQ ID NO: 3763878 - RNA, 22 nt, Human
gcuuaucucuuuuauauuugua

SEQ ID NO: 3763879 - RNA, 15 nt, Human
gcuuaugaaaagaau

SEQ ID NO: 3763880 - RNA, 21 nt, Human
gcuuaugaauauuuauaacag

SEQ ID NO: 3763881 - RNA, 18 nt, Human
gcuuaugacaucacuugu

SEQ ID NO: 3763882 - RNA, 17 nt, Human
gcuuaugagauacuuug

SEQ ID NO: 3763883 - RNA, 18 nt, Human
gcuuaugagauacuuugc

SEQ ID NO: 3763884 - RNA, 16 nt, Human
gcuuauucucaaagca

SEQ ID NO: 3763885 - RNA, 18 nt, Human
gcuuauucucaaagcagg

SEQ ID NO: 3763886 - RNA, 20 nt, Human
gcuuauuguuccaagacauu

SEQ ID NO: 3763887 - RNA, 22 nt, Human
gcuuauuguuccaagacauugu

SEQ ID NO: 3763888 - RNA, 11 nt, Human
gcuuauuuaau

SEQ ID NO: 3763889 - RNA, 20 nt, Human
gcuuauuuauuguauucugg

SEQ ID NO: 3763890 - RNA, 17 nt, Human
gcuuauuuuaaugugau

SEQ ID NO: 3763891 - RNA, 17 nt, Human
gcuuauuuuuaaaauuu

SEQ ID NO: 3763892 - RNA, 22 nt, Human
gcuuauuuuuaaaauuuuaaua

SEQ ID NO: 3763893 - RNA, 16 nt, Human
gcuucaaaauagagaa

SEQ ID NO: 3763894 - RNA, 18 nt, Human
gcuucaaccuugagacag

SEQ ID NO: 3763895 - RNA, 21 nt, Human
gcuucaaggauccugagccag

SEQ ID NO: 3763896 - RNA, 18 nt, Human
gcuucaagucugugccug

SEQ ID NO: 3763897 - RNA, 17 nt, Human
gcuucacaguagagcca

SEQ ID NO: 3763898 - RNA, 19 nt, Human
gcuucacaguagagccagc

SEQ ID NO: 3763899 - RNA, 14 nt, Human
gcuucaccagagca

SEQ ID NO: 3763900 - RNA, 17 nt, Human
gcuucaccauggccuua

SEQ ID NO: 3763901 - RNA, 18 nt, Human
gcuucacggaagagccuu

SEQ ID NO: 3763902 - RNA, 20 nt, Human
gcuucacuccugcuguaaau

SEQ ID NO: 3763903 - RNA, 21 nt, Human
gcuucacuucugacucuuccc

SEQ ID NO: 3763904 - RNA, 17 nt, Human
gcuucagaauuaaaacu

SEQ ID NO: 3763905 - RNA, 21 nt, Human
gcuucagauguggagccaggc

SEQ ID NO: 3763906 - RNA, 14 nt, Human
gcuucagccaggag

SEQ ID NO: 3763907 - RNA, 19 nt, Human
gcuucagccucccacagug

SEQ ID NO: 3763908 - RNA, 21 nt, Human
gcuucagccucccacagugcu

SEQ ID NO: 3763909 - RNA, 12 nt, Human
gcuucagccuga

SEQ ID NO: 3763910 - RNA, 15 nt, Human
gcuucagccugaggc

SEQ ID NO: 3763911 - RNA, 21 nt, Human
gcuucagccugaggcugagac

SEQ ID NO: 3763912 - RNA, 14 nt, Human
gcuucagcuccagc

SEQ ID NO: 3763913 - RNA, 13 nt, Human
gcuucaggaaccu

SEQ ID NO: 3763914 - RNA, 14 nt, Human
gcuucaggaaccuc

SEQ ID NO: 3763915 - RNA, 23 nt, Human
gcuucaggaaccucgaguacugu

SEQ ID NO: 3763916 - RNA, 10 nt, Human
gcuucagggc

SEQ ID NO: 3763917 - RNA, 13 nt, Human
gcuucagggcagg

SEQ ID NO: 3763918 - RNA, 19 nt, Human
gcuucagggcagguggggu

SEQ ID NO: 3763919 - RNA, 19 nt, Human
gcuucagguuaucgaaaua

SEQ ID NO: 3763920 - RNA, 23 nt, Human
gcuucagguuaucgaaauaacaa

SEQ ID NO: 3763921 - RNA, 19 nt, Human
gcuucaguggcagcugcuu

SEQ ID NO: 3763922 - RNA, 15 nt, Human
gcuucaguuguuuuc

SEQ ID NO: 3763923 - RNA, 19 nt, Human
gcuucaguuuccuggucug

SEQ ID NO: 3763924 - RNA, 14 nt, Human
gcuucauaaaugaa

SEQ ID NO: 3763925 - RNA, 18 nt, Human
gcuucauaaaugaagcag

SEQ ID NO: 3763926 - RNA, 11 nt, Human
gcuucauacac

SEQ ID NO: 3763927 - RNA, 14 nt, Human
gcuucauagagacu

SEQ ID NO: 3763928 - RNA, 18 nt, Human
gcuccuagagggaggggc

SEQ ID NO: 3763929 - RNA, 22 nt, Human
gcuccuaggacccgucuccagc

SEQ ID NO: 3763930 - RNA, 15 nt, Human
gcuccuaucuguguu

SEQ ID NO: 3763931 - RNA, 14 nt, Human
gcuccucacugccc

SEQ ID NO: 3763932 - RNA, 23 nt, Human
gcuccucacugcccgcacacccu

SEQ ID NO: 3763933 - RNA, 19 nt, Human
gcuccucagggacucaggu

SEQ ID NO: 3763934 - RNA, 20 nt, Human
gcuccuccagggugugugcu

SEQ ID NO: 3763935 - RNA, 23 nt, Human
gcuccucccagcuuguaggagcu

SEQ ID NO: 3763936 - RNA, 23 nt, Human
gcuccuccccuuccucuugucug

SEQ ID NO: 3763937 - RNA, 14 nt, Human
gcuccucccggugc

SEQ ID NO: 3763938 - RNA, 19 nt, Human
gcuccucccggugcccaag

SEQ ID NO: 3763939 - RNA, 14 nt, Human
gcuccucccucuca

SEQ ID NO: 3763940 - RNA, 17 nt, Human
gcuccucccucugaggc

SEQ ID NO: 3763941 - RNA, 13 nt, Human
gcuccucccuggc

SEQ ID NO: 3763942 - RNA, 15 nt, Human
gcuccuccucccugc

SEQ ID NO: 3763943 - RNA, 20 nt, Human
gcuccuccucccugcaucug

SEQ ID NO: 3763944 - RNA, 20 nt, Human
gcuccuccuuggugccuggc

SEQ ID NO: 3763945 - RNA, 18 nt, Human
gcuccucgagggcaggga

SEQ ID NO: 3763946 - RNA, 12 nt, Human
gcuccucucagu

SEQ ID NO: 3763947 - RNA, 12 nt, Human
gcuccucuccag

SEQ ID NO: 3763948 - RNA, 15 nt, Human
gcuccucuccccagc

SEQ ID NO: 3763949 - RNA, 16 nt, Human
gcuccucuccccagca

SEQ ID NO: 3763950 - RNA, 18 nt, Human
gcuccucuccccagccca

SEQ ID NO: 3763951 - RNA, 19 nt, Human
gcuccucuccccagcccag

SEQ ID NO: 3763952 - RNA, 20 nt, Human
gcuccucuccccagcccaga

SEQ ID NO: 3763953 - RNA, 21 nt, Human
gcuccucuccccagcccagag

SEQ ID NO: 3763954 - RNA, 22 nt, Human
gcuccucuccccagcccagaga

SEQ ID NO: 3763955 - RNA, 14 nt, Human
gcuccucuccugga

SEQ ID NO: 3763956 - RNA, 18 nt, Human
gcuccucuccuggaggau

SEQ ID NO: 3763957 - RNA, 19 nt, Human
gcuccucuguccugcuucu

SEQ ID NO: 3763958 - RNA, 23 nt, Human
gcuccucugucucgagcgcccug

SEQ ID NO: 3763959 - RNA, 17 nt, Human
gcuccugacacugcugg

SEQ ID NO: 3763960 - RNA, 18 nt, Human
gcuccugacacugcugga

SEQ ID NO: 3763961 - RNA, 20 nt, Human
gcuccugaccaguugcaguc

SEQ ID NO: 3763962 - RNA, 23 nt, Human
gcuccugaggggcaucugccccu

SEQ ID NO: 3763963 - RNA, 23 nt, Human
gcuccugcaggccacagccaccu

SEQ ID NO: 3763964 - RNA, 18 nt, Human
gcuccugccaccacgccc

SEQ ID NO: 3763965 - RNA, 22 nt, Human
gcuccugccaccacgcccggcu

SEQ ID NO: 3763966 - RNA, 14 nt, Human
gcuccugcccccau

SEQ ID NO: 3763967 - RNA, 15 nt, Human
gcuccugccgcagag

SEQ ID NO: 3763968 - RNA, 17 nt, Human
gcuccugccgcagagcu

SEQ ID NO: 3763969 - RNA, 19 nt, Human
gcuccugccgcagagcugg

SEQ ID NO: 3763970 - RNA, 22 nt, Human
gcuccugccgcagagcuggccg

SEQ ID NO: 3763971 - RNA, 19 nt, Human
gcuccuggacucauugcuu

SEQ ID NO: 3763972 - RNA, 15 nt, Human
gcuccuggcccacug

SEQ ID NO: 3763973 - RNA, 17 nt, Human
gcuccuggcccagccuu

SEQ ID NO: 3763974 - RNA, 19 nt, Human
gcuccuggcccagccuuug

SEQ ID NO: 3763975 - RNA, 12 nt, Human
gcuccugggaag

SEQ ID NO: 3763976 - RNA, 19 nt, Human
gcuccuggucuugagaugu

SEQ ID NO: 3763977 - RNA, 14 nt, Human
gcuccuguccccug

SEQ ID NO: 3763978 - RNA, 13 nt, Human
gcuccuguccucc

SEQ ID NO: 3763979 - RNA, 20 nt, Human
gcuccuguggccccacccug

SEQ ID NO: 3763980 - RNA, 21 nt, Human
gcuccuguggccccacccugg

SEQ ID NO: 3763981 - RNA, 12 nt, Human
gcuccugugucu

SEQ ID NO: 3763982 - RNA, 17 nt, Human
gcuccuguuagcuccuc

SEQ ID NO: 3763983 - RNA, 15 nt, Human
gcuccuuaaggcucu

SEQ ID NO: 3763984 - RNA, 15 nt, Human
gcuccuuagcugcca

SEQ ID NO: 3763985 - RNA, 18 nt, Human
gcuccuuagcugccaagc

SEQ ID NO: 3763986 - RNA, 19 nt, Human
gcuccuuaggguuuucucu

SEQ ID NO: 3763987 - RNA, 15 nt, Human
gcuccuucccuugcu

SEQ ID NO: 3763988 - RNA, 13 nt, Human
gcuccuuccuguc

SEQ ID NO: 3763989 - RNA, 15 nt, Human
gcuccuugacuccuu

SEQ ID NO: 3763990 - RNA, 17 nt, Human
gcuccuugggaggaagc

SEQ ID NO: 3763991 - RNA, 18 nt, Human
gcuccuugggaggaagca

SEQ ID NO: 3763992 - RNA, 21 nt, Human
gcuccuugggaggccccacug

SEQ ID NO: 3763993 - RNA, 11 nt, Human
gcuccuugggc

SEQ ID NO: 3763994 - RNA, 19 nt, Human
gcuccuugggcccuuugag

SEQ ID NO: 3763995 - RNA, 15 nt, Human
gcuccuugugggccu

SEQ ID NO: 3763996 - RNA, 18 nt, Human
gcuccuugugggccuggg

SEQ ID NO: 3763997 - RNA, 14 nt, Human
gcuccuuguuccua

SEQ ID NO: 3763998 - RNA, 16 nt, Human
gcuccuuguuccuaga

SEQ ID NO: 3763999 - RNA, 17 nt, Human
gcuccuuucuccagcca

SEQ ID NO: 3764000 - RNA, 19 nt, Human
gcuccuuuguguguguguc

SEQ ID NO: 3764001 - RNA, 18 nt, Human
gcuccuuuuccagagcau

SEQ ID NO: 3764002 - RNA, 16 nt, Human
gcuccuuuuucucccu

SEQ ID NO: 3764003 - RNA, 19 nt, Human
gcuccuuuuucucccucug

SEQ ID NO: 3764004 - RNA, 17 nt, Human
gcucgagcaguccugcc

SEQ ID NO: 3764005 - RNA, 20 nt, Human
gcucgagcaguccugccuca

SEQ ID NO: 3764006 - RNA, 16 nt, Human
gcucgaugcagacagg

SEQ ID NO: 3764007 - RNA, 22 nt, Human
gcucgauguggucacagcugua

SEQ ID NO: 3764008 - RNA, 14 nt, Human
gcucgauuuuguau

SEQ ID NO: 3764009 - RNA, 16 nt, Human
gcucgccacagugggc

SEQ ID NO: 3764010 - RNA, 19 nt, Human
gcucgcccuccuuucugug

SEQ ID NO: 3764011 - RNA, 21 nt, Human
gcucgccucaggaaugggcug

SEQ ID NO: 3764012 - RNA, 13 nt, Human
gcucgccuucccu

SEQ ID NO: 3764013 - RNA, 14 nt, Human
gcucgcuguugcug

SEQ ID NO: 3764014 - RNA, 21 nt, Human
gcucgcuguugcugaauaggc

SEQ ID NO: 3764015 - RNA, 19 nt, Human
gcucggagaagagcgcagu

SEQ ID NO: 3764016 - RNA, 21 nt, Human
gcucggaggccccaaaggaaa

SEQ ID NO: 3764017 - RNA, 17 nt, Human
gcucggaggcugccccc

SEQ ID NO: 3764018 - RNA, 18 nt, Human
gcucggaggcugcccccg

SEQ ID NO: 3764019 - RNA, 17 nt, Human
gcucggccugcccccac

SEQ ID NO: 3764020 - RNA, 13 nt, Human
gcucggcucagcu

SEQ ID NO: 3764021 - RNA, 12 nt, Human
gcucgguggacc

SEQ ID NO: 3764022 - RNA, 17 nt, Human
gcucgguggacccaggg

SEQ ID NO: 3764023 - RNA, 22 nt, Human
gcucguggacugagugggaagc

SEQ ID NO: 3764024 - RNA, 23 nt, Human
gcucguguauccuggggcucccu

SEQ ID NO: 3764025 - RNA, 14 nt, Human
gcucuaacgccuga

SEQ ID NO: 3764026 - RNA, 17 nt, Human
gcucuaauguuugcaua

SEQ ID NO: 3764027 - RNA, 15 nt, Human
gcucuaauucacagu

SEQ ID NO: 3764028 - RNA, 16 nt, Human
gcucuaauucacagug

SEQ ID NO: 3764029 - RNA, 19 nt, Human
gcucuaauucacagugcuc

SEQ ID NO: 3764030 - RNA, 20 nt, Human
gcucuacagcuaaucagcau

SEQ ID NO: 3764031 - RNA, 17 nt, Human
gcucuacaucuucugcc

SEQ ID NO: 3764032 - RNA, 13 nt, Human
gcucuacgggggc

SEQ ID NO: 3764033 - RNA, 15 nt, Human
gcucuacuuccccau

SEQ ID NO: 3764034 - RNA, 16 nt, Human
gcucuacuuccccaug

SEQ ID NO: 3764035 - RNA, 13 nt, Human
gcucuagaaucug

SEQ ID NO: 3764036 - RNA, 17 nt, Human
gcucuagaugagcuggg

SEQ ID NO: 3764037 - RNA, 21 nt, Human
gcucuagccugggcaacaaca

SEQ ID NO: 3764038 - RNA, 19 nt, Human
gcucuaggguugcuggagc

SEQ ID NO: 3764039 - RNA, 24 nt, Human
gcucuaggguugcuggagccugag

SEQ ID NO: 3764040 - RNA, 15 nt, Human
gcucuagugggacag

SEQ ID NO: 3764041 - RNA, 19 nt, Human
gcucuaucgcccaggcugg

SEQ ID NO: 3764042 - RNA, 14 nt, Human
gcucuaucucucaa

SEQ ID NO: 3764043 - RNA, 17 nt, Human
gcucuaugcuuuccaaa

SEQ ID NO: 3764044 - RNA, 21 nt, Human
gcucuaugggcagaucuaccc

SEQ ID NO: 3764045 - RNA, 21 nt, Human
gcucuauuauauaaacuuuau

SEQ ID NO: 3764046 - RNA, 16 nt, Human
gcucuauuaugaaugu

SEQ ID NO: 3764047 - RNA, 22 nt, Human
gcucuauuaugaaugugaagcc

SEQ ID NO: 3764048 - RNA, 12 nt, Human
gcucucaccucu

SEQ ID NO: 3764049 - RNA, 13 nt, Human
gcucucagaagcc

SEQ ID NO: 3764050 - RNA, 11 nt, Human
gcucucagcca

SEQ ID NO: 3764051 - RNA, 13 nt, Human
gcucucaggccag

SEQ ID NO: 3764052 - RNA, 14 nt, Human
gcucucaggccagc

SEQ ID NO: 3764053 - RNA, 16 nt, Human
gcucucaggccagcug

SEQ ID NO: 3764054 - RNA, 18 nt, Human
gcucucaggccagcugcu

SEQ ID NO: 3764055 - RNA, 20 nt, Human
gcucucaggccagcugcuug

SEQ ID NO: 3764056 - RNA, 15 nt, Human
gcucucaucugaggc

SEQ ID NO: 3764057 - RNA, 18 nt, Human
gcucuccaagucucagug

SEQ ID NO: 3764058 - RNA, 22 nt, Human
gcucuccaagucucaguggcuu

SEQ ID NO: 3764059 - RNA, 13 nt, Human
gcucuccaagugc

SEQ ID NO: 3764060 - RNA, 17 nt, Human
gcucuccaagugccaga

SEQ ID NO: 3764061 - RNA, 15 nt, Human
gcucuccaccucagc

SEQ ID NO: 3764062 - RNA, 20 nt, Human
gcucuccaccucagccuugg

SEQ ID NO: 3764063 - RNA, 18 nt, Human
gcucuccauucugcuccu

SEQ ID NO: 3764064 - RNA, 20 nt, Human
gcucuccauucugcuccuuc

SEQ ID NO: 3764065 - RNA, 21 nt, Human
gcucuccauucugcuccuucc

SEQ ID NO: 3764066 - RNA, 16 nt, Human
gcucuccccugcccug

SEQ ID NO: 3764067 - RNA, 18 nt, Human
gcucucccgguucuucca

SEQ ID NO: 3764068 - RNA, 20 nt, Human
gcucucccgguucuuccagu

SEQ ID NO: 3764069 - RNA, 11 nt, Human
gcucucccucu

SEQ ID NO: 3764070 - RNA, 19 nt, Human
gcucucccucuggcccugc

SEQ ID NO: 3764071 - RNA, 21 nt, Human
gcucucccucuggcccugccu

SEQ ID NO: 3764072 - RNA, 23 nt, Human
gcucucccucuggcccugccuuc

SEQ ID NO: 3764073 - RNA, 15 nt, Human
gcucucccucuucuc

SEQ ID NO: 3764074 - RNA, 21 nt, Human
gcucucccucuucucaagugc

SEQ ID NO: 3764075 - RNA, 23 nt, Human
gcucucccucuucucaagugccu

SEQ ID NO: 3764076 - RNA, 24 nt, Human
gcucucccucuucucaagugccuu

SEQ ID NO: 3764077 - RNA, 20 nt, Human
cuuccugucuuccugcauuc

SEQ ID NO: 3764078 - RNA, 16 nt, Human
cuuccugugauccacc

SEQ ID NO: 3764079 - RNA, 23 nt, Human
cuuccuguguguccaaaacugcc

SEQ ID NO: 3764080 - RNA, 16 nt, Human
cuuccuguuuuucaca

SEQ ID NO: 3764081 - RNA, 19 nt, Human
cuuccuuacucccaggcac

SEQ ID NO: 3764082 - RNA, 15 nt, Human
cuuccuuaugcuucu

SEQ ID NO: 3764083 - RNA, 15 nt, Human
cuuccuucagagagc

SEQ ID NO: 3764084 - RNA, 16 nt, Human
cuuccuucagagagca

SEQ ID NO: 3764085 - RNA, 21 nt, Human
cuuccuucagagagcagugcu

SEQ ID NO: 3764086 - RNA, 22 nt, Human
cuuccuucagagagcagugcuu

SEQ ID NO: 3764087 - RNA, 13 nt, Human
cuuccuucauuuc

SEQ ID NO: 3764088 - RNA, 15 nt, Human
cuuccuucauuuccu

SEQ ID NO: 3764089 - RNA, 16 nt, Human
cuuccuucauuuccuc

SEQ ID NO: 3764090 - RNA, 12 nt, Human
cuuccuucccac

SEQ ID NO: 3764091 - RNA, 15 nt, Human
cuuccuucccugcug

SEQ ID NO: 3764092 - RNA, 17 nt, Human
cuuccuucccuggcuug

SEQ ID NO: 3764093 - RNA, 16 nt, Human
cuuccuucccugggcu

SEQ ID NO: 3764094 - RNA, 18 nt, Human
cuuccuucccugggcugu

SEQ ID NO: 3764095 - RNA, 14 nt, Human
cuuccuuccucucc

SEQ ID NO: 3764096 - RNA, 13 nt, Human
cuuccuuccuguu

SEQ ID NO: 3764097 - RNA, 11 nt, Human
cuuccuucugc

SEQ ID NO: 3764098 - RNA, 21 nt, Human
cuuccuugaagaacugcaggc

SEQ ID NO: 3764099 - RNA, 15 nt, Human
cuuccuugaccagca

SEQ ID NO: 3764100 - RNA, 18 nt, Human
cuuccuugaccuuccucu

SEQ ID NO: 3764101 - RNA, 15 nt, Human
cuuccuugcucuccc

SEQ ID NO: 3764102 - RNA, 16 nt, Human
cuuccuugcucugcac

SEQ ID NO: 3764103 - RNA, 19 nt, Human
cuuccuuggcaucacaggg

SEQ ID NO: 3764104 - RNA, 15 nt, Human
cuuccuuuaaaaaac

SEQ ID NO: 3764105 - RNA, 16 nt, Human
cuuccuuuaaaaaacu

SEQ ID NO: 3764106 - RNA, 17 nt, Human
cuuccuuuacuuucccu

SEQ ID NO: 3764107 - RNA, 21 nt, Human
cuuccuuuacuuucccuugcu

SEQ ID NO: 3764108 - RNA, 23 nt, Human
cuuccuuuacuuucccuugcuuu

SEQ ID NO: 3764109 - RNA, 17 nt, Human
cuuccuuucuccaggac

SEQ ID NO: 3764110 - RNA, 20 nt, Human
cuuccuuucucuuucucucu

SEQ ID NO: 3764111 - RNA, 21 nt, Human
cuuccuuucucuuucucucuu

SEQ ID NO: 3764112 - RNA, 23 nt, Human
cuuccuuucucuuucucucuucc

SEQ ID NO: 3764113 - RNA, 18 nt, Human
cuuccuuucuuucucucu

SEQ ID NO: 3764114 - RNA, 20 nt, Human
cuuccuuuuacuuuucuucu

SEQ ID NO: 3764115 - RNA, 15 nt, Human
cuuccuuuucccugc

SEQ ID NO: 3764116 - RNA, 15 nt, Human
cuuccuuuugaggga

SEQ ID NO: 3764117 - RNA, 15 nt, Human
cuucgaaaccuggga

SEQ ID NO: 3764118 - RNA, 20 nt, Human
cuucgaaagcaucauuauuu

SEQ ID NO: 3764119 - RNA, 15 nt, Human
cuucgacagcauuuu

SEQ ID NO: 3764120 - RNA, 18 nt, Human
cuucgacucaggauccag

SEQ ID NO: 3764121 - RNA, 23 nt, Human
cuucgacuguuguuaucuguuug

SEQ ID NO: 3764122 - RNA, 17 nt, Human
cuucgacuuuucuuaac

SEQ ID NO: 3764123 - RNA, 18 nt, Human
cuucgacuuuucuuaaca

SEQ ID NO: 3764124 - RNA, 17 nt, Human
cuucgagcacuguccag

SEQ ID NO: 3764125 - RNA, 23 nt, Human
cuucgagguggaucacagaggcu

SEQ ID NO: 3764126 - RNA, 16 nt, Human
cuucgaguucccaggg

SEQ ID NO: 3764127 - RNA, 16 nt, Human
cuucgcaucaaaagac

SEQ ID NO: 3764128 - RNA, 17 nt, Human
cuucgcaucaaaagaca

SEQ ID NO: 3764129 - RNA, 20 nt, Human
cuucgcaucaaaagacaauu

SEQ ID NO: 3764130 - RNA, 21 nt, Human
cuucgcaucaaaagacaauuc

SEQ ID NO: 3764131 - RNA, 17 nt, Human
cuucgcuccugugucuu

SEQ ID NO: 3764132 - RNA, 15 nt, Human
cuucgcuucuugccu

SEQ ID NO: 3764133 - RNA, 16 nt, Human
cuucgcuucuugccuc

SEQ ID NO: 3764134 - RNA, 21 nt, Human
cuucgcuucuugccucugugc

SEQ ID NO: 3764135 - RNA, 14 nt, Human
cuucggacaaaaua

SEQ ID NO: 3764136 - RNA, 15 nt, Human
cuucggacaaaauau

SEQ ID NO: 3764137 - RNA, 21 nt, Human
cuucggcauugguucccuuug

SEQ ID NO: 3764138 - RNA, 16 nt, Human
cuucggccagagcuga

SEQ ID NO: 3764139 - RNA, 17 nt, Human
cuucggccuccauccug

SEQ ID NO: 3764140 - RNA, 19 nt, Human
cuucggccuccauccugag

SEQ ID NO: 3764141 - RNA, 17 nt, Human
cuucgggaagagaggag

SEQ ID NO: 3764142 - RNA, 16 nt, Human
cuucgggcccuuccca

SEQ ID NO: 3764143 - RNA, 18 nt, Human
cuucgggcgucugugugc

SEQ ID NO: 3764144 - RNA, 14 nt, Human
cuucgggcugugcc

SEQ ID NO: 3764145 - RNA, 15 nt, Human
cuucgggcugugccc

SEQ ID NO: 3764146 - RNA, 14 nt, Human
cuucggggcuggga

SEQ ID NO: 3764147 - RNA, 12 nt, Human
cuucguacaguu

SEQ ID NO: 3764148 - RNA, 13 nt, Human
cuucguacaguuc

SEQ ID NO: 3764149 - RNA, 14 nt, Human
cuucguacaguucu

SEQ ID NO: 3764150 - RNA, 21 nt, Human
cuucguaucccgagucuggga

SEQ ID NO: 3764151 - RNA, 21 nt, Human
cuucgucuuucccauggggag

SEQ ID NO: 3764152 - RNA, 22 nt, Human
cuucgucuuucccauggggagg

SEQ ID NO: 3764153 - RNA, 21 nt, Human
cuucgugcggaaucagcuucu

SEQ ID NO: 3764154 - RNA, 23 nt, Human
cuucgugggaucugccccucccu

SEQ ID NO: 3764155 - RNA, 20 nt, Human
cuucguuaacuguguaugua

SEQ ID NO: 3764156 - RNA, 13 nt, Human
cuucguucgcaga

SEQ ID NO: 3764157 - RNA, 18 nt, Human
cuucguucuuuuuaaguu

SEQ ID NO: 3764158 - RNA, 19 nt, Human
cuucguuuacuaugccugu

SEQ ID NO: 3764159 - RNA, 15 nt, Human
cuucguuuauuuuca

SEQ ID NO: 3764160 - RNA, 16 nt, Human
cuucguuuauuuucaa

SEQ ID NO: 3764161 - RNA, 18 nt, Human
cuucguuuauuuucaaga

SEQ ID NO: 3764162 - RNA, 12 nt, Human
cuucuaaaaacu

SEQ ID NO: 3764163 - RNA, 14 nt, Human
cuucuaaaacugua

SEQ ID NO: 3764164 - RNA, 18 nt, Human
cuucuaaaacuguacuuu

SEQ ID NO: 3764165 - RNA, 19 nt, Human
cuucuaaacccaauccaaa

SEQ ID NO: 3764166 - RNA, 19 nt, Human
cuucuaaacuuccccaucu

SEQ ID NO: 3764167 - RNA, 22 nt, Human
cuucuaaacuuccccaucuucu

SEQ ID NO: 3764168 - RNA, 23 nt, Human
cuucuaaauggcaaaggaaggug

SEQ ID NO: 3764169 - RNA, 21 nt, Human
cuucuaaguugaguauauuau

SEQ ID NO: 3764170 - RNA, 17 nt, Human
cuucuaauaaauuauac

SEQ ID NO: 3764171 - RNA, 21 nt, Human
cuucuaauaaauuauacaaau

SEQ ID NO: 3764172 - RNA, 18 nt, Human
cuucuaauauauuuuuau

SEQ ID NO: 3764173 - RNA, 17 nt, Human
cuucuaauauuuauugc

SEQ ID NO: 3764174 - RNA, 20 nt, Human
cuucuaauauuuauugcuuu

SEQ ID NO: 3764175 - RNA, 21 nt, Human
cuucuaauauuuauugcuuua

SEQ ID NO: 3764176 - RNA, 16 nt, Human
cuucuaauugccaugu

SEQ ID NO: 3764177 - RNA, 15 nt, Human
cuucuaauugcugug

SEQ ID NO: 3764178 - RNA, 18 nt, Human
cuucuacacucuccuggg

SEQ ID NO: 3764179 - RNA, 15 nt, Human
cuucuaccaacugga

SEQ ID NO: 3764180 - RNA, 15 nt, Human
cuucuaccugccacu

SEQ ID NO: 3764181 - RNA, 16 nt, Human
cuucuaccugccacuc

SEQ ID NO: 3764182 - RNA, 14 nt, Human
cuucuaccugcccu

SEQ ID NO: 3764183 - RNA, 20 nt, Human
cuucuacucacuuuucccac

SEQ ID NO: 3764184 - RNA, 13 nt, Human
cuucuacuucugc

SEQ ID NO: 3764185 - RNA, 21 nt, Human
cuucuacuuuuaaguugcuga

SEQ ID NO: 3764186 - RNA, 13 nt, Human
cuucuagagcuua

SEQ ID NO: 3764187 - RNA, 15 nt, Human
cuucuagaguuuuau

SEQ ID NO: 3764188 - RNA, 19 nt, Human
cuucuaggguuauugcauu

SEQ ID NO: 3764189 - RNA, 16 nt, Human
cuucuagguucuaaaa

SEQ ID NO: 3764190 - RNA, 21 nt, Human
cuucuagugauuucuggggcc

SEQ ID NO: 3764191 - RNA, 17 nt, Human
cuucuaguucugccagg

SEQ ID NO: 3764192 - RNA, 19 nt, Human
cuucuaguucugccaggag

SEQ ID NO: 3764193 - RNA, 18 nt, Human
cuucuauagcaucacuua

SEQ ID NO: 3764194 - RNA, 15 nt, Human
cuucuaucccaggag

SEQ ID NO: 3764195 - RNA, 19 nt, Human
cuucuauuauagccacauc

SEQ ID NO: 3764196 - RNA, 20 nt, Human
cuucuauucuagccugcauu

SEQ ID NO: 3764197 - RNA, 18 nt, Human
cuucuauugccucugaga

SEQ ID NO: 3764198 - RNA, 19 nt, Human
cuucuauugccucugagag

SEQ ID NO: 3764199 - RNA, 22 nt, Human
cuucuauugccucugagagcau

SEQ ID NO: 3764200 - RNA, 24 nt, Human
cuucuauugccucugagagcauca

SEQ ID NO: 3764201 - RNA, 16 nt, Human
cuucuauuuuguaaac

SEQ ID NO: 3764202 - RNA, 17 nt, Human
cuucuauuuuguaaacu

SEQ ID NO: 3764203 - RNA, 19 nt, Human
cuucucaaaccuguuuaaa

SEQ ID NO: 3764204 - RNA, 22 nt, Human
cuucucaaaccuguuuaaauau

SEQ ID NO: 3764205 - RNA, 16 nt, Human
cuucucaaaccuugau

SEQ ID NO: 3764206 - RNA, 21 nt, Human
cuucucaaaggguacuuccac

SEQ ID NO: 3764207 - RNA, 15 nt, Human
cuucucaagauacug

SEQ ID NO: 3764208 - RNA, 12 nt, Human
cuucucaagugc

SEQ ID NO: 3764209 - RNA, 14 nt, Human
cuucucaagugccu

SEQ ID NO: 3764210 - RNA, 15 nt, Human
cuucucaagugccuu

SEQ ID NO: 3764211 - RNA, 16 nt, Human
cuucucaagugccuua

SEQ ID NO: 3764212 - RNA, 18 nt, Human
cuucucaagugccuuaau

SEQ ID NO: 3764213 - RNA, 17 nt, Human
cuucucaaguucuaaga

SEQ ID NO: 3764214 - RNA, 13 nt, Human
cuucucacagcac

SEQ ID NO: 3764215 - RNA, 18 nt, Human
cuucucacagcacaugcu

SEQ ID NO: 3764216 - RNA, 19 nt, Human
cuucucacagcacaugcug

SEQ ID NO: 3764217 - RNA, 13 nt, Human
cuucucacauuua

SEQ ID NO: 3764218 - RNA, 16 nt, Human
cuucucaccagcugca

SEQ ID NO: 3764219 - RNA, 17 nt, Human
cuucucaccagcugcaa

SEQ ID NO: 3764220 - RNA, 19 nt, Human
cuucucaccagcugcaaag

SEQ ID NO: 3764221 - RNA, 21 nt, Human
cuucucaccagcugcaaagug

SEQ ID NO: 3764222 - RNA, 22 nt, Human
cuucucaccagcugcaaagugu

SEQ ID NO: 3764223 - RNA, 14 nt, Human
cuucucagaagcac

SEQ ID NO: 3764224 - RNA, 22 nt, Human
cuucucagaaggcaaaugacuu

SEQ ID NO: 3764225 - RNA, 14 nt, Human
cuucucagaaucua

SEQ ID NO: 3764226 - RNA, 14 nt, Human
gcuucaucuggcaa

SEQ ID NO: 3764227 - RNA, 13 nt, Human
gcuucaugccuuu

SEQ ID NO: 3764228 - RNA, 14 nt, Human
gcuucauguguccc

SEQ ID NO: 3764229 - RNA, 15 nt, Human
gcuucauguguccca

SEQ ID NO: 3764230 - RNA, 15 nt, Human
gcuucauuagagcag

SEQ ID NO: 3764231 - RNA, 18 nt, Human
gcuucauucaauauugac

SEQ ID NO: 3764232 - RNA, 11 nt, Human
gcuucauugua

SEQ ID NO: 3764233 - RNA, 13 nt, Human
gcuucauuuccug

SEQ ID NO: 3764234 - RNA, 10 nt, Human
gcuuccacau

SEQ ID NO: 3764235 - RNA, 21 nt, Human
gcuuccagagaguccucugga

SEQ ID NO: 3764236 - RNA, 22 nt, Human
gcuuccagauugacgacaagug

SEQ ID NO: 3764237 - RNA, 23 nt, Human
gcuuccagauugacgacaagugc

SEQ ID NO: 3764238 - RNA, 15 nt, Human
gcuuccagcaggagg

SEQ ID NO: 3764239 - RNA, 16 nt, Human
gcuuccagugaggcuc

SEQ ID NO: 3764240 - RNA, 23 nt, Human
gcuuccagugaggcucugcccuu

SEQ ID NO: 3764241 - RNA, 16 nt, Human
gcuuccauagcugcug

SEQ ID NO: 3764242 - RNA, 17 nt, Human
gcuuccaugagaacagc

SEQ ID NO: 3764243 - RNA, 19 nt, Human
gcuuccaugauucuauuua

SEQ ID NO: 3764244 - RNA, 12 nt, Human
gcuuccauucca

SEQ ID NO: 3764245 - RNA, 23 nt, Human
gcuucccaaaugugugcccagcu

SEQ ID NO: 3764246 - RNA, 21 nt, Human
gcuucccaguggcugcugccc

SEQ ID NO: 3764247 - RNA, 12 nt, Human
gcuucccauccu

SEQ ID NO: 3764248 - RNA, 13 nt, Human
gcuucccauccua

SEQ ID NO: 3764249 - RNA, 19 nt, Human
gcuucccauuguggcuccu

SEQ ID NO: 3764250 - RNA, 14 nt, Human
gcuuccccaguagc

SEQ ID NO: 3764251 - RNA, 14 nt, Human
gcuucccccauagc

SEQ ID NO: 3764252 - RNA, 16 nt, Human
gcuucccccauagcca

SEQ ID NO: 3764253 - RNA, 14 nt, Human
gcuuccccucucuc

SEQ ID NO: 3764254 - RNA, 18 nt, Human
gcuuccccucucuccucc

SEQ ID NO: 3764255 - RNA, 17 nt, Human
gcuucccgcucagcccu

SEQ ID NO: 3764256 - RNA, 13 nt, Human
gcuucccuaaucu

SEQ ID NO: 3764257 - RNA, 17 nt, Human
gcuucccuccauccccc

SEQ ID NO: 3764258 - RNA, 14 nt, Human
gcuucccucccugc

SEQ ID NO: 3764259 - RNA, 17 nt, Human
gcuucccucugccuguc

SEQ ID NO: 3764260 - RNA, 11 nt, Human
gcuucccugaa

SEQ ID NO: 3764261 - RNA, 16 nt, Human
gcuucccugaagcucc

SEQ ID NO: 3764262 - RNA, 14 nt, Human
gcuucccugacuca

SEQ ID NO: 3764263 - RNA, 19 nt, Human
gcuucccugguucaagcga

SEQ ID NO: 3764264 - RNA, 19 nt, Human
gcuucccuuuuuuccuuuc

SEQ ID NO: 3764265 - RNA, 18 nt, Human
gcuuccggcuccugugcu

SEQ ID NO: 3764266 - RNA, 21 nt, Human
gcuuccgguagggaggcagcc

SEQ ID NO: 3764267 - RNA, 14 nt, Human
gcuuccucccaaca

SEQ ID NO: 3764268 - RNA, 15 nt, Human
gcuuccucuagaagc

SEQ ID NO: 3764269 - RNA, 20 nt, Human
gcuuccugcguccuccucac

SEQ ID NO: 3764270 - RNA, 14 nt, Human
gcuuccugcuugcc

SEQ ID NO: 3764271 - RNA, 16 nt, Human
gcuuccuggugcugga

SEQ ID NO: 3764272 - RNA, 14 nt, Human
gcuuccuguuugua

SEQ ID NO: 3764273 - RNA, 14 nt, Human
gcuuccuucagaga

SEQ ID NO: 3764274 - RNA, 20 nt, Human
gcuuccuucagagagcagug

SEQ ID NO: 3764275 - RNA, 23 nt, Human
gcuuccuuuccuguguguacucu

SEQ ID NO: 3764276 - RNA, 12 nt, Human
gcuuccuuucuu

SEQ ID NO: 3764277 - RNA, 22 nt, Human
gcuuccuuuguuuuuuuuuccu

SEQ ID NO: 3764278 - RNA, 19 nt, Human
gcuucgaggcccagcgacc

SEQ ID NO: 3764279 - RNA, 14 nt, Human
gcuucggcauuuga

SEQ ID NO: 3764280 - RNA, 18 nt, Human
gcuucgggcccuucccac

SEQ ID NO: 3764281 - RNA, 20 nt, Human
gcuucgggcccuucccacag

SEQ ID NO: 3764282 - RNA, 22 nt, Human
gcuucgguuucuaacuuggagc

SEQ ID NO: 3764283 - RNA, 16 nt, Human
gcuucguuuauuuuca

SEQ ID NO: 3764284 - RNA, 12 nt, Human
gcuucuaauaaa

SEQ ID NO: 3764285 - RNA, 18 nt, Human
gcuucuaauauuuauugc

SEQ ID NO: 3764286 - RNA, 22 nt, Human
gcuucuaauauuuauugcuuua

SEQ ID NO: 3764287 - RNA, 20 nt, Human
gcuucuaccaacuggaagca

SEQ ID NO: 3764288 - RNA, 22 nt, Human
gcuucuaccaacuggaagcaca

SEQ ID NO: 3764289 - RNA, 17 nt, Human
gcuucuaccaugaacag

SEQ ID NO: 3764290 - RNA, 19 nt, Human
gcuucuaccaugaacagaa

SEQ ID NO: 3764291 - RNA, 17 nt, Human
gcuucuaguucugccag

SEQ ID NO: 3764292 - RNA, 19 nt, Human
gcuucuaguucugccagga

SEQ ID NO: 3764293 - RNA, 14 nt, Human
gcuucuaucccagg

SEQ ID NO: 3764294 - RNA, 20 nt, Human
gcuucuaucccaggaggugg

SEQ ID NO: 3764295 - RNA, 16 nt, Human
gcuucuauuagccagu

SEQ ID NO: 3764296 - RNA, 16 nt, Human
gcuucucagcucgcug

SEQ ID NO: 3764297 - RNA, 16 nt, Human
gcuucucauacgucca

SEQ ID NO: 3764298 - RNA, 16 nt, Human
gcuucucauccugcag

SEQ ID NO: 3764299 - RNA, 12 nt, Human
gcuucuccaggc

SEQ ID NO: 3764300 - RNA, 14 nt, Human
gcuucucccaggca

SEQ ID NO: 3764301 - RNA, 15 nt, Human
gcuucucccaggcaa

SEQ ID NO: 3764302 - RNA, 18 nt, Human
gcuucucccaggcaaggc

SEQ ID NO: 3764303 - RNA, 23 nt, Human
gcuucucccaggcaaggcugugg

SEQ ID NO: 3764304 - RNA, 13 nt, Human
gcuucuccccaga

SEQ ID NO: 3764305 - RNA, 18 nt, Human
gcuucuccgccagccucc

SEQ ID NO: 3764306 - RNA, 19 nt, Human
gcuucuccgccagccuccu

SEQ ID NO: 3764307 - RNA, 23 nt, Human
gcuucuccgccagccuccucugg

SEQ ID NO: 3764308 - RNA, 15 nt, Human
gcuucuccuguguga

SEQ ID NO: 3764309 - RNA, 14 nt, Human
gcuucucuacagac

SEQ ID NO: 3764310 - RNA, 14 nt, Human
gcuucucucugugg

SEQ ID NO: 3764311 - RNA, 16 nt, Human
gcuucucucuguggga

SEQ ID NO: 3764312 - RNA, 13 nt, Human
gcuucucugacuu

SEQ ID NO: 3764313 - RNA, 18 nt, Human
gcuucucugacuucugcc

SEQ ID NO: 3764314 - RNA, 21 nt, Human
gcuucucugacuucugccugg

SEQ ID NO: 3764315 - RNA, 22 nt, Human
gcuucucugcccagcuuuucau

SEQ ID NO: 3764316 - RNA, 16 nt, Human
gcuucugaccucagca

SEQ ID NO: 3764317 - RNA, 21 nt, Human
gcuucugagcagcgagccugc

SEQ ID NO: 3764318 - RNA, 22 nt, Human
gcuucugagcagcgagccugcu

SEQ ID NO: 3764319 - RNA, 12 nt, Human
gcuucugcaccc

SEQ ID NO: 3764320 - RNA, 15 nt, Human
gcuucugcacccucc

SEQ ID NO: 3764321 - RNA, 17 nt, Human
gcuucugcacccuccac

SEQ ID NO: 3764322 - RNA, 19 nt, Human
gcuucugcacccuccaccc

SEQ ID NO: 3764323 - RNA, 21 nt, Human
gcuucugcacccuccacccug

SEQ ID NO: 3764324 - RNA, 21 nt, Human
gcuucugccacugcugggcuc

SEQ ID NO: 3764325 - RNA, 18 nt, Human
gcuucugccacuucccag

SEQ ID NO: 3764326 - RNA, 19 nt, Human
gcuucugccacuucccagg

SEQ ID NO: 3764327 - RNA, 17 nt, Human
gcuucugcccccugcag

SEQ ID NO: 3764328 - RNA, 18 nt, Human
gcuucugcccccugcaga

SEQ ID NO: 3764329 - RNA, 12 nt, Human
gcuucugcuggg

SEQ ID NO: 3764330 - RNA, 14 nt, Human
gcuucugcugggcu

SEQ ID NO: 3764331 - RNA, 15 nt, Human
gcuucugcugggcug

SEQ ID NO: 3764332 - RNA, 16 nt, Human
gcuucugcugggcugg

SEQ ID NO: 3764333 - RNA, 16 nt, Human
gcuucugcuggggccu

SEQ ID NO: 3764334 - RNA, 21 nt, Human
gcuucugcuggggccugggac

SEQ ID NO: 3764335 - RNA, 14 nt, Human
gcuucugcuuuucu

SEQ ID NO: 3764336 - RNA, 20 nt, Human
gcuucugcuuuucugcccug

SEQ ID NO: 3764337 - RNA, 17 nt, Human
gcuucuggagcccuugg

SEQ ID NO: 3764338 - RNA, 17 nt, Human
gcuucuggccaggaagc

SEQ ID NO: 3764339 - RNA, 21 nt, Human
gcuucugggguccccagggcu

SEQ ID NO: 3764340 - RNA, 16 nt, Human
gcuucugguacucucc

SEQ ID NO: 3764341 - RNA, 19 nt, Human
gcuucugguacucuccuag

SEQ ID NO: 3764342 - RNA, 19 nt, Human
gcuucuggugaccuuccaa

SEQ ID NO: 3764343 - RNA, 20 nt, Human
gcuucuguaguacuccuuaa

SEQ ID NO: 3764344 - RNA, 11 nt, Human
gcuucugucuc

SEQ ID NO: 3764345 - RNA, 23 nt, Human
gcuucugucuuauuugaaggcca

SEQ ID NO: 3764346 - RNA, 17 nt, Human
gcuucugugaugagcug

SEQ ID NO: 3764347 - RNA, 19 nt, Human
gcuucugugcccagaauac

SEQ ID NO: 3764348 - RNA, 18 nt, Human
gcuucuguggggccccuc

SEQ ID NO: 3764349 - RNA, 16 nt, Human
gcuucuguugucaccu

SEQ ID NO: 3764350 - RNA, 19 nt, Human
gcuucuguugucaccuuca

SEQ ID NO: 3764351 - RNA, 14 nt, Human
gcuucuguuucuag

SEQ ID NO: 3764352 - RNA, 15 nt, Human
gcuucuguuucuagu

SEQ ID NO: 3764353 - RNA, 16 nt, Human
gcuucuuaauuaauuu

SEQ ID NO: 3764354 - RNA, 17 nt, Human
gcuucuuaauuaauuug

SEQ ID NO: 3764355 - RNA, 18 nt, Human
gcuucuuacugauaauuu

SEQ ID NO: 3764356 - RNA, 15 nt, Human
gcuucuucagagacu

SEQ ID NO: 3764357 - RNA, 19 nt, Human
gcuucuucagagacuccug

SEQ ID NO: 3764358 - RNA, 21 nt, Human
gcuucuucagagacuccugca

SEQ ID NO: 3764359 - RNA, 18 nt, Human
gcuucuucuccuaugugu

SEQ ID NO: 3764360 - RNA, 16 nt, Human
gcuucuucugaggccu

SEQ ID NO: 3764361 - RNA, 17 nt, Human
gcuucuucugaggccug

SEQ ID NO: 3764362 - RNA, 12 nt, Human
gcuucuugccuc

SEQ ID NO: 3764363 - RNA, 15 nt, Human
gcuucuugccucugu

SEQ ID NO: 3764364 - RNA, 17 nt, Human
gcuucuugccucugugc

SEQ ID NO: 3764365 - RNA, 18 nt, Human
gcuucuugccucugugcu

SEQ ID NO: 3764366 - RNA, 21 nt, Human
gcuucuugccucugugcugug

SEQ ID NO: 3764367 - RNA, 20 nt, Human
gcuucuuuaaaaaagcuaua

SEQ ID NO: 3764368 - RNA, 22 nt, Human
gcuucuuucaagggcuuuccug

SEQ ID NO: 3764369 - RNA, 16 nt, Human
gcuucuuucauuuucu

SEQ ID NO: 3764370 - RNA, 21 nt, Human
gcuucuuucuagaaagagaaa

SEQ ID NO: 3764371 - RNA, 18 nt, Human
gcuucuuucuuugggaau

SEQ ID NO: 3764372 - RNA, 19 nt, Human
gcuugaaaagcuaguguac

SEQ ID NO: 3764373 - RNA, 19 nt, Human
gcuugaaacccguggcgcu

SEQ ID NO: 3764374 - RNA, 20 nt, Human
gcuugaaagaaaauaugcau

SEQ ID NO: 3764375 - RNA, 11 nt, Human
gcuugaacaca

SEQ ID NO: 3764376 - RNA, 13 nt, Human
gcuugaacccagg

SEQ ID NO: 3764377 - RNA, 17 nt, Human
cuucucaggacacaggc

SEQ ID NO: 3764378 - RNA, 18 nt, Human
cuucucaggacacaggcc

SEQ ID NO: 3764379 - RNA, 22 nt, Human
cuucucaggacacaggccugug

SEQ ID NO: 3764380 - RNA, 19 nt, Human
cuucucaucacacacaugg

SEQ ID NO: 3764381 - RNA, 18 nt, Human
cuucucaucacuccccuc

SEQ ID NO: 3764382 - RNA, 22 nt, Human
cuucucauuacuuguugccuau

SEQ ID NO: 3764383 - RNA, 17 nt, Human
cuucucauuucaccccu

SEQ ID NO: 3764384 - RNA, 20 nt, Human
cuucucauuuuuuaaaaaag

SEQ ID NO: 3764385 - RNA, 21 nt, Human
cuucuccaaaaaucugccugg

SEQ ID NO: 3764386 - RNA, 14 nt, Human
cuucuccaaggaaa

SEQ ID NO: 3764387 - RNA, 19 nt, Human
cuucuccaauucugcccaa

SEQ ID NO: 3764388 - RNA, 14 nt, Human
cuucuccacccugc

SEQ ID NO: 3764389 - RNA, 13 nt, Human
cuucuccacugga

SEQ ID NO: 3764390 - RNA, 11 nt, Human
cuucuccacuu

SEQ ID NO: 3764391 - RNA, 13 nt, Human
cuucuccaggcug

SEQ ID NO: 3764392 - RNA, 14 nt, Human
cuucuccaggcugu

SEQ ID NO: 3764393 - RNA, 19 nt, Human
cuucuccaggguccacagg

SEQ ID NO: 3764394 - RNA, 14 nt, Human
cuucuccauccaca

SEQ ID NO: 3764395 - RNA, 16 nt, Human
cuucuccauccacaug

SEQ ID NO: 3764396 - RNA, 14 nt, Human
cuucuccaucuggc

SEQ ID NO: 3764397 - RNA, 16 nt, Human
cuucucccacucuccu

SEQ ID NO: 3764398 - RNA, 17 nt, Human
cuucucccacucuccua

SEQ ID NO: 3764399 - RNA, 20 nt, Human
cuucucccacucuccuaggc

SEQ ID NO: 3764400 - RNA, 21 nt, Human
cuucucccaggcaaggcugug

SEQ ID NO: 3764401 - RNA, 17 nt, Human
cuucucccaucucuucc

SEQ ID NO: 3764402 - RNA, 13 nt, Human
cuucucccaugag

SEQ ID NO: 3764403 - RNA, 12 nt, Human
cuucuccccaga

SEQ ID NO: 3764404 - RNA, 13 nt, Human
cuucuccccagaa

SEQ ID NO: 3764405 - RNA, 19 nt, Human
cuucuccccagcucccagg

SEQ ID NO: 3764406 - RNA, 20 nt, Human
cuucuccccagcucccagga

SEQ ID NO: 3764407 - RNA, 17 nt, Human
cuucucccccauccuac

SEQ ID NO: 3764408 - RNA, 20 nt, Human
cuucucccccccggggcugg

SEQ ID NO: 3764409 - RNA, 22 nt, Human
cuucucccccccggggcugggu

SEQ ID NO: 3764410 - RNA, 16 nt, Human
cuucuccccugcacug

SEQ ID NO: 3764411 - RNA, 21 nt, Human
cuucuccccugcacuguaaaa

SEQ ID NO: 3764412 - RNA, 14 nt, Human
cuucuccccuucca

SEQ ID NO: 3764413 - RNA, 20 nt, Human
cuucuccccuuccauuucug

SEQ ID NO: 3764414 - RNA, 17 nt, Human
cuucuccgccagccucc

SEQ ID NO: 3764415 - RNA, 23 nt, Human
cuucuccgccagccuccucugga

SEQ ID NO: 3764416 - RNA, 14 nt, Human
cuucuccuaugugu

SEQ ID NO: 3764417 - RNA, 16 nt, Human
cuucuccuauguguaa

SEQ ID NO: 3764418 - RNA, 18 nt, Human
cuucuccucuuguaaaua

SEQ ID NO: 3764419 - RNA, 23 nt, Human
cuucuccucuuguaaauaaagcc

SEQ ID NO: 3764420 - RNA, 18 nt, Human
cuucuccuuccaacugcu

SEQ ID NO: 3764421 - RNA, 19 nt, Human
cuucuccuugauaacagcu

SEQ ID NO: 3764422 - RNA, 17 nt, Human
cuucuccuuucacaacc

SEQ ID NO: 3764423 - RNA, 22 nt, Human
cuucuccuuucacaaccuucug

SEQ ID NO: 3764424 - RNA, 21 nt, Human
cuucucguccucguuuguguu

SEQ ID NO: 3764425 - RNA, 13 nt, Human
cuucucuacagac

SEQ ID NO: 3764426 - RNA, 15 nt, Human
cuucucuauaaaaaa

SEQ ID NO: 3764427 - RNA, 18 nt, Human
cuucucuauaaaaaauau

SEQ ID NO: 3764428 - RNA, 14 nt, Human
cuucucucaccucc

SEQ ID NO: 3764429 - RNA, 15 nt, Human
cuucucucaccuccu

SEQ ID NO: 3764430 - RNA, 23 nt, Human
cuucucucagaccgucuuccucc

SEQ ID NO: 3764431 - RNA, 14 nt, Human
cuucucucaucucu

SEQ ID NO: 3764432 - RNA, 15 nt, Human
cuucucuccagcccc

SEQ ID NO: 3764433 - RNA, 14 nt, Human
cuucucuccagcug

SEQ ID NO: 3764434 - RNA, 13 nt, Human
cuucucucccugc

SEQ ID NO: 3764435 - RNA, 18 nt, Human
cuucucucucuaaaauga

SEQ ID NO: 3764436 - RNA, 13 nt, Human
cuucucucugcuc

SEQ ID NO: 3764437 - RNA, 14 nt, Human
cuucucucugcucu

SEQ ID NO: 3764438 - RNA, 18 nt, Human
cuucucugaacacaggca

SEQ ID NO: 3764439 - RNA, 22 nt, Human
cuucucugaacacaggcagcuu

SEQ ID NO: 3764440 - RNA, 13 nt, Human
cuucucugaagga

SEQ ID NO: 3764441 - RNA, 17 nt, Human
cuucucugaagggaggu

SEQ ID NO: 3764442 - RNA, 20 nt, Human
cuucucugacuucugccugg

SEQ ID NO: 3764443 - RNA, 21 nt, Human
cuucucugacuucugccugga

SEQ ID NO: 3764444 - RNA, 22 nt, Human
cuucucugacuucugccuggag

SEQ ID NO: 3764445 - RNA, 13 nt, Human
cuucucugcccau

SEQ ID NO: 3764446 - RNA, 17 nt, Human
cuucucugcccauuccc

SEQ ID NO: 3764447 - RNA, 19 nt, Human
cuucucugcccauucccca

SEQ ID NO: 3764448 - RNA, 12 nt, Human
cuucucugcucc

SEQ ID NO: 3764449 - RNA, 15 nt, Human
cuucucugcuccacc

SEQ ID NO: 3764450 - RNA, 21 nt, Human
cuucucugcuccaccacaucc

SEQ ID NO: 3764451 - RNA, 12 nt, Human
cuucucugcugc

SEQ ID NO: 3764452 - RNA, 20 nt, Human
cuucucuggagccaagucca

SEQ ID NO: 3764453 - RNA, 22 nt, Human
cuucucugugaacgauuuagaa

SEQ ID NO: 3764454 - RNA, 20 nt, Human
cuucucugugacccacuucu

SEQ ID NO: 3764455 - RNA, 13 nt, Human
cuucucuguucau

SEQ ID NO: 3764456 - RNA, 14 nt, Human
cuucucuguucauu

SEQ ID NO: 3764457 - RNA, 12 nt, Human
cuucucuuaauu

SEQ ID NO: 3764458 - RNA, 14 nt, Human
cuucucuuaauuua

SEQ ID NO: 3764459 - RNA, 16 nt, Human
cuucucuuccaggcag

SEQ ID NO: 3764460 - RNA, 17 nt, Human
cuucucuuccaggcagc

SEQ ID NO: 3764461 - RNA, 15 nt, Human
cuucucuugcuuucu

SEQ ID NO: 3764462 - RNA, 19 nt, Human
cuucucuuuaacucaggac

SEQ ID NO: 3764463 - RNA, 15 nt, Human
cuucucuuugccuca

SEQ ID NO: 3764464 - RNA, 17 nt, Human
cuucugaacucaaacug

SEQ ID NO: 3764465 - RNA, 18 nt, Human
cuucugaacucaaacuga

SEQ ID NO: 3764466 - RNA, 14 nt, Human
cuucugaauauuuu

SEQ ID NO: 3764467 - RNA, 15 nt, Human
cuucugaaugcugcu

SEQ ID NO: 3764468 - RNA, 15 nt, Human
cuucugacagccuca

SEQ ID NO: 3764469 - RNA, 19 nt, Human
cuucugacagccucaguga

SEQ ID NO: 3764470 - RNA, 19 nt, Human
cuucugacauaauccagua

SEQ ID NO: 3764471 - RNA, 23 nt, Human
cuucugacccaugcugcccugug

SEQ ID NO: 3764472 - RNA, 15 nt, Human
cuucugaccucagca

SEQ ID NO: 3764473 - RNA, 16 nt, Human
cuucugacggcccugc

SEQ ID NO: 3764474 - RNA, 17 nt, Human
cuucugacggcccugca

SEQ ID NO: 3764475 - RNA, 23 nt, Human
cuucugacucuuccccaggaagg

SEQ ID NO: 3764476 - RNA, 15 nt, Human
cuucugagcacagau

SEQ ID NO: 3764477 - RNA, 18 nt, Human
cuucugagcagcgagccu

SEQ ID NO: 3764478 - RNA, 22 nt, Human
cuucugagcccgguaagagcaa

SEQ ID NO: 3764479 - RNA, 20 nt, Human
cuucugagcuauuucaucua

SEQ ID NO: 3764480 - RNA, 13 nt, Human
cuucugagcuccu

SEQ ID NO: 3764481 - RNA, 15 nt, Human
cuucugaggacauuc

SEQ ID NO: 3764482 - RNA, 15 nt, Human
cuucugaugaaucuu

SEQ ID NO: 3764483 - RNA, 22 nt, Human
cuucugcaaaaauggauauuau

SEQ ID NO: 3764484 - RNA, 18 nt, Human
cuucugcaacaagcaugc

SEQ ID NO: 3764485 - RNA, 14 nt, Human
cuucugcacccucc

SEQ ID NO: 3764486 - RNA, 17 nt, Human
cuucugcacccuccacc

SEQ ID NO: 3764487 - RNA, 22 nt, Human
cuucugcacccuccacccuguc

SEQ ID NO: 3764488 - RNA, 17 nt, Human
cuucugcaccuuaucuu

SEQ ID NO: 3764489 - RNA, 14 nt, Human
cuucugccaagaga

SEQ ID NO: 3764490 - RNA, 12 nt, Human
cuucugccacuu

SEQ ID NO: 3764491 - RNA, 16 nt, Human
cuucugccacuuccca

SEQ ID NO: 3764492 - RNA, 17 nt, Human
cuucugccacuucccag

SEQ ID NO: 3764493 - RNA, 18 nt, Human
cuucugccagcauaauac

SEQ ID NO: 3764494 - RNA, 17 nt, Human
cuucugccauauucugu

SEQ ID NO: 3764495 - RNA, 21 nt, Human
cuucugccauauucuguuggc

SEQ ID NO: 3764496 - RNA, 20 nt, Human
cuucugccauuucugagauc

SEQ ID NO: 3764497 - RNA, 14 nt, Human
cuucugccugagcu

SEQ ID NO: 3764498 - RNA, 23 nt, Human
cuucugccugaggggcagccugc

SEQ ID NO: 3764499 - RNA, 18 nt, Human
cuucugccuuagucucag

SEQ ID NO: 3764500 - RNA, 14 nt, Human
cuucugccuucuca

SEQ ID NO: 3764501 - RNA, 15 nt, Human
cuucugcgccucagg

SEQ ID NO: 3764502 - RNA, 19 nt, Human
cuucugcuacuggcaaaag

SEQ ID NO: 3764503 - RNA, 20 nt, Human
cuucugcuacuggcaaaagg

SEQ ID NO: 3764504 - RNA, 14 nt, Human
cuucugcucagcuc

SEQ ID NO: 3764505 - RNA, 16 nt, Human
cuucugcucagcucug

SEQ ID NO: 3764506 - RNA, 12 nt, Human
cuucugcuccac

SEQ ID NO: 3764507 - RNA, 13 nt, Human
cuucugcuccacc

SEQ ID NO: 3764508 - RNA, 15 nt, Human
cuucugcuccacccu

SEQ ID NO: 3764509 - RNA, 17 nt, Human
cuucugcuccacccuug

SEQ ID NO: 3764510 - RNA, 19 nt, Human
cuucugcuccacccuuggc

SEQ ID NO: 3764511 - RNA, 15 nt, Human
cuucugcuggauaaa

SEQ ID NO: 3764512 - RNA, 13 nt, Human
cuucugcugggcu

SEQ ID NO: 3764513 - RNA, 17 nt, Human
cuucugcugggcugggg

SEQ ID NO: 3764514 - RNA, 15 nt, Human
cuucugcuggggccu

SEQ ID NO: 3764515 - RNA, 21 nt, Human
cuucugcuggggccugggaca

SEQ ID NO: 3764516 - RNA, 15 nt, Human
cuucugcuuaggaga

SEQ ID NO: 3764517 - RNA, 16 nt, Human
cuucugcuuaggagag

SEQ ID NO: 3764518 - RNA, 13 nt, Human
cuucugcuucagc

SEQ ID NO: 3764519 - RNA, 18 nt, Human
cuucugcuucagccuccc

SEQ ID NO: 3764520 - RNA, 11 nt, Human
cuucugcuuug

SEQ ID NO: 3764521 - RNA, 12 nt, Human
cuucugcuuugu

SEQ ID NO: 3764522 - RNA, 20 nt, Human
cuucugcuuuguugugugcc

SEQ ID NO: 3764523 - RNA, 14 nt, Human
cuucugcuuuucug

SEQ ID NO: 3764524 - RNA, 16 nt, Human
cuucugcuuuucugcc

SEQ ID NO: 3764525 - RNA, 21 nt, Human
cuucugcuuuucugcccuggc

SEQ ID NO: 3764526 - RNA, 22 nt, Human
cuucugcuuuucugcccuggcu

SEQ ID NO: 3764527 - RNA, 18 nt, Human
cuucuggacaggcucugc

SEQ ID NO: 3764528 - RNA, 17 nt, Human
gcucuccgaccagacac

SEQ ID NO: 3764529 - RNA, 20 nt, Human
gcucuccuagguagcccccu

SEQ ID NO: 3764530 - RNA, 17 nt, Human
gcucuccuccaccucaa

SEQ ID NO: 3764531 - RNA, 15 nt, Human
gcucuccucuucuac

SEQ ID NO: 3764532 - RNA, 15 nt, Human
gcucuccucuugcca

SEQ ID NO: 3764533 - RNA, 16 nt, Human
gcucuccugacuuuua

SEQ ID NO: 3764534 - RNA, 14 nt, Human
gcucuccugccaca

SEQ ID NO: 3764535 - RNA, 11 nt, Human
gcucuccuucc

SEQ ID NO: 3764536 - RNA, 20 nt, Human
gcucucuacccagcccaucu

SEQ ID NO: 3764537 - RNA, 19 nt, Human
gcucucuaggccucuccag

SEQ ID NO: 3764538 - RNA, 12 nt, Human
gcucucuccagg

SEQ ID NO: 3764539 - RNA, 15 nt, Human
gcucucugcagccag

SEQ ID NO: 3764540 - RNA, 20 nt, Human
gcucucugcaucuacuccca

SEQ ID NO: 3764541 - RNA, 11 nt, Human
gcucucugcca

SEQ ID NO: 3764542 - RNA, 11 nt, Human
gcucucuggcc

SEQ ID NO: 3764543 - RNA, 15 nt, Human
gcucucuggccuucg

SEQ ID NO: 3764544 - RNA, 18 nt, Human
gcucucuggccuuuuccu

SEQ ID NO: 3764545 - RNA, 18 nt, Human
gcucucuguauaaacauu

SEQ ID NO: 3764546 - RNA, 23 nt, Human
gcucucuguauaaacauuaaaug

SEQ ID NO: 3764547 - RNA, 20 nt, Human
gcucucugugggcuggcagu

SEQ ID NO: 3764548 - RNA, 18 nt, Human
gcucucugugucugagag

SEQ ID NO: 3764549 - RNA, 13 nt, Human
gcucucuuccugc

SEQ ID NO: 3764550 - RNA, 23 nt, Human
gcucucuuccugccccucuuucu

SEQ ID NO: 3764551 - RNA, 22 nt, Human
gcucucuugccgaggagccagg

SEQ ID NO: 3764552 - RNA, 23 nt, Human
gcucucuugccgaggagccaggc

SEQ ID NO: 3764553 - RNA, 14 nt, Human
gcucucuuucuguc

SEQ ID NO: 3764554 - RNA, 14 nt, Human
gcucucuuugcaac

SEQ ID NO: 3764555 - RNA, 17 nt, Human
gcucucuuuuauucugu

SEQ ID NO: 3764556 - RNA, 17 nt, Human
gcucucuuuucuguacu

SEQ ID NO: 3764557 - RNA, 23 nt, Human
gcucucuuuuucuccagggucag

SEQ ID NO: 3764558 - RNA, 14 nt, Human
gcucugacaaagcu

SEQ ID NO: 3764559 - RNA, 19 nt, Human
gcucugacaaagcuucccg

SEQ ID NO: 3764560 - RNA, 21 nt, Human
gcucugaccgaaacagcgcug

SEQ ID NO: 3764561 - RNA, 17 nt, Human
gcucugacuuuacacuc

SEQ ID NO: 3764562 - RNA, 10 nt, Human
gcucugagaa

SEQ ID NO: 3764563 - RNA, 14 nt, Human
gcucugagaagagg

SEQ ID NO: 3764564 - RNA, 23 nt, Human
gcucugagaggcccuggaucagc

SEQ ID NO: 3764565 - RNA, 14 nt, Human
gcucugagcgccuc

SEQ ID NO: 3764566 - RNA, 10 nt, Human
gcucugaggc

SEQ ID NO: 3764567 - RNA, 18 nt, Human
gcucugaggcuuccagag

SEQ ID NO: 3764568 - RNA, 19 nt, Human
gcucugaggcuuccagaga

SEQ ID NO: 3764569 - RNA, 22 nt, Human
gcucugaguaccccugcuuugg

SEQ ID NO: 3764570 - RNA, 21 nt, Human
gcucugauauuccaugaaugu

SEQ ID NO: 3764571 - RNA, 21 nt, Human
gcucugaucauccacugugcc

SEQ ID NO: 3764572 - RNA, 23 nt, Human
gcucugaucccucuacagagcuu

SEQ ID NO: 3764573 - RNA, 11 nt, Human
gcucugaugca

SEQ ID NO: 3764574 - RNA, 20 nt, Human
gcucugaugcaucagaaagg

SEQ ID NO: 3764575 - RNA, 23 nt, Human
gcucugcaagaauugaagcagga

SEQ ID NO: 3764576 - RNA, 23 nt, Human
gcucugcaaugggcacugggaug

SEQ ID NO: 3764577 - RNA, 11 nt, Human
gcucugcacag

SEQ ID NO: 3764578 - RNA, 18 nt, Human
gcucugcacagauggauu

SEQ ID NO: 3764579 - RNA, 12 nt, Human
gcucugccccag

SEQ ID NO: 3764580 - RNA, 13 nt, Human
gcucugccccagu

SEQ ID NO: 3764581 - RNA, 20 nt, Human
gcucugcccucccuccuucc

SEQ ID NO: 3764582 - RNA, 13 nt, Human
gcucugcccugcc

SEQ ID NO: 3764583 - RNA, 15 nt, Human
gcucugcccugcccu

SEQ ID NO: 3764584 - RNA, 13 nt, Human
gcucugcccuugg

SEQ ID NO: 3764585 - RNA, 14 nt, Human
gcucugcccuuggu

SEQ ID NO: 3764586 - RNA, 16 nt, Human
gcucugccgucucugg

SEQ ID NO: 3764587 - RNA, 16 nt, Human
gcucugccugacagag

SEQ ID NO: 3764588 - RNA, 14 nt, Human
gcucugcugacaga

SEQ ID NO: 3764589 - RNA, 17 nt, Human
gcucugcuggccuggcc

SEQ ID NO: 3764590 - RNA, 19 nt, Human
gcucugcuggccuggccgg

SEQ ID NO: 3764591 - RNA, 14 nt, Human
gcucuggaagagag

SEQ ID NO: 3764592 - RNA, 11 nt, Human
gcucuggaccu

SEQ ID NO: 3764593 - RNA, 12 nt, Human
gcucuggaccug

SEQ ID NO: 3764594 - RNA, 22 nt, Human
gcucuggaccugcccccgcauc

SEQ ID NO: 3764595 - RNA, 19 nt, Human
gcucuggagacagccccag

SEQ ID NO: 3764596 - RNA, 16 nt, Human
gcucuggagccaccug

SEQ ID NO: 3764597 - RNA, 22 nt, Human
gcucuggagccaccugucccac

SEQ ID NO: 3764598 - RNA, 17 nt, Human
gcucuggccuccaaguc

SEQ ID NO: 3764599 - RNA, 11 nt, Human
gcucuggcuga

SEQ ID NO: 3764600 - RNA, 17 nt, Human
gcucugggauccugggg

SEQ ID NO: 3764601 - RNA, 23 nt, Human
gcucugggccauucuccacagca

SEQ ID NO: 3764602 - RNA, 19 nt, Human
gcucuggggugggcaguuu

SEQ ID NO: 3764603 - RNA, 20 nt, Human
gcucugguuguuucuguucc

SEQ ID NO: 3764604 - RNA, 21 nt, Human
gcucugguuguuucuguucca

SEQ ID NO: 3764605 - RNA, 19 nt, Human
gcucuguaaucucguuuca

SEQ ID NO: 3764606 - RNA, 23 nt, Human
gcucuguaaucucguuucaaaaa

SEQ ID NO: 3764607 - RNA, 13 nt, Human
gcucuguccccag

SEQ ID NO: 3764608 - RNA, 15 nt, Human
gcucuguccccagcc

SEQ ID NO: 3764609 - RNA, 15 nt, Human
gcucuguccugggag

SEQ ID NO: 3764610 - RNA, 16 nt, Human
gcucuguccugggagu

SEQ ID NO: 3764611 - RNA, 23 nt, Human
gcucugucgcccaggcuggagug

SEQ ID NO: 3764612 - RNA, 22 nt, Human
gcucugugagggugcugacugg

SEQ ID NO: 3764613 - RNA, 14 nt, Human
gcucugugcaggga

SEQ ID NO: 3764614 - RNA, 19 nt, Human
gcucugugcagucacugga

SEQ ID NO: 3764615 - RNA, 19 nt, Human
gcucugugcugacccuccu

SEQ ID NO: 3764616 - RNA, 21 nt, Human
gcucugugcugacccuccugu

SEQ ID NO: 3764617 - RNA, 24 nt, Human
gcucuguggaugccagggccgacc

SEQ ID NO: 3764618 - RNA, 12 nt, Human
gcucugugggcu

SEQ ID NO: 3764619 - RNA, 24 nt, Human
gcucugugggcugcacucugugcc

SEQ ID NO: 3764620 - RNA, 16 nt, Human
gcucugugggugaugg

SEQ ID NO: 3764621 - RNA, 23 nt, Human
gcucugugggugauggggagggg

SEQ ID NO: 3764622 - RNA, 16 nt, Human
gcucuguguugccaug

SEQ ID NO: 3764623 - RNA, 20 nt, Human
gcucuguuaauaaucucaca

SEQ ID NO: 3764624 - RNA, 19 nt, Human
gcucuguucuuccucagcc

SEQ ID NO: 3764625 - RNA, 20 nt, Human
gcucuguucuuccucagcca

SEQ ID NO: 3764626 - RNA, 16 nt, Human
gcucuguugcccaggc

SEQ ID NO: 3764627 - RNA, 17 nt, Human
gcucuguugcccaggcu

SEQ ID NO: 3764628 - RNA, 18 nt, Human
gcucuuagcagcuuccag

SEQ ID NO: 3764629 - RNA, 13 nt, Human
gcucuuauuucau

SEQ ID NO: 3764630 - RNA, 15 nt, Human
gcucuuauuucauca

SEQ ID NO: 3764631 - RNA, 18 nt, Human
gcucuucaggccucccuc

SEQ ID NO: 3764632 - RNA, 18 nt, Human
gcucuuccaggcugggag

SEQ ID NO: 3764633 - RNA, 22 nt, Human
gcucuuccuggacaggccaggu

SEQ ID NO: 3764634 - RNA, 21 nt, Human
gcucuucgcgcccgccccugc

SEQ ID NO: 3764635 - RNA, 16 nt, Human
gcucuucucauuucac

SEQ ID NO: 3764636 - RNA, 22 nt, Human
gcucuucucauuucaccccucc

SEQ ID NO: 3764637 - RNA, 16 nt, Human
gcucuucuccaggcug

SEQ ID NO: 3764638 - RNA, 21 nt, Human
gcucuucuccuuucacaaccu

SEQ ID NO: 3764639 - RNA, 23 nt, Human
gcucuucugcccaauuggaggaa

SEQ ID NO: 3764640 - RNA, 14 nt, Human
gcucuugaacuccu

SEQ ID NO: 3764641 - RNA, 19 nt, Human
gcucuugaacuccugaccu

SEQ ID NO: 3764642 - RNA, 17 nt, Human
gcucuugaugccuggcg

SEQ ID NO: 3764643 - RNA, 20 nt, Human
gcucuugaugccuggcgggg

SEQ ID NO: 3764644 - RNA, 22 nt, Human
gcucuugcauaguaaauguagu

SEQ ID NO: 3764645 - RNA, 12 nt, Human
gcucuugcccuu

SEQ ID NO: 3764646 - RNA, 20 nt, Human
gcucuugcuaaucagugucu

SEQ ID NO: 3764647 - RNA, 15 nt, Human
gcucuuggcuggacc

SEQ ID NO: 3764648 - RNA, 20 nt, Human
gcucuuggcuggacccagcc

SEQ ID NO: 3764649 - RNA, 21 nt, Human
gcucuuggcuggacccagcca

SEQ ID NO: 3764650 - RNA, 23 nt, Human
gcucuuguccucaguccauuuau

SEQ ID NO: 3764651 - RNA, 16 nt, Human
gcucuugugaggaaag

SEQ ID NO: 3764652 - RNA, 20 nt, Human
gcucuugugaggaaagucau

SEQ ID NO: 3764653 - RNA, 23 nt, Human
gcucuuguuuuuauuaauuuaua

SEQ ID NO: 3764654 - RNA, 12 nt, Human
gcucuuucaggg

SEQ ID NO: 3764655 - RNA, 22 nt, Human
gcucuuucccacccagccuggg

SEQ ID NO: 3764656 - RNA, 16 nt, Human
gcucuuuccuugcuca

SEQ ID NO: 3764657 - RNA, 18 nt, Human
gcucuuuccuugcucaac

SEQ ID NO: 3764658 - RNA, 17 nt, Human
gcucuuucuacucugaa

SEQ ID NO: 3764659 - RNA, 17 nt, Human
gcucuuucucugccagu

SEQ ID NO: 3764660 - RNA, 14 nt, Human
gcucuuuggagauc

SEQ ID NO: 3764661 - RNA, 24 nt, Human
gcucuuuggccugaugaccaauuu

SEQ ID NO: 3764662 - RNA, 18 nt, Human
gcucuuuggggucagcca

SEQ ID NO: 3764663 - RNA, 13 nt, Human
gcucuuugguaga

SEQ ID NO: 3764664 - RNA, 22 nt, Human
gcucuuugguagaaaaggcuag

SEQ ID NO: 3764665 - RNA, 16 nt, Human
gcucuuugucagggag

SEQ ID NO: 3764666 - RNA, 18 nt, Human
gcucuuugucagggagug

SEQ ID NO: 3764667 - RNA, 12 nt, Human
gcucuuuuccua

SEQ ID NO: 3764668 - RNA, 21 nt, Human
gcucuuuuuuacucauugaaa

SEQ ID NO: 3764669 - RNA, 22 nt, Human
gcucuuuuuuguuuguuucuuu

SEQ ID NO: 3764670 - RNA, 20 nt, Human
gcugaaaaaucacauccugg

SEQ ID NO: 3764671 - RNA, 21 nt, Human
gcugaaaaccaucuggccugg

SEQ ID NO: 3764672 - RNA, 22 nt, Human
gcugaaaauugccuuucugugu

SEQ ID NO: 3764673 - RNA, 20 nt, Human
gcugaaauacugaggggucu

SEQ ID NO: 3764674 - RNA, 16 nt, Human
gcugaaaugcugcauu

SEQ ID NO: 3764675 - RNA, 17 nt, Human
gcugaaauucuccugga

SEQ ID NO: 3764676 - RNA, 18 nt, Human
gcugaaauucuccuggag

SEQ ID NO: 3764677 - RNA, 16 nt, Human
gcuugaacccaggagg

SEQ ID NO: 3764678 - RNA, 11 nt, Human
gcuugaagcca

SEQ ID NO: 3764679 - RNA, 20 nt, Human
gcuugaagccaaagaaaaau

SEQ ID NO: 3764680 - RNA, 11 nt, Human
gcuugaagcug

SEQ ID NO: 3764681 - RNA, 16 nt, Human
gcuugaaggcccugcu

SEQ ID NO: 3764682 - RNA, 19 nt, Human
gcuugaccaguauaaaauu

SEQ ID NO: 3764683 - RNA, 18 nt, Human
gcuugaccuuuaagagaa

SEQ ID NO: 3764684 - RNA, 17 nt, Human
gcuugacucccaaguuu

SEQ ID NO: 3764685 - RNA, 20 nt, Human
gcuugagaaauauggacacu

SEQ ID NO: 3764686 - RNA, 18 nt, Human
gcuugagccgggccccug

SEQ ID NO: 3764687 - RNA, 21 nt, Human
gcuugagccgggccccugggc

SEQ ID NO: 3764688 - RNA, 16 nt, Human
gcuugaggguugggcu

SEQ ID NO: 3764689 - RNA, 22 nt, Human
gcuugaggguugggcugguguc

SEQ ID NO: 3764690 - RNA, 19 nt, Human
gcuugaguuuggggaaugc

SEQ ID NO: 3764691 - RNA, 20 nt, Human
gcuugauagaaaugccaagc

SEQ ID NO: 3764692 - RNA, 20 nt, Human
gcuugaugaagcaaggaaga

SEQ ID NO: 3764693 - RNA, 14 nt, Human
gcuugauuuuugcc

SEQ ID NO: 3764694 - RNA, 18 nt, Human
gcuugcacucucuuggcu

SEQ ID NO: 3764695 - RNA, 11 nt, Human
gcuugcagaac

SEQ ID NO: 3764696 - RNA, 22 nt, Human
gcuugcagagaugaggccgcca

SEQ ID NO: 3764697 - RNA, 15 nt, Human
gcuugccaaggcaga

SEQ ID NO: 3764698 - RNA, 18 nt, Human
gcuugccaaggcagaggc

SEQ ID NO: 3764699 - RNA, 14 nt, Human
gcuugccacagagc

SEQ ID NO: 3764700 - RNA, 18 nt, Human
gcuugccaucccucccuc

SEQ ID NO: 3764701 - RNA, 18 nt, Human
gcuugccauuuuucaaaa

SEQ ID NO: 3764702 - RNA, 14 nt, Human
gcuugccccggccc

SEQ ID NO: 3764703 - RNA, 19 nt, Human
gcuugcccuggugccucac

SEQ ID NO: 3764704 - RNA, 16 nt, Human
gcuugccgaaacugga

SEQ ID NO: 3764705 - RNA, 19 nt, Human
gcuugccgaaacuggaagu

SEQ ID NO: 3764706 - RNA, 22 nt, Human
gcuugccuagggccugguccau

SEQ ID NO: 3764707 - RNA, 16 nt, Human
gcuugccucggcuccu

SEQ ID NO: 3764708 - RNA, 19 nt, Human
gcuugccucggcuccugcu

SEQ ID NO: 3764709 - RNA, 21 nt, Human
gcuugccucggcuccugcugc

SEQ ID NO: 3764710 - RNA, 23 nt, Human
gcuugccucggcuccugcugcac

SEQ ID NO: 3764711 - RNA, 14 nt, Human
gcuugccugcaggc

SEQ ID NO: 3764712 - RNA, 22 nt, Human
gcuugccugcagggccauggcu

SEQ ID NO: 3764713 - RNA, 14 nt, Human
gcuugccuggagac

SEQ ID NO: 3764714 - RNA, 16 nt, Human
gcuugcuagcuaugug

SEQ ID NO: 3764715 - RNA, 18 nt, Human
gcuugcuauucugucccu

SEQ ID NO: 3764716 - RNA, 13 nt, Human
gcuugcucccugu

SEQ ID NO: 3764717 - RNA, 23 nt, Human
gcuugcucuucagugggagaaaa

SEQ ID NO: 3764718 - RNA, 12 nt, Human
gcuugcugagag

SEQ ID NO: 3764719 - RNA, 12 nt, Human
gcuugcugcacc

SEQ ID NO: 3764720 - RNA, 11 nt, Human
gcuugcuggcc

SEQ ID NO: 3764721 - RNA, 23 nt, Human
gcuugcuuuucaugcaaacucuu

SEQ ID NO: 3764722 - RNA, 19 nt, Human
gcuuggaaagcaucaccuc

SEQ ID NO: 3764723 - RNA, 23 nt, Human
gcuuggaccucgugcuuuaagug

SEQ ID NO: 3764724 - RNA, 15 nt, Human
gcuuggaggaaggaa

SEQ ID NO: 3764725 - RNA, 14 nt, Human
gcuuggcacaugac

SEQ ID NO: 3764726 - RNA, 13 nt, Human
gcuuggcagcuga

SEQ ID NO: 3764727 - RNA, 16 nt, Human
gcuuggcccaggaguu

SEQ ID NO: 3764728 - RNA, 22 nt, Human
gcuuggcccaggaguuuggcca

SEQ ID NO: 3764729 - RNA, 23 nt, Human
gcuuggcccaggaguuuggccag

SEQ ID NO: 3764730 - RNA, 13 nt, Human
gcuuggcccaggg

SEQ ID NO: 3764731 - RNA, 17 nt, Human
gcuuggcccuggcagcc

SEQ ID NO: 3764732 - RNA, 13 nt, Human
gcuuggccugcug

SEQ ID NO: 3764733 - RNA, 14 nt, Human
gcuuggccugcugu

SEQ ID NO: 3764734 - RNA, 16 nt, Human
gcuuggccugcuguga

SEQ ID NO: 3764735 - RNA, 18 nt, Human
gcuuggcgaugccagcca

SEQ ID NO: 3764736 - RNA, 19 nt, Human
gcuuggcgaugccagccaa

SEQ ID NO: 3764737 - RNA, 15 nt, Human
gcuuggcuccaugcu

SEQ ID NO: 3764738 - RNA, 21 nt, Human
gcuugggaagacuccuagcug

SEQ ID NO: 3764739 - RNA, 21 nt, Human
gcuugggagagccccuggggc

SEQ ID NO: 3764740 - RNA, 16 nt, Human
gcuugggcagaucucc

SEQ ID NO: 3764741 - RNA, 17 nt, Human
gcuugggcagcaucccc

SEQ ID NO: 3764742 - RNA, 18 nt, Human
gcuugggcccagcugggc

SEQ ID NO: 3764743 - RNA, 20 nt, Human
gcuugggcccagcugggcuc

SEQ ID NO: 3764744 - RNA, 23 nt, Human
gcuugggcgccgugcugggcagc

SEQ ID NO: 3764745 - RNA, 21 nt, Human
gcuuggggaccagagcugcca

SEQ ID NO: 3764746 - RNA, 19 nt, Human
gcuuggggccaccaaagcu

SEQ ID NO: 3764747 - RNA, 20 nt, Human
gcuuggggccaccaaagcug

SEQ ID NO: 3764748 - RNA, 19 nt, Human
gcuuggguggagaagccau

SEQ ID NO: 3764749 - RNA, 19 nt, Human
gcuuggguguaacaggucu

SEQ ID NO: 3764750 - RNA, 16 nt, Human
gcuugguuccuuccca

SEQ ID NO: 3764751 - RNA, 15 nt, Human
gcuuguaaauaccag

SEQ ID NO: 3764752 - RNA, 17 nt, Human
gcuuguaacuaaaauaa

SEQ ID NO: 3764753 - RNA, 16 nt, Human
gcuuguaacuccacca

SEQ ID NO: 3764754 - RNA, 22 nt, Human
gcuuguaccacuuuugcaaaua

SEQ ID NO: 3764755 - RNA, 17 nt, Human
gcuuguagaauuguuau

SEQ ID NO: 3764756 - RNA, 15 nt, Human
gcuuguagccagccg

SEQ ID NO: 3764757 - RNA, 17 nt, Human
gcuuguagccagccggg

SEQ ID NO: 3764758 - RNA, 14 nt, Human
gcuuguaggagcug

SEQ ID NO: 3764759 - RNA, 18 nt, Human
gcuugucauuaccagacg

SEQ ID NO: 3764760 - RNA, 15 nt, Human
gcuuguccagcgccu

SEQ ID NO: 3764761 - RNA, 22 nt, Human
gcuuguccccuccucacucccu

SEQ ID NO: 3764762 - RNA, 15 nt, Human
gcuugucccugccca

SEQ ID NO: 3764763 - RNA, 13 nt, Human
gcuugugaacaga

SEQ ID NO: 3764764 - RNA, 20 nt, Human
gcuugugaauguauuuuucu

SEQ ID NO: 3764765 - RNA, 14 nt, Human
gcuugugcacaauu

SEQ ID NO: 3764766 - RNA, 23 nt, Human
gcuuguggauugaggguaggagg

SEQ ID NO: 3764767 - RNA, 18 nt, Human
gcuuguggggacccaggc

SEQ ID NO: 3764768 - RNA, 17 nt, Human
gcuuguggggccuggga

SEQ ID NO: 3764769 - RNA, 19 nt, Human
gcuuguguauccauuauca

SEQ ID NO: 3764770 - RNA, 20 nt, Human
gcuuguguauccauuaucau

SEQ ID NO: 3764771 - RNA, 22 nt, Human
gcuuguguauccauuaucaugu

SEQ ID NO: 3764772 - RNA, 14 nt, Human
gcuuguguguuuca

SEQ ID NO: 3764773 - RNA, 16 nt, Human
gcuuguguguuucacu

SEQ ID NO: 3764774 - RNA, 19 nt, Human
gcuuguguguuucacuuuu

SEQ ID NO: 3764775 - RNA, 20 nt, Human
gcuuguguguuucacuuuua

SEQ ID NO: 3764776 - RNA, 14 nt, Human
gcuuguuaaauuuu

SEQ ID NO: 3764777 - RNA, 23 nt, Human
gcuuguuaaugcuuucugaagcu

SEQ ID NO: 3764778 - RNA, 18 nt, Human
gcuuguucaucauccaga

SEQ ID NO: 3764779 - RNA, 21 nt, Human
gcuuguucaucauccagaugu

SEQ ID NO: 3764780 - RNA, 19 nt, Human
gcuuguuccaaugccacau

SEQ ID NO: 3764781 - RNA, 13 nt, Human
gcuuguugacaga

SEQ ID NO: 3764782 - RNA, 20 nt, Human
gcuuguugggauuccugacc

SEQ ID NO: 3764783 - RNA, 13 nt, Human
gcuuguugugcuu

SEQ ID NO: 3764784 - RNA, 13 nt, Human
gcuuguuuacagc

SEQ ID NO: 3764785 - RNA, 20 nt, Human
gcuuguuuacagcacuacuc

SEQ ID NO: 3764786 - RNA, 15 nt, Human
gcuuguuuacaugcu

SEQ ID NO: 3764787 - RNA, 16 nt, Human
gcuuguuuacaugcuu

SEQ ID NO: 3764788 - RNA, 23 nt, Human
gcuuguuuccuagcacacacuuu

SEQ ID NO: 3764789 - RNA, 20 nt, Human
gcuuguuuuauaaaauuuug

SEQ ID NO: 3764790 - RNA, 23 nt, Human
gcuuguuuucuugccaaugaggu

SEQ ID NO: 3764791 - RNA, 16 nt, Human
gcuuguuuuggacuuu

SEQ ID NO: 3764792 - RNA, 15 nt, Human
gcuuuaaaaacuauu

SEQ ID NO: 3764793 - RNA, 20 nt, Human
gcuuuaaaaagggaagaaac

SEQ ID NO: 3764794 - RNA, 22 nt, Human
gcuuuaaaaagggaagaaacug

SEQ ID NO: 3764795 - RNA, 13 nt, Human
gcuuuaaacaaau

SEQ ID NO: 3764796 - RNA, 14 nt, Human
gcuuuaagccuuca

SEQ ID NO: 3764797 - RNA, 13 nt, Human
gcuuuaauaaugu

SEQ ID NO: 3764798 - RNA, 21 nt, Human
gcuuuaauauaaaugcaaaua

SEQ ID NO: 3764799 - RNA, 20 nt, Human
gcuuuaauaucaucaguauu

SEQ ID NO: 3764800 - RNA, 19 nt, Human
gcuuuaauuccaugaaugu

SEQ ID NO: 3764801 - RNA, 16 nt, Human
gcuuuaauugugaauu

SEQ ID NO: 3764802 - RNA, 16 nt, Human
gcuuuacacacacaga

SEQ ID NO: 3764803 - RNA, 19 nt, Human
gcuuuacauacuuuaucaa

SEQ ID NO: 3764804 - RNA, 22 nt, Human
gcuuuaccaauugaaguaaaau

SEQ ID NO: 3764805 - RNA, 17 nt, Human
gcuuuaccuuuucaggg

SEQ ID NO: 3764806 - RNA, 18 nt, Human
gcuuuaccuuuucagggc

SEQ ID NO: 3764807 - RNA, 19 nt, Human
gcuuuacuccguaacagau

SEQ ID NO: 3764808 - RNA, 23 nt, Human
gcuuuacuggggcuggggaagga

SEQ ID NO: 3764809 - RNA, 16 nt, Human
gcuuuacuguuuguua

SEQ ID NO: 3764810 - RNA, 18 nt, Human
gcuuuacuuagcuuauca

SEQ ID NO: 3764811 - RNA, 20 nt, Human
gcuuuagaaagguuuugagc

SEQ ID NO: 3764812 - RNA, 14 nt, Human
gcuuuagacuugaa

SEQ ID NO: 3764813 - RNA, 18 nt, Human
gcuuuagacuugaaaaga

SEQ ID NO: 3764814 - RNA, 12 nt, Human
gcuuuagcuuau

SEQ ID NO: 3764815 - RNA, 14 nt, Human
gcuuuauaaauaaa

SEQ ID NO: 3764816 - RNA, 16 nt, Human
gcuuuauauauggaca

SEQ ID NO: 3764817 - RNA, 14 nt, Human
gcuuuaucaaaggg

SEQ ID NO: 3764818 - RNA, 19 nt, Human
gcuuuauccucuuuagagu

SEQ ID NO: 3764819 - RNA, 11 nt, Human
gcuuuaugauu

SEQ ID NO: 3764820 - RNA, 13 nt, Human
gcuuuaugcugaa

SEQ ID NO: 3764821 - RNA, 22 nt, Human
gcuuuaugguccuaaaagcaaa

SEQ ID NO: 3764822 - RNA, 15 nt, Human
gcuuuauguaauaau

SEQ ID NO: 3764823 - RNA, 21 nt, Human
gcuuuauuuuuuaaguauuua

SEQ ID NO: 3764824 - RNA, 23 nt, Human
gcuuucaaaggagcucgaaggau

SEQ ID NO: 3764825 - RNA, 20 nt, Human
gcuuucacggaaacucccga

SEQ ID NO: 3764826 - RNA, 17 nt, Human
gcuuucacuauuuccuu

SEQ ID NO: 3764827 - RNA, 19 nt, Human
gcuuucacuauuuccuuua

SEQ ID NO: 3764828 - RNA, 18 nt, Human
gcuuucagaaaacgggaa

SEQ ID NO: 3764829 - RNA, 19 nt, Human
gcuuucagaaaacgggaag

SEQ ID NO: 3764830 - RNA, 15 nt, Human
gcuuucagaagugcc

SEQ ID NO: 3764831 - RNA, 13 nt, Human
gcuuucagagccu

SEQ ID NO: 3764832 - RNA, 15 nt, Human
gcuuucagccucugg

SEQ ID NO: 3764833 - RNA, 18 nt, Human
gcuuucagggaggcccug

SEQ ID NO: 3764834 - RNA, 12 nt, Human
gcuuucaguauu

SEQ ID NO: 3764835 - RNA, 18 nt, Human
gcuuucaugauuagcaag

SEQ ID NO: 3764836 - RNA, 15 nt, Human
gcuuucauguaaacu

SEQ ID NO: 3764837 - RNA, 21 nt, Human
gcuuucauuuucucucaggug

SEQ ID NO: 3764838 - RNA, 19 nt, Human
gcuuuccaaaccuuaucuc

SEQ ID NO: 3764839 - RNA, 22 nt, Human
gcuuuccaaaccuuaucuccac

SEQ ID NO: 3764840 - RNA, 18 nt, Human
gcuuuccacaccuggcac

SEQ ID NO: 3764841 - RNA, 11 nt, Human
gcuuuccagcu

SEQ ID NO: 3764842 - RNA, 20 nt, Human
gcuuuccauauuuuuuuccu

SEQ ID NO: 3764843 - RNA, 21 nt, Human
gcuuucccacuucccacccug

SEQ ID NO: 3764844 - RNA, 17 nt, Human
gcuuuccccugugggga

SEQ ID NO: 3764845 - RNA, 15 nt, Human
gcuuucccuuggaua

SEQ ID NO: 3764846 - RNA, 16 nt, Human
gcuuuccucuuccuga

SEQ ID NO: 3764847 - RNA, 17 nt, Human
gcuuuccugccccaggc

SEQ ID NO: 3764848 - RNA, 14 nt, Human
gcuuuccugugcca

SEQ ID NO: 3764849 - RNA, 22 nt, Human
gcuuuccuuguggcagaggaug

SEQ ID NO: 3764850 - RNA, 23 nt, Human
gcuuuccuuuuuuaaaaaugcaa

SEQ ID NO: 3764851 - RNA, 13 nt, Human
gcuuucguccaca

SEQ ID NO: 3764852 - RNA, 19 nt, Human
gcuuucguguaaauuaugu

SEQ ID NO: 3764853 - RNA, 18 nt, Human
gcuuucucugcuucagcu

SEQ ID NO: 3764854 - RNA, 13 nt, Human
gcuuucucuucau

SEQ ID NO: 3764855 - RNA, 19 nt, Human
gcuuucugaacagcuggug

SEQ ID NO: 3764856 - RNA, 13 nt, Human
gcuuucugccacc

SEQ ID NO: 3764857 - RNA, 13 nt, Human
gcuuucuggagag

SEQ ID NO: 3764858 - RNA, 23 nt, Human
gcuuucuggggccuagcgaucuc

SEQ ID NO: 3764859 - RNA, 23 nt, Human
gcuuucuguugucauugcuguug

SEQ ID NO: 3764860 - RNA, 14 nt, Human
gcuuucuugcuggu

SEQ ID NO: 3764861 - RNA, 16 nt, Human
gcuuugaauaaaugug

SEQ ID NO: 3764862 - RNA, 20 nt, Human
gcuuugacucaggagccugu

SEQ ID NO: 3764863 - RNA, 15 nt, Human
gcuuugaguccccca

SEQ ID NO: 3764864 - RNA, 14 nt, Human
gcuuugaucccuga

SEQ ID NO: 3764865 - RNA, 14 nt, Human
gcuuugaucccuuc

SEQ ID NO: 3764866 - RNA, 15 nt, Human
gcuuugauguuccuu

SEQ ID NO: 3764867 - RNA, 19 nt, Human
gcuuugauguuccuuccag

SEQ ID NO: 3764868 - RNA, 15 nt, Human
gcuuugauucauagu

SEQ ID NO: 3764869 - RNA, 16 nt, Human
gcuuugauuccaucuc

SEQ ID NO: 3764870 - RNA, 20 nt, Human
gcuuugauuccaucuccuug

SEQ ID NO: 3764871 - RNA, 21 nt, Human
gcuuugauuuagauugaguaa

SEQ ID NO: 3764872 - RNA, 13 nt, Human
gcuuugcacuuuu

SEQ ID NO: 3764873 - RNA, 19 nt, Human
gcuuugccagcugcugcug

SEQ ID NO: 3764874 - RNA, 23 nt, Human
gcuuugcccaacaccagccccug

SEQ ID NO: 3764875 - RNA, 22 nt, Human
gcuuugccuuccacgcugucuc

SEQ ID NO: 3764876 - RNA, 16 nt, Human
gcuuugcuaccaaagc

SEQ ID NO: 3764877 - RNA, 12 nt, Human
gcuuugcucugc

SEQ ID NO: 3764878 - RNA, 13 nt, Human
gcuuugcucugcc

SEQ ID NO: 3764879 - RNA, 16 nt, Human
gcuuugcugcuacagg

SEQ ID NO: 3764880 - RNA, 19 nt, Human
gcuuugcuuucugcucagc

SEQ ID NO: 3764881 - RNA, 14 nt, Human
gcuuuggaagccau

SEQ ID NO: 3764882 - RNA, 14 nt, Human
gcuuuggaaguuuu

SEQ ID NO: 3764883 - RNA, 18 nt, Human
gcuuuggacccaaggaaa

SEQ ID NO: 3764884 - RNA, 18 nt, Human
gcuuuggacgcacacagc

SEQ ID NO: 3764885 - RNA, 18 nt, Human
gcuuugggcugcccuggu

SEQ ID NO: 3764886 - RNA, 18 nt, Human
gcuuuggggugucuuuuu

SEQ ID NO: 3764887 - RNA, 15 nt, Human
gcuuuguaggugucu

SEQ ID NO: 3764888 - RNA, 12 nt, Human
gcuuuguauaga

SEQ ID NO: 3764889 - RNA, 16 nt, Human
gcuuugucccacagcu

SEQ ID NO: 3764890 - RNA, 19 nt, Human
gcuuugucccacagcuugg

SEQ ID NO: 3764891 - RNA, 19 nt, Human
gcuuugucuccucuauccu

SEQ ID NO: 3764892 - RNA, 14 nt, Human
gcuuugucugucgu

SEQ ID NO: 3764893 - RNA, 16 nt, Human
gcuuugugugauugaa

SEQ ID NO: 3764894 - RNA, 13 nt, Human
gcuuuguguugua

SEQ ID NO: 3764895 - RNA, 22 nt, Human
gcuuuguguuguaauucuucag

SEQ ID NO: 3764896 - RNA, 13 nt, Human
gcuuuguguuugg

SEQ ID NO: 3764897 - RNA, 19 nt, Human
gcuuuguguuugguuuaca

SEQ ID NO: 3764898 - RNA, 20 nt, Human
gcuuuguguuugguuuacau

SEQ ID NO: 3764899 - RNA, 23 nt, Human
gcuuuguuaaaaaaaaaaagauu

SEQ ID NO: 3764900 - RNA, 15 nt, Human
gcuuuguugugugcc

SEQ ID NO: 3764901 - RNA, 17 nt, Human
gcuuuguugugugccuc

SEQ ID NO: 3764902 - RNA, 23 nt, Human
gcuuuguugugugccucuagcug

SEQ ID NO: 3764903 - RNA, 21 nt, Human
gcuuuguuuguugucagcuga

SEQ ID NO: 3764904 - RNA, 23 nt, Human
gcuuuguuuugcacacuuugcca

SEQ ID NO: 3764905 - RNA, 20 nt, Human
gcuuuuaaaacuacuuagca

SEQ ID NO: 3764906 - RNA, 23 nt, Human
gcuuuuaacuuuauaaauccagu

SEQ ID NO: 3764907 - RNA, 18 nt, Human
gcuuuuaaggaaaggcaa

SEQ ID NO: 3764908 - RNA, 20 nt, Human
gcuuuuaaugaaaaggaauc

SEQ ID NO: 3764909 - RNA, 17 nt, Human
gcuuuuacccuuuuucu

SEQ ID NO: 3764910 - RNA, 16 nt, Human
gcuuuuaccuuuuucu

SEQ ID NO: 3764911 - RNA, 19 nt, Human
gcuuuuacugaacuuucuu

SEQ ID NO: 3764912 - RNA, 21 nt, Human
gcuuuuacugaagccuuucuu

SEQ ID NO: 3764913 - RNA, 14 nt, Human
gcuuuuacuuaaac

SEQ ID NO: 3764914 - RNA, 12 nt, Human
gcuuuuagaaaa

SEQ ID NO: 3764915 - RNA, 22 nt, Human
gcuuuuaguacccaccugagcu

SEQ ID NO: 3764916 - RNA, 22 nt, Human
gcuuuuauagaggcuagcuucu

SEQ ID NO: 3764917 - RNA, 20 nt, Human
gcuuuuaugugaaacauguu

SEQ ID NO: 3764918 - RNA, 19 nt, Human
gcuuuuauuaaugcacuuu

SEQ ID NO: 3764919 - RNA, 22 nt, Human
gcuuuuauuaaugcacuuucua

SEQ ID NO: 3764920 - RNA, 15 nt, Human
gcuuuuauuuugaaa

SEQ ID NO: 3764921 - RNA, 22 nt, Human
gcuuuuauuuugaaaagcuucu

SEQ ID NO: 3764922 - RNA, 14 nt, Human
gcuuuucaaacaaa

SEQ ID NO: 3764923 - RNA, 13 nt, Human
gcuuuucacugcu

SEQ ID NO: 3764924 - RNA, 22 nt, Human
gcuuuucacugcuggcugccuu

SEQ ID NO: 3764925 - RNA, 23 nt, Human
gcuuuucagauuguggaauguug

SEQ ID NO: 3764926 - RNA, 15 nt, Human
gcuuuucccucuuuu

SEQ ID NO: 3764927 - RNA, 20 nt, Human
gcuuuucccuuuuuuuaagu

SEQ ID NO: 3764928 - RNA, 22 nt, Human
gcuuuuccuauuuguuuucaug

SEQ ID NO: 3764929 - RNA, 20 nt, Human
gcuuuuccuuggggcaggca

SEQ ID NO: 3764930 - RNA, 23 nt, Human
gcuuuuccuuggggcaggcagug

SEQ ID NO: 3764931 - RNA, 11 nt, Human
gcuuuucugau

SEQ ID NO: 3764932 - RNA, 15 nt, Human
gcuuuucugcccugg

SEQ ID NO: 3764933 - RNA, 18 nt, Human
gcuuuucugcccuggcug

SEQ ID NO: 3764934 - RNA, 14 nt, Human
gcuuuucuguauuu

SEQ ID NO: 3764935 - RNA, 18 nt, Human
gcuuuucuguauuuuauu

SEQ ID NO: 3764936 - RNA, 18 nt, Human
gcuuuucuguuuccugua

SEQ ID NO: 3764937 - RNA, 17 nt, Human
gcuuuucuuucuaccaa

SEQ ID NO: 3764938 - RNA, 13 nt, Human
gcuuuugccauua

SEQ ID NO: 3764939 - RNA, 23 nt, Human
gcuuuugcgguucaggaaaauug

SEQ ID NO: 3764940 - RNA, 22 nt, Human
gcuuuugcuggucacugccaug

SEQ ID NO: 3764941 - RNA, 21 nt, Human
gcuuuuggcggggaggaggaa

SEQ ID NO: 3764942 - RNA, 19 nt, Human
gcuuuugugauggagugcu

SEQ ID NO: 3764943 - RNA, 19 nt, Human
gcuuuugugcauuaucuag

SEQ ID NO: 3764944 - RNA, 23 nt, Human
gcuuuugugggggacuguaaguu

SEQ ID NO: 3764945 - RNA, 14 nt, Human
gcuuuuguuuugcu

SEQ ID NO: 3764946 - RNA, 15 nt, Human
gcuuuuuaauauuga

SEQ ID NO: 3764947 - RNA, 20 nt, Human
gcuuuuuaauuguuguuucu

SEQ ID NO: 3764948 - RNA, 21 nt, Human
gcuuuuuaauuguuguuucuu

SEQ ID NO: 3764949 - RNA, 22 nt, Human
gcuuuuuaauuguuguuucuuu

SEQ ID NO: 3764950 - RNA, 13 nt, Human
gcuuuuuauaaaa

SEQ ID NO: 3764951 - RNA, 15 nt, Human
gcuuuuuauuucugc

SEQ ID NO: 3764952 - RNA, 15 nt, Human
gcuuuuucacaguca

SEQ ID NO: 3764953 - RNA, 13 nt, Human
gcuuuuuccagag

SEQ ID NO: 3764954 - RNA, 14 nt, Human
gcuuuuugaaaacc

SEQ ID NO: 3764955 - RNA, 13 nt, Human
gcuuuuugaaaug

SEQ ID NO: 3764956 - RNA, 20 nt, Human
cuugccucagcuuccccagu

SEQ ID NO: 3764957 - RNA, 15 nt, Human
cuugccuccaggugc

SEQ ID NO: 3764958 - RNA, 16 nt, Human
cuugccuccaggugca

SEQ ID NO: 3764959 - RNA, 18 nt, Human
cuugccuccaggugcaga

SEQ ID NO: 3764960 - RNA, 23 nt, Human
cuugccuccaggugcagagguac

SEQ ID NO: 3764961 - RNA, 12 nt, Human
cuugccucccca

SEQ ID NO: 3764962 - RNA, 13 nt, Human
cuugccuccugga

SEQ ID NO: 3764963 - RNA, 15 nt, Human
cuugccucggcuccu

SEQ ID NO: 3764964 - RNA, 16 nt, Human
cuugccucggcuccug

SEQ ID NO: 3764965 - RNA, 20 nt, Human
cuugccucggcuccugcugc

SEQ ID NO: 3764966 - RNA, 21 nt, Human
cuugccucggcuccugcugca

SEQ ID NO: 3764967 - RNA, 24 nt, Human
cuugccucugcacacccuccagag

SEQ ID NO: 3764968 - RNA, 15 nt, Human
cuugccucugugcug

SEQ ID NO: 3764969 - RNA, 19 nt, Human
cuugccucugugcugugug

SEQ ID NO: 3764970 - RNA, 16 nt, Human
cuugccucuuccuuga

SEQ ID NO: 3764971 - RNA, 20 nt, Human
cuugccugaacauccuuccu

SEQ ID NO: 3764972 - RNA, 14 nt, Human
cuugccugauauaa

SEQ ID NO: 3764973 - RNA, 16 nt, Human
cuugccugcacaaacu

SEQ ID NO: 3764974 - RNA, 12 nt, Human
cuugccugcagg

SEQ ID NO: 3764975 - RNA, 13 nt, Human
cuugccugcaggc

SEQ ID NO: 3764976 - RNA, 15 nt, Human
cuugccugccuuucc

SEQ ID NO: 3764977 - RNA, 15 nt, Human
cuugccugguacagu

SEQ ID NO: 3764978 - RNA, 20 nt, Human
cuugccuguuucccaggccc

SEQ ID NO: 3764979 - RNA, 18 nt, Human
cuugccuuauuagagugu

SEQ ID NO: 3764980 - RNA, 20 nt, Human
cuugccuuauuagagugucu

SEQ ID NO: 3764981 - RNA, 21 nt, Human
cuugccuuccuaagccugugg

SEQ ID NO: 3764982 - RNA, 14 nt, Human
cuugccuuugaaga

SEQ ID NO: 3764983 - RNA, 22 nt, Human
cuugccuuuuucauuauuuuau

SEQ ID NO: 3764984 - RNA, 14 nt, Human
cuugcgaauccaag

SEQ ID NO: 3764985 - RNA, 20 nt, Human
cuugcgguuccggcauggac

SEQ ID NO: 3764986 - RNA, 15 nt, Human
cuugcuaaucagugu

SEQ ID NO: 3764987 - RNA, 21 nt, Human
cuugcuaaucagugucucaca

SEQ ID NO: 3764988 - RNA, 22 nt, Human
cuugcuaaucagugucucacac

SEQ ID NO: 3764989 - RNA, 17 nt, Human
cuugcuaauuuucucaa

SEQ ID NO: 3764990 - RNA, 22 nt, Human
cuugcuaccacggccuccuuuc

SEQ ID NO: 3764991 - RNA, 14 nt, Human
cuugcuauucuguc

SEQ ID NO: 3764992 - RNA, 17 nt, Human
cuugcuauucugucccu

SEQ ID NO: 3764993 - RNA, 15 nt, Human
cuugcucccuguguc

SEQ ID NO: 3764994 - RNA, 20 nt, Human
cuugcuccuggccuugcuga

SEQ ID NO: 3764995 - RNA, 22 nt, Human
cuugcucuaucucacagcacac

SEQ ID NO: 3764996 - RNA, 15 nt, Human
cuugcucucccucuu

SEQ ID NO: 3764997 - RNA, 12 nt, Human
cuugcucugcug

SEQ ID NO: 3764998 - RNA, 15 nt, Human
cuugcucuggaccug

SEQ ID NO: 3764999 - RNA, 16 nt, Human
cuugcucuggaccugc

SEQ ID NO: 3765000 - RNA, 18 nt, Human
cuugcucuggaccugccc

SEQ ID NO: 3765001 - RNA, 15 nt, Human
cuugcucuguaaucu

SEQ ID NO: 3765002 - RNA, 19 nt, Human
cuugcucuguuuguggggu

SEQ ID NO: 3765003 - RNA, 20 nt, Human
cuugcugcaagcacagcccu

SEQ ID NO: 3765004 - RNA, 21 nt, Human
cuugcugcaagcacagcccuu

SEQ ID NO: 3765005 - RNA, 12 nt, Human
cuugcugcaccc

SEQ ID NO: 3765006 - RNA, 16 nt, Human
cuugcugcacucuugc

SEQ ID NO: 3765007 - RNA, 16 nt, Human
cuugcugcccugcccc

SEQ ID NO: 3765008 - RNA, 20 nt, Human
cuugcugcccugccccaagu

SEQ ID NO: 3765009 - RNA, 11 nt, Human
cuugcugccuc

SEQ ID NO: 3765010 - RNA, 13 nt, Human
cuugcugccucgg

SEQ ID NO: 3765011 - RNA, 20 nt, Human
cuugcugccuucuggauucu

SEQ ID NO: 3765012 - RNA, 14 nt, Human
cuugcugcuagaac

SEQ ID NO: 3765013 - RNA, 17 nt, Human
cuugcugcuagaacuuu

SEQ ID NO: 3765014 - RNA, 17 nt, Human
cuugcugcugauuuaaa

SEQ ID NO: 3765015 - RNA, 22 nt, Human
cuugcuggacggggacugggga

SEQ ID NO: 3765016 - RNA, 16 nt, Human
ggaaggauuguaaaaa

SEQ ID NO: 3765017 - RNA, 17 nt, Human
ggaaggcagacagcagg

SEQ ID NO: 3765018 - RNA, 22 nt, Human
ggaaggcagacagcaggcagcg

SEQ ID NO: 3765019 - RNA, 14 nt, Human
ggaaggcaggcagg

SEQ ID NO: 3765020 - RNA, 17 nt, Human
ggaaggcagggaggagg

SEQ ID NO: 3765021 - RNA, 22 nt, Human
ggaaggccaaggggagucaccu

SEQ ID NO: 3765022 - RNA, 15 nt, Human
ggaaggcccagcacc

SEQ ID NO: 3765023 - RNA, 12 nt, Human
ggaaggccugac

SEQ ID NO: 3765024 - RNA, 19 nt, Human
ggaaggcuacuucggggcu

SEQ ID NO: 3765025 - RNA, 21 nt, Human
ggaaggcucuucuccccagag

SEQ ID NO: 3765026 - RNA, 19 nt, Human
ggaaggcuuguugugcuuu

SEQ ID NO: 3765027 - RNA, 15 nt, Human
ggaagggaccaaggc

SEQ ID NO: 3765028 - RNA, 16 nt, Human
ggaagggaccaaggca

SEQ ID NO: 3765029 - RNA, 16 nt, Human
ggaagggacuaggagc

SEQ ID NO: 3765030 - RNA, 15 nt, Human
ggaagggagccaagg

SEQ ID NO: 3765031 - RNA, 15 nt, Human
ggaagggcaggaagg

SEQ ID NO: 3765032 - RNA, 21 nt, Human
ggaaggggcccgugggaguca

SEQ ID NO: 3765033 - RNA, 20 nt, Human
ggaaggggcuggacuggcug

SEQ ID NO: 3765034 - RNA, 21 nt, Human
ggaagggggggcuacauuaua

SEQ ID NO: 3765035 - RNA, 21 nt, Human
ggaagggguuccucaaauuuu

SEQ ID NO: 3765036 - RNA, 22 nt, Human
ggaagggguuccucaaauuuuu

SEQ ID NO: 3765037 - RNA, 19 nt, Human
ggaaggugggcgggcaggg

SEQ ID NO: 3765038 - RNA, 18 nt, Human
ggaagguuuguauauugu

SEQ ID NO: 3765039 - RNA, 23 nt, Human
ggaaguaacaguaacgcagggga

SEQ ID NO: 3765040 - RNA, 18 nt, Human
ggaaguacaugaauacaa

SEQ ID NO: 3765041 - RNA, 12 nt, Human
ggaaguacugga

SEQ ID NO: 3765042 - RNA, 15 nt, Human
ggaaguagcacaggc

SEQ ID NO: 3765043 - RNA, 17 nt, Human
ggaaguagcacaggcug

SEQ ID NO: 3765044 - RNA, 18 nt, Human
ggaaguagcacaggcuga

SEQ ID NO: 3765045 - RNA, 18 nt, Human
ggaaguauguauauuaaa

SEQ ID NO: 3765046 - RNA, 18 nt, Human
ggaaguccccaggcccca

SEQ ID NO: 3765047 - RNA, 23 nt, Human
ggaaguccccaggccccaggaag

SEQ ID NO: 3765048 - RNA, 16 nt, Human
ggaaguccggccccag

SEQ ID NO: 3765049 - RNA, 21 nt, Human
ggaagucguccuuacuccugu

SEQ ID NO: 3765050 - RNA, 23 nt, Human
ggaagucguccuuacuccugugg

SEQ ID NO: 3765051 - RNA, 14 nt, Human
ggaagucuaggagc

SEQ ID NO: 3765052 - RNA, 22 nt, Human
ggaagucucaaauaauauuuuu

SEQ ID NO: 3765053 - RNA, 17 nt, Human
ggaagugacaaggcccc

SEQ ID NO: 3765054 - RNA, 19 nt, Human
ggaagugacaaggccccag

SEQ ID NO: 3765055 - RNA, 18 nt, Human
ggaagugcuaauuuugaa

SEQ ID NO: 3765056 - RNA, 22 nt, Human
ggaaguggcugagucaggacuu

SEQ ID NO: 3765057 - RNA, 11 nt, Human
ggaaguuuuca

SEQ ID NO: 3765058 - RNA, 18 nt, Human
ggaaguuuugcauuuaug

SEQ ID NO: 3765059 - RNA, 14 nt, Human
ggaauaaaauacua

SEQ ID NO: 3765060 - RNA, 12 nt, Human
ggaauaaauaug

SEQ ID NO: 3765061 - RNA, 18 nt, Human
ggaauaacauguaauuaa

SEQ ID NO: 3765062 - RNA, 22 nt, Human
ggaauaaccuuccauacauuuu

SEQ ID NO: 3765063 - RNA, 13 nt, Human
ggaauaauaccua

SEQ ID NO: 3765064 - RNA, 15 nt, Human
ggaauaauagaagaa

SEQ ID NO: 3765065 - RNA, 13 nt, Human
ggaauaauuauuu

SEQ ID NO: 3765066 - RNA, 14 nt, Human
ggaauaauugcuuu

SEQ ID NO: 3765067 - RNA, 17 nt, Human
ggaauaguauccuccag

SEQ ID NO: 3765068 - RNA, 19 nt, Human
ggaauaguauccuccaggu

SEQ ID NO: 3765069 - RNA, 20 nt, Human
ggaauaguauccuccagguu

SEQ ID NO: 3765070 - RNA, 16 nt, Human
ggaauaguugagcccc

SEQ ID NO: 3765071 - RNA, 23 nt, Human
ggaauauaaggaaagcaauaaau

SEQ ID NO: 3765072 - RNA, 16 nt, Human
ggaauauauaaccagu

SEQ ID NO: 3765073 - RNA, 17 nt, Human
ggaauaugggagaaaua

SEQ ID NO: 3765074 - RNA, 15 nt, Human
ggaauauuaaaaaac

SEQ ID NO: 3765075 - RNA, 15 nt, Human
ggaauauuuauaaau

SEQ ID NO: 3765076 - RNA, 15 nt, Human
ggaauauuugaaucu

SEQ ID NO: 3765077 - RNA, 13 nt, Human
ggaauauuuuauu

SEQ ID NO: 3765078 - RNA, 14 nt, Human
ggaaucaaaaauug

SEQ ID NO: 3765079 - RNA, 16 nt, Human
ggaaucaacagggcag

SEQ ID NO: 3765080 - RNA, 23 nt, Human
ggaaucaagagcugcccuccuug

SEQ ID NO: 3765081 - RNA, 20 nt, Human
ggaaucacucuuguggaugu

SEQ ID NO: 3765082 - RNA, 13 nt, Human
ggaaucagcuucu

SEQ ID NO: 3765083 - RNA, 14 nt, Human
ggaaucagcuucua

SEQ ID NO: 3765084 - RNA, 15 nt, Human
ggaaucaugucaggc

SEQ ID NO: 3765085 - RNA, 21 nt, Human
ggaaucaugucaggccugugu

SEQ ID NO: 3765086 - RNA, 17 nt, Human
ggaaucauuguccagag

SEQ ID NO: 3765087 - RNA, 24 nt, Human
ggaaucauuucuauuucuccucca

SEQ ID NO: 3765088 - RNA, 16 nt, Human
ggaauccagacccggc

SEQ ID NO: 3765089 - RNA, 23 nt, Human
ggaauccuauauagaaugcugca

SEQ ID NO: 3765090 - RNA, 14 nt, Human
ggaauccuccucca

SEQ ID NO: 3765091 - RNA, 20 nt, Human
ggaaucgaggaaccagagcc

SEQ ID NO: 3765092 - RNA, 22 nt, Human
ggaaucuaauauccccaaauua

SEQ ID NO: 3765093 - RNA, 18 nt, Human
ggaaucuagaagaaauga

SEQ ID NO: 3765094 - RNA, 18 nt, Human
ggaaucuucucuuugaca

SEQ ID NO: 3765095 - RNA, 23 nt, Human
ggaaugaacuuauuaauauuuuu

SEQ ID NO: 3765096 - RNA, 12 nt, Human
ggaaugaagcuu

SEQ ID NO: 3765097 - RNA, 16 nt, Human
ggaaugaagcuugugu

SEQ ID NO: 3765098 - RNA, 20 nt, Human
ggaaugagauuaauuccuuu

SEQ ID NO: 3765099 - RNA, 17 nt, Human
ggaaugagcccagagaa

SEQ ID NO: 3765100 - RNA, 17 nt, Human
ggaaugagcugaaggug

SEQ ID NO: 3765101 - RNA, 20 nt, Human
ggaaugaggcuugcugagag

SEQ ID NO: 3765102 - RNA, 20 nt, Human
ggaaugauauaagguuuuuu

SEQ ID NO: 3765103 - RNA, 18 nt, Human
ggaaugauaugcauuuga

SEQ ID NO: 3765104 - RNA, 12 nt, Human
ggaaugcagugg

SEQ ID NO: 3765105 - RNA, 16 nt, Human
ggaaugcggcaagaag

SEQ ID NO: 3765106 - RNA, 23 nt, Human
ggaaugcggccgcauucccugag

SEQ ID NO: 3765107 - RNA, 18 nt, Human
ggaaugcuugaaaaaugu

SEQ ID NO: 3765108 - RNA, 21 nt, Human
ggaauggaaaaagcagaaggc

SEQ ID NO: 3765109 - RNA, 14 nt, Human
ggaauggaggggca

SEQ ID NO: 3765110 - RNA, 16 nt, Human
ggaauggaggggcaga

SEQ ID NO: 3765111 - RNA, 12 nt, Human
ggaaugggcugu

SEQ ID NO: 3765112 - RNA, 20 nt, Human
ggaauguaacugcugaaaac

SEQ ID NO: 3765113 - RNA, 15 nt, Human
ggaauguguggccug

SEQ ID NO: 3765114 - RNA, 15 nt, Human
ggaauguuggauaag

SEQ ID NO: 3765115 - RNA, 20 nt, Human
ggaauguuggauaaggaauu

SEQ ID NO: 3765116 - RNA, 22 nt, Human
ggaauuaaguuaucuuuaaaau

SEQ ID NO: 3765117 - RNA, 22 nt, Human
ggaauuagcuuggggccaggga

SEQ ID NO: 3765118 - RNA, 15 nt, Human
ggaauuauuuuaaaa

SEQ ID NO: 3765119 - RNA, 13 nt, Human
ggaauucucuugg

SEQ ID NO: 3765120 - RNA, 22 nt, Human
ggaauuggagcucgugggacag

SEQ ID NO: 3765121 - RNA, 13 nt, Human
ggaauuguggcua

SEQ ID NO: 3765122 - RNA, 12 nt, Human
ggaauuguguuu

SEQ ID NO: 3765123 - RNA, 23 nt, Human
ggaauuuaagagcaguccauuuc

SEQ ID NO: 3765124 - RNA, 16 nt, Human
ggaauuucccaggacc

SEQ ID NO: 3765125 - RNA, 18 nt, Human
ggaauuucuuaacuucuu

SEQ ID NO: 3765126 - RNA, 22 nt, Human
ggaauuucuuaacuucuugcuu

SEQ ID NO: 3765127 - RNA, 16 nt, Human
ggaauuucuuguuucu

SEQ ID NO: 3765128 - RNA, 19 nt, Human
ggaauuuggaaaucucuuu

SEQ ID NO: 3765129 - RNA, 16 nt, Human
ggaauuuguaaccuca

SEQ ID NO: 3765130 - RNA, 18 nt, Human
ggaauuuguaaccucagc

SEQ ID NO: 3765131 - RNA, 12 nt, Human
ggaauuuguaag

SEQ ID NO: 3765132 - RNA, 20 nt, Human
ggaauuuucuccaauuuuuu

SEQ ID NO: 3765133 - RNA, 17 nt, Human
ggaauuuuugcuugacu

SEQ ID NO: 3765134 - RNA, 15 nt, Human
ggaauuuuuuauucu

SEQ ID NO: 3765135 - RNA, 17 nt, Human
ggaauuuuuuauucuug

SEQ ID NO: 3765136 - RNA, 20 nt, Human
ggaauuuuuuauucuuguga

SEQ ID NO: 3765137 - RNA, 18 nt, Human
ggacaaaacccaccuugu

SEQ ID NO: 3765138 - RNA, 15 nt, Human
ggacaaaggagccug

SEQ ID NO: 3765139 - RNA, 15 nt, Human
ggacaaaguauuuga

SEQ ID NO: 3765140 - RNA, 15 nt, Human
ggacaaagucuccag

SEQ ID NO: 3765141 - RNA, 19 nt, Human
ggacaaagucuccagccca

SEQ ID NO: 3765142 - RNA, 12 nt, Human
ggacaaagugcc

SEQ ID NO: 3765143 - RNA, 17 nt, Human
ggacaaagugccaaaga

SEQ ID NO: 3765144 - RNA, 18 nt, Human
ggacaaagugccaaagaa

SEQ ID NO: 3765145 - RNA, 21 nt, Human
ggacaaaucacauauuuuaaa

SEQ ID NO: 3765146 - RNA, 12 nt, Human
ggacaaauguga

SEQ ID NO: 3765147 - RNA, 19 nt, Human
ggacaaaugugaagaugca

SEQ ID NO: 3765148 - RNA, 14 nt, Human
ggacaaauugagac

SEQ ID NO: 3765149 - RNA, 13 nt, Human
ggacaagcagagg

SEQ ID NO: 3765150 - RNA, 20 nt, Human
ggacaagccaacuuguaaau

SEQ ID NO: 3765151 - RNA, 18 nt, Human
ggacaagcuucugagacg

SEQ ID NO: 3765152 - RNA, 20 nt, Human
ggacaaggaggucugugcca

SEQ ID NO: 3765153 - RNA, 22 nt, Human
ggacaagggaaaauaaaaaaag

SEQ ID NO: 3765154 - RNA, 12 nt, Human
ggacaauaaacc

SEQ ID NO: 3765155 - RNA, 15 nt, Human
ggacaauaugugcca

SEQ ID NO: 3765156 - RNA, 18 nt, Human
ggacaaucaguccccucc

SEQ ID NO: 3765157 - RNA, 23 nt, Human
ggacaauggaccggagagugggg

SEQ ID NO: 3765158 - RNA, 17 nt, Human
ggacacaaaacuccgcc

SEQ ID NO: 3765159 - RNA, 20 nt, Human
ggacacaaaacuccgccccc

SEQ ID NO: 3765160 - RNA, 14 nt, Human
ggacacacagccua

SEQ ID NO: 3765161 - RNA, 14 nt, Human
ggacacagcucuuc

SEQ ID NO: 3765162 - RNA, 12 nt, Human
ggacacaggccu

SEQ ID NO: 3765163 - RNA, 18 nt, Human
ggacacaggccugcucuc

SEQ ID NO: 3765164 - RNA, 23 nt, Human
ggacacaggccuguguagcugug

SEQ ID NO: 3765165 - RNA, 14 nt, Human
ggacacaguuccug

SEQ ID NO: 3765166 - RNA, 20 nt, Human
gcugcuuuguuaccuuaaaa

SEQ ID NO: 3765167 - RNA, 12 nt, Human
gcugcuuuuccu

SEQ ID NO: 3765168 - RNA, 22 nt, Human
gcugcuuuuccuuggggcaggc

SEQ ID NO: 3765169 - RNA, 23 nt, Human
gcugcuuuuccuuggggcaggca

SEQ ID NO: 3765170 - RNA, 22 nt, Human
gcugcuuuugucuaugggacuc

SEQ ID NO: 3765171 - RNA, 22 nt, Human
gcugcuuuuuuugaaacuuuga

SEQ ID NO: 3765172 - RNA, 23 nt, Human
gcuggaaaagggucuugggaaau

SEQ ID NO: 3765173 - RNA, 23 nt, Human
gcuggaaaaguauguuagugcaa

SEQ ID NO: 3765174 - RNA, 16 nt, Human
gcuggaacagauucac

SEQ ID NO: 3765175 - RNA, 21 nt, Human
gcuggaaccugcaaaaaauac

SEQ ID NO: 3765176 - RNA, 17 nt, Human
gcuggaagauagcugug

SEQ ID NO: 3765177 - RNA, 12 nt, Human
gcuggaagccca

SEQ ID NO: 3765178 - RNA, 14 nt, Human
gcuggaagcccagc

SEQ ID NO: 3765179 - RNA, 12 nt, Human
gcuggaaggagg

SEQ ID NO: 3765180 - RNA, 16 nt, Human
gcuggaaggaggaaga

SEQ ID NO: 3765181 - RNA, 18 nt, Human
gcuggaaggaggaagaau

SEQ ID NO: 3765182 - RNA, 16 nt, Human
gcuggaaucuggagag

SEQ ID NO: 3765183 - RNA, 16 nt, Human
gcuggaauuuuuuauu

SEQ ID NO: 3765184 - RNA, 14 nt, Human
gcuggacaaacugc

SEQ ID NO: 3765185 - RNA, 22 nt, Human
gcuggacagaggggacucuggg

SEQ ID NO: 3765186 - RNA, 20 nt, Human
gcuggacaguaucacugucu

SEQ ID NO: 3765187 - RNA, 16 nt, Human
gcuggacaugcugacu

SEQ ID NO: 3765188 - RNA, 13 nt, Human
gcuggacccagcc

SEQ ID NO: 3765189 - RNA, 21 nt, Human
gcuggacccagccaggcccag

SEQ ID NO: 3765190 - RNA, 23 nt, Human
gcuggaccuauguccuaaggaca

SEQ ID NO: 3765191 - RNA, 17 nt, Human
gcuggaccucaccaagc

SEQ ID NO: 3765192 - RNA, 18 nt, Human
gcuggaccuugaacuggg

SEQ ID NO: 3765193 - RNA, 19 nt, Human
gcuggacggggacugggga

SEQ ID NO: 3765194 - RNA, 12 nt, Human
gcuggacgucca

SEQ ID NO: 3765195 - RNA, 18 nt, Human
gcuggacgucuuucuuuu

SEQ ID NO: 3765196 - RNA, 14 nt, Human
gcuggacuacccac

SEQ ID NO: 3765197 - RNA, 22 nt, Human
gcuggacucucagucucugagc

SEQ ID NO: 3765198 - RNA, 13 nt, Human
gcuggacucugca

SEQ ID NO: 3765199 - RNA, 17 nt, Human
gcuggacugaggccuga

SEQ ID NO: 3765200 - RNA, 19 nt, Human
gcuggacugaggccugagc

SEQ ID NO: 3765201 - RNA, 14 nt, Human
gcuggagaaaaaua

SEQ ID NO: 3765202 - RNA, 13 nt, Human
gcuggagaagaga

SEQ ID NO: 3765203 - RNA, 15 nt, Human
gcuggagaagagagg

SEQ ID NO: 3765204 - RNA, 17 nt, Human
gcuggagaagagaggag

SEQ ID NO: 3765205 - RNA, 20 nt, Human
gcuggagaagagaggagagg

SEQ ID NO: 3765206 - RNA, 12 nt, Human
gcuggagaagcu

SEQ ID NO: 3765207 - RNA, 15 nt, Human
gcuggagaccaugca

SEQ ID NO: 3765208 - RNA, 17 nt, Human
gcuggagaccaugcaga

SEQ ID NO: 3765209 - RNA, 13 nt, Human
gcuggagacuccu

SEQ ID NO: 3765210 - RNA, 20 nt, Human
gcuggagacuccuaggcagg

SEQ ID NO: 3765211 - RNA, 22 nt, Human
gcuggagaggagcccugccucu

SEQ ID NO: 3765212 - RNA, 16 nt, Human
gcuggagcccagggag

SEQ ID NO: 3765213 - RNA, 11 nt, Human
gcuggagccug

SEQ ID NO: 3765214 - RNA, 23 nt, Human
gcuggagccugagucagggccca

SEQ ID NO: 3765215 - RNA, 14 nt, Human
gcuggagccugugu

SEQ ID NO: 3765216 - RNA, 22 nt, Human
gcuggagccuguguaacagcuc

SEQ ID NO: 3765217 - RNA, 22 nt, Human
gcuggagcuggcgucugucuuc

SEQ ID NO: 3765218 - RNA, 23 nt, Human
gcuggaggacuagaaccuggagg

SEQ ID NO: 3765219 - RNA, 13 nt, Human
gcuggaggagccc

SEQ ID NO: 3765220 - RNA, 15 nt, Human
gcuggaggagcccag

SEQ ID NO: 3765221 - RNA, 21 nt, Human
gcuggaggagcccaggccagg

SEQ ID NO: 3765222 - RNA, 12 nt, Human
gcuggaggcagg

SEQ ID NO: 3765223 - RNA, 14 nt, Human
gcuggaggcagggc

SEQ ID NO: 3765224 - RNA, 21 nt, Human
gcuggaggcagggccuugccc

SEQ ID NO: 3765225 - RNA, 20 nt, Human
gcuggaggcaggggcuuccu

SEQ ID NO: 3765226 - RNA, 21 nt, Human
gcuggaggcaggggcuuccug

SEQ ID NO: 3765227 - RNA, 12 nt, Human
gcuggaggccca

SEQ ID NO: 3765228 - RNA, 15 nt, Human
gcuggaggcccaggc

SEQ ID NO: 3765229 - RNA, 20 nt, Human
gcuggaggcccaggcuggga

SEQ ID NO: 3765230 - RNA, 12 nt, Human
gcuggaggccuc

SEQ ID NO: 3765231 - RNA, 14 nt, Human
gcuggaggccucag

SEQ ID NO: 3765232 - RNA, 19 nt, Human
gcuggaggccucaggugcu

SEQ ID NO: 3765233 - RNA, 14 nt, Human
gcuggaggugggag

SEQ ID NO: 3765234 - RNA, 15 nt, Human
gcuggaggugggagc

SEQ ID NO: 3765235 - RNA, 17 nt, Human
gcuggaggugggagcag

SEQ ID NO: 3765236 - RNA, 15 nt, Human
gcuggaguaaucaga

SEQ ID NO: 3765237 - RNA, 20 nt, Human
gcuggaguacaguggugcca

SEQ ID NO: 3765238 - RNA, 17 nt, Human
gcuggagugcagugagc

SEQ ID NO: 3765239 - RNA, 15 nt, Human
gcuggagugcagugg

SEQ ID NO: 3765240 - RNA, 20 nt, Human
gcuggagugcaguggugcga

SEQ ID NO: 3765241 - RNA, 22 nt, Human
gcuggaguuauugaagcagagu

SEQ ID NO: 3765242 - RNA, 19 nt, Human
gcuggaucucccagggcua

SEQ ID NO: 3765243 - RNA, 20 nt, Human
gcuggaucucccagggcuac

SEQ ID NO: 3765244 - RNA, 20 nt, Human
gcuggaugagacuuccaaac

SEQ ID NO: 3765245 - RNA, 23 nt, Human
gcuggaugagcucccacaagccu

SEQ ID NO: 3765246 - RNA, 15 nt, Human
gcuggaugauggucu

SEQ ID NO: 3765247 - RNA, 14 nt, Human
gcuggauggagccc

SEQ ID NO: 3765248 - RNA, 19 nt, Human
gcuggcaaagacagaagcc

SEQ ID NO: 3765249 - RNA, 14 nt, Human
gcuggcaacacaga

SEQ ID NO: 3765250 - RNA, 19 nt, Human
gcuggcaacacagaggcag

SEQ ID NO: 3765251 - RNA, 17 nt, Human
gcuggcaccgccuucuc

SEQ ID NO: 3765252 - RNA, 23 nt, Human
gcuggcagaaagggaacagaaag

SEQ ID NO: 3765253 - RNA, 13 nt, Human
gcuggcagcucuc

SEQ ID NO: 3765254 - RNA, 18 nt, Human
gcuggcagcucuccaguc

SEQ ID NO: 3765255 - RNA, 14 nt, Human
gcuggcagggcugg

SEQ ID NO: 3765256 - RNA, 21 nt, Human
gcuggcaugauccaagcaaga

SEQ ID NO: 3765257 - RNA, 15 nt, Human
gcuggccagccccac

SEQ ID NO: 3765258 - RNA, 19 nt, Human
gcuggccagccccacagcc

SEQ ID NO: 3765259 - RNA, 21 nt, Human
gcuggccagccuggggccugg

SEQ ID NO: 3765260 - RNA, 16 nt, Human
gcuggccagcgagcgc

SEQ ID NO: 3765261 - RNA, 22 nt, Human
gcuggccaguccacccugccug

SEQ ID NO: 3765262 - RNA, 17 nt, Human
gcuggccaguccaggcu

SEQ ID NO: 3765263 - RNA, 18 nt, Human
gcuggccauggagaaagc

SEQ ID NO: 3765264 - RNA, 14 nt, Human
gcuggcccagccaa

SEQ ID NO: 3765265 - RNA, 13 nt, Human
gcuggcccagggc

SEQ ID NO: 3765266 - RNA, 15 nt, Human
gcuggcccagggccc

SEQ ID NO: 3765267 - RNA, 16 nt, Human
gcuggcccagggccca

SEQ ID NO: 3765268 - RNA, 21 nt, Human
gcuggcccagggcccagagcc

SEQ ID NO: 3765269 - RNA, 18 nt, Human
gcuggccccagcccugcu

SEQ ID NO: 3765270 - RNA, 19 nt, Human
gcuggccccagcccugcug

SEQ ID NO: 3765271 - RNA, 22 nt, Human
gcuggccccagcccugcugggg

SEQ ID NO: 3765272 - RNA, 18 nt, Human
gcuggccccagggcaccc

SEQ ID NO: 3765273 - RNA, 20 nt, Human
gcuggccccagggcacccug

SEQ ID NO: 3765274 - RNA, 15 nt, Human
gcuggcccccacugg

SEQ ID NO: 3765275 - RNA, 17 nt, Human
gcuggcccccacuggcu

SEQ ID NO: 3765276 - RNA, 24 nt, Human
gcuggcccccacuggcugugggcu

SEQ ID NO: 3765277 - RNA, 13 nt, Human
gcuggccccgccg

SEQ ID NO: 3765278 - RNA, 19 nt, Human
gcuggccccucaccugggc

SEQ ID NO: 3765279 - RNA, 20 nt, Human
gcuggccccucaccugggca

SEQ ID NO: 3765280 - RNA, 23 nt, Human
gcuggccccucaccugggcaccu

SEQ ID NO: 3765281 - RNA, 13 nt, Human
gcuggcccugccc

SEQ ID NO: 3765282 - RNA, 15 nt, Human
gcuggcccugcccug

SEQ ID NO: 3765283 - RNA, 20 nt, Human
gcuggccgccucacccccuc

SEQ ID NO: 3765284 - RNA, 17 nt, Human
gcuggccgggcacagcu

SEQ ID NO: 3765285 - RNA, 19 nt, Human
gcuggccgggcacagcugu

SEQ ID NO: 3765286 - RNA, 13 nt, Human
gcuggccucagac

SEQ ID NO: 3765287 - RNA, 13 nt, Human
gcuggccucugcg

SEQ ID NO: 3765288 - RNA, 15 nt, Human
gcuggccucugcgag

SEQ ID NO: 3765289 - RNA, 16 nt, Human
gcuggccucugcgagu

SEQ ID NO: 3765290 - RNA, 14 nt, Human
gcuggccuggacag

SEQ ID NO: 3765291 - RNA, 13 nt, Human
gcuggccuggccc

SEQ ID NO: 3765292 - RNA, 14 nt, Human
gcuggccuggcccc

SEQ ID NO: 3765293 - RNA, 16 nt, Human
gcuggccuggccccuc

SEQ ID NO: 3765294 - RNA, 17 nt, Human
gcuggccuggccccuca

SEQ ID NO: 3765295 - RNA, 14 nt, Human
gcuggccuggccgg

SEQ ID NO: 3765296 - RNA, 13 nt, Human
gcuggccuuccug

SEQ ID NO: 3765297 - RNA, 16 nt, Human
gcuggccuuccugccc

SEQ ID NO: 3765298 - RNA, 19 nt, Human
gcuggccuuuguaagugca

SEQ ID NO: 3765299 - RNA, 14 nt, Human
gcuggcgcagccaa

SEQ ID NO: 3765300 - RNA, 16 nt, Human
gcuggcgcagccaagg

SEQ ID NO: 3765301 - RNA, 20 nt, Human
gcuggcgcagccaaggccga

SEQ ID NO: 3765302 - RNA, 16 nt, Human
gcuggcgccucugcaa

SEQ ID NO: 3765303 - RNA, 18 nt, Human
gcuggcgugcaguggugc

SEQ ID NO: 3765304 - RNA, 20 nt, Human
gcuggcgugcaguggugcga

SEQ ID NO: 3765305 - RNA, 18 nt, Human
gcuggcucacaguacagc

SEQ ID NO: 3765306 - RNA, 21 nt, Human
gcuggcuccagaugcagggca

SEQ ID NO: 3765307 - RNA, 22 nt, Human
gcuggcuccagaugcagggcag

SEQ ID NO: 3765308 - RNA, 23 nt, Human
gcuggcuccagaugcagggcagu

SEQ ID NO: 3765309 - RNA, 16 nt, Human
gcuggcucccagggcc

SEQ ID NO: 3765310 - RNA, 12 nt, Human
gcuggcucugag

SEQ ID NO: 3765311 - RNA, 16 nt, Human
gcuggcucuucugccc

SEQ ID NO: 3765312 - RNA, 16 nt, Human
gcuggcugagggcagu

SEQ ID NO: 3765313 - RNA, 11 nt, Human
gcuggcugccu

SEQ ID NO: 3765314 - RNA, 14 nt, Human
gcuggcuggccuca

SEQ ID NO: 3765315 - RNA, 16 nt, Human
gcuggcugggcaugga

SEQ ID NO: 3765316 - RNA, 21 nt, Human
gcuggcugggggccucacucc

SEQ ID NO: 3765317 - RNA, 13 nt, Human
gcuggcuggggug

SEQ ID NO: 3765318 - RNA, 16 nt, Human
gcuggcuguuggcugg

SEQ ID NO: 3765319 - RNA, 17 nt, Human
gcuggcuguuggcuggg

SEQ ID NO: 3765320 - RNA, 15 nt, Human
gcuggcuugggcagc

SEQ ID NO: 3765321 - RNA, 14 nt, Human
gcuggcuuuucugu

SEQ ID NO: 3765322 - RNA, 15 nt, Human
gcuggcuuuucuguu

SEQ ID NO: 3765323 - RNA, 20 nt, Human
gcugggaaacacuccuugca

SEQ ID NO: 3765324 - RNA, 18 nt, Human
gcugggaacucaccuggg

SEQ ID NO: 3765325 - RNA, 15 nt, Human
gcugggaacugcaga

SEQ ID NO: 3765326 - RNA, 23 nt, Human
gcugggacaccccgacuuuuguu

SEQ ID NO: 3765327 - RNA, 21 nt, Human
gcugggacguggcucagccag

SEQ ID NO: 3765328 - RNA, 14 nt, Human
gcugggacuacagg

SEQ ID NO: 3765329 - RNA, 14 nt, Human
gcugggacucagcc

SEQ ID NO: 3765330 - RNA, 22 nt, Human
gcugggacucagccuucagaca

SEQ ID NO: 3765331 - RNA, 23 nt, Human
gcugggacucagccuucagacag

SEQ ID NO: 3765332 - RNA, 16 nt, Human
gcugggacuggccagg

SEQ ID NO: 3765333 - RNA, 14 nt, Human
gcugggacugggaa

SEQ ID NO: 3765334 - RNA, 22 nt, Human
gcugggagaagggggucaaagc

SEQ ID NO: 3765335 - RNA, 22 nt, Human
gcugggagcuccacucugcuuc

SEQ ID NO: 3765336 - RNA, 13 nt, Human
gcugggagcugaa

SEQ ID NO: 3765337 - RNA, 15 nt, Human
gcugggaggaaggac

SEQ ID NO: 3765338 - RNA, 16 nt, Human
gcugggaggagggaga

SEQ ID NO: 3765339 - RNA, 16 nt, Human
gcugggaggcaagagg

SEQ ID NO: 3765340 - RNA, 21 nt, Human
gcugggagggauagagggggg

SEQ ID NO: 3765341 - RNA, 18 nt, Human
gcugggaguaguugucuu

SEQ ID NO: 3765342 - RNA, 18 nt, Human
gcugggaucugacugcac

SEQ ID NO: 3765343 - RNA, 20 nt, Human
gcugggaucugacugcacgu

SEQ ID NO: 3765344 - RNA, 19 nt, Human
gcugggaugauuggagggg

SEQ ID NO: 3765345 - RNA, 23 nt, Human
gcugggauggugggcuucagggc

SEQ ID NO: 3765346 - RNA, 18 nt, Human
gcugggauuacaggcgug

SEQ ID NO: 3765347 - RNA, 17 nt, Human
gcugggauuacagggau

SEQ ID NO: 3765348 - RNA, 15 nt, Human
gcugggcaaggaaaa

SEQ ID NO: 3765349 - RNA, 20 nt, Human
gcugggcaaggaaaaagaaa

SEQ ID NO: 3765350 - RNA, 22 nt, Human
gcugggcacacgccucccacug

SEQ ID NO: 3765351 - RNA, 15 nt, Human
gcugggcacuucccu

SEQ ID NO: 3765352 - RNA, 19 nt, Human
gcugggcagaaggccaaga

SEQ ID NO: 3765353 - RNA, 16 nt, Human
gcugggcagaggaaag

SEQ ID NO: 3765354 - RNA, 14 nt, Human
gcugggcagcccgc

SEQ ID NO: 3765355 - RNA, 13 nt, Human
gcugggcagcugu

SEQ ID NO: 3765356 - RNA, 14 nt, Human
gcugggcagcuguu

SEQ ID NO: 3765357 - RNA, 19 nt, Human
gcugggcaugguaccagcc

SEQ ID NO: 3765358 - RNA, 17 nt, Human
gcugggccauguccaaa

SEQ ID NO: 3765359 - RNA, 20 nt, Human
gcugggcccaacccugucug

SEQ ID NO: 3765360 - RNA, 20 nt, Human
gcugggcccacccaagcagg

SEQ ID NO: 3765361 - RNA, 12 nt, Human
gcugggcccaga

SEQ ID NO: 3765362 - RNA, 14 nt, Human
gcugggcccagaag

SEQ ID NO: 3765363 - RNA, 14 nt, Human
gcugggcccagagg

SEQ ID NO: 3765364 - RNA, 16 nt, Human
gcugggcccagaggca

SEQ ID NO: 3765365 - RNA, 24 nt, Human
gcugggccccagcccacccuccug

SEQ ID NO: 3765366 - RNA, 19 nt, Human
gcugggccccccagcucag

SEQ ID NO: 3765367 - RNA, 22 nt, Human
gcugggccccccagcucagggg

SEQ ID NO: 3765368 - RNA, 20 nt, Human
gcugggcccgacauggcucc

SEQ ID NO: 3765369 - RNA, 17 nt, Human
gcugggcccucucuucu

SEQ ID NO: 3765370 - RNA, 14 nt, Human
gcugggcucaguga

SEQ ID NO: 3765371 - RNA, 21 nt, Human
gcugggcucccuucccaccuc

SEQ ID NO: 3765372 - RNA, 21 nt, Human
gcugggcucuccaccucagcc

SEQ ID NO: 3765373 - RNA, 15 nt, Human
gcugggcucugccac

SEQ ID NO: 3765374 - RNA, 19 nt, Human
gcugggcugagccccuacc

SEQ ID NO: 3765375 - RNA, 15 nt, Human
gcugggcugggugcg

SEQ ID NO: 3765376 - RNA, 17 nt, Human
gcugggcuucaguggca

SEQ ID NO: 3765377 - RNA, 18 nt, Human
gcugggcuucaguggcag

SEQ ID NO: 3765378 - RNA, 20 nt, Human
gcugggcuucaguggcagcu

SEQ ID NO: 3765379 - RNA, 21 nt, Human
gcuggggaagacaguggcccc

SEQ ID NO: 3765380 - RNA, 20 nt, Human
gcuggggaaguccucugggu

SEQ ID NO: 3765381 - RNA, 18 nt, Human
gcuggggacagguccuca

SEQ ID NO: 3765382 - RNA, 15 nt, Human
gcuggggccucagac

SEQ ID NO: 3765383 - RNA, 13 nt, Human
gcuggggccuggg

SEQ ID NO: 3765384 - RNA, 16 nt, Human
gcuggggccugggaca

SEQ ID NO: 3765385 - RNA, 15 nt, Human
gcuggggcugaccuu

SEQ ID NO: 3765386 - RNA, 21 nt, Human
gcugggggaaugagcccagag

SEQ ID NO: 3765387 - RNA, 14 nt, Human
gcugggggcaacug

SEQ ID NO: 3765388 - RNA, 18 nt, Human
gcugggggcaacuggcca

SEQ ID NO: 3765389 - RNA, 20 nt, Human
gcugggggcagccugcgugg

SEQ ID NO: 3765390 - RNA, 22 nt, Human
gcugggggcagccugcguggcu

SEQ ID NO: 3765391 - RNA, 20 nt, Human
gcugggggcaggagggcccu

SEQ ID NO: 3765392 - RNA, 16 nt, Human
gcugggggccaugagc

SEQ ID NO: 3765393 - RNA, 13 nt, Human
gcugggggccuca

SEQ ID NO: 3765394 - RNA, 15 nt, Human
gcugggggccucagu

SEQ ID NO: 3765395 - RNA, 18 nt, Human
gcugggggccucagugcc

SEQ ID NO: 3765396 - RNA, 20 nt, Human
gcugggggccucagugccac

SEQ ID NO: 3765397 - RNA, 18 nt, Human
gcugggggugggccaggc

SEQ ID NO: 3765398 - RNA, 14 nt, Human
gcuggggucccagc

SEQ ID NO: 3765399 - RNA, 12 nt, Human
gcuggggugcag

SEQ ID NO: 3765400 - RNA, 15 nt, Human
gcuggggugcaggga

SEQ ID NO: 3765401 - RNA, 14 nt, Human
gcugggguggccug

SEQ ID NO: 3765402 - RNA, 18 nt, Human
gcugggguggccugugug

SEQ ID NO: 3765403 - RNA, 17 nt, Human
gcugggguggggaccuc

SEQ ID NO: 3765404 - RNA, 22 nt, Human
gcugggguuaucugaagucaga

SEQ ID NO: 3765405 - RNA, 23 nt, Human
gcugggguuaucugaagucagau

SEQ ID NO: 3765406 - RNA, 15 nt, Human
gcuggguauuggaaa

SEQ ID NO: 3765407 - RNA, 23 nt, Human
gcuggguauuggaaauggaugca

SEQ ID NO: 3765408 - RNA, 13 nt, Human
gcugggucaggca

SEQ ID NO: 3765409 - RNA, 19 nt, Human
gcuggguccaauuguggca

SEQ ID NO: 3765410 - RNA, 23 nt, Human
gcuggguccauaucacacacauu

SEQ ID NO: 3765411 - RNA, 15 nt, Human
gcugggucgcccugg

SEQ ID NO: 3765412 - RNA, 22 nt, Human
gcuggguggcaccagcagccug

SEQ ID NO: 3765413 - RNA, 17 nt, Human
gcuggguggcacugcca

SEQ ID NO: 3765414 - RNA, 20 nt, Human
gcuggguguauuaggacugg

SEQ ID NO: 3765415 - RNA, 15 nt, Human
gcuggguucuaccca

SEQ ID NO: 3765416 - RNA, 18 nt, Human
gcuggguucuacccaggu

SEQ ID NO: 3765417 - RNA, 14 nt, Human
gcuggguucugcac

SEQ ID NO: 3765418 - RNA, 18 nt, Human
gcugguaaaaugaagaau

SEQ ID NO: 3765419 - RNA, 23 nt, Human
gcugguaaaaugaagaauuuaaa

SEQ ID NO: 3765420 - RNA, 15 nt, Human
gcugguaagggccaa

SEQ ID NO: 3765421 - RNA, 17 nt, Human
gcugguacaacggaggc

SEQ ID NO: 3765422 - RNA, 14 nt, Human
gcugguagagcagg

SEQ ID NO: 3765423 - RNA, 14 nt, Human
gcugguagcucagg

SEQ ID NO: 3765424 - RNA, 16 nt, Human
gcugguaucucagaaa

SEQ ID NO: 3765425 - RNA, 18 nt, Human
gcugguauugguggcuuu

SEQ ID NO: 3765426 - RNA, 21 nt, Human
gcuggucacuucuucugucca

SEQ ID NO: 3765427 - RNA, 14 nt, Human
gcuggucccacuca

SEQ ID NO: 3765428 - RNA, 12 nt, Human
gcuggugcacag

SEQ ID NO: 3765429 - RNA, 15 nt, Human
gcuggugcagggccu

SEQ ID NO: 3765430 - RNA, 13 nt, Human
gcuggugcauuac

SEQ ID NO: 3765431 - RNA, 22 nt, Human
gcuggugcauuacagagaggag

SEQ ID NO: 3765432 - RNA, 13 nt, Human
gcuggugccagcc

SEQ ID NO: 3765433 - RNA, 15 nt, Human
gcuggugccagccuu

SEQ ID NO: 3765434 - RNA, 22 nt, Human
gcuggugcccugcuuucagaua

SEQ ID NO: 3765435 - RNA, 18 nt, Human
gcuggugcggcuggccau

SEQ ID NO: 3765436 - RNA, 15 nt, Human
gcugguggcccagga

SEQ ID NO: 3765437 - RNA, 15 nt, Human
gcuggugggcaccaa

SEQ ID NO: 3765438 - RNA, 12 nt, Human
gcuggugguuuc

SEQ ID NO: 3765439 - RNA, 22 nt, Human
gcuggugguuucacggugccag

SEQ ID NO: 3765440 - RNA, 22 nt, Human
gcugguguagcuacagagaaac

SEQ ID NO: 3765441 - RNA, 21 nt, Human
gcugguguaugugugaaguga

SEQ ID NO: 3765442 - RNA, 15 nt, Human
gcugguguccugacc

SEQ ID NO: 3765443 - RNA, 17 nt, Human
gcugguguccugaccac

SEQ ID NO: 3765444 - RNA, 18 nt, Human
gcugguguccugaccacc

SEQ ID NO: 3765445 - RNA, 22 nt, Human
gcugguguccugaccacccucc

SEQ ID NO: 3765446 - RNA, 16 nt, Human
gcugguguuaacagaa

SEQ ID NO: 3765447 - RNA, 22 nt, Human
gcugguguuaacagaagggagg

SEQ ID NO: 3765448 - RNA, 20 nt, Human
gcugguucggauuuggggug

SEQ ID NO: 3765449 - RNA, 21 nt, Human
gcugguucggauuuggggugg

SEQ ID NO: 3765450 - RNA, 15 nt, Human
gcugguugcugugug

SEQ ID NO: 3765451 - RNA, 12 nt, Human
gcugguuuuccu

SEQ ID NO: 3765452 - RNA, 21 nt, Human
gcugguuuuguaagaugcugg

SEQ ID NO: 3765453 - RNA, 22 nt, Human
gcugguuuuguaagaugcuggg

SEQ ID NO: 3765454 - RNA, 16 nt, Human
gcuguaaaaugcauga

SEQ ID NO: 3765455 - RNA, 20 nt, Human
gcuguaaauuuggcuucugu

SEQ ID NO: 3765456 - RNA, 16 nt, Human
gcuguaacguggcacu

SEQ ID NO: 3765457 - RNA, 21 nt, Human
gcuguaacuacuuuauaacua

SEQ ID NO: 3765458 - RNA, 13 nt, Human
gcuguaagaaauc

SEQ ID NO: 3765459 - RNA, 16 nt, Human
gcuguaagaagagacu

SEQ ID NO: 3765460 - RNA, 24 nt, Human
gcuguaagaagagacugggaagau

SEQ ID NO: 3765461 - RNA, 15 nt, Human
gcuguaagaugucug

SEQ ID NO: 3765462 - RNA, 19 nt, Human
gcuguaaggcaugaaggau

SEQ ID NO: 3765463 - RNA, 15 nt, Human
gcuguaaggcucuag

SEQ ID NO: 3765464 - RNA, 15 nt, Human
gcuguaaucauuugu

SEQ ID NO: 3765465 - RNA, 19 nt, Human
ggacacaguuccugggaac

SEQ ID NO: 3765466 - RNA, 12 nt, Human
ggacacaugucc

SEQ ID NO: 3765467 - RNA, 19 nt, Human
ggacacauguccaguggga

SEQ ID NO: 3765468 - RNA, 19 nt, Human
ggacaccagccaggcucug

SEQ ID NO: 3765469 - RNA, 13 nt, Human
ggacaccaggagu

SEQ ID NO: 3765470 - RNA, 21 nt, Human
ggacaccauuaccaaaauaau

SEQ ID NO: 3765471 - RNA, 13 nt, Human
ggacacccuguga

SEQ ID NO: 3765472 - RNA, 13 nt, Human
ggacaccugcccu

SEQ ID NO: 3765473 - RNA, 15 nt, Human
ggacaccugcccugc

SEQ ID NO: 3765474 - RNA, 16 nt, Human
ggacaccugcccugcc

SEQ ID NO: 3765475 - RNA, 22 nt, Human
ggacacgcgccccccucccaga

SEQ ID NO: 3765476 - RNA, 20 nt, Human
ggacacgcgcgucgccgcca

SEQ ID NO: 3765477 - RNA, 20 nt, Human
ggacacuacacccagcaaua

SEQ ID NO: 3765478 - RNA, 21 nt, Human
ggacacuacacccagcaauag

SEQ ID NO: 3765479 - RNA, 22 nt, Human
ggacacuacacccagcaauaga

SEQ ID NO: 3765480 - RNA, 15 nt, Human
ggacacuccagugcc

SEQ ID NO: 3765481 - RNA, 18 nt, Human
ggacacuccagugccagc

SEQ ID NO: 3765482 - RNA, 21 nt, Human
ggacacuguaacgugugcugu

SEQ ID NO: 3765483 - RNA, 18 nt, Human
ggacacuuaacagaugca

SEQ ID NO: 3765484 - RNA, 19 nt, Human
ggacacuuauccacgagag

SEQ ID NO: 3765485 - RNA, 17 nt, Human
ggacacuucccucuguu

SEQ ID NO: 3765486 - RNA, 14 nt, Human
ggacacuuccugcc

SEQ ID NO: 3765487 - RNA, 20 nt, Human
ggacacuuugaaauguguuu

SEQ ID NO: 3765488 - RNA, 23 nt, Human
ggacacuuugaaauguguuucug

SEQ ID NO: 3765489 - RNA, 22 nt, Human
ggacagaaaggagaguggccau

SEQ ID NO: 3765490 - RNA, 23 nt, Human
ggacagaggccccagccucccug

SEQ ID NO: 3765491 - RNA, 16 nt, Human
ggacagaggccugccc

SEQ ID NO: 3765492 - RNA, 17 nt, Human
ggacagaggccugcccg

SEQ ID NO: 3765493 - RNA, 12 nt, Human
ggacagagggga

SEQ ID NO: 3765494 - RNA, 20 nt, Human
ggacagaggggguggccucc

SEQ ID NO: 3765495 - RNA, 16 nt, Human
ggacagaguaugaaca

SEQ ID NO: 3765496 - RNA, 18 nt, Human
ggacagaucaauggcgca

SEQ ID NO: 3765497 - RNA, 23 nt, Human
ggacagauccagggacugaagcc

SEQ ID NO: 3765498 - RNA, 19 nt, Human
ggacagcaacuaucagacu

SEQ ID NO: 3765499 - RNA, 17 nt, Human
ggacagcauugccagua

SEQ ID NO: 3765500 - RNA, 15 nt, Human
ggacagccacggcca

SEQ ID NO: 3765501 - RNA, 20 nt, Human
ggacagccacggccaggcca

SEQ ID NO: 3765502 - RNA, 14 nt, Human
ggacagccccaccc

SEQ ID NO: 3765503 - RNA, 15 nt, Human
ggacagccccacccu

SEQ ID NO: 3765504 - RNA, 16 nt, Human
ggacagccccacccug

SEQ ID NO: 3765505 - RNA, 15 nt, Human
ggacagccccuccuc

SEQ ID NO: 3765506 - RNA, 21 nt, Human
ggacagccuguggcggugccu

SEQ ID NO: 3765507 - RNA, 16 nt, Human
ggacagcuccuucugu

SEQ ID NO: 3765508 - RNA, 12 nt, Human
ggacagcugugc

SEQ ID NO: 3765509 - RNA, 19 nt, Human
ggacagcuugagccgggcc

SEQ ID NO: 3765510 - RNA, 16 nt, Human
ggacaggaccccagcu

SEQ ID NO: 3765511 - RNA, 19 nt, Human
ggacaggacuaacacucag

SEQ ID NO: 3765512 - RNA, 18 nt, Human
ggacaggagaugcugugc

SEQ ID NO: 3765513 - RNA, 19 nt, Human
ggacaggagaugcugugcc

SEQ ID NO: 3765514 - RNA, 15 nt, Human
ggacaggauccaggc

SEQ ID NO: 3765515 - RNA, 17 nt, Human
ggacaggcagaaagagu

SEQ ID NO: 3765516 - RNA, 11 nt, Human
ggacaggcccg

SEQ ID NO: 3765517 - RNA, 16 nt, Human
ggacaggccgcagcuc

SEQ ID NO: 3765518 - RNA, 23 nt, Human
ggacaggccucaccucuacccaa

SEQ ID NO: 3765519 - RNA, 22 nt, Human
ggacaggcugcggccccucccc

SEQ ID NO: 3765520 - RNA, 13 nt, Human
ggacaggcuggcu

SEQ ID NO: 3765521 - RNA, 15 nt, Human
ggacaggcuggcucc

SEQ ID NO: 3765522 - RNA, 22 nt, Human
ggacagggcauggccagguggc

SEQ ID NO: 3765523 - RNA, 18 nt, Human
ggacagggcuggcccagc

SEQ ID NO: 3765524 - RNA, 20 nt, Human
ggacagggcuggcccagccc

SEQ ID NO: 3765525 - RNA, 22 nt, Human
ggacagggcuggcccagcccug

SEQ ID NO: 3765526 - RNA, 14 nt, Human
ggacagggucccug

SEQ ID NO: 3765527 - RNA, 20 nt, Human
ggacaggucugggagaggca

SEQ ID NO: 3765528 - RNA, 20 nt, Human
ggacaggugugccgacagaa

SEQ ID NO: 3765529 - RNA, 20 nt, Human
ggacaguaauaagaauggaa

SEQ ID NO: 3765530 - RNA, 18 nt, Human
ggacaguaucccacaucc

SEQ ID NO: 3765531 - RNA, 19 nt, Human
ggacaguauuuguggggag

SEQ ID NO: 3765532 - RNA, 17 nt, Human
ggacagucaccucaugg

SEQ ID NO: 3765533 - RNA, 12 nt, Human
ggacagucacug

SEQ ID NO: 3765534 - RNA, 13 nt, Human
ggacaguccuggg

SEQ ID NO: 3765535 - RNA, 16 nt, Human
ggacaguccugggaga

SEQ ID NO: 3765536 - RNA, 16 nt, Human
ggacaguggcaggaca

SEQ ID NO: 3765537 - RNA, 16 nt, Human
ggacaguucacacccu

SEQ ID NO: 3765538 - RNA, 22 nt, Human
ggacaguugcuuuucagcaugg

SEQ ID NO: 3765539 - RNA, 22 nt, Human
ggacaguuuaucaugaagccug

SEQ ID NO: 3765540 - RNA, 14 nt, Human
ggacauauucauuu

SEQ ID NO: 3765541 - RNA, 21 nt, Human
ggacaucacagggugggccuc

SEQ ID NO: 3765542 - RNA, 15 nt, Human
ggacaucagcaaaca

SEQ ID NO: 3765543 - RNA, 14 nt, Human
ggacauccucuucu

SEQ ID NO: 3765544 - RNA, 15 nt, Human
ggacaucucuuugaa

SEQ ID NO: 3765545 - RNA, 19 nt, Human
ggacaugcgguagccagca

SEQ ID NO: 3765546 - RNA, 19 nt, Human
ggacaugcugaagccaaag

SEQ ID NO: 3765547 - RNA, 14 nt, Human
ggacaugcuuagca

SEQ ID NO: 3765548 - RNA, 19 nt, Human
ggacaugggucgcccauga

SEQ ID NO: 3765549 - RNA, 21 nt, Human
ggacauguucccuucuccuuc

SEQ ID NO: 3765550 - RNA, 16 nt, Human
ggacauguuuugauaa

SEQ ID NO: 3765551 - RNA, 15 nt, Human
ggacauuaugugugc

SEQ ID NO: 3765552 - RNA, 20 nt, Human
ggacauuccaauuugcacuu

SEQ ID NO: 3765553 - RNA, 15 nt, Human
ggacauuuuuucagu

SEQ ID NO: 3765554 - RNA, 14 nt, Human
ggaccaaaaaccag

SEQ ID NO: 3765555 - RNA, 16 nt, Human
ggaccaaaaaccagua

SEQ ID NO: 3765556 - RNA, 12 nt, Human
ggaccaaagcaa

SEQ ID NO: 3765557 - RNA, 17 nt, Human
ggaccaaggagaugaag

SEQ ID NO: 3765558 - RNA, 19 nt, Human
ggaccaaggcaaggcaggu

SEQ ID NO: 3765559 - RNA, 15 nt, Human
ggaccacaggcucag

SEQ ID NO: 3765560 - RNA, 20 nt, Human
ggaccacaggugcccgccac

SEQ ID NO: 3765561 - RNA, 22 nt, Human
ggaccacccucacuggcucucc

SEQ ID NO: 3765562 - RNA, 16 nt, Human
ggaccacucagccccu

SEQ ID NO: 3765563 - RNA, 19 nt, Human
ggaccacuguuucuugcuu

SEQ ID NO: 3765564 - RNA, 15 nt, Human
ggaccagaagcuccc

SEQ ID NO: 3765565 - RNA, 21 nt, Human
ggaccagaagcucccccagca

SEQ ID NO: 3765566 - RNA, 14 nt, Human
ggaccagagcugcc

SEQ ID NO: 3765567 - RNA, 19 nt, Human
ggaccagagcugccaccug

SEQ ID NO: 3765568 - RNA, 14 nt, Human
ggaccagaugcuga

SEQ ID NO: 3765569 - RNA, 19 nt, Human
ggaccagcagccccacacc

SEQ ID NO: 3765570 - RNA, 23 nt, Human
ggaccagccagcagcagcccaag

SEQ ID NO: 3765571 - RNA, 12 nt, Human
ggaccagccucu

SEQ ID NO: 3765572 - RNA, 13 nt, Human
ggaccagccuggc

SEQ ID NO: 3765573 - RNA, 15 nt, Human
ggaccagccuggccc

SEQ ID NO: 3765574 - RNA, 15 nt, Human
ggaccagcuuuuccc

SEQ ID NO: 3765575 - RNA, 17 nt, Human
ggaccaggacaggacca

SEQ ID NO: 3765576 - RNA, 11 nt, Human
ggaccaggagu

SEQ ID NO: 3765577 - RNA, 15 nt, Human
ggaccaggcuguagg

SEQ ID NO: 3765578 - RNA, 17 nt, Human
ggaccagggcagggcca

SEQ ID NO: 3765579 - RNA, 17 nt, Human
ggaccagguauagagaa

SEQ ID NO: 3765580 - RNA, 19 nt, Human
ggaccaugcugucuggcac

SEQ ID NO: 3765581 - RNA, 22 nt, Human
ggaccauggaguggcagcccag

SEQ ID NO: 3765582 - RNA, 16 nt, Human
ggaccaugugucacuu

SEQ ID NO: 3765583 - RNA, 22 nt, Human
ggacccaaggaaaacugcaugg

SEQ ID NO: 3765584 - RNA, 17 nt, Human
ggacccagacccagugg

SEQ ID NO: 3765585 - RNA, 12 nt, Human
ggacccagccag

SEQ ID NO: 3765586 - RNA, 16 nt, Human
ggacccagccaggccc

SEQ ID NO: 3765587 - RNA, 17 nt, Human
ggacccagcgggcaggu

SEQ ID NO: 3765588 - RNA, 13 nt, Human
ggacccaggcucc

SEQ ID NO: 3765589 - RNA, 17 nt, Human
ggacccaggcuccgccc

SEQ ID NO: 3765590 - RNA, 19 nt, Human
ggacccaguggcagggcac

SEQ ID NO: 3765591 - RNA, 21 nt, Human
ggaccccagagauucccaagc

SEQ ID NO: 3765592 - RNA, 13 nt, Human
ggaccccagccuc

SEQ ID NO: 3765593 - RNA, 13 nt, Human
ggaccccagcucu

SEQ ID NO: 3765594 - RNA, 21 nt, Human
ggaccccagcugugagccuug

SEQ ID NO: 3765595 - RNA, 12 nt, Human
ggaccccaggcc

SEQ ID NO: 3765596 - RNA, 18 nt, Human
ggaccccaucugugaaua

SEQ ID NO: 3765597 - RNA, 13 nt, Human
ggacccccagcuu

SEQ ID NO: 3765598 - RNA, 21 nt, Human
ggaccccccuuucacaggcag

SEQ ID NO: 3765599 - RNA, 22 nt, Human
ggaccccccuuucacaggcagc

SEQ ID NO: 3765600 - RNA, 14 nt, Human
ggacccccgccccc

SEQ ID NO: 3765601 - RNA, 15 nt, Human
ggacccccgcccccu

SEQ ID NO: 3765602 - RNA, 19 nt, Human
ggacccccgcccccugccc

SEQ ID NO: 3765603 - RNA, 22 nt, Human
ggacccccgcccccugcccucc

SEQ ID NO: 3765604 - RNA, 12 nt, Human
ggacccccuucc

SEQ ID NO: 3765605 - RNA, 18 nt, Human
ggaccccgagccuggcuc

SEQ ID NO: 3765606 - RNA, 12 nt, Human
ggaccccugcau

SEQ ID NO: 3765607 - RNA, 23 nt, Human
ggaccccugcauuggaacuggag

SEQ ID NO: 3765608 - RNA, 19 nt, Human
ggacccgcucuggaccaac

SEQ ID NO: 3765609 - RNA, 21 nt, Human
ggacccuccaaggccaggccu

SEQ ID NO: 3765610 - RNA, 21 nt, Human
ggacccucgcuggcccccacu

SEQ ID NO: 3765611 - RNA, 13 nt, Human
ggacccugaggcc

SEQ ID NO: 3765612 - RNA, 24 nt, Human
ggacccugccaggcacaggcaggg

SEQ ID NO: 3765613 - RNA, 11 nt, Human
ggacccugcuu

SEQ ID NO: 3765614 - RNA, 13 nt, Human
ggacccuguugcu

SEQ ID NO: 3765615 - RNA, 12 nt, Human
cuugcuggcccc

SEQ ID NO: 3765616 - RNA, 16 nt, Human
cuugcuggucuaguca

SEQ ID NO: 3765617 - RNA, 19 nt, Human
cuugcugucccuuggaacu

SEQ ID NO: 3765618 - RNA, 16 nt, Human
cuugcuguccugaucu

SEQ ID NO: 3765619 - RNA, 16 nt, Human
cuugcugucucugcuc

SEQ ID NO: 3765620 - RNA, 16 nt, Human
cuugcuguggucucuu

SEQ ID NO: 3765621 - RNA, 23 nt, Human
cuugcuguugacauauuuaaugu

SEQ ID NO: 3765622 - RNA, 18 nt, Human
cuugcuguuuuguucugu

SEQ ID NO: 3765623 - RNA, 22 nt, Human
cuugcuuaaaugugaauuacua

SEQ ID NO: 3765624 - RNA, 16 nt, Human
cuugcuuaaauuucuu

SEQ ID NO: 3765625 - RNA, 22 nt, Human
cuugcuuaaauuucuuauguga

SEQ ID NO: 3765626 - RNA, 24 nt, Human
cuugcuuaccuugacuguugaugu

SEQ ID NO: 3765627 - RNA, 15 nt, Human
cuugcuuauuugaca

SEQ ID NO: 3765628 - RNA, 20 nt, Human
cuugcuucaaccccaugaga

SEQ ID NO: 3765629 - RNA, 19 nt, Human
cuugcuucucuagcucucu

SEQ ID NO: 3765630 - RNA, 14 nt, Human
cuugcuuguuacau

SEQ ID NO: 3765631 - RNA, 17 nt, Human
cuugcuuuaccuuuuca

SEQ ID NO: 3765632 - RNA, 22 nt, Human
cuugcuuucuuuuuuaaaauca

SEQ ID NO: 3765633 - RNA, 23 nt, Human
cuugcuuucuuuuuuaaaaucaa

SEQ ID NO: 3765634 - RNA, 14 nt, Human
cuugcuuugauuua

SEQ ID NO: 3765635 - RNA, 21 nt, Human
cuugcuuugauuuacagcaag

SEQ ID NO: 3765636 - RNA, 13 nt, Human
cuugcuuuucaug

SEQ ID NO: 3765637 - RNA, 15 nt, Human
cuugcuuuucccucu

SEQ ID NO: 3765638 - RNA, 22 nt, Human
cuugcuuuucccucuuuucuua

SEQ ID NO: 3765639 - RNA, 16 nt, Human
cuuggaaaccugcccu

SEQ ID NO: 3765640 - RNA, 18 nt, Human
cuuggaaaccugcccugc

SEQ ID NO: 3765641 - RNA, 21 nt, Human
cuuggaaaccugcccugccug

SEQ ID NO: 3765642 - RNA, 20 nt, Human
cuuggaaagcaucaccucag

SEQ ID NO: 3765643 - RNA, 23 nt, Human
cuuggaaagcaucaccucaggcc

SEQ ID NO: 3765644 - RNA, 15 nt, Human
cuuggaaaggaccag

SEQ ID NO: 3765645 - RNA, 13 nt, Human
cuuggaacugcau

SEQ ID NO: 3765646 - RNA, 22 nt, Human
cuuggaacuugccugccuuucc

SEQ ID NO: 3765647 - RNA, 14 nt, Human
cuuggaagcuccgc

SEQ ID NO: 3765648 - RNA, 15 nt, Human
cuuggaagcuguuug

SEQ ID NO: 3765649 - RNA, 20 nt, Human
cuuggaauuuguaaccucag

SEQ ID NO: 3765650 - RNA, 14 nt, Human
cuuggacaaaucac

SEQ ID NO: 3765651 - RNA, 19 nt, Human
cuuggacauccuccuccca

SEQ ID NO: 3765652 - RNA, 22 nt, Human
cuuggacauccuccucccaccc

SEQ ID NO: 3765653 - RNA, 16 nt, Human
cuuggaccagaucuaa

SEQ ID NO: 3765654 - RNA, 22 nt, Human
cuuggaccucgugcuuuaagug

SEQ ID NO: 3765655 - RNA, 12 nt, Human
cuuggaccucug

SEQ ID NO: 3765656 - RNA, 15 nt, Human
cuuggaccucugcuc

SEQ ID NO: 3765657 - RNA, 19 nt, Human
cuuggaccucugcucugag

SEQ ID NO: 3765658 - RNA, 15 nt, Human
cuuggacucuugcuc

SEQ ID NO: 3765659 - RNA, 15 nt, Human
cuuggagaaaugaaa

SEQ ID NO: 3765660 - RNA, 18 nt, Human
cuuggagaagucucagcu

SEQ ID NO: 3765661 - RNA, 15 nt, Human
cuuggagacccugca

SEQ ID NO: 3765662 - RNA, 22 nt, Human
cuuggagccaauggagacuguc

SEQ ID NO: 3765663 - RNA, 18 nt, Human
cuuggagccccagugcca

SEQ ID NO: 3765664 - RNA, 21 nt, Human
cuuggagccccagugccaagc

SEQ ID NO: 3765665 - RNA, 14 nt, Human
cuuggagccggacu

SEQ ID NO: 3765666 - RNA, 13 nt, Human
cuuggagccugca

SEQ ID NO: 3765667 - RNA, 17 nt, Human
cuuggagccugcagagc

SEQ ID NO: 3765668 - RNA, 12 nt, Human
cuuggagcugag

SEQ ID NO: 3765669 - RNA, 14 nt, Human
cuuggagcugagca

SEQ ID NO: 3765670 - RNA, 17 nt, Human
cuuggagcugagcaaau

SEQ ID NO: 3765671 - RNA, 17 nt, Human
cuuggaggagaugggga

SEQ ID NO: 3765672 - RNA, 15 nt, Human
cuuggaggccagcca

SEQ ID NO: 3765673 - RNA, 15 nt, Human
cuuggagggauaagc

SEQ ID NO: 3765674 - RNA, 12 nt, Human
cuuggagggcau

SEQ ID NO: 3765675 - RNA, 20 nt, Human
cuuggagggcccacuuguau

SEQ ID NO: 3765676 - RNA, 18 nt, Human
cuuggagggucccaagcu

SEQ ID NO: 3765677 - RNA, 19 nt, Human
cuuggagggucccaagcug

SEQ ID NO: 3765678 - RNA, 23 nt, Human
cuuggagggucccaagcugggcc

SEQ ID NO: 3765679 - RNA, 18 nt, Human
cuuggaggguugguccuc

SEQ ID NO: 3765680 - RNA, 17 nt, Human
cuuggagguagcuuuga

SEQ ID NO: 3765681 - RNA, 22 nt, Human
cuuggaguuuuucauugucgcu

SEQ ID NO: 3765682 - RNA, 22 nt, Human
cuuggauaaugcuguugccuca

SEQ ID NO: 3765683 - RNA, 23 nt, Human
cuuggauaaugcuguugccucau

SEQ ID NO: 3765684 - RNA, 15 nt, Human
cuuggauuaaauaca

SEQ ID NO: 3765685 - RNA, 17 nt, Human
cuuggauuccugauagu

SEQ ID NO: 3765686 - RNA, 15 nt, Human
cuuggauucucuaac

SEQ ID NO: 3765687 - RNA, 13 nt, Human
cuuggauuguccc

SEQ ID NO: 3765688 - RNA, 18 nt, Human
cuuggauuguccccgacc

SEQ ID NO: 3765689 - RNA, 15 nt, Human
cuuggcaacagaagc

SEQ ID NO: 3765690 - RNA, 23 nt, Human
cuuggcacauuuaagagacaguc

SEQ ID NO: 3765691 - RNA, 22 nt, Human
cuuggcaccaaagaugcagccg

SEQ ID NO: 3765692 - RNA, 19 nt, Human
cuuggcagcccaggccggg

SEQ ID NO: 3765693 - RNA, 16 nt, Human
cuuggcagccuuguga

SEQ ID NO: 3765694 - RNA, 15 nt, Human
cuuggcagcugaacu

SEQ ID NO: 3765695 - RNA, 15 nt, Human
cuuggcauagacaug

SEQ ID NO: 3765696 - RNA, 18 nt, Human
cuuggcaucacagggcag

SEQ ID NO: 3765697 - RNA, 20 nt, Human
cuuggcaucacagggcagag

SEQ ID NO: 3765698 - RNA, 17 nt, Human
cuuggcaucagcuggcg

SEQ ID NO: 3765699 - RNA, 17 nt, Human
cuuggcaugccuuccag

SEQ ID NO: 3765700 - RNA, 20 nt, Human
cuuggcaugccuuccagcac

SEQ ID NO: 3765701 - RNA, 15 nt, Human
cuuggccaagcaggg

SEQ ID NO: 3765702 - RNA, 16 nt, Human
cuuggccaugggaggc

SEQ ID NO: 3765703 - RNA, 23 nt, Human
cuuggcccaggaguuuggccaga

SEQ ID NO: 3765704 - RNA, 21 nt, Human
cuuggccgcaccuaaagcagc

SEQ ID NO: 3765705 - RNA, 19 nt, Human
cuuggccggcugugcucag

SEQ ID NO: 3765706 - RNA, 21 nt, Human
cuuggccggcugugcucagag

SEQ ID NO: 3765707 - RNA, 13 nt, Human
cuuggccuaucuc

SEQ ID NO: 3765708 - RNA, 21 nt, Human
cuuggccuaucuccuagggcu

SEQ ID NO: 3765709 - RNA, 11 nt, Human
cuuggccucag

SEQ ID NO: 3765710 - RNA, 14 nt, Human
cuuggccuggagca

SEQ ID NO: 3765711 - RNA, 15 nt, Human
cuuggccuggagcac

SEQ ID NO: 3765712 - RNA, 13 nt, Human
cuuggccugggcc

SEQ ID NO: 3765713 - RNA, 20 nt, Human
cuuggcgcugccccuggcag

SEQ ID NO: 3765714 - RNA, 21 nt, Human
cuuggcgcugccccuggcagc

SEQ ID NO: 3765715 - RNA, 17 nt, Human
cuuggcggcagcagcca

SEQ ID NO: 3765716 - RNA, 15 nt, Human
cuuggcguggagcag

SEQ ID NO: 3765717 - RNA, 16 nt, Human
cuuggcguggagcagg

SEQ ID NO: 3765718 - RNA, 17 nt, Human
cuuggcguggagccagg

SEQ ID NO: 3765719 - RNA, 21 nt, Human
cuuggcguggagccagggagc

SEQ ID NO: 3765720 - RNA, 17 nt, Human
cuuggcuacacagggau

SEQ ID NO: 3765721 - RNA, 16 nt, Human
cuuggcucagacaugu

SEQ ID NO: 3765722 - RNA, 18 nt, Human
cuuggcucgaaucucugu

SEQ ID NO: 3765723 - RNA, 13 nt, Human
cuuggcucugagg

SEQ ID NO: 3765724 - RNA, 12 nt, Human
cuuggcugcagg

SEQ ID NO: 3765725 - RNA, 13 nt, Human
cuuggcugcaggg

SEQ ID NO: 3765726 - RNA, 14 nt, Human
cuuggcugcaggga

SEQ ID NO: 3765727 - RNA, 14 nt, Human
cuuggcugcuuggc

SEQ ID NO: 3765728 - RNA, 20 nt, Human
cuuggcuggacccagccagg

SEQ ID NO: 3765729 - RNA, 11 nt, Human
cuuggcuggug

SEQ ID NO: 3765730 - RNA, 13 nt, Human
cuuggcuggugca

SEQ ID NO: 3765731 - RNA, 20 nt, Human
cuuggcuggugugguacaga

SEQ ID NO: 3765732 - RNA, 19 nt, Human
cuuggcuuaaucauuuuca

SEQ ID NO: 3765733 - RNA, 14 nt, Human
cuuggcuuaccuga

SEQ ID NO: 3765734 - RNA, 18 nt, Human
cuuggcuuaccugaccuc

SEQ ID NO: 3765735 - RNA, 22 nt, Human
cuuggcuuaccugaccucuugc

SEQ ID NO: 3765736 - RNA, 16 nt, Human
cuuggcuuccuuucuu

SEQ ID NO: 3765737 - RNA, 17 nt, Human
cuuggcuucugugauga

SEQ ID NO: 3765738 - RNA, 21 nt, Human
cuuggcuucugugaugagcug

SEQ ID NO: 3765739 - RNA, 17 nt, Human
cuuggcuugccauuuuu

SEQ ID NO: 3765740 - RNA, 22 nt, Human
cuuggcuuucauuauuaguacu

SEQ ID NO: 3765741 - RNA, 12 nt, Human
cuuggcuuuguu

SEQ ID NO: 3765742 - RNA, 19 nt, Human
cuugggaaauaugaaugcc

SEQ ID NO: 3765743 - RNA, 21 nt, Human
cuugggaagacuccuagcugu

SEQ ID NO: 3765744 - RNA, 10 nt, Human
cuugggaaug

SEQ ID NO: 3765745 - RNA, 13 nt, Human
cuugggaauuuua

SEQ ID NO: 3765746 - RNA, 19 nt, Human
cuugggacuaaaugcccug

SEQ ID NO: 3765747 - RNA, 17 nt, Human
cuugggagagccccugg

SEQ ID NO: 3765748 - RNA, 22 nt, Human
cuugggagagccccuggggccu

SEQ ID NO: 3765749 - RNA, 16 nt, Human
cuugggaggaagcaga

SEQ ID NO: 3765750 - RNA, 17 nt, Human
cuugggaggaagcagaa

SEQ ID NO: 3765751 - RNA, 20 nt, Human
cuugggaggaagcagaauaa

SEQ ID NO: 3765752 - RNA, 15 nt, Human
cuugggaggccccac

SEQ ID NO: 3765753 - RNA, 22 nt, Human
cuugggaggccccacuggggaa

SEQ ID NO: 3765754 - RNA, 16 nt, Human
cuugggaggcugaggc

SEQ ID NO: 3765755 - RNA, 15 nt, Human
cuugggaggcuuccc

SEQ ID NO: 3765756 - RNA, 14 nt, Human
cuugggaguuuuga

SEQ ID NO: 3765757 - RNA, 17 nt, Human
cuugggauccaggcccc

SEQ ID NO: 3765758 - RNA, 20 nt, Human
cuugggcaauauucucugua

SEQ ID NO: 3765759 - RNA, 19 nt, Human
cuugggcacccccagccug

SEQ ID NO: 3765760 - RNA, 15 nt, Human
cuugggcagagcugg

SEQ ID NO: 3765761 - RNA, 13 nt, Human
cuugggccacccc

SEQ ID NO: 3765762 - RNA, 16 nt, Human
cuugggccauagcucc

SEQ ID NO: 3765763 - RNA, 22 nt, Human
cuugggcccagcugggcucugc

SEQ ID NO: 3765764 - RNA, 14 nt, Human
cuugggcccucugg

SEQ ID NO: 3765765 - RNA, 22 nt, Human
gcuguaaucauuuguuuacauu

SEQ ID NO: 3765766 - RNA, 21 nt, Human
gcuguaaugaaacaccuucuc

SEQ ID NO: 3765767 - RNA, 13 nt, Human
gcuguacauacuu

SEQ ID NO: 3765768 - RNA, 14 nt, Human
gcuguacauacuuu

SEQ ID NO: 3765769 - RNA, 12 nt, Human
gcuguacaucua

SEQ ID NO: 3765770 - RNA, 13 nt, Human
gcuguacccaguu

SEQ ID NO: 3765771 - RNA, 18 nt, Human
gcuguacgacacgggugg

SEQ ID NO: 3765772 - RNA, 17 nt, Human
gcuguacugcucaggcu

SEQ ID NO: 3765773 - RNA, 20 nt, Human
gcuguacuucuugaauauaa

SEQ ID NO: 3765774 - RNA, 18 nt, Human
gcuguagacaucuguccu

SEQ ID NO: 3765775 - RNA, 20 nt, Human
gcuguaguccucauaaaaag

SEQ ID NO: 3765776 - RNA, 20 nt, Human
gcuguauaaaaucagccaau

SEQ ID NO: 3765777 - RNA, 17 nt, Human
gcuguaucccaugagcc

SEQ ID NO: 3765778 - RNA, 19 nt, Human
gcuguaucccaugagccuc

SEQ ID NO: 3765779 - RNA, 14 nt, Human
gcuguaucuuguuu

SEQ ID NO: 3765780 - RNA, 15 nt, Human
gcuguaugcugauca

SEQ ID NO: 3765781 - RNA, 20 nt, Human
gcuguaugucuuaaaaccug

SEQ ID NO: 3765782 - RNA, 17 nt, Human
gcuguauuaagccacuu

SEQ ID NO: 3765783 - RNA, 13 nt, Human
gcuguauucuucu

SEQ ID NO: 3765784 - RNA, 17 nt, Human
gcuguauugaaucaugu

SEQ ID NO: 3765785 - RNA, 12 nt, Human
gcuguauuuuaa

SEQ ID NO: 3765786 - RNA, 18 nt, Human
gcuguauuuuaaaagaau

SEQ ID NO: 3765787 - RNA, 20 nt, Human
gcuguauuuuaaaagaauga

SEQ ID NO: 3765788 - RNA, 13 nt, Human
gcuguauuuugaa

SEQ ID NO: 3765789 - RNA, 20 nt, Human
gcugucaaaacaaguuuuuc

SEQ ID NO: 3765790 - RNA, 22 nt, Human
gcugucaaugggaccuguggcu

SEQ ID NO: 3765791 - RNA, 16 nt, Human
gcugucaauuacagga

SEQ ID NO: 3765792 - RNA, 17 nt, Human
gcugucaauuacaggaa

SEQ ID NO: 3765793 - RNA, 16 nt, Human
gcugucacugcugcuu

SEQ ID NO: 3765794 - RNA, 17 nt, Human
gcugucagccauuccug

SEQ ID NO: 3765795 - RNA, 22 nt, Human
gcugucaggauugcgagagaug

SEQ ID NO: 3765796 - RNA, 23 nt, Human
gcugucaucaauugaauggucag

SEQ ID NO: 3765797 - RNA, 21 nt, Human
gcugucauugcacauaagcuu

SEQ ID NO: 3765798 - RNA, 20 nt, Human
gcugucauugcuucuucuga

SEQ ID NO: 3765799 - RNA, 18 nt, Human
gcuguccagacagccugu

SEQ ID NO: 3765800 - RNA, 16 nt, Human
gcuguccagugcccau

SEQ ID NO: 3765801 - RNA, 18 nt, Human
gcuguccagugcccauuc

SEQ ID NO: 3765802 - RNA, 18 nt, Human
gcugucccauagucccug

SEQ ID NO: 3765803 - RNA, 15 nt, Human
gcuguccccccacuc

SEQ ID NO: 3765804 - RNA, 19 nt, Human
gcuguccccucuugcccca

SEQ ID NO: 3765805 - RNA, 21 nt, Human
gcugucccuuacgugaguccu

SEQ ID NO: 3765806 - RNA, 16 nt, Human
gcugucccuuuuccuu

SEQ ID NO: 3765807 - RNA, 19 nt, Human
gcuguccucagguggccau

SEQ ID NO: 3765808 - RNA, 20 nt, Human
gcuguccucagguggccaug

SEQ ID NO: 3765809 - RNA, 21 nt, Human
gcuguccucagguggccaugc

SEQ ID NO: 3765810 - RNA, 13 nt, Human
gcuguccucccuc

SEQ ID NO: 3765811 - RNA, 18 nt, Human
gcuguccuugaaugccau

SEQ ID NO: 3765812 - RNA, 19 nt, Human
gcuguccuuuuuccucucc

SEQ ID NO: 3765813 - RNA, 14 nt, Human
gcugucuccagacc

SEQ ID NO: 3765814 - RNA, 15 nt, Human
gcugucuccagaccc

SEQ ID NO: 3765815 - RNA, 18 nt, Human
gcugucugaggcuaggug

SEQ ID NO: 3765816 - RNA, 17 nt, Human
gcugucuggccaggccu

SEQ ID NO: 3765817 - RNA, 23 nt, Human
gcugucuguuguauucauugugg

SEQ ID NO: 3765818 - RNA, 21 nt, Human
gcugucuuaaacuaaaugugc

SEQ ID NO: 3765819 - RNA, 20 nt, Human
gcugucuucucaggcucugc

SEQ ID NO: 3765820 - RNA, 22 nt, Human
gcugucuucucaggcucugccc

SEQ ID NO: 3765821 - RNA, 23 nt, Human
gcugucuucuggacaggcucugc

SEQ ID NO: 3765822 - RNA, 17 nt, Human
gcugucuuucuugcucc

SEQ ID NO: 3765823 - RNA, 18 nt, Human
gcugucuuucuugcuccc

SEQ ID NO: 3765824 - RNA, 23 nt, Human
gcugucuuucuugcucccugacu

SEQ ID NO: 3765825 - RNA, 13 nt, Human
gcugugaaaaaaa

SEQ ID NO: 3765826 - RNA, 20 nt, Human
gcugugaacaagugaacaca

SEQ ID NO: 3765827 - RNA, 16 nt, Human
gcugugaacaggcugg

SEQ ID NO: 3765828 - RNA, 19 nt, Human
gcugugaacccuggggccu

SEQ ID NO: 3765829 - RNA, 21 nt, Human
gcugugaacccuggggccuga

SEQ ID NO: 3765830 - RNA, 17 nt, Human
gcugugaacugaaauua

SEQ ID NO: 3765831 - RNA, 19 nt, Human
gcugugacccucaauucau

SEQ ID NO: 3765832 - RNA, 15 nt, Human
gcugugaccugcuga

SEQ ID NO: 3765833 - RNA, 16 nt, Human
gcugugaccugcugag

SEQ ID NO: 3765834 - RNA, 15 nt, Human
gcugugagacagugg

SEQ ID NO: 3765835 - RNA, 15 nt, Human
gcugugagccccugg

SEQ ID NO: 3765836 - RNA, 13 nt, Human
gcugugagccuug

SEQ ID NO: 3765837 - RNA, 14 nt, Human
gcugugagccuugg

SEQ ID NO: 3765838 - RNA, 18 nt, Human
gcugugaggccccuggac

SEQ ID NO: 3765839 - RNA, 15 nt, Human
gcugugaggcugucc

SEQ ID NO: 3765840 - RNA, 17 nt, Human
gcugugaggcuguccug

SEQ ID NO: 3765841 - RNA, 18 nt, Human
gcugugaggcuguccugu

SEQ ID NO: 3765842 - RNA, 14 nt, Human
gcugugagggaggg

SEQ ID NO: 3765843 - RNA, 15 nt, Human
gcugugagggagggg

SEQ ID NO: 3765844 - RNA, 20 nt, Human
gcugugcaacgccgugggcu

SEQ ID NO: 3765845 - RNA, 18 nt, Human
gcugugcacaaaguggca

SEQ ID NO: 3765846 - RNA, 21 nt, Human
gcugugcacaaaguggcauaa

SEQ ID NO: 3765847 - RNA, 16 nt, Human
gcugugcagccugucc

SEQ ID NO: 3765848 - RNA, 13 nt, Human
gcugugccacagg

SEQ ID NO: 3765849 - RNA, 15 nt, Human
gcugugccacaggcu

SEQ ID NO: 3765850 - RNA, 22 nt, Human
gcugugccacccugggcucugu

SEQ ID NO: 3765851 - RNA, 17 nt, Human
gcugugccucccaaaau

SEQ ID NO: 3765852 - RNA, 23 nt, Human
gcugugccucgcuccccacucug

SEQ ID NO: 3765853 - RNA, 12 nt, Human
gcugugccucug

SEQ ID NO: 3765854 - RNA, 16 nt, Human
gcugugcgcccagggc

SEQ ID NO: 3765855 - RNA, 16 nt, Human
gcugugcggaucucug

SEQ ID NO: 3765856 - RNA, 14 nt, Human
gcugugcuaugaau

SEQ ID NO: 3765857 - RNA, 12 nt, Human
gcugugcugccc

SEQ ID NO: 3765858 - RNA, 17 nt, Human
gcugugcugcccugaag

SEQ ID NO: 3765859 - RNA, 15 nt, Human
gcugugcugcccugc

SEQ ID NO: 3765860 - RNA, 16 nt, Human
gcugugcugcccugcc

SEQ ID NO: 3765861 - RNA, 22 nt, Human
gcugugcugcccugcccaccug

SEQ ID NO: 3765862 - RNA, 15 nt, Human
gcugugcugggagaa

SEQ ID NO: 3765863 - RNA, 18 nt, Human
gcugugcuugaaggcccu

SEQ ID NO: 3765864 - RNA, 19 nt, Human
gcugugcuugaaggcccug

SEQ ID NO: 3765865 - RNA, 19 nt, Human
gcuguggagacaaugucug

SEQ ID NO: 3765866 - RNA, 21 nt, Human
gcuguggagacaaugucugca

SEQ ID NO: 3765867 - RNA, 23 nt, Human
gcuguggagacaaugucugcagc

SEQ ID NO: 3765868 - RNA, 17 nt, Human
gcuguggaggauugcua

SEQ ID NO: 3765869 - RNA, 23 nt, Human
gcuguggcaggccagcugugguu

SEQ ID NO: 3765870 - RNA, 21 nt, Human
gcuguggcaugggugaagagg

SEQ ID NO: 3765871 - RNA, 13 nt, Human
gcuguggccaggg

SEQ ID NO: 3765872 - RNA, 18 nt, Human
gcugugggcaagccuaag

SEQ ID NO: 3765873 - RNA, 23 nt, Human
gcugugggcaggugggagcuuga

SEQ ID NO: 3765874 - RNA, 18 nt, Human
gcugugggccucaaggac

SEQ ID NO: 3765875 - RNA, 20 nt, Human
gcugugggcgugagaccugc

SEQ ID NO: 3765876 - RNA, 16 nt, Human
gcugugggcucccuuc

SEQ ID NO: 3765877 - RNA, 16 nt, Human
gcuguggguuuuuaau

SEQ ID NO: 3765878 - RNA, 23 nt, Human
gcugugguagggggugucucagg

SEQ ID NO: 3765879 - RNA, 19 nt, Human
gcuguggucaaggcuacag

SEQ ID NO: 3765880 - RNA, 19 nt, Human
gcuguggugagggaagacg

SEQ ID NO: 3765881 - RNA, 23 nt, Human
gcuguggugugucccccucuguc

SEQ ID NO: 3765882 - RNA, 16 nt, Human
gcugugguuccugggg

SEQ ID NO: 3765883 - RNA, 23 nt, Human
gcugugguuuccaucugaaagua

SEQ ID NO: 3765884 - RNA, 14 nt, Human
gcugugguuuucuu

SEQ ID NO: 3765885 - RNA, 23 nt, Human
gcugugguuuucuuuugccauga

SEQ ID NO: 3765886 - RNA, 14 nt, Human
gcuguguaaaguua

SEQ ID NO: 3765887 - RNA, 16 nt, Human
gcuguguaaaguuagu

SEQ ID NO: 3765888 - RNA, 19 nt, Human
gcuguguaaaguuagucua

SEQ ID NO: 3765889 - RNA, 18 nt, Human
gcuguguaagauuuguuu

SEQ ID NO: 3765890 - RNA, 14 nt, Human
gcuguguaucugau

SEQ ID NO: 3765891 - RNA, 19 nt, Human
gcuguguccaacuccagua

SEQ ID NO: 3765892 - RNA, 14 nt, Human
gcuguguccuugca

SEQ ID NO: 3765893 - RNA, 18 nt, Human
gcuguguccuugcaccug

SEQ ID NO: 3765894 - RNA, 20 nt, Human
gcuguguccuugcaccugca

SEQ ID NO: 3765895 - RNA, 21 nt, Human
gcuguguccuugcaccugcau

SEQ ID NO: 3765896 - RNA, 23 nt, Human
gcuguguccuugcaccugcaucc

SEQ ID NO: 3765897 - RNA, 14 nt, Human
gcugugucuaaacu

SEQ ID NO: 3765898 - RNA, 15 nt, Human
gcugugucucccuuc

SEQ ID NO: 3765899 - RNA, 18 nt, Human
gcugugugcuuuuuuugu

SEQ ID NO: 3765900 - RNA, 16 nt, Human
gcuguguggcagucug

SEQ ID NO: 3765901 - RNA, 15 nt, Human
gcugugugucccagg

SEQ ID NO: 3765902 - RNA, 14 nt, Human
gcuguguguggcuu

SEQ ID NO: 3765903 - RNA, 17 nt, Human
gcuguguucuggugagg

SEQ ID NO: 3765904 - RNA, 19 nt, Human
gcuguguuggguagaauag

SEQ ID NO: 3765905 - RNA, 19 nt, Human
gcuguguugguguggccca

SEQ ID NO: 3765906 - RNA, 22 nt, Human
gcuguguuuauauggaagaaag

SEQ ID NO: 3765907 - RNA, 17 nt, Human
gcuguguuugcagccug

SEQ ID NO: 3765908 - RNA, 19 nt, Human
gcuguguuugcagccugcu

SEQ ID NO: 3765909 - RNA, 14 nt, Human
gcuguguuugcucc

SEQ ID NO: 3765910 - RNA, 15 nt, Human
gcuguuaaacuguua

SEQ ID NO: 3765911 - RNA, 22 nt, Human
gcuguuaaauacaggaaacagu

SEQ ID NO: 3765912 - RNA, 18 nt, Human
gcuguuacuguuaaccau

SEQ ID NO: 3765913 - RNA, 20 nt, Human
gcuguuaugucuguuuaaga

SEQ ID NO: 3765914 - RNA, 17 nt, Human
cuugggcccuuugagug

SEQ ID NO: 3765915 - RNA, 13 nt, Human
cuugggcucccug

SEQ ID NO: 3765916 - RNA, 21 nt, Human
cuugggcucccuguaaccucu

SEQ ID NO: 3765917 - RNA, 21 nt, Human
cuugggcuccgugugggagac

SEQ ID NO: 3765918 - RNA, 14 nt, Human
cuugggcugagacu

SEQ ID NO: 3765919 - RNA, 17 nt, Human
cuugggcugagacugga

SEQ ID NO: 3765920 - RNA, 14 nt, Human
cuugggcugcuccu

SEQ ID NO: 3765921 - RNA, 18 nt, Human
cuuggggaacaagggugg

SEQ ID NO: 3765922 - RNA, 17 nt, Human
cuuggggaauuuccucu

SEQ ID NO: 3765923 - RNA, 22 nt, Human
cuuggggacaaccuuggcuugg

SEQ ID NO: 3765924 - RNA, 20 nt, Human
cuuggggacaggggcaggag

SEQ ID NO: 3765925 - RNA, 17 nt, Human
cuuggggaccagagcug

SEQ ID NO: 3765926 - RNA, 18 nt, Human
cuuggggaccagagcugc

SEQ ID NO: 3765927 - RNA, 20 nt, Human
cuuggggaccagagcugcca

SEQ ID NO: 3765928 - RNA, 23 nt, Human
cuuggggaggacaaaacuucuug

SEQ ID NO: 3765929 - RNA, 21 nt, Human
cuuggggaguuuagggugggg

SEQ ID NO: 3765930 - RNA, 19 nt, Human
cuuggggauucuuccaucu

SEQ ID NO: 3765931 - RNA, 21 nt, Human
cuuggggauucuuccaucuga

SEQ ID NO: 3765932 - RNA, 20 nt, Human
cuuggggcaacauuguucac

SEQ ID NO: 3765933 - RNA, 19 nt, Human
cuuggggccaccaaagcug

SEQ ID NO: 3765934 - RNA, 16 nt, Human
cuuggggcccagugca

SEQ ID NO: 3765935 - RNA, 17 nt, Human
cuuggggcccagugcau

SEQ ID NO: 3765936 - RNA, 19 nt, Human
cuuggggcccagugcaugg

SEQ ID NO: 3765937 - RNA, 15 nt, Human
cuuggggccuaugca

SEQ ID NO: 3765938 - RNA, 14 nt, Human
cuuggggcuuccua

SEQ ID NO: 3765939 - RNA, 16 nt, Human
cuuggggggcugaggu

SEQ ID NO: 3765940 - RNA, 18 nt, Human
cuuggggggguggccgcu

SEQ ID NO: 3765941 - RNA, 22 nt, Human
cuuggggggguggccgcugagu

SEQ ID NO: 3765942 - RNA, 13 nt, Human
cuuggggggugau

SEQ ID NO: 3765943 - RNA, 20 nt, Human
cuuggggguccuccuccagg

SEQ ID NO: 3765944 - RNA, 23 nt, Human
cuuggggguccuccuccagggac

SEQ ID NO: 3765945 - RNA, 23 nt, Human
cuuggggguucaggcccggcagg

SEQ ID NO: 3765946 - RNA, 15 nt, Human
cuuggggucaagaaa

SEQ ID NO: 3765947 - RNA, 13 nt, Human
cuuggggucaggu

SEQ ID NO: 3765948 - RNA, 20 nt, Human
cuugggguuuucaguaugaa

SEQ ID NO: 3765949 - RNA, 23 nt, Human
cuuggguagaguuuacagcucug

SEQ ID NO: 3765950 - RNA, 16 nt, Human
cuuggguagcgcacuc

SEQ ID NO: 3765951 - RNA, 15 nt, Human
cuuggguaggcggga

SEQ ID NO: 3765952 - RNA, 23 nt, Human
cuugggucccccacgugacagug

SEQ ID NO: 3765953 - RNA, 18 nt, Human
cuuggguggagaagccau

SEQ ID NO: 3765954 - RNA, 18 nt, Human
cuuggguuagaccuacag

SEQ ID NO: 3765955 - RNA, 18 nt, Human
cuugguacuugcugcuau

SEQ ID NO: 3765956 - RNA, 16 nt, Human
cuuggucaccagcucc

SEQ ID NO: 3765957 - RNA, 16 nt, Human
cuugguccaggaaaug

SEQ ID NO: 3765958 - RNA, 15 nt, Human
cuugguccuugauuu

SEQ ID NO: 3765959 - RNA, 16 nt, Human
cuuggucuuuguaucu

SEQ ID NO: 3765960 - RNA, 18 nt, Human
cuuggugcuuauugauau

SEQ ID NO: 3765961 - RNA, 19 nt, Human
cuugguggcucacgccugu

SEQ ID NO: 3765962 - RNA, 13 nt, Human
cuugguguaauuu

SEQ ID NO: 3765963 - RNA, 16 nt, Human
cuugguguccaccugg

SEQ ID NO: 3765964 - RNA, 20 nt, Human
cuuggugucgggcaugacac

SEQ ID NO: 3765965 - RNA, 21 nt, Human
cuugguguuaaaacacuucug

SEQ ID NO: 3765966 - RNA, 16 nt, Human
cuugguucauaaauga

SEQ ID NO: 3765967 - RNA, 19 nt, Human
cuugguucccccacugauc

SEQ ID NO: 3765968 - RNA, 13 nt, Human
cuugguuccuggg

SEQ ID NO: 3765969 - RNA, 16 nt, Human
cuugguuccuucccaa

SEQ ID NO: 3765970 - RNA, 19 nt, Human
cuugguucuugaggggacc

SEQ ID NO: 3765971 - RNA, 16 nt, Human
cuugguugaggaaaca

SEQ ID NO: 3765972 - RNA, 17 nt, Human
cuugguuggguccucac

SEQ ID NO: 3765973 - RNA, 18 nt, Human
cuugguugucuccacaca

SEQ ID NO: 3765974 - RNA, 15 nt, Human
cuugguugucuggca

SEQ ID NO: 3765975 - RNA, 23 nt, Human
cuugguuucucucuacagugcca

SEQ ID NO: 3765976 - RNA, 21 nt, Human
cuugguuuugcuacauaauua

SEQ ID NO: 3765977 - RNA, 22 nt, Human
cuugguuuuuacugcucugaga

SEQ ID NO: 3765978 - RNA, 18 nt, Human
cuuguaaaagacagugua

SEQ ID NO: 3765979 - RNA, 17 nt, Human
cuuguaaacagaagcaa

SEQ ID NO: 3765980 - RNA, 13 nt, Human
cuuguaaagacug

SEQ ID NO: 3765981 - RNA, 15 nt, Human
cuuguaaagacuggu

SEQ ID NO: 3765982 - RNA, 18 nt, Human
cuuguaaaggaauuuaaa

SEQ ID NO: 3765983 - RNA, 19 nt, Human
cuuguaaaggaauuuaaaa

SEQ ID NO: 3765984 - RNA, 17 nt, Human
cuuguaaauaaagcccu

SEQ ID NO: 3765985 - RNA, 19 nt, Human
cuuguaaauaaagcccugg

SEQ ID NO: 3765986 - RNA, 21 nt, Human
cuuguaaauagcucagguguc

SEQ ID NO: 3765987 - RNA, 14 nt, Human
cuuguaaauauaaa

SEQ ID NO: 3765988 - RNA, 16 nt, Human
cuuguaaauauaaaga

SEQ ID NO: 3765989 - RNA, 19 nt, Human
cuuguaaauauaaagacgu

SEQ ID NO: 3765990 - RNA, 23 nt, Human
cuuguaaauguguuggacaaaug

SEQ ID NO: 3765991 - RNA, 23 nt, Human
cuuguaaauuauuaauuuaugca

SEQ ID NO: 3765992 - RNA, 14 nt, Human
cuuguaacuccacc

SEQ ID NO: 3765993 - RNA, 15 nt, Human
cuuguaacuccacca

SEQ ID NO: 3765994 - RNA, 14 nt, Human
cuuguaagacccuu

SEQ ID NO: 3765995 - RNA, 19 nt, Human
cuuguaagagcuauacagu

SEQ ID NO: 3765996 - RNA, 12 nt, Human
cuuguaagauuu

SEQ ID NO: 3765997 - RNA, 15 nt, Human
cuuguaagauuuuga

SEQ ID NO: 3765998 - RNA, 18 nt, Human
cuuguaagauuuugaaaa

SEQ ID NO: 3765999 - RNA, 15 nt, Human
cuuguaaggcuuuga

SEQ ID NO: 3766000 - RNA, 21 nt, Human
cuuguaaugauauagccagaa

SEQ ID NO: 3766001 - RNA, 14 nt, Human
cuuguaauguaacu

SEQ ID NO: 3766002 - RNA, 10 nt, Human
cuuguaauua

SEQ ID NO: 3766003 - RNA, 12 nt, Human
cuuguaauuuaa

SEQ ID NO: 3766004 - RNA, 14 nt, Human
cuuguaauuuccag

SEQ ID NO: 3766005 - RNA, 19 nt, Human
cuuguacauaaugcgugca

SEQ ID NO: 3766006 - RNA, 22 nt, Human
cuuguacauguguagccugugc

SEQ ID NO: 3766007 - RNA, 23 nt, Human
cuuguacauguguagccugugca

SEQ ID NO: 3766008 - RNA, 18 nt, Human
cuuguagaacucacucug

SEQ ID NO: 3766009 - RNA, 14 nt, Human
cuuguagaauuguu

SEQ ID NO: 3766010 - RNA, 21 nt, Human
cuuguagccagccggggcgag

SEQ ID NO: 3766011 - RNA, 13 nt, Human
cuuguagcuccuc

SEQ ID NO: 3766012 - RNA, 22 nt, Human
cuuguagcuguaaaacgcuguc

SEQ ID NO: 3766013 - RNA, 13 nt, Human
cuuguauaaaugu

SEQ ID NO: 3766014 - RNA, 23 nt, Human
cuuguauaaauguauauacacau

SEQ ID NO: 3766015 - RNA, 19 nt, Human
cuuguauaagauccuagau

SEQ ID NO: 3766016 - RNA, 15 nt, Human
cuuguauaguguaaa

SEQ ID NO: 3766017 - RNA, 16 nt, Human
cuuguauaguguaaaa

SEQ ID NO: 3766018 - RNA, 18 nt, Human
cuuguauauuuguacaaa

SEQ ID NO: 3766019 - RNA, 20 nt, Human
cuuguaucaacacuguuacu

SEQ ID NO: 3766020 - RNA, 19 nt, Human
cuuguaucuggauucaaau

SEQ ID NO: 3766021 - RNA, 17 nt, Human
cuuguauuaaagacaga

SEQ ID NO: 3766022 - RNA, 13 nt, Human
cuuguauuaaguu

SEQ ID NO: 3766023 - RNA, 20 nt, Human
cuuguauuccaagcauauaa

SEQ ID NO: 3766024 - RNA, 16 nt, Human
cuuguauuuuuuaaug

SEQ ID NO: 3766025 - RNA, 19 nt, Human
cuugucaagccugugcaaa

SEQ ID NO: 3766026 - RNA, 22 nt, Human
cuugucaauauuuaaacauggu

SEQ ID NO: 3766027 - RNA, 18 nt, Human
cuugucacugacacaaag

SEQ ID NO: 3766028 - RNA, 23 nt, Human
cuugucacugacacaaaggaagu

SEQ ID NO: 3766029 - RNA, 15 nt, Human
cuugucacugguaga

SEQ ID NO: 3766030 - RNA, 13 nt, Human
cuugucacuugca

SEQ ID NO: 3766031 - RNA, 15 nt, Human
cuugucagagcuggg

SEQ ID NO: 3766032 - RNA, 16 nt, Human
cuugucauagccagug

SEQ ID NO: 3766033 - RNA, 20 nt, Human
cuugucauauguagccuuca

SEQ ID NO: 3766034 - RNA, 12 nt, Human
cuugucaugugu

SEQ ID NO: 3766035 - RNA, 16 nt, Human
cuugucauguguauaa

SEQ ID NO: 3766036 - RNA, 18 nt, Human
cuugucauuuuuuuucuu

SEQ ID NO: 3766037 - RNA, 18 nt, Human
cuuguccagcgccuagug

SEQ ID NO: 3766038 - RNA, 18 nt, Human
cuugucccacucaagcca

SEQ ID NO: 3766039 - RNA, 19 nt, Human
cuugucccacucaagccaa

SEQ ID NO: 3766040 - RNA, 21 nt, Human
cuugucccacucaagccaagc

SEQ ID NO: 3766041 - RNA, 13 nt, Human
cuuguccccacac

SEQ ID NO: 3766042 - RNA, 16 nt, Human
cuuguccccacacucc

SEQ ID NO: 3766043 - RNA, 16 nt, Human
cuuguccuagcacaga

SEQ ID NO: 3766044 - RNA, 16 nt, Human
cuuguccucaguccau

SEQ ID NO: 3766045 - RNA, 14 nt, Human
cuuguccuuagccu

SEQ ID NO: 3766046 - RNA, 22 nt, Human
cuugucgccccucccucccaga

SEQ ID NO: 3766047 - RNA, 16 nt, Human
cuugucuauaaagcau

SEQ ID NO: 3766048 - RNA, 20 nt, Human
cuugucuauaaagcauuuaa

SEQ ID NO: 3766049 - RNA, 13 nt, Human
cuugucucagauu

SEQ ID NO: 3766050 - RNA, 14 nt, Human
cuugucucagauuu

SEQ ID NO: 3766051 - RNA, 12 nt, Human
cuugucuccccu

SEQ ID NO: 3766052 - RNA, 18 nt, Human
cuugucuccuacuccuga

SEQ ID NO: 3766053 - RNA, 20 nt, Human
cuugucuccuacuccugacu

SEQ ID NO: 3766054 - RNA, 19 nt, Human
cuugucucuucaucuaaua

SEQ ID NO: 3766055 - RNA, 21 nt, Human
cuugucuguagcgucuguaua

SEQ ID NO: 3766056 - RNA, 21 nt, Human
cuugucuucugguacuuucug

SEQ ID NO: 3766057 - RNA, 16 nt, Human
cuugucuuucuggggu

SEQ ID NO: 3766058 - RNA, 18 nt, Human
cuugucuuuggacccuga

SEQ ID NO: 3766059 - RNA, 20 nt, Human
cuugucuuuggacccugagg

SEQ ID NO: 3766060 - RNA, 16 nt, Human
cuugugaaaauguguu

SEQ ID NO: 3766061 - RNA, 14 nt, Human
cuugugaaacacag

SEQ ID NO: 3766062 - RNA, 19 nt, Human
cuugugaaugcuucucacu

SEQ ID NO: 3766063 - RNA, 21 nt, Human
ggacccuucccuugagcccuc

SEQ ID NO: 3766064 - RNA, 12 nt, Human
ggacccuuuccu

SEQ ID NO: 3766065 - RNA, 23 nt, Human
ggacccuuuccuuccuucccugg

SEQ ID NO: 3766066 - RNA, 16 nt, Human
ggaccgaguagaggca

SEQ ID NO: 3766067 - RNA, 17 nt, Human
ggaccgccagauggggc

SEQ ID NO: 3766068 - RNA, 20 nt, Human
ggaccgcuacaccacucugg

SEQ ID NO: 3766069 - RNA, 15 nt, Human
ggaccggcugccccg

SEQ ID NO: 3766070 - RNA, 23 nt, Human
ggaccgggccgcuagaugggcau

SEQ ID NO: 3766071 - RNA, 22 nt, Human
ggaccuaaauggccucaugugg

SEQ ID NO: 3766072 - RNA, 17 nt, Human
ggaccuagggaggcaug

SEQ ID NO: 3766073 - RNA, 19 nt, Human
ggaccucagaguccaggcc

SEQ ID NO: 3766074 - RNA, 13 nt, Human
ggaccucaggccu

SEQ ID NO: 3766075 - RNA, 15 nt, Human
ggaccucaggccugg

SEQ ID NO: 3766076 - RNA, 19 nt, Human
ggaccucaggugagaagca

SEQ ID NO: 3766077 - RNA, 18 nt, Human
ggaccucauccaaacaau

SEQ ID NO: 3766078 - RNA, 17 nt, Human
ggaccuccccugaggcu

SEQ ID NO: 3766079 - RNA, 17 nt, Human
ggaccucccuuccgacc

SEQ ID NO: 3766080 - RNA, 15 nt, Human
ggaccuccucuuccc

SEQ ID NO: 3766081 - RNA, 23 nt, Human
ggaccuccucuucccccuuccaa

SEQ ID NO: 3766082 - RNA, 14 nt, Human
ggaccuccugagcg

SEQ ID NO: 3766083 - RNA, 12 nt, Human
ggaccucuccca

SEQ ID NO: 3766084 - RNA, 14 nt, Human
ggaccucucccagg

SEQ ID NO: 3766085 - RNA, 17 nt, Human
ggaccucugacagcagc

SEQ ID NO: 3766086 - RNA, 12 nt, Human
ggaccucugcuc

SEQ ID NO: 3766087 - RNA, 14 nt, Human
ggaccucugggcuu

SEQ ID NO: 3766088 - RNA, 14 nt, Human
ggaccugagccugc

SEQ ID NO: 3766089 - RNA, 13 nt, Human
ggaccuggggcac

SEQ ID NO: 3766090 - RNA, 16 nt, Human
ggaccuggggcacagu

SEQ ID NO: 3766091 - RNA, 16 nt, Human
ggaccuguggcugucg

SEQ ID NO: 3766092 - RNA, 15 nt, Human
ggaccuuaucugugc

SEQ ID NO: 3766093 - RNA, 22 nt, Human
ggaccuucacucuaagauguua

SEQ ID NO: 3766094 - RNA, 15 nt, Human
ggaccuuccugccac

SEQ ID NO: 3766095 - RNA, 18 nt, Human
ggaccuucgggcugugcc

SEQ ID NO: 3766096 - RNA, 20 nt, Human
ggaccuucgggcugugcccg

SEQ ID NO: 3766097 - RNA, 18 nt, Human
ggaccuugaacuggguac

SEQ ID NO: 3766098 - RNA, 19 nt, Human
ggaccuuuagugguggcca

SEQ ID NO: 3766099 - RNA, 20 nt, Human
ggaccuuuccaccacagcca

SEQ ID NO: 3766100 - RNA, 15 nt, Human
ggaccuuuuaaagug

SEQ ID NO: 3766101 - RNA, 22 nt, Human
ggaccuuuuaaaguguuucagc

SEQ ID NO: 3766102 - RNA, 19 nt, Human
ggacgaagaagagccacag

SEQ ID NO: 3766103 - RNA, 21 nt, Human
ggacgagaugggaaggcacag

SEQ ID NO: 3766104 - RNA, 14 nt, Human
ggacgcacugagca

SEQ ID NO: 3766105 - RNA, 15 nt, Human
ggacgccacccagca

SEQ ID NO: 3766106 - RNA, 20 nt, Human
ggacgccacucauuucaucu

SEQ ID NO: 3766107 - RNA, 20 nt, Human
ggacgccugggggugccagg

SEQ ID NO: 3766108 - RNA, 13 nt, Human
ggacgcucugcug

SEQ ID NO: 3766109 - RNA, 18 nt, Human
ggacgcugaccguggagc

SEQ ID NO: 3766110 - RNA, 15 nt, Human
ggacgcuuugucugu

SEQ ID NO: 3766111 - RNA, 17 nt, Human
ggacggccaagaaugua

SEQ ID NO: 3766112 - RNA, 20 nt, Human
uuuuucaucuucaguugucu

SEQ ID NO: 3766113 - RNA, 18 nt, Human
uuuuucaugauuuugaaa

SEQ ID NO: 3766114 - RNA, 10 nt, Human
uuuuucaugu

SEQ ID NO: 3766115 - RNA, 13 nt, Human
uuuuucauuauuu

SEQ ID NO: 3766116 - RNA, 22 nt, Human
uuuuucauuauuuuauuaugaa

SEQ ID NO: 3766117 - RNA, 19 nt, Human
uuuuucauugccaaaaacu

SEQ ID NO: 3766118 - RNA, 16 nt, Human
uuuuuccaaaaaaaua

SEQ ID NO: 3766119 - RNA, 11 nt, Human
uuuuuccaaca

SEQ ID NO: 3766120 - RNA, 20 nt, Human
uuuuuccaauuuuagaaaau

SEQ ID NO: 3766121 - RNA, 12 nt, Human
uuuuuccaggcu

SEQ ID NO: 3766122 - RNA, 14 nt, Human
uuuuuccauaguuu

SEQ ID NO: 3766123 - RNA, 20 nt, Human
uuuuuccauaguuuugauga

SEQ ID NO: 3766124 - RNA, 13 nt, Human
uuuuuccaucuuu

SEQ ID NO: 3766125 - RNA, 19 nt, Human
uuuuucccagcuacaccuu

SEQ ID NO: 3766126 - RNA, 15 nt, Human
uuuuucccauuuaga

SEQ ID NO: 3766127 - RNA, 17 nt, Human
uuuuuccccagacuugu

SEQ ID NO: 3766128 - RNA, 18 nt, Human
uuuuucccuaucacugaa

SEQ ID NO: 3766129 - RNA, 15 nt, Human
uuuuuccguaaaaau

SEQ ID NO: 3766130 - RNA, 18 nt, Human
uuuuuccuagcccucuca

SEQ ID NO: 3766131 - RNA, 15 nt, Human
uuuuuccuagccugu

SEQ ID NO: 3766132 - RNA, 22 nt, Human
uuuuuccuaugaccauaaaauu

SEQ ID NO: 3766133 - RNA, 17 nt, Human
uuuuuccuaugcuauug

SEQ ID NO: 3766134 - RNA, 22 nt, Human
uuuuuccuucaaaguuuaauaa

SEQ ID NO: 3766135 - RNA, 21 nt, Human
uuuuuccuucaagaaugcagu

SEQ ID NO: 3766136 - RNA, 15 nt, Human
uuuuuccuucucugg

SEQ ID NO: 3766137 - RNA, 17 nt, Human
uuuuuccuuguauuuaa

SEQ ID NO: 3766138 - RNA, 18 nt, Human
uuuuuccuuuaacugaca

SEQ ID NO: 3766139 - RNA, 14 nt, Human
uuuuucuaaaggag

SEQ ID NO: 3766140 - RNA, 18 nt, Human
uuuuucuacuuuuaaaga

SEQ ID NO: 3766141 - RNA, 11 nt, Human
uuuuucuauua

SEQ ID NO: 3766142 - RNA, 18 nt, Human
uuuuucuauuaaaagacu

SEQ ID NO: 3766143 - RNA, 21 nt, Human
uuuuucuauuaaaagacucau

SEQ ID NO: 3766144 - RNA, 15 nt, Human
uuuuucuccagugcu

SEQ ID NO: 3766145 - RNA, 11 nt, Human
uuuuucucuaa

SEQ ID NO: 3766146 - RNA, 16 nt, Human
uuuuucucucaacacc

SEQ ID NO: 3766147 - RNA, 18 nt, Human
uuuuucugacuccagugg

SEQ ID NO: 3766148 - RNA, 13 nt, Human
uuuuucugcacua

SEQ ID NO: 3766149 - RNA, 14 nt, Human
uuuuucugcacuga

SEQ ID NO: 3766150 - RNA, 14 nt, Human
uuuuucuguuauau

SEQ ID NO: 3766151 - RNA, 17 nt, Human
uuuuucuguuguaacuu

SEQ ID NO: 3766152 - RNA, 15 nt, Human
uuuuucuuaaaaagu

SEQ ID NO: 3766153 - RNA, 23 nt, Human
uuuuucuuaaauaauaaagauca

SEQ ID NO: 3766154 - RNA, 21 nt, Human
uuuuucuuaauauauagcauu

SEQ ID NO: 3766155 - RNA, 13 nt, Human
uuuuucuuuauaa

SEQ ID NO: 3766156 - RNA, 16 nt, Human
uuuuucuuuauaaacu

SEQ ID NO: 3766157 - RNA, 13 nt, Human
uuuuugaaaacau

SEQ ID NO: 3766158 - RNA, 20 nt, Human
uuuuugaaaagcagacauuu

SEQ ID NO: 3766159 - RNA, 23 nt, Human
uuuuugaaaggcauguuccucug

SEQ ID NO: 3766160 - RNA, 14 nt, Human
uuuuugaaauaaua

SEQ ID NO: 3766161 - RNA, 17 nt, Human
uuuuugaaaugcugaaa

SEQ ID NO: 3766162 - RNA, 20 nt, Human
uuuuugaaaugcugaaaauu

SEQ ID NO: 3766163 - RNA, 23 nt, Human
uuuuugaacuaagaaacuuuugu

SEQ ID NO: 3766164 - RNA, 22 nt, Human
uuuuugaaggcagaaagcaaaa

SEQ ID NO: 3766165 - RNA, 14 nt, Human
uuuuugaaguguag

SEQ ID NO: 3766166 - RNA, 12 nt, Human
uuuuugacacug

SEQ ID NO: 3766167 - RNA, 19 nt, Human
uuuuugacacugaaaguuu

SEQ ID NO: 3766168 - RNA, 22 nt, Human
uuuuugacacugaaaguuuugu

SEQ ID NO: 3766169 - RNA, 12 nt, Human
uuuuugacagaa

SEQ ID NO: 3766170 - RNA, 16 nt, Human
uuuuugacucccagau

SEQ ID NO: 3766171 - RNA, 12 nt, Human
uuuuugacuuuu

SEQ ID NO: 3766172 - RNA, 20 nt, Human
uuuuugacuuuuuuuguaug

SEQ ID NO: 3766173 - RNA, 16 nt, Human
uuuuugagacagaguc

SEQ ID NO: 3766174 - RNA, 16 nt, Human
uuuuugagucaaagac

SEQ ID NO: 3766175 - RNA, 13 nt, Human
uuuuugauagcau

SEQ ID NO: 3766176 - RNA, 19 nt, Human
uuuuugauagcauuguaag

SEQ ID NO: 3766177 - RNA, 12 nt, Human
uuuuugauauag

SEQ ID NO: 3766178 - RNA, 15 nt, Human
uuuuugcaagugaag

SEQ ID NO: 3766179 - RNA, 22 nt, Human
uuuuugcaauaaugcaguaugg

SEQ ID NO: 3766180 - RNA, 9 nt, Human
uuuuugcag

SEQ ID NO: 3766181 - RNA, 18 nt, Human
uuuuugcaggagcaguau

SEQ ID NO: 3766182 - RNA, 14 nt, Human
uuuuugcaguaacu

SEQ ID NO: 3766183 - RNA, 14 nt, Human
uuuuugccuucauu

SEQ ID NO: 3766184 - RNA, 18 nt, Human
uuuuuggaaaagaauaaa

SEQ ID NO: 3766185 - RNA, 15 nt, Human
uuuuuggacacauuu

SEQ ID NO: 3766186 - RNA, 18 nt, Human
uuuuuggacuucaaagca

SEQ ID NO: 3766187 - RNA, 24 nt, Human
uuuuuggcauaacauaaaucugug

SEQ ID NO: 3766188 - RNA, 20 nt, Human
uuuuuggcuuuagacacugg

SEQ ID NO: 3766189 - RNA, 22 nt, Human
uuuuugggaaaagaaaagucaa

SEQ ID NO: 3766190 - RNA, 21 nt, Human
uuuuugggcagcaauuuaaau

SEQ ID NO: 3766191 - RNA, 12 nt, Human
uuuuuggggaua

SEQ ID NO: 3766192 - RNA, 16 nt, Human
uuuuuggggauaugcu

SEQ ID NO: 3766193 - RNA, 22 nt, Human
uuuuugggggguuuucuugccu

SEQ ID NO: 3766194 - RNA, 22 nt, Human
uuuuuggucgaggaguaacaau

SEQ ID NO: 3766195 - RNA, 18 nt, Human
uuuuugguugucaauauu

SEQ ID NO: 3766196 - RNA, 10 nt, Human
uuuuuguaaa

SEQ ID NO: 3766197 - RNA, 14 nt, Human
uuuuuguaaagauu

SEQ ID NO: 3766198 - RNA, 22 nt, Human
uuuuuguaauaagcaaucaagg

SEQ ID NO: 3766199 - RNA, 11 nt, Human
uuuuuguacau

SEQ ID NO: 3766200 - RNA, 16 nt, Human
uuuuuguaccugguga

SEQ ID NO: 3766201 - RNA, 19 nt, Human
uuuuuguagcacugacaga

SEQ ID NO: 3766202 - RNA, 16 nt, Human
uuuuuguagccuuccu

SEQ ID NO: 3766203 - RNA, 13 nt, Human
uuuuugucucaau

SEQ ID NO: 3766204 - RNA, 13 nt, Human
uuuuugucuuuuc

SEQ ID NO: 3766205 - RNA, 19 nt, Human
uuuuugugaaaagcuccau

SEQ ID NO: 3766206 - RNA, 21 nt, Human
uuuuugugaagacggcacggu

SEQ ID NO: 3766207 - RNA, 15 nt, Human
uuuuuguguguauuu

SEQ ID NO: 3766208 - RNA, 18 nt, Human
uuuuuguguguauuugcu

SEQ ID NO: 3766209 - RNA, 20 nt, Human
uuuuuguucuuaauugcacu

SEQ ID NO: 3766210 - RNA, 14 nt, Human
uuuuuguuggagug

SEQ ID NO: 3766211 - RNA, 17 nt, Human
uuuuuguuuuacaaugu

SEQ ID NO: 3766212 - RNA, 13 nt, Human
uuuuuuaaaaaag

SEQ ID NO: 3766213 - RNA, 13 nt, Human
uuuuuuaaaaacu

SEQ ID NO: 3766214 - RNA, 16 nt, Human
uuuuuuaaacaaacau

SEQ ID NO: 3766215 - RNA, 12 nt, Human
uuuuuuaagcuu

SEQ ID NO: 3766216 - RNA, 15 nt, Human
uuuuuuaagcuucag

SEQ ID NO: 3766217 - RNA, 23 nt, Human
uuuuuuaagcuucaguugcuugu

SEQ ID NO: 3766218 - RNA, 15 nt, Human
uuuuuuaauaaauuu

SEQ ID NO: 3766219 - RNA, 12 nt, Human
uuuuuuacauuu

SEQ ID NO: 3766220 - RNA, 22 nt, Human
uuuuuuacucauugaaauguca

SEQ ID NO: 3766221 - RNA, 16 nt, Human
uuuuuuagaucaaaua

SEQ ID NO: 3766222 - RNA, 23 nt, Human
uuuuuuaguaaguuaauguauau

SEQ ID NO: 3766223 - RNA, 21 nt, Human
uuuuuuaguauuuauuuaugu

SEQ ID NO: 3766224 - RNA, 13 nt, Human
uuuuuuaguugaa

SEQ ID NO: 3766225 - RNA, 15 nt, Human
uuuuuuauacacaua

SEQ ID NO: 3766226 - RNA, 20 nt, Human
uuuuuuauacaggaugauga

SEQ ID NO: 3766227 - RNA, 13 nt, Human
uuuuuuaugcuaa

SEQ ID NO: 3766228 - RNA, 18 nt, Human
uuuuuucaauauuuauua

SEQ ID NO: 3766229 - RNA, 12 nt, Human
uuuuuucaaugu

SEQ ID NO: 3766230 - RNA, 11 nt, Human
uuuuuucagac

SEQ ID NO: 3766231 - RNA, 12 nt, Human
uuuuuucaucuu

SEQ ID NO: 3766232 - RNA, 13 nt, Human
uuuuuucaucuuc

SEQ ID NO: 3766233 - RNA, 20 nt, Human
uuuuuucauguuuuaacaaa

SEQ ID NO: 3766234 - RNA, 13 nt, Human
uuuuuucauuuau

SEQ ID NO: 3766235 - RNA, 13 nt, Human
uuuuuuccaucuu

SEQ ID NO: 3766236 - RNA, 15 nt, Human
uuuuuucccauaaga

SEQ ID NO: 3766237 - RNA, 12 nt, Human
uuuuuuccccag

SEQ ID NO: 3766238 - RNA, 15 nt, Human
uuuuuuccugucaua

SEQ ID NO: 3766239 - RNA, 20 nt, Human
uuuuuuccuuacauaaacau

SEQ ID NO: 3766240 - RNA, 12 nt, Human
uuuuuucugaau

SEQ ID NO: 3766241 - RNA, 11 nt, Human
uuuuuucugau

SEQ ID NO: 3766242 - RNA, 19 nt, Human
uuuuuugaacucuucucau

SEQ ID NO: 3766243 - RNA, 13 nt, Human
uuuuuugauauau

SEQ ID NO: 3766244 - RNA, 9 nt, Human
uuuuuugca

SEQ ID NO: 3766245 - RNA, 23 nt, Human
uuuuuuggggauaugcuuaguaa

SEQ ID NO: 3766246 - RNA, 13 nt, Human
uuuuuuguaauaa

SEQ ID NO: 3766247 - RNA, 13 nt, Human
uuuuuuguaccaa

SEQ ID NO: 3766248 - RNA, 13 nt, Human
uuuuuuguaugaa

SEQ ID NO: 3766249 - RNA, 12 nt, Human
uuuuuuguuauu

SEQ ID NO: 3766250 - RNA, 13 nt, Human
uuuuuuguuucau

SEQ ID NO: 3766251 - RNA, 13 nt, Human
uuuuuuguuuguu

SEQ ID NO: 3766252 - RNA, 13 nt, Human
uuuuuuucaaugu

SEQ ID NO: 3766253 - RNA, 14 nt, Human
uuuuuuucaaugug

SEQ ID NO: 3766254 - RNA, 14 nt, Human
uuuuuuucuaagag

SEQ ID NO: 3766255 - RNA, 11 nt, Human
uuuuuuugcca

SEQ ID NO: 3766256 - RNA, 10 nt, Human
uuuuuuuggc

SEQ ID NO: 3766257 - RNA, 13 nt, Human
uuuuuuuguuugu

SEQ ID NO: 3766258 - RNA, 11 nt, Human
uuuuuuuugca

SEQ ID NO: 3766259 - RNA, 12 nt, Human
uuuuuuuugcag

SEQ ID NO: 3766260 - RNA, 15 nt, Human
uuaaacgauuuuuaa

SEQ ID NO: 3766261 - RNA, 23 nt, Human
uuaaacgcucuagguacgaugac

SEQ ID NO: 3766262 - RNA, 14 nt, Human
uuaaacggauuauu

SEQ ID NO: 3766263 - RNA, 16 nt, Human
uuaaacggauuauuuu

SEQ ID NO: 3766264 - RNA, 18 nt, Human
uuaaacguaugcauguga

SEQ ID NO: 3766265 - RNA, 14 nt, Human
uuaaacgugcagac

SEQ ID NO: 3766266 - RNA, 23 nt, Human
uuaaacuagaugaccucauuaac

SEQ ID NO: 3766267 - RNA, 19 nt, Human
uuaaacuagcauaucugcc

SEQ ID NO: 3766268 - RNA, 16 nt, Human
uuaaacuaucuugugu

SEQ ID NO: 3766269 - RNA, 14 nt, Human
uuaaacucagggac

SEQ ID NO: 3766270 - RNA, 20 nt, Human
uuaaacucagggacagagcc

SEQ ID NO: 3766271 - RNA, 22 nt, Human
uuaaacucuguugcaagugcaa

SEQ ID NO: 3766272 - RNA, 19 nt, Human
uuaaacucuucacaaaauc

SEQ ID NO: 3766273 - RNA, 13 nt, Human
uuaaacuguacag

SEQ ID NO: 3766274 - RNA, 18 nt, Human
uuaaacuguacagugucu

SEQ ID NO: 3766275 - RNA, 20 nt, Human
uuaaacuguacagugucuuu

SEQ ID NO: 3766276 - RNA, 20 nt, Human
uuaaacugucgugucauacu

SEQ ID NO: 3766277 - RNA, 12 nt, Human
uuaaacugugua

SEQ ID NO: 3766278 - RNA, 19 nt, Human
uuaaacuguguacauaacu

SEQ ID NO: 3766279 - RNA, 20 nt, Human
uuaaacuguguggacuguga

SEQ ID NO: 3766280 - RNA, 20 nt, Human
uuaaacuguuagcacuguug

SEQ ID NO: 3766281 - RNA, 22 nt, Human
uuaaacuuaaucuaaauggaac

SEQ ID NO: 3766282 - RNA, 16 nt, Human
uuaaacuuccaaagaa

SEQ ID NO: 3766283 - RNA, 17 nt, Human
uuaaacuuccaaagaaa

SEQ ID NO: 3766284 - RNA, 20 nt, Human
uuaaacuucucugaagggag

SEQ ID NO: 3766285 - RNA, 15 nt, Human
uuaaacuugucuuuu

SEQ ID NO: 3766286 - RNA, 17 nt, Human
uuaaacuugugaaugcu

SEQ ID NO: 3766287 - RNA, 21 nt, Human
uuaaacuuuagugcuacagaa

SEQ ID NO: 3766288 - RNA, 19 nt, Human
uuaaagaaaaaaauguauu

SEQ ID NO: 3766289 - RNA, 20 nt, Human
uuaaagaaaaaaauguauuu

SEQ ID NO: 3766290 - RNA, 23 nt, Human
uuaaagaaaaaaaugucaaaagu

SEQ ID NO: 3766291 - RNA, 15 nt, Human
uuaaagaaaacccac

SEQ ID NO: 3766292 - RNA, 15 nt, Human
uuaaagaaaagauga

SEQ ID NO: 3766293 - RNA, 16 nt, Human
uuaaagaaaagaugaa

SEQ ID NO: 3766294 - RNA, 18 nt, Human
uuaaagaaaaguuuugua

SEQ ID NO: 3766295 - RNA, 19 nt, Human
uuaaagaaaaguuuuguaa

SEQ ID NO: 3766296 - RNA, 16 nt, Human
uuaaagaaacagcuuu

SEQ ID NO: 3766297 - RNA, 21 nt, Human
uuaaagaaacagcuuucaagu

SEQ ID NO: 3766298 - RNA, 17 nt, Human
uuaaagaaaggaaaaga

SEQ ID NO: 3766299 - RNA, 17 nt, Human
uuaaagaaaguguauuu

SEQ ID NO: 3766300 - RNA, 14 nt, Human
uuaaagaaguauuu

SEQ ID NO: 3766301 - RNA, 15 nt, Human
uuaaagaauucaaau

SEQ ID NO: 3766302 - RNA, 14 nt, Human
uuaaagacuuuuau

SEQ ID NO: 3766303 - RNA, 14 nt, Human
uuaaagagucuaga

SEQ ID NO: 3766304 - RNA, 23 nt, Human
uuaaagagucuagauucaaaggu

SEQ ID NO: 3766305 - RNA, 16 nt, Human
uuaaagcaaaaaauga

SEQ ID NO: 3766306 - RNA, 22 nt, Human
uuaaagcaagcaacacagagga

SEQ ID NO: 3766307 - RNA, 22 nt, Human
uuaaagcacuuacagauaggcc

SEQ ID NO: 3766308 - RNA, 18 nt, Human
uuaaagcagugcuucuca

SEQ ID NO: 3766309 - RNA, 19 nt, Human
uuaaagcauauagagauga

SEQ ID NO: 3766310 - RNA, 22 nt, Human
uuaaagcauugcuguuaugucu

SEQ ID NO: 3766311 - RNA, 16 nt, Human
uuaaagcauugcuuuu

SEQ ID NO: 3766312 - RNA, 22 nt, Human
uuaaagcauugcuuuuauuuug

SEQ ID NO: 3766313 - RNA, 13 nt, Human
uuaaagccuccuc

SEQ ID NO: 3766314 - RNA, 20 nt, Human
uuaaagcuuccauuguuguc

SEQ ID NO: 3766315 - RNA, 17 nt, Human
uuaaagcuuuugaugug

SEQ ID NO: 3766316 - RNA, 22 nt, Human
uuaaaggaagguucugguguga

SEQ ID NO: 3766317 - RNA, 12 nt, Human
uuaaaggaguua

SEQ ID NO: 3766318 - RNA, 17 nt, Human
uuaaaggauguuggugu

SEQ ID NO: 3766319 - RNA, 21 nt, Human
uuaaaggcaguauuuuguguc

SEQ ID NO: 3766320 - RNA, 16 nt, Human
uuaaaggcuucucucu

SEQ ID NO: 3766321 - RNA, 15 nt, Human
uuaaaggugucuucc

SEQ ID NO: 3766322 - RNA, 16 nt, Human
uuaaaguaauuguucc

SEQ ID NO: 3766323 - RNA, 22 nt, Human
uuaaaguaauuguuccagagac

SEQ ID NO: 3766324 - RNA, 13 nt, Human
uuaaaguauauau

SEQ ID NO: 3766325 - RNA, 23 nt, Human
uuaaaguaugcauuauuaaauug

SEQ ID NO: 3766326 - RNA, 18 nt, Human
uuaaagucagguccaauu

SEQ ID NO: 3766327 - RNA, 20 nt, Human
uuaaagugacuaauggcaug

SEQ ID NO: 3766328 - RNA, 17 nt, Human
uuaaaguggcaaucuca

SEQ ID NO: 3766329 - RNA, 17 nt, Human
uuaaaguguuucagcua

SEQ ID NO: 3766330 - RNA, 23 nt, Human
uuaaaguuaguaucuuuugauau

SEQ ID NO: 3766331 - RNA, 14 nt, Human
uuaaaguucaaacu

SEQ ID NO: 3766332 - RNA, 15 nt, Human
uuaaaguucaaacuc

SEQ ID NO: 3766333 - RNA, 13 nt, Human
uuaaaguucugug

SEQ ID NO: 3766334 - RNA, 22 nt, Human
uuaaaguugaauuuauuggcuu

SEQ ID NO: 3766335 - RNA, 19 nt, Human
uuaaaguuggaauuuacca

SEQ ID NO: 3766336 - RNA, 15 nt, Human
uuaaaguuguuugug

SEQ ID NO: 3766337 - RNA, 13 nt, Human
uuaaaguuucaaa

SEQ ID NO: 3766338 - RNA, 16 nt, Human
uuaaaguuucaaaaau

SEQ ID NO: 3766339 - RNA, 13 nt, Human
uuaaauaaaagaa

SEQ ID NO: 3766340 - RNA, 21 nt, Human
uuaaauaaaagaaaugcacaa

SEQ ID NO: 3766341 - RNA, 13 nt, Human
uuaaauaaacuuu

SEQ ID NO: 3766342 - RNA, 15 nt, Human
uuaaauaaacuuuuu

SEQ ID NO: 3766343 - RNA, 22 nt, Human
uuaaauaaacuuuuuuucaaug

SEQ ID NO: 3766344 - RNA, 21 nt, Human
uuaaauaaaguaucaugcauu

SEQ ID NO: 3766345 - RNA, 12 nt, Human
uuaaauaaaugu

SEQ ID NO: 3766346 - RNA, 17 nt, Human
uuaaauaaauuguauau

SEQ ID NO: 3766347 - RNA, 16 nt, Human
uuaaauaagauucuaa

SEQ ID NO: 3766348 - RNA, 18 nt, Human
uuaaauaagauucuaacg

SEQ ID NO: 3766349 - RNA, 24 nt, Human
uuaaauaauauggcuaugcuuaaa

SEQ ID NO: 3766350 - RNA, 15 nt, Human
uuaaauaauuuaacu

SEQ ID NO: 3766351 - RNA, 15 nt, Human
uuaaauaauuuccua

SEQ ID NO: 3766352 - RNA, 16 nt, Human
uuaaauacaaaacuuc

SEQ ID NO: 3766353 - RNA, 10 nt, Human
uuaaauacag

SEQ ID NO: 3766354 - RNA, 19 nt, Human
uuaaauacagacacuaagu

SEQ ID NO: 3766355 - RNA, 17 nt, Human
uuaaauacaggaaacag

SEQ ID NO: 3766356 - RNA, 20 nt, Human
uuaaauacaggaaacaguug

SEQ ID NO: 3766357 - RNA, 16 nt, Human
uuaaauacauauggau

SEQ ID NO: 3766358 - RNA, 23 nt, Human
uuaaauacauauggauguuacuc

SEQ ID NO: 3766359 - RNA, 13 nt, Human
uuaaauagauaca

SEQ ID NO: 3766360 - RNA, 17 nt, Human
uuaaauagauacaaaug

SEQ ID NO: 3766361 - RNA, 16 nt, Human
uuaaauagaugacauu

SEQ ID NO: 3766362 - RNA, 19 nt, Human
uuaaauagcuuuuuucucu

SEQ ID NO: 3766363 - RNA, 18 nt, Human
uuaaauaguuauauaauu

SEQ ID NO: 3766364 - RNA, 18 nt, Human
uuaaauauaauucuguaa

SEQ ID NO: 3766365 - RNA, 20 nt, Human
uuaaauauauguauguaaaa

SEQ ID NO: 3766366 - RNA, 23 nt, Human
uuaaauauauuuucaaaguacau

SEQ ID NO: 3766367 - RNA, 22 nt, Human
uuaaauaucaguagaaacucua

SEQ ID NO: 3766368 - RNA, 22 nt, Human
uuaaauaucugaacauuuacua

SEQ ID NO: 3766369 - RNA, 14 nt, Human
uuaaauaucuuuua

SEQ ID NO: 3766370 - RNA, 18 nt, Human
uuaaauaucuuuuauguu

SEQ ID NO: 3766371 - RNA, 20 nt, Human
uuaaauaucuuuuauguuug

SEQ ID NO: 3766372 - RNA, 14 nt, Human
uuaaauauuuacau

SEQ ID NO: 3766373 - RNA, 18 nt, Human
uuaaauauuucaagacau

SEQ ID NO: 3766374 - RNA, 22 nt, Human
uuaaaucauacuccuaugcuuu

SEQ ID NO: 3766375 - RNA, 14 nt, Human
uuaaauccuguuga

SEQ ID NO: 3766376 - RNA, 20 nt, Human
uuaaaucuaaaucuauuuau

SEQ ID NO: 3766377 - RNA, 16 nt, Human
uuaaaucuaugaagua

SEQ ID NO: 3766378 - RNA, 16 nt, Human
uuaaaucucauugcuu

SEQ ID NO: 3766379 - RNA, 15 nt, Human
uuaaaucugugauga

SEQ ID NO: 3766380 - RNA, 22 nt, Human
uuaaaugaacaagagaagcauu

SEQ ID NO: 3766381 - RNA, 21 nt, Human
uuaaaugaauauuuugauaau

SEQ ID NO: 3766382 - RNA, 21 nt, Human
uuaaaugacacucauauaauu

SEQ ID NO: 3766383 - RNA, 16 nt, Human
uuaaaugaggauuauu

SEQ ID NO: 3766384 - RNA, 16 nt, Human
uuaaaugauuuaaauu

SEQ ID NO: 3766385 - RNA, 20 nt, Human
uuaaaugcaaccauuugaaa

SEQ ID NO: 3766386 - RNA, 18 nt, Human
uuaaauguaaagacaaaa

SEQ ID NO: 3766387 - RNA, 16 nt, Human
uuaaauguacagacau

SEQ ID NO: 3766388 - RNA, 19 nt, Human
uuaaauguagcuucaguca

SEQ ID NO: 3766389 - RNA, 21 nt, Human
uuaaauguagcuucagucauu

SEQ ID NO: 3766390 - RNA, 19 nt, Human
uuaaaugucaaaugugaau

SEQ ID NO: 3766391 - RNA, 17 nt, Human
uuaaaugucuaauguau

SEQ ID NO: 3766392 - RNA, 18 nt, Human
uuaaaugugaauuacuaa

SEQ ID NO: 3766393 - RNA, 18 nt, Human
uuaaauguguacaaugua

SEQ ID NO: 3766394 - RNA, 21 nt, Human
uuaaaugugugagugcaugua

SEQ ID NO: 3766395 - RNA, 20 nt, Human
uuaaauguuaugacuaugua

SEQ ID NO: 3766396 - RNA, 11 nt, Human
uuaaauguuuu

SEQ ID NO: 3766397 - RNA, 17 nt, Human
uuaaauguuuuauaagu

SEQ ID NO: 3766398 - RNA, 12 nt, Human
uuaaauguuuug

SEQ ID NO: 3766399 - RNA, 15 nt, Human
uuaaauguuuuguaa

SEQ ID NO: 3766400 - RNA, 21 nt, Human
uuaaauguuuuuuuuuaaaga

SEQ ID NO: 3766401 - RNA, 11 nt, Human
uuaaauuaaua

SEQ ID NO: 3766402 - RNA, 12 nt, Human
uuaaauuacaau

SEQ ID NO: 3766403 - RNA, 16 nt, Human
uuaaauuacauuugua

SEQ ID NO: 3766404 - RNA, 21 nt, Human
uuaagagguugauuauaaagu

SEQ ID NO: 3766405 - RNA, 12 nt, Human
uuaagaguaaaa

SEQ ID NO: 3766406 - RNA, 12 nt, Human
uuaagagugaaa

SEQ ID NO: 3766407 - RNA, 14 nt, Human
uuaagauacaaauu

SEQ ID NO: 3766408 - RNA, 14 nt, Human
uuaagauggauucu

SEQ ID NO: 3766409 - RNA, 18 nt, Human
uuaagauggauucucaga

SEQ ID NO: 3766410 - RNA, 21 nt, Human
uuaagauggauucucagauau

SEQ ID NO: 3766411 - RNA, 22 nt, Human
uuaagauggauucucagauauu

SEQ ID NO: 3766412 - RNA, 13 nt, Human
uuaagauggcaau

SEQ ID NO: 3766413 - RNA, 21 nt, Human
uuaagauggcaauuacuuugg

SEQ ID NO: 3766414 - RNA, 13 nt, Human
uuaagaugugaaa

SEQ ID NO: 3766415 - RNA, 15 nt, Human
uuaagauuuuucuca

SEQ ID NO: 3766416 - RNA, 16 nt, Human
uuaagcaaaggggaca

SEQ ID NO: 3766417 - RNA, 14 nt, Human
uuaagcaaauacuu

SEQ ID NO: 3766418 - RNA, 19 nt, Human
uuaagcaaauguuaaaagu

SEQ ID NO: 3766419 - RNA, 19 nt, Human
uuaagcaacaucuuuuuaa

SEQ ID NO: 3766420 - RNA, 15 nt, Human
uuaagcaaguuaagu

SEQ ID NO: 3766421 - RNA, 16 nt, Human
uuaagcagaagcauua

SEQ ID NO: 3766422 - RNA, 21 nt, Human
uuaagcagauggaaugcugug

SEQ ID NO: 3766423 - RNA, 13 nt, Human
uuaagcagcucuu

SEQ ID NO: 3766424 - RNA, 15 nt, Human
uuaagcauauauuuu

SEQ ID NO: 3766425 - RNA, 23 nt, Human
uuaagcauauauuuuuauauuua

SEQ ID NO: 3766426 - RNA, 18 nt, Human
uuaagcaucacaaaugau

SEQ ID NO: 3766427 - RNA, 22 nt, Human
uuaagcaucuggcucuaauuca

SEQ ID NO: 3766428 - RNA, 23 nt, Human
uuaagcauuacucuuguaagauu

SEQ ID NO: 3766429 - RNA, 19 nt, Human
uuaagcauuguuugcuuau

SEQ ID NO: 3766430 - RNA, 20 nt, Human
uuaagccacugccucucccu

SEQ ID NO: 3766431 - RNA, 18 nt, Human
uuaagccaucuugguaaa

SEQ ID NO: 3766432 - RNA, 13 nt, Human
uuaagcccugagg

SEQ ID NO: 3766433 - RNA, 20 nt, Human
uuaagccuaaagauuuugau

SEQ ID NO: 3766434 - RNA, 17 nt, Human
uuaagccuuuguugaac

SEQ ID NO: 3766435 - RNA, 16 nt, Human
uuaagcucugagcugu

SEQ ID NO: 3766436 - RNA, 17 nt, Human
uuaagcucugagcuguc

SEQ ID NO: 3766437 - RNA, 18 nt, Human
uuaagcucugagcuguca

SEQ ID NO: 3766438 - RNA, 11 nt, Human
uuaagcugcag

SEQ ID NO: 3766439 - RNA, 16 nt, Human
uuaagcuuuuuggaau

SEQ ID NO: 3766440 - RNA, 23 nt, Human
uuaaggaaaacuaccuguauuua

SEQ ID NO: 3766441 - RNA, 12 nt, Human
uuaaggaaacaa

SEQ ID NO: 3766442 - RNA, 14 nt, Human
uuaaggaaacaaua

SEQ ID NO: 3766443 - RNA, 16 nt, Human
uuaaggaaacucuuau

SEQ ID NO: 3766444 - RNA, 20 nt, Human
uuaaggaaacucuuaucuca

SEQ ID NO: 3766445 - RNA, 23 nt, Human
uuaaggaaauuuguaccauuuca

SEQ ID NO: 3766446 - RNA, 17 nt, Human
uuaaggaagaaaaauca

SEQ ID NO: 3766447 - RNA, 18 nt, Human
uuaaggaagaaaaaucag

SEQ ID NO: 3766448 - RNA, 15 nt, Human
uuaaggacugacuga

SEQ ID NO: 3766449 - RNA, 18 nt, Human
uuaaggagaaucauguuu

SEQ ID NO: 3766450 - RNA, 21 nt, Human
uuaaggagaaucauguuucuu

SEQ ID NO: 3766451 - RNA, 14 nt, Human
uuaaggauaaauca

SEQ ID NO: 3766452 - RNA, 20 nt, Human
uuaaggaugcuuguacauaa

SEQ ID NO: 3766453 - RNA, 16 nt, Human
uuaagggaaaaauaua

SEQ ID NO: 3766454 - RNA, 15 nt, Human
uuaagggaaagaaaa

SEQ ID NO: 3766455 - RNA, 22 nt, Human
uuaagggaguguacucccaggg

SEQ ID NO: 3766456 - RNA, 20 nt, Human
uuaaggggaagaaugaaagc

SEQ ID NO: 3766457 - RNA, 16 nt, Human
uuaaggucucucuuug

SEQ ID NO: 3766458 - RNA, 13 nt, Human
uuaaggucuguuu

SEQ ID NO: 3766459 - RNA, 20 nt, Human
uuaaggugaggccugucugu

SEQ ID NO: 3766460 - RNA, 18 nt, Human
uuaaggugauauauuuaa

SEQ ID NO: 3766461 - RNA, 9 nt, Human
uuaaggugg

SEQ ID NO: 3766462 - RNA, 15 nt, Human
uuaagguuauuuauu

SEQ ID NO: 3766463 - RNA, 13 nt, Human
uuaaguaaacuaa

SEQ ID NO: 3766464 - RNA, 17 nt, Human
uuaaguacuauguauca

SEQ ID NO: 3766465 - RNA, 12 nt, Human
uuaaguagauuu

SEQ ID NO: 3766466 - RNA, 14 nt, Human
uuaaguaucagaaa

SEQ ID NO: 3766467 - RNA, 15 nt, Human
uuaaguauugcaucu

SEQ ID NO: 3766468 - RNA, 19 nt, Human
uuaaguauugcaucuguau

SEQ ID NO: 3766469 - RNA, 16 nt, Human
uuaaguauuuauauau

SEQ ID NO: 3766470 - RNA, 13 nt, Human
uuaagucagaaca

SEQ ID NO: 3766471 - RNA, 19 nt, Human
uuaagucccugucaccucu

SEQ ID NO: 3766472 - RNA, 20 nt, Human
uuaagucccugucaccucuu

SEQ ID NO: 3766473 - RNA, 14 nt, Human
uuaagucuguuuua

SEQ ID NO: 3766474 - RNA, 17 nt, Human
uuaagucuguuuuauga

SEQ ID NO: 3766475 - RNA, 18 nt, Human
uuaagucuguuuuaugac

SEQ ID NO: 3766476 - RNA, 12 nt, Human
uuaagugaaauu

SEQ ID NO: 3766477 - RNA, 13 nt, Human
uuaagugaaauuu

SEQ ID NO: 3766478 - RNA, 22 nt, Human
uuaaguuauagugaauacugcu

SEQ ID NO: 3766479 - RNA, 22 nt, Human
uuaaguucuggaugcauuucuc

SEQ ID NO: 3766480 - RNA, 21 nt, Human
uuaaguugagauaguuuucau

SEQ ID NO: 3766481 - RNA, 17 nt, Human
uuaaguuggcuucuguu

SEQ ID NO: 3766482 - RNA, 18 nt, Human
uuaaguuggcuucuguuu

SEQ ID NO: 3766483 - RNA, 23 nt, Human
uuaaguuggcuucuguuucuagu

SEQ ID NO: 3766484 - RNA, 16 nt, Human
uuaaguuguuugcaug

SEQ ID NO: 3766485 - RNA, 16 nt, Human
uuaaguuucaaacuua

SEQ ID NO: 3766486 - RNA, 21 nt, Human
uuaaguuuccuuccagcccag

SEQ ID NO: 3766487 - RNA, 13 nt, Human
uuaaguuugcacu

SEQ ID NO: 3766488 - RNA, 20 nt, Human
uuaaguuuugacaagcuggc

SEQ ID NO: 3766489 - RNA, 11 nt, Human
uuaauaaaaag

SEQ ID NO: 3766490 - RNA, 17 nt, Human
uuaauaaaaaugacaga

SEQ ID NO: 3766491 - RNA, 19 nt, Human
uuaauaaaaaugacagacu

SEQ ID NO: 3766492 - RNA, 18 nt, Human
uuaauaaaacacuauuuu

SEQ ID NO: 3766493 - RNA, 20 nt, Human
uuaauaaaacacuauuuuuu

SEQ ID NO: 3766494 - RNA, 20 nt, Human
uuaauaaaagaaaauuacaa

SEQ ID NO: 3766495 - RNA, 17 nt, Human
uuaauaaacacucuuga

SEQ ID NO: 3766496 - RNA, 13 nt, Human
uuaauaaagacag

SEQ ID NO: 3766497 - RNA, 14 nt, Human
uuaauaaagacagg

SEQ ID NO: 3766498 - RNA, 20 nt, Human
uuaauaaagcgaaaaacuca

SEQ ID NO: 3766499 - RNA, 15 nt, Human
uuaauaaauagagca

SEQ ID NO: 3766500 - RNA, 19 nt, Human
uuaauaaauccuacaguau

SEQ ID NO: 3766501 - RNA, 12 nt, Human
uuaauaacaauu

SEQ ID NO: 3766502 - RNA, 18 nt, Human
uuaauaacauaacaaaua

SEQ ID NO: 3766503 - RNA, 19 nt, Human
uuaauaacauaacaaauaa

SEQ ID NO: 3766504 - RNA, 14 nt, Human
uuaauaauaaauuc

SEQ ID NO: 3766505 - RNA, 16 nt, Human
uuaauaauaaucuagg

SEQ ID NO: 3766506 - RNA, 16 nt, Human
uuaauaauauacuugu

SEQ ID NO: 3766507 - RNA, 21 nt, Human
uuaauaauauacuuguggacu

SEQ ID NO: 3766508 - RNA, 20 nt, Human
uuaauaaucaagagccuuaa

SEQ ID NO: 3766509 - RNA, 24 nt, Human
uuaauaaucagcaagaauuugauc

SEQ ID NO: 3766510 - RNA, 16 nt, Human
uuaauaauguuucaaa

SEQ ID NO: 3766511 - RNA, 20 nt, Human
uuaauaauuauaugcuauuu

SEQ ID NO: 3766512 - RNA, 23 nt, Human
uuaauaauuauaugcuauuucua

SEQ ID NO: 3766513 - RNA, 13 nt, Human
uuaauacaaggua

SEQ ID NO: 3766514 - RNA, 22 nt, Human
uuaauacaguuuauuuuuaaag

SEQ ID NO: 3766515 - RNA, 21 nt, Human
uuaauacgcaggcaucugauu

SEQ ID NO: 3766516 - RNA, 15 nt, Human
uuaauacuaccuuga

SEQ ID NO: 3766517 - RNA, 21 nt, Human
uuaauacucaaaugaguaaca

SEQ ID NO: 3766518 - RNA, 20 nt, Human
uuaauacuguuauucuuugc

SEQ ID NO: 3766519 - RNA, 21 nt, Human
uuaauacuguuauucuuugca

SEQ ID NO: 3766520 - RNA, 18 nt, Human
uuaauagcaaagaauuga

SEQ ID NO: 3766521 - RNA, 20 nt, Human
uuaauagcaaagaauugacu

SEQ ID NO: 3766522 - RNA, 21 nt, Human
uuaauagguuuggacaaaaug

SEQ ID NO: 3766523 - RNA, 15 nt, Human
uuaauaguaauuugu

SEQ ID NO: 3766524 - RNA, 17 nt, Human
uuaauaguaauuuguaa

SEQ ID NO: 3766525 - RNA, 18 nt, Human
uuaauaguaauuuguaaa

SEQ ID NO: 3766526 - RNA, 14 nt, Human
uuaauaguguuaau

SEQ ID NO: 3766527 - RNA, 15 nt, Human
uuaauaguguuaauc

SEQ ID NO: 3766528 - RNA, 16 nt, Human
uuaauaguuugucuau

SEQ ID NO: 3766529 - RNA, 23 nt, Human
uuaauauaaaguaguccugugaa

SEQ ID NO: 3766530 - RNA, 23 nt, Human
uuaauauaaaguuuuauauauua

SEQ ID NO: 3766531 - RNA, 19 nt, Human
uuaauauauguauuauuua

SEQ ID NO: 3766532 - RNA, 13 nt, Human
uuaauauauuaaa

SEQ ID NO: 3766533 - RNA, 18 nt, Human
uuaauaucacucauuaau

SEQ ID NO: 3766534 - RNA, 20 nt, Human
uuaauaucacucauuaauua

SEQ ID NO: 3766535 - RNA, 19 nt, Human
uuaauauccuaaacaucau

SEQ ID NO: 3766536 - RNA, 14 nt, Human
uuaauaugaaaacu

SEQ ID NO: 3766537 - RNA, 19 nt, Human
uuaauaugcugcaacaaaa

SEQ ID NO: 3766538 - RNA, 20 nt, Human
uuaauaugcuuaaaauaagc

SEQ ID NO: 3766539 - RNA, 17 nt, Human
uuaauauggauuuguua

SEQ ID NO: 3766540 - RNA, 19 nt, Human
uuaauauguauuuuaugua

SEQ ID NO: 3766541 - RNA, 13 nt, Human
uuaauauuaaagc

SEQ ID NO: 3766542 - RNA, 14 nt, Human
uuaauauuaaagcc

SEQ ID NO: 3766543 - RNA, 20 nt, Human
uuaauauuaaagccauguuu

SEQ ID NO: 3766544 - RNA, 20 nt, Human
uuaauauucuuucaauaacg

SEQ ID NO: 3766545 - RNA, 22 nt, Human
uuaauauugauaugcuuauaca

SEQ ID NO: 3766546 - RNA, 15 nt, Human
uuaauauuuaaacag

SEQ ID NO: 3766547 - RNA, 16 nt, Human
uuaauauuuaaacagc

SEQ ID NO: 3766548 - RNA, 22 nt, Human
uuaauauuuauaggucacuuug

SEQ ID NO: 3766549 - RNA, 21 nt, Human
uuacauugcuggucuuguaag

SEQ ID NO: 3766550 - RNA, 13 nt, Human
uuacauuguaaau

SEQ ID NO: 3766551 - RNA, 15 nt, Human
uuacauugucauuua

SEQ ID NO: 3766552 - RNA, 17 nt, Human
uuacauuuacaaacuga

SEQ ID NO: 3766553 - RNA, 16 nt, Human
uuacauuuccaaauga

SEQ ID NO: 3766554 - RNA, 20 nt, Human
uuacauuuguauaaaauaau

SEQ ID NO: 3766555 - RNA, 15 nt, Human
uuacauuuuacacac

SEQ ID NO: 3766556 - RNA, 20 nt, Human
uuacauuuuuaagugcugca

SEQ ID NO: 3766557 - RNA, 21 nt, Human
uuacauuuuuaagugcugcau

SEQ ID NO: 3766558 - RNA, 18 nt, Human
uuacauuuuuacaauaaa

SEQ ID NO: 3766559 - RNA, 21 nt, Human
uuacauuuuuacaauaaauaa

SEQ ID NO: 3766560 - RNA, 21 nt, Human
uuacauuuuuauuuaugaagu

SEQ ID NO: 3766561 - RNA, 21 nt, Human
uuacauuuuuugggcagcaau

SEQ ID NO: 3766562 - RNA, 16 nt, Human
uuaccaaacagcaaac

SEQ ID NO: 3766563 - RNA, 19 nt, Human
uuaccaaacagcaaaccaa

SEQ ID NO: 3766564 - RNA, 12 nt, Human
uuaccaaccugu

SEQ ID NO: 3766565 - RNA, 15 nt, Human
uuaccaacuuucugu

SEQ ID NO: 3766566 - RNA, 16 nt, Human
uuaccaacuuucugua

SEQ ID NO: 3766567 - RNA, 14 nt, Human
uuaccaagaagccu

SEQ ID NO: 3766568 - RNA, 19 nt, Human
uuaccaauaggcaaauuaa

SEQ ID NO: 3766569 - RNA, 14 nt, Human
uuaccaaucauauu

SEQ ID NO: 3766570 - RNA, 14 nt, Human
uuaccacagacaua

SEQ ID NO: 3766571 - RNA, 17 nt, Human
uuaccacagacauacua

SEQ ID NO: 3766572 - RNA, 21 nt, Human
uuaccacuuguguuuugcaag

SEQ ID NO: 3766573 - RNA, 21 nt, Human
uuaccagauuuuuacacaugu

SEQ ID NO: 3766574 - RNA, 12 nt, Human
uuaccagcaaga

SEQ ID NO: 3766575 - RNA, 22 nt, Human
uuaccagccuccguauuucaga

SEQ ID NO: 3766576 - RNA, 23 nt, Human
uuaccaggcaccaaaagaaguaa

SEQ ID NO: 3766577 - RNA, 23 nt, Human
uuaccaguggcguuguugcaugu

SEQ ID NO: 3766578 - RNA, 24 nt, Human
uuaccaguggcguuguugcauguu

SEQ ID NO: 3766579 - RNA, 18 nt, Human
uuaccaguuaauuacuca

SEQ ID NO: 3766580 - RNA, 15 nt, Human
uuaccauaugugcuu

SEQ ID NO: 3766581 - RNA, 11 nt, Human
uuaccaugaga

SEQ ID NO: 3766582 - RNA, 16 nt, Human
uuaccaugugccugau

SEQ ID NO: 3766583 - RNA, 22 nt, Human
uuaccauuaaaccaucucccug

SEQ ID NO: 3766584 - RNA, 23 nt, Human
uuaccauuaaaccaucucccugg

SEQ ID NO: 3766585 - RNA, 15 nt, Human
uuaccauucacaaua

SEQ ID NO: 3766586 - RNA, 13 nt, Human
uuaccauuggaaa

SEQ ID NO: 3766587 - RNA, 15 nt, Human
uuaccauuggaaauu

SEQ ID NO: 3766588 - RNA, 14 nt, Human
uuaccauuuguaau

SEQ ID NO: 3766589 - RNA, 23 nt, Human
uuaccauuuugggguacccacug

SEQ ID NO: 3766590 - RNA, 14 nt, Human
uuacccaauuuccc

SEQ ID NO: 3766591 - RNA, 22 nt, Human
uuacccaccuagaacacuaacu

SEQ ID NO: 3766592 - RNA, 13 nt, Human
uuacccauauccc

SEQ ID NO: 3766593 - RNA, 17 nt, Human
uuacccccauucgcgcu

SEQ ID NO: 3766594 - RNA, 14 nt, Human
uuaccccucuacca

SEQ ID NO: 3766595 - RNA, 17 nt, Human
uuaccccuggcuguuug

SEQ ID NO: 3766596 - RNA, 12 nt, Human
uuacccuaaugu

SEQ ID NO: 3766597 - RNA, 18 nt, Human
uuacccuaaugucuucau

SEQ ID NO: 3766598 - RNA, 17 nt, Human
uuacccucuuugcugca

SEQ ID NO: 3766599 - RNA, 13 nt, Human
uuacccuucccug

SEQ ID NO: 3766600 - RNA, 21 nt, Human
uuacccuucugugcccagcuc

SEQ ID NO: 3766601 - RNA, 20 nt, Human
uuacccuugagcccucccca

SEQ ID NO: 3766602 - RNA, 20 nt, Human
uuaccgacaagcacagucag

SEQ ID NO: 3766603 - RNA, 21 nt, Human
uuaccgcguaaugcgccaaua

SEQ ID NO: 3766604 - RNA, 21 nt, Human
uuaccgcguuguaaaauauag

SEQ ID NO: 3766605 - RNA, 20 nt, Human
uuaccuaaacagauauaaau

SEQ ID NO: 3766606 - RNA, 15 nt, Human
uuaccuaaaguauuu

SEQ ID NO: 3766607 - RNA, 18 nt, Human
uuaccuaagugacauuug

SEQ ID NO: 3766608 - RNA, 13 nt, Human
uuaccuaauuaga

SEQ ID NO: 3766609 - RNA, 16 nt, Human
uuaccuaccacagugu

SEQ ID NO: 3766610 - RNA, 21 nt, Human
uuaccuaccacagugucugua

SEQ ID NO: 3766611 - RNA, 13 nt, Human
uuaccuacuuuga

SEQ ID NO: 3766612 - RNA, 14 nt, Human
uuaccucagccugg

SEQ ID NO: 3766613 - RNA, 15 nt, Human
uuaccucagccuggg

SEQ ID NO: 3766614 - RNA, 15 nt, Human
uuaccuccaacagaa

SEQ ID NO: 3766615 - RNA, 19 nt, Human
uuaccuccugcccaggaga

SEQ ID NO: 3766616 - RNA, 15 nt, Human
uuaccucucugucau

SEQ ID NO: 3766617 - RNA, 20 nt, Human
uuaccucuuaacaauuucug

SEQ ID NO: 3766618 - RNA, 15 nt, Human
uuaccucuuuggaaa

SEQ ID NO: 3766619 - RNA, 20 nt, Human
uuaccugaaaacacugugca

SEQ ID NO: 3766620 - RNA, 12 nt, Human
uuaccugacaca

SEQ ID NO: 3766621 - RNA, 16 nt, Human
uuaccugaccucuugc

SEQ ID NO: 3766622 - RNA, 20 nt, Human
uuaccugaucaaugacagag

SEQ ID NO: 3766623 - RNA, 12 nt, Human
uuaccugggaaa

SEQ ID NO: 3766624 - RNA, 19 nt, Human
uuaccuguauacagugcag

SEQ ID NO: 3766625 - RNA, 17 nt, Human
uuaccugucacauugca

SEQ ID NO: 3766626 - RNA, 15 nt, Human
uuaccuucaauaaag

SEQ ID NO: 3766627 - RNA, 18 nt, Human
uuaccuugacuguugaug

SEQ ID NO: 3766628 - RNA, 19 nt, Human
uuaccuugacuguugaugu

SEQ ID NO: 3766629 - RNA, 14 nt, Human
uuaccuuucucucu

SEQ ID NO: 3766630 - RNA, 20 nt, Human
uuaccuuuuuauuugcaugu

SEQ ID NO: 3766631 - RNA, 23 nt, Human
uuaccuuuuugaaaaagaaaaca

SEQ ID NO: 3766632 - RNA, 17 nt, Human
uuaccuuuuuugauaaa

SEQ ID NO: 3766633 - RNA, 23 nt, Human
uuaccuuuuuugauaaaguuucu

SEQ ID NO: 3766634 - RNA, 19 nt, Human
uuacgaaguucaagaucaa

SEQ ID NO: 3766635 - RNA, 15 nt, Human
uuacgaucaggcaca

SEQ ID NO: 3766636 - RNA, 18 nt, Human
uuacgcccaacccuuccc

SEQ ID NO: 3766637 - RNA, 15 nt, Human
uuacgcuuugauuca

SEQ ID NO: 3766638 - RNA, 16 nt, Human
uuacggacacccccuc

SEQ ID NO: 3766639 - RNA, 14 nt, Human
uuacggcuccucuc

SEQ ID NO: 3766640 - RNA, 19 nt, Human
uuacguaugucugguucuc

SEQ ID NO: 3766641 - RNA, 15 nt, Human
uuacgugagccaggu

SEQ ID NO: 3766642 - RNA, 15 nt, Human
uuacgugcucugugg

SEQ ID NO: 3766643 - RNA, 15 nt, Human
uuacuaaaaaguaua

SEQ ID NO: 3766644 - RNA, 19 nt, Human
uuacuaaaaguuuugagaa

SEQ ID NO: 3766645 - RNA, 23 nt, Human
uuacuaaagaaaauaucugaaau

SEQ ID NO: 3766646 - RNA, 15 nt, Human
uuacuaacuucuaaa

SEQ ID NO: 3766647 - RNA, 19 nt, Human
uuacuaacuucuaaaacug

SEQ ID NO: 3766648 - RNA, 20 nt, Human
uuacuaacuucuaaaacugu

SEQ ID NO: 3766649 - RNA, 22 nt, Human
uuacuaagaagaaaauugcugu

SEQ ID NO: 3766650 - RNA, 21 nt, Human
uuacuaagccacaagaaauuu

SEQ ID NO: 3766651 - RNA, 14 nt, Human
uuacuaagcuuugc

SEQ ID NO: 3766652 - RNA, 17 nt, Human
uuacuacaauauguaca

SEQ ID NO: 3766653 - RNA, 14 nt, Human
uuacuacaguuuuu

SEQ ID NO: 3766654 - RNA, 13 nt, Human
uuacuacaugcac

SEQ ID NO: 3766655 - RNA, 17 nt, Human
uuacuaccuccucuccu

SEQ ID NO: 3766656 - RNA, 13 nt, Human
uuacuaccuuauc

SEQ ID NO: 3766657 - RNA, 20 nt, Human
uuacuagaacacagaaagcc

SEQ ID NO: 3766658 - RNA, 15 nt, Human
uuacuagcuuuucaa

SEQ ID NO: 3766659 - RNA, 16 nt, Human
uuacuagguaacuuca

SEQ ID NO: 3766660 - RNA, 17 nt, Human
uuacuaguuucccuugc

SEQ ID NO: 3766661 - RNA, 20 nt, Human
uuacuauaagaacuuugagc

SEQ ID NO: 3766662 - RNA, 22 nt, Human
uuacuauauauauaugccuuuu

SEQ ID NO: 3766663 - RNA, 19 nt, Human
uuacuaucaugucaaacgu

SEQ ID NO: 3766664 - RNA, 19 nt, Human
uuacuauggcccuggccua

SEQ ID NO: 3766665 - RNA, 19 nt, Human
uuacuauucauuaaauguu

SEQ ID NO: 3766666 - RNA, 12 nt, Human
uuacuauuucuu

SEQ ID NO: 3766667 - RNA, 21 nt, Human
uuacuauuuugacaguuauuu

SEQ ID NO: 3766668 - RNA, 12 nt, Human
uuacucacugcu

SEQ ID NO: 3766669 - RNA, 18 nt, Human
uuacucagaauucucuag

SEQ ID NO: 3766670 - RNA, 22 nt, Human
uuacucagcccugggccccacc

SEQ ID NO: 3766671 - RNA, 21 nt, Human
uuacucagggcuccucccagc

SEQ ID NO: 3766672 - RNA, 18 nt, Human
uuacucauagcacuuccc

SEQ ID NO: 3766673 - RNA, 17 nt, Human
uuacucauuaucgccuu

SEQ ID NO: 3766674 - RNA, 14 nt, Human
uuacucauugaaau

SEQ ID NO: 3766675 - RNA, 15 nt, Human
uuacucauugaaaug

SEQ ID NO: 3766676 - RNA, 17 nt, Human
uuacucauugaaauguc

SEQ ID NO: 3766677 - RNA, 22 nt, Human
uuacuccagguuauugcaauaa

SEQ ID NO: 3766678 - RNA, 20 nt, Human
uuacucccaagacuucauug

SEQ ID NO: 3766679 - RNA, 22 nt, Human
uuacuccuauuuuuguaaacug

SEQ ID NO: 3766680 - RNA, 19 nt, Human
uuacucuaagaucuuagau

SEQ ID NO: 3766681 - RNA, 12 nt, Human
uuacucuuggga

SEQ ID NO: 3766682 - RNA, 14 nt, Human
uuacucuugggaca

SEQ ID NO: 3766683 - RNA, 18 nt, Human
uuacucuuguaagauuuu

SEQ ID NO: 3766684 - RNA, 21 nt, Human
uuacucuuguaagauuuugaa

SEQ ID NO: 3766685 - RNA, 22 nt, Human
uuacucuuguaagauuuugaaa

SEQ ID NO: 3766686 - RNA, 23 nt, Human
uuacugaacaaucaaagcacuug

SEQ ID NO: 3766687 - RNA, 14 nt, Human
uuacugauauauuu

SEQ ID NO: 3766688 - RNA, 14 nt, Human
uuacugaucaugca

SEQ ID NO: 3766689 - RNA, 13 nt, Human
uuacugauuauuu

SEQ ID NO: 3766690 - RNA, 21 nt, Human
uuacugcauggggaaagagau

SEQ ID NO: 3766691 - RNA, 11 nt, Human
uuacugccacu

SEQ ID NO: 3766692 - RNA, 19 nt, Human
uuacugcuuuaaucagaaa

SEQ ID NO: 3766693 - RNA, 16 nt, Human
uuacuggauaaauugu

SEQ ID NO: 3766694 - RNA, 20 nt, Human
uucaguguauggaaauaaau

SEQ ID NO: 3766695 - RNA, 22 nt, Human
uucaguguuaccugugugcuug

SEQ ID NO: 3766696 - RNA, 13 nt, Human
uucaguguuucug

SEQ ID NO: 3766697 - RNA, 15 nt, Human
uucaguuaagaaaaa

SEQ ID NO: 3766698 - RNA, 21 nt, Human
uucaguuaagaaaaaaauaau

SEQ ID NO: 3766699 - RNA, 13 nt, Human
uucaguucaaagu

SEQ ID NO: 3766700 - RNA, 10 nt, Human
uucaguucca

SEQ ID NO: 3766701 - RNA, 14 nt, Human
uucaguuccaagaa

SEQ ID NO: 3766702 - RNA, 19 nt, Human
uucaguucuaggaaaauaa

SEQ ID NO: 3766703 - RNA, 16 nt, Human
uucaguugaucacugg

SEQ ID NO: 3766704 - RNA, 16 nt, Human
uucaguugcacuucua

SEQ ID NO: 3766705 - RNA, 18 nt, Human
uucaguugcuugucuucu

SEQ ID NO: 3766706 - RNA, 17 nt, Human
uucaguugguaagcuuc

SEQ ID NO: 3766707 - RNA, 18 nt, Human
uucaguugguguguuuuu

SEQ ID NO: 3766708 - RNA, 19 nt, Human
uucaguugguugugucuuu

SEQ ID NO: 3766709 - RNA, 17 nt, Human
uucaguuguguuuguug

SEQ ID NO: 3766710 - RNA, 13 nt, Human
uucaguuucauaa

SEQ ID NO: 3766711 - RNA, 13 nt, Human
uucaguuuguaua

SEQ ID NO: 3766712 - RNA, 12 nt, Human
uucaguuuucag

SEQ ID NO: 3766713 - RNA, 21 nt, Human
uucaguuuucauuugguucau

SEQ ID NO: 3766714 - RNA, 16 nt, Human
uucaguuuuuguguuu

SEQ ID NO: 3766715 - RNA, 22 nt, Human
uucauaaagauucaccuaagag

SEQ ID NO: 3766716 - RNA, 20 nt, Human
uucauaaaguacuugagugu

SEQ ID NO: 3766717 - RNA, 15 nt, Human
uucauaaaugaauuu

SEQ ID NO: 3766718 - RNA, 16 nt, Human
uucauaaaugaauuuu

SEQ ID NO: 3766719 - RNA, 15 nt, Human
uucauaacagugcca

SEQ ID NO: 3766720 - RNA, 13 nt, Human
uucauaacuuauu

SEQ ID NO: 3766721 - RNA, 14 nt, Human
uucauaagccaauu

SEQ ID NO: 3766722 - RNA, 19 nt, Human
uucauaaguauuaugucuc

SEQ ID NO: 3766723 - RNA, 12 nt, Human
uucauacaaggc

SEQ ID NO: 3766724 - RNA, 18 nt, Human
uucauacacuaaccaaau

SEQ ID NO: 3766725 - RNA, 20 nt, Human
uucauacacuaaccaaaucu

SEQ ID NO: 3766726 - RNA, 21 nt, Human
uucauacagggaugguguuca

SEQ ID NO: 3766727 - RNA, 12 nt, Human
uucauacauauu

SEQ ID NO: 3766728 - RNA, 16 nt, Human
uucauaccuaaguacu

SEQ ID NO: 3766729 - RNA, 18 nt, Human
uucauaccuaaguacugu

SEQ ID NO: 3766730 - RNA, 15 nt, Human
uucauacuugaacgu

SEQ ID NO: 3766731 - RNA, 20 nt, Human
uucauagcugguuccugcua

SEQ ID NO: 3766732 - RNA, 17 nt, Human
uucauaguaagauugau

SEQ ID NO: 3766733 - RNA, 16 nt, Human
uucauaguucagaauu

SEQ ID NO: 3766734 - RNA, 14 nt, Human
uucauauaaaguau

SEQ ID NO: 3766735 - RNA, 16 nt, Human
uucauauaaaguauca

SEQ ID NO: 3766736 - RNA, 18 nt, Human
uucauauaugaggacuug

SEQ ID NO: 3766737 - RNA, 21 nt, Human
uucauauaugaggacuugugu

SEQ ID NO: 3766738 - RNA, 19 nt, Human
uucauaucacacuguuaaa

SEQ ID NO: 3766739 - RNA, 23 nt, Human
uucauaugaaaggugccauggaa

SEQ ID NO: 3766740 - RNA, 20 nt, Human
uucauaugacauucaugccu

SEQ ID NO: 3766741 - RNA, 13 nt, Human
uucauauguugcu

SEQ ID NO: 3766742 - RNA, 15 nt, Human
uucauauuacaauau

SEQ ID NO: 3766743 - RNA, 16 nt, Human
uucauauuacaauauu

SEQ ID NO: 3766744 - RNA, 14 nt, Human
uucauauugaauau

SEQ ID NO: 3766745 - RNA, 15 nt, Human
uucauauuugcacua

SEQ ID NO: 3766746 - RNA, 11 nt, Human
uucauauuugu

SEQ ID NO: 3766747 - RNA, 22 nt, Human
uucauauuuguacuuucuguua

SEQ ID NO: 3766748 - RNA, 21 nt, Human
uucauauuuuaaacagaggau

SEQ ID NO: 3766749 - RNA, 22 nt, Human
uucauauuuuaaacagaggaua

SEQ ID NO: 3766750 - RNA, 16 nt, Human
uucaucagaacagcug

SEQ ID NO: 3766751 - RNA, 18 nt, Human
uucaucagggaggaaagu

SEQ ID NO: 3766752 - RNA, 21 nt, Human
uucaucauccuaagcuauuca

SEQ ID NO: 3766753 - RNA, 19 nt, Human
uucaucaugaggaaagcag

SEQ ID NO: 3766754 - RNA, 19 nt, Human
uucaucauucccucucauc

SEQ ID NO: 3766755 - RNA, 22 nt, Human
uucaucauuguuucugcaugaa

SEQ ID NO: 3766756 - RNA, 18 nt, Human
uucauccaauccucacug

SEQ ID NO: 3766757 - RNA, 20 nt, Human
uucauccaauccucacuggg

SEQ ID NO: 3766758 - RNA, 22 nt, Human
uucauccaggcccaacugugag

SEQ ID NO: 3766759 - RNA, 21 nt, Human
uucaucccacuccaacucuuc

SEQ ID NO: 3766760 - RNA, 16 nt, Human
uucaucccaugaugua

SEQ ID NO: 3766761 - RNA, 15 nt, Human
uucauccccucagaa

SEQ ID NO: 3766762 - RNA, 15 nt, Human
uucauccuccucaga

SEQ ID NO: 3766763 - RNA, 13 nt, Human
uucauccuuagca

SEQ ID NO: 3766764 - RNA, 12 nt, Human
uucauccuuccc

SEQ ID NO: 3766765 - RNA, 12 nt, Human
uucauccuuuca

SEQ ID NO: 3766766 - RNA, 17 nt, Human
uucaucuauuucugaga

SEQ ID NO: 3766767 - RNA, 18 nt, Human
uucaucuauuucugagaa

SEQ ID NO: 3766768 - RNA, 14 nt, Human
uucaucuccaggga

SEQ ID NO: 3766769 - RNA, 15 nt, Human
uucaucuccagggag

SEQ ID NO: 3766770 - RNA, 12 nt, Human
uucaucugccca

SEQ ID NO: 3766771 - RNA, 15 nt, Human
uucaucugcucuccu

SEQ ID NO: 3766772 - RNA, 21 nt, Human
uucaucugcucuccuuccugg

SEQ ID NO: 3766773 - RNA, 13 nt, Human
uucaucuggaagu

SEQ ID NO: 3766774 - RNA, 14 nt, Human
uucaucuggaaguu

SEQ ID NO: 3766775 - RNA, 14 nt, Human
uucaucugggaaag

SEQ ID NO: 3766776 - RNA, 13 nt, Human
uucaucuguaacu

SEQ ID NO: 3766777 - RNA, 18 nt, Human
uucaucuguuguuuuguu

SEQ ID NO: 3766778 - RNA, 20 nt, Human
uucaucuuccaacucaaacu

SEQ ID NO: 3766779 - RNA, 15 nt, Human
uucaucuuccugugu

SEQ ID NO: 3766780 - RNA, 17 nt, Human
uucaucuugaauuguaa

SEQ ID NO: 3766781 - RNA, 16 nt, Human
uucaucuuuuaaagaa

SEQ ID NO: 3766782 - RNA, 21 nt, Human
uucaucuuuugaggcuucugu

SEQ ID NO: 3766783 - RNA, 17 nt, Human
uucaugaaaauccuacc

SEQ ID NO: 3766784 - RNA, 15 nt, Human
uucaugaaagauuca

SEQ ID NO: 3766785 - RNA, 18 nt, Human
uucaugaaagauucaaug

SEQ ID NO: 3766786 - RNA, 13 nt, Human
uucaugaaauccu

SEQ ID NO: 3766787 - RNA, 12 nt, Human
uucaugaaaugc

SEQ ID NO: 3766788 - RNA, 15 nt, Human
uucaugaaaugcuau

SEQ ID NO: 3766789 - RNA, 21 nt, Human
uucaugaaaugcuaugucauu

SEQ ID NO: 3766790 - RNA, 16 nt, Human
uucaugaguuuuuccc

SEQ ID NO: 3766791 - RNA, 15 nt, Human
uucaugauaaugaac

SEQ ID NO: 3766792 - RNA, 17 nt, Human
uucaugauuucauuuca

SEQ ID NO: 3766793 - RNA, 17 nt, Human
uucaugcaaacuuuauu

SEQ ID NO: 3766794 - RNA, 14 nt, Human
uucaugcagcugug

SEQ ID NO: 3766795 - RNA, 19 nt, Human
uucaugcauagguuuagca

SEQ ID NO: 3766796 - RNA, 13 nt, Human
uucaugcauggaa

SEQ ID NO: 3766797 - RNA, 16 nt, Human
uucaugcauggaaauu

SEQ ID NO: 3766798 - RNA, 21 nt, Human
uucaugccaauuagcaauuga

SEQ ID NO: 3766799 - RNA, 22 nt, Human
uucaugccagcuacuuccuccu

SEQ ID NO: 3766800 - RNA, 20 nt, Human
uucaugcuguucaugaaaga

SEQ ID NO: 3766801 - RNA, 20 nt, Human
uucauggaacgcguugaaau

SEQ ID NO: 3766802 - RNA, 19 nt, Human
uucauggaauggacauccu

SEQ ID NO: 3766803 - RNA, 14 nt, Human
uucauggacacuuu

SEQ ID NO: 3766804 - RNA, 16 nt, Human
uucauggacacuuuga

SEQ ID NO: 3766805 - RNA, 17 nt, Human
uucauggcagaaggcaa

SEQ ID NO: 3766806 - RNA, 23 nt, Human
uucauggcagauguaggagggac

SEQ ID NO: 3766807 - RNA, 21 nt, Human
uucauggcaugcuuaaauuuu

SEQ ID NO: 3766808 - RNA, 21 nt, Human
uucauggccuuugauaaaugu

SEQ ID NO: 3766809 - RNA, 18 nt, Human
uucauggcugcuguugcu

SEQ ID NO: 3766810 - RNA, 21 nt, Human
uucauggcugcuguugcuuaa

SEQ ID NO: 3766811 - RNA, 21 nt, Human
uucauggggugaugcugggcu

SEQ ID NO: 3766812 - RNA, 18 nt, Human
uucauguaaacugugcac

SEQ ID NO: 3766813 - RNA, 19 nt, Human
uucauguaaacugugcacc

SEQ ID NO: 3766814 - RNA, 18 nt, Human
uucauguaauccucaaga

SEQ ID NO: 3766815 - RNA, 13 nt, Human
uucauguacauuu

SEQ ID NO: 3766816 - RNA, 22 nt, Human
uucaugucccagaacuuagccu

SEQ ID NO: 3766817 - RNA, 16 nt, Human
uucaugucugcuauca

SEQ ID NO: 3766818 - RNA, 22 nt, Human
uucaugugggaucccaucuuuu

SEQ ID NO: 3766819 - RNA, 16 nt, Human
uucaugugucccagaa

SEQ ID NO: 3766820 - RNA, 22 nt, Human
uucauguuaguuaccuuauagu

SEQ ID NO: 3766821 - RNA, 12 nt, Human
uucauguuucuu

SEQ ID NO: 3766822 - RNA, 14 nt, Human
uucauguuuggugc

SEQ ID NO: 3766823 - RNA, 15 nt, Human
uucauguuuggugca

SEQ ID NO: 3766824 - RNA, 22 nt, Human
uucauguuuggugcauagaacu

SEQ ID NO: 3766825 - RNA, 15 nt, Human
uucauuaaagcauuu

SEQ ID NO: 3766826 - RNA, 23 nt, Human
uucauuaaaggcuucucucucac

SEQ ID NO: 3766827 - RNA, 14 nt, Human
uucauuaaauguuu

SEQ ID NO: 3766828 - RNA, 15 nt, Human
uucauuaaauguuug

SEQ ID NO: 3766829 - RNA, 15 nt, Human
uucauuaauaauaaa

SEQ ID NO: 3766830 - RNA, 16 nt, Human
uucauuaauucaggca

SEQ ID NO: 3766831 - RNA, 20 nt, Human
uucauuagcaaaaaaaguug

SEQ ID NO: 3766832 - RNA, 14 nt, Human
uucauuaguuuuga

SEQ ID NO: 3766833 - RNA, 14 nt, Human
uucauuauguaaaa

SEQ ID NO: 3766834 - RNA, 13 nt, Human
uucauuauucucu

SEQ ID NO: 3766835 - RNA, 17 nt, Human
uucauuauuggaauuaa

SEQ ID NO: 3766836 - RNA, 15 nt, Human
uucauuauuugucaa

SEQ ID NO: 3766837 - RNA, 21 nt, Human
uucauuauuugucaaauuguc

SEQ ID NO: 3766838 - RNA, 18 nt, Human
uucauuauuuuaaaaaua

SEQ ID NO: 3766839 - RNA, 18 nt, Human
uucauucaauauugacau

SEQ ID NO: 3766840 - RNA, 20 nt, Human
uucccaggacccugaagggg

SEQ ID NO: 3766841 - RNA, 16 nt, Human
uucccaggcaaauaaa

SEQ ID NO: 3766842 - RNA, 18 nt, Human
uucccaggcaaauaaaau

SEQ ID NO: 3766843 - RNA, 19 nt, Human
uucccaggcaaauaaaauu

SEQ ID NO: 3766844 - RNA, 19 nt, Human
uucccaggcccacugugcc

SEQ ID NO: 3766845 - RNA, 21 nt, Human
uucccagguaggccaaggugu

SEQ ID NO: 3766846 - RNA, 12 nt, Human
uucccaggugcu

SEQ ID NO: 3766847 - RNA, 15 nt, Human
uucccagucugucga

SEQ ID NO: 3766848 - RNA, 15 nt, Human
uucccaguggcugcu

SEQ ID NO: 3766849 - RNA, 17 nt, Human
uucccaguggcugcugc

SEQ ID NO: 3766850 - RNA, 20 nt, Human
uucccaguggcugcugccca

SEQ ID NO: 3766851 - RNA, 15 nt, Human
uucccaguuggagcu

SEQ ID NO: 3766852 - RNA, 16 nt, Human
uucccaguuggagcuc

SEQ ID NO: 3766853 - RNA, 21 nt, Human
uucccauaccacccaaugcug

SEQ ID NO: 3766854 - RNA, 23 nt, Human
uucccaucacuggagcaccaggc

SEQ ID NO: 3766855 - RNA, 15 nt, Human
uucccauccccagcg

SEQ ID NO: 3766856 - RNA, 15 nt, Human
uucccaucgcuguca

SEQ ID NO: 3766857 - RNA, 13 nt, Human
uucccaucuccuu

SEQ ID NO: 3766858 - RNA, 16 nt, Human
uucccaucuuuacucc

SEQ ID NO: 3766859 - RNA, 19 nt, Human
uucccaugacccaggcugg

SEQ ID NO: 3766860 - RNA, 20 nt, Human
uucccaugacccaggcuggg

SEQ ID NO: 3766861 - RNA, 20 nt, Human
uucccaugauuucauguacu

SEQ ID NO: 3766862 - RNA, 14 nt, Human
uucccauggggagg

SEQ ID NO: 3766863 - RNA, 23 nt, Human
uucccauugcaucaccucuguaa

SEQ ID NO: 3766864 - RNA, 15 nt, Human
uucccauuuagaaug

SEQ ID NO: 3766865 - RNA, 14 nt, Human
uucccauuuugcaa

SEQ ID NO: 3766866 - RNA, 19 nt, Human
uucccauuuugcaaaauuu

SEQ ID NO: 3766867 - RNA, 20 nt, Human
uuccccaccagaugcugaaa

SEQ ID NO: 3766868 - RNA, 19 nt, Human
uuccccacccaccaacccu

SEQ ID NO: 3766869 - RNA, 22 nt, Human
uuccccaccccagcucaugccc

SEQ ID NO: 3766870 - RNA, 15 nt, Human
uuccccacguuaaag

SEQ ID NO: 3766871 - RNA, 17 nt, Human
uuccccacugcacacac

SEQ ID NO: 3766872 - RNA, 15 nt, Human
uuccccagacuuguu

SEQ ID NO: 3766873 - RNA, 12 nt, Human
uuccccagcauc

SEQ ID NO: 3766874 - RNA, 18 nt, Human
uuccccagcaucacuccc

SEQ ID NO: 3766875 - RNA, 19 nt, Human
uuccccagcuuugcugccu

SEQ ID NO: 3766876 - RNA, 15 nt, Human
uuccccaggaggcca

SEQ ID NO: 3766877 - RNA, 17 nt, Human
uuccccaggaggccagc

SEQ ID NO: 3766878 - RNA, 23 nt, Human
uuccccauaacucaauggccuaa

SEQ ID NO: 3766879 - RNA, 14 nt, Human
uuccccauacaaau

SEQ ID NO: 3766880 - RNA, 20 nt, Human
uuccccaucguugcccccau

SEQ ID NO: 3766881 - RNA, 11 nt, Human
uuccccauggg

SEQ ID NO: 3766882 - RNA, 22 nt, Human
uuccccauuauaucacacuuau

SEQ ID NO: 3766883 - RNA, 18 nt, Human
uucccccaccagcuaagg

SEQ ID NO: 3766884 - RNA, 13 nt, Human
uucccccagccca

SEQ ID NO: 3766885 - RNA, 13 nt, Human
uucccccagcccu

SEQ ID NO: 3766886 - RNA, 14 nt, Human
uucccccauagcca

SEQ ID NO: 3766887 - RNA, 16 nt, Human
uucccccauuuuuccc

SEQ ID NO: 3766888 - RNA, 13 nt, Human
uuccccccaaggg

SEQ ID NO: 3766889 - RNA, 21 nt, Human
uuccccccacucuccccacac

SEQ ID NO: 3766890 - RNA, 23 nt, Human
uucccccgccgcuuuucuccucu

SEQ ID NO: 3766891 - RNA, 19 nt, Human
uucccccuccaaucccacc

SEQ ID NO: 3766892 - RNA, 15 nt, Human
uucccccucccaggg

SEQ ID NO: 3766893 - RNA, 14 nt, Human
uucccccuccccca

SEQ ID NO: 3766894 - RNA, 14 nt, Human
uucccccucuccca

SEQ ID NO: 3766895 - RNA, 17 nt, Human
uucccccucucccaguu

SEQ ID NO: 3766896 - RNA, 22 nt, Human
uucccccugcuuccaccucacc

SEQ ID NO: 3766897 - RNA, 22 nt, Human
uucccccuggccaccacccccc

SEQ ID NO: 3766898 - RNA, 15 nt, Human
uucccccuuucuucc

SEQ ID NO: 3766899 - RNA, 19 nt, Human
uuccccgcauuccaggcuc

SEQ ID NO: 3766900 - RNA, 16 nt, Human
uuccccggucccuuga

SEQ ID NO: 3766901 - RNA, 17 nt, Human
uuccccggucccuugag

SEQ ID NO: 3766902 - RNA, 19 nt, Human
uuccccgugggccauggca

SEQ ID NO: 3766903 - RNA, 19 nt, Human
uuccccucacuggaugaaa

SEQ ID NO: 3766904 - RNA, 16 nt, Human
uuccccucccuggcuc

SEQ ID NO: 3766905 - RNA, 13 nt, Human
uuccccuccuacc

SEQ ID NO: 3766906 - RNA, 17 nt, Human
uuccccuccuucucccu

SEQ ID NO: 3766907 - RNA, 12 nt, Human
uuccccucuccc

SEQ ID NO: 3766908 - RNA, 21 nt, Human
uuccccucucccuucccuccu

SEQ ID NO: 3766909 - RNA, 14 nt, Human
uuccccucugcugc

SEQ ID NO: 3766910 - RNA, 21 nt, Human
uuccccuggggacccacgugg

SEQ ID NO: 3766911 - RNA, 15 nt, Human
uuccccugugucauc

SEQ ID NO: 3766912 - RNA, 17 nt, Human
uuccccuuauccucccu

SEQ ID NO: 3766913 - RNA, 21 nt, Human
uuccccuuccacugagggcag

SEQ ID NO: 3766914 - RNA, 22 nt, Human
uuccccuuccuaauuccacagc

SEQ ID NO: 3766915 - RNA, 23 nt, Human
uuccccuugcccagggcucagcc

SEQ ID NO: 3766916 - RNA, 23 nt, Human
uuccccuugcccuugcccugacc

SEQ ID NO: 3766917 - RNA, 14 nt, Human
uuccccuuucccca

SEQ ID NO: 3766918 - RNA, 14 nt, Human
uuccccuuuccugu

SEQ ID NO: 3766919 - RNA, 15 nt, Human
uuccccuuuccuguc

SEQ ID NO: 3766920 - RNA, 20 nt, Human
uucccgcagugggagcaaac

SEQ ID NO: 3766921 - RNA, 22 nt, Human
uucccgcucagcccucccugcc

SEQ ID NO: 3766922 - RNA, 14 nt, Human
uucccggucccgag

SEQ ID NO: 3766923 - RNA, 15 nt, Human
uucccguggccccag

SEQ ID NO: 3766924 - RNA, 11 nt, Human
uucccuaaagc

SEQ ID NO: 3766925 - RNA, 12 nt, Human
uucccuaaagcc

SEQ ID NO: 3766926 - RNA, 15 nt, Human
uucccuaaagugaug

SEQ ID NO: 3766927 - RNA, 15 nt, Human
uucccuaagccaagg

SEQ ID NO: 3766928 - RNA, 19 nt, Human
uucccuacauuaaacauga

SEQ ID NO: 3766929 - RNA, 13 nt, Human
uucccuacuuccu

SEQ ID NO: 3766930 - RNA, 18 nt, Human
uucccuaggggacacuuc

SEQ ID NO: 3766931 - RNA, 21 nt, Human
uucccuaggggacacuucccu

SEQ ID NO: 3766932 - RNA, 22 nt, Human
uucccucaaagcuuccauucca

SEQ ID NO: 3766933 - RNA, 15 nt, Human
uucccucaaaugugu

SEQ ID NO: 3766934 - RNA, 14 nt, Human
uucccucacccccu

SEQ ID NO: 3766935 - RNA, 18 nt, Human
uucccucacccccuccca

SEQ ID NO: 3766936 - RNA, 19 nt, Human
uucccucacccccucccac

SEQ ID NO: 3766937 - RNA, 20 nt, Human
uucccucacucgucuccccc

SEQ ID NO: 3766938 - RNA, 17 nt, Human
uucccucaucucuccuc

SEQ ID NO: 3766939 - RNA, 23 nt, Human
uucccuccaucccccuuuacccu

SEQ ID NO: 3766940 - RNA, 13 nt, Human
uucccucccugcu

SEQ ID NO: 3766941 - RNA, 15 nt, Human
uucccucccugcugu

SEQ ID NO: 3766942 - RNA, 16 nt, Human
uucccucccugcuguc

SEQ ID NO: 3766943 - RNA, 17 nt, Human
uucccucccuuccucuu

SEQ ID NO: 3766944 - RNA, 20 nt, Human
uucccucccuuccucuuucc

SEQ ID NO: 3766945 - RNA, 12 nt, Human
uucccuccuccc

SEQ ID NO: 3766946 - RNA, 13 nt, Human
uucccuccuccca

SEQ ID NO: 3766947 - RNA, 14 nt, Human
uucccuccucccau

SEQ ID NO: 3766948 - RNA, 16 nt, Human
uucccucucccaggcc

SEQ ID NO: 3766949 - RNA, 13 nt, Human
uucccucucugga

SEQ ID NO: 3766950 - RNA, 15 nt, Human
uucccucucuggaga

SEQ ID NO: 3766951 - RNA, 11 nt, Human
uucccucugag

SEQ ID NO: 3766952 - RNA, 14 nt, Human
uucccucugccugu

SEQ ID NO: 3766953 - RNA, 18 nt, Human
uucccucugccugucccu

SEQ ID NO: 3766954 - RNA, 20 nt, Human
uucccucuuuggcuccccug

SEQ ID NO: 3766955 - RNA, 23 nt, Human
uucccucuuuucuuacuccuccu

SEQ ID NO: 3766956 - RNA, 23 nt, Human
uucccugaaaaccucacaugcau

SEQ ID NO: 3766957 - RNA, 13 nt, Human
uucccugaagcuc

SEQ ID NO: 3766958 - RNA, 19 nt, Human
uucccugagucaccaggaa

SEQ ID NO: 3766959 - RNA, 22 nt, Human
uucccugcacuaaagccagccu

SEQ ID NO: 3766960 - RNA, 23 nt, Human
uucccugccucucaucaacugaa

SEQ ID NO: 3766961 - RNA, 19 nt, Human
uucccugcgccugugaugc

SEQ ID NO: 3766962 - RNA, 15 nt, Human
uucccugcuuccagg

SEQ ID NO: 3766963 - RNA, 11 nt, Human
uucccuggacc

SEQ ID NO: 3766964 - RNA, 17 nt, Human
uucccuggccuuucaua

SEQ ID NO: 3766965 - RNA, 23 nt, Human
uucccuggcuuguaacuccacca

SEQ ID NO: 3766966 - RNA, 23 nt, Human
uucccuggguuagacugccagcu

SEQ ID NO: 3766967 - RNA, 22 nt, Human
uucccugguaagaaaaagcaaa

SEQ ID NO: 3766968 - RNA, 23 nt, Human
uucccuggucccuuguauccccu

SEQ ID NO: 3766969 - RNA, 20 nt, Human
uucccuguauuuucuuucuc

SEQ ID NO: 3766970 - RNA, 12 nt, Human
uucccugugcug

SEQ ID NO: 3766971 - RNA, 18 nt, Human
uucccuguuuucccccca

SEQ ID NO: 3766972 - RNA, 14 nt, Human
uucccuuaaaauuu

SEQ ID NO: 3766973 - RNA, 22 nt, Human
uucccuucaguacccucucagc

SEQ ID NO: 3766974 - RNA, 15 nt, Human
uucccuucaucugga

SEQ ID NO: 3766975 - RNA, 15 nt, Human
uucccuuccacugcc

SEQ ID NO: 3766976 - RNA, 19 nt, Human
uucccuuccacugccucug

SEQ ID NO: 3766977 - RNA, 20 nt, Human
uucccuuccaguuuauucca

SEQ ID NO: 3766978 - RNA, 13 nt, Human
uucccuuccucca

SEQ ID NO: 3766979 - RNA, 17 nt, Human
uucccuuccuccauccu

SEQ ID NO: 3766980 - RNA, 17 nt, Human
uucccuuccucuucggc

SEQ ID NO: 3766981 - RNA, 14 nt, Human
uucccuuccugcca

SEQ ID NO: 3766982 - RNA, 15 nt, Human
uucccuuccugccag

SEQ ID NO: 3766983 - RNA, 19 nt, Human
uucccuucgacagcauuuu

SEQ ID NO: 3766984 - RNA, 22 nt, Human
uucccuucuugguuuccaaagg

SEQ ID NO: 3766985 - RNA, 14 nt, Human
uugaggauuaguuu

SEQ ID NO: 3766986 - RNA, 17 nt, Human
uugaggauuaguuuaga

SEQ ID NO: 3766987 - RNA, 19 nt, Human
uugaggauuaguuuagaac

SEQ ID NO: 3766988 - RNA, 15 nt, Human
uugaggauuuugagu

SEQ ID NO: 3766989 - RNA, 16 nt, Human
uugaggcaaaagaagg

SEQ ID NO: 3766990 - RNA, 18 nt, Human
uugaggcaagugugggcc

SEQ ID NO: 3766991 - RNA, 21 nt, Human
uugaggccaagaauauugcaa

SEQ ID NO: 3766992 - RNA, 22 nt, Human
uugaggcuugguuccuucccaa

SEQ ID NO: 3766993 - RNA, 15 nt, Human
uugaggcuuucaggu

SEQ ID NO: 3766994 - RNA, 15 nt, Human
uugaggcuuuguguu

SEQ ID NO: 3766995 - RNA, 23 nt, Human
uugagggacaaauuuaaaacaaa

SEQ ID NO: 3766996 - RNA, 17 nt, Human
uugagggacugccucug

SEQ ID NO: 3766997 - RNA, 20 nt, Human
uugagggacugccucugcca

SEQ ID NO: 3766998 - RNA, 19 nt, Human
uugagggcccagagcagga

SEQ ID NO: 3766999 - RNA, 23 nt, Human
uugagggcccagagcaggaagca

SEQ ID NO: 3767000 - RNA, 15 nt, Human
uugaggggaccagga

SEQ ID NO: 3767001 - RNA, 20 nt, Human
uugaggggauuaauaugaaa

SEQ ID NO: 3767002 - RNA, 15 nt, Human
uugaggggcuccugg

SEQ ID NO: 3767003 - RNA, 17 nt, Human
uugagggugggguaagg

SEQ ID NO: 3767004 - RNA, 21 nt, Human
uugagguccagcccuggcuga

SEQ ID NO: 3767005 - RNA, 17 nt, Human
uugaggucugcucggcc

SEQ ID NO: 3767006 - RNA, 22 nt, Human
uugaggucuuuugacaugugga

SEQ ID NO: 3767007 - RNA, 22 nt, Human
uugagguggaagcccuccuucc

SEQ ID NO: 3767008 - RNA, 14 nt, Human
uugaguaaucugau

SEQ ID NO: 3767009 - RNA, 21 nt, Human
uugaguaaugguguagaacac

SEQ ID NO: 3767010 - RNA, 13 nt, Human
uugaguagaggcu

SEQ ID NO: 3767011 - RNA, 16 nt, Human
uugaguagauauuacu

SEQ ID NO: 3767012 - RNA, 17 nt, Human
uugaguagauauuacuu

SEQ ID NO: 3767013 - RNA, 19 nt, Human
uugaguagauauuacuuua

SEQ ID NO: 3767014 - RNA, 17 nt, Human
uugaguauaagaaaugc

SEQ ID NO: 3767015 - RNA, 19 nt, Human
uugaguauaagaaaugcau

SEQ ID NO: 3767016 - RNA, 13 nt, Human
uugaguauuguuu

SEQ ID NO: 3767017 - RNA, 14 nt, Human
uugaguauuguuua

SEQ ID NO: 3767018 - RNA, 13 nt, Human
uugagucauuuua

SEQ ID NO: 3767019 - RNA, 18 nt, Human
uugagucuguuuuguaaa

SEQ ID NO: 3767020 - RNA, 11 nt, Human
uugagucuuuu

SEQ ID NO: 3767021 - RNA, 11 nt, Human
uugagugccuu

SEQ ID NO: 3767022 - RNA, 14 nt, Human
uugagugcucugau

SEQ ID NO: 3767023 - RNA, 17 nt, Human
uugaguggaugauguuu

SEQ ID NO: 3767024 - RNA, 19 nt, Human
uugaguggaugauguuucg

SEQ ID NO: 3767025 - RNA, 23 nt, Human
uugagugggguuaucucuguguu

SEQ ID NO: 3767026 - RNA, 15 nt, Human
uugagugugugugug

SEQ ID NO: 3767027 - RNA, 18 nt, Human
uugagugugugugugcau

SEQ ID NO: 3767028 - RNA, 16 nt, Human
uugaguucagguagcu

SEQ ID NO: 3767029 - RNA, 18 nt, Human
uugaguucuguagagccu

SEQ ID NO: 3767030 - RNA, 23 nt, Human
uugaguucuuccuguaaucuugu

SEQ ID NO: 3767031 - RNA, 20 nt, Human
uugaguugauucagcucugc

SEQ ID NO: 3767032 - RNA, 22 nt, Human
uugaguuuccucaggcugcugg

SEQ ID NO: 3767033 - RNA, 15 nt, Human
uugauaaaaauacug

SEQ ID NO: 3767034 - RNA, 14 nt, Human
uugauaaagauuuu

SEQ ID NO: 3767035 - RNA, 20 nt, Human
uugauaaagauuuuuuaaua

SEQ ID NO: 3767036 - RNA, 15 nt, Human
uugauaaaucauuuu

SEQ ID NO: 3767037 - RNA, 15 nt, Human
uugauaaauccauca

SEQ ID NO: 3767038 - RNA, 18 nt, Human
uugauaacaauguuuuaa

SEQ ID NO: 3767039 - RNA, 12 nt, Human
uugauaacagcu

SEQ ID NO: 3767040 - RNA, 18 nt, Human
uugauaaccuugaaaaaa

SEQ ID NO: 3767041 - RNA, 16 nt, Human
uugauaagagggcaca

SEQ ID NO: 3767042 - RNA, 18 nt, Human
uugauaagaucuuuuauu

SEQ ID NO: 3767043 - RNA, 20 nt, Human
uugauaagggacugauguuu

SEQ ID NO: 3767044 - RNA, 17 nt, Human
uugauaaguucauacau

SEQ ID NO: 3767045 - RNA, 18 nt, Human
uugauaauaauauuguuu

SEQ ID NO: 3767046 - RNA, 14 nt, Human
uugauaaugauaaa

SEQ ID NO: 3767047 - RNA, 15 nt, Human
uugauaaugcuuuca

SEQ ID NO: 3767048 - RNA, 14 nt, Human
uugauaauguuaaa

SEQ ID NO: 3767049 - RNA, 18 nt, Human
uugauaauguuaaauuug

SEQ ID NO: 3767050 - RNA, 19 nt, Human
uugauaauguuaaauuugu

SEQ ID NO: 3767051 - RNA, 12 nt, Human
uugauaauucuu

SEQ ID NO: 3767052 - RNA, 22 nt, Human
uugauaauucuuauuuugugga

SEQ ID NO: 3767053 - RNA, 15 nt, Human
uugauaauugcauuc

SEQ ID NO: 3767054 - RNA, 17 nt, Human
uugauaauuuuccuuua

SEQ ID NO: 3767055 - RNA, 23 nt, Human
uugauacauaauaaaaaauuaug

SEQ ID NO: 3767056 - RNA, 15 nt, Human
uugauacauucaaau

SEQ ID NO: 3767057 - RNA, 21 nt, Human
uugauacauucaaauuugucu

SEQ ID NO: 3767058 - RNA, 15 nt, Human
uugauaccccccucu

SEQ ID NO: 3767059 - RNA, 20 nt, Human
uugauacucuuucuaaugcu

SEQ ID NO: 3767060 - RNA, 14 nt, Human
uugauacuguugca

SEQ ID NO: 3767061 - RNA, 16 nt, Human
uugauacuguugcacg

SEQ ID NO: 3767062 - RNA, 20 nt, Human
uugauacuguugcacgugug

SEQ ID NO: 3767063 - RNA, 17 nt, Human
uugauacuuguucaaaa

SEQ ID NO: 3767064 - RNA, 13 nt, Human
uugauagcaaagc

SEQ ID NO: 3767065 - RNA, 19 nt, Human
uugauagcacagacccugc

SEQ ID NO: 3767066 - RNA, 18 nt, Human
uugauauaaauaaaacau

SEQ ID NO: 3767067 - RNA, 20 nt, Human
uugauauacuuuuuucuuau

SEQ ID NO: 3767068 - RNA, 18 nt, Human
uugauauagaaguauaaa

SEQ ID NO: 3767069 - RNA, 20 nt, Human
uugauauagaaguauaaaga

SEQ ID NO: 3767070 - RNA, 22 nt, Human
uugauauagaaguauaaagaau

SEQ ID NO: 3767071 - RNA, 16 nt, Human
uugauaugaaaaauau

SEQ ID NO: 3767072 - RNA, 21 nt, Human
uugauaugaaaaauaugauau

SEQ ID NO: 3767073 - RNA, 22 nt, Human
uugauaugaaaaauaugauauu

SEQ ID NO: 3767074 - RNA, 13 nt, Human
uugauaugaguau

SEQ ID NO: 3767075 - RNA, 18 nt, Human
uugauaugaguauacaau

SEQ ID NO: 3767076 - RNA, 20 nt, Human
uugauaugccuuuucccaac

SEQ ID NO: 3767077 - RNA, 16 nt, Human
uugauaugugaacagu

SEQ ID NO: 3767078 - RNA, 15 nt, Human
uugauauucuaagaa

SEQ ID NO: 3767079 - RNA, 17 nt, Human
uugauauugugaacauu

SEQ ID NO: 3767080 - RNA, 20 nt, Human
uugauauugugaacauuugu

SEQ ID NO: 3767081 - RNA, 17 nt, Human
uugaucaaauucauuuu

SEQ ID NO: 3767082 - RNA, 14 nt, Human
uugaucacacuauu

SEQ ID NO: 3767083 - RNA, 17 nt, Human
uugaucacacuauuuua

SEQ ID NO: 3767084 - RNA, 18 nt, Human
uugaucaguaguuugcau

SEQ ID NO: 3767085 - RNA, 17 nt, Human
uugauccagaaagaaaa

SEQ ID NO: 3767086 - RNA, 18 nt, Human
uugauccauccagcuugc

SEQ ID NO: 3767087 - RNA, 19 nt, Human
uugaucgccuuucccaggu

SEQ ID NO: 3767088 - RNA, 14 nt, Human
uugaucucacauuu

SEQ ID NO: 3767089 - RNA, 18 nt, Human
uugaucucccuuuccuau

SEQ ID NO: 3767090 - RNA, 21 nt, Human
uugaucugcucagcccuggag

SEQ ID NO: 3767091 - RNA, 22 nt, Human
uugaucugcucagcccuggagg

SEQ ID NO: 3767092 - RNA, 13 nt, Human
uugaucuucaaca

SEQ ID NO: 3767093 - RNA, 17 nt, Human
uugaucuucaacaaauu

SEQ ID NO: 3767094 - RNA, 20 nt, Human
uugaugaaaagauuuaagca

SEQ ID NO: 3767095 - RNA, 14 nt, Human
uugaugaaaaugua

SEQ ID NO: 3767096 - RNA, 20 nt, Human
uugaugaaacgucauguguu

SEQ ID NO: 3767097 - RNA, 23 nt, Human
uugaugaagaaguugauaugccu

SEQ ID NO: 3767098 - RNA, 20 nt, Human
uugaugaccaaaguccuuuu

SEQ ID NO: 3767099 - RNA, 17 nt, Human
uugaugacccccaacca

SEQ ID NO: 3767100 - RNA, 18 nt, Human
uugaugacuggaauuuuu

SEQ ID NO: 3767101 - RNA, 16 nt, Human
uugaugacuggcauuu

SEQ ID NO: 3767102 - RNA, 22 nt, Human
uugaugacuggcauuuuauaga

SEQ ID NO: 3767103 - RNA, 19 nt, Human
uugaugcaauccuuacaaa

SEQ ID NO: 3767104 - RNA, 15 nt, Human
uugaugcagcauuug

SEQ ID NO: 3767105 - RNA, 20 nt, Human
uugaugcauuaaaagaaaau

SEQ ID NO: 3767106 - RNA, 15 nt, Human
uugaugccaggacac

SEQ ID NO: 3767107 - RNA, 15 nt, Human
uugaugcuggagagg

SEQ ID NO: 3767108 - RNA, 17 nt, Human
uugaugcuggagagguu

SEQ ID NO: 3767109 - RNA, 16 nt, Human
uugauggagugugagc

SEQ ID NO: 3767110 - RNA, 21 nt, Human
uugauggagugugagccaccu

SEQ ID NO: 3767111 - RNA, 12 nt, Human
uugauggcugcg

SEQ ID NO: 3767112 - RNA, 14 nt, Human
uugauggggaagga

SEQ ID NO: 3767113 - RNA, 21 nt, Human
uugauggucagacacaaacaa

SEQ ID NO: 3767114 - RNA, 23 nt, Human
uugauggugaugaaauguaaaua

SEQ ID NO: 3767115 - RNA, 19 nt, Human
uugauggugguauguuuuc

SEQ ID NO: 3767116 - RNA, 22 nt, Human
uugauguauccaacaagccaga

SEQ ID NO: 3767117 - RNA, 12 nt, Human
uugauguaucug

SEQ ID NO: 3767118 - RNA, 15 nt, Human
uugauguaucugagu

SEQ ID NO: 3767119 - RNA, 18 nt, Human
uugaugucagcaguugcu

SEQ ID NO: 3767120 - RNA, 19 nt, Human
uugaugugacaauaauauu

SEQ ID NO: 3767121 - RNA, 18 nt, Human
uugauguggcccuggcug

SEQ ID NO: 3767122 - RNA, 20 nt, Human
uugauguggcccuggcugcc

SEQ ID NO: 3767123 - RNA, 21 nt, Human
uugauguggugaaaagcaggu

SEQ ID NO: 3767124 - RNA, 14 nt, Human
uugauguuaacaca

SEQ ID NO: 3767125 - RNA, 16 nt, Human
uugauguuaacacauu

SEQ ID NO: 3767126 - RNA, 15 nt, Human
uugauguugaugcaa

SEQ ID NO: 3767127 - RNA, 16 nt, Human
uugauguugaugcaau

SEQ ID NO: 3767128 - RNA, 13 nt, Human
uugauguuugugg

SEQ ID NO: 3767129 - RNA, 19 nt, Human
uugccugcagagagaagcc

SEQ ID NO: 3767130 - RNA, 12 nt, Human
uugccugcaggc

SEQ ID NO: 3767131 - RNA, 14 nt, Human
uugccugccuuucc

SEQ ID NO: 3767132 - RNA, 18 nt, Human
uugccugcggucaaggcc

SEQ ID NO: 3767133 - RNA, 12 nt, Human
uugccugguaca

SEQ ID NO: 3767134 - RNA, 16 nt, Human
uugccuguucaguuac

SEQ ID NO: 3767135 - RNA, 23 nt, Human
uugccuguucaguuacagaaagu

SEQ ID NO: 3767136 - RNA, 14 nt, Human
uugccuucaacuaa

SEQ ID NO: 3767137 - RNA, 22 nt, Human
uugccuuccuaagccuguggcu

SEQ ID NO: 3767138 - RNA, 17 nt, Human
uugccuucucaccagcu

SEQ ID NO: 3767139 - RNA, 18 nt, Human
uugccuucuuugaagaag

SEQ ID NO: 3767140 - RNA, 21 nt, Human
uugccuugaaccacuucccuc

SEQ ID NO: 3767141 - RNA, 15 nt, Human
uugccuugcagaacu

SEQ ID NO: 3767142 - RNA, 19 nt, Human
uugccuugcagaacugcca

SEQ ID NO: 3767143 - RNA, 16 nt, Human
uugccuugcuguuugu

SEQ ID NO: 3767144 - RNA, 18 nt, Human
uugccuuggcugcaguuu

SEQ ID NO: 3767145 - RNA, 16 nt, Human
uugccuuucgaggccu

SEQ ID NO: 3767146 - RNA, 17 nt, Human
uugccuuucgaggccug

SEQ ID NO: 3767147 - RNA, 12 nt, Human
uugccuuucugu

SEQ ID NO: 3767148 - RNA, 17 nt, Human
uugccuuucuguguuua

SEQ ID NO: 3767149 - RNA, 15 nt, Human
uugccuuuuaauuuu

SEQ ID NO: 3767150 - RNA, 18 nt, Human
uugccuuuugcaaacuuu

SEQ ID NO: 3767151 - RNA, 17 nt, Human
uugccuuuuuauaacuu

SEQ ID NO: 3767152 - RNA, 13 nt, Human
uugccuuuuucau

SEQ ID NO: 3767153 - RNA, 17 nt, Human
uugccuuuuucauuuuc

SEQ ID NO: 3767154 - RNA, 22 nt, Human
uugccuuuuucauuuuccaaua

SEQ ID NO: 3767155 - RNA, 20 nt, Human
uugcgaauccaagcucccug

SEQ ID NO: 3767156 - RNA, 15 nt, Human
uugcgagagaugugu

SEQ ID NO: 3767157 - RNA, 19 nt, Human
uugcgagagauguguguug

SEQ ID NO: 3767158 - RNA, 21 nt, Human
uugcgcuccuggcccagccuu

SEQ ID NO: 3767159 - RNA, 16 nt, Human
uugcggcaaaaggaaa

SEQ ID NO: 3767160 - RNA, 21 nt, Human
uugcggccaguauuagacugg

SEQ ID NO: 3767161 - RNA, 14 nt, Human
uugcggggggaggg

SEQ ID NO: 3767162 - RNA, 14 nt, Human
uugcgguucaggaa

SEQ ID NO: 3767163 - RNA, 14 nt, Human
uugcguaugucugu

SEQ ID NO: 3767164 - RNA, 18 nt, Human
uugcguaugucuguuacc

SEQ ID NO: 3767165 - RNA, 21 nt, Human
uugcguggaauugugcugagu

SEQ ID NO: 3767166 - RNA, 12 nt, Human
uugcuaaaugua

SEQ ID NO: 3767167 - RNA, 23 nt, Human
uugcuaacagcaacacaaagcuu

SEQ ID NO: 3767168 - RNA, 13 nt, Human
uugcuaacugaac

SEQ ID NO: 3767169 - RNA, 14 nt, Human
uugcuaagaugcuc

SEQ ID NO: 3767170 - RNA, 16 nt, Human
uugcuaagaugcucua

SEQ ID NO: 3767171 - RNA, 17 nt, Human
uugcuaaguaaaucucu

SEQ ID NO: 3767172 - RNA, 16 nt, Human
uugcuaaucaaagcca

SEQ ID NO: 3767173 - RNA, 18 nt, Human
uugcuaaucaaagccagg

SEQ ID NO: 3767174 - RNA, 22 nt, Human
uugcuaaucaaagccagggucu

SEQ ID NO: 3767175 - RNA, 14 nt, Human
uugcuaaucagugu

SEQ ID NO: 3767176 - RNA, 14 nt, Human
uugcuaauugcugu

SEQ ID NO: 3767177 - RNA, 15 nt, Human
uugcuaauuuuuauu

SEQ ID NO: 3767178 - RNA, 22 nt, Human
uugcuacuuccugccuggucuc

SEQ ID NO: 3767179 - RNA, 21 nt, Human
uugcuagagcuccucccucuc

SEQ ID NO: 3767180 - RNA, 15 nt, Human
uugcuaguauuugaa

SEQ ID NO: 3767181 - RNA, 16 nt, Human
uugcuaguauuugaau

SEQ ID NO: 3767182 - RNA, 13 nt, Human
uugcuaucauugu

SEQ ID NO: 3767183 - RNA, 18 nt, Human
uugcuaucggggaagcca

SEQ ID NO: 3767184 - RNA, 15 nt, Human
uugcuaucuauugau

SEQ ID NO: 3767185 - RNA, 14 nt, Human
uugcuaucucuauu

SEQ ID NO: 3767186 - RNA, 23 nt, Human
uugcuaucuggaggccuuccagc

SEQ ID NO: 3767187 - RNA, 13 nt, Human
uugcuaucuuaau

SEQ ID NO: 3767188 - RNA, 15 nt, Human
uugcuauguuacuau

SEQ ID NO: 3767189 - RNA, 16 nt, Human
uugcuauguuacuauu

SEQ ID NO: 3767190 - RNA, 14 nt, Human
uugcuauuagagca

SEQ ID NO: 3767191 - RNA, 13 nt, Human
uugcuauucuguc

SEQ ID NO: 3767192 - RNA, 12 nt, Human
uugcuauuguaa

SEQ ID NO: 3767193 - RNA, 15 nt, Human
uugcuauuguaaaua

SEQ ID NO: 3767194 - RNA, 16 nt, Human
uugcuauuuuuguaaa

SEQ ID NO: 3767195 - RNA, 15 nt, Human
uugcucaaaaaauga

SEQ ID NO: 3767196 - RNA, 17 nt, Human
uugcucaaaaaaugagc

SEQ ID NO: 3767197 - RNA, 18 nt, Human
uugcucaaaaaaugagcu

SEQ ID NO: 3767198 - RNA, 16 nt, Human
uugcucaaaaaucugu

SEQ ID NO: 3767199 - RNA, 20 nt, Human
uugcucacaguuauuacaua

SEQ ID NO: 3767200 - RNA, 16 nt, Human
uugcucauauuuccca

SEQ ID NO: 3767201 - RNA, 23 nt, Human
uugcucaucucaguccucaaagc

SEQ ID NO: 3767202 - RNA, 12 nt, Human
uugcucauggaa

SEQ ID NO: 3767203 - RNA, 17 nt, Human
uugcuccaccccacuca

SEQ ID NO: 3767204 - RNA, 15 nt, Human
uugcucccuucagcc

SEQ ID NO: 3767205 - RNA, 13 nt, Human
uugcuccgccucu

SEQ ID NO: 3767206 - RNA, 21 nt, Human
uugcucuaaaauauuuaugaa

SEQ ID NO: 3767207 - RNA, 22 nt, Human
uugcucucccgguucuuccagu

SEQ ID NO: 3767208 - RNA, 13 nt, Human
uugcucucccucu

SEQ ID NO: 3767209 - RNA, 23 nt, Human
uugcucucccucuucucaagugc

SEQ ID NO: 3767210 - RNA, 13 nt, Human
uugcucugcaccc

SEQ ID NO: 3767211 - RNA, 20 nt, Human
uugcucugccaacuucuuca

SEQ ID NO: 3767212 - RNA, 13 nt, Human
uugcucuggaccu

SEQ ID NO: 3767213 - RNA, 16 nt, Human
uugcucuggaccugcc

SEQ ID NO: 3767214 - RNA, 14 nt, Human
uugcucuggcugag

SEQ ID NO: 3767215 - RNA, 19 nt, Human
uugcucuuaaguuguggag

SEQ ID NO: 3767216 - RNA, 14 nt, Human
uugcucuugaugcc

SEQ ID NO: 3767217 - RNA, 17 nt, Human
uugcugaaaaugguauu

SEQ ID NO: 3767218 - RNA, 14 nt, Human
uugcugaaagaucu

SEQ ID NO: 3767219 - RNA, 18 nt, Human
uugcugaacauuggagaa

SEQ ID NO: 3767220 - RNA, 19 nt, Human
uugcugaagggcauucuuu

SEQ ID NO: 3767221 - RNA, 21 nt, Human
uugcugaagggcauucuuucc

SEQ ID NO: 3767222 - RNA, 15 nt, Human
uugcugaaugcaaga

SEQ ID NO: 3767223 - RNA, 15 nt, Human
uugcugacccucccc

SEQ ID NO: 3767224 - RNA, 22 nt, Human
uugcugaccucagcgguugcca

SEQ ID NO: 3767225 - RNA, 15 nt, Human
uugcugacuuagaau

SEQ ID NO: 3767226 - RNA, 15 nt, Human
uugcugagccucugc

SEQ ID NO: 3767227 - RNA, 20 nt, Human
uugcugauggugcaaugacc

SEQ ID NO: 3767228 - RNA, 22 nt, Human
uugcugauggugcaaugaccuu

SEQ ID NO: 3767229 - RNA, 17 nt, Human
uugcugauuuccccucu

SEQ ID NO: 3767230 - RNA, 16 nt, Human
uugcugauuuuaaugg

SEQ ID NO: 3767231 - RNA, 18 nt, Human
uugcugauuuuaauggau

SEQ ID NO: 3767232 - RNA, 17 nt, Human
uugcugcacucuugcac

SEQ ID NO: 3767233 - RNA, 19 nt, Human
uugcugcacucuugcacau

SEQ ID NO: 3767234 - RNA, 16 nt, Human
uugcugcauggcaggg

SEQ ID NO: 3767235 - RNA, 16 nt, Human
uugcugcccugcccca

SEQ ID NO: 3767236 - RNA, 11 nt, Human
uugcugccuca

SEQ ID NO: 3767237 - RNA, 16 nt, Human
uugcugcuagaacuuu

SEQ ID NO: 3767238 - RNA, 18 nt, Human
uugcugcuagaacuuuuu

SEQ ID NO: 3767239 - RNA, 19 nt, Human
uugcugcugauuuaaacac

SEQ ID NO: 3767240 - RNA, 12 nt, Human
uugcugcugucu

SEQ ID NO: 3767241 - RNA, 13 nt, Human
uugcugcuucucc

SEQ ID NO: 3767242 - RNA, 14 nt, Human
uugcuggaaagagc

SEQ ID NO: 3767243 - RNA, 21 nt, Human
uugcuggaagacgcaagggcc

SEQ ID NO: 3767244 - RNA, 21 nt, Human
uugcuggacggggacugggga

SEQ ID NO: 3767245 - RNA, 23 nt, Human
uugcuggacugucauagaaauua

SEQ ID NO: 3767246 - RNA, 16 nt, Human
uugcuggcaaagacag

SEQ ID NO: 3767247 - RNA, 22 nt, Human
uugcuggccaguccacccugcc

SEQ ID NO: 3767248 - RNA, 12 nt, Human
uugcuggcugga

SEQ ID NO: 3767249 - RNA, 14 nt, Human
uugcugguacacac

SEQ ID NO: 3767250 - RNA, 18 nt, Human
uugcuggucuuguaagag

SEQ ID NO: 3767251 - RNA, 14 nt, Human
uugcugguugcugu

SEQ ID NO: 3767252 - RNA, 22 nt, Human
uugcugguugcugugugguuug

SEQ ID NO: 3767253 - RNA, 18 nt, Human
uugcuguaagaugucugu

SEQ ID NO: 3767254 - RNA, 16 nt, Human
uugcuguaauguuaau

SEQ ID NO: 3767255 - RNA, 17 nt, Human
uugcuguacaaaagcaa

SEQ ID NO: 3767256 - RNA, 21 nt, Human
uugcuguaccagcccagaugu

SEQ ID NO: 3767257 - RNA, 19 nt, Human
uugcuguaggaucuaaggc

SEQ ID NO: 3767258 - RNA, 16 nt, Human
uugcuguauaaguuau

SEQ ID NO: 3767259 - RNA, 11 nt, Human
uugcuguauau

SEQ ID NO: 3767260 - RNA, 18 nt, Human
uugcuguaugcugaucau

SEQ ID NO: 3767261 - RNA, 21 nt, Human
uugcugucauaagaaugaaua

SEQ ID NO: 3767262 - RNA, 15 nt, Human
uugcuguccuaggcc

SEQ ID NO: 3767263 - RNA, 16 nt, Human
uugcuguccugaucug

SEQ ID NO: 3767264 - RNA, 14 nt, Human
uugcugucucugcu

SEQ ID NO: 3767265 - RNA, 14 nt, Human
uugcugugaggcug

SEQ ID NO: 3767266 - RNA, 19 nt, Human
uugcugugaggcuguccug

SEQ ID NO: 3767267 - RNA, 12 nt, Human
uugcugugggaa

SEQ ID NO: 3767268 - RNA, 23 nt, Human
uugcugugggaacgagaggggaa

SEQ ID NO: 3767269 - RNA, 19 nt, Human
uugcuguguccaacuccag

SEQ ID NO: 3767270 - RNA, 20 nt, Human
uugcugugugucccaggcag

SEQ ID NO: 3767271 - RNA, 22 nt, Human
uugcuguugaaagcaaaaaugc

SEQ ID NO: 3767272 - RNA, 14 nt, Human
uugcuguugcuuga

SEQ ID NO: 3767273 - RNA, 13 nt, Human
uugcuguuuccuu

SEQ ID NO: 3767274 - RNA, 15 nt, Human
uugcuguuuccuuuu

SEQ ID NO: 3767275 - RNA, 11 nt, Human
uugggagcacu

SEQ ID NO: 3767276 - RNA, 16 nt, Human
uugggagcacuggagu

SEQ ID NO: 3767277 - RNA, 14 nt, Human
uugggagccucugg

SEQ ID NO: 3767278 - RNA, 22 nt, Human
uugggaggaagcagaauaaagc

SEQ ID NO: 3767279 - RNA, 17 nt, Human
uugggaggccccacugg

SEQ ID NO: 3767280 - RNA, 16 nt, Human
uugggaggccgaggcg

SEQ ID NO: 3767281 - RNA, 12 nt, Human
uugggaguccag

SEQ ID NO: 3767282 - RNA, 19 nt, Human
uugggagugagaugccugc

SEQ ID NO: 3767283 - RNA, 13 nt, Human
uugggaguuuuua

SEQ ID NO: 3767284 - RNA, 19 nt, Human
uugggauccaggccccucc

SEQ ID NO: 3767285 - RNA, 21 nt, Human
uugggauccaggccccucccu

SEQ ID NO: 3767286 - RNA, 19 nt, Human
uugggaugucuuauuuuua

SEQ ID NO: 3767287 - RNA, 13 nt, Human
uugggauuugcug

SEQ ID NO: 3767288 - RNA, 16 nt, Human
uugggauuuuagaaca

SEQ ID NO: 3767289 - RNA, 19 nt, Human
uugggcaauauucucugua

SEQ ID NO: 3767290 - RNA, 17 nt, Human
uugggcacccccagccu

SEQ ID NO: 3767291 - RNA, 23 nt, Human
uugggcacccccagccugggccu

SEQ ID NO: 3767292 - RNA, 16 nt, Human
uugggcacuauuuauu

SEQ ID NO: 3767293 - RNA, 18 nt, Human
uugggcagcaauuuaaau

SEQ ID NO: 3767294 - RNA, 14 nt, Human
uugggccagaagua

SEQ ID NO: 3767295 - RNA, 21 nt, Human
uugggccagaaguaccagacu

SEQ ID NO: 3767296 - RNA, 17 nt, Human
uugggccagacaugcca

SEQ ID NO: 3767297 - RNA, 18 nt, Human
uugggccagcuuuucaaa

SEQ ID NO: 3767298 - RNA, 19 nt, Human
uugggccauacuggccucg

SEQ ID NO: 3767299 - RNA, 16 nt, Human
uugggcccagcugggc

SEQ ID NO: 3767300 - RNA, 13 nt, Human
uugggcccaggga

SEQ ID NO: 3767301 - RNA, 13 nt, Human
uugggcccugcau

SEQ ID NO: 3767302 - RNA, 17 nt, Human
uugggccugcuccagac

SEQ ID NO: 3767303 - RNA, 21 nt, Human
uugggcgccgugcugggcagc

SEQ ID NO: 3767304 - RNA, 18 nt, Human
uugggcggcugagagccc

SEQ ID NO: 3767305 - RNA, 14 nt, Human
uugggcucugauga

SEQ ID NO: 3767306 - RNA, 22 nt, Human
uugggcugugcggaucucugga

SEQ ID NO: 3767307 - RNA, 14 nt, Human
uugggcuucagccu

SEQ ID NO: 3767308 - RNA, 23 nt, Human
uugggcuugcuauucugucccua

SEQ ID NO: 3767309 - RNA, 19 nt, Human
uuggggacaucucuuugaa

SEQ ID NO: 3767310 - RNA, 22 nt, Human
uuggggaggagggggccgggcg

SEQ ID NO: 3767311 - RNA, 20 nt, Human
uuggggaguuaagaccuggc

SEQ ID NO: 3767312 - RNA, 21 nt, Human
uuggggaguuaagaccuggca

SEQ ID NO: 3767313 - RNA, 16 nt, Human
uuggggauguuuuucu

SEQ ID NO: 3767314 - RNA, 22 nt, Human
uuggggcaacauuguucaccuu

SEQ ID NO: 3767315 - RNA, 16 nt, Human
uuggggcaagucaugu

SEQ ID NO: 3767316 - RNA, 22 nt, Human
uuggggcaggaguagcugagcu

SEQ ID NO: 3767317 - RNA, 23 nt, Human
uuggggcaggaguagcugagcuc

SEQ ID NO: 3767318 - RNA, 23 nt, Human
uuggggccaccaaagcugcccac

SEQ ID NO: 3767319 - RNA, 13 nt, Human
uuggggcccugcc

SEQ ID NO: 3767320 - RNA, 21 nt, Human
uuggggcgaggcagaggacag

SEQ ID NO: 3767321 - RNA, 13 nt, Human
uuggggcucccag

SEQ ID NO: 3767322 - RNA, 21 nt, Human
uuggggcuuuacauacuuuau

SEQ ID NO: 3767323 - RNA, 22 nt, Human
uugggggaggggagacuuugau

SEQ ID NO: 3767324 - RNA, 14 nt, Human
uugggggcuggugc

SEQ ID NO: 3767325 - RNA, 16 nt, Human
uugggggcuggugcca

SEQ ID NO: 3767326 - RNA, 23 nt, Human
uuggggggaguaaagaauuauuu

SEQ ID NO: 3767327 - RNA, 21 nt, Human
uugggggggcucccguggccu

SEQ ID NO: 3767328 - RNA, 20 nt, Human
uugggggucagugcugccug

SEQ ID NO: 3767329 - RNA, 15 nt, Human
uuggggucagccagg

SEQ ID NO: 3767330 - RNA, 14 nt, Human
uuggggucugaccc

SEQ ID NO: 3767331 - RNA, 15 nt, Human
uuggggucugacccc

SEQ ID NO: 3767332 - RNA, 18 nt, Human
uugggguggguauaaaag

SEQ ID NO: 3767333 - RNA, 15 nt, Human
uugggguuguguugu

SEQ ID NO: 3767334 - RNA, 16 nt, Human
uugggguuguguuguc

SEQ ID NO: 3767335 - RNA, 19 nt, Human
uugggucaccccuccagga

SEQ ID NO: 3767336 - RNA, 12 nt, Human
uuggguccagga

SEQ ID NO: 3767337 - RNA, 18 nt, Human
uuggguggagaagccauu

SEQ ID NO: 3767338 - RNA, 22 nt, Human
uuggguggggggcuucauacac

SEQ ID NO: 3767339 - RNA, 19 nt, Human
uuggguguaacaggucucc

SEQ ID NO: 3767340 - RNA, 18 nt, Human
uuggguuacuauuucuug

SEQ ID NO: 3767341 - RNA, 12 nt, Human
uuggguuagacc

SEQ ID NO: 3767342 - RNA, 16 nt, Human
uuggguuagaccuaca

SEQ ID NO: 3767343 - RNA, 20 nt, Human
uuggguuaggagaagucaag

SEQ ID NO: 3767344 - RNA, 17 nt, Human
uuggguucauuauugga

SEQ ID NO: 3767345 - RNA, 16 nt, Human
uuggguuccauucuca

SEQ ID NO: 3767346 - RNA, 18 nt, Human
uugguaaaacucacugug

SEQ ID NO: 3767347 - RNA, 16 nt, Human
uugguaaauuucccca

SEQ ID NO: 3767348 - RNA, 22 nt, Human
uugguaaauuuccccaacagug

SEQ ID NO: 3767349 - RNA, 19 nt, Human
uugguaacauccuuucuau

SEQ ID NO: 3767350 - RNA, 21 nt, Human
uugguaacauccuuucuauug

SEQ ID NO: 3767351 - RNA, 14 nt, Human
uugguaacuuuugu

SEQ ID NO: 3767352 - RNA, 15 nt, Human
uugguaacuuuugug

SEQ ID NO: 3767353 - RNA, 18 nt, Human
uugguaagagacagaaug

SEQ ID NO: 3767354 - RNA, 20 nt, Human
uugguaaggggaauugagga

SEQ ID NO: 3767355 - RNA, 12 nt, Human
uugguaaugugu

SEQ ID NO: 3767356 - RNA, 15 nt, Human
uugguaauuauuuug

SEQ ID NO: 3767357 - RNA, 15 nt, Human
uugguacaaaaauaa

SEQ ID NO: 3767358 - RNA, 13 nt, Human
uugguaccuugca

SEQ ID NO: 3767359 - RNA, 13 nt, Human
uugguagauuaaa

SEQ ID NO: 3767360 - RNA, 15 nt, Human
uugguagauuaaaua

SEQ ID NO: 3767361 - RNA, 18 nt, Human
uugguauuaauaaaaaga

SEQ ID NO: 3767362 - RNA, 16 nt, Human
uugguauuuaucuauu

SEQ ID NO: 3767363 - RNA, 22 nt, Human
uugguauuuaucuauuguaaga

SEQ ID NO: 3767364 - RNA, 23 nt, Human
uugguauuuaucuauuguaagau

SEQ ID NO: 3767365 - RNA, 15 nt, Human
uugguauuugaaaca

SEQ ID NO: 3767366 - RNA, 20 nt, Human
uuggucagaguaagcugcuu

SEQ ID NO: 3767367 - RNA, 15 nt, Human
uugguccaagauucc

SEQ ID NO: 3767368 - RNA, 17 nt, Human
uugguccacuuuuccag

SEQ ID NO: 3767369 - RNA, 12 nt, Human
uugguccagagc

SEQ ID NO: 3767370 - RNA, 15 nt, Human
uugguccucuugccu

SEQ ID NO: 3767371 - RNA, 13 nt, Human
uugguccugcugc

SEQ ID NO: 3767372 - RNA, 21 nt, Human
uugguccuggaggcucaaauu

SEQ ID NO: 3767373 - RNA, 17 nt, Human
uugguccuguccccgca

SEQ ID NO: 3767374 - RNA, 17 nt, Human
uuggucuaauuuauuca

SEQ ID NO: 3767375 - RNA, 21 nt, Human
uuggucucccauaugcagaaa

SEQ ID NO: 3767376 - RNA, 14 nt, Human
uuggucucuauuuc

SEQ ID NO: 3767377 - RNA, 17 nt, Human
uuggucugggacuuccu

SEQ ID NO: 3767378 - RNA, 14 nt, Human
uuggucuguacuga

SEQ ID NO: 3767379 - RNA, 15 nt, Human
uuggucuuauuuauu

SEQ ID NO: 3767380 - RNA, 18 nt, Human
uuggucuugccccaucac

SEQ ID NO: 3767381 - RNA, 13 nt, Human
uuggucuuuguau

SEQ ID NO: 3767382 - RNA, 14 nt, Human
uuggugagaaccug

SEQ ID NO: 3767383 - RNA, 16 nt, Human
uuggugauuccgcagu

SEQ ID NO: 3767384 - RNA, 17 nt, Human
uuggugcacagugauuu

SEQ ID NO: 3767385 - RNA, 15 nt, Human
uuggugcauagaacu

SEQ ID NO: 3767386 - RNA, 22 nt, Human
uuggugcauagaacuggguaaa

SEQ ID NO: 3767387 - RNA, 22 nt, Human
uuggugccuggccuggcacaca

SEQ ID NO: 3767388 - RNA, 14 nt, Human
uuggugccuuuccu

SEQ ID NO: 3767389 - RNA, 21 nt, Human
uuggugccuuuccuguucagc

SEQ ID NO: 3767390 - RNA, 16 nt, Human
uuggugcgggguacac

SEQ ID NO: 3767391 - RNA, 14 nt, Human
uuggugcugggaac

SEQ ID NO: 3767392 - RNA, 22 nt, Human
uuggugcuuacacaucucagac

SEQ ID NO: 3767393 - RNA, 17 nt, Human
uugguggaaucuuuagc

SEQ ID NO: 3767394 - RNA, 16 nt, Human
uugguggauguaaaua

SEQ ID NO: 3767395 - RNA, 14 nt, Human
uugguggccacaua

SEQ ID NO: 3767396 - RNA, 15 nt, Human
uugguggcuuauggg

SEQ ID NO: 3767397 - RNA, 23 nt, Human
uugguguaacaucuucaacaugu

SEQ ID NO: 3767398 - RNA, 21 nt, Human
uuggugucaacaugaaacacc

SEQ ID NO: 3767399 - RNA, 21 nt, Human
uugguguggcccauggcuguu

SEQ ID NO: 3767400 - RNA, 18 nt, Human
uugguguugucauuguaa

SEQ ID NO: 3767401 - RNA, 12 nt, Human
uugguguuuuuu

SEQ ID NO: 3767402 - RNA, 22 nt, Human
uugguuaaaacuguacauuuaa

SEQ ID NO: 3767403 - RNA, 13 nt, Human
uugguuauacaug

SEQ ID NO: 3767404 - RNA, 14 nt, Human
uugguuauacauga

SEQ ID NO: 3767405 - RNA, 23 nt, Human
uugguuauacaugacacugaaau

SEQ ID NO: 3767406 - RNA, 23 nt, Human
uugguuauagugcaauauauuuu

SEQ ID NO: 3767407 - RNA, 17 nt, Human
uugguucaucaguguua

SEQ ID NO: 3767408 - RNA, 20 nt, Human
uugguucaucaguguuaaaa

SEQ ID NO: 3767409 - RNA, 14 nt, Human
uugguucauuaauu

SEQ ID NO: 3767410 - RNA, 16 nt, Human
uugguucccuuugcuc

SEQ ID NO: 3767411 - RNA, 14 nt, Human
uugguucuaaggac

SEQ ID NO: 3767412 - RNA, 15 nt, Human
uugguucugugaaca

SEQ ID NO: 3767413 - RNA, 13 nt, Human
uugguugaauaaa

SEQ ID NO: 3767414 - RNA, 16 nt, Human
uugguuguauucuuug

SEQ ID NO: 3767415 - RNA, 22 nt, Human
uugguuuaaagaaaguguauuu

SEQ ID NO: 3767416 - RNA, 16 nt, Human
uugguuuaauuuaaag

SEQ ID NO: 3767417 - RNA, 14 nt, Human
uugguuuacauuua

SEQ ID NO: 3767418 - RNA, 17 nt, Human
uugguuucuagcaugaa

SEQ ID NO: 3767419 - RNA, 16 nt, Human
uugguuucucuucucc

SEQ ID NO: 3767420 - RNA, 13 nt, Human
uuucagcuuaaaa

SEQ ID NO: 3767421 - RNA, 17 nt, Human
uuucaggagcagccuca

SEQ ID NO: 3767422 - RNA, 12 nt, Human
uuucaggaggaa

SEQ ID NO: 3767423 - RNA, 18 nt, Human
uuucaggaggaauacuga

SEQ ID NO: 3767424 - RNA, 22 nt, Human
uuucaggaggaauacugaacau

SEQ ID NO: 3767425 - RNA, 19 nt, Human
uuucaggcauuggauauuu

SEQ ID NO: 3767426 - RNA, 21 nt, Human
uuucaggggucgucaccaccu

SEQ ID NO: 3767427 - RNA, 16 nt, Human
uuucaggugacaugug

SEQ ID NO: 3767428 - RNA, 19 nt, Human
uuucaggugacaugugaaa

SEQ ID NO: 3767429 - RNA, 20 nt, Human
uuucaggugacaugugaaac

SEQ ID NO: 3767430 - RNA, 20 nt, Human
uuucaggugcucaaaaugca

SEQ ID NO: 3767431 - RNA, 22 nt, Human
uuucaggugcucaaaaugcaaa

SEQ ID NO: 3767432 - RNA, 21 nt, Human
uuucagguucaguauuaugua

SEQ ID NO: 3767433 - RNA, 20 nt, Human
uuucaguaauaaaacaucuu

SEQ ID NO: 3767434 - RNA, 22 nt, Human
uuucaguacuucagcaagagag

SEQ ID NO: 3767435 - RNA, 15 nt, Human
uuucagucaaaacuu

SEQ ID NO: 3767436 - RNA, 17 nt, Human
uuucagucuuuuccugu

SEQ ID NO: 3767437 - RNA, 19 nt, Human
uuucagugaauaugccugu

SEQ ID NO: 3767438 - RNA, 11 nt, Human
uuucagugagg

SEQ ID NO: 3767439 - RNA, 20 nt, Human
uuucaguuauugucccuggc

SEQ ID NO: 3767440 - RNA, 13 nt, Human
uuucaguuccaag

SEQ ID NO: 3767441 - RNA, 15 nt, Human
uuucaguucuaggaa

SEQ ID NO: 3767442 - RNA, 21 nt, Human
uuucaguugaucacuggcaau

SEQ ID NO: 3767443 - RNA, 14 nt, Human
uuucaguuuguugg

SEQ ID NO: 3767444 - RNA, 15 nt, Human
uuucaguuuucagga

SEQ ID NO: 3767445 - RNA, 17 nt, Human
uuucauaaacaaguucg

SEQ ID NO: 3767446 - RNA, 20 nt, Human
uuucauaacuuauugcugau

SEQ ID NO: 3767447 - RNA, 14 nt, Human
uuucauaaguauuu

SEQ ID NO: 3767448 - RNA, 18 nt, Human
uuucauaaguauuucaaa

SEQ ID NO: 3767449 - RNA, 14 nt, Human
uuucauaaucuuug

SEQ ID NO: 3767450 - RNA, 20 nt, Human
uuucauacauuuucuaagaa

SEQ ID NO: 3767451 - RNA, 14 nt, Human
uuucauagcuaaaa

SEQ ID NO: 3767452 - RNA, 14 nt, Human
uuucauaggaagac

SEQ ID NO: 3767453 - RNA, 15 nt, Human
uuucauaguucagaa

SEQ ID NO: 3767454 - RNA, 20 nt, Human
uuucauaguuggggucauag

SEQ ID NO: 3767455 - RNA, 18 nt, Human
uuucauauaaauggaauu

SEQ ID NO: 3767456 - RNA, 21 nt, Human
uuucauauaggaauagaaaca

SEQ ID NO: 3767457 - RNA, 12 nt, Human
uuucauaucauu

SEQ ID NO: 3767458 - RNA, 17 nt, Human
uuucauaucuacagaua

SEQ ID NO: 3767459 - RNA, 15 nt, Human
uuucauaugcuguau

SEQ ID NO: 3767460 - RNA, 12 nt, Human
uuucauauugug

SEQ ID NO: 3767461 - RNA, 14 nt, Human
uuucauauugugcc

SEQ ID NO: 3767462 - RNA, 13 nt, Human
uuucauauuucuu

SEQ ID NO: 3767463 - RNA, 17 nt, Human
uuucauauuuuaaacag

SEQ ID NO: 3767464 - RNA, 22 nt, Human
uuucauauuuuaauuucaagcu

SEQ ID NO: 3767465 - RNA, 17 nt, Human
uuucaucauauuauaca

SEQ ID NO: 3767466 - RNA, 20 nt, Human
uuucaucauucacuucacug

SEQ ID NO: 3767467 - RNA, 16 nt, Human
uuucaucauuguuucu

SEQ ID NO: 3767468 - RNA, 17 nt, Human
uuucauccauaacugaa

SEQ ID NO: 3767469 - RNA, 22 nt, Human
uuucauccccuuacccuuagaa

SEQ ID NO: 3767470 - RNA, 19 nt, Human
uuucauccuaaagaacaaa

SEQ ID NO: 3767471 - RNA, 14 nt, Human
uuucauccuuccca

SEQ ID NO: 3767472 - RNA, 16 nt, Human
uuucauccuucccacu

SEQ ID NO: 3767473 - RNA, 16 nt, Human
uuucaucuauuucuga

SEQ ID NO: 3767474 - RNA, 21 nt, Human
uuucaucucauuuaagggaaa

SEQ ID NO: 3767475 - RNA, 22 nt, Human
uuucaucucauuuaagggaaaa

SEQ ID NO: 3767476 - RNA, 11 nt, Human
uuucaucugcu

SEQ ID NO: 3767477 - RNA, 19 nt, Human
uuucaucugcucuccuucc

SEQ ID NO: 3767478 - RNA, 22 nt, Human
uuucaucugcucuccuuccugg

SEQ ID NO: 3767479 - RNA, 15 nt, Human
uuucaucugggaaag

SEQ ID NO: 3767480 - RNA, 16 nt, Human
uuucaucugggaaaga

SEQ ID NO: 3767481 - RNA, 18 nt, Human
uuucaucugggaaagaca

SEQ ID NO: 3767482 - RNA, 19 nt, Human
uuucaucugggaaagacau

SEQ ID NO: 3767483 - RNA, 16 nt, Human
uuucaucuucaguugu

SEQ ID NO: 3767484 - RNA, 14 nt, Human
uuucaugaaaauac

SEQ ID NO: 3767485 - RNA, 17 nt, Human
uuucaugaccaguaaag

SEQ ID NO: 3767486 - RNA, 24 nt, Human
uuucaugaccaguaaaggcugcug

SEQ ID NO: 3767487 - RNA, 21 nt, Human
uuucaugcaaacucuuugguc

SEQ ID NO: 3767488 - RNA, 13 nt, Human
uuucaugcuuuau

SEQ ID NO: 3767489 - RNA, 18 nt, Human
uuucauggacacuuugaa

SEQ ID NO: 3767490 - RNA, 20 nt, Human
uuucauggcugcuguugcuu

SEQ ID NO: 3767491 - RNA, 22 nt, Human
uuucauggggugaugcugggcu

SEQ ID NO: 3767492 - RNA, 20 nt, Human
uuucauggugaaaauguacu

SEQ ID NO: 3767493 - RNA, 21 nt, Human
uuucauggugaaaauguacug

SEQ ID NO: 3767494 - RNA, 22 nt, Human
uuucauguacugcauuauuuga

SEQ ID NO: 3767495 - RNA, 23 nt, Human
uuucauguugcacacccacucag

SEQ ID NO: 3767496 - RNA, 19 nt, Human
uuucauguuuuaacaaaaa

SEQ ID NO: 3767497 - RNA, 15 nt, Human
uuucauguuuuugau

SEQ ID NO: 3767498 - RNA, 14 nt, Human
uuucauuaaagcau

SEQ ID NO: 3767499 - RNA, 14 nt, Human
uuucauuaaauaaa

SEQ ID NO: 3767500 - RNA, 17 nt, Human
uuucauuaaauaaauuu

SEQ ID NO: 3767501 - RNA, 16 nt, Human
uuucauuaaauccuuu

SEQ ID NO: 3767502 - RNA, 16 nt, Human
uuucauuacaauggaa

SEQ ID NO: 3767503 - RNA, 12 nt, Human
uuucauuagcaa

SEQ ID NO: 3767504 - RNA, 14 nt, Human
uuucauuagcaaaa

SEQ ID NO: 3767505 - RNA, 15 nt, Human
uuucauuagcaaaaa

SEQ ID NO: 3767506 - RNA, 23 nt, Human
uuucauuagcaaaaaaaguugua

SEQ ID NO: 3767507 - RNA, 20 nt, Human
uuucauuauguaaaauguuu

SEQ ID NO: 3767508 - RNA, 21 nt, Human
uuucauuauuaguacugcucu

SEQ ID NO: 3767509 - RNA, 14 nt, Human
uuucauuccaaagg

SEQ ID NO: 3767510 - RNA, 22 nt, Human
uuucauugacuaucaaacugaa

SEQ ID NO: 3767511 - RNA, 22 nt, Human
uuucauugauaugaaaaauaug

SEQ ID NO: 3767512 - RNA, 17 nt, Human
uuucauugccuguguau

SEQ ID NO: 3767513 - RNA, 22 nt, Human
uuucauugcugggcuugucugu

SEQ ID NO: 3767514 - RNA, 22 nt, Human
uuucauuggaaauuaggaugua

SEQ ID NO: 3767515 - RNA, 16 nt, Human
uuucauuguaugaugu

SEQ ID NO: 3767516 - RNA, 23 nt, Human
uuucauuuaagggaaagaaaaug

SEQ ID NO: 3767517 - RNA, 14 nt, Human
uuucauuucaacug

SEQ ID NO: 3767518 - RNA, 14 nt, Human
uuucauuugccuau

SEQ ID NO: 3767519 - RNA, 19 nt, Human
uuucauuugguucauuaau

SEQ ID NO: 3767520 - RNA, 14 nt, Human
uuucauuuuccaau

SEQ ID NO: 3767521 - RNA, 18 nt, Human
uuucauuuucucucaggu

SEQ ID NO: 3767522 - RNA, 15 nt, Human
uuucauuuucugcaa

SEQ ID NO: 3767523 - RNA, 16 nt, Human
uuucauuuugcuuuaa

SEQ ID NO: 3767524 - RNA, 23 nt, Human
uuucauuuugcuuuaauuuuagc

SEQ ID NO: 3767525 - RNA, 15 nt, Human
uuuccaaaacaaaaa

SEQ ID NO: 3767526 - RNA, 19 nt, Human
uuuccaaaauaaaacaaag

SEQ ID NO: 3767527 - RNA, 16 nt, Human
uuuccaaaauuuuuca

SEQ ID NO: 3767528 - RNA, 16 nt, Human
uuuccaaacaacagaa

SEQ ID NO: 3767529 - RNA, 16 nt, Human
uuuccaaacugacuca

SEQ ID NO: 3767530 - RNA, 14 nt, Human
uuuccaaaggcauu

SEQ ID NO: 3767531 - RNA, 15 nt, Human
uuuccaaaguacacu

SEQ ID NO: 3767532 - RNA, 22 nt, Human
uuuccaaauuauuucuuaauua

SEQ ID NO: 3767533 - RNA, 23 nt, Human
uuuccaaauucacaaguuguguu

SEQ ID NO: 3767534 - RNA, 12 nt, Human
uuuccaacuacu

SEQ ID NO: 3767535 - RNA, 13 nt, Human
uuuccaagcaaau

SEQ ID NO: 3767536 - RNA, 18 nt, Human
uuuccaagcaaauguuac

SEQ ID NO: 3767537 - RNA, 21 nt, Human
uuuccaagcaaauguuacaua

SEQ ID NO: 3767538 - RNA, 19 nt, Human
uuuccaagccucucuggca

SEQ ID NO: 3767539 - RNA, 13 nt, Human
uuuccaaggagcu

SEQ ID NO: 3767540 - RNA, 18 nt, Human
uuuccaaggagcugagaa

SEQ ID NO: 3767541 - RNA, 22 nt, Human
uuuccaaggagcugagaauaga

SEQ ID NO: 3767542 - RNA, 14 nt, Human
uuuccaaguaauau

SEQ ID NO: 3767543 - RNA, 16 nt, Human
uuuccaagugugcaua

SEQ ID NO: 3767544 - RNA, 17 nt, Human
uuuccaauaugugauuu

SEQ ID NO: 3767545 - RNA, 15 nt, Human
uuuccacaaaucagu

SEQ ID NO: 3767546 - RNA, 15 nt, Human
uuuccacagaagcuc

SEQ ID NO: 3767547 - RNA, 23 nt, Human
uuuccacauaaggaaacuggguu

SEQ ID NO: 3767548 - RNA, 15 nt, Human
uuuccacaugcucug

SEQ ID NO: 3767549 - RNA, 14 nt, Human
uuuccaccuucuca

SEQ ID NO: 3767550 - RNA, 19 nt, Human
uuuccacgaugaaaaacuu

SEQ ID NO: 3767551 - RNA, 21 nt, Human
uuuccacuaagaacaccugca

SEQ ID NO: 3767552 - RNA, 18 nt, Human
uuuccacuccuccuagcc

SEQ ID NO: 3767553 - RNA, 14 nt, Human
uuuccacucuggau

SEQ ID NO: 3767554 - RNA, 12 nt, Human
uuuccacugaag

SEQ ID NO: 3767555 - RNA, 16 nt, Human
uuuccacuucuucauu

SEQ ID NO: 3767556 - RNA, 16 nt, Human
uuuccacuuguucuca

SEQ ID NO: 3767557 - RNA, 18 nt, Human
uuuccacuuguucucagg

SEQ ID NO: 3767558 - RNA, 12 nt, Human
uuuccagagcau

SEQ ID NO: 3767559 - RNA, 18 nt, Human
uuuccagcauucccaggu

SEQ ID NO: 3767560 - RNA, 16 nt, Human
uuuccagcuuucuccc

SEQ ID NO: 3767561 - RNA, 22 nt, Human
uuuccaggcuauguauaaaaua

SEQ ID NO: 3767562 - RNA, 15 nt, Human
uuuccaggcugguuc

SEQ ID NO: 3767563 - RNA, 19 nt, Human
uuuccaggcuucugcuggg

SEQ ID NO: 3767564 - RNA, 12 nt, Human
uuuccaguauuu

SEQ ID NO: 3767565 - RNA, 11 nt, Human
uuucugagccc

SEQ ID NO: 3767566 - RNA, 21 nt, Human
uuucugagcccgggcugccug

SEQ ID NO: 3767567 - RNA, 14 nt, Human
uuucugagcgauua

SEQ ID NO: 3767568 - RNA, 15 nt, Human
uuucugaguuuuacc

SEQ ID NO: 3767569 - RNA, 23 nt, Human
uuucugauaacuagauggugcug

SEQ ID NO: 3767570 - RNA, 15 nt, Human
uuucugaucaaggcc

SEQ ID NO: 3767571 - RNA, 23 nt, Human
uuucugaucugaugcaagcaaga

SEQ ID NO: 3767572 - RNA, 16 nt, Human
uuucugauguugccuu

SEQ ID NO: 3767573 - RNA, 17 nt, Human
uuucugauuagcuuugu

SEQ ID NO: 3767574 - RNA, 20 nt, Human
uuucugauuagcuuuguguu

SEQ ID NO: 3767575 - RNA, 11 nt, Human
uuucugauugu

SEQ ID NO: 3767576 - RNA, 23 nt, Human
uuucugauuguaacguugcugug

SEQ ID NO: 3767577 - RNA, 18 nt, Human
uuucugcacugagcagag

SEQ ID NO: 3767578 - RNA, 21 nt, Human
uuucugcagccacuauuguua

SEQ ID NO: 3767579 - RNA, 13 nt, Human
uuucugcauaugu

SEQ ID NO: 3767580 - RNA, 12 nt, Human
uuucugcccugc

SEQ ID NO: 3767581 - RNA, 20 nt, Human
uuucugcccuggcugcugcc

SEQ ID NO: 3767582 - RNA, 13 nt, Human
uuucugccucuca

SEQ ID NO: 3767583 - RNA, 13 nt, Human
uuucugccuuccu

SEQ ID NO: 3767584 - RNA, 20 nt, Human
uuucugccuuccuugcuaau

SEQ ID NO: 3767585 - RNA, 16 nt, Human
uuucugccuuuuguuc

SEQ ID NO: 3767586 - RNA, 17 nt, Human
uuucugcuuuaaaaaug

SEQ ID NO: 3767587 - RNA, 20 nt, Human
uuucuggaauacaugaaaua

SEQ ID NO: 3767588 - RNA, 23 nt, Human
uuucuggcagguccuccccucuc

SEQ ID NO: 3767589 - RNA, 21 nt, Human
uuucuggccaaaagcaguaaa

SEQ ID NO: 3767590 - RNA, 16 nt, Human
uuucugggauaaguaa

SEQ ID NO: 3767591 - RNA, 19 nt, Human
uuucugggcugucuauucu

SEQ ID NO: 3767592 - RNA, 22 nt, Human
uuucuggggaaagacacugccu

SEQ ID NO: 3767593 - RNA, 17 nt, Human
uuucugguagauagaaa

SEQ ID NO: 3767594 - RNA, 15 nt, Human
uuucugguggucugu

SEQ ID NO: 3767595 - RNA, 22 nt, Human
uuucuguaagaaaccuacugcc

SEQ ID NO: 3767596 - RNA, 19 nt, Human
uuucuguaauucagguuuu

SEQ ID NO: 3767597 - RNA, 23 nt, Human
uuucuguaauucagguuuuuccu

SEQ ID NO: 3767598 - RNA, 14 nt, Human
uuucuguaccaguu

SEQ ID NO: 3767599 - RNA, 15 nt, Human
uuucuguaccaguua

SEQ ID NO: 3767600 - RNA, 20 nt, Human
uuucuguacuuuuuggcaua

SEQ ID NO: 3767601 - RNA, 24 nt, Human
uuucuguagucauuuacuaaacau

SEQ ID NO: 3767602 - RNA, 17 nt, Human
uuucuguauaaaugucu

SEQ ID NO: 3767603 - RNA, 19 nt, Human
uuucugucacaguaaaaau

SEQ ID NO: 3767604 - RNA, 16 nt, Human
uuucugucagaaugcu

SEQ ID NO: 3767605 - RNA, 17 nt, Human
uuucugugccugaauau

SEQ ID NO: 3767606 - RNA, 22 nt, Human
uuucugugugcaccuuaccaac

SEQ ID NO: 3767607 - RNA, 11 nt, Human
uuucugugugu

SEQ ID NO: 3767608 - RNA, 14 nt, Human
uuucuguuaaaaug

SEQ ID NO: 3767609 - RNA, 19 nt, Human
uuucuguuauauaaauggu

SEQ ID NO: 3767610 - RNA, 15 nt, Human
uuucuguuccaaauu

SEQ ID NO: 3767611 - RNA, 20 nt, Human
uuucuguuccaaauucaguu

SEQ ID NO: 3767612 - RNA, 16 nt, Human
uuucuguucuguggaa

SEQ ID NO: 3767613 - RNA, 20 nt, Human
uuucuguucuuucuggcuau

SEQ ID NO: 3767614 - RNA, 23 nt, Human
uuucuguuguaacuuauguagau

SEQ ID NO: 3767615 - RNA, 18 nt, Human
uuucuguugucauugcug

SEQ ID NO: 3767616 - RNA, 22 nt, Human
uuucuguuucuaauuugcugcu

SEQ ID NO: 3767617 - RNA, 12 nt, Human
uuucuuaaaaag

SEQ ID NO: 3767618 - RNA, 16 nt, Human
uuucuuaaacaaaugu

SEQ ID NO: 3767619 - RNA, 13 nt, Human
uuucuuaaagugc

SEQ ID NO: 3767620 - RNA, 21 nt, Human
uuucuuaaauaagaaacuuuu

SEQ ID NO: 3767621 - RNA, 21 nt, Human
uuucuuaaauaaugcuucaga

SEQ ID NO: 3767622 - RNA, 22 nt, Human
uuucuuaaauaaugcuucagau

SEQ ID NO: 3767623 - RNA, 14 nt, Human
uuucuuaacuucuu

SEQ ID NO: 3767624 - RNA, 16 nt, Human
uuucuuaauauauagc

SEQ ID NO: 3767625 - RNA, 15 nt, Human
uuucuuaaucauuuu

SEQ ID NO: 3767626 - RNA, 21 nt, Human
uuucuuaauuauuauaaaaau

SEQ ID NO: 3767627 - RNA, 17 nt, Human
uuucuuaauuuggaaac

SEQ ID NO: 3767628 - RNA, 18 nt, Human
uuucuuaauuuggaaacu

SEQ ID NO: 3767629 - RNA, 14 nt, Human
uuucuuagaaauuu

SEQ ID NO: 3767630 - RNA, 22 nt, Human
uuucuuagaaauuuauuuccua

SEQ ID NO: 3767631 - RNA, 21 nt, Human
uuucuuagcuuuuuaauuguu

SEQ ID NO: 3767632 - RNA, 22 nt, Human
uuucuuagcuuuuuaauuguug

SEQ ID NO: 3767633 - RNA, 19 nt, Human
uuucuuauaauacucuguu

SEQ ID NO: 3767634 - RNA, 21 nt, Human
uuucuuauaauacucuguugu

SEQ ID NO: 3767635 - RNA, 14 nt, Human
uuucuuaugugaca

SEQ ID NO: 3767636 - RNA, 21 nt, Human
uuucuucaaaauguauauauu

SEQ ID NO: 3767637 - RNA, 21 nt, Human
uuucuucaacaucaauguuca

SEQ ID NO: 3767638 - RNA, 18 nt, Human
uuucuucaccaaaucuug

SEQ ID NO: 3767639 - RNA, 16 nt, Human
uuucuucagggcugcu

SEQ ID NO: 3767640 - RNA, 16 nt, Human
uuucuucaugcaauga

SEQ ID NO: 3767641 - RNA, 14 nt, Human
uuucuucccaucac

SEQ ID NO: 3767642 - RNA, 17 nt, Human
uuucuuccuaccaaguc

SEQ ID NO: 3767643 - RNA, 15 nt, Human
uuucuuccuuuacuu

SEQ ID NO: 3767644 - RNA, 13 nt, Human
uuucuucucccuc

SEQ ID NO: 3767645 - RNA, 13 nt, Human
uuucuucucugcu

SEQ ID NO: 3767646 - RNA, 15 nt, Human
uuucuucucugugag

SEQ ID NO: 3767647 - RNA, 23 nt, Human
uuucuucuucaaaccuuugugug

SEQ ID NO: 3767648 - RNA, 21 nt, Human
uuucuugacaaaaccuaacuu

SEQ ID NO: 3767649 - RNA, 18 nt, Human
uuucuugauuugaguuga

SEQ ID NO: 3767650 - RNA, 12 nt, Human
uuucuugccuca

SEQ ID NO: 3767651 - RNA, 13 nt, Human
uuucuugccucau

SEQ ID NO: 3767652 - RNA, 12 nt, Human
uuucuugcuugu

SEQ ID NO: 3767653 - RNA, 21 nt, Human
uuucuuggacacuuaauucug

SEQ ID NO: 3767654 - RNA, 19 nt, Human
uuucuuguaauuuaaacag

SEQ ID NO: 3767655 - RNA, 16 nt, Human
uuucuuguugcuuugu

SEQ ID NO: 3767656 - RNA, 21 nt, Human
uuucuuguugcuuuguugcac

SEQ ID NO: 3767657 - RNA, 20 nt, Human
uuucuuguuuaucagcaguu

SEQ ID NO: 3767658 - RNA, 20 nt, Human
uuucuuuaaaagaaugggca

SEQ ID NO: 3767659 - RNA, 13 nt, Human
uuucuuuaaagau

SEQ ID NO: 3767660 - RNA, 14 nt, Human
uuucuuuaaagaug

SEQ ID NO: 3767661 - RNA, 23 nt, Human
uuucuuuaaccuuguauaaauua

SEQ ID NO: 3767662 - RNA, 18 nt, Human
uuucuuuaaugcuuuuau

SEQ ID NO: 3767663 - RNA, 16 nt, Human
uuucuuuagagaacug

SEQ ID NO: 3767664 - RNA, 19 nt, Human
uuucuuuagagaacugaaa

SEQ ID NO: 3767665 - RNA, 20 nt, Human
uuucuuuagagaacugaaaa

SEQ ID NO: 3767666 - RNA, 23 nt, Human
uuucuuuaucaccuggcuuguuu

SEQ ID NO: 3767667 - RNA, 15 nt, Human
uuucuuucagauuuu

SEQ ID NO: 3767668 - RNA, 11 nt, Human
uuucuuucagu

SEQ ID NO: 3767669 - RNA, 13 nt, Human
uuucuuuccagag

SEQ ID NO: 3767670 - RNA, 22 nt, Human
uuucuuugaaugcuuuuugaau

SEQ ID NO: 3767671 - RNA, 20 nt, Human
uuucuuugaauuuucauuuu

SEQ ID NO: 3767672 - RNA, 19 nt, Human
uuucuuugccaucucugcu

SEQ ID NO: 3767673 - RNA, 17 nt, Human
uuucuuugggaauauuu

SEQ ID NO: 3767674 - RNA, 21 nt, Human
uuucuuuggugccuuuccugu

SEQ ID NO: 3767675 - RNA, 17 nt, Human
uuucuuuguaucauuca

SEQ ID NO: 3767676 - RNA, 15 nt, Human
uuucuuuucuuccug

SEQ ID NO: 3767677 - RNA, 16 nt, Human
uuucuuuugaauuguu

SEQ ID NO: 3767678 - RNA, 24 nt, Human
uuucuuuuguuacuguucuugcug

SEQ ID NO: 3767679 - RNA, 22 nt, Human
uuucuuuuuaaguaauguggaa

SEQ ID NO: 3767680 - RNA, 13 nt, Human
uuucuuuuuacau

SEQ ID NO: 3767681 - RNA, 17 nt, Human
uuucuuuuuauuuuuua

SEQ ID NO: 3767682 - RNA, 20 nt, Human
uuucuuuuugaaucuuuaau

SEQ ID NO: 3767683 - RNA, 14 nt, Human
uuucuuuuuuuccu

SEQ ID NO: 3767684 - RNA, 16 nt, Human
uuugaaaaaaaauaaa

SEQ ID NO: 3767685 - RNA, 16 nt, Human
uuugaaaaaaacuuca

SEQ ID NO: 3767686 - RNA, 20 nt, Human
uuugaaaaagcagacagaag

SEQ ID NO: 3767687 - RNA, 15 nt, Human
uuugaaaaagcgaaa

SEQ ID NO: 3767688 - RNA, 23 nt, Human
uuugaaaaagcgaaaaaaucagg

SEQ ID NO: 3767689 - RNA, 13 nt, Human
uuugaaaaaguua

SEQ ID NO: 3767690 - RNA, 21 nt, Human
uuugaaaaauauaaaauuaug

SEQ ID NO: 3767691 - RNA, 14 nt, Human
uuugaaaacuacau

SEQ ID NO: 3767692 - RNA, 18 nt, Human
uuugaaaacuacauuuua

SEQ ID NO: 3767693 - RNA, 23 nt, Human
uuugaaaacuacauuuuaacaug

SEQ ID NO: 3767694 - RNA, 13 nt, Human
uuugaaaacuuca

SEQ ID NO: 3767695 - RNA, 16 nt, Human
uuugaaaagcagacau

SEQ ID NO: 3767696 - RNA, 13 nt, Human
uuugaaaagcuau

SEQ ID NO: 3767697 - RNA, 14 nt, Human
uuugaaaagcuauu

SEQ ID NO: 3767698 - RNA, 18 nt, Human
uuugaaaagcuauuagcc

SEQ ID NO: 3767699 - RNA, 17 nt, Human
uuugaaaagcuucuuaa

SEQ ID NO: 3767700 - RNA, 14 nt, Human
uuugaaaauaguuu

SEQ ID NO: 3767701 - RNA, 11 nt, Human
uuugaaaaugg

SEQ ID NO: 3767702 - RNA, 16 nt, Human
uuugaaacaauacuca

SEQ ID NO: 3767703 - RNA, 17 nt, Human
uuugaaacacuuugcau

SEQ ID NO: 3767704 - RNA, 21 nt, Human
uuugaaacaugcuuguguuuc

SEQ ID NO: 3767705 - RNA, 18 nt, Human
uuugaaacauugcuuuua

SEQ ID NO: 3767706 - RNA, 22 nt, Human
uuugaaaccccuguaggccuca

SEQ ID NO: 3767707 - RNA, 15 nt, Human
uuugaaaccugcucu

SEQ ID NO: 3767708 - RNA, 19 nt, Human
uuugaaagaaggaagacuu

SEQ ID NO: 3767709 - RNA, 16 nt, Human
ccuggaccaaagcuga

SEQ ID NO: 3767710 - RNA, 16 nt, Human
ccuggaccagaugcug

SEQ ID NO: 3767711 - RNA, 14 nt, Human
ccuggaccagccuc

SEQ ID NO: 3767712 - RNA, 15 nt, Human
ccuggaccagccucu

SEQ ID NO: 3767713 - RNA, 18 nt, Human
ccuggaccccccuuucac

SEQ ID NO: 3767714 - RNA, 13 nt, Human
ccuggaccccugc

SEQ ID NO: 3767715 - RNA, 23 nt, Human
ccuggacccguucaugggggagg

SEQ ID NO: 3767716 - RNA, 12 nt, Human
ccuggaccucug

SEQ ID NO: 3767717 - RNA, 19 nt, Human
ccuggaccucugacagcag

SEQ ID NO: 3767718 - RNA, 20 nt, Human
ccuggaccucugacagcagc

SEQ ID NO: 3767719 - RNA, 20 nt, Human
ccuggaccugccuccugccu

SEQ ID NO: 3767720 - RNA, 19 nt, Human
ccuggaccuuuuguuuucu

SEQ ID NO: 3767721 - RNA, 12 nt, Human
ccuggacucccg

SEQ ID NO: 3767722 - RNA, 13 nt, Human
ccuggacugaggg

SEQ ID NO: 3767723 - RNA, 15 nt, Human
ccuggacugcuaccu

SEQ ID NO: 3767724 - RNA, 22 nt, Human
ccuggacugguggccccugccu

SEQ ID NO: 3767725 - RNA, 17 nt, Human
ccuggacugugugcuca

SEQ ID NO: 3767726 - RNA, 20 nt, Human
ccuggacuuaagcaucuggc

SEQ ID NO: 3767727 - RNA, 12 nt, Human
ccuggagaacua

SEQ ID NO: 3767728 - RNA, 15 nt, Human
ccuggagaccccacc

SEQ ID NO: 3767729 - RNA, 19 nt, Human
ccuggagacuaaccccacc

SEQ ID NO: 3767730 - RNA, 14 nt, Human
ccuggagagccaga

SEQ ID NO: 3767731 - RNA, 14 nt, Human
ccuggagagcuaga

SEQ ID NO: 3767732 - RNA, 21 nt, Human
ccuggagagcuagaaccuaga

SEQ ID NO: 3767733 - RNA, 13 nt, Human
ccuggagauccuc

SEQ ID NO: 3767734 - RNA, 21 nt, Human
ccuggagaugacuugaggccu

SEQ ID NO: 3767735 - RNA, 21 nt, Human
ccuggagcaaucacagaugag

SEQ ID NO: 3767736 - RNA, 15 nt, Human
ccuggagcagaagca

SEQ ID NO: 3767737 - RNA, 22 nt, Human
ccuggagcagaagcagcaacuu

SEQ ID NO: 3767738 - RNA, 18 nt, Human
ccuggagcagaccacccc

SEQ ID NO: 3767739 - RNA, 17 nt, Human
ccuggagcagccacccc

SEQ ID NO: 3767740 - RNA, 18 nt, Human
ccuggagcaggccuugcg

SEQ ID NO: 3767741 - RNA, 18 nt, Human
ccuggagccaacugcugc

SEQ ID NO: 3767742 - RNA, 12 nt, Human
ccuggagcccga

SEQ ID NO: 3767743 - RNA, 17 nt, Human
ccuggagcccuccgccu

SEQ ID NO: 3767744 - RNA, 13 nt, Human
ccuggagcuccug

SEQ ID NO: 3767745 - RNA, 16 nt, Human
ccuggagcuccuggga

SEQ ID NO: 3767746 - RNA, 16 nt, Human
ccuggaggaaccgaaa

SEQ ID NO: 3767747 - RNA, 22 nt, Human
ccuggaggaaccgaaaggccaa

SEQ ID NO: 3767748 - RNA, 12 nt, Human
ccuggaggaccu

SEQ ID NO: 3767749 - RNA, 16 nt, Human
ccuggaggaccugagc

SEQ ID NO: 3767750 - RNA, 22 nt, Human
ccuggaggaccugagccugccg

SEQ ID NO: 3767751 - RNA, 15 nt, Human
ccuggaggaggagca

SEQ ID NO: 3767752 - RNA, 20 nt, Human
ccuggaggaggagcaggggc

SEQ ID NO: 3767753 - RNA, 13 nt, Human
ccuggaggcccag

SEQ ID NO: 3767754 - RNA, 16 nt, Human
ccuggaggcccaguuc

SEQ ID NO: 3767755 - RNA, 20 nt, Human
ccuggaggcggugcggcagg

SEQ ID NO: 3767756 - RNA, 17 nt, Human
ccuggaggcugccuccc

SEQ ID NO: 3767757 - RNA, 14 nt, Human
ccuggagggaagag

SEQ ID NO: 3767758 - RNA, 12 nt, Human
ccuggagggcua

SEQ ID NO: 3767759 - RNA, 23 nt, Human
ccuggagggcuagaaccuggaga

SEQ ID NO: 3767760 - RNA, 21 nt, Human
ccuggaggggcuagaaccuag

SEQ ID NO: 3767761 - RNA, 21 nt, Human
ccuggagggggaauggcagca

SEQ ID NO: 3767762 - RNA, 14 nt, Human
ccuggaggugccag

SEQ ID NO: 3767763 - RNA, 19 nt, Human
ccuggaggugccagcaaag

SEQ ID NO: 3767764 - RNA, 21 nt, Human
ccuggaggugccagcaaagcc

SEQ ID NO: 3767765 - RNA, 23 nt, Human
ccuggaggugccagcaaagcccc

SEQ ID NO: 3767766 - RNA, 22 nt, Human
ccuggagguggcugagccccug

SEQ ID NO: 3767767 - RNA, 20 nt, Human
ccuggaggugggguugggau

SEQ ID NO: 3767768 - RNA, 18 nt, Human
ccuggagucaugccaagc

SEQ ID NO: 3767769 - RNA, 21 nt, Human
ccuggaguguggcugaggagg

SEQ ID NO: 3767770 - RNA, 15 nt, Human
ccuggaguucugguu

SEQ ID NO: 3767771 - RNA, 21 nt, Human
ccuggaucacgacgcugcaga

SEQ ID NO: 3767772 - RNA, 19 nt, Human
ccuggaucuaccuggaggg

SEQ ID NO: 3767773 - RNA, 14 nt, Human
ccuggaucucccug

SEQ ID NO: 3767774 - RNA, 19 nt, Human
ccuggaugcagccucacag

SEQ ID NO: 3767775 - RNA, 16 nt, Human
ccuggaugcccccugu

SEQ ID NO: 3767776 - RNA, 18 nt, Human
ccuggauggggcaggcca

SEQ ID NO: 3767777 - RNA, 18 nt, Human
ccuggaugucugaacuuu

SEQ ID NO: 3767778 - RNA, 17 nt, Human
ccuggauguugugugua

SEQ ID NO: 3767779 - RNA, 12 nt, Human
ccuggauguuug

SEQ ID NO: 3767780 - RNA, 18 nt, Human
ccuggauucauuuccugc

SEQ ID NO: 3767781 - RNA, 14 nt, Human
ccuggauuugcaua

SEQ ID NO: 3767782 - RNA, 23 nt, Human
ccuggcaaagggagcagaacuga

SEQ ID NO: 3767783 - RNA, 13 nt, Human
ccuggcacacauc

SEQ ID NO: 3767784 - RNA, 16 nt, Human
ccuggcacagggcagu

SEQ ID NO: 3767785 - RNA, 18 nt, Human
ccuggcacagggcagugg

SEQ ID NO: 3767786 - RNA, 13 nt, Human
ccuggcacagugu

SEQ ID NO: 3767787 - RNA, 15 nt, Human
ccuggcacagugucu

SEQ ID NO: 3767788 - RNA, 22 nt, Human
ccuggcacagugucugggcuga

SEQ ID NO: 3767789 - RNA, 20 nt, Human
ccuggcacccggccccugcu

SEQ ID NO: 3767790 - RNA, 12 nt, Human
ccuggcacugcu

SEQ ID NO: 3767791 - RNA, 17 nt, Human
ccuggcacugcugugcu

SEQ ID NO: 3767792 - RNA, 21 nt, Human
ccuggcacugcuuccagugag

SEQ ID NO: 3767793 - RNA, 20 nt, Human
ccuggcacuggaccccagca

SEQ ID NO: 3767794 - RNA, 14 nt, Human
ccuggcagaacuga

SEQ ID NO: 3767795 - RNA, 19 nt, Human
ccuggcagagaugccuccc

SEQ ID NO: 3767796 - RNA, 15 nt, Human
ccuggcagcccagag

SEQ ID NO: 3767797 - RNA, 13 nt, Human
ccuggcagccccu

SEQ ID NO: 3767798 - RNA, 19 nt, Human
ccuggcagccgugccuuca

SEQ ID NO: 3767799 - RNA, 21 nt, Human
ccuggcagccgugccuucagc

SEQ ID NO: 3767800 - RNA, 17 nt, Human
ccuggcagcucuggaca

SEQ ID NO: 3767801 - RNA, 23 nt, Human
ccuggcagcucuggacagcccca

SEQ ID NO: 3767802 - RNA, 23 nt, Human
ccuggcagggucauccugugcuc

SEQ ID NO: 3767803 - RNA, 20 nt, Human
ccuggcagguuagaaccuag

SEQ ID NO: 3767804 - RNA, 19 nt, Human
ccuggcauucuuguacagu

SEQ ID NO: 3767805 - RNA, 18 nt, Human
ccuggccacgcagccagg

SEQ ID NO: 3767806 - RNA, 20 nt, Human
ccuggccacgcagccaggac

SEQ ID NO: 3767807 - RNA, 13 nt, Human
ccuggccacgccc

SEQ ID NO: 3767808 - RNA, 12 nt, Human
ccuggccagaca

SEQ ID NO: 3767809 - RNA, 16 nt, Human
ccuggccagacacagg

SEQ ID NO: 3767810 - RNA, 18 nt, Human
ccuggccagacacaggcc

SEQ ID NO: 3767811 - RNA, 12 nt, Human
ccuggccagagg

SEQ ID NO: 3767812 - RNA, 14 nt, Human
ccuggccagaggcu

SEQ ID NO: 3767813 - RNA, 23 nt, Human
ccuggccagaugcaccagcccuu

SEQ ID NO: 3767814 - RNA, 15 nt, Human
ccuggccagccuaca

SEQ ID NO: 3767815 - RNA, 11 nt, Human
ccuggccagga

SEQ ID NO: 3767816 - RNA, 14 nt, Human
ccuggccaggagca

SEQ ID NO: 3767817 - RNA, 14 nt, Human
ccuggccaggagcu

SEQ ID NO: 3767818 - RNA, 16 nt, Human
ccuggccaggagcucu

SEQ ID NO: 3767819 - RNA, 12 nt, Human
ccuggccaggca

SEQ ID NO: 3767820 - RNA, 14 nt, Human
ccuggccaucccac

SEQ ID NO: 3767821 - RNA, 16 nt, Human
ccuggcccacugcauc

SEQ ID NO: 3767822 - RNA, 12 nt, Human
ccuggcccagcc

SEQ ID NO: 3767823 - RNA, 14 nt, Human
ccuggcccagccuu

SEQ ID NO: 3767824 - RNA, 13 nt, Human
ccuggcccagcuc

SEQ ID NO: 3767825 - RNA, 14 nt, Human
ccuggcccagcucc

SEQ ID NO: 3767826 - RNA, 13 nt, Human
ccuggcccagggc

SEQ ID NO: 3767827 - RNA, 18 nt, Human
ccuggcccaucaguguac

SEQ ID NO: 3767828 - RNA, 15 nt, Human
ccuggcccauguaug

SEQ ID NO: 3767829 - RNA, 21 nt, Human
ccuggcccauguauggccagg

SEQ ID NO: 3767830 - RNA, 13 nt, Human
ccuggccccagga

SEQ ID NO: 3767831 - RNA, 18 nt, Human
ccuggccccauggucagc

SEQ ID NO: 3767832 - RNA, 17 nt, Human
ccuggccccaugucucu

SEQ ID NO: 3767833 - RNA, 20 nt, Human
ccuggcccccaaccucaggg

SEQ ID NO: 3767834 - RNA, 21 nt, Human
ccuggcccccacccucugcca

SEQ ID NO: 3767835 - RNA, 12 nt, Human
ccuggcccccag

SEQ ID NO: 3767836 - RNA, 13 nt, Human
ccuggcccccucc

SEQ ID NO: 3767837 - RNA, 16 nt, Human
ccuggccccucagggu

SEQ ID NO: 3767838 - RNA, 17 nt, Human
ccuggccccucgccugu

SEQ ID NO: 3767839 - RNA, 14 nt, Human
ccuggccccucucc

SEQ ID NO: 3767840 - RNA, 20 nt, Human
ccuggccccucucccuuggg

SEQ ID NO: 3767841 - RNA, 22 nt, Human
ccuggcccucaaggccucccac

SEQ ID NO: 3767842 - RNA, 16 nt, Human
ccuggcccugcccuga

SEQ ID NO: 3767843 - RNA, 17 nt, Human
ccuggcccugcccugag

SEQ ID NO: 3767844 - RNA, 13 nt, Human
ccuggcccugcuu

SEQ ID NO: 3767845 - RNA, 16 nt, Human
ccuggcccugcuuccu

SEQ ID NO: 3767846 - RNA, 21 nt, Human
ccuggcccugcuuccugcuug

SEQ ID NO: 3767847 - RNA, 23 nt, Human
ccuggcccugcuuccugcuugcc

SEQ ID NO: 3767848 - RNA, 17 nt, Human
ccuggcccuggggccug

SEQ ID NO: 3767849 - RNA, 12 nt, Human
ccuggccgcccc

SEQ ID NO: 3767850 - RNA, 14 nt, Human
ccuggccgcccccu

SEQ ID NO: 3767851 - RNA, 16 nt, Human
ccuggccgccuggguc

SEQ ID NO: 3767852 - RNA, 22 nt, Human
ccuggccggcaaccccaguucu

SEQ ID NO: 3767853 - RNA, 22 nt, Human
ccuggccggccagccagccacu

SEQ ID NO: 3767854 - RNA, 17 nt, Human
ccuggccuagaccagca

SEQ ID NO: 3767855 - RNA, 19 nt, Human
ccuguaaucccagcacacu

SEQ ID NO: 3767856 - RNA, 14 nt, Human
ccuguaauucagug

SEQ ID NO: 3767857 - RNA, 15 nt, Human
ccuguaauucagugu

SEQ ID NO: 3767858 - RNA, 23 nt, Human
ccuguaauuguuguuuguaugua

SEQ ID NO: 3767859 - RNA, 18 nt, Human
ccuguaauuuuuuucuua

SEQ ID NO: 3767860 - RNA, 15 nt, Human
ccuguacaauauuua

SEQ ID NO: 3767861 - RNA, 21 nt, Human
ccuguacaauauuuaaaauuu

SEQ ID NO: 3767862 - RNA, 12 nt, Human
ccuguacacuga

SEQ ID NO: 3767863 - RNA, 20 nt, Human
ccuguacagucugucuucug

SEQ ID NO: 3767864 - RNA, 14 nt, Human
ccuguacaguguua

SEQ ID NO: 3767865 - RNA, 21 nt, Human
ccuguacucaggaggcugagg

SEQ ID NO: 3767866 - RNA, 23 nt, Human
ccuguacucaggaggcugagggg

SEQ ID NO: 3767867 - RNA, 20 nt, Human
ccuguacucgcuugugcaga

SEQ ID NO: 3767868 - RNA, 16 nt, Human
ccuguacucuuccgaa

SEQ ID NO: 3767869 - RNA, 13 nt, Human
ccuguacuggaga

SEQ ID NO: 3767870 - RNA, 20 nt, Human
ccuguacuguucugugucuu

SEQ ID NO: 3767871 - RNA, 23 nt, Human
ccuguagaacucaaccucuacag

SEQ ID NO: 3767872 - RNA, 21 nt, Human
ccuguagaauagccuguggcc

SEQ ID NO: 3767873 - RNA, 13 nt, Human
ccuguagaccuag

SEQ ID NO: 3767874 - RNA, 18 nt, Human
ccuguagaccuagggagg

SEQ ID NO: 3767875 - RNA, 19 nt, Human
ccuguagagugggagcuga

SEQ ID NO: 3767876 - RNA, 21 nt, Human
ccuguagagugggagcugagu

SEQ ID NO: 3767877 - RNA, 13 nt, Human
ccuguagaguugc

SEQ ID NO: 3767878 - RNA, 14 nt, Human
ccuguagaguugcu

SEQ ID NO: 3767879 - RNA, 17 nt, Human
ccuguagaguugcugag

SEQ ID NO: 3767880 - RNA, 21 nt, Human
ccuguagcagugagaaaaagc

SEQ ID NO: 3767881 - RNA, 16 nt, Human
ccuguagcccacucug

SEQ ID NO: 3767882 - RNA, 19 nt, Human
ccuguagcccacucugcuc

SEQ ID NO: 3767883 - RNA, 22 nt, Human
ccuguagcccacucugcucgcc

SEQ ID NO: 3767884 - RNA, 13 nt, Human
ccuguagcccuaa

SEQ ID NO: 3767885 - RNA, 19 nt, Human
ccuguaggaagguacugua

SEQ ID NO: 3767886 - RNA, 18 nt, Human
ccuguaggauuuuuuucu

SEQ ID NO: 3767887 - RNA, 18 nt, Human
ccuguaguugcguggacu

SEQ ID NO: 3767888 - RNA, 19 nt, Human
ccuguaguuuuauuuuaug

SEQ ID NO: 3767889 - RNA, 17 nt, Human
ccuguauaagcacugaa

SEQ ID NO: 3767890 - RNA, 16 nt, Human
ccuguauaaguggagg

SEQ ID NO: 3767891 - RNA, 14 nt, Human
ccuguauaccuccu

SEQ ID NO: 3767892 - RNA, 12 nt, Human
ccuguauaguua

SEQ ID NO: 3767893 - RNA, 22 nt, Human
ccuguauaguuaggauagcauu

SEQ ID NO: 3767894 - RNA, 16 nt, Human
ccuguaugucuccagu

SEQ ID NO: 3767895 - RNA, 15 nt, Human
ccuguaugucuguca

SEQ ID NO: 3767896 - RNA, 13 nt, Human
ccuguauguuguc

SEQ ID NO: 3767897 - RNA, 14 nt, Human
ccuguauguugucc

SEQ ID NO: 3767898 - RNA, 13 nt, Human
ccugucaaacauu

SEQ ID NO: 3767899 - RNA, 22 nt, Human
ccugucaaacauuaguacuuua

SEQ ID NO: 3767900 - RNA, 20 nt, Human
ccugucaagcaaucaagaaa

SEQ ID NO: 3767901 - RNA, 15 nt, Human
ccugucacauugcau

SEQ ID NO: 3767902 - RNA, 20 nt, Human
ccugucacauugcauucuau

SEQ ID NO: 3767903 - RNA, 20 nt, Human
ccugucagauccaggagcuc

SEQ ID NO: 3767904 - RNA, 22 nt, Human
ccugucagauccaggagcucca

SEQ ID NO: 3767905 - RNA, 16 nt, Human
ccugucagcaugaauu

SEQ ID NO: 3767906 - RNA, 20 nt, Human
ccugucagcaugaauuugua

SEQ ID NO: 3767907 - RNA, 22 nt, Human
ccugucagcaugaauuuguaau

SEQ ID NO: 3767908 - RNA, 19 nt, Human
ccugucagugccgccgccu

SEQ ID NO: 3767909 - RNA, 19 nt, Human
ccugucaucaucauggcca

SEQ ID NO: 3767910 - RNA, 23 nt, Human
ccuguccaaacugccuaagcccu

SEQ ID NO: 3767911 - RNA, 23 nt, Human
ccuguccaaccuaaccccuuucc

SEQ ID NO: 3767912 - RNA, 12 nt, Human
ccugucccaccc

SEQ ID NO: 3767913 - RNA, 13 nt, Human
ccugucccacccc

SEQ ID NO: 3767914 - RNA, 18 nt, Human
ccugucccacccccaccc

SEQ ID NO: 3767915 - RNA, 13 nt, Human
ccugucccaccuc

SEQ ID NO: 3767916 - RNA, 14 nt, Human
ccugucccaccuca

SEQ ID NO: 3767917 - RNA, 14 nt, Human
ccugucccaccucu

SEQ ID NO: 3767918 - RNA, 13 nt, Human
ccuguccccaccc

SEQ ID NO: 3767919 - RNA, 15 nt, Human
ccuguccccaucugu

SEQ ID NO: 3767920 - RNA, 14 nt, Human
ccugucccccagcu

SEQ ID NO: 3767921 - RNA, 12 nt, Human
ccugucccccug

SEQ ID NO: 3767922 - RNA, 13 nt, Human
ccugucccccuga

SEQ ID NO: 3767923 - RNA, 17 nt, Human
ccugucccccugacaac

SEQ ID NO: 3767924 - RNA, 13 nt, Human
ccugucccuccca

SEQ ID NO: 3767925 - RNA, 14 nt, Human
ccugucccucccac

SEQ ID NO: 3767926 - RNA, 15 nt, Human
ccugucccucccacc

SEQ ID NO: 3767927 - RNA, 14 nt, Human
ccugucccuggcca

SEQ ID NO: 3767928 - RNA, 22 nt, Human
ccuguccgcccucuuccccucu

SEQ ID NO: 3767929 - RNA, 9 nt, Human
ccuguccuc

SEQ ID NO: 3767930 - RNA, 12 nt, Human
ccuguccucacu

SEQ ID NO: 3767931 - RNA, 16 nt, Human
ccuguccucacugcuc

SEQ ID NO: 3767932 - RNA, 21 nt, Human
ccuguccuccaacaccaagca

SEQ ID NO: 3767933 - RNA, 22 nt, Human
ccuguccuccaacaccaagcac

SEQ ID NO: 3767934 - RNA, 13 nt, Human
ccuguccucccag

SEQ ID NO: 3767935 - RNA, 22 nt, Human
ccuguccucccagcuccucacu

SEQ ID NO: 3767936 - RNA, 22 nt, Human
ccuguccucccauccccuggac

SEQ ID NO: 3767937 - RNA, 23 nt, Human
ccuguccucccauccccuggacu

SEQ ID NO: 3767938 - RNA, 13 nt, Human
ccuguccuccucg

SEQ ID NO: 3767939 - RNA, 19 nt, Human
ccuguccucuuucagcucc

SEQ ID NO: 3767940 - RNA, 22 nt, Human
ccuguccucuuucagcuccuga

SEQ ID NO: 3767941 - RNA, 12 nt, Human
ccuguccugccu

SEQ ID NO: 3767942 - RNA, 15 nt, Human
ccuguccugguggua

SEQ ID NO: 3767943 - RNA, 21 nt, Human
ccuguccuuuaccaaagauga

SEQ ID NO: 3767944 - RNA, 17 nt, Human
ccugucgagacacuugc

SEQ ID NO: 3767945 - RNA, 16 nt, Human
ccugucuaaaaauuca

SEQ ID NO: 3767946 - RNA, 22 nt, Human
ccugucuaaugaaaccuguguc

SEQ ID NO: 3767947 - RNA, 17 nt, Human
ccugucuagagagggag

SEQ ID NO: 3767948 - RNA, 21 nt, Human
ccugucuaggucaguacccac

SEQ ID NO: 3767949 - RNA, 22 nt, Human
ccugucuaggucaguacccacc

SEQ ID NO: 3767950 - RNA, 23 nt, Human
ccugucuaggucaguacccaccu

SEQ ID NO: 3767951 - RNA, 21 nt, Human
ccugucuagucucuccuguaa

SEQ ID NO: 3767952 - RNA, 23 nt, Human
ccugucuccacugugccuuugca

SEQ ID NO: 3767953 - RNA, 13 nt, Human
ccugucuccccuc

SEQ ID NO: 3767954 - RNA, 21 nt, Human
ccugucucccuccucugcccg

SEQ ID NO: 3767955 - RNA, 21 nt, Human
ccugucuccuuugcaggcuca

SEQ ID NO: 3767956 - RNA, 14 nt, Human
ccugucucuuccau

SEQ ID NO: 3767957 - RNA, 20 nt, Human
ccugucugaaggacacuucc

SEQ ID NO: 3767958 - RNA, 17 nt, Human
ccugucugacuacuuug

SEQ ID NO: 3767959 - RNA, 20 nt, Human
ccugucugagacucacagga

SEQ ID NO: 3767960 - RNA, 19 nt, Human
ccugucugccagccagcag

SEQ ID NO: 3767961 - RNA, 12 nt, Human
ccugucugcccc

SEQ ID NO: 3767962 - RNA, 17 nt, Human
ccugucugccccagccc

SEQ ID NO: 3767963 - RNA, 14 nt, Human
ccugucugcuccag

SEQ ID NO: 3767964 - RNA, 18 nt, Human
ccugucugcuccagcucu

SEQ ID NO: 3767965 - RNA, 22 nt, Human
ccugucuguagagggcccuggu

SEQ ID NO: 3767966 - RNA, 19 nt, Human
ccugucugucucuccaucu

SEQ ID NO: 3767967 - RNA, 13 nt, Human
ccugucugugacc

SEQ ID NO: 3767968 - RNA, 15 nt, Human
ccugucuucccaggg

SEQ ID NO: 3767969 - RNA, 18 nt, Human
ccugucuucccaggguag

SEQ ID NO: 3767970 - RNA, 19 nt, Human
ccugucuuccugcauucac

SEQ ID NO: 3767971 - RNA, 17 nt, Human
ccugucuugccuuuuuc

SEQ ID NO: 3767972 - RNA, 14 nt, Human
ccugucuuuaagga

SEQ ID NO: 3767973 - RNA, 19 nt, Human
ccugucuuuccuaagaccu

SEQ ID NO: 3767974 - RNA, 20 nt, Human
ccugucuuuccuaagaccug

SEQ ID NO: 3767975 - RNA, 21 nt, Human
ccugucuuuccuaagaccugg

SEQ ID NO: 3767976 - RNA, 22 nt, Human
ccugucuuugggagaaaacguc

SEQ ID NO: 3767977 - RNA, 18 nt, Human
ccugugaacccaggacaa

SEQ ID NO: 3767978 - RNA, 16 nt, Human
ccugugaacugaacuc

SEQ ID NO: 3767979 - RNA, 21 nt, Human
ccugugaagaaaggaccugca

SEQ ID NO: 3767980 - RNA, 19 nt, Human
ccugugaaugccacugccu

SEQ ID NO: 3767981 - RNA, 22 nt, Human
ccugugacauggugccugagag

SEQ ID NO: 3767982 - RNA, 23 nt, Human
ccugugacauggugccugagagg

SEQ ID NO: 3767983 - RNA, 16 nt, Human
ccugugaccagcacug

SEQ ID NO: 3767984 - RNA, 16 nt, Human
ccugugacugucucac

SEQ ID NO: 3767985 - RNA, 23 nt, Human
ccugugagauguguaucaguguu

SEQ ID NO: 3767986 - RNA, 14 nt, Human
ccugugagccaguc

SEQ ID NO: 3767987 - RNA, 15 nt, Human
ccugugagccagucu

SEQ ID NO: 3767988 - RNA, 16 nt, Human
ccugugagccagucua

SEQ ID NO: 3767989 - RNA, 23 nt, Human
ccugugagccagucuaguuccug

SEQ ID NO: 3767990 - RNA, 20 nt, Human
ccugugagcccagcuggguc

SEQ ID NO: 3767991 - RNA, 17 nt, Human
ccugugaggcaggggcg

SEQ ID NO: 3767992 - RNA, 20 nt, Human
ccugugaguacuacaguccu

SEQ ID NO: 3767993 - RNA, 22 nt, Human
ccugugaucuuauuuuucuaaa

SEQ ID NO: 3767994 - RNA, 22 nt, Human
ccugugauggggcccugccucc

SEQ ID NO: 3767995 - RNA, 22 nt, Human
ccugugcacaccccacucccac

SEQ ID NO: 3767996 - RNA, 13 nt, Human
ccugugcacagcc

SEQ ID NO: 3767997 - RNA, 23 nt, Human
ccugugcccacaucccaggcuuc

SEQ ID NO: 3767998 - RNA, 17 nt, Human
ccugugccucugggacu

SEQ ID NO: 3767999 - RNA, 16 nt, Human
ccuuccaggaccccug

SEQ ID NO: 3768000 - RNA, 18 nt, Human
ccuuccaggggugggaca

SEQ ID NO: 3768001 - RNA, 22 nt, Human
ccuuccaguguccuuagaacau

SEQ ID NO: 3768002 - RNA, 11 nt, Human
ccuuccauaau

SEQ ID NO: 3768003 - RNA, 16 nt, Human
ccuuccaucugauucc

SEQ ID NO: 3768004 - RNA, 17 nt, Human
ccuuccauggacuuugu

SEQ ID NO: 3768005 - RNA, 19 nt, Human
ccuuccaugucgccucugc

SEQ ID NO: 3768006 - RNA, 21 nt, Human
ccuuccaugucgccucugcau

SEQ ID NO: 3768007 - RNA, 12 nt, Human
ccuuccauucca

SEQ ID NO: 3768008 - RNA, 17 nt, Human
ccuuccauuuuccccca

SEQ ID NO: 3768009 - RNA, 19 nt, Human
ccuuccauuuucccccacu

SEQ ID NO: 3768010 - RNA, 20 nt, Human
ccuuccauuuucccccacua

SEQ ID NO: 3768011 - RNA, 22 nt, Human
ccuucccaaguaagaggcugga

SEQ ID NO: 3768012 - RNA, 19 nt, Human
ccuucccaaucagcacuga

SEQ ID NO: 3768013 - RNA, 20 nt, Human
ccuucccaaucagcacugaa

SEQ ID NO: 3768014 - RNA, 15 nt, Human
ccuucccacucaccc

SEQ ID NO: 3768015 - RNA, 17 nt, Human
ccuucccacucaccccg

SEQ ID NO: 3768016 - RNA, 22 nt, Human
ccuucccacucugucgagccug

SEQ ID NO: 3768017 - RNA, 17 nt, Human
ccuucccagaggggccu

SEQ ID NO: 3768018 - RNA, 22 nt, Human
ccuucccagaggggccugccac

SEQ ID NO: 3768019 - RNA, 13 nt, Human
ccuucccagcucu

SEQ ID NO: 3768020 - RNA, 16 nt, Human
ccuucccagcugcccc

SEQ ID NO: 3768021 - RNA, 23 nt, Human
ccuucccaugacccaggcugggc

SEQ ID NO: 3768022 - RNA, 15 nt, Human
ccuucccaugcccug

SEQ ID NO: 3768023 - RNA, 19 nt, Human
ccuuccccacugcacacac

SEQ ID NO: 3768024 - RNA, 22 nt, Human
ccuuccccacugccugcccacc

SEQ ID NO: 3768025 - RNA, 22 nt, Human
ccuuccccagcuuugcugccug

SEQ ID NO: 3768026 - RNA, 14 nt, Human
ccuuccccaugcuu

SEQ ID NO: 3768027 - RNA, 23 nt, Human
ccuuccccaugcuuccuugccug

SEQ ID NO: 3768028 - RNA, 21 nt, Human
ccuucccccaccgguccagcu

SEQ ID NO: 3768029 - RNA, 22 nt, Human
ccuucccccaccgguccagcug

SEQ ID NO: 3768030 - RNA, 17 nt, Human
ccuucccccagcccauc

SEQ ID NO: 3768031 - RNA, 19 nt, Human
ccuucccccuccaauccca

SEQ ID NO: 3768032 - RNA, 20 nt, Human
ccuucccccucccagggcca

SEQ ID NO: 3768033 - RNA, 23 nt, Human
ccuucccccuuuuuuguccccca

SEQ ID NO: 3768034 - RNA, 23 nt, Human
ccuuccccgagggaugaugccac

SEQ ID NO: 3768035 - RNA, 17 nt, Human
ccuuccccucccuggcu

SEQ ID NO: 3768036 - RNA, 21 nt, Human
ccuuccccuuauccucccugu

SEQ ID NO: 3768037 - RNA, 13 nt, Human
ccuuccccuuccu

SEQ ID NO: 3768038 - RNA, 13 nt, Human
ccuucccuccaag

SEQ ID NO: 3768039 - RNA, 14 nt, Human
ccuucccuccugcu

SEQ ID NO: 3768040 - RNA, 18 nt, Human
ccuucccucucuggagaa

SEQ ID NO: 3768041 - RNA, 18 nt, Human
ccuucccugggcugugcu

SEQ ID NO: 3768042 - RNA, 19 nt, Human
ccuucccugggcugugcua

SEQ ID NO: 3768043 - RNA, 14 nt, Human
ccuucccugucccu

SEQ ID NO: 3768044 - RNA, 16 nt, Human
ccuucccugucccucu

SEQ ID NO: 3768045 - RNA, 23 nt, Human
ccuucccuuccacugccucugcc

SEQ ID NO: 3768046 - RNA, 13 nt, Human
ccuucccuugcca

SEQ ID NO: 3768047 - RNA, 12 nt, Human
ccuucccuugcu

SEQ ID NO: 3768048 - RNA, 14 nt, Human
ccuuccgacccucu

SEQ ID NO: 3768049 - RNA, 17 nt, Human
ccuuccgacccucuggg

SEQ ID NO: 3768050 - RNA, 18 nt, Human
ccuuccgacccucuggga

SEQ ID NO: 3768051 - RNA, 19 nt, Human
ccuuccgacccucugggaa

SEQ ID NO: 3768052 - RNA, 22 nt, Human
ccuuccgccacuggggcucaga

SEQ ID NO: 3768053 - RNA, 9 nt, Human
ccuuccuaa

SEQ ID NO: 3768054 - RNA, 17 nt, Human
ccuuccuaagccugugg

SEQ ID NO: 3768055 - RNA, 20 nt, Human
ccuuccuaauuccacagcug

SEQ ID NO: 3768056 - RNA, 21 nt, Human
ccuuccuaauuccacagcugc

SEQ ID NO: 3768057 - RNA, 21 nt, Human
ccuuccuaguucaucccuucu

SEQ ID NO: 3768058 - RNA, 23 nt, Human
ccuuccuauaacuugaugcaugu

SEQ ID NO: 3768059 - RNA, 14 nt, Human
ccuuccucacugcc

SEQ ID NO: 3768060 - RNA, 15 nt, Human
ccuuccucacuucca

SEQ ID NO: 3768061 - RNA, 21 nt, Human
ccuuccucauccaccccaucc

SEQ ID NO: 3768062 - RNA, 21 nt, Human
ccuuccuccauccuccuccuu

SEQ ID NO: 3768063 - RNA, 16 nt, Human
ccuuccuccuccacca

SEQ ID NO: 3768064 - RNA, 21 nt, Human
ccuuccuccuccaccaccgcc

SEQ ID NO: 3768065 - RNA, 12 nt, Human
ccuuccuccugg

SEQ ID NO: 3768066 - RNA, 13 nt, Human
ccuuccuccuggg

SEQ ID NO: 3768067 - RNA, 21 nt, Human
ccuuccucuccacccucccag

SEQ ID NO: 3768068 - RNA, 14 nt, Human
ccuuccucuccacu

SEQ ID NO: 3768069 - RNA, 20 nt, Human
ccuuccucuccacugccuuc

SEQ ID NO: 3768070 - RNA, 15 nt, Human
ccuuccucugagccu

SEQ ID NO: 3768071 - RNA, 16 nt, Human
ccuuccucugagccuu

SEQ ID NO: 3768072 - RNA, 16 nt, Human
ccuuccucugcagcug

SEQ ID NO: 3768073 - RNA, 20 nt, Human
ccuuccucuucggcccucag

SEQ ID NO: 3768074 - RNA, 21 nt, Human
ccuuccucuugucugauuucu

SEQ ID NO: 3768075 - RNA, 14 nt, Human
ccuuccugccacca

SEQ ID NO: 3768076 - RNA, 16 nt, Human
ccuuccugccagcccc

SEQ ID NO: 3768077 - RNA, 17 nt, Human
ccuuccugccagccccu

SEQ ID NO: 3768078 - RNA, 13 nt, Human
ccuuccugcuuga

SEQ ID NO: 3768079 - RNA, 18 nt, Human
ccuuccuggacagcugug

SEQ ID NO: 3768080 - RNA, 13 nt, Human
ccuuccugggcac

SEQ ID NO: 3768081 - RNA, 19 nt, Human
ccuuccugucccaccucuu

SEQ ID NO: 3768082 - RNA, 12 nt, Human
ccuuccugucuu

SEQ ID NO: 3768083 - RNA, 17 nt, Human
ccuuccugucuuccugc

SEQ ID NO: 3768084 - RNA, 16 nt, Human
ccuuccuucccgccag

SEQ ID NO: 3768085 - RNA, 16 nt, Human
ccuuccuucccuggcu

SEQ ID NO: 3768086 - RNA, 15 nt, Human
ccuuccuucccuggg

SEQ ID NO: 3768087 - RNA, 14 nt, Human
ccuuccuucuugcu

SEQ ID NO: 3768088 - RNA, 22 nt, Human
ccuuccuuguuacccaugaaaa

SEQ ID NO: 3768089 - RNA, 19 nt, Human
ccuuccuuucuccaggacc

SEQ ID NO: 3768090 - RNA, 18 nt, Human
ccuuccuuuucccugcuu

SEQ ID NO: 3768091 - RNA, 20 nt, Human
ccuuccuuuucccugcuucc

SEQ ID NO: 3768092 - RNA, 21 nt, Human
ccuuccuuuucccugcuucca

SEQ ID NO: 3768093 - RNA, 22 nt, Human
ccuucgcguauuucaggauucu

SEQ ID NO: 3768094 - RNA, 15 nt, Human
ccuucgcuccugugu

SEQ ID NO: 3768095 - RNA, 18 nt, Human
ccuucgcuccugugucuu

SEQ ID NO: 3768096 - RNA, 18 nt, Human
ccuucgcuucuugccucu

SEQ ID NO: 3768097 - RNA, 19 nt, Human
ccuucgcuucuugccucug

SEQ ID NO: 3768098 - RNA, 21 nt, Human
ccuucgcuucuugccucugug

SEQ ID NO: 3768099 - RNA, 20 nt, Human
ccuucggacaacucaguccc

SEQ ID NO: 3768100 - RNA, 14 nt, Human
ccuucggccuccau

SEQ ID NO: 3768101 - RNA, 18 nt, Human
ccuucggccuccauccug

SEQ ID NO: 3768102 - RNA, 15 nt, Human
ccuucgggcugugcc

SEQ ID NO: 3768103 - RNA, 14 nt, Human
ccuucguaucccga

SEQ ID NO: 3768104 - RNA, 13 nt, Human
ccuucgugccccc

SEQ ID NO: 3768105 - RNA, 17 nt, Human
ccuucguuuacuaugcc

SEQ ID NO: 3768106 - RNA, 19 nt, Human
ccuucguuuacuaugccug

SEQ ID NO: 3768107 - RNA, 22 nt, Human
ccuucguuuacuaugccugugu

SEQ ID NO: 3768108 - RNA, 16 nt, Human
ccuucuacacucuccu

SEQ ID NO: 3768109 - RNA, 18 nt, Human
ccuucuacacucuccugg

SEQ ID NO: 3768110 - RNA, 20 nt, Human
ccuucuacacucuccugggc

SEQ ID NO: 3768111 - RNA, 13 nt, Human
ccuucuaccugcc

SEQ ID NO: 3768112 - RNA, 14 nt, Human
ccuucuaccugcca

SEQ ID NO: 3768113 - RNA, 17 nt, Human
ccuucuaccugccacuc

SEQ ID NO: 3768114 - RNA, 15 nt, Human
ccuucuacugagccu

SEQ ID NO: 3768115 - RNA, 17 nt, Human
ccuucuaguuucccaca

SEQ ID NO: 3768116 - RNA, 18 nt, Human
ccuucuaguuucccacaa

SEQ ID NO: 3768117 - RNA, 18 nt, Human
ccuucuauacccacccag

SEQ ID NO: 3768118 - RNA, 20 nt, Human
ccuucuauacccacccagaa

SEQ ID NO: 3768119 - RNA, 14 nt, Human
ccuucucacagcac

SEQ ID NO: 3768120 - RNA, 14 nt, Human
ccuucucaccagcu

SEQ ID NO: 3768121 - RNA, 17 nt, Human
ccuucucaccagcugca

SEQ ID NO: 3768122 - RNA, 18 nt, Human
ccuucucagaagcacaga

SEQ ID NO: 3768123 - RNA, 13 nt, Human
ccuucucaucacu

SEQ ID NO: 3768124 - RNA, 17 nt, Human
ccuucuccaucucucug

SEQ ID NO: 3768125 - RNA, 21 nt, Human
ccuucuccaucucucuggccc

SEQ ID NO: 3768126 - RNA, 22 nt, Human
ccuucuccauggcccugccaug

SEQ ID NO: 3768127 - RNA, 14 nt, Human
ccuucucccacacu

SEQ ID NO: 3768128 - RNA, 16 nt, Human
ccuucucccacacugc

SEQ ID NO: 3768129 - RNA, 15 nt, Human
ccuucucccacucuc

SEQ ID NO: 3768130 - RNA, 12 nt, Human
ccuucuccccag

SEQ ID NO: 3768131 - RNA, 14 nt, Human
ccuucucccccccg

SEQ ID NO: 3768132 - RNA, 22 nt, Human
ccuucucccccccggggcuggg

SEQ ID NO: 3768133 - RNA, 16 nt, Human
ccuucuccccugcacu

SEQ ID NO: 3768134 - RNA, 23 nt, Human
ccuucuccccugcacuguaaaau

SEQ ID NO: 3768135 - RNA, 17 nt, Human
ccuucucccuagcuccu

SEQ ID NO: 3768136 - RNA, 16 nt, Human
ccuucucccucauuuc

SEQ ID NO: 3768137 - RNA, 12 nt, Human
ccuucucccugg

SEQ ID NO: 3768138 - RNA, 17 nt, Human
ccuucuccucuuguaaa

SEQ ID NO: 3768139 - RNA, 18 nt, Human
ccuucuccuuccaacugc

SEQ ID NO: 3768140 - RNA, 17 nt, Human
ccuucucucaccuccua

SEQ ID NO: 3768141 - RNA, 12 nt, Human
ccuucucuccag

SEQ ID NO: 3768142 - RNA, 23 nt, Human
ccuucucuccagccccuggaugc

SEQ ID NO: 3768143 - RNA, 23 nt, Human
ucacuugaacccgggaggcagag

SEQ ID NO: 3768144 - RNA, 20 nt, Human
ucacuugaugauacaaugaa

SEQ ID NO: 3768145 - RNA, 19 nt, Human
ucacuugaugugccauuuu

SEQ ID NO: 3768146 - RNA, 15 nt, Human
ucacuugcauguccc

SEQ ID NO: 3768147 - RNA, 21 nt, Human
ucacuuggucugccaggcccc

SEQ ID NO: 3768148 - RNA, 15 nt, Human
ucacuuguacaaaau

SEQ ID NO: 3768149 - RNA, 16 nt, Human
ucacuuguacaaaaua

SEQ ID NO: 3768150 - RNA, 19 nt, Human
ucacuugucaggagugugu

SEQ ID NO: 3768151 - RNA, 21 nt, Human
ucacuugucaggagugugugu

SEQ ID NO: 3768152 - RNA, 13 nt, Human
ucacuugugcuuu

SEQ ID NO: 3768153 - RNA, 15 nt, Human
ucacuugugcuuugc

SEQ ID NO: 3768154 - RNA, 19 nt, Human
ucacuugugcuuugcucuu

SEQ ID NO: 3768155 - RNA, 15 nt, Human
ucacuuguuguuuua

SEQ ID NO: 3768156 - RNA, 17 nt, Human
ucacuuuagaugcugau

SEQ ID NO: 3768157 - RNA, 18 nt, Human
ucacuuucacauagaugu

SEQ ID NO: 3768158 - RNA, 14 nt, Human
ucacuuucuagauu

SEQ ID NO: 3768159 - RNA, 14 nt, Human
ucacuuucucaguu

SEQ ID NO: 3768160 - RNA, 14 nt, Human
ucacuuugcucugg

SEQ ID NO: 3768161 - RNA, 19 nt, Human
ucacuuuuaaugaacaaau

SEQ ID NO: 3768162 - RNA, 14 nt, Human
ucacuuuucaguga

SEQ ID NO: 3768163 - RNA, 13 nt, Human
ucacuuuucccac

SEQ ID NO: 3768164 - RNA, 21 nt, Human
ucacuuuucuguaacgccugc

SEQ ID NO: 3768165 - RNA, 18 nt, Human
ucacuuuugacaaaggca

SEQ ID NO: 3768166 - RNA, 21 nt, Human
ucacuuuugcaagguuccaca

SEQ ID NO: 3768167 - RNA, 13 nt, Human
ucacuuuuucuga

SEQ ID NO: 3768168 - RNA, 17 nt, Human
ucacuuuuucugauaaa

SEQ ID NO: 3768169 - RNA, 18 nt, Human
ucacuuuuugaacuaaga

SEQ ID NO: 3768170 - RNA, 19 nt, Human
ucacuuuuugaacuaagaa

SEQ ID NO: 3768171 - RNA, 20 nt, Human
ucacuuuuugaacuaagaaa

SEQ ID NO: 3768172 - RNA, 20 nt, Human
ucagaaaacagaaaaaaaac

SEQ ID NO: 3768173 - RNA, 14 nt, Human
ucagaaaagggaag

SEQ ID NO: 3768174 - RNA, 20 nt, Human
ucagaaaauaucccuccugu

SEQ ID NO: 3768175 - RNA, 20 nt, Human
ucagaaaauauuauguguuu

SEQ ID NO: 3768176 - RNA, 18 nt, Human
ucagaaaauguucuguuu

SEQ ID NO: 3768177 - RNA, 22 nt, Human
ucagaaacaaagcauuugacuu

SEQ ID NO: 3768178 - RNA, 24 nt, Human
ucagaaacaaagcauuugacuuuc

SEQ ID NO: 3768179 - RNA, 19 nt, Human
ucagaaacacccucacacu

SEQ ID NO: 3768180 - RNA, 21 nt, Human
ucagaaacacccucacacugg

SEQ ID NO: 3768181 - RNA, 18 nt, Human
ucagaaacacuggggcug

SEQ ID NO: 3768182 - RNA, 21 nt, Human
ucagaaacacuggggcuggca

SEQ ID NO: 3768183 - RNA, 14 nt, Human
ucagaaacaggacc

SEQ ID NO: 3768184 - RNA, 18 nt, Human
ucagaaaccaaacaguuu

SEQ ID NO: 3768185 - RNA, 15 nt, Human
ucagaaaccagacuc

SEQ ID NO: 3768186 - RNA, 13 nt, Human
ucagaaaccaguu

SEQ ID NO: 3768187 - RNA, 22 nt, Human
ucagaaaccaguuaugugaaug

SEQ ID NO: 3768188 - RNA, 16 nt, Human
ucagaaacuagaaaug

SEQ ID NO: 3768189 - RNA, 17 nt, Human
ucagaaacuugugaagu

SEQ ID NO: 3768190 - RNA, 23 nt, Human
ucagaaagccuuucauuuugcuu

SEQ ID NO: 3768191 - RNA, 19 nt, Human
ucagaaagggagggcucug

SEQ ID NO: 3768192 - RNA, 12 nt, Human
ucagaaagugua

SEQ ID NO: 3768193 - RNA, 15 nt, Human
ucagaaaguguaaau

SEQ ID NO: 3768194 - RNA, 18 nt, Human
ucagaaaguguaaauguu

SEQ ID NO: 3768195 - RNA, 14 nt, Human
ucagaaaugcugcc

SEQ ID NO: 3768196 - RNA, 18 nt, Human
ucagaaauguacaacuuu

SEQ ID NO: 3768197 - RNA, 15 nt, Human
ucagaaaugucugga

SEQ ID NO: 3768198 - RNA, 18 nt, Human
ucagaaauuggaacagaa

SEQ ID NO: 3768199 - RNA, 14 nt, Human
ucagaaauuuaauu

SEQ ID NO: 3768200 - RNA, 21 nt, Human
ucagaaauuuaauucauguuu

SEQ ID NO: 3768201 - RNA, 22 nt, Human
ucagaaauuuuuaucaguuucc

SEQ ID NO: 3768202 - RNA, 15 nt, Human
ucagaacacauucuu

SEQ ID NO: 3768203 - RNA, 23 nt, Human
ucagaacagcagacucagcucug

SEQ ID NO: 3768204 - RNA, 12 nt, Human
ucagaacccagg

SEQ ID NO: 3768205 - RNA, 14 nt, Human
ucagaacccagggc

SEQ ID NO: 3768206 - RNA, 22 nt, Human
ucagaacccagggcucugcccc

SEQ ID NO: 3768207 - RNA, 17 nt, Human
ucagaacccugccaugg

SEQ ID NO: 3768208 - RNA, 16 nt, Human
ucagaaccucuucccc

SEQ ID NO: 3768209 - RNA, 15 nt, Human
ucagaacuagaauuu

SEQ ID NO: 3768210 - RNA, 19 nt, Human
ucagaacuauguuuuuguu

SEQ ID NO: 3768211 - RNA, 14 nt, Human
ucagaacugugcca

SEQ ID NO: 3768212 - RNA, 16 nt, Human
ucagaacuugcugcug

SEQ ID NO: 3768213 - RNA, 18 nt, Human
ucagaacuugcugcuguc

SEQ ID NO: 3768214 - RNA, 14 nt, Human
ucagaagaaaauua

SEQ ID NO: 3768215 - RNA, 12 nt, Human
ucagaagaaauu

SEQ ID NO: 3768216 - RNA, 13 nt, Human
ucagaagacacug

SEQ ID NO: 3768217 - RNA, 14 nt, Human
ucagaagacacuga

SEQ ID NO: 3768218 - RNA, 17 nt, Human
ucagaagaguugugcac

SEQ ID NO: 3768219 - RNA, 13 nt, Human
ucagaagauaguc

SEQ ID NO: 3768220 - RNA, 16 nt, Human
ucagaagccuauugua

SEQ ID NO: 3768221 - RNA, 20 nt, Human
ucagaagccuauuguaaaua

SEQ ID NO: 3768222 - RNA, 12 nt, Human
ucagaagccugg

SEQ ID NO: 3768223 - RNA, 14 nt, Human
ucagaagccugggg

SEQ ID NO: 3768224 - RNA, 19 nt, Human
ucagaagccugggggccug

SEQ ID NO: 3768225 - RNA, 23 nt, Human
ucagaagggagcuagccagagga

SEQ ID NO: 3768226 - RNA, 13 nt, Human
ucagaagggaggc

SEQ ID NO: 3768227 - RNA, 19 nt, Human
ucagaaggucuguuuugag

SEQ ID NO: 3768228 - RNA, 17 nt, Human
ucagaagguuguuuuau

SEQ ID NO: 3768229 - RNA, 18 nt, Human
ucagaagucaucuugcua

SEQ ID NO: 3768230 - RNA, 22 nt, Human
ucagaagucaucuugcuaccag

SEQ ID NO: 3768231 - RNA, 21 nt, Human
ucagaagugagcuuugcugcu

SEQ ID NO: 3768232 - RNA, 17 nt, Human
ucagaaguuuggcaaua

SEQ ID NO: 3768233 - RNA, 15 nt, Human
ucagaauaaggcagg

SEQ ID NO: 3768234 - RNA, 22 nt, Human
ucagaauagccacauuuggaau

SEQ ID NO: 3768235 - RNA, 15 nt, Human
ucagaauaugucagu

SEQ ID NO: 3768236 - RNA, 17 nt, Human
ucagaaucacuucugag

SEQ ID NO: 3768237 - RNA, 15 nt, Human
ucagaaucagaagau

SEQ ID NO: 3768238 - RNA, 19 nt, Human
ucagaaucuacccaaagga

SEQ ID NO: 3768239 - RNA, 20 nt, Human
ucagaaucuacccaaaggau

SEQ ID NO: 3768240 - RNA, 17 nt, Human
ucagaaucucucuucuu

SEQ ID NO: 3768241 - RNA, 22 nt, Human
ucagaauuagagcaugggaggu

SEQ ID NO: 3768242 - RNA, 20 nt, Human
ucagaauucucagaaucuca

SEQ ID NO: 3768243 - RNA, 16 nt, Human
ucagaauucucuaguu

SEQ ID NO: 3768244 - RNA, 20 nt, Human
ucagaauuuuauacuuuccc

SEQ ID NO: 3768245 - RNA, 21 nt, Human
ucagaauuuuauacuuucccu

SEQ ID NO: 3768246 - RNA, 22 nt, Human
ucagaauuuuauacuuucccua

SEQ ID NO: 3768247 - RNA, 14 nt, Human
ucagacaaaaugga

SEQ ID NO: 3768248 - RNA, 22 nt, Human
ucagacacccucaaccucuucu

SEQ ID NO: 3768249 - RNA, 14 nt, Human
ucagacacuuugga

SEQ ID NO: 3768250 - RNA, 18 nt, Human
ucagacagaaccccuaca

SEQ ID NO: 3768251 - RNA, 17 nt, Human
ucagacagagaggacug

SEQ ID NO: 3768252 - RNA, 13 nt, Human
ucagacagcugcc

SEQ ID NO: 3768253 - RNA, 15 nt, Human
ucagacagcugccug

SEQ ID NO: 3768254 - RNA, 17 nt, Human
ucagacagcugccuggg

SEQ ID NO: 3768255 - RNA, 20 nt, Human
ucagacagcugccugggauc

SEQ ID NO: 3768256 - RNA, 14 nt, Human
ucagacauaaagcc

SEQ ID NO: 3768257 - RNA, 22 nt, Human
ucagacauagaauuaacacaug

SEQ ID NO: 3768258 - RNA, 18 nt, Human
ucagacccccacucucau

SEQ ID NO: 3768259 - RNA, 14 nt, Human
ucagacccuacccc

SEQ ID NO: 3768260 - RNA, 12 nt, Human
ucagacccugga

SEQ ID NO: 3768261 - RNA, 17 nt, Human
ucagacgacagccccug

SEQ ID NO: 3768262 - RNA, 16 nt, Human
ucagacgccugaggaa

SEQ ID NO: 3768263 - RNA, 17 nt, Human
ucagacuaagccagcac

SEQ ID NO: 3768264 - RNA, 19 nt, Human
ucagacucccauuccugaa

SEQ ID NO: 3768265 - RNA, 15 nt, Human
ucagacugcacccag

SEQ ID NO: 3768266 - RNA, 20 nt, Human
ucagacugcacccaggaggg

SEQ ID NO: 3768267 - RNA, 14 nt, Human
ucagacugcuggga

SEQ ID NO: 3768268 - RNA, 15 nt, Human
ucagacugcuuuaaa

SEQ ID NO: 3768269 - RNA, 21 nt, Human
ucagacuggcuggcugcagug

SEQ ID NO: 3768270 - RNA, 23 nt, Human
ucagacuugccaugugacucugg

SEQ ID NO: 3768271 - RNA, 14 nt, Human
ucagacuugucaag

SEQ ID NO: 3768272 - RNA, 17 nt, Human
ucagacuuuaaagaaua

SEQ ID NO: 3768273 - RNA, 20 nt, Human
ucagacuuuggaaaaugcau

SEQ ID NO: 3768274 - RNA, 17 nt, Human
ucagagaaaugucuguc

SEQ ID NO: 3768275 - RNA, 21 nt, Human
ucagagacaaaauauuuccca

SEQ ID NO: 3768276 - RNA, 12 nt, Human
ucagagacagau

SEQ ID NO: 3768277 - RNA, 23 nt, Human
ucagagacaggaagucuucaggg

SEQ ID NO: 3768278 - RNA, 16 nt, Human
ucagagaccaggcccu

SEQ ID NO: 3768279 - RNA, 20 nt, Human
ucagagaccagggcuccagc

SEQ ID NO: 3768280 - RNA, 14 nt, Human
ucagagacucaggg

SEQ ID NO: 3768281 - RNA, 22 nt, Human
ucagagacuccugcaggcagcc

SEQ ID NO: 3768282 - RNA, 15 nt, Human
ucagagacugcugug

SEQ ID NO: 3768283 - RNA, 19 nt, Human
ucagagagaauggcuuugg

SEQ ID NO: 3768284 - RNA, 12 nt, Human
ucagagagcagc

SEQ ID NO: 3768285 - RNA, 18 nt, Human
ucagagagcagugcuuuu

SEQ ID NO: 3768286 - RNA, 21 nt, Human
ucagagaggccuuuuggaaug

SEQ ID NO: 3768287 - RNA, 16 nt, Human
ucagagauaggccugu

SEQ ID NO: 3768288 - RNA, 18 nt, Human
ucaggggcuguuugagga

SEQ ID NO: 3768289 - RNA, 15 nt, Human
ucaggguaggcugga

SEQ ID NO: 3768290 - RNA, 19 nt, Human
ucagggucccugguggcag

SEQ ID NO: 3768291 - RNA, 16 nt, Human
ucagggucucugcugc

SEQ ID NO: 3768292 - RNA, 15 nt, Human
ucaggguucuccucu

SEQ ID NO: 3768293 - RNA, 18 nt, Human
ucaggguuggccccugcc

SEQ ID NO: 3768294 - RNA, 23 nt, Human
ucaggguuggccccugcccggcu

SEQ ID NO: 3768295 - RNA, 18 nt, Human
ucaggguuggugugcuga

SEQ ID NO: 3768296 - RNA, 13 nt, Human
ucagguaacaggc

SEQ ID NO: 3768297 - RNA, 16 nt, Human
ucagguaacaggcaga

SEQ ID NO: 3768298 - RNA, 16 nt, Human
ucagguaauacaaacu

SEQ ID NO: 3768299 - RNA, 20 nt, Human
ucagguaaucgaccugccuc

SEQ ID NO: 3768300 - RNA, 18 nt, Human
ucagguacagagaaggaa

SEQ ID NO: 3768301 - RNA, 21 nt, Human
ucagguagaggugcaugccua

SEQ ID NO: 3768302 - RNA, 21 nt, Human
ucagguauguugccuuuaugg

SEQ ID NO: 3768303 - RNA, 15 nt, Human
ucaggucagggugag

SEQ ID NO: 3768304 - RNA, 18 nt, Human
ucaggucagggugaggau

SEQ ID NO: 3768305 - RNA, 18 nt, Human
ucaggugaaaauguucau

SEQ ID NO: 3768306 - RNA, 23 nt, Human
ucaggugauccacccaccucagc

SEQ ID NO: 3768307 - RNA, 14 nt, Human
ucaggugcagagga

SEQ ID NO: 3768308 - RNA, 16 nt, Human
ucaggugcagaggaag

SEQ ID NO: 3768309 - RNA, 14 nt, Human
ucaggugcugccau

SEQ ID NO: 3768310 - RNA, 19 nt, Human
ucagguggggcagcuugag

SEQ ID NO: 3768311 - RNA, 21 nt, Human
ucagguggggucacucuggca

SEQ ID NO: 3768312 - RNA, 22 nt, Human
ucagguguuuuuuaugaagugc

SEQ ID NO: 3768313 - RNA, 23 nt, Human
ucagguuaucgaaauaacaaugu

SEQ ID NO: 3768314 - RNA, 22 nt, Human
ucagguugcugguugcugugug

SEQ ID NO: 3768315 - RNA, 17 nt, Human
ucagguuugccugaggg

SEQ ID NO: 3768316 - RNA, 13 nt, Human
ucagguuuuguaa

SEQ ID NO: 3768317 - RNA, 22 nt, Human
ucagguuuuuccuuuuuuugua

SEQ ID NO: 3768318 - RNA, 20 nt, Human
ucaguaaaauuauacugugu

SEQ ID NO: 3768319 - RNA, 23 nt, Human
ucaguaaaauuauacugugugug

SEQ ID NO: 3768320 - RNA, 21 nt, Human
ucaguaaacgggaacaugccc

SEQ ID NO: 3768321 - RNA, 22 nt, Human
ucaguaaacgggaacaugcccc

SEQ ID NO: 3768322 - RNA, 17 nt, Human
ucaguaaauaacuggaa

SEQ ID NO: 3768323 - RNA, 21 nt, Human
ucaguaacccccuuaaauuua

SEQ ID NO: 3768324 - RNA, 12 nt, Human
ucaguaagaggu

SEQ ID NO: 3768325 - RNA, 23 nt, Human
ucaguaaguuaucuuugaauaug

SEQ ID NO: 3768326 - RNA, 12 nt, Human
ucaguaauaaaa

SEQ ID NO: 3768327 - RNA, 13 nt, Human
ucaguaauaaaac

SEQ ID NO: 3768328 - RNA, 15 nt, Human
ucaguaauaaaacau

SEQ ID NO: 3768329 - RNA, 13 nt, Human
ucaguaauguuau

SEQ ID NO: 3768330 - RNA, 19 nt, Human
ucaguaauuuagaaaucau

SEQ ID NO: 3768331 - RNA, 20 nt, Human
ucaguaauuuagaaaucauu

SEQ ID NO: 3768332 - RNA, 15 nt, Human
ucaguaauuugagga

SEQ ID NO: 3768333 - RNA, 17 nt, Human
ucaguaauuugaggaca

SEQ ID NO: 3768334 - RNA, 18 nt, Human
ucaguacccaccugagcu

SEQ ID NO: 3768335 - RNA, 15 nt, Human
ucaguaccuggagga

SEQ ID NO: 3768336 - RNA, 18 nt, Human
ucaguaccuggaggagga

SEQ ID NO: 3768337 - RNA, 20 nt, Human
ucaguacuugugaaacacag

SEQ ID NO: 3768338 - RNA, 23 nt, Human
ucaguacuuuuuuaaauauuuuc

SEQ ID NO: 3768339 - RNA, 18 nt, Human
ucaguaggcuaaugucaa

SEQ ID NO: 3768340 - RNA, 15 nt, Human
ucaguagucccugca

SEQ ID NO: 3768341 - RNA, 19 nt, Human
ucaguaguuuaaaaguucu

SEQ ID NO: 3768342 - RNA, 15 nt, Human
ucaguaguuugcauu

SEQ ID NO: 3768343 - RNA, 16 nt, Human
ucaguauaauucugua

SEQ ID NO: 3768344 - RNA, 16 nt, Human
ucaguauaauuuuuua

SEQ ID NO: 3768345 - RNA, 13 nt, Human
ucaguauccaggc

SEQ ID NO: 3768346 - RNA, 17 nt, Human
ucaguauccaggcuuug

SEQ ID NO: 3768347 - RNA, 17 nt, Human
ucaguauccaugcucuu

SEQ ID NO: 3768348 - RNA, 17 nt, Human
ucaguaugaauuauuca

SEQ ID NO: 3768349 - RNA, 15 nt, Human
ucaguauguauucuu

SEQ ID NO: 3768350 - RNA, 12 nt, Human
ucaguaugugga

SEQ ID NO: 3768351 - RNA, 14 nt, Human
ucaguauguggaag

SEQ ID NO: 3768352 - RNA, 20 nt, Human
ucaguauguugucaaagaga

SEQ ID NO: 3768353 - RNA, 19 nt, Human
ucaguauguuuuacacugu

SEQ ID NO: 3768354 - RNA, 21 nt, Human
ucaguauuaaaggggggaggg

SEQ ID NO: 3768355 - RNA, 23 nt, Human
ucaguauuaauacuaaaauaugu

SEQ ID NO: 3768356 - RNA, 14 nt, Human
ucaguauuauaugu

SEQ ID NO: 3768357 - RNA, 16 nt, Human
ucaguauuauauguac

SEQ ID NO: 3768358 - RNA, 17 nt, Human
ucaguauuguuuugguu

SEQ ID NO: 3768359 - RNA, 13 nt, Human
ucaguauuuaacu

SEQ ID NO: 3768360 - RNA, 14 nt, Human
ucaguauuuaacua

SEQ ID NO: 3768361 - RNA, 14 nt, Human
ucaguauuucagug

SEQ ID NO: 3768362 - RNA, 23 nt, Human
ucaguauuuuggagaaauuauuu

SEQ ID NO: 3768363 - RNA, 14 nt, Human
ucaguauuuuuccu

SEQ ID NO: 3768364 - RNA, 15 nt, Human
ucagucagaaaacuu

SEQ ID NO: 3768365 - RNA, 19 nt, Human
ucagucagugcaaauguca

SEQ ID NO: 3768366 - RNA, 20 nt, Human
ucagucaugcauaaauaugc

SEQ ID NO: 3768367 - RNA, 15 nt, Human
ucaguccauagcaga

SEQ ID NO: 3768368 - RNA, 18 nt, Human
ucaguccaugaagaugua

SEQ ID NO: 3768369 - RNA, 15 nt, Human
ucaguccauuuauau

SEQ ID NO: 3768370 - RNA, 18 nt, Human
ucaguccccacagauaac

SEQ ID NO: 3768371 - RNA, 12 nt, Human
ucaguccccucc

SEQ ID NO: 3768372 - RNA, 13 nt, Human
ucaguccccuccc

SEQ ID NO: 3768373 - RNA, 15 nt, Human
ucaguccccucccau

SEQ ID NO: 3768374 - RNA, 18 nt, Human
ucaguccccucccaucug

SEQ ID NO: 3768375 - RNA, 20 nt, Human
ucaguccccucccaucuggg

SEQ ID NO: 3768376 - RNA, 18 nt, Human
ucagucccuauguauuug

SEQ ID NO: 3768377 - RNA, 19 nt, Human
ucaguccucaaagcuuuuu

SEQ ID NO: 3768378 - RNA, 23 nt, Human
ucaguccuccccucacagccucu

SEQ ID NO: 3768379 - RNA, 23 nt, Human
ucagucgccuuucagcaggcagc

SEQ ID NO: 3768380 - RNA, 14 nt, Human
ucagucucaggagc

SEQ ID NO: 3768381 - RNA, 16 nt, Human
ucagucucccucccuu

SEQ ID NO: 3768382 - RNA, 20 nt, Human
ucagucucccuucucccaug

SEQ ID NO: 3768383 - RNA, 14 nt, Human
ucagucucccuuuc

SEQ ID NO: 3768384 - RNA, 15 nt, Human
ucagucucuauacca

SEQ ID NO: 3768385 - RNA, 18 nt, Human
ucagucucuauaccaaua

SEQ ID NO: 3768386 - RNA, 20 nt, Human
ucagucucuauaccaauaaa

SEQ ID NO: 3768387 - RNA, 22 nt, Human
ucagucucuauaccaauaaagu

SEQ ID NO: 3768388 - RNA, 20 nt, Human
ucagucucucuucucuccag

SEQ ID NO: 3768389 - RNA, 17 nt, Human
ucagucucugagggcuu

SEQ ID NO: 3768390 - RNA, 23 nt, Human
ucagucugauucccaagcucugc

SEQ ID NO: 3768391 - RNA, 24 nt, Human
ucagucugauucccaagcucugcu

SEQ ID NO: 3768392 - RNA, 21 nt, Human
ucagucugcuuagaaauaaca

SEQ ID NO: 3768393 - RNA, 15 nt, Human
ucagucuggcccuuc

SEQ ID NO: 3768394 - RNA, 17 nt, Human
ucagucuggugggagga

SEQ ID NO: 3768395 - RNA, 12 nt, Human
ucagucuugccu

SEQ ID NO: 3768396 - RNA, 20 nt, Human
ucagucuugccuuacacaaa

SEQ ID NO: 3768397 - RNA, 22 nt, Human
ucagucuuucuuagugccugug

SEQ ID NO: 3768398 - RNA, 12 nt, Human
ucagucuuuuuc

SEQ ID NO: 3768399 - RNA, 21 nt, Human
ucagucuuuuucuguuguaac

SEQ ID NO: 3768400 - RNA, 13 nt, Human
ucagugaagacua

SEQ ID NO: 3768401 - RNA, 16 nt, Human
ucagugaaguugcugc

SEQ ID NO: 3768402 - RNA, 15 nt, Human
ucagugacagaguuc

SEQ ID NO: 3768403 - RNA, 19 nt, Human
ucagugacagaguucacua

SEQ ID NO: 3768404 - RNA, 19 nt, Human
ucagugauguaccaugaaa

SEQ ID NO: 3768405 - RNA, 15 nt, Human
ucagugcagcccgug

SEQ ID NO: 3768406 - RNA, 16 nt, Human
ucagugcauuugugcu

SEQ ID NO: 3768407 - RNA, 22 nt, Human
ucagugccaauaaaauuuagga

SEQ ID NO: 3768408 - RNA, 9 nt, Human
ucagugccc

SEQ ID NO: 3768409 - RNA, 13 nt, Human
ucagugcccacca

SEQ ID NO: 3768410 - RNA, 23 nt, Human
ucagugccccgucuacagcuccc

SEQ ID NO: 3768411 - RNA, 15 nt, Human
ucagugcccuccagc

SEQ ID NO: 3768412 - RNA, 16 nt, Human
ucagugccgccgccuc

SEQ ID NO: 3768413 - RNA, 21 nt, Human
ucagugccgccgccucgccca

SEQ ID NO: 3768414 - RNA, 11 nt, Human
ucagugccuua

SEQ ID NO: 3768415 - RNA, 12 nt, Human
ucagugccuuau

SEQ ID NO: 3768416 - RNA, 20 nt, Human
ucagugccuuauggaacacu

SEQ ID NO: 3768417 - RNA, 22 nt, Human
ucagugccuuauggaacacucu

SEQ ID NO: 3768418 - RNA, 13 nt, Human
ucagugcucccuc

SEQ ID NO: 3768419 - RNA, 12 nt, Human
ucagugcugccu

SEQ ID NO: 3768420 - RNA, 17 nt, Human
ucagugcuguggccugg

SEQ ID NO: 3768421 - RNA, 22 nt, Human
ucagugcuguggccugggcaag

SEQ ID NO: 3768422 - RNA, 21 nt, Human
ucaguggaagaagcagaugag

SEQ ID NO: 3768423 - RNA, 21 nt, Human
ucaguggacuuuccacccccu

SEQ ID NO: 3768424 - RNA, 12 nt, Human
ucaguggagcca

SEQ ID NO: 3768425 - RNA, 13 nt, Human
ucaguggcagcug

SEQ ID NO: 3768426 - RNA, 14 nt, Human
ucaguggcagcugc

SEQ ID NO: 3768427 - RNA, 16 nt, Human
ucaguggcagcugcuu

SEQ ID NO: 3768428 - RNA, 15 nt, Human
ucaguggcagggcuc

SEQ ID NO: 3768429 - RNA, 19 nt, Human
ucaguggcagggcucagga

SEQ ID NO: 3768430 - RNA, 19 nt, Human
ucaguggcauggcuccagu

SEQ ID NO: 3768431 - RNA, 17 nt, Human
ucaguggcuucaucugu

SEQ ID NO: 3768432 - RNA, 19 nt, Human
ucagugggaacgugacugc

SEQ ID NO: 3768433 - RNA, 14 nt, Human
ucauauuacaauau

SEQ ID NO: 3768434 - RNA, 22 nt, Human
ucauauuagacuucuguuuuca

SEQ ID NO: 3768435 - RNA, 16 nt, Human
ucauauucugucugga

SEQ ID NO: 3768436 - RNA, 16 nt, Human
ucauauucuuucaauu

SEQ ID NO: 3768437 - RNA, 14 nt, Human
ucauauugaugaaa

SEQ ID NO: 3768438 - RNA, 15 nt, Human
ucauauugaugaaaa

SEQ ID NO: 3768439 - RNA, 13 nt, Human
ucauauuuaauau

SEQ ID NO: 3768440 - RNA, 23 nt, Human
ucauauuuacuucuuauacauuu

SEQ ID NO: 3768441 - RNA, 13 nt, Human
ucauauuucccau

SEQ ID NO: 3768442 - RNA, 22 nt, Human
ucauauuucccaugauuucaug

SEQ ID NO: 3768443 - RNA, 19 nt, Human
ucauauuuguacuuucugu

SEQ ID NO: 3768444 - RNA, 15 nt, Human
ucauauuuucaugcu

SEQ ID NO: 3768445 - RNA, 23 nt, Human
ucaucaaauggaagacacauuga

SEQ ID NO: 3768446 - RNA, 18 nt, Human
ucaucaacaaagaaauau

SEQ ID NO: 3768447 - RNA, 15 nt, Human
ucaucaacugaauga

SEQ ID NO: 3768448 - RNA, 19 nt, Human
ucaucaagagaauuugggg

SEQ ID NO: 3768449 - RNA, 15 nt, Human
ucaucaaggcacugc

SEQ ID NO: 3768450 - RNA, 16 nt, Human
ucaucaaggcacugcc

SEQ ID NO: 3768451 - RNA, 13 nt, Human
ucaucaauaaaac

SEQ ID NO: 3768452 - RNA, 21 nt, Human
ucaucaaucaaauaaguauuu

SEQ ID NO: 3768453 - RNA, 19 nt, Human
ucaucaaucauuguacagu

SEQ ID NO: 3768454 - RNA, 19 nt, Human
ucaucaauggggccaguca

SEQ ID NO: 3768455 - RNA, 13 nt, Human
ucaucaauuaaag

SEQ ID NO: 3768456 - RNA, 12 nt, Human
ucaucaauuccc

SEQ ID NO: 3768457 - RNA, 15 nt, Human
ucaucaauucccauu

SEQ ID NO: 3768458 - RNA, 23 nt, Human
ucaucaauugaauggucagcguu

SEQ ID NO: 3768459 - RNA, 15 nt, Human
ucaucacuggaugaa

SEQ ID NO: 3768460 - RNA, 22 nt, Human
ucaucacuggaugaagauucuc

SEQ ID NO: 3768461 - RNA, 15 nt, Human
ucaucacuguggcug

SEQ ID NO: 3768462 - RNA, 16 nt, Human
ucaucagaaaggaaaa

SEQ ID NO: 3768463 - RNA, 15 nt, Human
ucaucagaacagcug

SEQ ID NO: 3768464 - RNA, 22 nt, Human
ucaucagaagugguaggaaagc

SEQ ID NO: 3768465 - RNA, 20 nt, Human
ucaucagauggaaauauuuu

SEQ ID NO: 3768466 - RNA, 12 nt, Human
ucaucagcauuu

SEQ ID NO: 3768467 - RNA, 15 nt, Human
ucaucaggaacguuu

SEQ ID NO: 3768468 - RNA, 20 nt, Human
ucaucagggaggaaaguuuc

SEQ ID NO: 3768469 - RNA, 13 nt, Human
ucaucagggccug

SEQ ID NO: 3768470 - RNA, 23 nt, Human
ucaucagggccuggggccugaga

SEQ ID NO: 3768471 - RNA, 14 nt, Human
ucaucaguauugaa

SEQ ID NO: 3768472 - RNA, 21 nt, Human
ucaucaguauugaagcauuuu

SEQ ID NO: 3768473 - RNA, 15 nt, Human
ucaucaguggagcca

SEQ ID NO: 3768474 - RNA, 15 nt, Human
ucaucauaaaauaaa

SEQ ID NO: 3768475 - RNA, 19 nt, Human
ucaucauaguaaaagaaau

SEQ ID NO: 3768476 - RNA, 17 nt, Human
ucaucauauuauacaga

SEQ ID NO: 3768477 - RNA, 16 nt, Human
ucaucaucauggccag

SEQ ID NO: 3768478 - RNA, 16 nt, Human
ucaucauccagaugug

SEQ ID NO: 3768479 - RNA, 17 nt, Human
ucaucauccagaugugg

SEQ ID NO: 3768480 - RNA, 19 nt, Human
ucaucaugcagcucaacuu

SEQ ID NO: 3768481 - RNA, 14 nt, Human
ucaucauggccagc

SEQ ID NO: 3768482 - RNA, 18 nt, Human
ucaucaugucuauugucc

SEQ ID NO: 3768483 - RNA, 14 nt, Human
ucaucauuauuauu

SEQ ID NO: 3768484 - RNA, 19 nt, Human
ucaucauucacuucacugu

SEQ ID NO: 3768485 - RNA, 14 nt, Human
ucaucauucccucu

SEQ ID NO: 3768486 - RNA, 14 nt, Human
ucaucauucucugu

SEQ ID NO: 3768487 - RNA, 19 nt, Human
ucaucauucucugucucau

SEQ ID NO: 3768488 - RNA, 20 nt, Human
ucaucauucucugucucauc

SEQ ID NO: 3768489 - RNA, 22 nt, Human
ucaucauucucugucucaucca

SEQ ID NO: 3768490 - RNA, 17 nt, Human
ucauccaacuuauguuu

SEQ ID NO: 3768491 - RNA, 19 nt, Human
ucauccaaguuaaauguag

SEQ ID NO: 3768492 - RNA, 15 nt, Human
ucauccaauccucac

SEQ ID NO: 3768493 - RNA, 18 nt, Human
ucauccaauccucacugg

SEQ ID NO: 3768494 - RNA, 20 nt, Human
ucauccaauccucacugggu

SEQ ID NO: 3768495 - RNA, 22 nt, Human
ucauccaauccucacugggugg

SEQ ID NO: 3768496 - RNA, 22 nt, Human
ucauccaaucuaaccacaucaa

SEQ ID NO: 3768497 - RNA, 19 nt, Human
ucauccacauacccugacc

SEQ ID NO: 3768498 - RNA, 16 nt, Human
ucauccacauuguuuu

SEQ ID NO: 3768499 - RNA, 20 nt, Human
ucauccaccccaucccuccc

SEQ ID NO: 3768500 - RNA, 14 nt, Human
ucauccacugugcc

SEQ ID NO: 3768501 - RNA, 21 nt, Human
ucauccacugugccaugugcc

SEQ ID NO: 3768502 - RNA, 17 nt, Human
ucauccaucaucaugug

SEQ ID NO: 3768503 - RNA, 14 nt, Human
ucauccauucuauu

SEQ ID NO: 3768504 - RNA, 17 nt, Human
ucaucccaugagacccu

SEQ ID NO: 3768505 - RNA, 22 nt, Human
ucaucccauuaaucauuucccc

SEQ ID NO: 3768506 - RNA, 20 nt, Human
ucaucccauuccaggcagcc

SEQ ID NO: 3768507 - RNA, 17 nt, Human
ucaucccuaaugcugca

SEQ ID NO: 3768508 - RNA, 14 nt, Human
ucaucccuucucuu

SEQ ID NO: 3768509 - RNA, 14 nt, Human
ucaucccuuuccag

SEQ ID NO: 3768510 - RNA, 15 nt, Human
ucauccgaggcaggg

SEQ ID NO: 3768511 - RNA, 15 nt, Human
ucauccuauuguuga

SEQ ID NO: 3768512 - RNA, 23 nt, Human
ucauccucacagugaacacucag

SEQ ID NO: 3768513 - RNA, 18 nt, Human
ucauccucauacccaccc

SEQ ID NO: 3768514 - RNA, 11 nt, Human
ucauccuccug

SEQ ID NO: 3768515 - RNA, 12 nt, Human
ucauccuccugg

SEQ ID NO: 3768516 - RNA, 16 nt, Human
ucauccugacucugcc

SEQ ID NO: 3768517 - RNA, 18 nt, Human
ucauccuucccacucugu

SEQ ID NO: 3768518 - RNA, 13 nt, Human
ucauccuugucuu

SEQ ID NO: 3768519 - RNA, 22 nt, Human
ucauccuuucacuucuuucccu

SEQ ID NO: 3768520 - RNA, 13 nt, Human
ucauccuuuucuc

SEQ ID NO: 3768521 - RNA, 14 nt, Human
ucauccuuuucucc

SEQ ID NO: 3768522 - RNA, 14 nt, Human
ucaucgccagaggu

SEQ ID NO: 3768523 - RNA, 15 nt, Human
ucaucgccagaggug

SEQ ID NO: 3768524 - RNA, 21 nt, Human
ucaucgccagaggugcuucac

SEQ ID NO: 3768525 - RNA, 17 nt, Human
ucaucgcguccuccuac

SEQ ID NO: 3768526 - RNA, 17 nt, Human
ucaucgcucguguguuc

SEQ ID NO: 3768527 - RNA, 20 nt, Human
ucaucguaggugauuugaag

SEQ ID NO: 3768528 - RNA, 16 nt, Human
ucaucuaaaagaaaaa

SEQ ID NO: 3768529 - RNA, 19 nt, Human
ucaucuaagucaguaccca

SEQ ID NO: 3768530 - RNA, 20 nt, Human
ucaucuaccauuuucugguu

SEQ ID NO: 3768531 - RNA, 18 nt, Human
ucaucuagguaaauuaca

SEQ ID NO: 3768532 - RNA, 13 nt, Human
ucaucuaguuuua

SEQ ID NO: 3768533 - RNA, 16 nt, Human
ucaucuauuucugaga

SEQ ID NO: 3768534 - RNA, 13 nt, Human
ucaucuauuuuga

SEQ ID NO: 3768535 - RNA, 13 nt, Human
ucaucucagcuca

SEQ ID NO: 3768536 - RNA, 20 nt, Human
ucaucucauuuaagggaaaa

SEQ ID NO: 3768537 - RNA, 23 nt, Human
ucaucucauuuaagggaaaaaua

SEQ ID NO: 3768538 - RNA, 20 nt, Human
ucaucucauuuaauccuccc

SEQ ID NO: 3768539 - RNA, 22 nt, Human
ucaucuccagggaguccccucc

SEQ ID NO: 3768540 - RNA, 23 nt, Human
ucaucuccagggaguccccuccc

SEQ ID NO: 3768541 - RNA, 13 nt, Human
ucaucuccaucag

SEQ ID NO: 3768542 - RNA, 22 nt, Human
ucaucucccaccuagcagcacc

SEQ ID NO: 3768543 - RNA, 18 nt, Human
ucaucuccugccuuccuc

SEQ ID NO: 3768544 - RNA, 21 nt, Human
ucaucuccugccuuccuccug

SEQ ID NO: 3768545 - RNA, 23 nt, Human
ucaucuccugccuuccuccuggg

SEQ ID NO: 3768546 - RNA, 15 nt, Human
ucaucucuccuccaa

SEQ ID NO: 3768547 - RNA, 14 nt, Human
ucaucucucugccc

SEQ ID NO: 3768548 - RNA, 16 nt, Human
ucaucucucugcccaa

SEQ ID NO: 3768549 - RNA, 16 nt, Human
ucaucucucuuuaaua

SEQ ID NO: 3768550 - RNA, 13 nt, Human
ucaucucuuagcu

SEQ ID NO: 3768551 - RNA, 23 nt, Human
ucaucugaauuugcccugggaaa

SEQ ID NO: 3768552 - RNA, 17 nt, Human
ucaucugacuaugacau

SEQ ID NO: 3768553 - RNA, 18 nt, Human
ucaucugacuaugacaua

SEQ ID NO: 3768554 - RNA, 14 nt, Human
ucaucugagaauga

SEQ ID NO: 3768555 - RNA, 19 nt, Human
ucaucugagaaugaacaaa

SEQ ID NO: 3768556 - RNA, 23 nt, Human
ucaucugagagaggcuaaaaugu

SEQ ID NO: 3768557 - RNA, 21 nt, Human
ucaucugcccaacuguguagc

SEQ ID NO: 3768558 - RNA, 17 nt, Human
ucaucugcucagcagcu

SEQ ID NO: 3768559 - RNA, 17 nt, Human
ucaucugcucuccuucc

SEQ ID NO: 3768560 - RNA, 14 nt, Human
ucaucugcuggucc

SEQ ID NO: 3768561 - RNA, 18 nt, Human
ucaucuggaaccaucaga

SEQ ID NO: 3768562 - RNA, 12 nt, Human
ucaucuggaagu

SEQ ID NO: 3768563 - RNA, 13 nt, Human
ucaucuggaaguu

SEQ ID NO: 3768564 - RNA, 21 nt, Human
ucaucuggauaggagccugcu

SEQ ID NO: 3768565 - RNA, 23 nt, Human
ucaucuggcaacaucuuuauccg

SEQ ID NO: 3768566 - RNA, 12 nt, Human
ucaucuggcugc

SEQ ID NO: 3768567 - RNA, 16 nt, Human
ucaucuggggagcagg

SEQ ID NO: 3768568 - RNA, 20 nt, Human
ucaucuggggagcaggcagc

SEQ ID NO: 3768569 - RNA, 23 nt, Human
ucaucuggggagcaggcagccag

SEQ ID NO: 3768570 - RNA, 16 nt, Human
ucaucugggggagugg

SEQ ID NO: 3768571 - RNA, 23 nt, Human
ucaucugguugaacucugguggc

SEQ ID NO: 3768572 - RNA, 16 nt, Human
ucaucuguaagcuguu

SEQ ID NO: 3768573 - RNA, 17 nt, Human
ucaucugucccuccggg

SEQ ID NO: 3768574 - RNA, 18 nt, Human
ucaucugucccuccggga

SEQ ID NO: 3768575 - RNA, 12 nt, Human
ucaucugugcac

SEQ ID NO: 3768576 - RNA, 14 nt, Human
ucaucugugugaaa

SEQ ID NO: 3768577 - RNA, 16 nt, Human
ucaucuuacuguaccu

SEQ ID NO: 3768578 - RNA, 17 nt, Human
uccccagacuuguuggc

SEQ ID NO: 3768579 - RNA, 11 nt, Human
uccccagagaa

SEQ ID NO: 3768580 - RNA, 23 nt, Human
uccccagagaaaggggagcccac

SEQ ID NO: 3768581 - RNA, 13 nt, Human
uccccagauugca

SEQ ID NO: 3768582 - RNA, 18 nt, Human
uccccagauugcaacagg

SEQ ID NO: 3768583 - RNA, 23 nt, Human
uccccagauugcaacaggcuggg

SEQ ID NO: 3768584 - RNA, 22 nt, Human
uccccagcaagugagagcuggg

SEQ ID NO: 3768585 - RNA, 10 nt, Human
uccccagcag

SEQ ID NO: 3768586 - RNA, 15 nt, Human
uccccagcagguggg

SEQ ID NO: 3768587 - RNA, 19 nt, Human
uccccagcaucacucccca

SEQ ID NO: 3768588 - RNA, 20 nt, Human
uccccagcaugcaccacggg

SEQ ID NO: 3768589 - RNA, 14 nt, Human
uccccagcccacug

SEQ ID NO: 3768590 - RNA, 14 nt, Human
uccccagcccagag

SEQ ID NO: 3768591 - RNA, 15 nt, Human
uccccagcccagaga

SEQ ID NO: 3768592 - RNA, 14 nt, Human
uccccagcccaggg

SEQ ID NO: 3768593 - RNA, 13 nt, Human
uccccagccccua

SEQ ID NO: 3768594 - RNA, 20 nt, Human
uccccagccccuagcccagg

SEQ ID NO: 3768595 - RNA, 13 nt, Human
uccccagcccugg

SEQ ID NO: 3768596 - RNA, 15 nt, Human
uccccagcccuggcu

SEQ ID NO: 3768597 - RNA, 16 nt, Human
uccccagcccuucaca

SEQ ID NO: 3768598 - RNA, 18 nt, Human
uccccagcccuuccucug

SEQ ID NO: 3768599 - RNA, 22 nt, Human
uccccagcccuuccucugcucc

SEQ ID NO: 3768600 - RNA, 18 nt, Human
uccccagccucucuuccu

SEQ ID NO: 3768601 - RNA, 15 nt, Human
uccccagcucccagg

SEQ ID NO: 3768602 - RNA, 20 nt, Human
uccccaggaggccagccuug

SEQ ID NO: 3768603 - RNA, 22 nt, Human
uccccaggccaggccaccagga

SEQ ID NO: 3768604 - RNA, 19 nt, Human
uccccaggccguggcugcc

SEQ ID NO: 3768605 - RNA, 17 nt, Human
uccccagggaagcagca

SEQ ID NO: 3768606 - RNA, 13 nt, Human
uccccagggcacg

SEQ ID NO: 3768607 - RNA, 21 nt, Human
uccccagggcacgugguugag

SEQ ID NO: 3768608 - RNA, 19 nt, Human
uccccaggggaaaaugaag

SEQ ID NO: 3768609 - RNA, 17 nt, Human
uccccaggggucccagc

SEQ ID NO: 3768610 - RNA, 23 nt, Human
uccccagguccagcucuggaggg

SEQ ID NO: 3768611 - RNA, 15 nt, Human
uccccagguggcuga

SEQ ID NO: 3768612 - RNA, 18 nt, Human
uccccagguggcugaccc

SEQ ID NO: 3768613 - RNA, 19 nt, Human
uccccagguggcugaccca

SEQ ID NO: 3768614 - RNA, 20 nt, Human
uccccagguggcugacccag

SEQ ID NO: 3768615 - RNA, 15 nt, Human
uccccaguaaaauug

SEQ ID NO: 3768616 - RNA, 16 nt, Human
uccccagucccaaugc

SEQ ID NO: 3768617 - RNA, 23 nt, Human
uccccaguucgccuggagcccuc

SEQ ID NO: 3768618 - RNA, 17 nt, Human
uccccaguuugcagaaa

SEQ ID NO: 3768619 - RNA, 15 nt, Human
uccccauacucuguc

SEQ ID NO: 3768620 - RNA, 18 nt, Human
uccccaucaucuguggaa

SEQ ID NO: 3768621 - RNA, 14 nt, Human
uccccaucucaggc

SEQ ID NO: 3768622 - RNA, 14 nt, Human
uccccaucucccug

SEQ ID NO: 3768623 - RNA, 15 nt, Human
uccccaucugucggc

SEQ ID NO: 3768624 - RNA, 14 nt, Human
uccccaucuucuaa

SEQ ID NO: 3768625 - RNA, 21 nt, Human
uccccaugccacguuccacag

SEQ ID NO: 3768626 - RNA, 22 nt, Human
uccccaugccacguuccacagu

SEQ ID NO: 3768627 - RNA, 13 nt, Human
uccccaugccugu

SEQ ID NO: 3768628 - RNA, 17 nt, Human
uccccaugccuguggcu

SEQ ID NO: 3768629 - RNA, 18 nt, Human
uccccaugccuguggcug

SEQ ID NO: 3768630 - RNA, 19 nt, Human
uccccaugccuguggcugc

SEQ ID NO: 3768631 - RNA, 13 nt, Human
uccccauggagcc

SEQ ID NO: 3768632 - RNA, 23 nt, Human
uccccauggcaugggggccucag

SEQ ID NO: 3768633 - RNA, 17 nt, Human
uccccaugucucgacuc

SEQ ID NO: 3768634 - RNA, 24 nt, Human
uccccauuagcuuucaauuccgua

SEQ ID NO: 3768635 - RNA, 15 nt, Human
uccccauuucccauc

SEQ ID NO: 3768636 - RNA, 16 nt, Human
uccccauuucccaucu

SEQ ID NO: 3768637 - RNA, 17 nt, Human
uccccauuucccaucug

SEQ ID NO: 3768638 - RNA, 19 nt, Human
uccccauuucccaucugca

SEQ ID NO: 3768639 - RNA, 15 nt, Human
ucccccaaccccagc

SEQ ID NO: 3768640 - RNA, 15 nt, Human
ucccccaacccccac

SEQ ID NO: 3768641 - RNA, 17 nt, Human
ucccccaacccccaccc

SEQ ID NO: 3768642 - RNA, 17 nt, Human
ucccccaaccucagacu

SEQ ID NO: 3768643 - RNA, 12 nt, Human
ucccccaacucu

SEQ ID NO: 3768644 - RNA, 19 nt, Human
ucccccaccccauuucucu

SEQ ID NO: 3768645 - RNA, 18 nt, Human
ucccccacccccucccca

SEQ ID NO: 3768646 - RNA, 22 nt, Human
ucccccaccgguccagcuggcc

SEQ ID NO: 3768647 - RNA, 18 nt, Human
ucccccacuacugcagca

SEQ ID NO: 3768648 - RNA, 13 nt, Human
ucccccacuccca

SEQ ID NO: 3768649 - RNA, 14 nt, Human
ucccccacugccau

SEQ ID NO: 3768650 - RNA, 19 nt, Human
ucccccagcagccuggggu

SEQ ID NO: 3768651 - RNA, 15 nt, Human
ucccccagccacucc

SEQ ID NO: 3768652 - RNA, 21 nt, Human
ucccccagccaugccagcugg

SEQ ID NO: 3768653 - RNA, 12 nt, Human
ucccccagcccu

SEQ ID NO: 3768654 - RNA, 12 nt, Human
ucccccagccuc

SEQ ID NO: 3768655 - RNA, 23 nt, Human
ucccccagucauucugggaacau

SEQ ID NO: 3768656 - RNA, 12 nt, Human
ucccccagugcg

SEQ ID NO: 3768657 - RNA, 21 nt, Human
ucccccauccuccccuucccu

SEQ ID NO: 3768658 - RNA, 19 nt, Human
ucccccauguucugucccu

SEQ ID NO: 3768659 - RNA, 22 nt, Human
uccccccaagggaggcugcugc

SEQ ID NO: 3768660 - RNA, 11 nt, Human
uccccccaccu

SEQ ID NO: 3768661 - RNA, 12 nt, Human
uccccccacugc

SEQ ID NO: 3768662 - RNA, 19 nt, Human
uccccccacugcaggcccc

SEQ ID NO: 3768663 - RNA, 22 nt, Human
uccccccaucuugcuucccuaa

SEQ ID NO: 3768664 - RNA, 19 nt, Human
uccccccccaaccuuuccc

SEQ ID NO: 3768665 - RNA, 16 nt, Human
uccccccccccuccaa

SEQ ID NO: 3768666 - RNA, 14 nt, Human
ucccccccggggcu

SEQ ID NO: 3768667 - RNA, 18 nt, Human
ucccccccggggcugggu

SEQ ID NO: 3768668 - RNA, 15 nt, Human
uccccccuccucuga

SEQ ID NO: 3768669 - RNA, 18 nt, Human
uccccccuccucugaaac

SEQ ID NO: 3768670 - RNA, 20 nt, Human
uccccccuuuuuuuccuuuu

SEQ ID NO: 3768671 - RNA, 18 nt, Human
ucccccguguuccccucu

SEQ ID NO: 3768672 - RNA, 19 nt, Human
ucccccguguuccccucuu

SEQ ID NO: 3768673 - RNA, 17 nt, Human
ucccccuaaaccaacug

SEQ ID NO: 3768674 - RNA, 17 nt, Human
ucccccuauccuuggca

SEQ ID NO: 3768675 - RNA, 14 nt, Human
ucccccucccccag

SEQ ID NO: 3768676 - RNA, 18 nt, Human
ucccccucccccuucucc

SEQ ID NO: 3768677 - RNA, 16 nt, Human
ucccccucccuccccu

SEQ ID NO: 3768678 - RNA, 18 nt, Human
ucccccuccucuccacca

SEQ ID NO: 3768679 - RNA, 12 nt, Human
ucccccuccuuc

SEQ ID NO: 3768680 - RNA, 18 nt, Human
ucccccugccagugccuu

SEQ ID NO: 3768681 - RNA, 23 nt, Human
ucccccugcccucguggccagcc

SEQ ID NO: 3768682 - RNA, 22 nt, Human
ucccccugggcucugccccagc

SEQ ID NO: 3768683 - RNA, 23 nt, Human
ucccccugggcucugccccagcu

SEQ ID NO: 3768684 - RNA, 21 nt, Human
ucccccuggggcuucuccuga

SEQ ID NO: 3768685 - RNA, 19 nt, Human
ucccccuguccccucagcu

SEQ ID NO: 3768686 - RNA, 22 nt, Human
ucccccuucacaaagcccaagg

SEQ ID NO: 3768687 - RNA, 15 nt, Human
ucccccuucucccac

SEQ ID NO: 3768688 - RNA, 16 nt, Human
ucccccuugccacccc

SEQ ID NO: 3768689 - RNA, 24 nt, Human
uccccgaaacaggcuacucuccuc

SEQ ID NO: 3768690 - RNA, 19 nt, Human
uccccgaaggugcuggagg

SEQ ID NO: 3768691 - RNA, 20 nt, Human
uccccgagggaugaugccac

SEQ ID NO: 3768692 - RNA, 13 nt, Human
uccccgcccuuuu

SEQ ID NO: 3768693 - RNA, 16 nt, Human
uccccgccuggccagg

SEQ ID NO: 3768694 - RNA, 20 nt, Human
uccccgccuggccaggagca

SEQ ID NO: 3768695 - RNA, 17 nt, Human
uccccggcacccucugg

SEQ ID NO: 3768696 - RNA, 15 nt, Human
uccccggggcccagg

SEQ ID NO: 3768697 - RNA, 23 nt, Human
uccccguaugaguuagaauaaua

SEQ ID NO: 3768698 - RNA, 17 nt, Human
uccccgugggccauggc

SEQ ID NO: 3768699 - RNA, 14 nt, Human
uccccguuccugac

SEQ ID NO: 3768700 - RNA, 15 nt, Human
uccccguuccugaca

SEQ ID NO: 3768701 - RNA, 14 nt, Human
uccccuaaccucau

SEQ ID NO: 3768702 - RNA, 18 nt, Human
uccccuaguaagugccuu

SEQ ID NO: 3768703 - RNA, 20 nt, Human
uccccuaguaagugccuucc

SEQ ID NO: 3768704 - RNA, 21 nt, Human
uccccuaguaagugccuucca

SEQ ID NO: 3768705 - RNA, 16 nt, Human
uccccuauccacccag

SEQ ID NO: 3768706 - RNA, 21 nt, Human
uccccuauccacccagcccau

SEQ ID NO: 3768707 - RNA, 18 nt, Human
uccccucaaagucugcaa

SEQ ID NO: 3768708 - RNA, 22 nt, Human
uccccucaaggacaaagucucc

SEQ ID NO: 3768709 - RNA, 24 nt, Human
uccccucaaggacaaagucuccag

SEQ ID NO: 3768710 - RNA, 13 nt, Human
uccccucacagcc

SEQ ID NO: 3768711 - RNA, 14 nt, Human
uccccucacagccu

SEQ ID NO: 3768712 - RNA, 17 nt, Human
uccccucacagccucug

SEQ ID NO: 3768713 - RNA, 19 nt, Human
uccccucacagccucugac

SEQ ID NO: 3768714 - RNA, 19 nt, Human
uccccucacugauggacaa

SEQ ID NO: 3768715 - RNA, 12 nt, Human
uccccucagcuc

SEQ ID NO: 3768716 - RNA, 13 nt, Human
uccccucauucag

SEQ ID NO: 3768717 - RNA, 22 nt, Human
uccccuccaaccuggggggcag

SEQ ID NO: 3768718 - RNA, 15 nt, Human
uccccuccaucccug

SEQ ID NO: 3768719 - RNA, 16 nt, Human
uccccuccaucccugg

SEQ ID NO: 3768720 - RNA, 17 nt, Human
uccccucccaucuggga

SEQ ID NO: 3768721 - RNA, 14 nt, Human
uccccuccccaacu

SEQ ID NO: 3768722 - RNA, 18 nt, Human
uccccuccccggcccuac

SEQ ID NO: 3768723 - RNA, 19 nt, Human
ucccuggucccuuggagac

SEQ ID NO: 3768724 - RNA, 17 nt, Human
ucccugguggcagcuca

SEQ ID NO: 3768725 - RNA, 19 nt, Human
ucccugguggcagcucacc

SEQ ID NO: 3768726 - RNA, 14 nt, Human
ucccugguucaagc

SEQ ID NO: 3768727 - RNA, 17 nt, Human
ucccugguucugaugau

SEQ ID NO: 3768728 - RNA, 19 nt, Human
ucccuguaaccucuucaga

SEQ ID NO: 3768729 - RNA, 20 nt, Human
ucccuguauuuucuuucucu

SEQ ID NO: 3768730 - RNA, 21 nt, Human
ucccuguauuuucuuucucua

SEQ ID NO: 3768731 - RNA, 18 nt, Human
ucccugucaccucuuccg

SEQ ID NO: 3768732 - RNA, 12 nt, Human
ucccugucccag

SEQ ID NO: 3768733 - RNA, 16 nt, Human
ucccugucggccuggu

SEQ ID NO: 3768734 - RNA, 19 nt, Human
ucccugucuuuacuccuca

SEQ ID NO: 3768735 - RNA, 14 nt, Human
ucccugugccccca

SEQ ID NO: 3768736 - RNA, 20 nt, Human
ucccugugccuaacaccagc

SEQ ID NO: 3768737 - RNA, 17 nt, Human
ucccuguguugucucua

SEQ ID NO: 3768738 - RNA, 13 nt, Human
ucccuguuauuuu

SEQ ID NO: 3768739 - RNA, 17 nt, Human
ucccuguuauuuucaag

SEQ ID NO: 3768740 - RNA, 17 nt, Human
ucccuguuccccagaga

SEQ ID NO: 3768741 - RNA, 18 nt, Human
ucccuguuccccagagaa

SEQ ID NO: 3768742 - RNA, 21 nt, Human
ucccuguucuuccuccagcug

SEQ ID NO: 3768743 - RNA, 18 nt, Human
ucccuguuuaauauuuaa

SEQ ID NO: 3768744 - RNA, 22 nt, Human
ucccuguuuaauauuuaaacag

SEQ ID NO: 3768745 - RNA, 19 nt, Human
ucccuguuuucccacgagg

SEQ ID NO: 3768746 - RNA, 18 nt, Human
ucccuguuuucugagccc

SEQ ID NO: 3768747 - RNA, 18 nt, Human
ucccuuaaaauagaaaua

SEQ ID NO: 3768748 - RNA, 20 nt, Human
ucccuuaacaguuguauuua

SEQ ID NO: 3768749 - RNA, 14 nt, Human
ucccuuaauauccu

SEQ ID NO: 3768750 - RNA, 17 nt, Human
ucccuuaauauccuaaa

SEQ ID NO: 3768751 - RNA, 17 nt, Human
ucccuuacgugaguccu

SEQ ID NO: 3768752 - RNA, 21 nt, Human
ucccuuacuuuaccucucugu

SEQ ID NO: 3768753 - RNA, 15 nt, Human
ucccuuaucccugcu

SEQ ID NO: 3768754 - RNA, 11 nt, Human
ucccuucaacc

SEQ ID NO: 3768755 - RNA, 22 nt, Human
ucccuucaaccauuccccaugg

SEQ ID NO: 3768756 - RNA, 19 nt, Human
ucccuucacauaguuuuua

SEQ ID NO: 3768757 - RNA, 13 nt, Human
ucccuucagcccc

SEQ ID NO: 3768758 - RNA, 19 nt, Human
ucccuucaguacccucuca

SEQ ID NO: 3768759 - RNA, 10 nt, Human
ucccuucaua

SEQ ID NO: 3768760 - RNA, 14 nt, Human
ucccuucauacuug

SEQ ID NO: 3768761 - RNA, 18 nt, Human
ucccuucaucuccaggga

SEQ ID NO: 3768762 - RNA, 21 nt, Human
ucccuucaucuggaaccauca

SEQ ID NO: 3768763 - RNA, 14 nt, Human
ucccuuccaccugc

SEQ ID NO: 3768764 - RNA, 15 nt, Human
ucccuuccaccugcu

SEQ ID NO: 3768765 - RNA, 21 nt, Human
ucccuuccaccugcucugcug

SEQ ID NO: 3768766 - RNA, 17 nt, Human
ucccuuccacugccucu

SEQ ID NO: 3768767 - RNA, 22 nt, Human
ucccuuccacugccucugccuu

SEQ ID NO: 3768768 - RNA, 21 nt, Human
ucccuuccagauggucaucca

SEQ ID NO: 3768769 - RNA, 13 nt, Human
ucccuucccaccu

SEQ ID NO: 3768770 - RNA, 16 nt, Human
ucccuuccccaugcuu

SEQ ID NO: 3768771 - RNA, 20 nt, Human
ucccuuccccucccuggcuc

SEQ ID NO: 3768772 - RNA, 16 nt, Human
ucccuuccgacccucu

SEQ ID NO: 3768773 - RNA, 13 nt, Human
ucccuuccucuuc

SEQ ID NO: 3768774 - RNA, 14 nt, Human
ucccuuccucuucg

SEQ ID NO: 3768775 - RNA, 19 nt, Human
ucccuuccugccagccccu

SEQ ID NO: 3768776 - RNA, 20 nt, Human
ucccuuccuuguagccuuuu

SEQ ID NO: 3768777 - RNA, 18 nt, Human
ucccuuccuuuucccugc

SEQ ID NO: 3768778 - RNA, 20 nt, Human
ucccuuccuuuucccugcuu

SEQ ID NO: 3768779 - RNA, 17 nt, Human
ucccuucgacagcauuu

SEQ ID NO: 3768780 - RNA, 20 nt, Human
ucccuucuaccugccacuca

SEQ ID NO: 3768781 - RNA, 16 nt, Human
ucccuucuacugcuuc

SEQ ID NO: 3768782 - RNA, 11 nt, Human
ucccuucucca

SEQ ID NO: 3768783 - RNA, 20 nt, Human
ucccuucucuguagggaacu

SEQ ID NO: 3768784 - RNA, 23 nt, Human
ucccuucucuguagggaacucug

SEQ ID NO: 3768785 - RNA, 12 nt, Human
ucccuucucuuc

SEQ ID NO: 3768786 - RNA, 15 nt, Human
ucccuucucuuccag

SEQ ID NO: 3768787 - RNA, 13 nt, Human
ucccuucugcuac

SEQ ID NO: 3768788 - RNA, 13 nt, Human
ucccuucuugcau

SEQ ID NO: 3768789 - RNA, 20 nt, Human
ucccuugaaacuuugggaaa

SEQ ID NO: 3768790 - RNA, 20 nt, Human
ucccuugacuuugcuccuca

SEQ ID NO: 3768791 - RNA, 23 nt, Human
ucccuugaggaaacaacagcuuu

SEQ ID NO: 3768792 - RNA, 18 nt, Human
ucccuugagggcugcagu

SEQ ID NO: 3768793 - RNA, 15 nt, Human
ucccuugaugaagaa

SEQ ID NO: 3768794 - RNA, 15 nt, Human
ucccuugaugcacag

SEQ ID NO: 3768795 - RNA, 18 nt, Human
ucccuugaugcacagaga

SEQ ID NO: 3768796 - RNA, 13 nt, Human
ucccuugccacuu

SEQ ID NO: 3768797 - RNA, 20 nt, Human
ucccuugccucaaugccagu

SEQ ID NO: 3768798 - RNA, 20 nt, Human
ucccuugccuuucgaggccu

SEQ ID NO: 3768799 - RNA, 22 nt, Human
ucccuugccuuucgaggccuga

SEQ ID NO: 3768800 - RNA, 14 nt, Human
ucccuugcuugccu

SEQ ID NO: 3768801 - RNA, 20 nt, Human
ucccuugcuugccugcaggg

SEQ ID NO: 3768802 - RNA, 21 nt, Human
ucccuugcuugccugcagggc

SEQ ID NO: 3768803 - RNA, 18 nt, Human
ucccuuggacauuuuaug

SEQ ID NO: 3768804 - RNA, 14 nt, Human
ucccuuggccucag

SEQ ID NO: 3768805 - RNA, 12 nt, Human
ucccuugggcuc

SEQ ID NO: 3768806 - RNA, 17 nt, Human
ucccuugggcucugaug

SEQ ID NO: 3768807 - RNA, 15 nt, Human
ucccuuguauccccu

SEQ ID NO: 3768808 - RNA, 19 nt, Human
ucccuuguauccccugcag

SEQ ID NO: 3768809 - RNA, 16 nt, Human
ucccuugugcgugggu

SEQ ID NO: 3768810 - RNA, 18 nt, Human
ucccuuguucucuaaguu

SEQ ID NO: 3768811 - RNA, 18 nt, Human
ucccuuuagcuguguuau

SEQ ID NO: 3768812 - RNA, 20 nt, Human
ucccuuuagcuguguuauua

SEQ ID NO: 3768813 - RNA, 16 nt, Human
ucccuuuccccagcau

SEQ ID NO: 3768814 - RNA, 15 nt, Human
ucccuuucccuucuu

SEQ ID NO: 3768815 - RNA, 14 nt, Human
ucccuuuccuucca

SEQ ID NO: 3768816 - RNA, 23 nt, Human
ucccuuucuccccugcccccagg

SEQ ID NO: 3768817 - RNA, 18 nt, Human
ucccuuugacgccauccc

SEQ ID NO: 3768818 - RNA, 22 nt, Human
ucccuuugacgccaucccagcc

SEQ ID NO: 3768819 - RNA, 23 nt, Human
ucccuuugacgccaucccagccc

SEQ ID NO: 3768820 - RNA, 19 nt, Human
ucccuuuuaauccuggcug

SEQ ID NO: 3768821 - RNA, 16 nt, Human
ucccuuuucuguucua

SEQ ID NO: 3768822 - RNA, 14 nt, Human
ucccuuuucuugac

SEQ ID NO: 3768823 - RNA, 17 nt, Human
ucccuuuuuccuugucc

SEQ ID NO: 3768824 - RNA, 16 nt, Human
ucccuuuuugaagugu

SEQ ID NO: 3768825 - RNA, 13 nt, Human
ucccuuuuuuuaa

SEQ ID NO: 3768826 - RNA, 23 nt, Human
uccgaaaaauccucuuccucuga

SEQ ID NO: 3768827 - RNA, 21 nt, Human
uccgaaagggacuuggaagcu

SEQ ID NO: 3768828 - RNA, 22 nt, Human
uccgaaagggacuuggaagcuc

SEQ ID NO: 3768829 - RNA, 15 nt, Human
uccgaaccuccucug

SEQ ID NO: 3768830 - RNA, 17 nt, Human
uccgaaccuccucugug

SEQ ID NO: 3768831 - RNA, 19 nt, Human
uccgaaccuccucugugaa

SEQ ID NO: 3768832 - RNA, 18 nt, Human
uccgaagcuacuucucca

SEQ ID NO: 3768833 - RNA, 22 nt, Human
uccgacaaccgaugcuccagcc

SEQ ID NO: 3768834 - RNA, 23 nt, Human
uccgacaaccgaugcuccagcca

SEQ ID NO: 3768835 - RNA, 17 nt, Human
uccgacagcccccucug

SEQ ID NO: 3768836 - RNA, 17 nt, Human
uccgacucuucugagca

SEQ ID NO: 3768837 - RNA, 23 nt, Human
uccgacugcccucugaggccucc

SEQ ID NO: 3768838 - RNA, 12 nt, Human
uccgacugcuuu

SEQ ID NO: 3768839 - RNA, 17 nt, Human
uccgagagagcaccccu

SEQ ID NO: 3768840 - RNA, 14 nt, Human
uccgagagggagag

SEQ ID NO: 3768841 - RNA, 15 nt, Human
uccgagagggagaga

SEQ ID NO: 3768842 - RNA, 21 nt, Human
uccgagccggggaguuucuuu

SEQ ID NO: 3768843 - RNA, 21 nt, Human
uccgaggacccaggaaaggca

SEQ ID NO: 3768844 - RNA, 19 nt, Human
uccgaguguguuucauccu

SEQ ID NO: 3768845 - RNA, 15 nt, Human
uccgcacuuuccacu

SEQ ID NO: 3768846 - RNA, 18 nt, Human
uccgcaggugcugguccc

SEQ ID NO: 3768847 - RNA, 18 nt, Human
uccgcaguguggccaggc

SEQ ID NO: 3768848 - RNA, 14 nt, Human
uccgcaucccuacc

SEQ ID NO: 3768849 - RNA, 14 nt, Human
uccgccacuggggc

SEQ ID NO: 3768850 - RNA, 19 nt, Human
uccgccacuggggcucaga

SEQ ID NO: 3768851 - RNA, 15 nt, Human
uccgccagccuccuc

SEQ ID NO: 3768852 - RNA, 11 nt, Human
uccgcccccag

SEQ ID NO: 3768853 - RNA, 15 nt, Human
uccgcccccagccua

SEQ ID NO: 3768854 - RNA, 15 nt, Human
uccgccccugagccc

SEQ ID NO: 3768855 - RNA, 18 nt, Human
uccgccccugagcccacu

SEQ ID NO: 3768856 - RNA, 13 nt, Human
uccgccccugccu

SEQ ID NO: 3768857 - RNA, 15 nt, Human
uccgccccugccugc

SEQ ID NO: 3768858 - RNA, 19 nt, Human
uccgccccugccugccaug

SEQ ID NO: 3768859 - RNA, 17 nt, Human
uccgcccugcuccuccc

SEQ ID NO: 3768860 - RNA, 20 nt, Human
uccgcccugcuccucccugg

SEQ ID NO: 3768861 - RNA, 16 nt, Human
uccgccuggccuggcc

SEQ ID NO: 3768862 - RNA, 17 nt, Human
uccgccuucacuccggu

SEQ ID NO: 3768863 - RNA, 12 nt, Human
uccgcucucuuc

SEQ ID NO: 3768864 - RNA, 15 nt, Human
uccgcucucuuccug

SEQ ID NO: 3768865 - RNA, 17 nt, Human
uccgcucucuuccugcc

SEQ ID NO: 3768866 - RNA, 19 nt, Human
uccgcugccagccuugagc

SEQ ID NO: 3768867 - RNA, 13 nt, Human
uccgcugcuccuu

SEQ ID NO: 3768868 - RNA, 21 nt, Human
uccuccccaaaucaauacacu

SEQ ID NO: 3768869 - RNA, 16 nt, Human
uccuccccagcaggug

SEQ ID NO: 3768870 - RNA, 20 nt, Human
uccuccccccuccucugaaa

SEQ ID NO: 3768871 - RNA, 13 nt, Human
uccucccccugcc

SEQ ID NO: 3768872 - RNA, 23 nt, Human
uccucccccugccagugccuuac

SEQ ID NO: 3768873 - RNA, 19 nt, Human
uccuccccuccagcucccu

SEQ ID NO: 3768874 - RNA, 22 nt, Human
uccuccccuccuccuggacucc

SEQ ID NO: 3768875 - RNA, 17 nt, Human
uccuccccucucuuguc

SEQ ID NO: 3768876 - RNA, 13 nt, Human
uccuccccuggag

SEQ ID NO: 3768877 - RNA, 16 nt, Human
uccuccccuuccucuu

SEQ ID NO: 3768878 - RNA, 20 nt, Human
uccucccgagcuccucuucc

SEQ ID NO: 3768879 - RNA, 15 nt, Human
uccucccgggcccuc

SEQ ID NO: 3768880 - RNA, 14 nt, Human
uccucccucccucu

SEQ ID NO: 3768881 - RNA, 17 nt, Human
uccucccucccucuuuc

SEQ ID NO: 3768882 - RNA, 19 nt, Human
uccucccucccucuuuccc

SEQ ID NO: 3768883 - RNA, 18 nt, Human
uccucccucugaggcugu

SEQ ID NO: 3768884 - RNA, 17 nt, Human
uccucccugacuuuucu

SEQ ID NO: 3768885 - RNA, 18 nt, Human
uccucccugacuuuucug

SEQ ID NO: 3768886 - RNA, 17 nt, Human
uccucccuggcugcccu

SEQ ID NO: 3768887 - RNA, 21 nt, Human
uccucccuggcugcccuggcc

SEQ ID NO: 3768888 - RNA, 14 nt, Human
uccucccuguaacu

SEQ ID NO: 3768889 - RNA, 12 nt, Human
uccucccuguua

SEQ ID NO: 3768890 - RNA, 13 nt, Human
uccucccuguuau

SEQ ID NO: 3768891 - RNA, 14 nt, Human
uccucccuuagcuc

SEQ ID NO: 3768892 - RNA, 10 nt, Human
uccucccuuc

SEQ ID NO: 3768893 - RNA, 14 nt, Human
uccucccuuccucc

SEQ ID NO: 3768894 - RNA, 17 nt, Human
uccucccuuccuuuucc

SEQ ID NO: 3768895 - RNA, 21 nt, Human
uccucccuuccuuuucccugc

SEQ ID NO: 3768896 - RNA, 14 nt, Human
uccucccuucugcu

SEQ ID NO: 3768897 - RNA, 18 nt, Human
uccucccuucugcuacug

SEQ ID NO: 3768898 - RNA, 16 nt, Human
uccucccuuguucucu

SEQ ID NO: 3768899 - RNA, 17 nt, Human
uccucccuuuuuccuug

SEQ ID NO: 3768900 - RNA, 14 nt, Human
uccuccgaggccag

SEQ ID NO: 3768901 - RNA, 22 nt, Human
uccuccguccauaucagaacug

SEQ ID NO: 3768902 - RNA, 19 nt, Human
uccuccgugcuuccucagu

SEQ ID NO: 3768903 - RNA, 22 nt, Human
uccuccuaccgaaaccuugccu

SEQ ID NO: 3768904 - RNA, 16 nt, Human
uccuccucaccucaug

SEQ ID NO: 3768905 - RNA, 18 nt, Human
uccuccucaccucaugcc

SEQ ID NO: 3768906 - RNA, 12 nt, Human
uccuccucagau

SEQ ID NO: 3768907 - RNA, 21 nt, Human
uccuccuccaaaggcccccua

SEQ ID NO: 3768908 - RNA, 13 nt, Human
uccuccuccacca

SEQ ID NO: 3768909 - RNA, 12 nt, Human
uccuccuccagg

SEQ ID NO: 3768910 - RNA, 14 nt, Human
uccuccuccaggga

SEQ ID NO: 3768911 - RNA, 14 nt, Human
uccuccucccaccc

SEQ ID NO: 3768912 - RNA, 15 nt, Human
uccuccucccccaga

SEQ ID NO: 3768913 - RNA, 17 nt, Human
uccuccucccugcaucu

SEQ ID NO: 3768914 - RNA, 16 nt, Human
uccuccuccuuccuag

SEQ ID NO: 3768915 - RNA, 13 nt, Human
uccuccucuuucu

SEQ ID NO: 3768916 - RNA, 17 nt, Human
uccuccucuuucucucc

SEQ ID NO: 3768917 - RNA, 18 nt, Human
uccuccugacaccccacu

SEQ ID NO: 3768918 - RNA, 21 nt, Human
uccuccugacaccccacuuag

SEQ ID NO: 3768919 - RNA, 22 nt, Human
uccuccugacaccccacuuagc

SEQ ID NO: 3768920 - RNA, 14 nt, Human
uccuccugcugcca

SEQ ID NO: 3768921 - RNA, 15 nt, Human
uccuccugcugccag

SEQ ID NO: 3768922 - RNA, 19 nt, Human
uccuccuggaaccuugcug

SEQ ID NO: 3768923 - RNA, 20 nt, Human
uccuccugggcccucucugc

SEQ ID NO: 3768924 - RNA, 13 nt, Human
uccuccugguggg

SEQ ID NO: 3768925 - RNA, 20 nt, Human
uccuccugguggguccaggg

SEQ ID NO: 3768926 - RNA, 13 nt, Human
uccuccuucccaa

SEQ ID NO: 3768927 - RNA, 20 nt, Human
uccuccuuccggggaaggau

SEQ ID NO: 3768928 - RNA, 22 nt, Human
uccuccuuccggggaaggauuu

SEQ ID NO: 3768929 - RNA, 13 nt, Human
uccuccuuucucc

SEQ ID NO: 3768930 - RNA, 19 nt, Human
uccuccuuuucacaguucu

SEQ ID NO: 3768931 - RNA, 23 nt, Human
uccucgagaucccaacacugcca

SEQ ID NO: 3768932 - RNA, 14 nt, Human
uccucgcaagcugg

SEQ ID NO: 3768933 - RNA, 16 nt, Human
uccucgcagagaggcc

SEQ ID NO: 3768934 - RNA, 13 nt, Human
uccucgccugaca

SEQ ID NO: 3768935 - RNA, 15 nt, Human
uccucgcuucuuuca

SEQ ID NO: 3768936 - RNA, 15 nt, Human
uccucggcccccucc

SEQ ID NO: 3768937 - RNA, 17 nt, Human
uccucgguacucccaua

SEQ ID NO: 3768938 - RNA, 14 nt, Human
uccucguuuguguu

SEQ ID NO: 3768939 - RNA, 22 nt, Human
uccucuaacaggggcugguggg

SEQ ID NO: 3768940 - RNA, 20 nt, Human
uccucuaagccacucuucca

SEQ ID NO: 3768941 - RNA, 17 nt, Human
uccucuacuaacaauca

SEQ ID NO: 3768942 - RNA, 18 nt, Human
uccucuacuuaaugagau

SEQ ID NO: 3768943 - RNA, 18 nt, Human
uccucuagaagccaaggg

SEQ ID NO: 3768944 - RNA, 21 nt, Human
uccucuagcugugggggugag

SEQ ID NO: 3768945 - RNA, 17 nt, Human
uccucuaggaggucucu

SEQ ID NO: 3768946 - RNA, 16 nt, Human
uccucuauacaucucu

SEQ ID NO: 3768947 - RNA, 21 nt, Human
uccucuauacaucucucccca

SEQ ID NO: 3768948 - RNA, 19 nt, Human
uccucuauugauguacagu

SEQ ID NO: 3768949 - RNA, 20 nt, Human
uccucucaaccaccuuucag

SEQ ID NO: 3768950 - RNA, 18 nt, Human
uccucucacuaaacuuua

SEQ ID NO: 3768951 - RNA, 13 nt, Human
uccucuccacccu

SEQ ID NO: 3768952 - RNA, 14 nt, Human
uccucuccacccuc

SEQ ID NO: 3768953 - RNA, 17 nt, Human
uccucuccaccuagugg

SEQ ID NO: 3768954 - RNA, 19 nt, Human
uccucuccaccuaguggcu

SEQ ID NO: 3768955 - RNA, 12 nt, Human
uccucuccacug

SEQ ID NO: 3768956 - RNA, 15 nt, Human
uccucuccacugccu

SEQ ID NO: 3768957 - RNA, 18 nt, Human
uccucuccacugccuucg

SEQ ID NO: 3768958 - RNA, 15 nt, Human
uccucuccaggcacc

SEQ ID NO: 3768959 - RNA, 16 nt, Human
uccucucccauccccc

SEQ ID NO: 3768960 - RNA, 18 nt, Human
uccucucccaucccccug

SEQ ID NO: 3768961 - RNA, 19 nt, Human
uccucucccaucccccugc

SEQ ID NO: 3768962 - RNA, 23 nt, Human
uccucucccaucccccugcccuc

SEQ ID NO: 3768963 - RNA, 23 nt, Human
uccucucccauugucccucugcc

SEQ ID NO: 3768964 - RNA, 17 nt, Human
uccucuccccagcccag

SEQ ID NO: 3768965 - RNA, 19 nt, Human
uccucuccccagcccagag

SEQ ID NO: 3768966 - RNA, 20 nt, Human
uccucuccccagcccagaga

SEQ ID NO: 3768967 - RNA, 14 nt, Human
uccucuccccucca

SEQ ID NO: 3768968 - RNA, 17 nt, Human
uccucucgcggcccuca

SEQ ID NO: 3768969 - RNA, 17 nt, Human
uccucucuaaccuccuu

SEQ ID NO: 3768970 - RNA, 18 nt, Human
uccucucuaagugggcau

SEQ ID NO: 3768971 - RNA, 13 nt, Human
uccucucuauauu

SEQ ID NO: 3768972 - RNA, 11 nt, Human
uccucucugcc

SEQ ID NO: 3768973 - RNA, 17 nt, Human
uccucucugguggcucu

SEQ ID NO: 3768974 - RNA, 14 nt, Human
uccucucuuccucu

SEQ ID NO: 3768975 - RNA, 15 nt, Human
uccucucuuuguucu

SEQ ID NO: 3768976 - RNA, 19 nt, Human
uccucucuuuguucucagc

SEQ ID NO: 3768977 - RNA, 12 nt, Human
uccucugaaaca

SEQ ID NO: 3768978 - RNA, 16 nt, Human
uccucugaaacagcug

SEQ ID NO: 3768979 - RNA, 19 nt, Human
uccucugaaacagcugccu

SEQ ID NO: 3768980 - RNA, 20 nt, Human
uccucugaaacagcugccuu

SEQ ID NO: 3768981 - RNA, 15 nt, Human
uccucugacucaggg

SEQ ID NO: 3768982 - RNA, 12 nt, Human
uccucugagccu

SEQ ID NO: 3768983 - RNA, 13 nt, Human
uccucugaucucc

SEQ ID NO: 3768984 - RNA, 16 nt, Human
uccucugcacucccac

SEQ ID NO: 3768985 - RNA, 22 nt, Human
uccucugcccgggagcucagga

SEQ ID NO: 3768986 - RNA, 11 nt, Human
uccucugccug

SEQ ID NO: 3768987 - RNA, 14 nt, Human
uccucugccugccc

SEQ ID NO: 3768988 - RNA, 22 nt, Human
uccucugccugccccgccccca

SEQ ID NO: 3768989 - RNA, 15 nt, Human
uccucugcuaaauug

SEQ ID NO: 3768990 - RNA, 17 nt, Human
uccucugcuugccaucc

SEQ ID NO: 3768991 - RNA, 21 nt, Human
uccucugcuugccaucccucc

SEQ ID NO: 3768992 - RNA, 22 nt, Human
uccucugcuugccaucccuccc

SEQ ID NO: 3768993 - RNA, 15 nt, Human
uccucuggacggcag

SEQ ID NO: 3768994 - RNA, 17 nt, Human
uccucuggacggcaggc

SEQ ID NO: 3768995 - RNA, 24 nt, Human
uccucuggacggcaggcucacugc

SEQ ID NO: 3768996 - RNA, 17 nt, Human
uccucuggauggcacca

SEQ ID NO: 3768997 - RNA, 19 nt, Human
uccucuggauggcaccaga

SEQ ID NO: 3768998 - RNA, 15 nt, Human
uccucuggcuuggcc

SEQ ID NO: 3768999 - RNA, 17 nt, Human
uccucuggggcucuagg

SEQ ID NO: 3769000 - RNA, 15 nt, Human
uccucuguacagagc

SEQ ID NO: 3769001 - RNA, 23 nt, Human
uccucuguccagggcccugagcu

SEQ ID NO: 3769002 - RNA, 15 nt, Human
uccucugucucgagc

SEQ ID NO: 3769003 - RNA, 23 nt, Human
uccucugucucgagcgcccugca

SEQ ID NO: 3769004 - RNA, 15 nt, Human
uccucugucugcccu

SEQ ID NO: 3769005 - RNA, 18 nt, Human
uccucugucugcccuuca

SEQ ID NO: 3769006 - RNA, 19 nt, Human
uccucugugaccaaugucu

SEQ ID NO: 3769007 - RNA, 21 nt, Human
uccucugugaccaaugucuug

SEQ ID NO: 3769008 - RNA, 22 nt, Human
uccucuguuucuccuucugaaa

SEQ ID NO: 3769009 - RNA, 20 nt, Human
uccucuuaaaaaauaaaaac

SEQ ID NO: 3769010 - RNA, 15 nt, Human
uccucuuccaugcug

SEQ ID NO: 3769011 - RNA, 12 nt, Human
uccucuucccca

SEQ ID NO: 3769012 - RNA, 18 nt, Human
uccucuuccccagacgcc

SEQ ID NO: 3769013 - RNA, 19 nt, Human
ucucaggcucugcccugcc

SEQ ID NO: 3769014 - RNA, 15 nt, Human
ucucaggcugccuga

SEQ ID NO: 3769015 - RNA, 21 nt, Human
ucucagggaagcccagcucca

SEQ ID NO: 3769016 - RNA, 23 nt, Human
ucucagggaagcccagcuccagg

SEQ ID NO: 3769017 - RNA, 13 nt, Human
ucucagggccugg

SEQ ID NO: 3769018 - RNA, 17 nt, Human
ucucagggugucccaga

SEQ ID NO: 3769019 - RNA, 22 nt, Human
ucucagguagaagguugacaca

SEQ ID NO: 3769020 - RNA, 16 nt, Human
ucucaggucugaguug

SEQ ID NO: 3769021 - RNA, 14 nt, Human
ucucagucaugcau

SEQ ID NO: 3769022 - RNA, 11 nt, Human
ucucagucucu

SEQ ID NO: 3769023 - RNA, 16 nt, Human
ucucagugaagaauac

SEQ ID NO: 3769024 - RNA, 20 nt, Human
ucucagugaagacuaugaaa

SEQ ID NO: 3769025 - RNA, 19 nt, Human
ucucagugccaacuguggc

SEQ ID NO: 3769026 - RNA, 20 nt, Human
ucucagugccaacuguggcu

SEQ ID NO: 3769027 - RNA, 15 nt, Human
ucucagugcuuuccu

SEQ ID NO: 3769028 - RNA, 12 nt, Human
ucucaguguuuu

SEQ ID NO: 3769029 - RNA, 19 nt, Human
ucucaguguuuuggacucc

SEQ ID NO: 3769030 - RNA, 23 nt, Human
ucucaguguuuuggacuccaucu

SEQ ID NO: 3769031 - RNA, 21 nt, Human
ucucaguuccgauuucccagg

SEQ ID NO: 3769032 - RNA, 16 nt, Human
ucucaguuuguauaga

SEQ ID NO: 3769033 - RNA, 17 nt, Human
ucucaguuugugugucu

SEQ ID NO: 3769034 - RNA, 15 nt, Human
ucucaguuuucauaa

SEQ ID NO: 3769035 - RNA, 15 nt, Human
ucucaguuuuucuua

SEQ ID NO: 3769036 - RNA, 22 nt, Human
ucucaguuuuucuuaauauaua

SEQ ID NO: 3769037 - RNA, 22 nt, Human
ucucauaauuuauacaggucau

SEQ ID NO: 3769038 - RNA, 16 nt, Human
ucucauaccucugacc

SEQ ID NO: 3769039 - RNA, 19 nt, Human
ucucauaccucugaccaac

SEQ ID NO: 3769040 - RNA, 17 nt, Human
ucucauacguccaccau

SEQ ID NO: 3769041 - RNA, 16 nt, Human
ucucauacucaccuca

SEQ ID NO: 3769042 - RNA, 20 nt, Human
ucucauagcauuaacuaauc

SEQ ID NO: 3769043 - RNA, 21 nt, Human
ucucauaggaaaaguacauuu

SEQ ID NO: 3769044 - RNA, 22 nt, Human
ucucauaggaaaaguacauuua

SEQ ID NO: 3769045 - RNA, 24 nt, Human
ucucauaggaaaaguacauuuaau

SEQ ID NO: 3769046 - RNA, 21 nt, Human
ucucauauauagacagcuuug

SEQ ID NO: 3769047 - RNA, 21 nt, Human
ucucaucaguguccucuugcu

SEQ ID NO: 3769048 - RNA, 18 nt, Human
ucucaucaugucuauugu

SEQ ID NO: 3769049 - RNA, 12 nt, Human
ucucauccacau

SEQ ID NO: 3769050 - RNA, 13 nt, Human
ucucauccaucau

SEQ ID NO: 3769051 - RNA, 19 nt, Human
ucucaucccacgcacucca

SEQ ID NO: 3769052 - RNA, 14 nt, Human
ucucauccuccagu

SEQ ID NO: 3769053 - RNA, 21 nt, Human
ucucauccuccaguaccuugc

SEQ ID NO: 3769054 - RNA, 13 nt, Human
ucucauccuccug

SEQ ID NO: 3769055 - RNA, 18 nt, Human
ucucauccuccuggaacc

SEQ ID NO: 3769056 - RNA, 13 nt, Human
ucucauccugcag

SEQ ID NO: 3769057 - RNA, 15 nt, Human
ucucauccugcaggc

SEQ ID NO: 3769058 - RNA, 19 nt, Human
ucucaucgccagacaacug

SEQ ID NO: 3769059 - RNA, 20 nt, Human
ucucaucucagugaagaaua

SEQ ID NO: 3769060 - RNA, 17 nt, Human
ucucaucucuuagcucc

SEQ ID NO: 3769061 - RNA, 16 nt, Human
ucucaucugcacccuu

SEQ ID NO: 3769062 - RNA, 23 nt, Human
ucucaucugcacccuucuuuucu

SEQ ID NO: 3769063 - RNA, 11 nt, Human
ucucaucuggg

SEQ ID NO: 3769064 - RNA, 17 nt, Human
ucucaucugugauuccc

SEQ ID NO: 3769065 - RNA, 14 nt, Human
ucucaucuugugaa

SEQ ID NO: 3769066 - RNA, 15 nt, Human
ucucaucuugugaaa

SEQ ID NO: 3769067 - RNA, 13 nt, Human
ucucaucuuucuu

SEQ ID NO: 3769068 - RNA, 22 nt, Human
ucucaucuuucuugaucaacau

SEQ ID NO: 3769069 - RNA, 22 nt, Human
ucucaugaggggagaggagacg

SEQ ID NO: 3769070 - RNA, 15 nt, Human
ucucaugauuuacag

SEQ ID NO: 3769071 - RNA, 12 nt, Human
ucucaugccagu

SEQ ID NO: 3769072 - RNA, 18 nt, Human
ucucaugccccuggcugg

SEQ ID NO: 3769073 - RNA, 16 nt, Human
ucucaugccucagccu

SEQ ID NO: 3769074 - RNA, 19 nt, Human
ucucaugccucagccuccu

SEQ ID NO: 3769075 - RNA, 20 nt, Human
ucucaugccucagccuccug

SEQ ID NO: 3769076 - RNA, 21 nt, Human
ucucaugccucagccuccuga

SEQ ID NO: 3769077 - RNA, 20 nt, Human
ucucauggagaagcagaaau

SEQ ID NO: 3769078 - RNA, 16 nt, Human
ucucauggagaaguua

SEQ ID NO: 3769079 - RNA, 14 nt, Human
ucucaugugauccu

SEQ ID NO: 3769080 - RNA, 18 nt, Human
ucucauguuuucaacugc

SEQ ID NO: 3769081 - RNA, 18 nt, Human
ucucauguuuuccauugu

SEQ ID NO: 3769082 - RNA, 20 nt, Human
ucucauuaaaagaauaucug

SEQ ID NO: 3769083 - RNA, 16 nt, Human
ucucauuccagaggaa

SEQ ID NO: 3769084 - RNA, 18 nt, Human
ucucauuccguugucugu

SEQ ID NO: 3769085 - RNA, 21 nt, Human
ucucauuccguugucugugga

SEQ ID NO: 3769086 - RNA, 22 nt, Human
ucucauugacuuuuauaaagca

SEQ ID NO: 3769087 - RNA, 14 nt, Human
ucucauugcucuga

SEQ ID NO: 3769088 - RNA, 14 nt, Human
ucucauuggaaauu

SEQ ID NO: 3769089 - RNA, 20 nt, Human
ucucauuggaaauuuagcau

SEQ ID NO: 3769090 - RNA, 21 nt, Human
ucucauuggaaauuuagcauu

SEQ ID NO: 3769091 - RNA, 19 nt, Human
ucucauuguucaauuccca

SEQ ID NO: 3769092 - RNA, 16 nt, Human
ucucauuuaagggaaa

SEQ ID NO: 3769093 - RNA, 17 nt, Human
ucucauuuaagggaaaa

SEQ ID NO: 3769094 - RNA, 23 nt, Human
ucucauuuaagggaaaaauauau

SEQ ID NO: 3769095 - RNA, 16 nt, Human
ucucauuuaauccucu

SEQ ID NO: 3769096 - RNA, 18 nt, Human
ucucauuuagaacuugca

SEQ ID NO: 3769097 - RNA, 18 nt, Human
ucucauuuuaauguaaag

SEQ ID NO: 3769098 - RNA, 22 nt, Human
ucucauuuuaauguaaagauuu

SEQ ID NO: 3769099 - RNA, 20 nt, Human
ucucauuuuuuaaaaaagcu

SEQ ID NO: 3769100 - RNA, 21 nt, Human
ucuccaaaaaucugccugggu

SEQ ID NO: 3769101 - RNA, 17 nt, Human
ucuccaaaauaaaacuu

SEQ ID NO: 3769102 - RNA, 19 nt, Human
ucuccaaaauaaaacuuuu

SEQ ID NO: 3769103 - RNA, 11 nt, Human
ucuccaaagcu

SEQ ID NO: 3769104 - RNA, 19 nt, Human
ucuccaacaucacagccca

SEQ ID NO: 3769105 - RNA, 20 nt, Human
ucuccaacaucacagcccag

SEQ ID NO: 3769106 - RNA, 21 nt, Human
ucuccaacaucacagcccagc

SEQ ID NO: 3769107 - RNA, 20 nt, Human
ucuccaaccccccagcacug

SEQ ID NO: 3769108 - RNA, 21 nt, Human
ucuccaaccccccagcacuga

SEQ ID NO: 3769109 - RNA, 16 nt, Human
ucuccaagaaugcuga

SEQ ID NO: 3769110 - RNA, 19 nt, Human
ucuccaagcagcuuagagu

SEQ ID NO: 3769111 - RNA, 16 nt, Human
ucuccaagcaggacau

SEQ ID NO: 3769112 - RNA, 21 nt, Human
ucuccaagggcuucugcaccc

SEQ ID NO: 3769113 - RNA, 14 nt, Human
ucuccaagugccag

SEQ ID NO: 3769114 - RNA, 21 nt, Human
ucuccaagugccagagguggg

SEQ ID NO: 3769115 - RNA, 23 nt, Human
ucuccaagugccagaggugggca

SEQ ID NO: 3769116 - RNA, 16 nt, Human
ucuccaauaucagugc

SEQ ID NO: 3769117 - RNA, 14 nt, Human
ucuccacagcaacc

SEQ ID NO: 3769118 - RNA, 22 nt, Human
ucuccaccagucauuuuucaga

SEQ ID NO: 3769119 - RNA, 13 nt, Human
ucuccacccugcu

SEQ ID NO: 3769120 - RNA, 14 nt, Human
ucuccacccugcuc

SEQ ID NO: 3769121 - RNA, 14 nt, Human
ucuccaccuagugg

SEQ ID NO: 3769122 - RNA, 23 nt, Human
ucuccaccuaguggcuguccagu

SEQ ID NO: 3769123 - RNA, 11 nt, Human
ucuccaccuca

SEQ ID NO: 3769124 - RNA, 16 nt, Human
ucuccaccucagccuu

SEQ ID NO: 3769125 - RNA, 17 nt, Human
ucuccaccucagccuug

SEQ ID NO: 3769126 - RNA, 13 nt, Human
ucuccacuccaga

SEQ ID NO: 3769127 - RNA, 19 nt, Human
ucuccacugugcacaccca

SEQ ID NO: 3769128 - RNA, 17 nt, Human
ucuccacuuucagcugu

SEQ ID NO: 3769129 - RNA, 15 nt, Human
ucuccagacccccac

SEQ ID NO: 3769130 - RNA, 20 nt, Human
ucuccagacccccaccccuu

SEQ ID NO: 3769131 - RNA, 15 nt, Human
ucuccagauguuucc

SEQ ID NO: 3769132 - RNA, 18 nt, Human
ucuccagauguuuccaga

SEQ ID NO: 3769133 - RNA, 16 nt, Human
ucuccagauuuuuaau

SEQ ID NO: 3769134 - RNA, 14 nt, Human
ucuccagcccacgu

SEQ ID NO: 3769135 - RNA, 13 nt, Human
ucuccagccccug

SEQ ID NO: 3769136 - RNA, 22 nt, Human
ucuccagccccuucucagaauc

SEQ ID NO: 3769137 - RNA, 22 nt, Human
ucuccagccucagcccccugcu

SEQ ID NO: 3769138 - RNA, 23 nt, Human
ucuccagccucagcccccugcuu

SEQ ID NO: 3769139 - RNA, 14 nt, Human
ucuccagccuggac

SEQ ID NO: 3769140 - RNA, 15 nt, Human
ucuccagccuggacc

SEQ ID NO: 3769141 - RNA, 22 nt, Human
ucuccagccuggacccccagcu

SEQ ID NO: 3769142 - RNA, 18 nt, Human
ucuccagcggcccuguca

SEQ ID NO: 3769143 - RNA, 22 nt, Human
ucuccagcuauaacaguaggga

SEQ ID NO: 3769144 - RNA, 17 nt, Human
ucuccagcucagaaccc

SEQ ID NO: 3769145 - RNA, 14 nt, Human
ucuccagcugacua

SEQ ID NO: 3769146 - RNA, 15 nt, Human
ucuccagcugcugag

SEQ ID NO: 3769147 - RNA, 17 nt, Human
ucuccagcugggcucug

SEQ ID NO: 3769148 - RNA, 14 nt, Human
ucuccaggaccaau

SEQ ID NO: 3769149 - RNA, 13 nt, Human
ucuccaggaucca

SEQ ID NO: 3769150 - RNA, 17 nt, Human
ucuccaggcaccaucuc

SEQ ID NO: 3769151 - RNA, 19 nt, Human
ucuccaggcaccaucuccc

SEQ ID NO: 3769152 - RNA, 22 nt, Human
ucuccaggggcugcuuccuccu

SEQ ID NO: 3769153 - RNA, 18 nt, Human
ucuccagggucagaaaca

SEQ ID NO: 3769154 - RNA, 22 nt, Human
ucuccauaaccccacccuugcc

SEQ ID NO: 3769155 - RNA, 23 nt, Human
ucuccauaaccccacccuugccc

SEQ ID NO: 3769156 - RNA, 13 nt, Human
ucuccauccacau

SEQ ID NO: 3769157 - RNA, 20 nt, Human
ucucucugacucucaaaucu

SEQ ID NO: 3769158 - RNA, 21 nt, Human
ucucucugacucucaaaucuu

SEQ ID NO: 3769159 - RNA, 18 nt, Human
ucucucugcagcugccgg

SEQ ID NO: 3769160 - RNA, 13 nt, Human
ucucucuggcccu

SEQ ID NO: 3769161 - RNA, 13 nt, Human
ucucucuguugug

SEQ ID NO: 3769162 - RNA, 16 nt, Human
ucucucuucagacucu

SEQ ID NO: 3769163 - RNA, 16 nt, Human
ucucucuucucagagu

SEQ ID NO: 3769164 - RNA, 16 nt, Human
ucucucuucugcucca

SEQ ID NO: 3769165 - RNA, 22 nt, Human
ucucucuuguucuuacuuuccu

SEQ ID NO: 3769166 - RNA, 20 nt, Human
ucucucuuugcauggauuuc

SEQ ID NO: 3769167 - RNA, 14 nt, Human
ucucugaaagugug

SEQ ID NO: 3769168 - RNA, 12 nt, Human
ucucugaacaca

SEQ ID NO: 3769169 - RNA, 20 nt, Human
ucucugaacacaggcagcuu

SEQ ID NO: 3769170 - RNA, 11 nt, Human
ucucugaaccc

SEQ ID NO: 3769171 - RNA, 23 nt, Human
ucucugaagaguggguuucacaa

SEQ ID NO: 3769172 - RNA, 12 nt, Human
ucucugaagcau

SEQ ID NO: 3769173 - RNA, 13 nt, Human
ucucugaagcaug

SEQ ID NO: 3769174 - RNA, 16 nt, Human
ucucugaagcauguuu

SEQ ID NO: 3769175 - RNA, 23 nt, Human
ucucugaaggaggccaccuccua

SEQ ID NO: 3769176 - RNA, 16 nt, Human
ucucugaagggaggug

SEQ ID NO: 3769177 - RNA, 14 nt, Human
ucucugaauccuaa

SEQ ID NO: 3769178 - RNA, 15 nt, Human
ucucugaaugcccca

SEQ ID NO: 3769179 - RNA, 14 nt, Human
ucucugacuucugc

SEQ ID NO: 3769180 - RNA, 17 nt, Human
ucucugacuucugccug

SEQ ID NO: 3769181 - RNA, 19 nt, Human
ucucugagcuccaguggaa

SEQ ID NO: 3769182 - RNA, 16 nt, Human
ucucugagcugugcag

SEQ ID NO: 3769183 - RNA, 18 nt, Human
ucucugaggaagcugggg

SEQ ID NO: 3769184 - RNA, 21 nt, Human
ucucugaggggcuaccaggaa

SEQ ID NO: 3769185 - RNA, 15 nt, Human
ucucugaugcagcuu

SEQ ID NO: 3769186 - RNA, 20 nt, Human
ucucugauucccugauuuaa

SEQ ID NO: 3769187 - RNA, 19 nt, Human
ucucugcaaacugccuucu

SEQ ID NO: 3769188 - RNA, 11 nt, Human
ucucugcaccc

SEQ ID NO: 3769189 - RNA, 20 nt, Human
ucucugcagccagcccagcc

SEQ ID NO: 3769190 - RNA, 12 nt, Human
ucucugcagcug

SEQ ID NO: 3769191 - RNA, 15 nt, Human
ucucugcagcugccg

SEQ ID NO: 3769192 - RNA, 13 nt, Human
ucucugcaggucc

SEQ ID NO: 3769193 - RNA, 14 nt, Human
ucucugcagguccc

SEQ ID NO: 3769194 - RNA, 20 nt, Human
ucucugcaggucccuaauaa

SEQ ID NO: 3769195 - RNA, 18 nt, Human
ucucugcaucuacuccca

SEQ ID NO: 3769196 - RNA, 21 nt, Human
ucucugcaucuacucccaagu

SEQ ID NO: 3769197 - RNA, 17 nt, Human
ucucugcaucugaccac

SEQ ID NO: 3769198 - RNA, 21 nt, Human
ucucugcauuuuucugcagaa

SEQ ID NO: 3769199 - RNA, 15 nt, Human
ucucugccagugaca

SEQ ID NO: 3769200 - RNA, 21 nt, Human
ucucugccagugacagacagg

SEQ ID NO: 3769201 - RNA, 14 nt, Human
ucucugccauccuu

SEQ ID NO: 3769202 - RNA, 12 nt, Human
ucucugcccaac

SEQ ID NO: 3769203 - RNA, 13 nt, Human
ucucugcccaacc

SEQ ID NO: 3769204 - RNA, 15 nt, Human
ucucugcccagcuuu

SEQ ID NO: 3769205 - RNA, 14 nt, Human
ucucugcccauucc

SEQ ID NO: 3769206 - RNA, 15 nt, Human
ucucugcccauuccc

SEQ ID NO: 3769207 - RNA, 16 nt, Human
ucucugcccuccaaga

SEQ ID NO: 3769208 - RNA, 12 nt, Human
ucucugcccugu

SEQ ID NO: 3769209 - RNA, 14 nt, Human
ucucugcccugugu

SEQ ID NO: 3769210 - RNA, 20 nt, Human
ucucugcccuugaucagccc

SEQ ID NO: 3769211 - RNA, 22 nt, Human
ucucugcccuugaucagcccca

SEQ ID NO: 3769212 - RNA, 16 nt, Human
ucucugccgcuaccuc

SEQ ID NO: 3769213 - RNA, 22 nt, Human
ucucugccgcuaccucccuccc

SEQ ID NO: 3769214 - RNA, 21 nt, Human
ucucugccggcucuuuccuug

SEQ ID NO: 3769215 - RNA, 23 nt, Human
ucucugccucccucacccugagc

SEQ ID NO: 3769216 - RNA, 18 nt, Human
ucucugccugugagccag

SEQ ID NO: 3769217 - RNA, 15 nt, Human
ucucugccuugccuu

SEQ ID NO: 3769218 - RNA, 11 nt, Human
ucucugcucca

SEQ ID NO: 3769219 - RNA, 13 nt, Human
ucucugcuccacc

SEQ ID NO: 3769220 - RNA, 14 nt, Human
ucucugcuccacca

SEQ ID NO: 3769221 - RNA, 14 nt, Human
ucucugcuggccca

SEQ ID NO: 3769222 - RNA, 19 nt, Human
ucucugcuggcccagccaa

SEQ ID NO: 3769223 - RNA, 18 nt, Human
ucucugcuugagucaggu

SEQ ID NO: 3769224 - RNA, 15 nt, Human
ucucuggcacuuuga

SEQ ID NO: 3769225 - RNA, 17 nt, Human
ucucuggccucccaccc

SEQ ID NO: 3769226 - RNA, 18 nt, Human
ucucuggccucccacccg

SEQ ID NO: 3769227 - RNA, 19 nt, Human
ucucuggccuucggccucc

SEQ ID NO: 3769228 - RNA, 22 nt, Human
ucucuggccuucggccuccauc

SEQ ID NO: 3769229 - RNA, 23 nt, Human
ucucuggccuucggccuccaucc

SEQ ID NO: 3769230 - RNA, 16 nt, Human
ucucuggcgacaguuu

SEQ ID NO: 3769231 - RNA, 20 nt, Human
ucucuggcuguaaggcucua

SEQ ID NO: 3769232 - RNA, 17 nt, Human
ucucugggagaaaauca

SEQ ID NO: 3769233 - RNA, 13 nt, Human
ucucugggcugga

SEQ ID NO: 3769234 - RNA, 17 nt, Human
ucucugggcuggaugag

SEQ ID NO: 3769235 - RNA, 21 nt, Human
ucucugggcuuggggcuuccu

SEQ ID NO: 3769236 - RNA, 16 nt, Human
ucucuggggcaggcug

SEQ ID NO: 3769237 - RNA, 18 nt, Human
ucucuggggccacacaga

SEQ ID NO: 3769238 - RNA, 16 nt, Human
ucucugggggcugagg

SEQ ID NO: 3769239 - RNA, 13 nt, Human
ucucugguccgga

SEQ ID NO: 3769240 - RNA, 21 nt, Human
ucucugguuccuccccuccuc

SEQ ID NO: 3769241 - RNA, 22 nt, Human
ucucuguaauaaacucauuucu

SEQ ID NO: 3769242 - RNA, 21 nt, Human
ucucuguacuuuucauucucu

SEQ ID NO: 3769243 - RNA, 19 nt, Human
ucucuguagggaacucugg

SEQ ID NO: 3769244 - RNA, 16 nt, Human
ucucuguauaaacauu

SEQ ID NO: 3769245 - RNA, 21 nt, Human
ucucuguauaaacauuaaaug

SEQ ID NO: 3769246 - RNA, 22 nt, Human
ucucuguauaaacauuaaaugu

SEQ ID NO: 3769247 - RNA, 22 nt, Human
ucucuguccagcagucacuucg

SEQ ID NO: 3769248 - RNA, 15 nt, Human
ucucugucccauucc

SEQ ID NO: 3769249 - RNA, 14 nt, Human
ucucugucccuugc

SEQ ID NO: 3769250 - RNA, 15 nt, Human
ucucugucccuugcu

SEQ ID NO: 3769251 - RNA, 15 nt, Human
ucucuguccgagugu

SEQ ID NO: 3769252 - RNA, 15 nt, Human
ucucugucucaucca

SEQ ID NO: 3769253 - RNA, 16 nt, Human
ucucugucucauccau

SEQ ID NO: 3769254 - RNA, 18 nt, Human
ucucugugaccugccccg

SEQ ID NO: 3769255 - RNA, 19 nt, Human
ucucugugagaagguuuau

SEQ ID NO: 3769256 - RNA, 19 nt, Human
ucucugugagacucgagaa

SEQ ID NO: 3769257 - RNA, 19 nt, Human
ucucugugcuucaauuaau

SEQ ID NO: 3769258 - RNA, 15 nt, Human
ucucugugucuaaga

SEQ ID NO: 3769259 - RNA, 17 nt, Human
ucucugugucuaagauu

SEQ ID NO: 3769260 - RNA, 17 nt, Human
ucucuguucauuuccuc

SEQ ID NO: 3769261 - RNA, 14 nt, Human
ucucuguuccauag

SEQ ID NO: 3769262 - RNA, 15 nt, Human
ucucuuacccuucug

SEQ ID NO: 3769263 - RNA, 19 nt, Human
ucucuuagcuccccuccaa

SEQ ID NO: 3769264 - RNA, 16 nt, Human
ucucuuaucuuacgaa

SEQ ID NO: 3769265 - RNA, 20 nt, Human
ucucuuauggauguccccag

SEQ ID NO: 3769266 - RNA, 18 nt, Human
ucucuucacagucacauu

SEQ ID NO: 3769267 - RNA, 13 nt, Human
ucucuucagguuc

SEQ ID NO: 3769268 - RNA, 19 nt, Human
ucucuucauuauucucugc

SEQ ID NO: 3769269 - RNA, 13 nt, Human
ucucuuccccucu

SEQ ID NO: 3769270 - RNA, 17 nt, Human
ucucuuccccucucaga

SEQ ID NO: 3769271 - RNA, 13 nt, Human
ucucuuccuaucc

SEQ ID NO: 3769272 - RNA, 22 nt, Human
ucucuuccucuucccccaagau

SEQ ID NO: 3769273 - RNA, 15 nt, Human
ucucuuccugccccu

SEQ ID NO: 3769274 - RNA, 16 nt, Human
ucucuuccugccccuc

SEQ ID NO: 3769275 - RNA, 14 nt, Human
ucucuucucagagu

SEQ ID NO: 3769276 - RNA, 17 nt, Human
ucucuucucagaguggu

SEQ ID NO: 3769277 - RNA, 13 nt, Human
ucucuucuccacu

SEQ ID NO: 3769278 - RNA, 16 nt, Human
ucucuucucccagaau

SEQ ID NO: 3769279 - RNA, 21 nt, Human
ucucuucucccagaaucccag

SEQ ID NO: 3769280 - RNA, 12 nt, Human
ucucuucucucc

SEQ ID NO: 3769281 - RNA, 23 nt, Human
ucucuucucuccagcugacuaaa

SEQ ID NO: 3769282 - RNA, 20 nt, Human
ucucuucugaauaaagcaau

SEQ ID NO: 3769283 - RNA, 21 nt, Human
ucucuucugagcuauuucauc

SEQ ID NO: 3769284 - RNA, 16 nt, Human
ucucuucugcuccacc

SEQ ID NO: 3769285 - RNA, 18 nt, Human
ucucuucuggguuccuuc

SEQ ID NO: 3769286 - RNA, 14 nt, Human
ucucuucuguguuu

SEQ ID NO: 3769287 - RNA, 18 nt, Human
ucucuucuuaauguacau

SEQ ID NO: 3769288 - RNA, 12 nt, Human
ucucuucuuguu

SEQ ID NO: 3769289 - RNA, 18 nt, Human
ucucuucuuuuggcuucc

SEQ ID NO: 3769290 - RNA, 22 nt, Human
ucucuugagggagcuuagccaa

SEQ ID NO: 3769291 - RNA, 14 nt, Human
ucucuugaguuugu

SEQ ID NO: 3769292 - RNA, 15 nt, Human
ucucuugaguuuguc

SEQ ID NO: 3769293 - RNA, 12 nt, Human
ucucuugauuuu

SEQ ID NO: 3769294 - RNA, 12 nt, Human
ucucuugcaccc

SEQ ID NO: 3769295 - RNA, 13 nt, Human
ucucuugcacccg

SEQ ID NO: 3769296 - RNA, 17 nt, Human
ucucuugcacccgccuc

SEQ ID NO: 3769297 - RNA, 18 nt, Human
ucucuuggcuggcuuccu

SEQ ID NO: 3769298 - RNA, 16 nt, Human
ucucuugggaacugaa

SEQ ID NO: 3769299 - RNA, 16 nt, Human
ucucuugguccugcug

SEQ ID NO: 3769300 - RNA, 17 nt, Human
ucucuugguccugcugc

SEQ ID NO: 3769301 - RNA, 17 nt, Human
ucucuugguuuccuucc

SEQ ID NO: 3769302 - RNA, 21 nt, Human
ucucuuuaaaaggaaagaaaa

SEQ ID NO: 3769303 - RNA, 14 nt, Human
ucuugucucaaugc

SEQ ID NO: 3769304 - RNA, 12 nt, Human
ucuugucucccc

SEQ ID NO: 3769305 - RNA, 12 nt, Human
ucuugucucugg

SEQ ID NO: 3769306 - RNA, 15 nt, Human
ucuugucucugggcu

SEQ ID NO: 3769307 - RNA, 16 nt, Human
ucuugucugauuucuu

SEQ ID NO: 3769308 - RNA, 19 nt, Human
ucuugucuuccuauuucag

SEQ ID NO: 3769309 - RNA, 17 nt, Human
ucuugugaaaauaauug

SEQ ID NO: 3769310 - RNA, 15 nt, Human
ucuugugaaggcagg

SEQ ID NO: 3769311 - RNA, 16 nt, Human
ucuugugaaggccaug

SEQ ID NO: 3769312 - RNA, 18 nt, Human
ucuugugacuagugcuga

SEQ ID NO: 3769313 - RNA, 19 nt, Human
ucuugugacuagugcugaa

SEQ ID NO: 3769314 - RNA, 21 nt, Human
ucuugugacuagugcugaagc

SEQ ID NO: 3769315 - RNA, 23 nt, Human
ucuugugaggaaagucauuggcu

SEQ ID NO: 3769316 - RNA, 14 nt, Human
ucuugugcuagaau

SEQ ID NO: 3769317 - RNA, 18 nt, Human
ucuugugcuagaauacuu

SEQ ID NO: 3769318 - RNA, 21 nt, Human
ucuugugcuagaauacuuuuu

SEQ ID NO: 3769319 - RNA, 22 nt, Human
ucuugugcuggauggagcccag

SEQ ID NO: 3769320 - RNA, 21 nt, Human
ucuugugcuuuuccuauuugu

SEQ ID NO: 3769321 - RNA, 22 nt, Human
ucuuguggaagugcaucuacuu

SEQ ID NO: 3769322 - RNA, 19 nt, Human
ucuugugguuauaacuuaa

SEQ ID NO: 3769323 - RNA, 20 nt, Human
ucuuguuaauauucuuucaa

SEQ ID NO: 3769324 - RNA, 15 nt, Human
ucuuguuagaaaaca

SEQ ID NO: 3769325 - RNA, 17 nt, Human
ucuuguuagaaaacaaa

SEQ ID NO: 3769326 - RNA, 15 nt, Human
ucuuguucaggaaaa

SEQ ID NO: 3769327 - RNA, 20 nt, Human
ucuuguucugagauucaaua

SEQ ID NO: 3769328 - RNA, 13 nt, Human
ucuuguucuguca

SEQ ID NO: 3769329 - RNA, 13 nt, Human
ucuuguugagccg

SEQ ID NO: 3769330 - RNA, 16 nt, Human
ucuuguugauaaaaau

SEQ ID NO: 3769331 - RNA, 21 nt, Human
ucuuguugcucaaaaaaugag

SEQ ID NO: 3769332 - RNA, 22 nt, Human
ucuuguugcucaaaaaaugagc

SEQ ID NO: 3769333 - RNA, 17 nt, Human
ucuuguuggugcacagc

SEQ ID NO: 3769334 - RNA, 20 nt, Human
ucuuguuuauaccuuugccu

SEQ ID NO: 3769335 - RNA, 14 nt, Human
ucuuguuuucaguu

SEQ ID NO: 3769336 - RNA, 13 nt, Human
ucuuguuuugaaa

SEQ ID NO: 3769337 - RNA, 17 nt, Human
ucuuguuuuguuugucu

SEQ ID NO: 3769338 - RNA, 17 nt, Human
ucuuguuuuuaaguuug

SEQ ID NO: 3769339 - RNA, 17 nt, Human
ucuuguuuuuauuaauu

SEQ ID NO: 3769340 - RNA, 20 nt, Human
ucuuguuuuuauuaauuuau

SEQ ID NO: 3769341 - RNA, 17 nt, Human
ucuuuaaaagaaugacu

SEQ ID NO: 3769342 - RNA, 14 nt, Human
ucuuuaaaagagag

SEQ ID NO: 3769343 - RNA, 16 nt, Human
ucuuuaaaaggaaaga

SEQ ID NO: 3769344 - RNA, 17 nt, Human
ucuuuaaaauacacacu

SEQ ID NO: 3769345 - RNA, 21 nt, Human
ucuuuaaaauuuaaguaucuu

SEQ ID NO: 3769346 - RNA, 23 nt, Human
ucuuuaaacaguauuucauugcc

SEQ ID NO: 3769347 - RNA, 13 nt, Human
ucuuuaaagaugu

SEQ ID NO: 3769348 - RNA, 14 nt, Human
ucuuuaaaggccca

SEQ ID NO: 3769349 - RNA, 16 nt, Human
ucuuuaaaucauuuua

SEQ ID NO: 3769350 - RNA, 11 nt, Human
ucuuuaaaugu

SEQ ID NO: 3769351 - RNA, 12 nt, Human
ucuuuaaauguu

SEQ ID NO: 3769352 - RNA, 17 nt, Human
ucuuuaaccuuguauaa

SEQ ID NO: 3769353 - RNA, 20 nt, Human
ucuuuaacuuaauugcuaug

SEQ ID NO: 3769354 - RNA, 14 nt, Human
ucuuuaagaaagua

SEQ ID NO: 3769355 - RNA, 18 nt, Human
ucuuuaagggcaugccuu

SEQ ID NO: 3769356 - RNA, 19 nt, Human
ucuuuaagggcaugccuug

SEQ ID NO: 3769357 - RNA, 22 nt, Human
ucuuuaagggcaugccuugugc

SEQ ID NO: 3769358 - RNA, 14 nt, Human
ucuuuaaucacuua

SEQ ID NO: 3769359 - RNA, 15 nt, Human
ucuuuaaucuucagu

SEQ ID NO: 3769360 - RNA, 17 nt, Human
ucuuuaaugauuccuau

SEQ ID NO: 3769361 - RNA, 20 nt, Human
ucuuuaaugauuccuauaaa

SEQ ID NO: 3769362 - RNA, 20 nt, Human
ucuuuaauuaaaaccuggga

SEQ ID NO: 3769363 - RNA, 18 nt, Human
ucuuuaauuuuggaauuu

SEQ ID NO: 3769364 - RNA, 16 nt, Human
ucuuuacccuugagcc

SEQ ID NO: 3769365 - RNA, 13 nt, Human
ucuuuaccugaga

SEQ ID NO: 3769366 - RNA, 23 nt, Human
ucuuuacuccucacacuuacugu

SEQ ID NO: 3769367 - RNA, 16 nt, Human
ucuuuagagaacugaa

SEQ ID NO: 3769368 - RNA, 20 nt, Human
ucuuuagagaacugaaaaga

SEQ ID NO: 3769369 - RNA, 16 nt, Human
ucuuuagaguuagacu

SEQ ID NO: 3769370 - RNA, 18 nt, Human
ucuuuagaguuagacugu

SEQ ID NO: 3769371 - RNA, 20 nt, Human
ucuuuagauagcccuguccu

SEQ ID NO: 3769372 - RNA, 21 nt, Human
ucuuuagauagcccuguccug

SEQ ID NO: 3769373 - RNA, 17 nt, Human
ucuuuaggauugugaug

SEQ ID NO: 3769374 - RNA, 12 nt, Human
ucuuuaguuuuu

SEQ ID NO: 3769375 - RNA, 12 nt, Human
ucuuuauaagaa

SEQ ID NO: 3769376 - RNA, 16 nt, Human
ucuuuauaagaaagcc

SEQ ID NO: 3769377 - RNA, 16 nt, Human
ucuuuauacuguaauu

SEQ ID NO: 3769378 - RNA, 21 nt, Human
ucuuuauauacaauaauggaa

SEQ ID NO: 3769379 - RNA, 14 nt, Human
ucuuuaugcuugca

SEQ ID NO: 3769380 - RNA, 21 nt, Human
ucuuuauuaaauguagaaagu

SEQ ID NO: 3769381 - RNA, 15 nt, Human
ucuuuauuccuaguu

SEQ ID NO: 3769382 - RNA, 14 nt, Human
ucuuuauucuuuuu

SEQ ID NO: 3769383 - RNA, 14 nt, Human
ucuuuauugaaauu

SEQ ID NO: 3769384 - RNA, 13 nt, Human
ucuuuauugagaa

SEQ ID NO: 3769385 - RNA, 14 nt, Human
ucuuuauugucugu

SEQ ID NO: 3769386 - RNA, 12 nt, Human
ucuuuauuuuga

SEQ ID NO: 3769387 - RNA, 18 nt, Human
ucuuuauuuuguguaaaa

SEQ ID NO: 3769388 - RNA, 23 nt, Human
ucuuucaaaaccuuuugaaauua

SEQ ID NO: 3769389 - RNA, 17 nt, Human
ucuuucaacucauugca

SEQ ID NO: 3769390 - RNA, 15 nt, Human
ucuuucaacuugcau

SEQ ID NO: 3769391 - RNA, 18 nt, Human
ucuuucaacuugcaucca

SEQ ID NO: 3769392 - RNA, 14 nt, Human
ucuuucaagaauga

SEQ ID NO: 3769393 - RNA, 20 nt, Human
ucuuucaagggcuuuccugu

SEQ ID NO: 3769394 - RNA, 20 nt, Human
ucuuucaagugaaucuaaaa

SEQ ID NO: 3769395 - RNA, 21 nt, Human
ucuuucaagugaaucuaaaag

SEQ ID NO: 3769396 - RNA, 21 nt, Human
ucuuucaauaaacuaaagaaa

SEQ ID NO: 3769397 - RNA, 18 nt, Human
ucuuucaauacagauaua

SEQ ID NO: 3769398 - RNA, 14 nt, Human
ucuuucaauucugu

SEQ ID NO: 3769399 - RNA, 15 nt, Human
ucuuucacaaaaaag

SEQ ID NO: 3769400 - RNA, 14 nt, Human
ucuuucacagcucc

SEQ ID NO: 3769401 - RNA, 18 nt, Human
ucuuucacagcuccuccc

SEQ ID NO: 3769402 - RNA, 23 nt, Human
ucuuucacccuuuucuguuugcu

SEQ ID NO: 3769403 - RNA, 11 nt, Human
ucuuucagaaa

SEQ ID NO: 3769404 - RNA, 16 nt, Human
ucuuucagaaaacaga

SEQ ID NO: 3769405 - RNA, 18 nt, Human
ucuuucagacuugccaug

SEQ ID NO: 3769406 - RNA, 21 nt, Human
ucuuucagcaagauaaacauu

SEQ ID NO: 3769407 - RNA, 20 nt, Human
ucuuucagccaagaauucuu

SEQ ID NO: 3769408 - RNA, 14 nt, Human
ucuuucagcuccug

SEQ ID NO: 3769409 - RNA, 13 nt, Human
ucuuucauccacu

SEQ ID NO: 3769410 - RNA, 23 nt, Human
ucuuucauccacuagugcaaauc

SEQ ID NO: 3769411 - RNA, 16 nt, Human
ucuuucauuucuucua

SEQ ID NO: 3769412 - RNA, 21 nt, Human
ucuuucauuugcuuuggaagu

SEQ ID NO: 3769413 - RNA, 14 nt, Human
ucuuuccaaaguac

SEQ ID NO: 3769414 - RNA, 17 nt, Human
ucuuuccaaaguacacu

SEQ ID NO: 3769415 - RNA, 14 nt, Human
ucuuuccaaauuau

SEQ ID NO: 3769416 - RNA, 20 nt, Human
ucuuuccaaauuauuucuua

SEQ ID NO: 3769417 - RNA, 22 nt, Human
ucuuuccacggagccacuccuc

SEQ ID NO: 3769418 - RNA, 21 nt, Human
ucuuuccacuccuccuagcca

SEQ ID NO: 3769419 - RNA, 13 nt, Human
ucuuuccacucug

SEQ ID NO: 3769420 - RNA, 23 nt, Human
ucuuuccacucuggauucagccu

SEQ ID NO: 3769421 - RNA, 21 nt, Human
ucuuuccaguggaucauaaga

SEQ ID NO: 3769422 - RNA, 16 nt, Human
ucuuuccauaauaaaa

SEQ ID NO: 3769423 - RNA, 19 nt, Human
ucuuuccauuaugauucuu

SEQ ID NO: 3769424 - RNA, 18 nt, Human
ucuuucccauggggaggg

SEQ ID NO: 3769425 - RNA, 14 nt, Human
ucuuucccuccuug

SEQ ID NO: 3769426 - RNA, 23 nt, Human
ucuuuccuaaggcugcaagguuu

SEQ ID NO: 3769427 - RNA, 14 nt, Human
ucuuuccuauuuca

SEQ ID NO: 3769428 - RNA, 24 nt, Human
ucuuuccuauuucaguguuaccug

SEQ ID NO: 3769429 - RNA, 14 nt, Human
ucuuuccuccuucc

SEQ ID NO: 3769430 - RNA, 15 nt, Human
ucuuuccuccuucca

SEQ ID NO: 3769431 - RNA, 16 nt, Human
ucuuuccugaggcugg

SEQ ID NO: 3769432 - RNA, 17 nt, Human
ucuuuccugaggcuggg

SEQ ID NO: 3769433 - RNA, 13 nt, Human
ucuuuccuugcuc

SEQ ID NO: 3769434 - RNA, 18 nt, Human
ucuuucuaaugugugaau

SEQ ID NO: 3769435 - RNA, 16 nt, Human
ucuuucuacucugaac

SEQ ID NO: 3769436 - RNA, 19 nt, Human
ucuuucuacucugaacuaa

SEQ ID NO: 3769437 - RNA, 16 nt, Human
ucuuucuaguggucuu

SEQ ID NO: 3769438 - RNA, 17 nt, Human
ucuuucuaguggucuuu

SEQ ID NO: 3769439 - RNA, 20 nt, Human
ucuuucuaguggucuuugua

SEQ ID NO: 3769440 - RNA, 21 nt, Human
ucuuucuaguggucuuuguaa

SEQ ID NO: 3769441 - RNA, 22 nt, Human
ucuuucuaguggucuuuguaag

SEQ ID NO: 3769442 - RNA, 22 nt, Human
ucuuucuaguucagcugcccca

SEQ ID NO: 3769443 - RNA, 15 nt, Human
ucuuucucuccuuuc

SEQ ID NO: 3769444 - RNA, 15 nt, Human
ucuuucucugaggac

SEQ ID NO: 3769445 - RNA, 12 nt, Human
ucuuucucugcc

SEQ ID NO: 3769446 - RNA, 13 nt, Human
ucuuucucugcca

SEQ ID NO: 3769447 - RNA, 16 nt, Human
ucuuucucugccagug

SEQ ID NO: 3769448 - RNA, 17 nt, Human
ugaaacacagcuguucu

SEQ ID NO: 3769449 - RNA, 16 nt, Human
ugaaacaccuucucug

SEQ ID NO: 3769450 - RNA, 18 nt, Human
ugaaacaccuucucugga

SEQ ID NO: 3769451 - RNA, 15 nt, Human
ugaaacacgaaacuu

SEQ ID NO: 3769452 - RNA, 20 nt, Human
ugaaacacgaaacuuguuau

SEQ ID NO: 3769453 - RNA, 13 nt, Human
ugaaacagacuug

SEQ ID NO: 3769454 - RNA, 14 nt, Human
ugaaacagacuugu

SEQ ID NO: 3769455 - RNA, 16 nt, Human
ugaaacagcugccuua

SEQ ID NO: 3769456 - RNA, 17 nt, Human
ugaaacagcugccuuag

SEQ ID NO: 3769457 - RNA, 12 nt, Human
ugaaacaugcuu

SEQ ID NO: 3769458 - RNA, 16 nt, Human
ugaaacauugcuuuua

SEQ ID NO: 3769459 - RNA, 19 nt, Human
ugaaacauugcuuuuaaaa

SEQ ID NO: 3769460 - RNA, 20 nt, Human
ugaaaccaguguuagggaag

SEQ ID NO: 3769461 - RNA, 11 nt, Human
ugaaacccagu

SEQ ID NO: 3769462 - RNA, 19 nt, Human
ugaaaccccaaacagugac

SEQ ID NO: 3769463 - RNA, 16 nt, Human
ugaaacccccacacac

SEQ ID NO: 3769464 - RNA, 17 nt, Human
ugaaacccccacacaca

SEQ ID NO: 3769465 - RNA, 18 nt, Human
ugaaacccugucucuacu

SEQ ID NO: 3769466 - RNA, 17 nt, Human
ugaaaccuuauuuuuuc

SEQ ID NO: 3769467 - RNA, 19 nt, Human
ugaaaccuuuuuuaagauu

SEQ ID NO: 3769468 - RNA, 21 nt, Human
ugaaaccuuuuuuaagauuuu

SEQ ID NO: 3769469 - RNA, 19 nt, Human
ugaaacuaaagcaauagaa

SEQ ID NO: 3769470 - RNA, 14 nt, Human
ugaaacuaaugaaa

SEQ ID NO: 3769471 - RNA, 19 nt, Human
ugaaacuauauuuugucau

SEQ ID NO: 3769472 - RNA, 16 nt, Human
ugaaacucacaaauga

SEQ ID NO: 3769473 - RNA, 17 nt, Human
ugaaacucacaaaugau

SEQ ID NO: 3769474 - RNA, 13 nt, Human
ugaaacuccaccu

SEQ ID NO: 3769475 - RNA, 17 nt, Human
ugaaacuccagaugcca

SEQ ID NO: 3769476 - RNA, 21 nt, Human
ugaaacugacuugcugugacu

SEQ ID NO: 3769477 - RNA, 22 nt, Human
ugaaacugagaugugaacacau

SEQ ID NO: 3769478 - RNA, 17 nt, Human
ugaaacuggauuaaacu

SEQ ID NO: 3769479 - RNA, 16 nt, Human
ugaaacuuacacacaa

SEQ ID NO: 3769480 - RNA, 21 nt, Human
ugaaacuuauuuuuuucugau

SEQ ID NO: 3769481 - RNA, 17 nt, Human
ugaaacuuguguaaaua

SEQ ID NO: 3769482 - RNA, 23 nt, Human
ugaaacuuguguaaauacaauuu

SEQ ID NO: 3769483 - RNA, 20 nt, Human
ugaaacuuguuucacugaaa

SEQ ID NO: 3769484 - RNA, 12 nt, Human
ugaaacuuugag

SEQ ID NO: 3769485 - RNA, 16 nt, Human
ugaaacuuugggaaaa

SEQ ID NO: 3769486 - RNA, 19 nt, Human
ugaaacuuugggaaaacau

SEQ ID NO: 3769487 - RNA, 22 nt, Human
ugaaacuuugggaaaacauguu

SEQ ID NO: 3769488 - RNA, 23 nt, Human
ugaaacuuugggaaaacauguua

SEQ ID NO: 3769489 - RNA, 13 nt, Human
ugaaagaaaauaa

SEQ ID NO: 3769490 - RNA, 13 nt, Human
ugaaagaaaauug

SEQ ID NO: 3769491 - RNA, 22 nt, Human
ugaaagaaacaguuaacuuuca

SEQ ID NO: 3769492 - RNA, 18 nt, Human
ugaaagaaaucauguuau

SEQ ID NO: 3769493 - RNA, 20 nt, Human
ugaaagaacauggacuugua

SEQ ID NO: 3769494 - RNA, 13 nt, Human
ugaaagaagaaaa

SEQ ID NO: 3769495 - RNA, 22 nt, Human
ugaaagaagaauguguuucaaa

SEQ ID NO: 3769496 - RNA, 22 nt, Human
ugaaagaauauauuuauuuaaa

SEQ ID NO: 3769497 - RNA, 17 nt, Human
ugaaagaccuucuccaa

SEQ ID NO: 3769498 - RNA, 22 nt, Human
ugaaagacugaagaaaguguag

SEQ ID NO: 3769499 - RNA, 18 nt, Human
ugaaagacuguacaaagu

SEQ ID NO: 3769500 - RNA, 15 nt, Human
ugaaagacuuccaaa

SEQ ID NO: 3769501 - RNA, 17 nt, Human
ugaaagacuuccaaaga

SEQ ID NO: 3769502 - RNA, 14 nt, Human
ugaaagagaaacac

SEQ ID NO: 3769503 - RNA, 23 nt, Human
ugaaagaggccaaacaggcccuc

SEQ ID NO: 3769504 - RNA, 11 nt, Human
ugaaagaugau

SEQ ID NO: 3769505 - RNA, 17 nt, Human
ugaaagaugauuugcaa

SEQ ID NO: 3769506 - RNA, 13 nt, Human
ugaaagauucaau

SEQ ID NO: 3769507 - RNA, 16 nt, Human
ugaaagcaaaaaugcu

SEQ ID NO: 3769508 - RNA, 17 nt, Human
ugaaagcaaaaaugcua

SEQ ID NO: 3769509 - RNA, 21 nt, Human
ugaaagcacaggagacacugu

SEQ ID NO: 3769510 - RNA, 23 nt, Human
ugaaagccagcugccgaccagag

SEQ ID NO: 3769511 - RNA, 13 nt, Human
ugaaagccaugga

SEQ ID NO: 3769512 - RNA, 18 nt, Human
ugaaagcccugagcuuuc

SEQ ID NO: 3769513 - RNA, 20 nt, Human
ugaaagcugagaacuccuga

SEQ ID NO: 3769514 - RNA, 18 nt, Human
ugaaagcugauuacuguc

SEQ ID NO: 3769515 - RNA, 17 nt, Human
ugaaagcugguggcaga

SEQ ID NO: 3769516 - RNA, 17 nt, Human
ugaaaggaaagaggcuc

SEQ ID NO: 3769517 - RNA, 14 nt, Human
ugaaaggaaagugc

SEQ ID NO: 3769518 - RNA, 18 nt, Human
ugaaaggaagcuccacug

SEQ ID NO: 3769519 - RNA, 18 nt, Human
ugaaaggcaaacauuuga

SEQ ID NO: 3769520 - RNA, 19 nt, Human
ugaaaggcaggccuauuuc

SEQ ID NO: 3769521 - RNA, 20 nt, Human
ugaaaggcaguagucauuuu

SEQ ID NO: 3769522 - RNA, 20 nt, Human
ugaaagggagcuaucaggaa

SEQ ID NO: 3769523 - RNA, 16 nt, Human
ugaaagguacuucaaa

SEQ ID NO: 3769524 - RNA, 15 nt, Human
ugaaagguuuacauu

SEQ ID NO: 3769525 - RNA, 14 nt, Human
ugaaaguacauuug

SEQ ID NO: 3769526 - RNA, 15 nt, Human
ugaaaguagggggcu

SEQ ID NO: 3769527 - RNA, 15 nt, Human
ugaaaguauaacuga

SEQ ID NO: 3769528 - RNA, 22 nt, Human
ugaaaguauaacugaguuaaau

SEQ ID NO: 3769529 - RNA, 17 nt, Human
ugaaaguauguuuuacu

SEQ ID NO: 3769530 - RNA, 19 nt, Human
ugaaagucaugaacacauc

SEQ ID NO: 3769531 - RNA, 16 nt, Human
ugaaaguccagaaacu

SEQ ID NO: 3769532 - RNA, 12 nt, Human
ugaaagucuguc

SEQ ID NO: 3769533 - RNA, 17 nt, Human
ugaaagucuguccuuga

SEQ ID NO: 3769534 - RNA, 21 nt, Human
ugaaagucuugugacuagugc

SEQ ID NO: 3769535 - RNA, 18 nt, Human
ugaaagugaauaaacuuc

SEQ ID NO: 3769536 - RNA, 11 nt, Human
ugaaagugacu

SEQ ID NO: 3769537 - RNA, 15 nt, Human
ugaaagugaugacau

SEQ ID NO: 3769538 - RNA, 14 nt, Human
ugaaagugcauuuu

SEQ ID NO: 3769539 - RNA, 20 nt, Human
ugaaagugcauuuuuguaaa

SEQ ID NO: 3769540 - RNA, 13 nt, Human
ugaaagugccuuu

SEQ ID NO: 3769541 - RNA, 14 nt, Human
ugaaagugccuuug

SEQ ID NO: 3769542 - RNA, 18 nt, Human
ugaaaguuguacaugaaa

SEQ ID NO: 3769543 - RNA, 16 nt, Human
ugaaaguuuuguaaaa

SEQ ID NO: 3769544 - RNA, 17 nt, Human
ugaaaguuuuguaaaag

SEQ ID NO: 3769545 - RNA, 17 nt, Human
ugaaauaaaacuggcuu

SEQ ID NO: 3769546 - RNA, 19 nt, Human
ugaaauaaaacuggcuuug

SEQ ID NO: 3769547 - RNA, 14 nt, Human
ugaaauaaaagcua

SEQ ID NO: 3769548 - RNA, 14 nt, Human
ugaaauaaaauaua

SEQ ID NO: 3769549 - RNA, 21 nt, Human
ugaaauaaagacccaggggga

SEQ ID NO: 3769550 - RNA, 16 nt, Human
ugaaauaacaaaaugg

SEQ ID NO: 3769551 - RNA, 17 nt, Human
ugaaauaacacagcagu

SEQ ID NO: 3769552 - RNA, 23 nt, Human
ugaaauaaccguaaagguuuauu

SEQ ID NO: 3769553 - RNA, 14 nt, Human
ugaaauaacuccuu

SEQ ID NO: 3769554 - RNA, 14 nt, Human
ugaaauaacuggaa

SEQ ID NO: 3769555 - RNA, 13 nt, Human
ugaaauaagagaa

SEQ ID NO: 3769556 - RNA, 14 nt, Human
ugaaauaagccaga

SEQ ID NO: 3769557 - RNA, 14 nt, Human
ugaaauaagcuauu

SEQ ID NO: 3769558 - RNA, 16 nt, Human
ugaaauaagcuauuug

SEQ ID NO: 3769559 - RNA, 14 nt, Human
ugaaauaauaaauc

SEQ ID NO: 3769560 - RNA, 13 nt, Human
ugaaauaaugugu

SEQ ID NO: 3769561 - RNA, 22 nt, Human
ugaaauaauguguaguucaugu

SEQ ID NO: 3769562 - RNA, 14 nt, Human
ugaaauaccagugu

SEQ ID NO: 3769563 - RNA, 21 nt, Human
ugaaauaccucauguuuauga

SEQ ID NO: 3769564 - RNA, 22 nt, Human
ugaaauaccucauguuuaugaa

SEQ ID NO: 3769565 - RNA, 23 nt, Human
ugaaauagacccacaagaggcag

SEQ ID NO: 3769566 - RNA, 21 nt, Human
ugaaauaggagggaaaccuuu

SEQ ID NO: 3769567 - RNA, 16 nt, Human
ugaaauagucugugug

SEQ ID NO: 3769568 - RNA, 17 nt, Human
ugaaauagucuguguga

SEQ ID NO: 3769569 - RNA, 18 nt, Human
ugaaauagucugugugaa

SEQ ID NO: 3769570 - RNA, 22 nt, Human
ugaaauagugguucuuggaaaa

SEQ ID NO: 3769571 - RNA, 22 nt, Human
ugaaauauauggucuaauguuu

SEQ ID NO: 3769572 - RNA, 23 nt, Human
ugaaauaucaucacguauguuau

SEQ ID NO: 3769573 - RNA, 17 nt, Human
ugaaauauccugcuuga

SEQ ID NO: 3769574 - RNA, 18 nt, Human
ugaaauaugcucuuuugu

SEQ ID NO: 3769575 - RNA, 21 nt, Human
ugaaauaugcucuuuuguuug

SEQ ID NO: 3769576 - RNA, 23 nt, Human
ugaaauauguauaacuuuaacuu

SEQ ID NO: 3769577 - RNA, 19 nt, Human
ugaaaucaaugcaagagug

SEQ ID NO: 3769578 - RNA, 17 nt, Human
ugaaaucaguaaacacu

SEQ ID NO: 3769579 - RNA, 17 nt, Human
ugaaaucauauuuggaa

SEQ ID NO: 3769580 - RNA, 18 nt, Human
ugaaaucuaggaaaauua

SEQ ID NO: 3769581 - RNA, 16 nt, Human
ugaaaucucagaauuc

SEQ ID NO: 3769582 - RNA, 19 nt, Human
ugaaaucucagaauuccuu

SEQ ID NO: 3769583 - RNA, 21 nt, Human
ugaaaucugucaagaguaguu

SEQ ID NO: 3769584 - RNA, 14 nt, Human
ugaaaugaaaacau

SEQ ID NO: 3769585 - RNA, 19 nt, Human
ugaaaugaaaacauguaau

SEQ ID NO: 3769586 - RNA, 13 nt, Human
ugaaaugaaauuu

SEQ ID NO: 3769587 - RNA, 15 nt, Human
ugaaaugaaauuuaa

SEQ ID NO: 3769588 - RNA, 16 nt, Human
ugaaaugaaauuuaaa

SEQ ID NO: 3769589 - RNA, 23 nt, Human
ugaaaugaaauuuaaacauuaaa

SEQ ID NO: 3769590 - RNA, 19 nt, Human
ugaaaugaccucaagaugu

SEQ ID NO: 3769591 - RNA, 21 nt, Human
ugaaaugagcaccuccauuaa

SEQ ID NO: 3769592 - RNA, 20 nt, Human
ugaagccgacucuggcccug

SEQ ID NO: 3769593 - RNA, 22 nt, Human
ugaagccugcguugguccagag

SEQ ID NO: 3769594 - RNA, 13 nt, Human
ugaagccugcucc

SEQ ID NO: 3769595 - RNA, 13 nt, Human
ugaagccuuuuga

SEQ ID NO: 3769596 - RNA, 16 nt, Human
ugaagccuuuugaaag

SEQ ID NO: 3769597 - RNA, 19 nt, Human
ugaagcuaauuauuuuaau

SEQ ID NO: 3769598 - RNA, 22 nt, Human
ugaagcuaauuauuuuaauuag

SEQ ID NO: 3769599 - RNA, 16 nt, Human
ugaagcucacuucugg

SEQ ID NO: 3769600 - RNA, 14 nt, Human
ugaagcugaaaaua

SEQ ID NO: 3769601 - RNA, 15 nt, Human
ugaagcugaaaauau

SEQ ID NO: 3769602 - RNA, 16 nt, Human
ugaagcugccugcuuu

SEQ ID NO: 3769603 - RNA, 19 nt, Human
ugaagcuguugugugaggu

SEQ ID NO: 3769604 - RNA, 16 nt, Human
ugaagcuuauuaaugc

SEQ ID NO: 3769605 - RNA, 20 nt, Human
ugaagcuuauuaaugcuaag

SEQ ID NO: 3769606 - RNA, 14 nt, Human
ugaagcuucaugca

SEQ ID NO: 3769607 - RNA, 21 nt, Human
ugaagcuucaugcacuuaaag

SEQ ID NO: 3769608 - RNA, 12 nt, Human
ugaagcuuccuu

SEQ ID NO: 3769609 - RNA, 15 nt, Human
ugaagcuuguguauc

SEQ ID NO: 3769610 - RNA, 14 nt, Human
ugaagcuuuauacg

SEQ ID NO: 3769611 - RNA, 23 nt, Human
ugaaggaaaaacacaagcaaaaa

SEQ ID NO: 3769612 - RNA, 12 nt, Human
ugaaggaaacag

SEQ ID NO: 3769613 - RNA, 16 nt, Human
ugaaggaaacaguuaa

SEQ ID NO: 3769614 - RNA, 21 nt, Human
ugaaggaaauaaaaaagucuc

SEQ ID NO: 3769615 - RNA, 23 nt, Human
ugaaggaaauaaaaaagucucua

SEQ ID NO: 3769616 - RNA, 22 nt, Human
ugaaggaagccaaauuuaucaa

SEQ ID NO: 3769617 - RNA, 22 nt, Human
ugaaggaauauauggcagaguu

SEQ ID NO: 3769618 - RNA, 22 nt, Human
ugaaggacauugcggacagcca

SEQ ID NO: 3769619 - RNA, 12 nt, Human
ugaaggacccuu

SEQ ID NO: 3769620 - RNA, 17 nt, Human
ugaaggacuaauagaaa

SEQ ID NO: 3769621 - RNA, 10 nt, Human
ugaaggacug

SEQ ID NO: 3769622 - RNA, 14 nt, Human
ugaaggacugugac

SEQ ID NO: 3769623 - RNA, 20 nt, Human
ugaaggagagcccuucauuu

SEQ ID NO: 3769624 - RNA, 18 nt, Human
ugaaggaggccaccuccu

SEQ ID NO: 3769625 - RNA, 21 nt, Human
ugaaggaggccaccuccuaaa

SEQ ID NO: 3769626 - RNA, 20 nt, Human
ugaaggaggcuccaggcagc

SEQ ID NO: 3769627 - RNA, 22 nt, Human
ugaaggaggcuccaggcagcac

SEQ ID NO: 3769628 - RNA, 18 nt, Human
ugaaggaggugagagaag

SEQ ID NO: 3769629 - RNA, 17 nt, Human
ugaaggaggugagggau

SEQ ID NO: 3769630 - RNA, 21 nt, Human
ugaaggauuauggaaaaauaa

SEQ ID NO: 3769631 - RNA, 22 nt, Human
ugaaggauuauggaaaaauaaa

SEQ ID NO: 3769632 - RNA, 15 nt, Human
ugaaggcagaaagca

SEQ ID NO: 3769633 - RNA, 18 nt, Human
ugaaggcagaaagcaaaa

SEQ ID NO: 3769634 - RNA, 18 nt, Human
ugaaggcagagaaaggga

SEQ ID NO: 3769635 - RNA, 19 nt, Human
ugaaggccccgcccaggcu

SEQ ID NO: 3769636 - RNA, 14 nt, Human
ugaaggcccugcug

SEQ ID NO: 3769637 - RNA, 15 nt, Human
ugaaggcccugcuga

SEQ ID NO: 3769638 - RNA, 18 nt, Human
ugaaggccucgcaggaag

SEQ ID NO: 3769639 - RNA, 11 nt, Human
ugaaggccugg

SEQ ID NO: 3769640 - RNA, 21 nt, Human
ugaaggcucgagcaugccugg

SEQ ID NO: 3769641 - RNA, 12 nt, Human
ugaaggcuggca

SEQ ID NO: 3769642 - RNA, 13 nt, Human
ugaaggcuucucu

SEQ ID NO: 3769643 - RNA, 18 nt, Human
ugaagggaaaggauauuu

SEQ ID NO: 3769644 - RNA, 9 nt, Human
ugaagggag

SEQ ID NO: 3769645 - RNA, 19 nt, Human
ugaagggagagccagcucc

SEQ ID NO: 3769646 - RNA, 17 nt, Human
ugaagggcauucuuucc

SEQ ID NO: 3769647 - RNA, 16 nt, Human
ugaagggccagagcca

SEQ ID NO: 3769648 - RNA, 17 nt, Human
ugaagggccagagccag

SEQ ID NO: 3769649 - RNA, 19 nt, Human
ugaagggccagagccaggg

SEQ ID NO: 3769650 - RNA, 23 nt, Human
ugaaggggcaaauucuuuugaau

SEQ ID NO: 3769651 - RNA, 19 nt, Human
ugaagggggauaugaaugg

SEQ ID NO: 3769652 - RNA, 15 nt, Human
ugaagggguuuucuu

SEQ ID NO: 3769653 - RNA, 18 nt, Human
ugaagguaaauaaaaaga

SEQ ID NO: 3769654 - RNA, 18 nt, Human
ugaagguagaauguuuuc

SEQ ID NO: 3769655 - RNA, 22 nt, Human
ugaaggucacucuuccugcaag

SEQ ID NO: 3769656 - RNA, 15 nt, Human
ugaaggugcugacgg

SEQ ID NO: 3769657 - RNA, 20 nt, Human
ugaagguuaggauuuaacag

SEQ ID NO: 3769658 - RNA, 14 nt, Human
ugaagguuuuugau

SEQ ID NO: 3769659 - RNA, 17 nt, Human
ugaagguuuuuguaaag

SEQ ID NO: 3769660 - RNA, 19 nt, Human
ugaagguuuuuguaaagau

SEQ ID NO: 3769661 - RNA, 23 nt, Human
ugaaguaaaacaaacaauaccug

SEQ ID NO: 3769662 - RNA, 19 nt, Human
ugaaguaaaauguggcagg

SEQ ID NO: 3769663 - RNA, 15 nt, Human
ugaaguaaacugcag

SEQ ID NO: 3769664 - RNA, 22 nt, Human
ugaaguaaacuuuuuguucugg

SEQ ID NO: 3769665 - RNA, 12 nt, Human
ugaaguaccacc

SEQ ID NO: 3769666 - RNA, 18 nt, Human
ugaaguacccguucacau

SEQ ID NO: 3769667 - RNA, 21 nt, Human
ugaaguacuugccagaaguug

SEQ ID NO: 3769668 - RNA, 15 nt, Human
ugaaguauacuguau

SEQ ID NO: 3769669 - RNA, 17 nt, Human
ugaaguaucuaaaagug

SEQ ID NO: 3769670 - RNA, 17 nt, Human
ugaaguauuuuuucagu

SEQ ID NO: 3769671 - RNA, 16 nt, Human
ugaagucacugcacag

SEQ ID NO: 3769672 - RNA, 21 nt, Human
ugaagucacugcacagugcau

SEQ ID NO: 3769673 - RNA, 23 nt, Human
ugaagucagaucugccuaaggac

SEQ ID NO: 3769674 - RNA, 14 nt, Human
ugaagucagaugug

SEQ ID NO: 3769675 - RNA, 16 nt, Human
ugaagucaugcucccc

SEQ ID NO: 3769676 - RNA, 22 nt, Human
ugaagucaugcuccccugugcc

SEQ ID NO: 3769677 - RNA, 13 nt, Human
ugaaguccaagca

SEQ ID NO: 3769678 - RNA, 21 nt, Human
ugaaguccaagcauuuagaug

SEQ ID NO: 3769679 - RNA, 14 nt, Human
ugaaguccuggcuu

SEQ ID NO: 3769680 - RNA, 16 nt, Human
ugaaguccuggcuuca

SEQ ID NO: 3769681 - RNA, 16 nt, Human
ugaagucguugugagg

SEQ ID NO: 3769682 - RNA, 11 nt, Human
ugaagucugaa

SEQ ID NO: 3769683 - RNA, 12 nt, Human
ugaagucugaaa

SEQ ID NO: 3769684 - RNA, 14 nt, Human
ugaagucugaaauu

SEQ ID NO: 3769685 - RNA, 21 nt, Human
ugaagucuuacuacagaaaug

SEQ ID NO: 3769686 - RNA, 17 nt, Human
ugaagucuuuguacaga

SEQ ID NO: 3769687 - RNA, 12 nt, Human
ugaagugaaacu

SEQ ID NO: 3769688 - RNA, 13 nt, Human
ugaagugaaacug

SEQ ID NO: 3769689 - RNA, 17 nt, Human
ugaagugcgugaaugua

SEQ ID NO: 3769690 - RNA, 21 nt, Human
ugaagugcgugaauguaugua

SEQ ID NO: 3769691 - RNA, 18 nt, Human
ugaagugcuguuuauuaa

SEQ ID NO: 3769692 - RNA, 16 nt, Human
ugaaguguaggcagac

SEQ ID NO: 3769693 - RNA, 20 nt, Human
ugaaguguauaauauaaaaa

SEQ ID NO: 3769694 - RNA, 22 nt, Human
ugaaguguguuuccuucagugc

SEQ ID NO: 3769695 - RNA, 20 nt, Human
ugaaguguuuuguucuuucu

SEQ ID NO: 3769696 - RNA, 21 nt, Human
ugaaguuagaauuccuucagg

SEQ ID NO: 3769697 - RNA, 23 nt, Human
ugaaguuagcuuuaacuuaaaua

SEQ ID NO: 3769698 - RNA, 12 nt, Human
ugaaguuauauu

SEQ ID NO: 3769699 - RNA, 13 nt, Human
ugaaguuauauuu

SEQ ID NO: 3769700 - RNA, 16 nt, Human
ugaaguugaaaaucau

SEQ ID NO: 3769701 - RNA, 14 nt, Human
ugaaguugcugcuu

SEQ ID NO: 3769702 - RNA, 20 nt, Human
ugaaguuguuacuaacuaaa

SEQ ID NO: 3769703 - RNA, 12 nt, Human
ugaaguuuacau

SEQ ID NO: 3769704 - RNA, 13 nt, Human
ugaaguuuacauu

SEQ ID NO: 3769705 - RNA, 22 nt, Human
ugaaguuucaaguuuuaaaguu

SEQ ID NO: 3769706 - RNA, 12 nt, Human
ugaaguuugaau

SEQ ID NO: 3769707 - RNA, 17 nt, Human
ugaaguuugaauguuaa

SEQ ID NO: 3769708 - RNA, 18 nt, Human
ugaauaaaaacucaagga

SEQ ID NO: 3769709 - RNA, 21 nt, Human
ugaauaaaaacuuugcuaaau

SEQ ID NO: 3769710 - RNA, 14 nt, Human
ugaauaaaaauuaa

SEQ ID NO: 3769711 - RNA, 14 nt, Human
ugaauaaaagugca

SEQ ID NO: 3769712 - RNA, 19 nt, Human
ugaauaaaauuauuccuuu

SEQ ID NO: 3769713 - RNA, 20 nt, Human
ugaauaaacuagauuacauu

SEQ ID NO: 3769714 - RNA, 15 nt, Human
ugaauaaacuucagc

SEQ ID NO: 3769715 - RNA, 15 nt, Human
ugaauaaagaauacu

SEQ ID NO: 3769716 - RNA, 16 nt, Human
ugaauaaagacaccua

SEQ ID NO: 3769717 - RNA, 14 nt, Human
ugaauaaagcaauu

SEQ ID NO: 3769718 - RNA, 16 nt, Human
ugaauaaauaaaugua

SEQ ID NO: 3769719 - RNA, 21 nt, Human
ugaauaaauucuauaggaaca

SEQ ID NO: 3769720 - RNA, 15 nt, Human
ugaauaaccacuuaa

SEQ ID NO: 3769721 - RNA, 21 nt, Human
ugaauaaccugaggauucuau

SEQ ID NO: 3769722 - RNA, 22 nt, Human
ugaauaagccauucugacucau

SEQ ID NO: 3769723 - RNA, 12 nt, Human
ugaauaauacag

SEQ ID NO: 3769724 - RNA, 14 nt, Human
ugaauaauggaaaa

SEQ ID NO: 3769725 - RNA, 20 nt, Human
ugaauaaugguaccagauaa

SEQ ID NO: 3769726 - RNA, 13 nt, Human
ugaauaauuacag

SEQ ID NO: 3769727 - RNA, 14 nt, Human
ugaauaauuuccca

SEQ ID NO: 3769728 - RNA, 22 nt, Human
ugaauaauuucccaauuaggaa

SEQ ID NO: 3769729 - RNA, 15 nt, Human
ugaauacaaacaaug

SEQ ID NO: 3769730 - RNA, 16 nt, Human
ugaauacaaacaaugg

SEQ ID NO: 3769731 - RNA, 17 nt, Human
ugaauacaaacaaugga

SEQ ID NO: 3769732 - RNA, 23 nt, Human
ugaauacaaacaauggaaacuga

SEQ ID NO: 3769733 - RNA, 15 nt, Human
ugaauacaaagugau

SEQ ID NO: 3769734 - RNA, 17 nt, Human
ugaauacagcagcaaga

SEQ ID NO: 3769735 - RNA, 18 nt, Human
ugaauacagcagcaagaa

SEQ ID NO: 3769736 - RNA, 20 nt, Human
ugaauacagcagcaagaaaa

SEQ ID NO: 3769737 - RNA, 14 nt, Human
ugagggcccagagc

SEQ ID NO: 3769738 - RNA, 15 nt, Human
ugagggcccagagca

SEQ ID NO: 3769739 - RNA, 18 nt, Human
ugagggcccagagcagga

SEQ ID NO: 3769740 - RNA, 20 nt, Human
ugagggcccagagcaggaag

SEQ ID NO: 3769741 - RNA, 14 nt, Human
ugagggccccucug

SEQ ID NO: 3769742 - RNA, 16 nt, Human
ugagggccccucugcc

SEQ ID NO: 3769743 - RNA, 21 nt, Human
ugagggccccucugcccagcu

SEQ ID NO: 3769744 - RNA, 19 nt, Human
ugagggccugcuggaggcc

SEQ ID NO: 3769745 - RNA, 22 nt, Human
ugagggccugcuggaggccuca

SEQ ID NO: 3769746 - RNA, 13 nt, Human
ugaggggaccagg

SEQ ID NO: 3769747 - RNA, 14 nt, Human
ugaggggaccagga

SEQ ID NO: 3769748 - RNA, 14 nt, Human
ugaggggagccagg

SEQ ID NO: 3769749 - RNA, 11 nt, Human
ugaggggagga

SEQ ID NO: 3769750 - RNA, 17 nt, Human
ugaggggcaacgaagaa

SEQ ID NO: 3769751 - RNA, 12 nt, Human
ugaggggccucu

SEQ ID NO: 3769752 - RNA, 13 nt, Human
ugaggggccucuu

SEQ ID NO: 3769753 - RNA, 17 nt, Human
ugaggggcuaccaggaa

SEQ ID NO: 3769754 - RNA, 15 nt, Human
ugaggggcuccugga

SEQ ID NO: 3769755 - RNA, 22 nt, Human
ugagggggaauagucuagaugg

SEQ ID NO: 3769756 - RNA, 22 nt, Human
ugaggggucccuagcagcccac

SEQ ID NO: 3769757 - RNA, 14 nt, Human
ugaggggucccuga

SEQ ID NO: 3769758 - RNA, 13 nt, Human
ugagggguuccuc

SEQ ID NO: 3769759 - RNA, 16 nt, Human
ugagggguuccucccc

SEQ ID NO: 3769760 - RNA, 14 nt, Human
ugaggguaaguauu

SEQ ID NO: 3769761 - RNA, 19 nt, Human
ugaggguccccaccuggga

SEQ ID NO: 3769762 - RNA, 22 nt, Human
ugaggguccugcagccugcagg

SEQ ID NO: 3769763 - RNA, 15 nt, Human
ugagggucuguaggu

SEQ ID NO: 3769764 - RNA, 18 nt, Human
ugagggucuguagguugc

SEQ ID NO: 3769765 - RNA, 22 nt, Human
ugagggucuguagguugcacac

SEQ ID NO: 3769766 - RNA, 12 nt, Human
ugagggucuucu

SEQ ID NO: 3769767 - RNA, 19 nt, Human
ugagggucuucuuacaugc

SEQ ID NO: 3769768 - RNA, 14 nt, Human
ugaggguggagacu

SEQ ID NO: 3769769 - RNA, 18 nt, Human
ugaggguuucagagagcc

SEQ ID NO: 3769770 - RNA, 14 nt, Human
ugagguaaagauau

SEQ ID NO: 3769771 - RNA, 20 nt, Human
ugaggucaaguaagaagaca

SEQ ID NO: 3769772 - RNA, 14 nt, Human
ugaggucagagccu

SEQ ID NO: 3769773 - RNA, 17 nt, Human
ugaggucagagccugca

SEQ ID NO: 3769774 - RNA, 12 nt, Human
ugaggucaggga

SEQ ID NO: 3769775 - RNA, 14 nt, Human
ugaggucagggagu

SEQ ID NO: 3769776 - RNA, 16 nt, Human
ugagguccagcccugg

SEQ ID NO: 3769777 - RNA, 15 nt, Human
ugaggucccaggaag

SEQ ID NO: 3769778 - RNA, 16 nt, Human
ugaggucccaggaagu

SEQ ID NO: 3769779 - RNA, 16 nt, Human
ugagguccugagcacu

SEQ ID NO: 3769780 - RNA, 20 nt, Human
ugagguccugagcacugcca

SEQ ID NO: 3769781 - RNA, 23 nt, Human
ugaggucuaggaacauacuucag

SEQ ID NO: 3769782 - RNA, 16 nt, Human
ugaggucugcucggcc

SEQ ID NO: 3769783 - RNA, 21 nt, Human
ugaggucuuuugacaugugga

SEQ ID NO: 3769784 - RNA, 23 nt, Human
ugaggucuuuugacauguggaaa

SEQ ID NO: 3769785 - RNA, 17 nt, Human
ugaggugaaagggagcu

SEQ ID NO: 3769786 - RNA, 18 nt, Human
ugaggugaaagggagcua

SEQ ID NO: 3769787 - RNA, 16 nt, Human
ugaggugcacugggag

SEQ ID NO: 3769788 - RNA, 17 nt, Human
ugaggugcagagugccc

SEQ ID NO: 3769789 - RNA, 21 nt, Human
ugaggugcagagugcccagaa

SEQ ID NO: 3769790 - RNA, 21 nt, Human
ugaggugcccagcuagcugca

SEQ ID NO: 3769791 - RNA, 16 nt, Human
ugaggugcugggaggg

SEQ ID NO: 3769792 - RNA, 16 nt, Human
ugaggugggcccagga

SEQ ID NO: 3769793 - RNA, 12 nt, Human
ugaggugguagg

SEQ ID NO: 3769794 - RNA, 21 nt, Human
ugaggugguaguaaaacacag

SEQ ID NO: 3769795 - RNA, 18 nt, Human
ugagguggucugaauguu

SEQ ID NO: 3769796 - RNA, 19 nt, Human
ugagguggucugaauguuc

SEQ ID NO: 3769797 - RNA, 20 nt, Human
ugagguggucugaauguucu

SEQ ID NO: 3769798 - RNA, 17 nt, Human
ugagguuacuggaaauu

SEQ ID NO: 3769799 - RNA, 14 nt, Human
ugagguuccucugc

SEQ ID NO: 3769800 - RNA, 15 nt, Human
ugagguuccucugcc

SEQ ID NO: 3769801 - RNA, 16 nt, Human
ugagguuccucugccu

SEQ ID NO: 3769802 - RNA, 19 nt, Human
ugagguuccucugccugcc

SEQ ID NO: 3769803 - RNA, 15 nt, Human
ugagguugcuuacua

SEQ ID NO: 3769804 - RNA, 15 nt, Human
ugagguuucacccuu

SEQ ID NO: 3769805 - RNA, 14 nt, Human
ugagguuucccaau

SEQ ID NO: 3769806 - RNA, 21 nt, Human
ugagguuuccuucagacagau

SEQ ID NO: 3769807 - RNA, 20 nt, Human
ugaguaaaaaguuucuaaag

SEQ ID NO: 3769808 - RNA, 21 nt, Human
ugaguaaaggaguaagaaccu

SEQ ID NO: 3769809 - RNA, 17 nt, Human
ugaguaaaucagauguu

SEQ ID NO: 3769810 - RNA, 16 nt, Human
ugaguaacauuugcug

SEQ ID NO: 3769811 - RNA, 19 nt, Human
ugaguaagaaaugcugccc

SEQ ID NO: 3769812 - RNA, 17 nt, Human
ugaguaagagcuggugu

SEQ ID NO: 3769813 - RNA, 18 nt, Human
ugaguaaugguguagaac

SEQ ID NO: 3769814 - RNA, 17 nt, Human
ugaguaauuuuggauuu

SEQ ID NO: 3769815 - RNA, 20 nt, Human
ugaguacaugcacacucaug

SEQ ID NO: 3769816 - RNA, 18 nt, Human
ugaguacguugugcauuu

SEQ ID NO: 3769817 - RNA, 15 nt, Human
ugaguacuacagucc

SEQ ID NO: 3769818 - RNA, 17 nt, Human
ugaguacuacaguccuc

SEQ ID NO: 3769819 - RNA, 21 nt, Human
ugaguacuacaguccucccau

SEQ ID NO: 3769820 - RNA, 22 nt, Human
ugaguacuacaguccucccauc

SEQ ID NO: 3769821 - RNA, 19 nt, Human
ugaguagacacauuuaagg

SEQ ID NO: 3769822 - RNA, 20 nt, Human
ugaguagagagcaagggaag

SEQ ID NO: 3769823 - RNA, 15 nt, Human
ugaguagauauuacu

SEQ ID NO: 3769824 - RNA, 19 nt, Human
ugaguagauauuacuuuau

SEQ ID NO: 3769825 - RNA, 19 nt, Human
ugaguagcuuauacaauua

SEQ ID NO: 3769826 - RNA, 14 nt, Human
ugaguagucucaug

SEQ ID NO: 3769827 - RNA, 18 nt, Human
ugaguauacaauauauaa

SEQ ID NO: 3769828 - RNA, 14 nt, Human
ugaguaucagaauu

SEQ ID NO: 3769829 - RNA, 23 nt, Human
ugaguauggagcagccuggagac

SEQ ID NO: 3769830 - RNA, 14 nt, Human
ugagucaauuggaa

SEQ ID NO: 3769831 - RNA, 16 nt, Human
ugagucaccaagccca

SEQ ID NO: 3769832 - RNA, 22 nt, Human
ugagucagggcccagaggcuga

SEQ ID NO: 3769833 - RNA, 20 nt, Human
ugagucaucuguuagggccu

SEQ ID NO: 3769834 - RNA, 20 nt, Human
ugagucaugaucucccugcc

SEQ ID NO: 3769835 - RNA, 16 nt, Human
ugagucauuuaaaugu

SEQ ID NO: 3769836 - RNA, 23 nt, Human
ugagucauuuaaauguguacaau

SEQ ID NO: 3769837 - RNA, 15 nt, Human
ugagucccaggcuga

SEQ ID NO: 3769838 - RNA, 20 nt, Human
ugagucccaggcugagccuc

SEQ ID NO: 3769839 - RNA, 20 nt, Human
ugagucccccagagauguca

SEQ ID NO: 3769840 - RNA, 19 nt, Human
ugaguccccuguuuguuuc

SEQ ID NO: 3769841 - RNA, 21 nt, Human
ugaguccccuguuuguuucug

SEQ ID NO: 3769842 - RNA, 14 nt, Human
ugagucccuuccag

SEQ ID NO: 3769843 - RNA, 12 nt, Human
ugaguccuccag

SEQ ID NO: 3769844 - RNA, 16 nt, Human
ugaguccuccagaacu

SEQ ID NO: 3769845 - RNA, 15 nt, Human
ugagucgaggacagg

SEQ ID NO: 3769846 - RNA, 17 nt, Human
ugagucgcgcaccgaaa

SEQ ID NO: 3769847 - RNA, 19 nt, Human
ugagucguacagaaagcug

SEQ ID NO: 3769848 - RNA, 18 nt, Human
ugagucgucaucacuuuu

SEQ ID NO: 3769849 - RNA, 22 nt, Human
ugagucucuggggcaggcugcu

SEQ ID NO: 3769850 - RNA, 15 nt, Human
ugagucucuucagaa

SEQ ID NO: 3769851 - RNA, 15 nt, Human
ugagucugaaggcug

SEQ ID NO: 3769852 - RNA, 21 nt, Human
ugagucugggcagcugucccu

SEQ ID NO: 3769853 - RNA, 14 nt, Human
ugagucuguucugg

SEQ ID NO: 3769854 - RNA, 18 nt, Human
ugagucuucauguuccca

SEQ ID NO: 3769855 - RNA, 19 nt, Human
ugagucuucauguucccac

SEQ ID NO: 3769856 - RNA, 21 nt, Human
ugagucuuggcggcagcagcc

SEQ ID NO: 3769857 - RNA, 17 nt, Human
ugagucuuugguucuaa

SEQ ID NO: 3769858 - RNA, 20 nt, Human
ugagucuuuuuuuuuuaagu

SEQ ID NO: 3769859 - RNA, 17 nt, Human
ugagugagccuggcucu

SEQ ID NO: 3769860 - RNA, 19 nt, Human
ugagugagccuggcucuug

SEQ ID NO: 3769861 - RNA, 22 nt, Human
ugagugaggguuucugagcugc

SEQ ID NO: 3769862 - RNA, 17 nt, Human
ugagugaucccauuucu

SEQ ID NO: 3769863 - RNA, 15 nt, Human
ugagugauccuccaa

SEQ ID NO: 3769864 - RNA, 14 nt, Human
ugagugauuauuug

SEQ ID NO: 3769865 - RNA, 18 nt, Human
ugagugcaaacuucagag

SEQ ID NO: 3769866 - RNA, 22 nt, Human
ugagugcaaacuucagaguucu

SEQ ID NO: 3769867 - RNA, 13 nt, Human
ugagugcaggccc

SEQ ID NO: 3769868 - RNA, 14 nt, Human
ugagugcaggccca

SEQ ID NO: 3769869 - RNA, 14 nt, Human
ugagugccuggcca

SEQ ID NO: 3769870 - RNA, 14 nt, Human
ugagugccuuacac

SEQ ID NO: 3769871 - RNA, 16 nt, Human
ugagugccuuacacaa

SEQ ID NO: 3769872 - RNA, 19 nt, Human
ugagugccuuuugcagaag

SEQ ID NO: 3769873 - RNA, 13 nt, Human
ugagugcucugau

SEQ ID NO: 3769874 - RNA, 19 nt, Human
ugagugcuugcuuuucaug

SEQ ID NO: 3769875 - RNA, 17 nt, Human
ugaguggccagggaauc

SEQ ID NO: 3769876 - RNA, 23 nt, Human
ugaguggcuucacuccugcugua

SEQ ID NO: 3769877 - RNA, 23 nt, Human
ugaguggggagacaccucagagc

SEQ ID NO: 3769878 - RNA, 21 nt, Human
ugaguggggggaacgcccacu

SEQ ID NO: 3769879 - RNA, 21 nt, Human
ugagugggugaauaauacagu

SEQ ID NO: 3769880 - RNA, 17 nt, Human
ugaguguaacaagaaag

SEQ ID NO: 3769881 - RNA, 15 nt, Human
ugaguguaaguguga

SEQ ID NO: 3769882 - RNA, 23 nt, Human
ugaugaucuuugcagacaggcaa

SEQ ID NO: 3769883 - RNA, 18 nt, Human
ugaugaugggaauugugu

SEQ ID NO: 3769884 - RNA, 13 nt, Human
ugaugauguaauu

SEQ ID NO: 3769885 - RNA, 16 nt, Human
ugaugaugugccuggg

SEQ ID NO: 3769886 - RNA, 15 nt, Human
ugaugauuucagaaa

SEQ ID NO: 3769887 - RNA, 13 nt, Human
ugaugcacagaga

SEQ ID NO: 3769888 - RNA, 18 nt, Human
ugaugcacagagaagcug

SEQ ID NO: 3769889 - RNA, 15 nt, Human
ugaugcagcauuuga

SEQ ID NO: 3769890 - RNA, 18 nt, Human
ugaugcagcauuugauaa

SEQ ID NO: 3769891 - RNA, 13 nt, Human
ugaugcaggcacu

SEQ ID NO: 3769892 - RNA, 21 nt, Human
ugaugcaucagaaagggaggg

SEQ ID NO: 3769893 - RNA, 22 nt, Human
ugaugcaugcuauucacaauua

SEQ ID NO: 3769894 - RNA, 16 nt, Human
ugaugcaugucuuuua

SEQ ID NO: 3769895 - RNA, 11 nt, Human
ugaugcaugug

SEQ ID NO: 3769896 - RNA, 19 nt, Human
ugaugcauuaaaagaaaau

SEQ ID NO: 3769897 - RNA, 14 nt, Human
ugaugccaaaaaaa

SEQ ID NO: 3769898 - RNA, 19 nt, Human
ugaugccaaguuguuugag

SEQ ID NO: 3769899 - RNA, 17 nt, Human
ugaugccacaccaagcu

SEQ ID NO: 3769900 - RNA, 20 nt, Human
ugaugccacaccaagcugug

SEQ ID NO: 3769901 - RNA, 22 nt, Human
ugaugccacaccaagcugugcc

SEQ ID NO: 3769902 - RNA, 14 nt, Human
ugaugccaggacac

SEQ ID NO: 3769903 - RNA, 15 nt, Human
ugaugccgugauccu

SEQ ID NO: 3769904 - RNA, 16 nt, Human
ugaugcgcaguugcug

SEQ ID NO: 3769905 - RNA, 11 nt, Human
ugaugcuaaau

SEQ ID NO: 3769906 - RNA, 16 nt, Human
ugaugcuaaauaggag

SEQ ID NO: 3769907 - RNA, 19 nt, Human
ugaugcuaucaguuuuaua

SEQ ID NO: 3769908 - RNA, 14 nt, Human
ugaugcugagauuc

SEQ ID NO: 3769909 - RNA, 22 nt, Human
ugaugcuggaacucuugacagc

SEQ ID NO: 3769910 - RNA, 15 nt, Human
ugaugcuggagaggu

SEQ ID NO: 3769911 - RNA, 16 nt, Human
ugaugcuggagagguu

SEQ ID NO: 3769912 - RNA, 17 nt, Human
ugaugcuggagagguua

SEQ ID NO: 3769913 - RNA, 13 nt, Human
ugaugcugggcug

SEQ ID NO: 3769914 - RNA, 18 nt, Human
ugaugcugggcugggugc

SEQ ID NO: 3769915 - RNA, 20 nt, Human
ugaugcugugcuaugaauuu

SEQ ID NO: 3769916 - RNA, 18 nt, Human
ugaugcuguucucuucuu

SEQ ID NO: 3769917 - RNA, 18 nt, Human
ugaugcuucuucagagac

SEQ ID NO: 3769918 - RNA, 21 nt, Human
ugaugcuucuucagagacucc

SEQ ID NO: 3769919 - RNA, 23 nt, Human
ugaugcuucuucagagacuccug

SEQ ID NO: 3769920 - RNA, 21 nt, Human
ugaugcuuguaacaagaaaac

SEQ ID NO: 3769921 - RNA, 22 nt, Human
ugaugcuuguaacaagaaaaca

SEQ ID NO: 3769922 - RNA, 23 nt, Human
ugaugcuuguaacaagaaaacau

SEQ ID NO: 3769923 - RNA, 18 nt, Human
ugauggaaauauuuauuu

SEQ ID NO: 3769924 - RNA, 16 nt, Human
ugauggacacuccagg

SEQ ID NO: 3769925 - RNA, 23 nt, Human
ugauggaccagugguuuccaguc

SEQ ID NO: 3769926 - RNA, 23 nt, Human
ugauggaccuucuagaauuauaa

SEQ ID NO: 3769927 - RNA, 14 nt, Human
ugauggagaaggaa

SEQ ID NO: 3769928 - RNA, 15 nt, Human
ugauggagaaggaag

SEQ ID NO: 3769929 - RNA, 17 nt, Human
ugauggagaaggaaggc

SEQ ID NO: 3769930 - RNA, 15 nt, Human
ugauggagcagagca

SEQ ID NO: 3769931 - RNA, 14 nt, Human
ugauggagugcugu

SEQ ID NO: 3769932 - RNA, 16 nt, Human
ugauggagugcuguuu

SEQ ID NO: 3769933 - RNA, 19 nt, Human
ugauggcaacagaucugga

SEQ ID NO: 3769934 - RNA, 12 nt, Human
ugauggccacaa

SEQ ID NO: 3769935 - RNA, 18 nt, Human
ugauggcccauucuacuu

SEQ ID NO: 3769936 - RNA, 20 nt, Human
ugauggcccauucuacuugc

SEQ ID NO: 3769937 - RNA, 21 nt, Human
ugauggcccauucuacuugcu

SEQ ID NO: 3769938 - RNA, 19 nt, Human
ugauggccuuaauuuccuu

SEQ ID NO: 3769939 - RNA, 19 nt, Human
ugaugggaaagcauuguaa

SEQ ID NO: 3769940 - RNA, 21 nt, Human
ugaugggaaguccggccccag

SEQ ID NO: 3769941 - RNA, 16 nt, Human
ugaugggauucuggac

SEQ ID NO: 3769942 - RNA, 17 nt, Human
ugauggggaaggaggcu

SEQ ID NO: 3769943 - RNA, 22 nt, Human
ugauggggcccuaauucagcca

SEQ ID NO: 3769944 - RNA, 14 nt, Human
ugauggggcccugc

SEQ ID NO: 3769945 - RNA, 16 nt, Human
ugauggucacuuaaaa

SEQ ID NO: 3769946 - RNA, 20 nt, Human
ugauggucacuuaaaaugug

SEQ ID NO: 3769947 - RNA, 15 nt, Human
ugauggucagacaca

SEQ ID NO: 3769948 - RNA, 16 nt, Human
ugauggugaugaaaug

SEQ ID NO: 3769949 - RNA, 17 nt, Human
ugauggugaugaaaugu

SEQ ID NO: 3769950 - RNA, 20 nt, Human
ugaugguguggccuguggcu

SEQ ID NO: 3769951 - RNA, 22 nt, Human
ugaugguguuuuggggaugaga

SEQ ID NO: 3769952 - RNA, 11 nt, Human
ugauguaaaau

SEQ ID NO: 3769953 - RNA, 17 nt, Human
ugauguaaaugaaguaa

SEQ ID NO: 3769954 - RNA, 19 nt, Human
ugauguaaaugaaguaacu

SEQ ID NO: 3769955 - RNA, 21 nt, Human
ugauguaaccgauucaucucu

SEQ ID NO: 3769956 - RNA, 16 nt, Human
ugauguacagucuguc

SEQ ID NO: 3769957 - RNA, 13 nt, Human
ugauguacaugua

SEQ ID NO: 3769958 - RNA, 20 nt, Human
ugauguaggguaaggugccu

SEQ ID NO: 3769959 - RNA, 20 nt, Human
ugauguauucuagcuaaugu

SEQ ID NO: 3769960 - RNA, 21 nt, Human
ugauguauucuagcuaaugua

SEQ ID NO: 3769961 - RNA, 18 nt, Human
ugaugucaauuucugugu

SEQ ID NO: 3769962 - RNA, 19 nt, Human
ugaugucaauuucuguguu

SEQ ID NO: 3769963 - RNA, 22 nt, Human
ugaugucauacagagaagucac

SEQ ID NO: 3769964 - RNA, 17 nt, Human
ugaugucaucugucacu

SEQ ID NO: 3769965 - RNA, 15 nt, Human
ugaugucauguguuc

SEQ ID NO: 3769966 - RNA, 12 nt, Human
ugauguccagaa

SEQ ID NO: 3769967 - RNA, 19 nt, Human
ugaugucccaacuuguaaa

SEQ ID NO: 3769968 - RNA, 15 nt, Human
ugauguccuguaaac

SEQ ID NO: 3769969 - RNA, 16 nt, Human
ugaugucuccuaagca

SEQ ID NO: 3769970 - RNA, 18 nt, Human
ugaugucuuuucuuggca

SEQ ID NO: 3769971 - RNA, 23 nt, Human
ugaugucuuuucuuggcaaaagc

SEQ ID NO: 3769972 - RNA, 17 nt, Human
ugaugucuuuuuauuaa

SEQ ID NO: 3769973 - RNA, 17 nt, Human
ugaugugacaauaauau

SEQ ID NO: 3769974 - RNA, 17 nt, Human
ugauguggaguggggca

SEQ ID NO: 3769975 - RNA, 18 nt, Human
ugauguggaguggggcag

SEQ ID NO: 3769976 - RNA, 15 nt, Human
ugauguggugccuga

SEQ ID NO: 3769977 - RNA, 16 nt, Human
ugauguggugccugag

SEQ ID NO: 3769978 - RNA, 20 nt, Human
ugauguguugccacuuucca

SEQ ID NO: 3769979 - RNA, 14 nt, Human
ugauguguuguucu

SEQ ID NO: 3769980 - RNA, 18 nt, Human
ugauguguuuauuuauag

SEQ ID NO: 3769981 - RNA, 12 nt, Human
ugauguuaaaaa

SEQ ID NO: 3769982 - RNA, 22 nt, Human
ugauguuaaccagaauaaaguu

SEQ ID NO: 3769983 - RNA, 17 nt, Human
ugauguuaggcugggcc

SEQ ID NO: 3769984 - RNA, 14 nt, Human
ugauguucagugua

SEQ ID NO: 3769985 - RNA, 16 nt, Human
ugauguucaguguaau

SEQ ID NO: 3769986 - RNA, 18 nt, Human
ugauguucaguguaauuu

SEQ ID NO: 3769987 - RNA, 13 nt, Human
ugauguuccuucc

SEQ ID NO: 3769988 - RNA, 12 nt, Human
ugauguucuaag

SEQ ID NO: 3769989 - RNA, 15 nt, Human
ugauguucuaaggcu

SEQ ID NO: 3769990 - RNA, 19 nt, Human
ugauguucuaaggcucuga

SEQ ID NO: 3769991 - RNA, 14 nt, Human
ugauguuggcuggg

SEQ ID NO: 3769992 - RNA, 20 nt, Human
ugauguuugugcaguaacuu

SEQ ID NO: 3769993 - RNA, 16 nt, Human
ugauguuuguggccuc

SEQ ID NO: 3769994 - RNA, 17 nt, Human
ugauguuuuccaugagu

SEQ ID NO: 3769995 - RNA, 19 nt, Human
ugauguuuuccaugagucc

SEQ ID NO: 3769996 - RNA, 16 nt, Human
ugauguuuuuaaaauc

SEQ ID NO: 3769997 - RNA, 19 nt, Human
ugauguuuuuaaaaucuua

SEQ ID NO: 3769998 - RNA, 21 nt, Human
ugauguuuuuaaaaucuuauu

SEQ ID NO: 3769999 - RNA, 15 nt, Human
ugauuaaaaugguga

SEQ ID NO: 3770000 - RNA, 20 nt, Human
ugauuaaagugcucacguua

SEQ ID NO: 3770001 - RNA, 22 nt, Human
ugauuaaauaagauucuaacgg

SEQ ID NO: 3770002 - RNA, 13 nt, Human
ugauuaaauucuu

SEQ ID NO: 3770003 - RNA, 17 nt, Human
ugauuaaauucuugcaa

SEQ ID NO: 3770004 - RNA, 20 nt, Human
ugauuaaauucuugcaaagu

SEQ ID NO: 3770005 - RNA, 15 nt, Human
ugauuaacaaauaug

SEQ ID NO: 3770006 - RNA, 14 nt, Human
ugauuaacagagag

SEQ ID NO: 3770007 - RNA, 20 nt, Human
ugauuaaccacuucagcuga

SEQ ID NO: 3770008 - RNA, 13 nt, Human
ugauuaagauuuu

SEQ ID NO: 3770009 - RNA, 15 nt, Human
ugauuaaguaaugau

SEQ ID NO: 3770010 - RNA, 18 nt, Human
ugauuaaguaaugauaac

SEQ ID NO: 3770011 - RNA, 14 nt, Human
ugauuaaugcuaaa

SEQ ID NO: 3770012 - RNA, 17 nt, Human
ugauuaauggaaauguu

SEQ ID NO: 3770013 - RNA, 21 nt, Human
ugauuaauuucugccauuuca

SEQ ID NO: 3770014 - RNA, 22 nt, Human
ugauuaauuucugccauuucau

SEQ ID NO: 3770015 - RNA, 18 nt, Human
ugauuacaccagccucgu

SEQ ID NO: 3770016 - RNA, 16 nt, Human
ugauuaccagggacug

SEQ ID NO: 3770017 - RNA, 13 nt, Human
ugauuacugucaa

SEQ ID NO: 3770018 - RNA, 15 nt, Human
ugauuacugucaaua

SEQ ID NO: 3770019 - RNA, 17 nt, Human
ugauuacugucaauaaa

SEQ ID NO: 3770020 - RNA, 23 nt, Human
ugauuacugucaauaaacagcuu

SEQ ID NO: 3770021 - RNA, 16 nt, Human
ugauuagacagaacac

SEQ ID NO: 3770022 - RNA, 18 nt, Human
ugauuagcaaguuacagu

SEQ ID NO: 3770023 - RNA, 15 nt, Human
ugauuagcuuugugu

SEQ ID NO: 3770024 - RNA, 19 nt, Human
ugauuagcuuuguguuugg

SEQ ID NO: 3770025 - RNA, 21 nt, Human
ugauuaguaagucuugccuau

SEQ ID NO: 3770026 - RNA, 22 nt, Human
ugauuagugaaaggaagauaaa

SEQ ID NO: 3770027 - RNA, 14 nt, Human
ugauuuuaacucug

SEQ ID NO: 3770028 - RNA, 15 nt, Human
ugauuuuagccuucu

SEQ ID NO: 3770029 - RNA, 15 nt, Human
ugauuuuaucuguga

SEQ ID NO: 3770030 - RNA, 19 nt, Human
ugauuuucaagcagcaucu

SEQ ID NO: 3770031 - RNA, 19 nt, Human
ugauuuuccaucuaaaaau

SEQ ID NO: 3770032 - RNA, 19 nt, Human
ugauuuuuaaagaaaaguu

SEQ ID NO: 3770033 - RNA, 22 nt, Human
ugauuuuuaccguuucuucccu

SEQ ID NO: 3770034 - RNA, 13 nt, Human
ugauuuuuacugu

SEQ ID NO: 3770035 - RNA, 18 nt, Human
ugauuuuuaugccaccug

SEQ ID NO: 3770036 - RNA, 21 nt, Human
ugauuuuugagcccuuguuuc

SEQ ID NO: 3770037 - RNA, 13 nt, Human
ugauuuuuugcau

SEQ ID NO: 3770038 - RNA, 13 nt, Human
ugauuuuuuucca

SEQ ID NO: 3770039 - RNA, 22 nt, Human
ugauuuuuuuucccauuuagaa

SEQ ID NO: 3770040 - RNA, 16 nt, Human
ugauuuuuuuuccuuu

SEQ ID NO: 3770041 - RNA, 16 nt, Human
ugauuuuuuuuuccuu

SEQ ID NO: 3770042 - RNA, 19 nt, Human
ugauuuuuuuuuccuucag

SEQ ID NO: 3770043 - RNA, 22 nt, Human
ugauuuuuuuuuccuucagugc

SEQ ID NO: 3770044 - RNA, 20 nt, Human
ugauuuuuuuuuuuaaucua

SEQ ID NO: 3770045 - RNA, 20 nt, Human
ugauuuuuuuuuuuuuuucc

SEQ ID NO: 3770046 - RNA, 15 nt, Human
ugcaaaaaaaauuag

SEQ ID NO: 3770047 - RNA, 20 nt, Human
ugcaaaaaaaauuagccggg

SEQ ID NO: 3770048 - RNA, 22 nt, Human
ugcaaaaaauacuuuuucuaau

SEQ ID NO: 3770049 - RNA, 16 nt, Human
ugcaaaaaaucuuaau

SEQ ID NO: 3770050 - RNA, 21 nt, Human
ugcaaaaacucuuugagaggg

SEQ ID NO: 3770051 - RNA, 16 nt, Human
ugcaaaaagcuucugu

SEQ ID NO: 3770052 - RNA, 22 nt, Human
ugcaaaaauauuuauaaaacuu

SEQ ID NO: 3770053 - RNA, 18 nt, Human
ugcaaaaauccaaauauu

SEQ ID NO: 3770054 - RNA, 21 nt, Human
ugcaaaaauccaaauauuguu

SEQ ID NO: 3770055 - RNA, 17 nt, Human
ugcaaaaauuuuuggau

SEQ ID NO: 3770056 - RNA, 16 nt, Human
ugcaaaaccuuuuacu

SEQ ID NO: 3770057 - RNA, 17 nt, Human
ugcaaaaccuuuuacug

SEQ ID NO: 3770058 - RNA, 18 nt, Human
ugcaaaaccuuuuacugg

SEQ ID NO: 3770059 - RNA, 23 nt, Human
ugcaaaagacuaauuuaaaaaau

SEQ ID NO: 3770060 - RNA, 13 nt, Human
ugcaaaagcagug

SEQ ID NO: 3770061 - RNA, 22 nt, Human
ugcaaaagguucacuaaagcag

SEQ ID NO: 3770062 - RNA, 13 nt, Human
ugcaaaauacaug

SEQ ID NO: 3770063 - RNA, 14 nt, Human
ugcaaaauuccuga

SEQ ID NO: 3770064 - RNA, 15 nt, Human
ugcaaacagaacagg

SEQ ID NO: 3770065 - RNA, 17 nt, Human
ugcaaacagaacagggu

SEQ ID NO: 3770066 - RNA, 18 nt, Human
ugcaaacauuggaagauu

SEQ ID NO: 3770067 - RNA, 18 nt, Human
ugcaaaccaucauugaaa

SEQ ID NO: 3770068 - RNA, 21 nt, Human
ugcaaaccaucauugaaaucu

SEQ ID NO: 3770069 - RNA, 23 nt, Human
ugcaaaccugaccccugcucagu

SEQ ID NO: 3770070 - RNA, 15 nt, Human
ugcaaacgcugccug

SEQ ID NO: 3770071 - RNA, 19 nt, Human
ugcaaacgcugccugccca

SEQ ID NO: 3770072 - RNA, 16 nt, Human
ugcaaacucacugcuc

SEQ ID NO: 3770073 - RNA, 20 nt, Human
ugcaaacucuuuggucguuu

SEQ ID NO: 3770074 - RNA, 16 nt, Human
ugcaaacuucagaguu

SEQ ID NO: 3770075 - RNA, 12 nt, Human
ugcaaacuuuau

SEQ ID NO: 3770076 - RNA, 13 nt, Human
ugcaaagaggcaa

SEQ ID NO: 3770077 - RNA, 23 nt, Human
ugcaaagaucuguccucagccuu

SEQ ID NO: 3770078 - RNA, 12 nt, Human
ugcaaagauuug

SEQ ID NO: 3770079 - RNA, 17 nt, Human
ugcaaagcccagcuuga

SEQ ID NO: 3770080 - RNA, 21 nt, Human
ugcaaagcucuguggccacau

SEQ ID NO: 3770081 - RNA, 12 nt, Human
ugcaaaggacug

SEQ ID NO: 3770082 - RNA, 14 nt, Human
ugcaaaggcuggga

SEQ ID NO: 3770083 - RNA, 19 nt, Human
ugcaaaguacaauguguuu

SEQ ID NO: 3770084 - RNA, 17 nt, Human
ugcaaaguacagguacu

SEQ ID NO: 3770085 - RNA, 20 nt, Human
ugcaaaguauuguaaauuau

SEQ ID NO: 3770086 - RNA, 22 nt, Human
ugcaaagucaugcaaaggcugg

SEQ ID NO: 3770087 - RNA, 10 nt, Human
ugcaaagugu

SEQ ID NO: 3770088 - RNA, 17 nt, Human
ugcaaaguucuguguuu

SEQ ID NO: 3770089 - RNA, 19 nt, Human
ugcaaaguucuguguuuaa

SEQ ID NO: 3770090 - RNA, 20 nt, Human
ugcaaaguucuguguuuaau

SEQ ID NO: 3770091 - RNA, 13 nt, Human
ugcaaauaaauau

SEQ ID NO: 3770092 - RNA, 21 nt, Human
ugcaaauaaguguauuuugaa

SEQ ID NO: 3770093 - RNA, 14 nt, Human
ugcaaauagaaaac

SEQ ID NO: 3770094 - RNA, 12 nt, Human
ugcaaauccuau

SEQ ID NO: 3770095 - RNA, 14 nt, Human
ugcaaauccuaugu

SEQ ID NO: 3770096 - RNA, 18 nt, Human
ugcaaaugucaucagaac

SEQ ID NO: 3770097 - RNA, 14 nt, Human
ugcaaauuaacagu

SEQ ID NO: 3770098 - RNA, 12 nt, Human
ugcaacaaaaua

SEQ ID NO: 3770099 - RNA, 14 nt, Human
ugcaacaaaaugua

SEQ ID NO: 3770100 - RNA, 20 nt, Human
ugcaacaaaauguagaauau

SEQ ID NO: 3770101 - RNA, 14 nt, Human
ugcaacaggcuggg

SEQ ID NO: 3770102 - RNA, 17 nt, Human
ugcaacaggcugggcuu

SEQ ID NO: 3770103 - RNA, 14 nt, Human
ugcaacaggcuugu

SEQ ID NO: 3770104 - RNA, 20 nt, Human
ugcaaccaaacucccaucag

SEQ ID NO: 3770105 - RNA, 17 nt, Human
ugcaaccaacuacaacc

SEQ ID NO: 3770106 - RNA, 15 nt, Human
ugcaaccacugcaau

SEQ ID NO: 3770107 - RNA, 12 nt, Human
ugcaaccaggaa

SEQ ID NO: 3770108 - RNA, 17 nt, Human
ugcaaccaggaacagca

SEQ ID NO: 3770109 - RNA, 20 nt, Human
ugcaaccaggaacagcaaau

SEQ ID NO: 3770110 - RNA, 17 nt, Human
ugcaacccuuaccccuu

SEQ ID NO: 3770111 - RNA, 16 nt, Human
ugcaaccgucuguuau

SEQ ID NO: 3770112 - RNA, 19 nt, Human
ugcaaccuccaccuccugg

SEQ ID NO: 3770113 - RNA, 14 nt, Human
ugcaaccuccgccu

SEQ ID NO: 3770114 - RNA, 20 nt, Human
ugcaaccuccgccucccggg

SEQ ID NO: 3770115 - RNA, 21 nt, Human
ugcaaccuccgccucccgggu

SEQ ID NO: 3770116 - RNA, 20 nt, Human
ugcaaccucgcuggacucuc

SEQ ID NO: 3770117 - RNA, 21 nt, Human
ugcaaccucuaccuccugggu

SEQ ID NO: 3770118 - RNA, 14 nt, Human
ugcaaccucugccu

SEQ ID NO: 3770119 - RNA, 18 nt, Human
ugcaaccucugcuuccca

SEQ ID NO: 3770120 - RNA, 22 nt, Human
ugcaaccugauugugucucuug

SEQ ID NO: 3770121 - RNA, 16 nt, Human
ugcaacucaaggacuu

SEQ ID NO: 3770122 - RNA, 17 nt, Human
ugcaacucaaggacuuu

SEQ ID NO: 3770123 - RNA, 13 nt, Human
ugcaacuucugcc

SEQ ID NO: 3770124 - RNA, 14 nt, Human
ugcaacuucugccu

SEQ ID NO: 3770125 - RNA, 23 nt, Human
ugcaagaacucaucacuguggcu

SEQ ID NO: 3770126 - RNA, 22 nt, Human
ugcaagaccccaagaggaaguu

SEQ ID NO: 3770127 - RNA, 17 nt, Human
ugcaagagacucuggcc

SEQ ID NO: 3770128 - RNA, 19 nt, Human
ugcaagagacucuggccuc

SEQ ID NO: 3770129 - RNA, 14 nt, Human
ugcaagagccuugg

SEQ ID NO: 3770130 - RNA, 15 nt, Human
ugcaagagugauugc

SEQ ID NO: 3770131 - RNA, 13 nt, Human
ugcaagaugugaa

SEQ ID NO: 3770132 - RNA, 16 nt, Human
ugcaagaugugaauua

SEQ ID NO: 3770133 - RNA, 16 nt, Human
ugcaagcagggcucug

SEQ ID NO: 3770134 - RNA, 20 nt, Human
ugcaagcagggcucugcccc

SEQ ID NO: 3770135 - RNA, 17 nt, Human
ugcaagcaguuucaaua

SEQ ID NO: 3770136 - RNA, 23 nt, Human
ugcaagcaguuucaauaaaguuu

SEQ ID NO: 3770137 - RNA, 21 nt, Human
ugcaagccagauuuuccugaa

SEQ ID NO: 3770138 - RNA, 12 nt, Human
ugcaagccugcg

SEQ ID NO: 3770139 - RNA, 14 nt, Human
ugcaagccugcguu

SEQ ID NO: 3770140 - RNA, 20 nt, Human
ugcaagcuguccagagaaaa

SEQ ID NO: 3770141 - RNA, 19 nt, Human
ugcaaggaagccacagcug

SEQ ID NO: 3770142 - RNA, 20 nt, Human
ugcaaggaagccacagcugg

SEQ ID NO: 3770143 - RNA, 15 nt, Human
ugcaaggaaggaaag

SEQ ID NO: 3770144 - RNA, 16 nt, Human
ugcaaggaaggaaaga

SEQ ID NO: 3770145 - RNA, 14 nt, Human
ugcaaggaccagga

SEQ ID NO: 3770146 - RNA, 15 nt, Human
ugcaaggaccaggac

SEQ ID NO: 3770147 - RNA, 17 nt, Human
ugcaaggaccuaaaaca

SEQ ID NO: 3770148 - RNA, 15 nt, Human
ugcaaggcagccgug

SEQ ID NO: 3770149 - RNA, 12 nt, Human
ugcaaggcccac

SEQ ID NO: 3770150 - RNA, 23 nt, Human
ugcaaggccgcuguucacccaca

SEQ ID NO: 3770151 - RNA, 23 nt, Human
ugcaaggccugguguuucuugau

SEQ ID NO: 3770152 - RNA, 16 nt, Human
ugcaagggacugugug

SEQ ID NO: 3770153 - RNA, 22 nt, Human
ugcaagggaugaauuguaaaag

SEQ ID NO: 3770154 - RNA, 20 nt, Human
ugcaagggcuccccacugcc

SEQ ID NO: 3770155 - RNA, 15 nt, Human
ugcaagguaaaauuu

SEQ ID NO: 3770156 - RNA, 19 nt, Human
ugcaaggucuugcauuuaa

SEQ ID NO: 3770157 - RNA, 15 nt, Human
ugcaagguggcucca

SEQ ID NO: 3770158 - RNA, 18 nt, Human
ugcaagguuccacagagu

SEQ ID NO: 3770159 - RNA, 23 nt, Human
ugcaagguuuaggcugguggccc

SEQ ID NO: 3770160 - RNA, 15 nt, Human
ugcaaguacugcugu

SEQ ID NO: 3770161 - RNA, 18 nt, Human
ugcaaguaugugagugug

SEQ ID NO: 3770162 - RNA, 15 nt, Human
ugcaagucagaggau

SEQ ID NO: 3770163 - RNA, 23 nt, Human
ugcaagucaguccaggaugcuaa

SEQ ID NO: 3770164 - RNA, 16 nt, Human
ugcaagucauggcugu

SEQ ID NO: 3770165 - RNA, 16 nt, Human
ugcaaguccuuuugua

SEQ ID NO: 3770166 - RNA, 18 nt, Human
ugcaaguccuuuuguaaa

SEQ ID NO: 3770167 - RNA, 20 nt, Human
ugcaaguccuuuuguaaagu

SEQ ID NO: 3770168 - RNA, 13 nt, Human
ugcaagugcugga

SEQ ID NO: 3770169 - RNA, 23 nt, Human
ugcaagugcuggagucuccugag

SEQ ID NO: 3770170 - RNA, 21 nt, Human
ugcaaguguaugcacgugugc

SEQ ID NO: 3770171 - RNA, 19 nt, Human
ugcaaguguguaugugcgu

SEQ ID NO: 3770172 - RNA, 22 nt, Human
ugcaccaacccagccgcugccc

SEQ ID NO: 3770173 - RNA, 14 nt, Human
ugcaccaccaagcc

SEQ ID NO: 3770174 - RNA, 18 nt, Human
ugcaccaccaagccaagg

SEQ ID NO: 3770175 - RNA, 19 nt, Human
ugcaccaccaagccaaggg

SEQ ID NO: 3770176 - RNA, 15 nt, Human
ugcaccacugcacuc

SEQ ID NO: 3770177 - RNA, 21 nt, Human
ugcaccagagcaaccucucac

SEQ ID NO: 3770178 - RNA, 13 nt, Human
ugcaccaggagac

SEQ ID NO: 3770179 - RNA, 17 nt, Human
ugcaccauacucaugca

SEQ ID NO: 3770180 - RNA, 22 nt, Human
ugcaccaugcugcuggggaaga

SEQ ID NO: 3770181 - RNA, 23 nt, Human
ugcaccauugcgcucuagccugg

SEQ ID NO: 3770182 - RNA, 21 nt, Human
ugcacccacucugcuuugacu

SEQ ID NO: 3770183 - RNA, 15 nt, Human
ugcacccagaagaag

SEQ ID NO: 3770184 - RNA, 18 nt, Human
ugcaccccaaagcuuucc

SEQ ID NO: 3770185 - RNA, 19 nt, Human
ugcaccccaaagcuuuccu

SEQ ID NO: 3770186 - RNA, 21 nt, Human
ugcaccccaaagcuuuccugc

SEQ ID NO: 3770187 - RNA, 15 nt, Human
ugcacccccuccugc

SEQ ID NO: 3770188 - RNA, 16 nt, Human
ugcacccccuccugcu

SEQ ID NO: 3770189 - RNA, 17 nt, Human
ugcacccccuccugcug

SEQ ID NO: 3770190 - RNA, 13 nt, Human
ugcaccccuccca

SEQ ID NO: 3770191 - RNA, 15 nt, Human
ugcaccccuuccugg

SEQ ID NO: 3770192 - RNA, 18 nt, Human
ugcaccccuuccugggca

SEQ ID NO: 3770193 - RNA, 19 nt, Human
ugcaccccuuccugggcac

SEQ ID NO: 3770194 - RNA, 16 nt, Human
ugcacccucaggcagg

SEQ ID NO: 3770195 - RNA, 14 nt, Human
ugcacccuccaccc

SEQ ID NO: 3770196 - RNA, 15 nt, Human
ugcacccuccacccu

SEQ ID NO: 3770197 - RNA, 17 nt, Human
ugcacccuccacccugu

SEQ ID NO: 3770198 - RNA, 18 nt, Human
ugcacccuccacccuguc

SEQ ID NO: 3770199 - RNA, 16 nt, Human
ugcacccuccgccuuc

SEQ ID NO: 3770200 - RNA, 13 nt, Human
ugcacccuucuuu

SEQ ID NO: 3770201 - RNA, 17 nt, Human
ugcaccgggccacagag

SEQ ID NO: 3770202 - RNA, 15 nt, Human
ugcaccuaaagaaaa

SEQ ID NO: 3770203 - RNA, 21 nt, Human
ugcaccuaaagaaaaacaaac

SEQ ID NO: 3770204 - RNA, 15 nt, Human
ugcaccuccccccac

SEQ ID NO: 3770205 - RNA, 17 nt, Human
ugcaccuccccccacug

SEQ ID NO: 3770206 - RNA, 11 nt, Human
ugcaccugcau

SEQ ID NO: 3770207 - RNA, 18 nt, Human
ugcaccugcauccguagu

SEQ ID NO: 3770208 - RNA, 17 nt, Human
ugcaccugccagccugg

SEQ ID NO: 3770209 - RNA, 13 nt, Human
ugcaccugggaca

SEQ ID NO: 3770210 - RNA, 20 nt, Human
ugcaccuguacucaggaggc

SEQ ID NO: 3770211 - RNA, 16 nt, Human
ugcaccuguccccacc

SEQ ID NO: 3770212 - RNA, 18 nt, Human
ugcaccuuaccaacuuuc

SEQ ID NO: 3770213 - RNA, 21 nt, Human
ugcaccuuaccaacuuucugu

SEQ ID NO: 3770214 - RNA, 14 nt, Human
ugcaccuuaucuua

SEQ ID NO: 3770215 - RNA, 16 nt, Human
ugcaccuugugucugu

SEQ ID NO: 3770216 - RNA, 18 nt, Human
ugcaccuuucuaguugaa

SEQ ID NO: 3770217 - RNA, 15 nt, Human
ugcacgaccuuggga

SEQ ID NO: 3770218 - RNA, 19 nt, Human
ugcacgacgcccucucccc

SEQ ID NO: 3770219 - RNA, 20 nt, Human
ugcacgacgcccucucccca

SEQ ID NO: 3770220 - RNA, 16 nt, Human
ugcacgcacacugucu

SEQ ID NO: 3770221 - RNA, 19 nt, Human
ugcacgcacacugucugcc

SEQ ID NO: 3770222 - RNA, 21 nt, Human
ugcacgcagauuagcaggcca

SEQ ID NO: 3770223 - RNA, 17 nt, Human
ugcacgcccauguguga

SEQ ID NO: 3770224 - RNA, 15 nt, Human
ugcacgcuggggaag

SEQ ID NO: 3770225 - RNA, 14 nt, Human
ugcacggcugcuga

SEQ ID NO: 3770226 - RNA, 18 nt, Human
ugcacggugaauggcuuu

SEQ ID NO: 3770227 - RNA, 22 nt, Human
ugcacggugaauggcuuuguau

SEQ ID NO: 3770228 - RNA, 18 nt, Human
ugcacggugggccuugcu

SEQ ID NO: 3770229 - RNA, 18 nt, Human
ugcacguaaaguacuugu

SEQ ID NO: 3770230 - RNA, 19 nt, Human
ugcacguaaaguacuugua

SEQ ID NO: 3770231 - RNA, 16 nt, Human
ugcacguacacacaca

SEQ ID NO: 3770232 - RNA, 17 nt, Human
ugcacguauuuuaauag

SEQ ID NO: 3770233 - RNA, 21 nt, Human
ugcacguggagagcuggugcc

SEQ ID NO: 3770234 - RNA, 23 nt, Human
ugcacguggcauguggccugugg

SEQ ID NO: 3770235 - RNA, 15 nt, Human
ugcacguggccucuu

SEQ ID NO: 3770236 - RNA, 17 nt, Human
ugcacguggccucuuga

SEQ ID NO: 3770237 - RNA, 15 nt, Human
ugcacgugugugcac

SEQ ID NO: 3770238 - RNA, 19 nt, Human
ugcacguguguuuuucuau

SEQ ID NO: 3770239 - RNA, 22 nt, Human
ugcacguguguuuuucuauuaa

SEQ ID NO: 3770240 - RNA, 19 nt, Human
ugcacguuaugguguuucu

SEQ ID NO: 3770241 - RNA, 15 nt, Human
ugcacguugcuucag

SEQ ID NO: 3770242 - RNA, 20 nt, Human
ugcacuaaagccagccugac

SEQ ID NO: 3770243 - RNA, 23 nt, Human
ugcacuacuccucugcagugccu

SEQ ID NO: 3770244 - RNA, 15 nt, Human
ugcacuacugacaug

SEQ ID NO: 3770245 - RNA, 16 nt, Human
ugcacuacugacaugu

SEQ ID NO: 3770246 - RNA, 18 nt, Human
ugcacuacugacaugugg

SEQ ID NO: 3770247 - RNA, 12 nt, Human
ugcacuauaugc

SEQ ID NO: 3770248 - RNA, 15 nt, Human
ugcacuauaugcaaa

SEQ ID NO: 3770249 - RNA, 17 nt, Human
ugcacuauaugcaaaca

SEQ ID NO: 3770250 - RNA, 20 nt, Human
ugcacuauaugcaaacaggg

SEQ ID NO: 3770251 - RNA, 19 nt, Human
ugcacucaaaucuuaagaa

SEQ ID NO: 3770252 - RNA, 14 nt, Human
ugcacucagcucuu

SEQ ID NO: 3770253 - RNA, 14 nt, Human
ugcacuccaaucug

SEQ ID NO: 3770254 - RNA, 14 nt, Human
ugcacuccagccug

SEQ ID NO: 3770255 - RNA, 15 nt, Human
ugcacuccagccugg

SEQ ID NO: 3770256 - RNA, 20 nt, Human
ugcacuccagccugggcaac

SEQ ID NO: 3770257 - RNA, 17 nt, Human
ugcacuccagccugggg

SEQ ID NO: 3770258 - RNA, 18 nt, Human
ugcacuccagccuggggg

SEQ ID NO: 3770259 - RNA, 14 nt, Human
ugcacucccaccug

SEQ ID NO: 3770260 - RNA, 12 nt, Human
ugcacuccccug

SEQ ID NO: 3770261 - RNA, 13 nt, Human
ugcacuccccugc

SEQ ID NO: 3770262 - RNA, 16 nt, Human
ugcacucuagccuggg

SEQ ID NO: 3770263 - RNA, 16 nt, Human
ugcacucucuuggcug

SEQ ID NO: 3770264 - RNA, 12 nt, Human
ugcacucuucua

SEQ ID NO: 3770265 - RNA, 23 nt, Human
ugcacucuuguuucucccgugcu

SEQ ID NO: 3770266 - RNA, 19 nt, Human
ugcacugaaguuugauaaa

SEQ ID NO: 3770267 - RNA, 24 nt, Human
ugcacugaaguuugauaaauagug

SEQ ID NO: 3770268 - RNA, 18 nt, Human
ugcacugacccacagccu

SEQ ID NO: 3770269 - RNA, 22 nt, Human
ugcacugacccacagccucugc

SEQ ID NO: 3770270 - RNA, 12 nt, Human
ugcacugacccu

SEQ ID NO: 3770271 - RNA, 17 nt, Human
ugcacugacccuuccag

SEQ ID NO: 3770272 - RNA, 23 nt, Human
ugcacugacccuuccagacauac

SEQ ID NO: 3770273 - RNA, 14 nt, Human
ugcacugacucugg

SEQ ID NO: 3770274 - RNA, 15 nt, Human
ugcacugacucugga

SEQ ID NO: 3770275 - RNA, 16 nt, Human
ugcacugacucuggaa

SEQ ID NO: 3770276 - RNA, 15 nt, Human
ugcacugagcagagu

SEQ ID NO: 3770277 - RNA, 15 nt, Human
ugcacuggaguccag

SEQ ID NO: 3770278 - RNA, 19 nt, Human
ugcacuggaguccagucuc

SEQ ID NO: 3770279 - RNA, 20 nt, Human
ugcacuggaguccagucucu

SEQ ID NO: 3770280 - RNA, 21 nt, Human
ugcacuggaguccagucucuu

SEQ ID NO: 3770281 - RNA, 17 nt, Human
ugcacuggccccacccu

SEQ ID NO: 3770282 - RNA, 17 nt, Human
ugcacugggaggcuccc

SEQ ID NO: 3770283 - RNA, 21 nt, Human
ugcacugggaggcuccccuuc

SEQ ID NO: 3770284 - RNA, 15 nt, Human
ugcacuguaugcugg

SEQ ID NO: 3770285 - RNA, 16 nt, Human
ugcacuguaugcugga

SEQ ID NO: 3770286 - RNA, 22 nt, Human
ugcacugucacuuugcucuggg

SEQ ID NO: 3770287 - RNA, 16 nt, Human
ugcacuguccugcucc

SEQ ID NO: 3770288 - RNA, 19 nt, Human
ugcacuguucccccugugc

SEQ ID NO: 3770289 - RNA, 21 nt, Human
ugcacuguucccccugugcag

SEQ ID NO: 3770290 - RNA, 13 nt, Human
ugcacuuaaagaa

SEQ ID NO: 3770291 - RNA, 23 nt, Human
ugcacuuaacaagcucccaggcc

SEQ ID NO: 3770292 - RNA, 15 nt, Human
ugcacuuaauuuguu

SEQ ID NO: 3770293 - RNA, 18 nt, Human
ugcacuuacuugcuuauu

SEQ ID NO: 3770294 - RNA, 18 nt, Human
ugcacuuaugauuucaug

SEQ ID NO: 3770295 - RNA, 20 nt, Human
ugcacuuaugauuucaugug

SEQ ID NO: 3770296 - RNA, 14 nt, Human
ugcacuuggccucu

SEQ ID NO: 3770297 - RNA, 15 nt, Human
ugcacuuggccucug

SEQ ID NO: 3770298 - RNA, 19 nt, Human
ugcacuugggggcucagca

SEQ ID NO: 3770299 - RNA, 22 nt, Human
ugcacuugggggcucagcaagg

SEQ ID NO: 3770300 - RNA, 17 nt, Human
ugcacuugugauuauuu

SEQ ID NO: 3770301 - RNA, 17 nt, Human
ugcacuuugaugucaug

SEQ ID NO: 3770302 - RNA, 20 nt, Human
ugcacuuugaugucaugugu

SEQ ID NO: 3770303 - RNA, 15 nt, Human
ugcacuuuguaaauu

SEQ ID NO: 3770304 - RNA, 12 nt, Human
ugcacuuuguag

SEQ ID NO: 3770305 - RNA, 14 nt, Human
ugcacuuuguucug

SEQ ID NO: 3770306 - RNA, 20 nt, Human
ugcacuuuguucuggcucuu

SEQ ID NO: 3770307 - RNA, 15 nt, Human
ugcagaaaacauugu

SEQ ID NO: 3770308 - RNA, 16 nt, Human
ugcagaaaacauuguu

SEQ ID NO: 3770309 - RNA, 17 nt, Human
ugcagaaaagcaccugc

SEQ ID NO: 3770310 - RNA, 19 nt, Human
ugcagaaaagcaccugccg

SEQ ID NO: 3770311 - RNA, 22 nt, Human
ugcagaaaagcaccugccgacc

SEQ ID NO: 3770312 - RNA, 20 nt, Human
ugcagaaagcaucccucacc

SEQ ID NO: 3770313 - RNA, 14 nt, Human
ugcagaacacauuu

SEQ ID NO: 3770314 - RNA, 13 nt, Human
ugcagaacugcca

SEQ ID NO: 3770315 - RNA, 14 nt, Human
ugcagaacugccau

SEQ ID NO: 3770316 - RNA, 20 nt, Human
ugcagaacugccauuauuuu

SEQ ID NO: 3770317 - RNA, 16 nt, Human
ugccuggucacagggc

SEQ ID NO: 3770318 - RNA, 17 nt, Human
ugccugguccucacacu

SEQ ID NO: 3770319 - RNA, 15 nt, Human
ugccugguggcagcu

SEQ ID NO: 3770320 - RNA, 17 nt, Human
ugccugguggcagcugc

SEQ ID NO: 3770321 - RNA, 18 nt, Human
ugccugguggcagcugcg

SEQ ID NO: 3770322 - RNA, 19 nt, Human
ugccugguggcagcugcgg

SEQ ID NO: 3770323 - RNA, 13 nt, Human
ugccuguaaacau

SEQ ID NO: 3770324 - RNA, 15 nt, Human
ugccuguaaacauag

SEQ ID NO: 3770325 - RNA, 15 nt, Human
ugccuguaacuugag

SEQ ID NO: 3770326 - RNA, 22 nt, Human
ugccuguagccccagugacagc

SEQ ID NO: 3770327 - RNA, 22 nt, Human
ugccuguaguuaggaaauaaaa

SEQ ID NO: 3770328 - RNA, 15 nt, Human
ugccuguccagccug

SEQ ID NO: 3770329 - RNA, 19 nt, Human
ugccuguccagccugggca

SEQ ID NO: 3770330 - RNA, 20 nt, Human
ugccuguccagccugggcag

SEQ ID NO: 3770331 - RNA, 16 nt, Human
ugccugucccaccccc

SEQ ID NO: 3770332 - RNA, 19 nt, Human
ugccugucccacccccacc

SEQ ID NO: 3770333 - RNA, 20 nt, Human
ugccugucgcuuucccuugg

SEQ ID NO: 3770334 - RNA, 11 nt, Human
ugccugucucc

SEQ ID NO: 3770335 - RNA, 13 nt, Human
ugccugucugccc

SEQ ID NO: 3770336 - RNA, 20 nt, Human
ugccugugccacccaccagg

SEQ ID NO: 3770337 - RNA, 23 nt, Human
ugccugugccaggugaggucagc

SEQ ID NO: 3770338 - RNA, 19 nt, Human
ugccugugcuacaauucau

SEQ ID NO: 3770339 - RNA, 11 nt, Human
ugccuguggcg

SEQ ID NO: 3770340 - RNA, 22 nt, Human
ugccuguggcgccgucuccagg

SEQ ID NO: 3770341 - RNA, 23 nt, Human
ugccuguggcgccgucuccaggg

SEQ ID NO: 3770342 - RNA, 21 nt, Human
ugccuguguccaugcgcucag

SEQ ID NO: 3770343 - RNA, 14 nt, Human
ugccugugucuucu

SEQ ID NO: 3770344 - RNA, 21 nt, Human
ugccugugugacaucaguggc

SEQ ID NO: 3770345 - RNA, 19 nt, Human
ugccuguuauaacucugca

SEQ ID NO: 3770346 - RNA, 18 nt, Human
ugccuguucagcuccagc

SEQ ID NO: 3770347 - RNA, 21 nt, Human
ugccuguucagcuccagcuca

SEQ ID NO: 3770348 - RNA, 16 nt, Human
ugccuguuucccaggc

SEQ ID NO: 3770349 - RNA, 16 nt, Human
ugccuuaaaaccaaag

SEQ ID NO: 3770350 - RNA, 15 nt, Human
ugccuuaaaacuuua

SEQ ID NO: 3770351 - RNA, 19 nt, Human
ugccuuaaacacucaccuu

SEQ ID NO: 3770352 - RNA, 18 nt, Human
ugccuuaaaccuaccucc

SEQ ID NO: 3770353 - RNA, 17 nt, Human
ugccuuaaagucaguaa

SEQ ID NO: 3770354 - RNA, 21 nt, Human
ugccuuaagugaggaaaucaa

SEQ ID NO: 3770355 - RNA, 22 nt, Human
ugccuuaagugaggaaaucaaa

SEQ ID NO: 3770356 - RNA, 20 nt, Human
ugccuuaauaaaaaaugaaa

SEQ ID NO: 3770357 - RNA, 14 nt, Human
ugccuuacacaaag

SEQ ID NO: 3770358 - RNA, 14 nt, Human
ugccuuaccuccug

SEQ ID NO: 3770359 - RNA, 20 nt, Human
ugccuuaccuccugcccagg

SEQ ID NO: 3770360 - RNA, 15 nt, Human
ugccuuacuuuguau

SEQ ID NO: 3770361 - RNA, 17 nt, Human
ugccuuagaaccuuucu

SEQ ID NO: 3770362 - RNA, 18 nt, Human
ugccuuagaggagcccac

SEQ ID NO: 3770363 - RNA, 16 nt, Human
ugccuuagcuucagga

SEQ ID NO: 3770364 - RNA, 17 nt, Human
ugccuuagcuucaggaa

SEQ ID NO: 3770365 - RNA, 17 nt, Human
ugccuuaggccuaccug

SEQ ID NO: 3770366 - RNA, 16 nt, Human
ugccuuauggaacacu

SEQ ID NO: 3770367 - RNA, 20 nt, Human
ugccuuauggaacacucuga

SEQ ID NO: 3770368 - RNA, 16 nt, Human
ugccuucagauguucu

SEQ ID NO: 3770369 - RNA, 14 nt, Human
ugccuuccacgcug

SEQ ID NO: 3770370 - RNA, 17 nt, Human
ugccuuccacgcugucu

SEQ ID NO: 3770371 - RNA, 22 nt, Human
ugccuuccacgcugucuccaga

SEQ ID NO: 3770372 - RNA, 23 nt, Human
ugccuuccacgcugucuccagac

SEQ ID NO: 3770373 - RNA, 18 nt, Human
ugccuuccagaaaacaaa

SEQ ID NO: 3770374 - RNA, 14 nt, Human
ugccuuccauaauu

SEQ ID NO: 3770375 - RNA, 21 nt, Human
ugccuuccaugucggccucua

SEQ ID NO: 3770376 - RNA, 13 nt, Human
ugccuucccuagc

SEQ ID NO: 3770377 - RNA, 19 nt, Human
ugccuuccuaagccugugg

SEQ ID NO: 3770378 - RNA, 20 nt, Human
ugccuuccuaagccuguggc

SEQ ID NO: 3770379 - RNA, 21 nt, Human
ugccuuccuaagccuguggcu

SEQ ID NO: 3770380 - RNA, 19 nt, Human
ugccuuccuccugggcccu

SEQ ID NO: 3770381 - RNA, 18 nt, Human
ugccuuccuuucuccagg

SEQ ID NO: 3770382 - RNA, 21 nt, Human
ugccuuccuuucuccaggacc

SEQ ID NO: 3770383 - RNA, 20 nt, Human
ugccuucgcgguggaaggcc

SEQ ID NO: 3770384 - RNA, 14 nt, Human
ugccuucgcuucuu

SEQ ID NO: 3770385 - RNA, 17 nt, Human
ugccuucgcuucuugcc

SEQ ID NO: 3770386 - RNA, 23 nt, Human
ugccuucgcuucuugccucugug

SEQ ID NO: 3770387 - RNA, 19 nt, Human
ugccuucgguacccaccac

SEQ ID NO: 3770388 - RNA, 19 nt, Human
ugccuucguuaacugugua

SEQ ID NO: 3770389 - RNA, 20 nt, Human
ugccuucguuaacuguguau

SEQ ID NO: 3770390 - RNA, 20 nt, Human
ugccuucucaccagcugcaa

SEQ ID NO: 3770391 - RNA, 22 nt, Human
ugccuucucaccagcugcaaag

SEQ ID NO: 3770392 - RNA, 23 nt, Human
ugccuucuccagacaaaccagaa

SEQ ID NO: 3770393 - RNA, 22 nt, Human
ugccuucugacggcccugcaau

SEQ ID NO: 3770394 - RNA, 11 nt, Human
ugccuucugug

SEQ ID NO: 3770395 - RNA, 21 nt, Human
ugccuucuuauucucacucca

SEQ ID NO: 3770396 - RNA, 14 nt, Human
ugccuucuucaccc

SEQ ID NO: 3770397 - RNA, 13 nt, Human
ugccuucuucagg

SEQ ID NO: 3770398 - RNA, 15 nt, Human
ugccuucuucagggc

SEQ ID NO: 3770399 - RNA, 20 nt, Human
ugccuucuucagggccuggu

SEQ ID NO: 3770400 - RNA, 21 nt, Human
ugccuucuucggggaacuccu

SEQ ID NO: 3770401 - RNA, 23 nt, Human
ugccuucuucggggaacuccugg

SEQ ID NO: 3770402 - RNA, 20 nt, Human
ugccuucuucuuuuugcugu

SEQ ID NO: 3770403 - RNA, 14 nt, Human
ugccuucuuugaag

SEQ ID NO: 3770404 - RNA, 15 nt, Human
ugccuucuuugaaga

SEQ ID NO: 3770405 - RNA, 16 nt, Human
ugccuucuuuugauua

SEQ ID NO: 3770406 - RNA, 13 nt, Human
ugccuucuuuugu

SEQ ID NO: 3770407 - RNA, 19 nt, Human
ugccuugaaccacuucccu

SEQ ID NO: 3770408 - RNA, 17 nt, Human
ugccuugaaccugugag

SEQ ID NO: 3770409 - RNA, 12 nt, Human
ugccuugaauaa

SEQ ID NO: 3770410 - RNA, 15 nt, Human
ugccuugcagaacug

SEQ ID NO: 3770411 - RNA, 20 nt, Human
ugccuugcagaacugccauu

SEQ ID NO: 3770412 - RNA, 22 nt, Human
ugccuugcuguuuguccugaga

SEQ ID NO: 3770413 - RNA, 19 nt, Human
ugccuuggagggucccaag

SEQ ID NO: 3770414 - RNA, 20 nt, Human
ugccuuggagggucccaagc

SEQ ID NO: 3770415 - RNA, 17 nt, Human
ugccuuggccucccaag

SEQ ID NO: 3770416 - RNA, 15 nt, Human
ugccuugggcugcuc

SEQ ID NO: 3770417 - RNA, 19 nt, Human
ugccuugggcugcuccuca

SEQ ID NO: 3770418 - RNA, 19 nt, Human
ugccuuggggaauuuccuc

SEQ ID NO: 3770419 - RNA, 15 nt, Human
ugccuugucacgcca

SEQ ID NO: 3770420 - RNA, 13 nt, Human
ugccuuguuucau

SEQ ID NO: 3770421 - RNA, 20 nt, Human
ugccuuguuuuuuguuuguu

SEQ ID NO: 3770422 - RNA, 14 nt, Human
ugccuuuaaaucug

SEQ ID NO: 3770423 - RNA, 18 nt, Human
ugccuuuaaaucugugau

SEQ ID NO: 3770424 - RNA, 14 nt, Human
ugccuuuacuucag

SEQ ID NO: 3770425 - RNA, 21 nt, Human
ugccuuuagccccucccaagc

SEQ ID NO: 3770426 - RNA, 21 nt, Human
ugccuuuauuguguuugucau

SEQ ID NO: 3770427 - RNA, 17 nt, Human
ugccuuuauuuccacug

SEQ ID NO: 3770428 - RNA, 17 nt, Human
ugccuuucaggaucuau

SEQ ID NO: 3770429 - RNA, 13 nt, Human
ugccuuuccuguu

SEQ ID NO: 3770430 - RNA, 14 nt, Human
ugccuuuccuguuc

SEQ ID NO: 3770431 - RNA, 16 nt, Human
ugccuuugaagaguga

SEQ ID NO: 3770432 - RNA, 13 nt, Human
ugccuuugagaca

SEQ ID NO: 3770433 - RNA, 17 nt, Human
ugccuuugagacaguuu

SEQ ID NO: 3770434 - RNA, 20 nt, Human
ugccuuugagacaguuucuu

SEQ ID NO: 3770435 - RNA, 21 nt, Human
ugccuuugaguuuccucaggc

SEQ ID NO: 3770436 - RNA, 22 nt, Human
ugccuuugaguuuccucaggcu

SEQ ID NO: 3770437 - RNA, 16 nt, Human
ugccuuugcaaaucag

SEQ ID NO: 3770438 - RNA, 19 nt, Human
ugccuuuggcacucugacu

SEQ ID NO: 3770439 - RNA, 17 nt, Human
ugccuuuggcagaguuc

SEQ ID NO: 3770440 - RNA, 11 nt, Human
ugccuuuguaa

SEQ ID NO: 3770441 - RNA, 12 nt, Human
ugccuuuguaag

SEQ ID NO: 3770442 - RNA, 13 nt, Human
ugccuuuguaagu

SEQ ID NO: 3770443 - RNA, 16 nt, Human
ugccuuuguaaguuau

SEQ ID NO: 3770444 - RNA, 16 nt, Human
ugccuuuuaauuuuua

SEQ ID NO: 3770445 - RNA, 16 nt, Human
ugccuuuuaguuccug

SEQ ID NO: 3770446 - RNA, 17 nt, Human
ugccuuuucccaacucc

SEQ ID NO: 3770447 - RNA, 15 nt, Human
ugccuuuugcacccc

SEQ ID NO: 3770448 - RNA, 17 nt, Human
ugccuuuugcaccccuc

SEQ ID NO: 3770449 - RNA, 20 nt, Human
ugccuuuugcaccccuccca

SEQ ID NO: 3770450 - RNA, 20 nt, Human
ugccuuuuuauaacuuuuua

SEQ ID NO: 3770451 - RNA, 19 nt, Human
ugccuuuuuuguaguuuuu

SEQ ID NO: 3770452 - RNA, 13 nt, Human
ugcgaaaggauga

SEQ ID NO: 3770453 - RNA, 16 nt, Human
ugcgaaguccuaugga

SEQ ID NO: 3770454 - RNA, 18 nt, Human
ugcgaauccaagcucccu

SEQ ID NO: 3770455 - RNA, 22 nt, Human
ugcgaauccaagcucccugccc

SEQ ID NO: 3770456 - RNA, 22 nt, Human
ugcgaaugguagucuaaccaaa

SEQ ID NO: 3770457 - RNA, 19 nt, Human
ugcgaccccaucugcccag

SEQ ID NO: 3770458 - RNA, 21 nt, Human
ugcgacccugggggcacagga

SEQ ID NO: 3770459 - RNA, 19 nt, Human
ugcgacggagagaaaaaag

SEQ ID NO: 3770460 - RNA, 17 nt, Human
ugcgacuuucugccugg

SEQ ID NO: 3770461 - RNA, 20 nt, Human
ugcuaccacggccuccuuuc

SEQ ID NO: 3770462 - RNA, 15 nt, Human
ugcuaccaguauuua

SEQ ID NO: 3770463 - RNA, 13 nt, Human
ugcuacccagcca

SEQ ID NO: 3770464 - RNA, 14 nt, Human
ugcuacccucccug

SEQ ID NO: 3770465 - RNA, 18 nt, Human
ugcuacccucccugcugu

SEQ ID NO: 3770466 - RNA, 18 nt, Human
ugcuaccguugacuucca

SEQ ID NO: 3770467 - RNA, 22 nt, Human
ugcuaccucacugggguccugg

SEQ ID NO: 3770468 - RNA, 19 nt, Human
ugcuaccugaucccacucc

SEQ ID NO: 3770469 - RNA, 19 nt, Human
ugcuaccuggguccuuuuc

SEQ ID NO: 3770470 - RNA, 15 nt, Human
ugcuaccuugcccca

SEQ ID NO: 3770471 - RNA, 13 nt, Human
ugcuacgugugau

SEQ ID NO: 3770472 - RNA, 15 nt, Human
ugcuacgugugauuu

SEQ ID NO: 3770473 - RNA, 19 nt, Human
ugcuacgugugauuuuucu

SEQ ID NO: 3770474 - RNA, 18 nt, Human
ugcuacuaaguucacauu

SEQ ID NO: 3770475 - RNA, 19 nt, Human
ugcuacucaaguagcauuu

SEQ ID NO: 3770476 - RNA, 15 nt, Human
ugcuacugcacucca

SEQ ID NO: 3770477 - RNA, 20 nt, Human
ugcuacugcacuccagccug

SEQ ID NO: 3770478 - RNA, 13 nt, Human
ugcuacuguacau

SEQ ID NO: 3770479 - RNA, 21 nt, Human
ugcuacuguccuacccacccu

SEQ ID NO: 3770480 - RNA, 22 nt, Human
ugcuacuguccuacccacccuc

SEQ ID NO: 3770481 - RNA, 18 nt, Human
ugcuacugucuuuggaaa

SEQ ID NO: 3770482 - RNA, 21 nt, Human
ugcuacuguuguaagaauucu

SEQ ID NO: 3770483 - RNA, 23 nt, Human
ugcuacuguuguaagaauucuga

SEQ ID NO: 3770484 - RNA, 19 nt, Human
ugcuacuuaauuccuuucu

SEQ ID NO: 3770485 - RNA, 22 nt, Human
ugcuacuuccugccuggucucc

SEQ ID NO: 3770486 - RNA, 13 nt, Human
ugcuacuuugccu

SEQ ID NO: 3770487 - RNA, 18 nt, Human
ugcuacuuugccuuuugc

SEQ ID NO: 3770488 - RNA, 15 nt, Human
ugcuagaacucccuu

SEQ ID NO: 3770489 - RNA, 17 nt, Human
ugcuagaacucccuuuc

SEQ ID NO: 3770490 - RNA, 19 nt, Human
ugcuagaacucccuuucaa

SEQ ID NO: 3770491 - RNA, 21 nt, Human
ugcuagaacucccuuucaaca

SEQ ID NO: 3770492 - RNA, 12 nt, Human
ugcuagaacuuu

SEQ ID NO: 3770493 - RNA, 20 nt, Human
ugcuagaacuuuuuuaaaua

SEQ ID NO: 3770494 - RNA, 15 nt, Human
ugcuagaagaaaaca

SEQ ID NO: 3770495 - RNA, 13 nt, Human
ugcuagaauacuu

SEQ ID NO: 3770496 - RNA, 14 nt, Human
ugcuagagcuccuc

SEQ ID NO: 3770497 - RNA, 16 nt, Human
ugcuagcacaugcccu

SEQ ID NO: 3770498 - RNA, 20 nt, Human
ugcuagcacuuggagccaag

SEQ ID NO: 3770499 - RNA, 18 nt, Human
ugcuagcaguaaaagaug

SEQ ID NO: 3770500 - RNA, 22 nt, Human
ugcuagcaguaaaagaugaagu

SEQ ID NO: 3770501 - RNA, 20 nt, Human
ugcuagccggccacuuugga

SEQ ID NO: 3770502 - RNA, 18 nt, Human
ugcuagcucugagccagu

SEQ ID NO: 3770503 - RNA, 17 nt, Human
ugcuaggaacacuccuu

SEQ ID NO: 3770504 - RNA, 12 nt, Human
ugcuaggaagag

SEQ ID NO: 3770505 - RNA, 20 nt, Human
ugcuaggguuaggagguccu

SEQ ID NO: 3770506 - RNA, 14 nt, Human
ugcuaggucucgga

SEQ ID NO: 3770507 - RNA, 15 nt, Human
ugcuaggugggccag

SEQ ID NO: 3770508 - RNA, 16 nt, Human
ugcuagguuaauucca

SEQ ID NO: 3770509 - RNA, 13 nt, Human
ugcuaguauuuga

SEQ ID NO: 3770510 - RNA, 16 nt, Human
ugcuagucuuaagaac

SEQ ID NO: 3770511 - RNA, 13 nt, Human
ugcuagugagcug

SEQ ID NO: 3770512 - RNA, 15 nt, Human
ugcuaguguucuguc

SEQ ID NO: 3770513 - RNA, 13 nt, Human
ugcuauaaucugu

SEQ ID NO: 3770514 - RNA, 21 nt, Human
ugcuauaaucuguuuuuacgu

SEQ ID NO: 3770515 - RNA, 13 nt, Human
ugcuauacugcau

SEQ ID NO: 3770516 - RNA, 18 nt, Human
ugcuauagagccuaccug

SEQ ID NO: 3770517 - RNA, 20 nt, Human
ugcuauaguauuugauucaa

SEQ ID NO: 3770518 - RNA, 22 nt, Human
ugcuauaguauuugauucaaaa

SEQ ID NO: 3770519 - RNA, 23 nt, Human
ugcuauauuugugauauaggaau

SEQ ID NO: 3770520 - RNA, 16 nt, Human
ugcuauauuuucauga

SEQ ID NO: 3770521 - RNA, 22 nt, Human
ugcuauauuuucaugacuuuuc

SEQ ID NO: 3770522 - RNA, 19 nt, Human
ugcuaucaacaauaaaauu

SEQ ID NO: 3770523 - RNA, 14 nt, Human
ugcuaucacacagu

SEQ ID NO: 3770524 - RNA, 17 nt, Human
ugcuaucauuauucgua

SEQ ID NO: 3770525 - RNA, 19 nt, Human
ugcuauccagcuauuuuua

SEQ ID NO: 3770526 - RNA, 20 nt, Human
ugcuauccccaucucccugc

SEQ ID NO: 3770527 - RNA, 17 nt, Human
ugcuaucucccccagcc

SEQ ID NO: 3770528 - RNA, 15 nt, Human
ugcuaucucuauuau

SEQ ID NO: 3770529 - RNA, 23 nt, Human
ugcuaucuggaggccuuccagcu

SEQ ID NO: 3770530 - RNA, 17 nt, Human
ugcuaucuuaauuuugg

SEQ ID NO: 3770531 - RNA, 18 nt, Human
ugcuaucuuaauuuuggu

SEQ ID NO: 3770532 - RNA, 13 nt, Human
ugcuaugaaugau

SEQ ID NO: 3770533 - RNA, 15 nt, Human
ugcuauggugcucug

SEQ ID NO: 3770534 - RNA, 17 nt, Human
ugcuaugucauuucaug

SEQ ID NO: 3770535 - RNA, 19 nt, Human
ugcuaugucauuucauguc

SEQ ID NO: 3770536 - RNA, 18 nt, Human
ugcuauguuacuauuuuc

SEQ ID NO: 3770537 - RNA, 20 nt, Human
ugcuauguuuugacauuuuu

SEQ ID NO: 3770538 - RNA, 12 nt, Human
ugcuauucuguc

SEQ ID NO: 3770539 - RNA, 16 nt, Human
ugcuauugacaauaaa

SEQ ID NO: 3770540 - RNA, 17 nt, Human
ugcuauugacaauaaaa

SEQ ID NO: 3770541 - RNA, 22 nt, Human
ugcuauuguagagccagagguc

SEQ ID NO: 3770542 - RNA, 16 nt, Human
ugcuauugugaauagu

SEQ ID NO: 3770543 - RNA, 18 nt, Human
ugcuauuuauuuuccuaa

SEQ ID NO: 3770544 - RNA, 19 nt, Human
ugcuauuuauuuuccuaaa

SEQ ID NO: 3770545 - RNA, 12 nt, Human
ugcuauuucuau

SEQ ID NO: 3770546 - RNA, 22 nt, Human
ugcuauuucuauauuuucauuc

SEQ ID NO: 3770547 - RNA, 20 nt, Human
ugcuauuugaacaagugggc

SEQ ID NO: 3770548 - RNA, 13 nt, Human
ugcuauuugcaau

SEQ ID NO: 3770549 - RNA, 15 nt, Human
ugcuauuuuacuguc

SEQ ID NO: 3770550 - RNA, 18 nt, Human
ugcuauuuuacugucuua

SEQ ID NO: 3770551 - RNA, 20 nt, Human
ugcuauuuuacugucuuaau

SEQ ID NO: 3770552 - RNA, 12 nt, Human
ugcuauuuuugu

SEQ ID NO: 3770553 - RNA, 14 nt, Human
ugcucaaaauuuga

SEQ ID NO: 3770554 - RNA, 19 nt, Human
ugcucaaaucuauucagac

SEQ ID NO: 3770555 - RNA, 13 nt, Human
ugcucaacuugca

SEQ ID NO: 3770556 - RNA, 17 nt, Human
ugcucaacuugcaaaau

SEQ ID NO: 3770557 - RNA, 13 nt, Human
ugcucaaggccag

SEQ ID NO: 3770558 - RNA, 19 nt, Human
ugcucacacuccacauccc

SEQ ID NO: 3770559 - RNA, 13 nt, Human
ugcucacagcugu

SEQ ID NO: 3770560 - RNA, 15 nt, Human
ugcucacaguuauua

SEQ ID NO: 3770561 - RNA, 17 nt, Human
ugcucaccaugcuucca

SEQ ID NO: 3770562 - RNA, 12 nt, Human
ugcucaccuggg

SEQ ID NO: 3770563 - RNA, 13 nt, Human
ugcucaccugggg

SEQ ID NO: 3770564 - RNA, 14 nt, Human
ugcucaccuggggu

SEQ ID NO: 3770565 - RNA, 23 nt, Human
ugcucaccuggggugugggaggc

SEQ ID NO: 3770566 - RNA, 16 nt, Human
ugcucacguuaccuug

SEQ ID NO: 3770567 - RNA, 21 nt, Human
ugcucacguuaccuugacaca

SEQ ID NO: 3770568 - RNA, 20 nt, Human
ugcucacuaccuccucaggg

SEQ ID NO: 3770569 - RNA, 21 nt, Human
ugcucacuaccuccucaggga

SEQ ID NO: 3770570 - RNA, 20 nt, Human
ugcucagaacuugcugcugu

SEQ ID NO: 3770571 - RNA, 22 nt, Human
ugcucagcccugacuggugcua

SEQ ID NO: 3770572 - RNA, 16 nt, Human
ugcucagcccugagga

SEQ ID NO: 3770573 - RNA, 17 nt, Human
ugcucagcccugaggac

SEQ ID NO: 3770574 - RNA, 15 nt, Human
ugcucagcccuggag

SEQ ID NO: 3770575 - RNA, 16 nt, Human
ugcucagcccuggagg

SEQ ID NO: 3770576 - RNA, 23 nt, Human
ugcucagcccuggaggugccagc

SEQ ID NO: 3770577 - RNA, 20 nt, Human
ugcucagcucugggccauuc

SEQ ID NO: 3770578 - RNA, 12 nt, Human
ugcucagcuucu

SEQ ID NO: 3770579 - RNA, 14 nt, Human
ugcucaggacucag

SEQ ID NO: 3770580 - RNA, 23 nt, Human
ugcucaggacucagaagccucug

SEQ ID NO: 3770581 - RNA, 18 nt, Human
ugcucaggagcccuggga

SEQ ID NO: 3770582 - RNA, 20 nt, Human
ugcucaggagcccugggagg

SEQ ID NO: 3770583 - RNA, 20 nt, Human
ugcucaggcugcagcuggac

SEQ ID NO: 3770584 - RNA, 21 nt, Human
ugcucaggcugcagcuggaca

SEQ ID NO: 3770585 - RNA, 22 nt, Human
ugcucaggcugcagcuggacag

SEQ ID NO: 3770586 - RNA, 23 nt, Human
ugcucaggcugcagcuggacaga

SEQ ID NO: 3770587 - RNA, 21 nt, Human
ugcucagggaaaagcagcucu

SEQ ID NO: 3770588 - RNA, 14 nt, Human
ugcucaggggcccu

SEQ ID NO: 3770589 - RNA, 17 nt, Human
ugcucaggggcccugga

SEQ ID NO: 3770590 - RNA, 21 nt, Human
ugcucagggggcgccuguggu

SEQ ID NO: 3770591 - RNA, 16 nt, Human
ugcucagggucaauuu

SEQ ID NO: 3770592 - RNA, 16 nt, Human
ugcucagucucccuuu

SEQ ID NO: 3770593 - RNA, 15 nt, Human
ugcucaguguuucau

SEQ ID NO: 3770594 - RNA, 16 nt, Human
ugcucaguguuucaua

SEQ ID NO: 3770595 - RNA, 18 nt, Human
ugcucaguucagaaucac

SEQ ID NO: 3770596 - RNA, 23 nt, Human
ugcucaguucagaaucacuucug

SEQ ID NO: 3770597 - RNA, 20 nt, Human
ugcucaguugcuaaacacug

SEQ ID NO: 3770598 - RNA, 17 nt, Human
ugcucaguuguagaaug

SEQ ID NO: 3770599 - RNA, 21 nt, Human
ugcucaguuguagaauguauu

SEQ ID NO: 3770600 - RNA, 24 nt, Human
ugcucauauuucccaugauuucau

SEQ ID NO: 3770601 - RNA, 17 nt, Human
ugcucaucauucucugu

SEQ ID NO: 3770602 - RNA, 23 nt, Human
ugcucaucauucucugucucauc

SEQ ID NO: 3770603 - RNA, 16 nt, Human
ugcucaucugcugguc

SEQ ID NO: 3770604 - RNA, 15 nt, Human
ugcucauuaauuuug

SEQ ID NO: 3770605 - RNA, 23 nt, Human
ugcucuuguuuuuauuaauuuau

SEQ ID NO: 3770606 - RNA, 17 nt, Human
ugcucuuucucugccag

SEQ ID NO: 3770607 - RNA, 21 nt, Human
ugcucuuucuucuuccacaca

SEQ ID NO: 3770608 - RNA, 20 nt, Human
ugcucuuuggccugaugacc

SEQ ID NO: 3770609 - RNA, 22 nt, Human
ugcucuuuguuuugugucucuu

SEQ ID NO: 3770610 - RNA, 22 nt, Human
ugcucuuuuuuacucauugaaa

SEQ ID NO: 3770611 - RNA, 16 nt, Human
ugcugaaaaaugggca

SEQ ID NO: 3770612 - RNA, 21 nt, Human
ugcugaaaaccaucuggccug

SEQ ID NO: 3770613 - RNA, 18 nt, Human
ugcugaaaauguccuugu

SEQ ID NO: 3770614 - RNA, 22 nt, Human
ugcugaaaauugccuuucugug

SEQ ID NO: 3770615 - RNA, 18 nt, Human
ugcugaacaaaaaauaaa

SEQ ID NO: 3770616 - RNA, 21 nt, Human
ugcugaacaccuuguggaagc

SEQ ID NO: 3770617 - RNA, 14 nt, Human
ugcugaacauugga

SEQ ID NO: 3770618 - RNA, 18 nt, Human
ugcugaagcuuauuaaug

SEQ ID NO: 3770619 - RNA, 20 nt, Human
ugcugaagcuuauuaaugcu

SEQ ID NO: 3770620 - RNA, 23 nt, Human
ugcugaaggaauaaauugcuccu

SEQ ID NO: 3770621 - RNA, 12 nt, Human
ugcugaaggcuc

SEQ ID NO: 3770622 - RNA, 13 nt, Human
ugcugaagggcau

SEQ ID NO: 3770623 - RNA, 23 nt, Human
ugcugaauacagaggcaacugca

SEQ ID NO: 3770624 - RNA, 11 nt, Human
ugcugaauagg

SEQ ID NO: 3770625 - RNA, 18 nt, Human
ugcugaauauacagcagg

SEQ ID NO: 3770626 - RNA, 22 nt, Human
ugcugaaugguuuucaaaauaa

SEQ ID NO: 3770627 - RNA, 18 nt, Human
ugcugaauguugggacug

SEQ ID NO: 3770628 - RNA, 14 nt, Human
ugcugaauuuucac

SEQ ID NO: 3770629 - RNA, 22 nt, Human
ugcugaauuuucacaugaacau

SEQ ID NO: 3770630 - RNA, 16 nt, Human
ugcugacagacacagg

SEQ ID NO: 3770631 - RNA, 22 nt, Human
ugcugacagacacaggcccggc

SEQ ID NO: 3770632 - RNA, 15 nt, Human
ugcugacagcugcuc

SEQ ID NO: 3770633 - RNA, 16 nt, Human
ugcugaccaauugugc

SEQ ID NO: 3770634 - RNA, 21 nt, Human
ugcugaccaauugugcugcca

SEQ ID NO: 3770635 - RNA, 16 nt, Human
ugcugacccaugggca

SEQ ID NO: 3770636 - RNA, 16 nt, Human
ugcugaccuccacagc

SEQ ID NO: 3770637 - RNA, 14 nt, Human
ugcugaccugcuga

SEQ ID NO: 3770638 - RNA, 17 nt, Human
ugcugacggccagggag

SEQ ID NO: 3770639 - RNA, 22 nt, Human
ugcugacggccagggagaagcu

SEQ ID NO: 3770640 - RNA, 23 nt, Human
ugcugacuccacgauccugccac

SEQ ID NO: 3770641 - RNA, 19 nt, Human
ugcugacuguacuccuccc

SEQ ID NO: 3770642 - RNA, 24 nt, Human
ugcugacuguuuucucuugagagg

SEQ ID NO: 3770643 - RNA, 21 nt, Human
ugcugagagacccaaggagga

SEQ ID NO: 3770644 - RNA, 22 nt, Human
ugcugagagggcucgaggggug

SEQ ID NO: 3770645 - RNA, 12 nt, Human
ugcugagccucu

SEQ ID NO: 3770646 - RNA, 14 nt, Human
ugcugagccucugc

SEQ ID NO: 3770647 - RNA, 21 nt, Human
ugcugagcucugagaggcccu

SEQ ID NO: 3770648 - RNA, 22 nt, Human
ugcugagcucugagaggcccug

SEQ ID NO: 3770649 - RNA, 17 nt, Human
ugcugaggccugggccg

SEQ ID NO: 3770650 - RNA, 14 nt, Human
ugcugagggaccag

SEQ ID NO: 3770651 - RNA, 16 nt, Human
ugcugagggaccagcc

SEQ ID NO: 3770652 - RNA, 19 nt, Human
ugcugagggaccagccaag

SEQ ID NO: 3770653 - RNA, 20 nt, Human
ugcugagggaccagccaaga

SEQ ID NO: 3770654 - RNA, 11 nt, Human
ugcugaggguc

SEQ ID NO: 3770655 - RNA, 12 nt, Human
ugcugagggugu

SEQ ID NO: 3770656 - RNA, 23 nt, Human
ugcugaggguguuucuuccugca

SEQ ID NO: 3770657 - RNA, 21 nt, Human
ugcugagucaucuguuagggc

SEQ ID NO: 3770658 - RNA, 20 nt, Human
ugcugaguccgaccuggccu

SEQ ID NO: 3770659 - RNA, 17 nt, Human
ugcugagucucccaagg

SEQ ID NO: 3770660 - RNA, 15 nt, Human
ugcugagucugaagg

SEQ ID NO: 3770661 - RNA, 17 nt, Human
ugcugagucugaaggcu

SEQ ID NO: 3770662 - RNA, 19 nt, Human
ugcugagucuguucuggua

SEQ ID NO: 3770663 - RNA, 21 nt, Human
ugcugagucuguucugguaau

SEQ ID NO: 3770664 - RNA, 19 nt, Human
ugcugaucaucgccagagg

SEQ ID NO: 3770665 - RNA, 14 nt, Human
ugcugauccuugca

SEQ ID NO: 3770666 - RNA, 17 nt, Human
ugcugaucgccuucccc

SEQ ID NO: 3770667 - RNA, 17 nt, Human
ugcugauggagccuucc

SEQ ID NO: 3770668 - RNA, 13 nt, Human
ugcugauggugca

SEQ ID NO: 3770669 - RNA, 17 nt, Human
ugcugauguccucacca

SEQ ID NO: 3770670 - RNA, 21 nt, Human
ugcugauguggcaacugcuga

SEQ ID NO: 3770671 - RNA, 13 nt, Human
ugcugauguucag

SEQ ID NO: 3770672 - RNA, 15 nt, Human
ugcugauguucagug

SEQ ID NO: 3770673 - RNA, 18 nt, Human
ugcugauguucaguguaa

SEQ ID NO: 3770674 - RNA, 15 nt, Human
ugcugauuuaaacac

SEQ ID NO: 3770675 - RNA, 17 nt, Human
ugcugauuuaaacacau

SEQ ID NO: 3770676 - RNA, 13 nt, Human
ugcugauuuuauu

SEQ ID NO: 3770677 - RNA, 19 nt, Human
ugcugauuuuauucuugau

SEQ ID NO: 3770678 - RNA, 13 nt, Human
ugcugcaaaccug

SEQ ID NO: 3770679 - RNA, 20 nt, Human
ugcugcaaaccugaccccug

SEQ ID NO: 3770680 - RNA, 19 nt, Human
ugcugcaagcacagcccuu

SEQ ID NO: 3770681 - RNA, 21 nt, Human
ugcugcaaggacauucuugua

SEQ ID NO: 3770682 - RNA, 13 nt, Human
ugcugcaaggccu

SEQ ID NO: 3770683 - RNA, 21 nt, Human
ugcugcagaggggcaggcccu

SEQ ID NO: 3770684 - RNA, 22 nt, Human
ugcugcagaggggcaggcccug

SEQ ID NO: 3770685 - RNA, 13 nt, Human
ugcugcagauacu

SEQ ID NO: 3770686 - RNA, 16 nt, Human
ugcugcagcucccugg

SEQ ID NO: 3770687 - RNA, 13 nt, Human
ugcugcaggggcu

SEQ ID NO: 3770688 - RNA, 19 nt, Human
ugcugcaggggcucuggag

SEQ ID NO: 3770689 - RNA, 18 nt, Human
ugcugcaguugccaguca

SEQ ID NO: 3770690 - RNA, 21 nt, Human
ugcugcaguugccagucaccc

SEQ ID NO: 3770691 - RNA, 22 nt, Human
ugcugcauggcagggggcugcu

SEQ ID NO: 3770692 - RNA, 18 nt, Human
ugcugcauuuaaaagaua

SEQ ID NO: 3770693 - RNA, 19 nt, Human
ugcugcauuuaaaagauac

SEQ ID NO: 3770694 - RNA, 19 nt, Human
ugcugccaguaccagcccc

SEQ ID NO: 3770695 - RNA, 12 nt, Human
ugcugccaucca

SEQ ID NO: 3770696 - RNA, 21 nt, Human
ugcugccauccagguucagcu

SEQ ID NO: 3770697 - RNA, 14 nt, Human
ugcugcccccaccc

SEQ ID NO: 3770698 - RNA, 20 nt, Human
ugcugcccccaccccgggga

SEQ ID NO: 3770699 - RNA, 20 nt, Human
ugcugccccugcacagcagg

SEQ ID NO: 3770700 - RNA, 15 nt, Human
ugcugccccugccuu

SEQ ID NO: 3770701 - RNA, 13 nt, Human
ugcugcccuccau

SEQ ID NO: 3770702 - RNA, 16 nt, Human
ugcugcccugcccacc

SEQ ID NO: 3770703 - RNA, 19 nt, Human
ugcugcccugcccaccugg

SEQ ID NO: 3770704 - RNA, 14 nt, Human
ugcugcccugugag

SEQ ID NO: 3770705 - RNA, 20 nt, Human
ugcugccgccucccagccug

SEQ ID NO: 3770706 - RNA, 13 nt, Human
ugcugccucagga

SEQ ID NO: 3770707 - RNA, 22 nt, Human
ugcugccuccccaacccugccc

SEQ ID NO: 3770708 - RNA, 21 nt, Human
ugcugccugcccgcacagcag

SEQ ID NO: 3770709 - RNA, 23 nt, Human
ugcugccugcccgcacagcagcc

SEQ ID NO: 3770710 - RNA, 14 nt, Human
ugcugccugccugu

SEQ ID NO: 3770711 - RNA, 18 nt, Human
ugcugccuggccacugcu

SEQ ID NO: 3770712 - RNA, 15 nt, Human
ugcugccugucccca

SEQ ID NO: 3770713 - RNA, 18 nt, Human
ugcugccuuauucaggga

SEQ ID NO: 3770714 - RNA, 23 nt, Human
ugcugccuucugacggcccugca

SEQ ID NO: 3770715 - RNA, 20 nt, Human
ugcugccuucuggauucuug

SEQ ID NO: 3770716 - RNA, 17 nt, Human
ugcugcgcccugggcuc

SEQ ID NO: 3770717 - RNA, 20 nt, Human
ugcugcgcccuuaccuuccc

SEQ ID NO: 3770718 - RNA, 16 nt, Human
ugcugcggagcaagag

SEQ ID NO: 3770719 - RNA, 19 nt, Human
ugcugcuaauauuuuccuc

SEQ ID NO: 3770720 - RNA, 22 nt, Human
ugcugcuaaucuucagggcacu

SEQ ID NO: 3770721 - RNA, 14 nt, Human
ugcugcuaauucuu

SEQ ID NO: 3770722 - RNA, 20 nt, Human
ugcugcuacccucccugcug

SEQ ID NO: 3770723 - RNA, 15 nt, Human
ugcugcuacuuauau

SEQ ID NO: 3770724 - RNA, 12 nt, Human
ugcugcuagaac

SEQ ID NO: 3770725 - RNA, 16 nt, Human
ugcugcuauuuuacug

SEQ ID NO: 3770726 - RNA, 18 nt, Human
ugcugcuauuuuacuguc

SEQ ID NO: 3770727 - RNA, 16 nt, Human
ugcugcucccucagac

SEQ ID NO: 3770728 - RNA, 17 nt, Human
ugcugcuccuuagcugc

SEQ ID NO: 3770729 - RNA, 23 nt, Human
ugcugcucuuggcuggacccagc

SEQ ID NO: 3770730 - RNA, 15 nt, Human
ugcugcugagaaccu

SEQ ID NO: 3770731 - RNA, 16 nt, Human
ugcugcugagaaccug

SEQ ID NO: 3770732 - RNA, 17 nt, Human
ugcugcugagaaccugg

SEQ ID NO: 3770733 - RNA, 20 nt, Human
ugcugcugagaaccuggccu

SEQ ID NO: 3770734 - RNA, 21 nt, Human
ugcugcugagaaccuggccuu

SEQ ID NO: 3770735 - RNA, 17 nt, Human
ugcugcugcugcgcccu

SEQ ID NO: 3770736 - RNA, 13 nt, Human
ugcugcuggccaa

SEQ ID NO: 3770737 - RNA, 12 nt, Human
ugcugcuggugc

SEQ ID NO: 3770738 - RNA, 14 nt, Human
ugcugcuguguuuu

SEQ ID NO: 3770739 - RNA, 17 nt, Human
ugcugcuucccucugcc

SEQ ID NO: 3770740 - RNA, 20 nt, Human
ugcugcuucccucugccugu

SEQ ID NO: 3770741 - RNA, 21 nt, Human
ugcugcuucccucugccuguc

SEQ ID NO: 3770742 - RNA, 20 nt, Human
ugcugcuuccgguagggagg

SEQ ID NO: 3770743 - RNA, 21 nt, Human
ugcugcuuuccccugugggga

SEQ ID NO: 3770744 - RNA, 23 nt, Human
ugcugcuuuccccuguggggauc

SEQ ID NO: 3770745 - RNA, 14 nt, Human
ugcugcuuugauau

SEQ ID NO: 3770746 - RNA, 20 nt, Human
ugcugcuuuuccuuggggca

SEQ ID NO: 3770747 - RNA, 22 nt, Human
ugcugcuuuuugagguggcacu

SEQ ID NO: 3770748 - RNA, 17 nt, Human
ugcuuaaaauaagcagg

SEQ ID NO: 3770749 - RNA, 14 nt, Human
ugcuuaaaccacuu

SEQ ID NO: 3770750 - RNA, 19 nt, Human
ugcuuaaagaauucaaauu

SEQ ID NO: 3770751 - RNA, 22 nt, Human
ugcuuaaaguugguauuaauaa

SEQ ID NO: 3770752 - RNA, 14 nt, Human
ugcuuaaaugugaa

SEQ ID NO: 3770753 - RNA, 16 nt, Human
ugcuuaaaugugaauu

SEQ ID NO: 3770754 - RNA, 23 nt, Human
ugcuuaaaugugaauuacuaacu

SEQ ID NO: 3770755 - RNA, 13 nt, Human
ugcuuaaauuucu

SEQ ID NO: 3770756 - RNA, 14 nt, Human
ugcuuaacauaccc

SEQ ID NO: 3770757 - RNA, 13 nt, Human
ugcuuaacuucac

SEQ ID NO: 3770758 - RNA, 14 nt, Human
ugcuuaacuucaca

SEQ ID NO: 3770759 - RNA, 14 nt, Human
ugcuuaaguuccag

SEQ ID NO: 3770760 - RNA, 16 nt, Human
ugcuuaaucuucaaag

SEQ ID NO: 3770761 - RNA, 16 nt, Human
ugcuuaauucaaauaa

SEQ ID NO: 3770762 - RNA, 20 nt, Human
ugcuuaauuucuaaagauaa

SEQ ID NO: 3770763 - RNA, 20 nt, Human
ugcuuacaauucccugcugu

SEQ ID NO: 3770764 - RNA, 22 nt, Human
ugcuuacaauucccugcugucg

SEQ ID NO: 3770765 - RNA, 14 nt, Human
ugcuuacaauuuuu

SEQ ID NO: 3770766 - RNA, 23 nt, Human
ugcuuacaauuuuuuuaauuuug

SEQ ID NO: 3770767 - RNA, 15 nt, Human
ugcuuacauuuuuac

SEQ ID NO: 3770768 - RNA, 18 nt, Human
ugcuuacauuuuuacaau

SEQ ID NO: 3770769 - RNA, 17 nt, Human
ugcuuaccuacuuucuu

SEQ ID NO: 3770770 - RNA, 14 nt, Human
ugcuuaccucucag

SEQ ID NO: 3770771 - RNA, 22 nt, Human
ugcuuaccucucagccuuagcu

SEQ ID NO: 3770772 - RNA, 16 nt, Human
ugcuuaccuugacugu

SEQ ID NO: 3770773 - RNA, 23 nt, Human
ugcuuacuaagcuuugccagcug

SEQ ID NO: 3770774 - RNA, 16 nt, Human
ugcuuacucauuaaaa

SEQ ID NO: 3770775 - RNA, 18 nt, Human
ugcuuacuuuggaauaca

SEQ ID NO: 3770776 - RNA, 14 nt, Human
ugcuuagaaaagaa

SEQ ID NO: 3770777 - RNA, 19 nt, Human
ugcuuagaauccaaacuug

SEQ ID NO: 3770778 - RNA, 17 nt, Human
ugcuuagagacuaucaa

SEQ ID NO: 3770779 - RNA, 14 nt, Human
ugcuuagccuccug

SEQ ID NO: 3770780 - RNA, 14 nt, Human
ugcuuaggaugugu

SEQ ID NO: 3770781 - RNA, 16 nt, Human
ugcuuaggaugugugc

SEQ ID NO: 3770782 - RNA, 14 nt, Human
ugcuuaggauguuu

SEQ ID NO: 3770783 - RNA, 14 nt, Human
ugcuuaguaaugcu

SEQ ID NO: 3770784 - RNA, 21 nt, Human
ugcuuaguaucucaucaacaa

SEQ ID NO: 3770785 - RNA, 23 nt, Human
ugcuuagucacuuauuucauaaa

SEQ ID NO: 3770786 - RNA, 20 nt, Human
ugcuuaguccaauuccuugc

SEQ ID NO: 3770787 - RNA, 19 nt, Human
ugcuuauaaccuaguuaaa

SEQ ID NO: 3770788 - RNA, 18 nt, Human
ugcuuauagguggccucu

SEQ ID NO: 3770789 - RNA, 20 nt, Human
ugcuuaugaauauuuauaac

SEQ ID NO: 3770790 - RNA, 21 nt, Human
ugcuuaugacaucacuuguac

SEQ ID NO: 3770791 - RNA, 14 nt, Human
ugcuuaugguacca

SEQ ID NO: 3770792 - RNA, 21 nt, Human
ugcuuaugguaccagaugcag

SEQ ID NO: 3770793 - RNA, 19 nt, Human
ugcuuauuuauuguauucu

SEQ ID NO: 3770794 - RNA, 15 nt, Human
ugcuuauuuuaaaau

SEQ ID NO: 3770795 - RNA, 14 nt, Human
ugcuucaacugucu

SEQ ID NO: 3770796 - RNA, 16 nt, Human
ugcuucaauaaaucuu

SEQ ID NO: 3770797 - RNA, 22 nt, Human
ugcuucaauaaaucuuuggaaa

SEQ ID NO: 3770798 - RNA, 15 nt, Human
ugcuucaaucccagc

SEQ ID NO: 3770799 - RNA, 15 nt, Human
ugcuucaauuaauaa

SEQ ID NO: 3770800 - RNA, 17 nt, Human
ugcuucacaacccaucu

SEQ ID NO: 3770801 - RNA, 13 nt, Human
ugcuucacaguag

SEQ ID NO: 3770802 - RNA, 22 nt, Human
ugcuucacaguagagccagcuu

SEQ ID NO: 3770803 - RNA, 21 nt, Human
ugcuucaccauggccuuauga

SEQ ID NO: 3770804 - RNA, 20 nt, Human
ugcuucagauauuauugcuu

SEQ ID NO: 3770805 - RNA, 20 nt, Human
ugcuucagauguggagccag

SEQ ID NO: 3770806 - RNA, 17 nt, Human
ugcuucagccugaggcu

SEQ ID NO: 3770807 - RNA, 22 nt, Human
ugcuucagccugaggcugagac

SEQ ID NO: 3770808 - RNA, 14 nt, Human
ugcuucagcuugcu

SEQ ID NO: 3770809 - RNA, 15 nt, Human
ugcuucagcuugcuu

SEQ ID NO: 3770810 - RNA, 18 nt, Human
ugcuucaguggagaauua

SEQ ID NO: 3770811 - RNA, 18 nt, Human
ugcuucauaaaugaagca

SEQ ID NO: 3770812 - RNA, 11 nt, Human
ugcuucauaca

SEQ ID NO: 3770813 - RNA, 21 nt, Human
ugcuucauagcugguuccugc

SEQ ID NO: 3770814 - RNA, 17 nt, Human
ugcuucaucauucccuc

SEQ ID NO: 3770815 - RNA, 23 nt, Human
ugcuucaucauucccucucaucu

SEQ ID NO: 3770816 - RNA, 14 nt, Human
ugcuucaucccuuu

SEQ ID NO: 3770817 - RNA, 21 nt, Human
ugcuucaugaaaauccuacca

SEQ ID NO: 3770818 - RNA, 18 nt, Human
ugcuucauguuugccuuc

SEQ ID NO: 3770819 - RNA, 20 nt, Human
ugcuuccaccucaccccacu

SEQ ID NO: 3770820 - RNA, 12 nt, Human
ugcuuccagaaa

SEQ ID NO: 3770821 - RNA, 22 nt, Human
ugcuuccagugaggcucugccc

SEQ ID NO: 3770822 - RNA, 17 nt, Human
ugcuucccaccucccug

SEQ ID NO: 3770823 - RNA, 20 nt, Human
ugcuucccaccucccugccc

SEQ ID NO: 3770824 - RNA, 23 nt, Human
ugcuucccauuguggcuccuauc

SEQ ID NO: 3770825 - RNA, 18 nt, Human
ugcuuccccuuuugccaa

SEQ ID NO: 3770826 - RNA, 13 nt, Human
ugcuucccucugc

SEQ ID NO: 3770827 - RNA, 15 nt, Human
ugcuucccucugccu

SEQ ID NO: 3770828 - RNA, 21 nt, Human
ugcuuccgguagggaggcagc

SEQ ID NO: 3770829 - RNA, 19 nt, Human
ugcuuccuauaauuuugau

SEQ ID NO: 3770830 - RNA, 15 nt, Human
ugcuuccucccaaca

SEQ ID NO: 3770831 - RNA, 13 nt, Human
ugcuuccuuucuu

SEQ ID NO: 3770832 - RNA, 18 nt, Human
ugcuucgggcccuuccca

SEQ ID NO: 3770833 - RNA, 22 nt, Human
ugcuucuaaguaaauacaauuu

SEQ ID NO: 3770834 - RNA, 21 nt, Human
ugcuucuaccaacuggaagca

SEQ ID NO: 3770835 - RNA, 14 nt, Human
ugcuucuagagcuu

SEQ ID NO: 3770836 - RNA, 15 nt, Human
ugcuucucacuuuuu

SEQ ID NO: 3770837 - RNA, 21 nt, Human
ugcuucucagauuucugagga

SEQ ID NO: 3770838 - RNA, 14 nt, Human
ugcuucucaucccc

SEQ ID NO: 3770839 - RNA, 17 nt, Human
ugcuucucaucuuguga

SEQ ID NO: 3770840 - RNA, 18 nt, Human
ugcuucucaucuugugaa

SEQ ID NO: 3770841 - RNA, 22 nt, Human
ugcuucuccaaaaaucugccug

SEQ ID NO: 3770842 - RNA, 13 nt, Human
ugcuucuccagcc

SEQ ID NO: 3770843 - RNA, 16 nt, Human
ugcuucucccaggcaa

SEQ ID NO: 3770844 - RNA, 22 nt, Human
ugcuucucccaggcaaggcugu

SEQ ID NO: 3770845 - RNA, 22 nt, Human
ugcuucucugacuucugccugg

SEQ ID NO: 3770846 - RNA, 18 nt, Human
ugcuucugaaugugcuga

SEQ ID NO: 3770847 - RNA, 17 nt, Human
ugcuucuguaguacucc

SEQ ID NO: 3770848 - RNA, 22 nt, Human
ugcuucuguuuuauaauuuugu

SEQ ID NO: 3770849 - RNA, 19 nt, Human
ugcuucuuaaccccaguaa

SEQ ID NO: 3770850 - RNA, 17 nt, Human
ugcuucuuacugauaau

SEQ ID NO: 3770851 - RNA, 16 nt, Human
ugcuucuucagagacu

SEQ ID NO: 3770852 - RNA, 14 nt, Human
ugcuucuucucagg

SEQ ID NO: 3770853 - RNA, 23 nt, Human
ugcuucuucuccuauguguaagg

SEQ ID NO: 3770854 - RNA, 14 nt, Human
ugcuucuugugaag

SEQ ID NO: 3770855 - RNA, 16 nt, Human
ugcuugaaaaaugugc

SEQ ID NO: 3770856 - RNA, 14 nt, Human
ugcuugaaagaaaa

SEQ ID NO: 3770857 - RNA, 17 nt, Human
ugcuugaacacaguauu

SEQ ID NO: 3770858 - RNA, 20 nt, Human
ugcuugaacacaguauuuuc

SEQ ID NO: 3770859 - RNA, 14 nt, Human
ugcuugaacuuaca

SEQ ID NO: 3770860 - RNA, 12 nt, Human
ugcuugaauaaa

SEQ ID NO: 3770861 - RNA, 19 nt, Human
ugcuugagaauauugaagu

SEQ ID NO: 3770862 - RNA, 15 nt, Human
ugcuugagcucagga

SEQ ID NO: 3770863 - RNA, 12 nt, Human
ugcuugaggaaa

SEQ ID NO: 3770864 - RNA, 21 nt, Human
ugcuugaggcaacucaucuua

SEQ ID NO: 3770865 - RNA, 14 nt, Human
ugcuugaugaagca

SEQ ID NO: 3770866 - RNA, 19 nt, Human
ugcuugaugggauucugga

SEQ ID NO: 3770867 - RNA, 16 nt, Human
ugcuugcauaagagcu

SEQ ID NO: 3770868 - RNA, 17 nt, Human
ugcuugcauaagagcuu

SEQ ID NO: 3770869 - RNA, 15 nt, Human
ugcuugccaaaguac

SEQ ID NO: 3770870 - RNA, 18 nt, Human
ugcuugccaaaguacaga

SEQ ID NO: 3770871 - RNA, 23 nt, Human
ugcuugccaaggcagaggccugg

SEQ ID NO: 3770872 - RNA, 18 nt, Human
ugcuugcccuaagcagaa

SEQ ID NO: 3770873 - RNA, 18 nt, Human
ugcuugccgaaacuggaa

SEQ ID NO: 3770874 - RNA, 19 nt, Human
ugcuugccuagggccuggu

SEQ ID NO: 3770875 - RNA, 11 nt, Human
ugcuugccucu

SEQ ID NO: 3770876 - RNA, 18 nt, Human
ugcuugccugcagggcca

SEQ ID NO: 3770877 - RNA, 18 nt, Human
ugcuugcucauaugcaug

SEQ ID NO: 3770878 - RNA, 18 nt, Human
ugcuugcugcugauuuaa

SEQ ID NO: 3770879 - RNA, 19 nt, Human
ugcuugcuuucuuuuuuaa

SEQ ID NO: 3770880 - RNA, 15 nt, Human
ugcuuggagcugagc

SEQ ID NO: 3770881 - RNA, 17 nt, Human
ugcuuggagcugagcaa

SEQ ID NO: 3770882 - RNA, 14 nt, Human
ugcuuggaggaagg

SEQ ID NO: 3770883 - RNA, 18 nt, Human
ugcuuggcccaggaguuu

SEQ ID NO: 3770884 - RNA, 23 nt, Human
ugcuuggcccaggaguuuggcca

SEQ ID NO: 3770885 - RNA, 19 nt, Human
ugcuugggcuucauccucc

SEQ ID NO: 3770886 - RNA, 19 nt, Human
ugcuuggguggagaagcca

SEQ ID NO: 3770887 - RNA, 20 nt, Human
ugcuuggguggagaagccau

SEQ ID NO: 3770888 - RNA, 22 nt, Human
ugcuuguacacucauucauuac

SEQ ID NO: 3770889 - RNA, 13 nt, Human
ugcuuguacauaa

SEQ ID NO: 3770890 - RNA, 22 nt, Human
ugcuuguacauaaugcgugcau

SEQ ID NO: 3770891 - RNA, 12 nt, Human
ugcuuguaccuc

SEQ ID NO: 3770892 - RNA, 23 nt, Human
uggcgagccauuugucccaagug

SEQ ID NO: 3770893 - RNA, 19 nt, Human
uggcgagugaaugccagug

SEQ ID NO: 3770894 - RNA, 13 nt, Human
uggcgaugccagc

SEQ ID NO: 3770895 - RNA, 18 nt, Human
uggcgauucccauugaaa

SEQ ID NO: 3770896 - RNA, 14 nt, Human
uggcgcaagccugu

SEQ ID NO: 3770897 - RNA, 13 nt, Human
uggcgcacccucc

SEQ ID NO: 3770898 - RNA, 18 nt, Human
uggcgcacccuccccucc

SEQ ID NO: 3770899 - RNA, 13 nt, Human
uggcgcagccaag

SEQ ID NO: 3770900 - RNA, 15 nt, Human
uggcgcaggaacuca

SEQ ID NO: 3770901 - RNA, 13 nt, Human
uggcgcagugccu

SEQ ID NO: 3770902 - RNA, 15 nt, Human
uggcgcagugccucu

SEQ ID NO: 3770903 - RNA, 17 nt, Human
uggcgccaccagcucug

SEQ ID NO: 3770904 - RNA, 21 nt, Human
uggcgcgaucucggcucacug

SEQ ID NO: 3770905 - RNA, 17 nt, Human
uggcgcuauuacaaaua

SEQ ID NO: 3770906 - RNA, 13 nt, Human
uggcgcugccccu

SEQ ID NO: 3770907 - RNA, 13 nt, Human
uggcgcuuagaga

SEQ ID NO: 3770908 - RNA, 20 nt, Human
uggcggcuggggucccagca

SEQ ID NO: 3770909 - RNA, 21 nt, Human
uggcggcuggggucccagcag

SEQ ID NO: 3770910 - RNA, 17 nt, Human
uggcgggccaaggacug

SEQ ID NO: 3770911 - RNA, 19 nt, Human
uggcggggaggaggaaauc

SEQ ID NO: 3770912 - RNA, 19 nt, Human
uggcguaaguacagagaag

SEQ ID NO: 3770913 - RNA, 20 nt, Human
uggcguaggcuacagagaag

SEQ ID NO: 3770914 - RNA, 22 nt, Human
uggcguaggcuacagagaagcc

SEQ ID NO: 3770915 - RNA, 23 nt, Human
uggcguaggcuacagagaagccu

SEQ ID NO: 3770916 - RNA, 14 nt, Human
uggcguggagcagg

SEQ ID NO: 3770917 - RNA, 17 nt, Human
uggcgugggagccagcc

SEQ ID NO: 3770918 - RNA, 18 nt, Human
uggcgugggagccagccu

SEQ ID NO: 3770919 - RNA, 14 nt, Human
uggcuaaagcucga

SEQ ID NO: 3770920 - RNA, 14 nt, Human
uggcuaaagguccc

SEQ ID NO: 3770921 - RNA, 17 nt, Human
uggcuaaggcaccagcc

SEQ ID NO: 3770922 - RNA, 16 nt, Human
uggcuaauaaggcuuu

SEQ ID NO: 3770923 - RNA, 19 nt, Human
uggcuaauguacugcauau

SEQ ID NO: 3770924 - RNA, 23 nt, Human
uggcuacgccucuucugucccug

SEQ ID NO: 3770925 - RNA, 19 nt, Human
uggcuagaggccagcccca

SEQ ID NO: 3770926 - RNA, 22 nt, Human
uggcuagaggccagccccaccc

SEQ ID NO: 3770927 - RNA, 15 nt, Human
uggcuagaguccuca

SEQ ID NO: 3770928 - RNA, 21 nt, Human
uggcuagaguccucacuccca

SEQ ID NO: 3770929 - RNA, 15 nt, Human
uggcuagucaagcuc

SEQ ID NO: 3770930 - RNA, 23 nt, Human
uggcuagucaagcuccuccuccc

SEQ ID NO: 3770931 - RNA, 15 nt, Human
uggcuaguccuuguu

SEQ ID NO: 3770932 - RNA, 19 nt, Human
uggcuauaaauauauaaaa

SEQ ID NO: 3770933 - RNA, 22 nt, Human
uggcuauagaugucuuuuccca

SEQ ID NO: 3770934 - RNA, 22 nt, Human
uggcuaucaaagaauaagaaaa

SEQ ID NO: 3770935 - RNA, 16 nt, Human
uggcuaugagggccuu

SEQ ID NO: 3770936 - RNA, 14 nt, Human
uggcuauggccacc

SEQ ID NO: 3770937 - RNA, 18 nt, Human
uggcuauguuuuuaaugu

SEQ ID NO: 3770938 - RNA, 15 nt, Human
uggcuauuuaaaacu

SEQ ID NO: 3770939 - RNA, 16 nt, Human
uggcuauuuaaagaca

SEQ ID NO: 3770940 - RNA, 13 nt, Human
uggcucacacuga

SEQ ID NO: 3770941 - RNA, 14 nt, Human
uggcucacaguaca

SEQ ID NO: 3770942 - RNA, 15 nt, Human
uggcucacccaagca

SEQ ID NO: 3770943 - RNA, 14 nt, Human
uggcucaccuuccg

SEQ ID NO: 3770944 - RNA, 14 nt, Human
uggcucacgccugu

SEQ ID NO: 3770945 - RNA, 17 nt, Human
uggcucacgccuguaau

SEQ ID NO: 3770946 - RNA, 22 nt, Human
uggcucacgucuguaaucccag

SEQ ID NO: 3770947 - RNA, 18 nt, Human
uggcucacuauggugcca

SEQ ID NO: 3770948 - RNA, 18 nt, Human
uggcucacucagcacuug

SEQ ID NO: 3770949 - RNA, 18 nt, Human
uggcucagacauguuuuc

SEQ ID NO: 3770950 - RNA, 16 nt, Human
uggcucagccagcacu

SEQ ID NO: 3770951 - RNA, 20 nt, Human
uggcucagguggggucacuc

SEQ ID NO: 3770952 - RNA, 18 nt, Human
uggcuccaaacccucgag

SEQ ID NO: 3770953 - RNA, 18 nt, Human
uggcuccacacacacaaa

SEQ ID NO: 3770954 - RNA, 15 nt, Human
uggcuccagaaaugu

SEQ ID NO: 3770955 - RNA, 13 nt, Human
uggcuccagccug

SEQ ID NO: 3770956 - RNA, 19 nt, Human
uggcuccagucugcugccc

SEQ ID NO: 3770957 - RNA, 16 nt, Human
uggcucccacaggagu

SEQ ID NO: 3770958 - RNA, 17 nt, Human
uggcucccacaggcccu

SEQ ID NO: 3770959 - RNA, 20 nt, Human
uggcucccacaggcccuucc

SEQ ID NO: 3770960 - RNA, 13 nt, Human
uggcucccaggac

SEQ ID NO: 3770961 - RNA, 15 nt, Human
uggcucccaggacac

SEQ ID NO: 3770962 - RNA, 15 nt, Human
uggcucccagggcca

SEQ ID NO: 3770963 - RNA, 16 nt, Human
uggcuccccuggggug

SEQ ID NO: 3770964 - RNA, 21 nt, Human
uggcuccccuggggugcaggc

SEQ ID NO: 3770965 - RNA, 19 nt, Human
uggcucccgcggugccaug

SEQ ID NO: 3770966 - RNA, 18 nt, Human
uggcucccucacucucag

SEQ ID NO: 3770967 - RNA, 20 nt, Human
uggcucccucacucucagga

SEQ ID NO: 3770968 - RNA, 19 nt, Human
uggcuccgaacacccucga

SEQ ID NO: 3770969 - RNA, 14 nt, Human
uggcuccggccucu

SEQ ID NO: 3770970 - RNA, 18 nt, Human
uggcuccggccucugccu

SEQ ID NO: 3770971 - RNA, 18 nt, Human
uggcuccuaucuguguuu

SEQ ID NO: 3770972 - RNA, 14 nt, Human
uggcuccucaaaca

SEQ ID NO: 3770973 - RNA, 13 nt, Human
uggcuccucucag

SEQ ID NO: 3770974 - RNA, 14 nt, Human
uggcuccucucagu

SEQ ID NO: 3770975 - RNA, 15 nt, Human
uggcuccucuguggu

SEQ ID NO: 3770976 - RNA, 21 nt, Human
uggcuccucuguggugucugc

SEQ ID NO: 3770977 - RNA, 21 nt, Human
uggcuccugaggggcaucugc

SEQ ID NO: 3770978 - RNA, 23 nt, Human
uggcuccugaggggcaucugccc

SEQ ID NO: 3770979 - RNA, 18 nt, Human
uggcuccuugugccagag

SEQ ID NO: 3770980 - RNA, 20 nt, Human
uggcuccuugugccagagaa

SEQ ID NO: 3770981 - RNA, 18 nt, Human
uggcuccuuuacaaaaga

SEQ ID NO: 3770982 - RNA, 19 nt, Human
uggcucguuggcuagauua

SEQ ID NO: 3770983 - RNA, 14 nt, Human
uggcucuccaagug

SEQ ID NO: 3770984 - RNA, 19 nt, Human
uggcucuccaagugccaga

SEQ ID NO: 3770985 - RNA, 17 nt, Human
uggcucucccauuuccu

SEQ ID NO: 3770986 - RNA, 14 nt, Human
uggcucuccuggcc

SEQ ID NO: 3770987 - RNA, 14 nt, Human
uggcucucuccagg

SEQ ID NO: 3770988 - RNA, 15 nt, Human
uggcucucuccagga

SEQ ID NO: 3770989 - RNA, 13 nt, Human
uggcucugagaag

SEQ ID NO: 3770990 - RNA, 15 nt, Human
uggcucugagaaggg

SEQ ID NO: 3770991 - RNA, 19 nt, Human
uggcucugagcgccuccau

SEQ ID NO: 3770992 - RNA, 21 nt, Human
uggcucugaggugccuguccc

SEQ ID NO: 3770993 - RNA, 22 nt, Human
uggcucugaggugccuguccca

SEQ ID NO: 3770994 - RNA, 23 nt, Human
uggcucugcaaugggcacuggga

SEQ ID NO: 3770995 - RNA, 13 nt, Human
uggcucugccagu

SEQ ID NO: 3770996 - RNA, 11 nt, Human
uggcucugcug

SEQ ID NO: 3770997 - RNA, 21 nt, Human
uggcucuggagacagccccag

SEQ ID NO: 3770998 - RNA, 18 nt, Human
uggcucuguggcuugcua

SEQ ID NO: 3770999 - RNA, 19 nt, Human
uggcucuuccaggcuggga

SEQ ID NO: 3771000 - RNA, 20 nt, Human
uggcucuuccaggcugggag

SEQ ID NO: 3771001 - RNA, 16 nt, Human
uggcucuugaacugag

SEQ ID NO: 3771002 - RNA, 22 nt, Human
uggcucuugaacugagcuugga

SEQ ID NO: 3771003 - RNA, 19 nt, Human
uggcucuugauaccccccu

SEQ ID NO: 3771004 - RNA, 20 nt, Human
uggcucuugauaccccccuc

SEQ ID NO: 3771005 - RNA, 19 nt, Human
uggcugaaauucuccugga

SEQ ID NO: 3771006 - RNA, 15 nt, Human
uggcugaacccugug

SEQ ID NO: 3771007 - RNA, 18 nt, Human
uggcugaacccugugcug

SEQ ID NO: 3771008 - RNA, 11 nt, Human
uggcugaagga

SEQ ID NO: 3771009 - RNA, 20 nt, Human
uggcugagagaguggcauug

SEQ ID NO: 3771010 - RNA, 13 nt, Human
uggcugagcccug

SEQ ID NO: 3771011 - RNA, 17 nt, Human
uggcugaggaggccucc

SEQ ID NO: 3771012 - RNA, 23 nt, Human
uggcugaggaggccuccaucuca

SEQ ID NO: 3771013 - RNA, 20 nt, Human
uggcugaggauuucaagccu

SEQ ID NO: 3771014 - RNA, 21 nt, Human
uggcugagguuccucugccug

SEQ ID NO: 3771015 - RNA, 14 nt, Human
uggcugauaauuuu

SEQ ID NO: 3771016 - RNA, 19 nt, Human
uggcugauaauuuuaaauu

SEQ ID NO: 3771017 - RNA, 23 nt, Human
uggcugcaaaggguaucaggugc

SEQ ID NO: 3771018 - RNA, 15 nt, Human
uggcugcagagcagu

SEQ ID NO: 3771019 - RNA, 13 nt, Human
uggcugcagcagc

SEQ ID NO: 3771020 - RNA, 21 nt, Human
uggcugcagcagcgguggccu

SEQ ID NO: 3771021 - RNA, 13 nt, Human
uggcugcagccuc

SEQ ID NO: 3771022 - RNA, 15 nt, Human
uggcugcagccucag

SEQ ID NO: 3771023 - RNA, 16 nt, Human
uggcugcagccucagg

SEQ ID NO: 3771024 - RNA, 17 nt, Human
uggcugcagccucagga

SEQ ID NO: 3771025 - RNA, 20 nt, Human
uggcugcagccucaggacug

SEQ ID NO: 3771026 - RNA, 13 nt, Human
uggcugcagggag

SEQ ID NO: 3771027 - RNA, 22 nt, Human
uggcugccagcuauuuuuacua

SEQ ID NO: 3771028 - RNA, 20 nt, Human
uggcugccccaaccugcuga

SEQ ID NO: 3771029 - RNA, 16 nt, Human
uggcugccuccacucc

SEQ ID NO: 3771030 - RNA, 17 nt, Human
uggcugccuccacuccc

SEQ ID NO: 3771031 - RNA, 18 nt, Human
uggcugccuccacuccca

SEQ ID NO: 3771032 - RNA, 11 nt, Human
uggcugcugaa

SEQ ID NO: 3771033 - RNA, 13 nt, Human
uggcugcugaagg

SEQ ID NO: 3771034 - RNA, 16 nt, Human
uggcugcugaaggcuc

SEQ ID NO: 3771035 - RNA, 14 nt, Human
uggcugcugacuga

SEQ ID NO: 3771036 - RNA, 14 nt, Human
uggcugcugcccag

SEQ ID NO: 3771037 - RNA, 14 nt, Human
ugggaaugaagcuu

SEQ ID NO: 3771038 - RNA, 15 nt, Human
ugggaaugaagcuug

SEQ ID NO: 3771039 - RNA, 19 nt, Human
ugggaaugaagcuugugua

SEQ ID NO: 3771040 - RNA, 21 nt, Human
ugggaaugaagcuuguguauc

SEQ ID NO: 3771041 - RNA, 18 nt, Human
ugggaaugaggcuugcug

SEQ ID NO: 3771042 - RNA, 16 nt, Human
ugggaaugcggcaaga

SEQ ID NO: 3771043 - RNA, 21 nt, Human
ugggaauguauaguauuugaa

SEQ ID NO: 3771044 - RNA, 23 nt, Human
ugggaauguauaguauuugaaaa

SEQ ID NO: 3771045 - RNA, 20 nt, Human
ugggaauguuacauuguuug

SEQ ID NO: 3771046 - RNA, 22 nt, Human
ugggaauguuugucucauccca

SEQ ID NO: 3771047 - RNA, 15 nt, Human
ugggacaacugcucc

SEQ ID NO: 3771048 - RNA, 17 nt, Human
ugggacaauuguuuuaa

SEQ ID NO: 3771049 - RNA, 13 nt, Human
ugggacaccaggg

SEQ ID NO: 3771050 - RNA, 12 nt, Human
ugggacacccug

SEQ ID NO: 3771051 - RNA, 13 nt, Human
ugggacacccugu

SEQ ID NO: 3771052 - RNA, 14 nt, Human
ugggacagggagga

SEQ ID NO: 3771053 - RNA, 18 nt, Human
ugggacagucaccucaug

SEQ ID NO: 3771054 - RNA, 22 nt, Human
ugggacaguuuaucaugaagcc

SEQ ID NO: 3771055 - RNA, 16 nt, Human
ugggacaugggaaagg

SEQ ID NO: 3771056 - RNA, 19 nt, Human
ugggacauuugcucaugga

SEQ ID NO: 3771057 - RNA, 16 nt, Human
ugggaccaaaccuagc

SEQ ID NO: 3771058 - RNA, 23 nt, Human
ugggaccaacccuggggaaggag

SEQ ID NO: 3771059 - RNA, 17 nt, Human
ugggaccacaacuauuu

SEQ ID NO: 3771060 - RNA, 20 nt, Human
ugggaccacaggugcccgcc

SEQ ID NO: 3771061 - RNA, 14 nt, Human
ugggaccaggcacc

SEQ ID NO: 3771062 - RNA, 22 nt, Human
ugggacccacgaaacugcccug

SEQ ID NO: 3771063 - RNA, 20 nt, Human
ugggacccaguggcagggca

SEQ ID NO: 3771064 - RNA, 21 nt, Human
ugggacccaguggcagggcac

SEQ ID NO: 3771065 - RNA, 20 nt, Human
ugggacccauagaucuucug

SEQ ID NO: 3771066 - RNA, 13 nt, Human
ugggacccugcuu

SEQ ID NO: 3771067 - RNA, 18 nt, Human
ugggacccuuuccuuccu

SEQ ID NO: 3771068 - RNA, 19 nt, Human
ugggaccgccagauggggc

SEQ ID NO: 3771069 - RNA, 21 nt, Human
ugggaccgccagauggggccu

SEQ ID NO: 3771070 - RNA, 23 nt, Human
ugggaccgccagauggggccucu

SEQ ID NO: 3771071 - RNA, 15 nt, Human
ugggaccgcuacacc

SEQ ID NO: 3771072 - RNA, 17 nt, Human
ugggaccugccaggcag

SEQ ID NO: 3771073 - RNA, 14 nt, Human
ugggaccuguggcu

SEQ ID NO: 3771074 - RNA, 14 nt, Human
ugggacggugccca

SEQ ID NO: 3771075 - RNA, 23 nt, Human
ugggacggugcccaagccagagg

SEQ ID NO: 3771076 - RNA, 18 nt, Human
ugggacuacaggcaccca

SEQ ID NO: 3771077 - RNA, 19 nt, Human
ugggacuagccuggcuugg

SEQ ID NO: 3771078 - RNA, 19 nt, Human
ugggacuaugcuuuucuca

SEQ ID NO: 3771079 - RNA, 20 nt, Human
ugggacuaugcuuuucucaa

SEQ ID NO: 3771080 - RNA, 18 nt, Human
ugggacucaaugcacuga

SEQ ID NO: 3771081 - RNA, 14 nt, Human
ugggacugagccag

SEQ ID NO: 3771082 - RNA, 15 nt, Human
ugggacugagccagu

SEQ ID NO: 3771083 - RNA, 17 nt, Human
ugggacugcuaaauaaa

SEQ ID NO: 3771084 - RNA, 18 nt, Human
ugggacugcuaaauaaaa

SEQ ID NO: 3771085 - RNA, 13 nt, Human
ugggacuggaguc

SEQ ID NO: 3771086 - RNA, 18 nt, Human
ugggacuggagucccugu

SEQ ID NO: 3771087 - RNA, 23 nt, Human
ugggacuggccagguuucugccc

SEQ ID NO: 3771088 - RNA, 13 nt, Human
ugggacuggccuc

SEQ ID NO: 3771089 - RNA, 16 nt, Human
ugggacuggccucugc

SEQ ID NO: 3771090 - RNA, 20 nt, Human
ugggacugggaacagaacuc

SEQ ID NO: 3771091 - RNA, 14 nt, Human
ugggacuuaacucc

SEQ ID NO: 3771092 - RNA, 19 nt, Human
ugggacuuccuugcucucc

SEQ ID NO: 3771093 - RNA, 13 nt, Human
ugggacuucuuuu

SEQ ID NO: 3771094 - RNA, 15 nt, Human
ugggacuucuuuuca

SEQ ID NO: 3771095 - RNA, 18 nt, Human
ugggacuucuuuucacau

SEQ ID NO: 3771096 - RNA, 19 nt, Human
ugggagaaauacuugaacu

SEQ ID NO: 3771097 - RNA, 23 nt, Human
ugggagaaccucaggcuuccuug

SEQ ID NO: 3771098 - RNA, 22 nt, Human
ugggagaauucuuacauguuuu

SEQ ID NO: 3771099 - RNA, 21 nt, Human
ugggagacaagaaaucccugu

SEQ ID NO: 3771100 - RNA, 22 nt, Human
ugggagacaagaaaucccuguu

SEQ ID NO: 3771101 - RNA, 21 nt, Human
ugggagaccggccugccagga

SEQ ID NO: 3771102 - RNA, 22 nt, Human
ugggagaccggccugccaggag

SEQ ID NO: 3771103 - RNA, 21 nt, Human
ugggagagagacguguacaua

SEQ ID NO: 3771104 - RNA, 18 nt, Human
ugggagagcccagccauu

SEQ ID NO: 3771105 - RNA, 16 nt, Human
ugggagagccccuggg

SEQ ID NO: 3771106 - RNA, 20 nt, Human
ugggagaggauuuuuuucug

SEQ ID NO: 3771107 - RNA, 12 nt, Human
ugggagagggcg

SEQ ID NO: 3771108 - RNA, 15 nt, Human
ugggagagggcgcag

SEQ ID NO: 3771109 - RNA, 17 nt, Human
ugggagaggugccagca

SEQ ID NO: 3771110 - RNA, 23 nt, Human
ugggagagugucaaccagacaga

SEQ ID NO: 3771111 - RNA, 21 nt, Human
ugggagauauauuuuuaagau

SEQ ID NO: 3771112 - RNA, 23 nt, Human
ugggagauauauuuuuaagauaa

SEQ ID NO: 3771113 - RNA, 18 nt, Human
ugggagauuuuuuugagu

SEQ ID NO: 3771114 - RNA, 23 nt, Human
ugggagcacuggagugcagggag

SEQ ID NO: 3771115 - RNA, 17 nt, Human
ugggagcaguccaugca

SEQ ID NO: 3771116 - RNA, 19 nt, Human
ugggagcaguccaugcaug

SEQ ID NO: 3771117 - RNA, 13 nt, Human
ugggagccagccu

SEQ ID NO: 3771118 - RNA, 20 nt, Human
ugggagccaugccgucugcc

SEQ ID NO: 3771119 - RNA, 14 nt, Human
ugggagccccaggg

SEQ ID NO: 3771120 - RNA, 16 nt, Human
ugggagccccaggguc

SEQ ID NO: 3771121 - RNA, 19 nt, Human
ugggagcccccagccuguc

SEQ ID NO: 3771122 - RNA, 14 nt, Human
ugggagccgggucu

SEQ ID NO: 3771123 - RNA, 22 nt, Human
ugggagcgucaggguuggugug

SEQ ID NO: 3771124 - RNA, 22 nt, Human
ugggagcuccacucugcuucuc

SEQ ID NO: 3771125 - RNA, 16 nt, Human
ugggagcuccucuccu

SEQ ID NO: 3771126 - RNA, 20 nt, Human
ugggagcuccucuccuggag

SEQ ID NO: 3771127 - RNA, 16 nt, Human
ugggagcugccaagag

SEQ ID NO: 3771128 - RNA, 20 nt, Human
ugggaggaaaagaaaagagg

SEQ ID NO: 3771129 - RNA, 15 nt, Human
ugggaggaagcagaa

SEQ ID NO: 3771130 - RNA, 19 nt, Human
ugggaggaagcagaauaaa

SEQ ID NO: 3771131 - RNA, 20 nt, Human
ugggaggaagcagaauaaag

SEQ ID NO: 3771132 - RNA, 20 nt, Human
ugggaggacggugcaaccca

SEQ ID NO: 3771133 - RNA, 14 nt, Human
ugggaggagggaga

SEQ ID NO: 3771134 - RNA, 15 nt, Human
ugggaggagggagag

SEQ ID NO: 3771135 - RNA, 14 nt, Human
ugggaggagggcag

SEQ ID NO: 3771136 - RNA, 18 nt, Human
ugggaggagggcaggcau

SEQ ID NO: 3771137 - RNA, 21 nt, Human
ugggaggaucucuugagccug

SEQ ID NO: 3771138 - RNA, 21 nt, Human
ugggaggauugcuugagcuca

SEQ ID NO: 3771139 - RNA, 19 nt, Human
ugggaggcaagaggggugg

SEQ ID NO: 3771140 - RNA, 16 nt, Human
ugggaggcauggcccu

SEQ ID NO: 3771141 - RNA, 18 nt, Human
ugggaggccuaggcgggc

SEQ ID NO: 3771142 - RNA, 14 nt, Human
ugggaggcgcgagc

SEQ ID NO: 3771143 - RNA, 13 nt, Human
ugggaggcucacc

SEQ ID NO: 3771144 - RNA, 23 nt, Human
ugggaggcucuggagcccacugu

SEQ ID NO: 3771145 - RNA, 19 nt, Human
ugggagggagcagacagga

SEQ ID NO: 3771146 - RNA, 22 nt, Human
ugggagggaggcucaggucccu

SEQ ID NO: 3771147 - RNA, 18 nt, Human
ugggagggauagaggggg

SEQ ID NO: 3771148 - RNA, 14 nt, Human
ugggagggauggcc

SEQ ID NO: 3771149 - RNA, 11 nt, Human
ugggaggggca

SEQ ID NO: 3771150 - RNA, 12 nt, Human
ugggaggggcag

SEQ ID NO: 3771151 - RNA, 19 nt, Human
ugggaggggcaggcugaca

SEQ ID NO: 3771152 - RNA, 20 nt, Human
ugggaggggcgcccaccucc

SEQ ID NO: 3771153 - RNA, 19 nt, Human
ugggagguggaagaaggga

SEQ ID NO: 3771154 - RNA, 19 nt, Human
ugggagguugaucagaucu

SEQ ID NO: 3771155 - RNA, 14 nt, Human
ugggaguacaaaag

SEQ ID NO: 3771156 - RNA, 15 nt, Human
ugggagucaagugug

SEQ ID NO: 3771157 - RNA, 18 nt, Human
ugggaguccaggcacagg

SEQ ID NO: 3771158 - RNA, 13 nt, Human
ugggaguccccuu

SEQ ID NO: 3771159 - RNA, 20 nt, Human
ugggaguccccuuuucuuuu

SEQ ID NO: 3771160 - RNA, 18 nt, Human
ugggagugugguuucuuu

SEQ ID NO: 3771161 - RNA, 19 nt, Human
ugggaguucagcugcuucu

SEQ ID NO: 3771162 - RNA, 22 nt, Human
ugggaguugaucgccuuuccca

SEQ ID NO: 3771163 - RNA, 14 nt, Human
ugggaguuguaguu

SEQ ID NO: 3771164 - RNA, 20 nt, Human
ugggauaaaggcccagacuc

SEQ ID NO: 3771165 - RNA, 12 nt, Human
ugggauaaaugc

SEQ ID NO: 3771166 - RNA, 12 nt, Human
ugggauacaacc

SEQ ID NO: 3771167 - RNA, 17 nt, Human
ugggauagagaauguuc

SEQ ID NO: 3771168 - RNA, 16 nt, Human
ugggauaggggcagag

SEQ ID NO: 3771169 - RNA, 20 nt, Human
ugggauauaagaggcagcgu

SEQ ID NO: 3771170 - RNA, 18 nt, Human
ugggauauugaauguuaa

SEQ ID NO: 3771171 - RNA, 20 nt, Human
ugggaucacaggugucagcc

SEQ ID NO: 3771172 - RNA, 14 nt, Human
ugggaucaugaaag

SEQ ID NO: 3771173 - RNA, 23 nt, Human
ugggaucccugucuuuccuaaga

SEQ ID NO: 3771174 - RNA, 13 nt, Human
ugggauccuggag

SEQ ID NO: 3771175 - RNA, 16 nt, Human
ugggaucuaggagagg

SEQ ID NO: 3771176 - RNA, 18 nt, Human
ugggaucugccccucccu

SEQ ID NO: 3771177 - RNA, 23 nt, Human
ugggaucugccccucccugcuuc

SEQ ID NO: 3771178 - RNA, 23 nt, Human
ugggaucugguggucagcccuag

SEQ ID NO: 3771179 - RNA, 14 nt, Human
ugggaugaaugcca

SEQ ID NO: 3771180 - RNA, 14 nt, Human
ugggcccucugguu

SEQ ID NO: 3771181 - RNA, 21 nt, Human
ugggcccugagucugggcagc

SEQ ID NO: 3771182 - RNA, 13 nt, Human
ugggcccugcaug

SEQ ID NO: 3771183 - RNA, 13 nt, Human
ugggcccugccuc

SEQ ID NO: 3771184 - RNA, 14 nt, Human
ugggcccugggcug

SEQ ID NO: 3771185 - RNA, 19 nt, Human
ugggcccuggggccuguac

SEQ ID NO: 3771186 - RNA, 13 nt, Human
ugggccgcugcca

SEQ ID NO: 3771187 - RNA, 14 nt, Human
ugggccgcugccac

SEQ ID NO: 3771188 - RNA, 18 nt, Human
ugggccguagcuugucug

SEQ ID NO: 3771189 - RNA, 18 nt, Human
ugggccuauggagagccc

SEQ ID NO: 3771190 - RNA, 20 nt, Human
ugggccuauggagagcccug

SEQ ID NO: 3771191 - RNA, 14 nt, Human
ugggccuccugugu

SEQ ID NO: 3771192 - RNA, 19 nt, Human
ugggccucggccccuccca

SEQ ID NO: 3771193 - RNA, 20 nt, Human
ugggccugccgggcugaggg

SEQ ID NO: 3771194 - RNA, 19 nt, Human
ugggccugcuccagaccug

SEQ ID NO: 3771195 - RNA, 20 nt, Human
ugggccugcuccagaccuga

SEQ ID NO: 3771196 - RNA, 16 nt, Human
ugggccugcugcugag

SEQ ID NO: 3771197 - RNA, 13 nt, Human
ugggccugcuucc

SEQ ID NO: 3771198 - RNA, 17 nt, Human
ugggccugcuuccuguc

SEQ ID NO: 3771199 - RNA, 17 nt, Human
ugggccuggcauucuug

SEQ ID NO: 3771200 - RNA, 14 nt, Human
ugggccuggcuccc

SEQ ID NO: 3771201 - RNA, 19 nt, Human
ugggccuggcucccucacu

SEQ ID NO: 3771202 - RNA, 16 nt, Human
ugggccugggcuaggg

SEQ ID NO: 3771203 - RNA, 16 nt, Human
ugggccugggcuccug

SEQ ID NO: 3771204 - RNA, 21 nt, Human
ugggccuggucucacccugga

SEQ ID NO: 3771205 - RNA, 18 nt, Human
ugggccuuagugggccag

SEQ ID NO: 3771206 - RNA, 19 nt, Human
ugggccuuagugggccagg

SEQ ID NO: 3771207 - RNA, 14 nt, Human
ugggccuugcuggg

SEQ ID NO: 3771208 - RNA, 12 nt, Human
ugggccuuggcc

SEQ ID NO: 3771209 - RNA, 17 nt, Human
ugggccuuggccuggag

SEQ ID NO: 3771210 - RNA, 14 nt, Human
ugggccuugggcuc

SEQ ID NO: 3771211 - RNA, 16 nt, Human
ugggccuugggcuccg

SEQ ID NO: 3771212 - RNA, 17 nt, Human
ugggcgcccuggaagcc

SEQ ID NO: 3771213 - RNA, 18 nt, Human
ugggcgccgugcugggca

SEQ ID NO: 3771214 - RNA, 13 nt, Human
ugggcggcagaga

SEQ ID NO: 3771215 - RNA, 15 nt, Human
ugggcggcagagagg

SEQ ID NO: 3771216 - RNA, 18 nt, Human
ugggcgggcagcacagca

SEQ ID NO: 3771217 - RNA, 17 nt, Human
ugggcgggcaggggagg

SEQ ID NO: 3771218 - RNA, 14 nt, Human
ugggcggggccuug

SEQ ID NO: 3771219 - RNA, 16 nt, Human
ugggcggggccuugcg

SEQ ID NO: 3771220 - RNA, 19 nt, Human
ugggcguacgcuggugcug

SEQ ID NO: 3771221 - RNA, 17 nt, Human
ugggcgugagaccugcc

SEQ ID NO: 3771222 - RNA, 19 nt, Human
ugggcgugagaccugcccc

SEQ ID NO: 3771223 - RNA, 22 nt, Human
ugggcuaagugauccucccacc

SEQ ID NO: 3771224 - RNA, 23 nt, Human
ugggcuagguagaaaaaggguca

SEQ ID NO: 3771225 - RNA, 16 nt, Human
ugggcuaguugggcuu

SEQ ID NO: 3771226 - RNA, 13 nt, Human
ugggcuauggaca

SEQ ID NO: 3771227 - RNA, 17 nt, Human
ugggcuauggacacagg

SEQ ID NO: 3771228 - RNA, 16 nt, Human
ugggcucaagcagucu

SEQ ID NO: 3771229 - RNA, 10 nt, Human
ugggcucagc

SEQ ID NO: 3771230 - RNA, 19 nt, Human
ugggcucccguguuuugua

SEQ ID NO: 3771231 - RNA, 11 nt, Human
ugggcucccug

SEQ ID NO: 3771232 - RNA, 14 nt, Human
ugggcucccuuccc

SEQ ID NO: 3771233 - RNA, 15 nt, Human
ugggcucccuuccuc

SEQ ID NO: 3771234 - RNA, 19 nt, Human
ugggcucccuuccucccaa

SEQ ID NO: 3771235 - RNA, 17 nt, Human
ugggcucccuugugcgu

SEQ ID NO: 3771236 - RNA, 15 nt, Human
ugggcuccuccaggg

SEQ ID NO: 3771237 - RNA, 18 nt, Human
ugggcuccuggacccccc

SEQ ID NO: 3771238 - RNA, 15 nt, Human
ugggcuccuggcaga

SEQ ID NO: 3771239 - RNA, 23 nt, Human
ugggcuccuggcagaagggagca

SEQ ID NO: 3771240 - RNA, 15 nt, Human
ugggcucuccaccuc

SEQ ID NO: 3771241 - RNA, 18 nt, Human
ugggcucuccaccucagc

SEQ ID NO: 3771242 - RNA, 13 nt, Human
ugggcucugauga

SEQ ID NO: 3771243 - RNA, 14 nt, Human
ugggcucugaugaa

SEQ ID NO: 3771244 - RNA, 15 nt, Human
ugggcucugccaccc

SEQ ID NO: 3771245 - RNA, 21 nt, Human
ugggcucugccccagcucugg

SEQ ID NO: 3771246 - RNA, 12 nt, Human
ugggcucugcug

SEQ ID NO: 3771247 - RNA, 15 nt, Human
ugggcucugcugagu

SEQ ID NO: 3771248 - RNA, 15 nt, Human
ugggcucugggagca

SEQ ID NO: 3771249 - RNA, 16 nt, Human
ugggcucugggagcag

SEQ ID NO: 3771250 - RNA, 17 nt, Human
ugggcucugugcaguca

SEQ ID NO: 3771251 - RNA, 13 nt, Human
ugggcucuuccaa

SEQ ID NO: 3771252 - RNA, 21 nt, Human
ugggcugaccccgguggcggc

SEQ ID NO: 3771253 - RNA, 18 nt, Human
ugggcugacggugcaguc

SEQ ID NO: 3771254 - RNA, 23 nt, Human
ugggcugagacuggauacugccc

SEQ ID NO: 3771255 - RNA, 19 nt, Human
ugggcugagccccuacccc

SEQ ID NO: 3771256 - RNA, 15 nt, Human
ugggcugagcccugg

SEQ ID NO: 3771257 - RNA, 18 nt, Human
ugggcugagcccuggcag

SEQ ID NO: 3771258 - RNA, 16 nt, Human
ugggcugccaugugaa

SEQ ID NO: 3771259 - RNA, 17 nt, Human
ugggcugcccuggugcu

SEQ ID NO: 3771260 - RNA, 17 nt, Human
ugggcugcuacccagaa

SEQ ID NO: 3771261 - RNA, 15 nt, Human
ugggcugcuccucau

SEQ ID NO: 3771262 - RNA, 16 nt, Human
ugggcugcuccucaug

SEQ ID NO: 3771263 - RNA, 18 nt, Human
ugggcuggaacagauuca

SEQ ID NO: 3771264 - RNA, 18 nt, Human
ugggcuggaaucaggaau

SEQ ID NO: 3771265 - RNA, 19 nt, Human
ugggcuggcaguccuggaa

SEQ ID NO: 3771266 - RNA, 16 nt, Human
ugggcugggcccacaa

SEQ ID NO: 3771267 - RNA, 12 nt, Human
ugggcugugcua

SEQ ID NO: 3771268 - RNA, 17 nt, Human
ugggcuguuggcacuca

SEQ ID NO: 3771269 - RNA, 18 nt, Human
ugggcuucacuguauaaa

SEQ ID NO: 3771270 - RNA, 23 nt, Human
ugggcuucacuguauaaauagga

SEQ ID NO: 3771271 - RNA, 13 nt, Human
ugggcuucagccu

SEQ ID NO: 3771272 - RNA, 19 nt, Human
ugggcuucagccuaguggc

SEQ ID NO: 3771273 - RNA, 18 nt, Human
ugggcuucagcugccagu

SEQ ID NO: 3771274 - RNA, 13 nt, Human
ugggcuucagggc

SEQ ID NO: 3771275 - RNA, 15 nt, Human
ugggcuucagggcag

SEQ ID NO: 3771276 - RNA, 15 nt, Human
ugggcuucauccucc

SEQ ID NO: 3771277 - RNA, 22 nt, Human
ugggcuucauccuccucagauc

SEQ ID NO: 3771278 - RNA, 12 nt, Human
ugggcuucccag

SEQ ID NO: 3771279 - RNA, 19 nt, Human
ugggcuucccaguggcugc

SEQ ID NO: 3771280 - RNA, 13 nt, Human
ugggcuuccugga

SEQ ID NO: 3771281 - RNA, 15 nt, Human
ugggcuuccuggagc

SEQ ID NO: 3771282 - RNA, 16 nt, Human
ugggcuuccuggagca

SEQ ID NO: 3771283 - RNA, 16 nt, Human
ugggcuucugugccca

SEQ ID NO: 3771284 - RNA, 22 nt, Human
ugggcuugaccaggcuuggccu

SEQ ID NO: 3771285 - RNA, 14 nt, Human
ugggcuugcuauuc

SEQ ID NO: 3771286 - RNA, 14 nt, Human
ugggcuuggccugc

SEQ ID NO: 3771287 - RNA, 15 nt, Human
ugggcuuggccugcu

SEQ ID NO: 3771288 - RNA, 18 nt, Human
ugggcuuggccugcugug

SEQ ID NO: 3771289 - RNA, 14 nt, Human
ugggcuugggccua

SEQ ID NO: 3771290 - RNA, 22 nt, Human
ugggcuuggggaccagagcugc

SEQ ID NO: 3771291 - RNA, 20 nt, Human
ugggcuuguggggccuggga

SEQ ID NO: 3771292 - RNA, 22 nt, Human
ugggcuuuuggggagccagaag

SEQ ID NO: 3771293 - RNA, 16 nt, Human
uggggaaacagcaucu

SEQ ID NO: 3771294 - RNA, 21 nt, Human
uggggaaagacacugccuggg

SEQ ID NO: 3771295 - RNA, 17 nt, Human
uggggaaaggagguggg

SEQ ID NO: 3771296 - RNA, 19 nt, Human
uggggaaaggagguggggg

SEQ ID NO: 3771297 - RNA, 21 nt, Human
uggggaaaggggucggcugac

SEQ ID NO: 3771298 - RNA, 22 nt, Human
uggggaaaggggucggcugacc

SEQ ID NO: 3771299 - RNA, 23 nt, Human
uggggaaaggggucggcugacca

SEQ ID NO: 3771300 - RNA, 23 nt, Human
uggggaacauuucuguaaauacc

SEQ ID NO: 3771301 - RNA, 17 nt, Human
uggggaagacuguggcu

SEQ ID NO: 3771302 - RNA, 18 nt, Human
uggggaagcuucuuaaau

SEQ ID NO: 3771303 - RNA, 11 nt, Human
uggggaaggag

SEQ ID NO: 3771304 - RNA, 16 nt, Human
uggggaaggagccagu

SEQ ID NO: 3771305 - RNA, 20 nt, Human
uggggaagguuaucagugcu

SEQ ID NO: 3771306 - RNA, 22 nt, Human
uggggacaggggcaggaggaag

SEQ ID NO: 3771307 - RNA, 17 nt, Human
uggggaccagagcugcc

SEQ ID NO: 3771308 - RNA, 18 nt, Human
uggggaccagagcugcca

SEQ ID NO: 3771309 - RNA, 21 nt, Human
uggggaccagcagucugccug

SEQ ID NO: 3771310 - RNA, 23 nt, Human
uggggaccagcagucugccugga

SEQ ID NO: 3771311 - RNA, 21 nt, Human
uggggacccaggcuccgcccu

SEQ ID NO: 3771312 - RNA, 19 nt, Human
uggggacggggggccccag

SEQ ID NO: 3771313 - RNA, 19 nt, Human
uggggacuccggcugugcu

SEQ ID NO: 3771314 - RNA, 17 nt, Human
uggggagacugggcuga

SEQ ID NO: 3771315 - RNA, 20 nt, Human
uggggagaucggggccagag

SEQ ID NO: 3771316 - RNA, 17 nt, Human
uggggagcagagacacu

SEQ ID NO: 3771317 - RNA, 16 nt, Human
uggggagcaggcagcc

SEQ ID NO: 3771318 - RNA, 18 nt, Human
uggggagcccgucucagu

SEQ ID NO: 3771319 - RNA, 16 nt, Human
uggggaggaaauagaa

SEQ ID NO: 3771320 - RNA, 13 nt, Human
uggggaggaggag

SEQ ID NO: 3771321 - RNA, 21 nt, Human
uggggagggccguaccccacc

SEQ ID NO: 3771322 - RNA, 15 nt, Human
uggggaggggcgcug

SEQ ID NO: 3771323 - RNA, 23 nt, Human
uggggaggggcgcuggcccagcc

SEQ ID NO: 3771324 - RNA, 16 nt, Human
uggggagguguucacu

SEQ ID NO: 3771325 - RNA, 14 nt, Human
uguauuagauguuc

SEQ ID NO: 3771326 - RNA, 18 nt, Human
uguauuagauguucucua

SEQ ID NO: 3771327 - RNA, 18 nt, Human
uguauuaggacuggcuuu

SEQ ID NO: 3771328 - RNA, 19 nt, Human
uguauuagugauauuucuc

SEQ ID NO: 3771329 - RNA, 12 nt, Human
uguauuauugcu

SEQ ID NO: 3771330 - RNA, 14 nt, Human
uguauuauuuauaa

SEQ ID NO: 3771331 - RNA, 15 nt, Human
uguauucauauuugu

SEQ ID NO: 3771332 - RNA, 22 nt, Human
uguauucauugaagucagaugu

SEQ ID NO: 3771333 - RNA, 17 nt, Human
uguauucccaguuacuu

SEQ ID NO: 3771334 - RNA, 17 nt, Human
uguauucccauaucaaa

SEQ ID NO: 3771335 - RNA, 20 nt, Human
uguauucuagcuaauguaau

SEQ ID NO: 3771336 - RNA, 22 nt, Human
uguauucucuccuguaccucuu

SEQ ID NO: 3771337 - RNA, 21 nt, Human
uguauucucugagcugugcag

SEQ ID NO: 3771338 - RNA, 17 nt, Human
uguauucugucuucauc

SEQ ID NO: 3771339 - RNA, 20 nt, Human
uguauucuuaaaaugcaaua

SEQ ID NO: 3771340 - RNA, 16 nt, Human
uguauucuuugauguu

SEQ ID NO: 3771341 - RNA, 18 nt, Human
uguauucuuugauguuaa

SEQ ID NO: 3771342 - RNA, 22 nt, Human
uguauucuuugauguuaacaca

SEQ ID NO: 3771343 - RNA, 23 nt, Human
uguauucuuugauguuaacacau

SEQ ID NO: 3771344 - RNA, 14 nt, Human
uguauugcacauug

SEQ ID NO: 3771345 - RNA, 15 nt, Human
uguauugcacauugu

SEQ ID NO: 3771346 - RNA, 17 nt, Human
uguauugcgucuuagca

SEQ ID NO: 3771347 - RNA, 13 nt, Human
uguauugcuuucu

SEQ ID NO: 3771348 - RNA, 17 nt, Human
uguauugcuuucuuuca

SEQ ID NO: 3771349 - RNA, 13 nt, Human
uguauuggccugg

SEQ ID NO: 3771350 - RNA, 14 nt, Human
uguauuguccuauu

SEQ ID NO: 3771351 - RNA, 19 nt, Human
uguauuguccuauuagugu

SEQ ID NO: 3771352 - RNA, 15 nt, Human
uguauugugcaaugu

SEQ ID NO: 3771353 - RNA, 18 nt, Human
uguauugugcaaugugua

SEQ ID NO: 3771354 - RNA, 14 nt, Human
uguauugugguauu

SEQ ID NO: 3771355 - RNA, 21 nt, Human
uguauugugucuuuugcauga

SEQ ID NO: 3771356 - RNA, 17 nt, Human
uguauuguuagauguuu

SEQ ID NO: 3771357 - RNA, 13 nt, Human
uguauuguuccca

SEQ ID NO: 3771358 - RNA, 14 nt, Human
uguauuguucccag

SEQ ID NO: 3771359 - RNA, 16 nt, Human
uguauuuaaaaaaauc

SEQ ID NO: 3771360 - RNA, 13 nt, Human
uguauuuaaauau

SEQ ID NO: 3771361 - RNA, 16 nt, Human
uguauuuaacagaaau

SEQ ID NO: 3771362 - RNA, 21 nt, Human
uguauuuaacagaaauuguau

SEQ ID NO: 3771363 - RNA, 14 nt, Human
uguauuuaagcaaa

SEQ ID NO: 3771364 - RNA, 13 nt, Human
uguauuuaauugu

SEQ ID NO: 3771365 - RNA, 18 nt, Human
uguauuuaauuguaaacu

SEQ ID NO: 3771366 - RNA, 21 nt, Human
uguauuuauauuuugugcuau

SEQ ID NO: 3771367 - RNA, 22 nt, Human
uguauuuauguaaugaaguaaa

SEQ ID NO: 3771368 - RNA, 16 nt, Human
uguauuuaugugugag

SEQ ID NO: 3771369 - RNA, 23 nt, Human
uguauuuauuccauauucaugua

SEQ ID NO: 3771370 - RNA, 22 nt, Human
uguauuuauugguuuugcagaa

SEQ ID NO: 3771371 - RNA, 16 nt, Human
uguauuuauuuaaaag

SEQ ID NO: 3771372 - RNA, 20 nt, Human
uguauuuauuuaaaagauuc

SEQ ID NO: 3771373 - RNA, 20 nt, Human
uguauuuauuuaguauuuau

SEQ ID NO: 3771374 - RNA, 23 nt, Human
uguauuuccccaacauguaauaa

SEQ ID NO: 3771375 - RNA, 13 nt, Human
uguauuugcuaau

SEQ ID NO: 3771376 - RNA, 21 nt, Human
uguauuuggaaauaaagucag

SEQ ID NO: 3771377 - RNA, 17 nt, Human
uguauuuguaguguuau

SEQ ID NO: 3771378 - RNA, 13 nt, Human
uguauuugugacu

SEQ ID NO: 3771379 - RNA, 14 nt, Human
uguauuugugacua

SEQ ID NO: 3771380 - RNA, 18 nt, Human
uguauuuguuaaugguuu

SEQ ID NO: 3771381 - RNA, 16 nt, Human
uguauuuguucauguu

SEQ ID NO: 3771382 - RNA, 12 nt, Human
uguauuuuaugu

SEQ ID NO: 3771383 - RNA, 13 nt, Human
uguauuuuauguu

SEQ ID NO: 3771384 - RNA, 14 nt, Human
uguauuuuauguua

SEQ ID NO: 3771385 - RNA, 19 nt, Human
uguauuuuauuuagacaag

SEQ ID NO: 3771386 - RNA, 21 nt, Human
uguauuuuauuuuuuucucuc

SEQ ID NO: 3771387 - RNA, 12 nt, Human
uguauuuucaug

SEQ ID NO: 3771388 - RNA, 16 nt, Human
uguauuuucaugaaaa

SEQ ID NO: 3771389 - RNA, 10 nt, Human
uguauuuucc

SEQ ID NO: 3771390 - RNA, 12 nt, Human
uguauuuuccaa

SEQ ID NO: 3771391 - RNA, 18 nt, Human
uguauuuuccaagugugc

SEQ ID NO: 3771392 - RNA, 13 nt, Human
uguauuuugaaau

SEQ ID NO: 3771393 - RNA, 15 nt, Human
uguauuuugugaguu

SEQ ID NO: 3771394 - RNA, 19 nt, Human
uguauuuugugugaccaac

SEQ ID NO: 3771395 - RNA, 23 nt, Human
uguauuuuuauauaauaucuaaa

SEQ ID NO: 3771396 - RNA, 14 nt, Human
uguauuuuucuaca

SEQ ID NO: 3771397 - RNA, 22 nt, Human
uguauuuuucuacauuauugcu

SEQ ID NO: 3771398 - RNA, 14 nt, Human
uguauuuuuuaaag

SEQ ID NO: 3771399 - RNA, 17 nt, Human
uguauuuuuuaaagcua

SEQ ID NO: 3771400 - RNA, 19 nt, Human
uguauuuuuuaaugcuaau

SEQ ID NO: 3771401 - RNA, 17 nt, Human
uguauuuuuuugcaagu

SEQ ID NO: 3771402 - RNA, 22 nt, Human
uguauuuuuuuuucuaagagaa

SEQ ID NO: 3771403 - RNA, 14 nt, Human
ugucaaaaaaaaaa

SEQ ID NO: 3771404 - RNA, 23 nt, Human
ugucaaaaaugucuuggguaggc

SEQ ID NO: 3771405 - RNA, 16 nt, Human
ugucaaaacacugugg

SEQ ID NO: 3771406 - RNA, 17 nt, Human
ugucaaaacacugugga

SEQ ID NO: 3771407 - RNA, 17 nt, Human
ugucaaaaguagaacuu

SEQ ID NO: 3771408 - RNA, 20 nt, Human
ugucaaaaguagaacuuugu

SEQ ID NO: 3771409 - RNA, 22 nt, Human
ugucaaaaguagaacuuuguau

SEQ ID NO: 3771410 - RNA, 15 nt, Human
ugucaaaauaauuuu

SEQ ID NO: 3771411 - RNA, 21 nt, Human
ugucaaacaaagccagaagcu

SEQ ID NO: 3771412 - RNA, 20 nt, Human
ugucaaacauuaguacuuua

SEQ ID NO: 3771413 - RNA, 14 nt, Human
ugucaaagugguga

SEQ ID NO: 3771414 - RNA, 18 nt, Human
ugucaaauaaacacugug

SEQ ID NO: 3771415 - RNA, 22 nt, Human
ugucaacaaaccaagcaucagg

SEQ ID NO: 3771416 - RNA, 23 nt, Human
ugucaacaaaccaagcaucaggg

SEQ ID NO: 3771417 - RNA, 13 nt, Human
ugucaacauugug

SEQ ID NO: 3771418 - RNA, 22 nt, Human
ugucaaccagacagagggucac

SEQ ID NO: 3771419 - RNA, 15 nt, Human
ugucaacuuuaugca

SEQ ID NO: 3771420 - RNA, 20 nt, Human
ugucaagaguaguuauauaa

SEQ ID NO: 3771421 - RNA, 15 nt, Human
ugucaagcugcucug

SEQ ID NO: 3771422 - RNA, 19 nt, Human
ugucaaggcugcuuagaau

SEQ ID NO: 3771423 - RNA, 18 nt, Human
ugucaagggcagaaugaa

SEQ ID NO: 3771424 - RNA, 21 nt, Human
ugucaagggcagcuuugcuca

SEQ ID NO: 3771425 - RNA, 13 nt, Human
ugucaaggugcug

SEQ ID NO: 3771426 - RNA, 16 nt, Human
ugucaagucucugcug

SEQ ID NO: 3771427 - RNA, 19 nt, Human
ugucaagucucugcuggcc

SEQ ID NO: 3771428 - RNA, 21 nt, Human
ugucaauaaacagcuucaugc

SEQ ID NO: 3771429 - RNA, 13 nt, Human
ugucaauauuaaa

SEQ ID NO: 3771430 - RNA, 15 nt, Human
ugucaaucuguccgu

SEQ ID NO: 3771431 - RNA, 23 nt, Human
ugucaaugcaguugucucuguuu

SEQ ID NO: 3771432 - RNA, 12 nt, Human
ugucaaugugug

SEQ ID NO: 3771433 - RNA, 14 nt, Human
ugucaauuacagga

SEQ ID NO: 3771434 - RNA, 17 nt, Human
ugucaauuacaggaagu

SEQ ID NO: 3771435 - RNA, 21 nt, Human
ugucaauuacaggaaguacug

SEQ ID NO: 3771436 - RNA, 17 nt, Human
ugucaauuuaugaauau

SEQ ID NO: 3771437 - RNA, 12 nt, Human
ugucacaaagaa

SEQ ID NO: 3771438 - RNA, 21 nt, Human
ugucacaauccuaacacauua

SEQ ID NO: 3771439 - RNA, 13 nt, Human
ugucacaccagcc

SEQ ID NO: 3771440 - RNA, 14 nt, Human
ugucacacuggcua

SEQ ID NO: 3771441 - RNA, 15 nt, Human
ugucacacuggcuau

SEQ ID NO: 3771442 - RNA, 21 nt, Human
ugucacaggaaggcugucuca

SEQ ID NO: 3771443 - RNA, 16 nt, Human
ugucacaggcaggucc

SEQ ID NO: 3771444 - RNA, 17 nt, Human
ugucacaggcaggucca

SEQ ID NO: 3771445 - RNA, 17 nt, Human
ugucacagggacugaaa

SEQ ID NO: 3771446 - RNA, 14 nt, Human
ugucacagggccaa

SEQ ID NO: 3771447 - RNA, 17 nt, Human
ugucacauggugccccu

SEQ ID NO: 3771448 - RNA, 21 nt, Human
ugucacauggugccccuagcu

SEQ ID NO: 3771449 - RNA, 21 nt, Human
ugucacauugcauucuauugc

SEQ ID NO: 3771450 - RNA, 18 nt, Human
ugucaccaccuucccagc

SEQ ID NO: 3771451 - RNA, 21 nt, Human
ugucaccaccuucccagcucu

SEQ ID NO: 3771452 - RNA, 22 nt, Human
ugucacccagguuggagugcag

SEQ ID NO: 3771453 - RNA, 14 nt, Human
ugucaccccagagc

SEQ ID NO: 3771454 - RNA, 18 nt, Human
ugucaccccagagccaca

SEQ ID NO: 3771455 - RNA, 20 nt, Human
ugucaccccagagccacaca

SEQ ID NO: 3771456 - RNA, 20 nt, Human
ugucacccgaucgccagcaa

SEQ ID NO: 3771457 - RNA, 18 nt, Human
ugucaccggauccugggu

SEQ ID NO: 3771458 - RNA, 16 nt, Human
ugucaccgugagcagc

SEQ ID NO: 3771459 - RNA, 22 nt, Human
ugucaccguggaccuuccugcc

SEQ ID NO: 3771460 - RNA, 23 nt, Human
ugucaccucuuccgacucuuucu

SEQ ID NO: 3771461 - RNA, 17 nt, Human
ugucaccugcuucucug

SEQ ID NO: 3771462 - RNA, 18 nt, Human
ugucaccugcuucucugc

SEQ ID NO: 3771463 - RNA, 20 nt, Human
ugucaccugcuucucugccc

SEQ ID NO: 3771464 - RNA, 14 nt, Human
ugucaccugugcuu

SEQ ID NO: 3771465 - RNA, 14 nt, Human
ugucaccuucaccu

SEQ ID NO: 3771466 - RNA, 14 nt, Human
ugucacgccagacu

SEQ ID NO: 3771467 - RNA, 19 nt, Human
ugucacguacugucugauu

SEQ ID NO: 3771468 - RNA, 15 nt, Human
ugucacuaaagcagg

SEQ ID NO: 3771469 - RNA, 16 nt, Human
ugucacuacucacagu

SEQ ID NO: 3771470 - RNA, 16 nt, Human
uguccuuagccuggac

SEQ ID NO: 3771471 - RNA, 22 nt, Human
uguccuuagccuggaccucuga

SEQ ID NO: 3771472 - RNA, 22 nt, Human
uguccuucccugcauuucugag

SEQ ID NO: 3771473 - RNA, 18 nt, Human
uguccuucucucaccucc

SEQ ID NO: 3771474 - RNA, 20 nt, Human
uguccuugaaggacuaauag

SEQ ID NO: 3771475 - RNA, 14 nt, Human
uguccuuggggaca

SEQ ID NO: 3771476 - RNA, 19 nt, Human
uguccuuuaaaaaagaaaa

SEQ ID NO: 3771477 - RNA, 17 nt, Human
uguccuuucccuccacu

SEQ ID NO: 3771478 - RNA, 19 nt, Human
uguccuuucuagagcacug

SEQ ID NO: 3771479 - RNA, 13 nt, Human
uguccuuuucaua

SEQ ID NO: 3771480 - RNA, 15 nt, Human
uguccuuuugcaaag

SEQ ID NO: 3771481 - RNA, 17 nt, Human
uguccuuuuuccucucc

SEQ ID NO: 3771482 - RNA, 18 nt, Human
uguccuuuuuccucucca

SEQ ID NO: 3771483 - RNA, 21 nt, Human
uguccuuuuuccucuccacac

SEQ ID NO: 3771484 - RNA, 21 nt, Human
ugucgaauuuuuauuauuugu

SEQ ID NO: 3771485 - RNA, 20 nt, Human
ugucgauuagacuggacagc

SEQ ID NO: 3771486 - RNA, 23 nt, Human
ugucgauuagacuggacagcuug

SEQ ID NO: 3771487 - RNA, 15 nt, Human
ugucgcccaggcugg

SEQ ID NO: 3771488 - RNA, 15 nt, Human
ugucgcucaugugug

SEQ ID NO: 3771489 - RNA, 16 nt, Human
ugucgcucaugugugc

SEQ ID NO: 3771490 - RNA, 15 nt, Human
ugucgcugcuucgug

SEQ ID NO: 3771491 - RNA, 14 nt, Human
ugucggcacauuca

SEQ ID NO: 3771492 - RNA, 22 nt, Human
ugucggccccaccagugccucu

SEQ ID NO: 3771493 - RNA, 23 nt, Human
ugucggcuccaguccccagaacu

SEQ ID NO: 3771494 - RNA, 14 nt, Human
ugucgggcaugaca

SEQ ID NO: 3771495 - RNA, 12 nt, Human
ugucgggcccuu

SEQ ID NO: 3771496 - RNA, 16 nt, Human
ugucguaaagauuugg

SEQ ID NO: 3771497 - RNA, 20 nt, Human
ugucguggacacacacagac

SEQ ID NO: 3771498 - RNA, 21 nt, Human
ugucguggguguguguagcca

SEQ ID NO: 3771499 - RNA, 22 nt, Human
ugucguugacuuuagggacuca

SEQ ID NO: 3771500 - RNA, 13 nt, Human
ugucuaaaaaaca

SEQ ID NO: 3771501 - RNA, 13 nt, Human
ugucuaaaacaau

SEQ ID NO: 3771502 - RNA, 16 nt, Human
ugucuaaacaaugcug

SEQ ID NO: 3771503 - RNA, 17 nt, Human
ugucuaaacaaugcuga

SEQ ID NO: 3771504 - RNA, 22 nt, Human
ugucuaaacaaugcugauuugg

SEQ ID NO: 3771505 - RNA, 11 nt, Human
ugucuaaacug

SEQ ID NO: 3771506 - RNA, 14 nt, Human
ugucuaagaaacau

SEQ ID NO: 3771507 - RNA, 15 nt, Human
ugucuaagaaacauu

SEQ ID NO: 3771508 - RNA, 15 nt, Human
ugucuaagauucuag

SEQ ID NO: 3771509 - RNA, 14 nt, Human
ugucuaaugaaacc

SEQ ID NO: 3771510 - RNA, 12 nt, Human
ugucuacaaaua

SEQ ID NO: 3771511 - RNA, 15 nt, Human
ugucuacaaauauaa

SEQ ID NO: 3771512 - RNA, 23 nt, Human
ugucuacacagauguucacccaa

SEQ ID NO: 3771513 - RNA, 17 nt, Human
ugucuacaccauuaugu

SEQ ID NO: 3771514 - RNA, 21 nt, Human
ugucuacaugaaaguccucag

SEQ ID NO: 3771515 - RNA, 14 nt, Human
ugucuagaguagcu

SEQ ID NO: 3771516 - RNA, 16 nt, Human
ugucuagcacuuccuu

SEQ ID NO: 3771517 - RNA, 21 nt, Human
ugucuagcaugccaacaagaa

SEQ ID NO: 3771518 - RNA, 19 nt, Human
ugucuaggcaggaccugug

SEQ ID NO: 3771519 - RNA, 15 nt, Human
ugucuauaaaagaaa

SEQ ID NO: 3771520 - RNA, 14 nt, Human
ugucuauaaagcau

SEQ ID NO: 3771521 - RNA, 13 nt, Human
ugucuauucagcu

SEQ ID NO: 3771522 - RNA, 18 nt, Human
ugucuauuguccaaaguu

SEQ ID NO: 3771523 - RNA, 15 nt, Human
ugucuauuucugcug

SEQ ID NO: 3771524 - RNA, 11 nt, Human
ugucuauuuua

SEQ ID NO: 3771525 - RNA, 16 nt, Human
ugucuauuuuaaaaua

SEQ ID NO: 3771526 - RNA, 20 nt, Human
ugucuauuuuuaauguuugu

SEQ ID NO: 3771527 - RNA, 12 nt, Human
ugucucaaaaaa

SEQ ID NO: 3771528 - RNA, 21 nt, Human
ugucucaaaaaaagaaaaaga

SEQ ID NO: 3771529 - RNA, 21 nt, Human
ugucucaaacuucagauggga

SEQ ID NO: 3771530 - RNA, 19 nt, Human
ugucucaagagggcacugg

SEQ ID NO: 3771531 - RNA, 14 nt, Human
ugucucaaugcuca

SEQ ID NO: 3771532 - RNA, 16 nt, Human
ugucucaaugcucaua

SEQ ID NO: 3771533 - RNA, 22 nt, Human
ugucucaaugcucauaacggau

SEQ ID NO: 3771534 - RNA, 23 nt, Human
ugucucacuaaagcaugaaaugu

SEQ ID NO: 3771535 - RNA, 22 nt, Human
ugucucagacuuuuguacaucu

SEQ ID NO: 3771536 - RNA, 22 nt, Human
ugucucagauuuuauuauguaa

SEQ ID NO: 3771537 - RNA, 14 nt, Human
ugucucagccuccc

SEQ ID NO: 3771538 - RNA, 16 nt, Human
ugucucaggcugccug

SEQ ID NO: 3771539 - RNA, 19 nt, Human
ugucucaggcugccugagu

SEQ ID NO: 3771540 - RNA, 17 nt, Human
ugucucaguccaccuga

SEQ ID NO: 3771541 - RNA, 11 nt, Human
ugucucaucca

SEQ ID NO: 3771542 - RNA, 21 nt, Human
ugucucauccaucaucaugug

SEQ ID NO: 3771543 - RNA, 13 nt, Human
ugucucaucccca

SEQ ID NO: 3771544 - RNA, 23 nt, Human
ugucucauccccaggggucccag

SEQ ID NO: 3771545 - RNA, 19 nt, Human
ugucucauccuccuggaac

SEQ ID NO: 3771546 - RNA, 21 nt, Human
ugucucaugccaguaacaggc

SEQ ID NO: 3771547 - RNA, 13 nt, Human
ugucucaugugug

SEQ ID NO: 3771548 - RNA, 14 nt, Human
ugucucauuuuaau

SEQ ID NO: 3771549 - RNA, 19 nt, Human
ugucuccaaccccccagca

SEQ ID NO: 3771550 - RNA, 23 nt, Human
ugucuccaaccccccagcacuga

SEQ ID NO: 3771551 - RNA, 11 nt, Human
ugucuccagac

SEQ ID NO: 3771552 - RNA, 17 nt, Human
ugucuccagacccccac

SEQ ID NO: 3771553 - RNA, 21 nt, Human
ugucucccagggccuuaaaag

SEQ ID NO: 3771554 - RNA, 12 nt, Human
ugucuccccucu

SEQ ID NO: 3771555 - RNA, 13 nt, Human
ugucucccgcccc

SEQ ID NO: 3771556 - RNA, 14 nt, Human
ugucuccuacuccu

SEQ ID NO: 3771557 - RNA, 17 nt, Human
ugucuccuacugaggau

SEQ ID NO: 3771558 - RNA, 15 nt, Human
ugucuccucucucug

SEQ ID NO: 3771559 - RNA, 17 nt, Human
ugucuccucuucuuugu

SEQ ID NO: 3771560 - RNA, 11 nt, Human
ugucuccugca

SEQ ID NO: 3771561 - RNA, 19 nt, Human
ugucuccuuugcaggcuca

SEQ ID NO: 3771562 - RNA, 15 nt, Human
ugucucgagcgcccu

SEQ ID NO: 3771563 - RNA, 18 nt, Human
ugucucgugguaggacug

SEQ ID NO: 3771564 - RNA, 19 nt, Human
ugucucgugguaggacugu

SEQ ID NO: 3771565 - RNA, 15 nt, Human
ugucucuagccacuu

SEQ ID NO: 3771566 - RNA, 16 nt, Human
ugucucuagccacuuu

SEQ ID NO: 3771567 - RNA, 12 nt, Human
ugucucucauga

SEQ ID NO: 3771568 - RNA, 13 nt, Human
ugucucuccugcc

SEQ ID NO: 3771569 - RNA, 16 nt, Human
ugucucuccugccccu

SEQ ID NO: 3771570 - RNA, 17 nt, Human
ugucucuccugccccuu

SEQ ID NO: 3771571 - RNA, 15 nt, Human
ugucucuccuuuucu

SEQ ID NO: 3771572 - RNA, 21 nt, Human
ugucucuccuuuucuuuuguu

SEQ ID NO: 3771573 - RNA, 18 nt, Human
ugucucucuucagacucu

SEQ ID NO: 3771574 - RNA, 19 nt, Human
ugucucucuucagacucuc

SEQ ID NO: 3771575 - RNA, 21 nt, Human
ugucucucuucagacucucag

SEQ ID NO: 3771576 - RNA, 15 nt, Human
ugucucugauaaaag

SEQ ID NO: 3771577 - RNA, 15 nt, Human
ugucucuuauggaug

SEQ ID NO: 3771578 - RNA, 20 nt, Human
ugucucuuauggaugucccc

SEQ ID NO: 3771579 - RNA, 13 nt, Human
ugucucuucuccu

SEQ ID NO: 3771580 - RNA, 14 nt, Human
ugucucuucuccuu

SEQ ID NO: 3771581 - RNA, 16 nt, Human
ugucucuucugagcua

SEQ ID NO: 3771582 - RNA, 17 nt, Human
ugucucuugaguuuguc

SEQ ID NO: 3771583 - RNA, 18 nt, Human
ugucucuugguccugcug

SEQ ID NO: 3771584 - RNA, 22 nt, Human
ugucucuugguccugcugcagu

SEQ ID NO: 3771585 - RNA, 22 nt, Human
ugucucuuuaagggcaugccuu

SEQ ID NO: 3771586 - RNA, 22 nt, Human
ugucucuuuaaugucacaggca

SEQ ID NO: 3771587 - RNA, 14 nt, Human
ugucucuuuucucu

SEQ ID NO: 3771588 - RNA, 18 nt, Human
ugucucuuuucucuuucu

SEQ ID NO: 3771589 - RNA, 13 nt, Human
ugucugaaacauu

SEQ ID NO: 3771590 - RNA, 12 nt, Human
ugucugaacuuu

SEQ ID NO: 3771591 - RNA, 22 nt, Human
ugucugaaggacacuuccugcc

SEQ ID NO: 3771592 - RNA, 20 nt, Human
ugucugaagucacugcacag

SEQ ID NO: 3771593 - RNA, 18 nt, Human
ugucugagaguuuaguug

SEQ ID NO: 3771594 - RNA, 15 nt, Human
ugucugaucugugcu

SEQ ID NO: 3771595 - RNA, 20 nt, Human
ugucugaucugugcuuucca

SEQ ID NO: 3771596 - RNA, 19 nt, Human
ugucugauuggcucaccca

SEQ ID NO: 3771597 - RNA, 16 nt, Human
ugucugauuggcuugu

SEQ ID NO: 3771598 - RNA, 13 nt, Human
ugucugauuucuu

SEQ ID NO: 3771599 - RNA, 16 nt, Human
ugucugcagcccugag

SEQ ID NO: 3771600 - RNA, 17 nt, Human
ugucugcagcccugaga

SEQ ID NO: 3771601 - RNA, 18 nt, Human
ugucugcagcccugagaa

SEQ ID NO: 3771602 - RNA, 19 nt, Human
ugucugcagugugcccccc

SEQ ID NO: 3771603 - RNA, 21 nt, Human
ugucugcauuucgguggcuag

SEQ ID NO: 3771604 - RNA, 15 nt, Human
ugucugccagccagc

SEQ ID NO: 3771605 - RNA, 16 nt, Human
ugucugccagccagca

SEQ ID NO: 3771606 - RNA, 16 nt, Human
ugucugccccaaguuu

SEQ ID NO: 3771607 - RNA, 17 nt, Human
ugucugccccaaguuuu

SEQ ID NO: 3771608 - RNA, 14 nt, Human
ugucugccccagcc

SEQ ID NO: 3771609 - RNA, 17 nt, Human
ugucugcgugggucaga

SEQ ID NO: 3771610 - RNA, 16 nt, Human
ugucugcuccagcucu

SEQ ID NO: 3771611 - RNA, 21 nt, Human
ugucugcuggucacuucuucu

SEQ ID NO: 3771612 - RNA, 20 nt, Human
ugucugcuuuaaagggccug

SEQ ID NO: 3771613 - RNA, 21 nt, Human
ugucugcuuuaaagggccugc

SEQ ID NO: 3771614 - RNA, 22 nt, Human
ugucugcuuuaaagggccugcc

SEQ ID NO: 3771615 - RNA, 17 nt, Human
ugugaucugucuuguaa

SEQ ID NO: 3771616 - RNA, 21 nt, Human
ugugaucuuaauauauuugaa

SEQ ID NO: 3771617 - RNA, 22 nt, Human
ugugaucuuauuuuucuaaacg

SEQ ID NO: 3771618 - RNA, 18 nt, Human
ugugaucuugcucuaucu

SEQ ID NO: 3771619 - RNA, 18 nt, Human
ugugaugaauacuguauu

SEQ ID NO: 3771620 - RNA, 18 nt, Human
ugugaugagaggaaauca

SEQ ID NO: 3771621 - RNA, 13 nt, Human
ugugaugagcuga

SEQ ID NO: 3771622 - RNA, 17 nt, Human
ugugaugauguaauuga

SEQ ID NO: 3771623 - RNA, 17 nt, Human
ugugaugcuuugaagua

SEQ ID NO: 3771624 - RNA, 15 nt, Human
ugugauggggcccug

SEQ ID NO: 3771625 - RNA, 18 nt, Human
ugugauggggcccugccu

SEQ ID NO: 3771626 - RNA, 19 nt, Human
ugugaugguucguucuguu

SEQ ID NO: 3771627 - RNA, 23 nt, Human
ugugaugguucguucuguuuaca

SEQ ID NO: 3771628 - RNA, 14 nt, Human
ugugauguauucua

SEQ ID NO: 3771629 - RNA, 18 nt, Human
ugugaugucauacagaga

SEQ ID NO: 3771630 - RNA, 19 nt, Human
ugugaugucauacagagaa

SEQ ID NO: 3771631 - RNA, 20 nt, Human
ugugaugucauacagagaag

SEQ ID NO: 3771632 - RNA, 17 nt, Human
ugugaugugacauuugu

SEQ ID NO: 3771633 - RNA, 13 nt, Human
ugugauguucuaa

SEQ ID NO: 3771634 - RNA, 16 nt, Human
ugugauguucuaaggc

SEQ ID NO: 3771635 - RNA, 16 nt, Human
ugugauuagacagaac

SEQ ID NO: 3771636 - RNA, 15 nt, Human
ugugauuauuucacu

SEQ ID NO: 3771637 - RNA, 15 nt, Human
ugugauucaaucugu

SEQ ID NO: 3771638 - RNA, 20 nt, Human
ugugauucaaucuguaaacu

SEQ ID NO: 3771639 - RNA, 22 nt, Human
ugugauuccacuacaccuggcu

SEQ ID NO: 3771640 - RNA, 20 nt, Human
ugugauuccuuugaagagga

SEQ ID NO: 3771641 - RNA, 14 nt, Human
ugugauucuaaugu

SEQ ID NO: 3771642 - RNA, 19 nt, Human
ugugauucuuccagaugug

SEQ ID NO: 3771643 - RNA, 16 nt, Human
ugugauugacagcuuu

SEQ ID NO: 3771644 - RNA, 19 nt, Human
ugugauugggaauaaauau

SEQ ID NO: 3771645 - RNA, 20 nt, Human
ugugauugggaauaaauaug

SEQ ID NO: 3771646 - RNA, 14 nt, Human
ugugauuguggaau

SEQ ID NO: 3771647 - RNA, 19 nt, Human
ugugauuuaauaguguuaa

SEQ ID NO: 3771648 - RNA, 15 nt, Human
ugugauuucccgugg

SEQ ID NO: 3771649 - RNA, 23 nt, Human
ugugauuucccguggccccagcc

SEQ ID NO: 3771650 - RNA, 24 nt, Human
ugugauuucccguggccccagccu

SEQ ID NO: 3771651 - RNA, 12 nt, Human
ugugauuugacu

SEQ ID NO: 3771652 - RNA, 16 nt, Human
ugugauuuuaacucug

SEQ ID NO: 3771653 - RNA, 19 nt, Human
ugugauuuuaacucugucu

SEQ ID NO: 3771654 - RNA, 19 nt, Human
ugugauuuuugguauuuga

SEQ ID NO: 3771655 - RNA, 21 nt, Human
ugugauuuuugguauuugaaa

SEQ ID NO: 3771656 - RNA, 15 nt, Human
ugugcaaaaauuuuu

SEQ ID NO: 3771657 - RNA, 20 nt, Human
ugugcaaaaccuuuuacugg

SEQ ID NO: 3771658 - RNA, 18 nt, Human
ugugcaacaggguaugga

SEQ ID NO: 3771659 - RNA, 20 nt, Human
ugugcaacaggguauggacu

SEQ ID NO: 3771660 - RNA, 19 nt, Human
ugugcaacgccgugggcug

SEQ ID NO: 3771661 - RNA, 18 nt, Human
ugugcaagcuuuuccuaa

SEQ ID NO: 3771662 - RNA, 19 nt, Human
ugugcaagcuuuuccuaau

SEQ ID NO: 3771663 - RNA, 18 nt, Human
ugugcaagguauuacacu

SEQ ID NO: 3771664 - RNA, 15 nt, Human
ugugcaagugucugu

SEQ ID NO: 3771665 - RNA, 19 nt, Human
ugugcaagugucugugugc

SEQ ID NO: 3771666 - RNA, 20 nt, Human
ugugcaagugucugugugca

SEQ ID NO: 3771667 - RNA, 14 nt, Human
ugugcaauguguau

SEQ ID NO: 3771668 - RNA, 22 nt, Human
ugugcacacacaccacacauac

SEQ ID NO: 3771669 - RNA, 22 nt, Human
ugugcacauccgcgugugccug

SEQ ID NO: 3771670 - RNA, 23 nt, Human
ugugcacauccgcgugugccugu

SEQ ID NO: 3771671 - RNA, 15 nt, Human
ugugcacaucucugc

SEQ ID NO: 3771672 - RNA, 19 nt, Human
ugugcacaucucugcuuga

SEQ ID NO: 3771673 - RNA, 17 nt, Human
ugugcacaucugugucu

SEQ ID NO: 3771674 - RNA, 17 nt, Human
ugugcacaucuguuuug

SEQ ID NO: 3771675 - RNA, 16 nt, Human
ugugcacaugcacgug

SEQ ID NO: 3771676 - RNA, 13 nt, Human
ugugcaccagggu

SEQ ID NO: 3771677 - RNA, 21 nt, Human
ugugcaccuuaccaacuuucu

SEQ ID NO: 3771678 - RNA, 22 nt, Human
ugugcaccuuaccaacuuucug

SEQ ID NO: 3771679 - RNA, 23 nt, Human
ugugcacgcagauuagcaggcca

SEQ ID NO: 3771680 - RNA, 21 nt, Human
ugugcacugcccauggacagg

SEQ ID NO: 3771681 - RNA, 14 nt, Human
ugugcacugucacu

SEQ ID NO: 3771682 - RNA, 19 nt, Human
ugugcagacucaauaaaau

SEQ ID NO: 3771683 - RNA, 15 nt, Human
ugugcagagcugaag

SEQ ID NO: 3771684 - RNA, 17 nt, Human
ugugcagcagauuggaa

SEQ ID NO: 3771685 - RNA, 17 nt, Human
ugugcagcauuucacuu

SEQ ID NO: 3771686 - RNA, 23 nt, Human
ugugcagccccgccuccaggcca

SEQ ID NO: 3771687 - RNA, 22 nt, Human
ugugcagccuguccugggcugg

SEQ ID NO: 3771688 - RNA, 17 nt, Human
ugugcagcuuuugguca

SEQ ID NO: 3771689 - RNA, 18 nt, Human
ugugcaggagcggcagau

SEQ ID NO: 3771690 - RNA, 19 nt, Human
ugugcaggugcuauuguua

SEQ ID NO: 3771691 - RNA, 16 nt, Human
ugugcagguggggaga

SEQ ID NO: 3771692 - RNA, 14 nt, Human
ugugcaguaacuug

SEQ ID NO: 3771693 - RNA, 19 nt, Human
ugugcaguaauagcacugc

SEQ ID NO: 3771694 - RNA, 12 nt, Human
ugugcaguguug

SEQ ID NO: 3771695 - RNA, 15 nt, Human
ugugcauagugcugg

SEQ ID NO: 3771696 - RNA, 17 nt, Human
ugugcauagugcuggga

SEQ ID NO: 3771697 - RNA, 14 nt, Human
ugugcauaguuucu

SEQ ID NO: 3771698 - RNA, 19 nt, Human
ugugcauauuguacacuuu

SEQ ID NO: 3771699 - RNA, 15 nt, Human
ugugcauguguguau

SEQ ID NO: 3771700 - RNA, 16 nt, Human
ugugcauguguguaua

SEQ ID NO: 3771701 - RNA, 15 nt, Human
ugugcaugugugugc

SEQ ID NO: 3771702 - RNA, 23 nt, Human
ugugcauuaucuagauacuguau

SEQ ID NO: 3771703 - RNA, 15 nt, Human
ugugcauucuggauu

SEQ ID NO: 3771704 - RNA, 22 nt, Human
ugugcauucuuuuaaaagacaa

SEQ ID NO: 3771705 - RNA, 13 nt, Human
ugugcauuuucua

SEQ ID NO: 3771706 - RNA, 19 nt, Human
ugugcauuuucuaaacaga

SEQ ID NO: 3771707 - RNA, 20 nt, Human
ugugccacaacgccuggcua

SEQ ID NO: 3771708 - RNA, 12 nt, Human
ugugccacaggc

SEQ ID NO: 3771709 - RNA, 21 nt, Human
ugugccacccugggcucugug

SEQ ID NO: 3771710 - RNA, 22 nt, Human
ugugccacccugggcucugugg

SEQ ID NO: 3771711 - RNA, 21 nt, Human
ugugccacuaaacuacauugu

SEQ ID NO: 3771712 - RNA, 20 nt, Human
ugugccagagaacccagccc

SEQ ID NO: 3771713 - RNA, 23 nt, Human
ugugccagagaacccagcccacc

SEQ ID NO: 3771714 - RNA, 16 nt, Human
ugugccagagccuggg

SEQ ID NO: 3771715 - RNA, 20 nt, Human
ugugccagagccuggggcuc

SEQ ID NO: 3771716 - RNA, 21 nt, Human
ugugccagagccuggggcucu

SEQ ID NO: 3771717 - RNA, 23 nt, Human
ugugccagaggaauccuggcagc

SEQ ID NO: 3771718 - RNA, 18 nt, Human
ugugccagauuuaugcau

SEQ ID NO: 3771719 - RNA, 20 nt, Human
ugugccagauuuaugcauau

SEQ ID NO: 3771720 - RNA, 21 nt, Human
ugugccagggcaaugaugaau

SEQ ID NO: 3771721 - RNA, 20 nt, Human
ugugccauagaguuuaacac

SEQ ID NO: 3771722 - RNA, 17 nt, Human
ugugcccacaucccagg

SEQ ID NO: 3771723 - RNA, 23 nt, Human
ugugcccacccuccacucuccuc

SEQ ID NO: 3771724 - RNA, 21 nt, Human
ugugcccagaauacugaugga

SEQ ID NO: 3771725 - RNA, 13 nt, Human
ugugcccagcuca

SEQ ID NO: 3771726 - RNA, 15 nt, Human
ugugcccagcucagu

SEQ ID NO: 3771727 - RNA, 21 nt, Human
ugugcccaguuaaucuugcuu

SEQ ID NO: 3771728 - RNA, 18 nt, Human
ugugcccaugggcacugc

SEQ ID NO: 3771729 - RNA, 22 nt, Human
ugugcccaugggcacugcuggg

SEQ ID NO: 3771730 - RNA, 14 nt, Human
ugugccccaugccu

SEQ ID NO: 3771731 - RNA, 23 nt, Human
ugugcccccaaccauuuccucag

SEQ ID NO: 3771732 - RNA, 22 nt, Human
ugugccccccauccuggcccau

SEQ ID NO: 3771733 - RNA, 14 nt, Human
ugugcccccucuac

SEQ ID NO: 3771734 - RNA, 13 nt, Human
ugugcccuccuga

SEQ ID NO: 3771735 - RNA, 17 nt, Human
ugugcccuccugaccca

SEQ ID NO: 3771736 - RNA, 23 nt, Human
ugugcccuccugacccauugcug

SEQ ID NO: 3771737 - RNA, 21 nt, Human
ugugcccucugggcucugagu

SEQ ID NO: 3771738 - RNA, 15 nt, Human
ugugccgaaugugca

SEQ ID NO: 3771739 - RNA, 18 nt, Human
ugugccuaauguguuuga

SEQ ID NO: 3771740 - RNA, 22 nt, Human
ugugccuauugcuagagcuccu

SEQ ID NO: 3771741 - RNA, 15 nt, Human
ugugccuccucccuc

SEQ ID NO: 3771742 - RNA, 16 nt, Human
ugugccuccucccucc

SEQ ID NO: 3771743 - RNA, 13 nt, Human
ugugccucugccu

SEQ ID NO: 3771744 - RNA, 15 nt, Human
ugugccugacccuac

SEQ ID NO: 3771745 - RNA, 14 nt, Human
ugugccugcaccag

SEQ ID NO: 3771746 - RNA, 16 nt, Human
ugugccugcaccagga

SEQ ID NO: 3771747 - RNA, 17 nt, Human
ugugccugcaccaggag

SEQ ID NO: 3771748 - RNA, 18 nt, Human
ugugccugcaccaggaga

SEQ ID NO: 3771749 - RNA, 13 nt, Human
ugugccugcagcc

SEQ ID NO: 3771750 - RNA, 13 nt, Human
ugugccuggagcu

SEQ ID NO: 3771751 - RNA, 17 nt, Human
ugugccuggagcuccug

SEQ ID NO: 3771752 - RNA, 18 nt, Human
ugugccuggagcuccugg

SEQ ID NO: 3771753 - RNA, 19 nt, Human
ugugccuggagcuccuggg

SEQ ID NO: 3771754 - RNA, 22 nt, Human
ugugccuggcuucuuucucuca

SEQ ID NO: 3771755 - RNA, 23 nt, Human
ugugccuggcuucuuucucucag

SEQ ID NO: 3771756 - RNA, 13 nt, Human
ugugccuggggga

SEQ ID NO: 3771757 - RNA, 14 nt, Human
ugugccuucgucuu

SEQ ID NO: 3771758 - RNA, 20 nt, Human
ugugccuugucacgccagac

SEQ ID NO: 3771759 - RNA, 14 nt, Human
ugugccuuuuuuau

SEQ ID NO: 3771760 - RNA, 19 nt, Human
ugugcgcauaggccugcuu

SEQ ID NO: 3771761 - RNA, 22 nt, Human
ugugcgcauaggccugcuuugu

SEQ ID NO: 3771762 - RNA, 15 nt, Human
ugugcggugcauaca

SEQ ID NO: 3771763 - RNA, 20 nt, Human
ugugcguaugcaguguagau

SEQ ID NO: 3771764 - RNA, 22 nt, Human
ugugcguggggcucccgccucc

SEQ ID NO: 3771765 - RNA, 21 nt, Human
ugugcgugguggucccugggu

SEQ ID NO: 3771766 - RNA, 22 nt, Human
ugugcgugguggucccugggua

SEQ ID NO: 3771767 - RNA, 20 nt, Human
ugugcguguguccaugugug

SEQ ID NO: 3771768 - RNA, 21 nt, Human
ugugcuaaacguguauguuuu

SEQ ID NO: 3771769 - RNA, 22 nt, Human
ugugcuaaacguguauguuuuu

SEQ ID NO: 3771770 - RNA, 14 nt, Human
ugugcuaaauauca

SEQ ID NO: 3771771 - RNA, 23 nt, Human
ugugcuaaccacgucugucuuca

SEQ ID NO: 3771772 - RNA, 14 nt, Human
ugugcuacagauga

SEQ ID NO: 3771773 - RNA, 18 nt, Human
ugugcuacaggggccaga

SEQ ID NO: 3771774 - RNA, 13 nt, Human
ugugcuagaugug

SEQ ID NO: 3771775 - RNA, 20 nt, Human
ugugcuagggaaacuucccg

SEQ ID NO: 3771776 - RNA, 18 nt, Human
ugugcuauacugcauacu

SEQ ID NO: 3771777 - RNA, 20 nt, Human
ugugcuauacugcauacuuu

SEQ ID NO: 3771778 - RNA, 14 nt, Human
ugugcuaugaauuu

SEQ ID NO: 3771779 - RNA, 18 nt, Human
ugugcuauggugcucugu

SEQ ID NO: 3771780 - RNA, 21 nt, Human
ugugcucagaauuauuaauua

SEQ ID NO: 3771781 - RNA, 16 nt, Human
ugugcucaggagcccu

SEQ ID NO: 3771782 - RNA, 22 nt, Human
ugugcucaugcauugcuugugu

SEQ ID NO: 3771783 - RNA, 17 nt, Human
ugugcuccccuuugccu

SEQ ID NO: 3771784 - RNA, 14 nt, Human
ugugcuccgugccu

SEQ ID NO: 3771785 - RNA, 16 nt, Human
ugugcuccuccuuggu

SEQ ID NO: 3771786 - RNA, 16 nt, Human
ugugcucucaccagcu

SEQ ID NO: 3771787 - RNA, 12 nt, Human
ugugcucugauc

SEQ ID NO: 3771788 - RNA, 18 nt, Human
ugugcucuggacaggcau

SEQ ID NO: 3771789 - RNA, 21 nt, Human
ugugcugaggccuuaucauuc

SEQ ID NO: 3771790 - RNA, 20 nt, Human
ugugcugaucauuugaggaa

SEQ ID NO: 3771791 - RNA, 13 nt, Human
ugugcugcagugc

SEQ ID NO: 3771792 - RNA, 16 nt, Human
ugugcugcccugaaga

SEQ ID NO: 3771793 - RNA, 14 nt, Human
ugugcugcccugcc

SEQ ID NO: 3771794 - RNA, 15 nt, Human
ugugcugcccugccc

SEQ ID NO: 3771795 - RNA, 18 nt, Human
ugugcugcccugcccacc

SEQ ID NO: 3771796 - RNA, 19 nt, Human
ugugcugcccugcccaccu

SEQ ID NO: 3771797 - RNA, 18 nt, Human
ugugcugcuguaagaaau

SEQ ID NO: 3771798 - RNA, 18 nt, Human
ugugcugcuuugauauau

SEQ ID NO: 3771799 - RNA, 20 nt, Human
ugugcuggagccacuaacua

SEQ ID NO: 3771800 - RNA, 10 nt, Human
ugugcuggga

SEQ ID NO: 3771801 - RNA, 18 nt, Human
ugugcugggagaaauacu

SEQ ID NO: 3771802 - RNA, 23 nt, Human
ugugcugggggaaugagcccaga

SEQ ID NO: 3771803 - RNA, 24 nt, Human
ugugcugggggaaugagcccagag

SEQ ID NO: 3771804 - RNA, 18 nt, Human
ugugcugggguuaucuga

SEQ ID NO: 3771805 - RNA, 12 nt, Human
ugugcuguaauu

SEQ ID NO: 3771806 - RNA, 17 nt, Human
ugugcugugcccaaguu

SEQ ID NO: 3771807 - RNA, 20 nt, Human
ugugcuguggggcugguagc

SEQ ID NO: 3771808 - RNA, 17 nt, Human
ugugcugugguuccugg

SEQ ID NO: 3771809 - RNA, 16 nt, Human
ugugcuguguaaaguu

SEQ ID NO: 3771810 - RNA, 12 nt, Human
ugugcugugugu

SEQ ID NO: 3771811 - RNA, 15 nt, Human
ugugcuguguuugcu

SEQ ID NO: 3771812 - RNA, 21 nt, Human
ugugcuguguuugcuccccuu

SEQ ID NO: 3771813 - RNA, 19 nt, Human
ugugcuguuguuaugaugu

SEQ ID NO: 3771814 - RNA, 19 nt, Human
ugugcuuaacagggaacgu

SEQ ID NO: 3771815 - RNA, 15 nt, Human
ugugcuucacaguag

SEQ ID NO: 3771816 - RNA, 22 nt, Human
ugugcuucacaguagagccagc

SEQ ID NO: 3771817 - RNA, 19 nt, Human
ugugcuucgggcccuuccc

SEQ ID NO: 3771818 - RNA, 21 nt, Human
ugugcuucuaauauuuauugc

SEQ ID NO: 3771819 - RNA, 15 nt, Human
ugugcuugaaggccc

SEQ ID NO: 3771820 - RNA, 17 nt, Human
ugugcuugaaggcccug

SEQ ID NO: 3771821 - RNA, 18 nt, Human
ugugcuuggucuguuuga

SEQ ID NO: 3771822 - RNA, 23 nt, Human
ugugcuuguuuacagcacuacuc

SEQ ID NO: 3771823 - RNA, 14 nt, Human
ugugcuuguuuuau

SEQ ID NO: 3771824 - RNA, 19 nt, Human
ugugcuuuaugcugaaaca

SEQ ID NO: 3771825 - RNA, 20 nt, Human
ugugcuuuccagcucacccc

SEQ ID NO: 3771826 - RNA, 14 nt, Human
ugugcuuugagaag

SEQ ID NO: 3771827 - RNA, 17 nt, Human
ugugcuuugcauuccua

SEQ ID NO: 3771828 - RNA, 18 nt, Human
ugugcuuugcucuugucc

SEQ ID NO: 3771829 - RNA, 16 nt, Human
ugugcuuuuaaaugca

SEQ ID NO: 3771830 - RNA, 20 nt, Human
uguggaaaagaaacacgcac

SEQ ID NO: 3771831 - RNA, 21 nt, Human
uguggaaaagccaagaggcug

SEQ ID NO: 3771832 - RNA, 19 nt, Human
uguggaaagccucugcugc

SEQ ID NO: 3771833 - RNA, 20 nt, Human
uguggaaagccucugcugcc

SEQ ID NO: 3771834 - RNA, 16 nt, Human
uguggaaagugaauuu

SEQ ID NO: 3771835 - RNA, 19 nt, Human
uguggaaagugaauuugaa

SEQ ID NO: 3771836 - RNA, 22 nt, Human
uguggaaagugaauuugaauga

SEQ ID NO: 3771837 - RNA, 23 nt, Human
uguggaaagugaauuugaaugaa

SEQ ID NO: 3771838 - RNA, 12 nt, Human
uguggaaagugu

SEQ ID NO: 3771839 - RNA, 16 nt, Human
uguggaaaguguaaag

SEQ ID NO: 3771840 - RNA, 20 nt, Human
uguggaaaguguaaagcauu

SEQ ID NO: 3771841 - RNA, 21 nt, Human
uguggaaaguguaaagcauuc

SEQ ID NO: 3771842 - RNA, 19 nt, Human
uguggaaauuaagaagaaa

SEQ ID NO: 3771843 - RNA, 21 nt, Human
uguggaacauaaaaaggacau

SEQ ID NO: 3771844 - RNA, 21 nt, Human
uguggaacccagcaguucugu

SEQ ID NO: 3771845 - RNA, 20 nt, Human
uguggaacuaauaaauacau

SEQ ID NO: 3771846 - RNA, 17 nt, Human
uguggaacugcugccac

SEQ ID NO: 3771847 - RNA, 18 nt, Human
uguggaacugcugccacu

SEQ ID NO: 3771848 - RNA, 19 nt, Human
uguggaagaaaaugguuua

SEQ ID NO: 3771849 - RNA, 20 nt, Human
uguggaagaaaaugguuuau

SEQ ID NO: 3771850 - RNA, 19 nt, Human
uguggaaggcaagccaggc

SEQ ID NO: 3771851 - RNA, 18 nt, Human
uguggaaucuggagugag

SEQ ID NO: 3771852 - RNA, 15 nt, Human
uguggaccaauuauu

SEQ ID NO: 3771853 - RNA, 17 nt, Human
uguggaccacugcauga

SEQ ID NO: 3771854 - RNA, 21 nt, Human
uguggaccauggaguggcagc

SEQ ID NO: 3771855 - RNA, 15 nt, Human
uguggacuaaaagau

SEQ ID NO: 3771856 - RNA, 23 nt, Human
uguggagaaacuguagucucagg

SEQ ID NO: 3771857 - RNA, 19 nt, Human
uguggagaagccacaggcc

SEQ ID NO: 3771858 - RNA, 24 nt, Human
uguggagacaaugucugcagcccu

SEQ ID NO: 3771859 - RNA, 13 nt, Human
uguggagccaggc

SEQ ID NO: 3771860 - RNA, 15 nt, Human
uguggagccaggcgu

SEQ ID NO: 3771861 - RNA, 16 nt, Human
uguggagcccgcaccc

SEQ ID NO: 3771862 - RNA, 16 nt, Human
uguggagccgaggccu

SEQ ID NO: 3771863 - RNA, 12 nt, Human
uguggaggaagg

SEQ ID NO: 3771864 - RNA, 16 nt, Human
uguggaggaaggauug

SEQ ID NO: 3771865 - RNA, 20 nt, Human
uguggaggaaggauuguaaa

SEQ ID NO: 3771866 - RNA, 18 nt, Human
uguggaggcagugucauu

SEQ ID NO: 3771867 - RNA, 13 nt, Human
uguggagggcaca

SEQ ID NO: 3771868 - RNA, 18 nt, Human
uguggagucauuucugau

SEQ ID NO: 3771869 - RNA, 19 nt, Human
uguggaucaaccaucgcuu

SEQ ID NO: 3771870 - RNA, 14 nt, Human
uguggauccaaugu

SEQ ID NO: 3771871 - RNA, 15 nt, Human
uguggauccaauguu

SEQ ID NO: 3771872 - RNA, 16 nt, Human
uguggaucuuuucauu

SEQ ID NO: 3771873 - RNA, 19 nt, Human
uguggaugaucaauccuuu

SEQ ID NO: 3771874 - RNA, 22 nt, Human
uguggauuuuuuccuucaaagu

SEQ ID NO: 3771875 - RNA, 22 nt, Human
uguggcaaagccuucauugccu

SEQ ID NO: 3771876 - RNA, 15 nt, Human
uguggcaagugaauu

SEQ ID NO: 3771877 - RNA, 17 nt, Human
uguggcaaucugugggc

SEQ ID NO: 3771878 - RNA, 19 nt, Human
uguggcacuggggcagggg

SEQ ID NO: 3771879 - RNA, 16 nt, Human
uguggcacuugccugg

SEQ ID NO: 3771880 - RNA, 23 nt, Human
uguggcagagagagagaaagaga

SEQ ID NO: 3771881 - RNA, 14 nt, Human
uguggcagaguuac

SEQ ID NO: 3771882 - RNA, 20 nt, Human
uguggcagaguuacaguucu

SEQ ID NO: 3771883 - RNA, 16 nt, Human
uguggcagcaggcagc

SEQ ID NO: 3771884 - RNA, 14 nt, Human
uguggcaggcagcg

SEQ ID NO: 3771885 - RNA, 20 nt, Human
uguggcagggguuagagcag

SEQ ID NO: 3771886 - RNA, 23 nt, Human
uguggcagggguuagagcaggac

SEQ ID NO: 3771887 - RNA, 18 nt, Human
uguggcaguaaagagaaa

SEQ ID NO: 3771888 - RNA, 20 nt, Human
uguggcaguaaagagaaacu

SEQ ID NO: 3771889 - RNA, 15 nt, Human
uguggcagugguuuu

SEQ ID NO: 3771890 - RNA, 23 nt, Human
uguggcaguuuggcaaacucucc

SEQ ID NO: 3771891 - RNA, 19 nt, Human
uguggcauccagagucccu

SEQ ID NO: 3771892 - RNA, 21 nt, Human
uguggcauccagagucccugc

SEQ ID NO: 3771893 - RNA, 21 nt, Human
uguggcaucuuugccuugggc

SEQ ID NO: 3771894 - RNA, 17 nt, Human
uguggcaugggugaaga

SEQ ID NO: 3771895 - RNA, 16 nt, Human
uguggccaaaggaggg

SEQ ID NO: 3771896 - RNA, 21 nt, Human
uguggccaaggagcugcuaua

SEQ ID NO: 3771897 - RNA, 13 nt, Human
uguggccaggagg

SEQ ID NO: 3771898 - RNA, 12 nt, Human
uguggccccuuc

SEQ ID NO: 3771899 - RNA, 13 nt, Human
uguggccccuuca

SEQ ID NO: 3771900 - RNA, 20 nt, Human
uguggcccucucccuuaccc

SEQ ID NO: 3771901 - RNA, 18 nt, Human
caccaugauggggcccua

SEQ ID NO: 3771902 - RNA, 20 nt, Human
caccauggcuaaggcaccag

SEQ ID NO: 3771903 - RNA, 16 nt, Human
caccaugggauuaaua

SEQ ID NO: 3771904 - RNA, 18 nt, Human
caccaugggguccuacca

SEQ ID NO: 3771905 - RNA, 23 nt, Human
caccaugggguccuaccaauaga

SEQ ID NO: 3771906 - RNA, 18 nt, Human
caccauguaaaacaaaaa

SEQ ID NO: 3771907 - RNA, 21 nt, Human
caccauguaaaacaaaaaaca

SEQ ID NO: 3771908 - RNA, 15 nt, Human
caccauguauuuugu

SEQ ID NO: 3771909 - RNA, 17 nt, Human
caccaugugagcucuuc

SEQ ID NO: 3771910 - RNA, 19 nt, Human
caccauguuggccaggcug

SEQ ID NO: 3771911 - RNA, 20 nt, Human
caccauguuggccaggcugc

SEQ ID NO: 3771912 - RNA, 19 nt, Human
caccauguuugagcucaga

SEQ ID NO: 3771913 - RNA, 18 nt, Human
caccauuauaaugaauuu

SEQ ID NO: 3771914 - RNA, 23 nt, Human
caccauucguacauaauacugaa

SEQ ID NO: 3771915 - RNA, 15 nt, Human
caccauugaacugua

SEQ ID NO: 3771916 - RNA, 15 nt, Human
caccauugaaggcuu

SEQ ID NO: 3771917 - RNA, 16 nt, Human
caccauugaaggcuua

SEQ ID NO: 3771918 - RNA, 17 nt, Human
caccauuuccccagggc

SEQ ID NO: 3771919 - RNA, 20 nt, Human
caccauuuggcaucccuggg

SEQ ID NO: 3771920 - RNA, 14 nt, Human
cacccaaaagucaa

SEQ ID NO: 3771921 - RNA, 23 nt, Human
cacccaaaagucaaaaggugccu

SEQ ID NO: 3771922 - RNA, 20 nt, Human
cacccaaaccggcaggugcg

SEQ ID NO: 3771923 - RNA, 15 nt, Human
cacccaaagcugagc

SEQ ID NO: 3771924 - RNA, 16 nt, Human
cacccaaagcugagcc

SEQ ID NO: 3771925 - RNA, 18 nt, Human
cacccaaagcugagccug

SEQ ID NO: 3771926 - RNA, 22 nt, Human
cacccaaagcugagccugcagg

SEQ ID NO: 3771927 - RNA, 24 nt, Human
cacccaacccuaucuccugacaga

SEQ ID NO: 3771928 - RNA, 16 nt, Human
cacccaagggccuggc

SEQ ID NO: 3771929 - RNA, 20 nt, Human
cacccaagggccuggccuga

SEQ ID NO: 3771930 - RNA, 17 nt, Human
cacccaauucaaaacau

SEQ ID NO: 3771931 - RNA, 14 nt, Human
cacccaauuccacu

SEQ ID NO: 3771932 - RNA, 17 nt, Human
cacccaauuccacucug

SEQ ID NO: 3771933 - RNA, 20 nt, Human
cacccacaagugccacugcc

SEQ ID NO: 3771934 - RNA, 17 nt, Human
cacccacacacucgccc

SEQ ID NO: 3771935 - RNA, 21 nt, Human
cacccacacacucgcccgccc

SEQ ID NO: 3771936 - RNA, 23 nt, Human
cacccacacacucgcccgcccac

SEQ ID NO: 3771937 - RNA, 13 nt, Human
cacccacauguga

SEQ ID NO: 3771938 - RNA, 20 nt, Human
cacccaccaucaugucuggc

SEQ ID NO: 3771939 - RNA, 14 nt, Human
cacccaccccugca

SEQ ID NO: 3771940 - RNA, 13 nt, Human
cacccacccuggg

SEQ ID NO: 3771941 - RNA, 15 nt, Human
cacccacccuuuuuu

SEQ ID NO: 3771942 - RNA, 22 nt, Human
cacccaccguccgcccugcucc

SEQ ID NO: 3771943 - RNA, 16 nt, Human
cacccaccguggagga

SEQ ID NO: 3771944 - RNA, 16 nt, Human
cacccaccucagccuc

SEQ ID NO: 3771945 - RNA, 18 nt, Human
cacccaccucccugccuc

SEQ ID NO: 3771946 - RNA, 15 nt, Human
cacccacuucugcac

SEQ ID NO: 3771947 - RNA, 11 nt, Human
cacccagaaac

SEQ ID NO: 3771948 - RNA, 21 nt, Human
cacccagacauaaaggaaaag

SEQ ID NO: 3771949 - RNA, 18 nt, Human
cacccagcaacuccaacu

SEQ ID NO: 3771950 - RNA, 16 nt, Human
cacccagcaauagaga

SEQ ID NO: 3771951 - RNA, 10 nt, Human
cacccagccc

SEQ ID NO: 3771952 - RNA, 11 nt, Human
cacccagccca

SEQ ID NO: 3771953 - RNA, 12 nt, Human
cacccagcccac

SEQ ID NO: 3771954 - RNA, 19 nt, Human
cacccagcccacuucugcc

SEQ ID NO: 3771955 - RNA, 16 nt, Human
cacccagcccagauug

SEQ ID NO: 3771956 - RNA, 19 nt, Human
cacccagccccagccaggg

SEQ ID NO: 3771957 - RNA, 12 nt, Human
cacccagcccug

SEQ ID NO: 3771958 - RNA, 22 nt, Human
cacccagcccuggucucagcag

SEQ ID NO: 3771959 - RNA, 13 nt, Human
cacccagccucag

SEQ ID NO: 3771960 - RNA, 15 nt, Human
cacccagccucaguc

SEQ ID NO: 3771961 - RNA, 14 nt, Human
cacccagcucagca

SEQ ID NO: 3771962 - RNA, 23 nt, Human
cacccaggagccccgaggccuuc

SEQ ID NO: 3771963 - RNA, 20 nt, Human
cacccaggcuggacugcaau

SEQ ID NO: 3771964 - RNA, 14 nt, Human
cacccaggggcagc

SEQ ID NO: 3771965 - RNA, 19 nt, Human
cacccaguccugcccgcca

SEQ ID NO: 3771966 - RNA, 18 nt, Human
cacccagucucugcucca

SEQ ID NO: 3771967 - RNA, 23 nt, Human
cacccagugagcacucccaaguc

SEQ ID NO: 3771968 - RNA, 23 nt, Human
cacccagugcccucuccccucag

SEQ ID NO: 3771969 - RNA, 22 nt, Human
cacccaguuuccuugggaguug

SEQ ID NO: 3771970 - RNA, 17 nt, Human
cacccauaauccuuucu

SEQ ID NO: 3771971 - RNA, 11 nt, Human
cacccaucugu

SEQ ID NO: 3771972 - RNA, 18 nt, Human
cacccaucugucugccaa

SEQ ID NO: 3771973 - RNA, 15 nt, Human
cacccaugaaucaaa

SEQ ID NO: 3771974 - RNA, 13 nt, Human
cacccaugguacc

SEQ ID NO: 3771975 - RNA, 18 nt, Human
caccccaaagcuuuccug

SEQ ID NO: 3771976 - RNA, 21 nt, Human
caccccaaccugcucuccucu

SEQ ID NO: 3771977 - RNA, 22 nt, Human
caccccaaccugcucuccucuu

SEQ ID NO: 3771978 - RNA, 12 nt, Human
caccccaagaga

SEQ ID NO: 3771979 - RNA, 19 nt, Human
caccccaauccucccagaa

SEQ ID NO: 3771980 - RNA, 12 nt, Human
caccccacacuu

SEQ ID NO: 3771981 - RNA, 21 nt, Human
caccccacccacuucugcacu

SEQ ID NO: 3771982 - RNA, 13 nt, Human
caccccacccccu

SEQ ID NO: 3771983 - RNA, 20 nt, Human
caccccacccucccuggagu

SEQ ID NO: 3771984 - RNA, 14 nt, Human
caccccacccuucc

SEQ ID NO: 3771985 - RNA, 16 nt, Human
caccccaccucuuccu

SEQ ID NO: 3771986 - RNA, 15 nt, Human
caccccaccugcgcu

SEQ ID NO: 3771987 - RNA, 18 nt, Human
caccccacgccuuauccc

SEQ ID NO: 3771988 - RNA, 14 nt, Human
caccccacucacag

SEQ ID NO: 3771989 - RNA, 15 nt, Human
caccccacucccaca

SEQ ID NO: 3771990 - RNA, 19 nt, Human
caccccacuuaucccucuc

SEQ ID NO: 3771991 - RNA, 19 nt, Human
caccccagagccacacaug

SEQ ID NO: 3771992 - RNA, 11 nt, Human
caccccagccu

SEQ ID NO: 3771993 - RNA, 17 nt, Human
caccccaggacgccacu

SEQ ID NO: 3771994 - RNA, 18 nt, Human
caccccaggacgccacuc

SEQ ID NO: 3771995 - RNA, 13 nt, Human
caccccaggacuc

SEQ ID NO: 3771996 - RNA, 22 nt, Human
caccccagggcagccagggaga

SEQ ID NO: 3771997 - RNA, 15 nt, Human
caccccagggccuga

SEQ ID NO: 3771998 - RNA, 16 nt, Human
caccccagggccugag

SEQ ID NO: 3771999 - RNA, 20 nt, Human
caccccagugcacccacucu

SEQ ID NO: 3772000 - RNA, 15 nt, Human
caccccaugcuggcc

SEQ ID NO: 3772001 - RNA, 15 nt, Human
caccccauggccggc

SEQ ID NO: 3772002 - RNA, 17 nt, Human
caccccauuuucugugg

SEQ ID NO: 3772003 - RNA, 19 nt, Human
cacccccaaggggcagucu

SEQ ID NO: 3772004 - RNA, 12 nt, Human
cacccccaaggu

SEQ ID NO: 3772005 - RNA, 11 nt, Human
cacccccaccc

SEQ ID NO: 3772006 - RNA, 22 nt, Human
cacccccacccaagggccuggc

SEQ ID NO: 3772007 - RNA, 17 nt, Human
cacccccacccccagcu

SEQ ID NO: 3772008 - RNA, 21 nt, Human
cacccccagccccgacuccag

SEQ ID NO: 3772009 - RNA, 14 nt, Human
cacccccagccugg

SEQ ID NO: 3772010 - RNA, 17 nt, Human
cacccccagcugcuugu

SEQ ID NO: 3772011 - RNA, 13 nt, Human
caccccccacacu

SEQ ID NO: 3772012 - RNA, 23 nt, Human
caccccccacacucacuccugag

SEQ ID NO: 3772013 - RNA, 16 nt, Human
caccccccacucugug

SEQ ID NO: 3772014 - RNA, 16 nt, Human
cacccccgcuggagga

SEQ ID NO: 3772015 - RNA, 18 nt, Human
cacccccggcagcagccc

SEQ ID NO: 3772016 - RNA, 21 nt, Human
cacccccggcagcagccccca

SEQ ID NO: 3772017 - RNA, 20 nt, Human
cacccccucaagccaauccc

SEQ ID NO: 3772018 - RNA, 16 nt, Human
cacccccucccacccc

SEQ ID NO: 3772019 - RNA, 14 nt, Human
cacccccuccccag

SEQ ID NO: 3772020 - RNA, 13 nt, Human
cacccccucccug

SEQ ID NO: 3772021 - RNA, 14 nt, Human
cacccccucccugg

SEQ ID NO: 3772022 - RNA, 23 nt, Human
cacccccucccuggccuguucug

SEQ ID NO: 3772023 - RNA, 13 nt, Human
cacccccugcccu

SEQ ID NO: 3772024 - RNA, 14 nt, Human
cacccccuuccccc

SEQ ID NO: 3772025 - RNA, 16 nt, Human
cacccccuucucugcu

SEQ ID NO: 3772026 - RNA, 15 nt, Human
caccccgaggcccug

SEQ ID NO: 3772027 - RNA, 17 nt, Human
caccccgaggcccugca

SEQ ID NO: 3772028 - RNA, 18 nt, Human
caccccgaggcccugcau

SEQ ID NO: 3772029 - RNA, 19 nt, Human
caccccgaggcccugcaug

SEQ ID NO: 3772030 - RNA, 13 nt, Human
caccccgcucugc

SEQ ID NO: 3772031 - RNA, 14 nt, Human
caccccgcucugca

SEQ ID NO: 3772032 - RNA, 22 nt, Human
caccccgcuguaagcuccuuug

SEQ ID NO: 3772033 - RNA, 13 nt, Human
caccccggcaggc

SEQ ID NO: 3772034 - RNA, 14 nt, Human
caccccggcaggcc

SEQ ID NO: 3772035 - RNA, 15 nt, Human
caccccggcaggccc

SEQ ID NO: 3772036 - RNA, 16 nt, Human
caccccggcaggcccu

SEQ ID NO: 3772037 - RNA, 18 nt, Human
caccccggcaggcccugc

SEQ ID NO: 3772038 - RNA, 18 nt, Human
caccccggcccccugccc

SEQ ID NO: 3772039 - RNA, 18 nt, Human
caccccgggcucucugcu

SEQ ID NO: 3772040 - RNA, 18 nt, Human
caccccggggacccugug

SEQ ID NO: 3772041 - RNA, 17 nt, Human
caccccuaaacuccagg

SEQ ID NO: 3772042 - RNA, 12 nt, Human
caccccucacuc

SEQ ID NO: 3772043 - RNA, 13 nt, Human
caccccucccauu

SEQ ID NO: 3772044 - RNA, 17 nt, Human
caccccucccauuagga

SEQ ID NO: 3772045 - RNA, 13 nt, Human
caccccuccccau

SEQ ID NO: 3772046 - RNA, 22 nt, Human
caccccuccccugcccuagagc

SEQ ID NO: 3772047 - RNA, 12 nt, Human
caccccucucug

SEQ ID NO: 3772048 - RNA, 13 nt, Human
caccccugccccc

SEQ ID NO: 3772049 - RNA, 19 nt, Human
caccccugcccccagcccc

SEQ ID NO: 3772050 - RNA, 24 nt, Human
caccccugcccugggauguccaca

SEQ ID NO: 3772051 - RNA, 15 nt, Human
caccccugccuccac

SEQ ID NO: 3772052 - RNA, 22 nt, Human
caccccugccucccgcccccuu

SEQ ID NO: 3772053 - RNA, 12 nt, Human
caccccuggggg

SEQ ID NO: 3772054 - RNA, 17 nt, Human
caccccugguucucauc

SEQ ID NO: 3772055 - RNA, 21 nt, Human
caccccuguccucacugcucc

SEQ ID NO: 3772056 - RNA, 21 nt, Human
caccccugugcuccgugccuc

SEQ ID NO: 3772057 - RNA, 12 nt, Human
caccccuuagau

SEQ ID NO: 3772058 - RNA, 16 nt, Human
caccccuuauccagga

SEQ ID NO: 3772059 - RNA, 19 nt, Human
caccccuuauccaggacuc

SEQ ID NO: 3772060 - RNA, 20 nt, Human
caccccuuauccaggacucu

SEQ ID NO: 3772061 - RNA, 14 nt, Human
caccccuuccaugu

SEQ ID NO: 3772062 - RNA, 14 nt, Human
caccccuuccccac

SEQ ID NO: 3772063 - RNA, 12 nt, Human
caccccuuccug

SEQ ID NO: 3772064 - RNA, 19 nt, Human
caccccuuccugggcacac

SEQ ID NO: 3772065 - RNA, 14 nt, Human
caccccuuccuguc

SEQ ID NO: 3772066 - RNA, 14 nt, Human
cacccgacuccuca

SEQ ID NO: 3772067 - RNA, 16 nt, Human
cacccgacuccucaaa

SEQ ID NO: 3772068 - RNA, 16 nt, Human
cacccgaggcugccca

SEQ ID NO: 3772069 - RNA, 15 nt, Human
cacccgaugcugcuu

SEQ ID NO: 3772070 - RNA, 13 nt, Human
cacccgccucucc

SEQ ID NO: 3772071 - RNA, 14 nt, Human
cacccgccucuccc

SEQ ID NO: 3772072 - RNA, 19 nt, Human
cacccgcuaagagggaggg

SEQ ID NO: 3772073 - RNA, 12 nt, Human
cacccggccccu

SEQ ID NO: 3772074 - RNA, 18 nt, Human
cacccggccccugcuggu

SEQ ID NO: 3772075 - RNA, 21 nt, Human
cacccggccccugcugguuca

SEQ ID NO: 3772076 - RNA, 20 nt, Human
cacccguucugcuggccugg

SEQ ID NO: 3772077 - RNA, 16 nt, Human
cacccuagcccucucc

SEQ ID NO: 3772078 - RNA, 19 nt, Human
cacccucacucugccaggg

SEQ ID NO: 3772079 - RNA, 20 nt, Human
cacccucagcaccccuucca

SEQ ID NO: 3772080 - RNA, 16 nt, Human
cacccucaugcugugu

SEQ ID NO: 3772081 - RNA, 12 nt, Human
cacccuccaccc

SEQ ID NO: 3772082 - RNA, 14 nt, Human
cacccuccacccug

SEQ ID NO: 3772083 - RNA, 18 nt, Human
cacccuccacccuguccc

SEQ ID NO: 3772084 - RNA, 17 nt, Human
cacccuccaccucuuca

SEQ ID NO: 3772085 - RNA, 15 nt, Human
cacccucccagcucu

SEQ ID NO: 3772086 - RNA, 12 nt, Human
cacccuccccuc

SEQ ID NO: 3772087 - RNA, 16 nt, Human
cacccuccccucucuu

SEQ ID NO: 3772088 - RNA, 22 nt, Human
cacccucccuccgauccuuccu

SEQ ID NO: 3772089 - RNA, 16 nt, Human
cacccucccuggagug

SEQ ID NO: 3772090 - RNA, 14 nt, Human
cacccuccugucuu

SEQ ID NO: 3772091 - RNA, 12 nt, Human
cacccuccuucc

SEQ ID NO: 3772092 - RNA, 20 nt, Human
cacccuccuucccacucuuc

SEQ ID NO: 3772093 - RNA, 19 nt, Human
cacccucgaagcgcgccac

SEQ ID NO: 3772094 - RNA, 17 nt, Human
cacccucguggacaccu

SEQ ID NO: 3772095 - RNA, 18 nt, Human
cacccucguggacaccug

SEQ ID NO: 3772096 - RNA, 21 nt, Human
cacccucguggacaccugccc

SEQ ID NO: 3772097 - RNA, 23 nt, Human
cacccucguggacaccugcccug

SEQ ID NO: 3772098 - RNA, 16 nt, Human
cacccucucccaggac

SEQ ID NO: 3772099 - RNA, 12 nt, Human
cacccucuggcc

SEQ ID NO: 3772100 - RNA, 13 nt, Human
cacccucuggccg

SEQ ID NO: 3772101 - RNA, 15 nt, Human
cacccucuuccuacu

SEQ ID NO: 3772102 - RNA, 21 nt, Human
cacccugaacaacgagccuuu

SEQ ID NO: 3772103 - RNA, 23 nt, Human
cacccugaaugguuccaugccug

SEQ ID NO: 3772104 - RNA, 17 nt, Human
cacccugagccccuucc

SEQ ID NO: 3772105 - RNA, 18 nt, Human
cacccugagccccuuccu

SEQ ID NO: 3772106 - RNA, 12 nt, Human
cacccugagccg

SEQ ID NO: 3772107 - RNA, 15 nt, Human
cacccugaggagucu

SEQ ID NO: 3772108 - RNA, 16 nt, Human
cacccugaggagucug

SEQ ID NO: 3772109 - RNA, 20 nt, Human
cacccugaggucagggagug

SEQ ID NO: 3772110 - RNA, 22 nt, Human
cacccugauuuaggagaagcca

SEQ ID NO: 3772111 - RNA, 17 nt, Human
cacccugauuucuugcu

SEQ ID NO: 3772112 - RNA, 17 nt, Human
cacccugcaaggcccac

SEQ ID NO: 3772113 - RNA, 12 nt, Human
cacccugcuaca

SEQ ID NO: 3772114 - RNA, 11 nt, Human
cacccuggaau

SEQ ID NO: 3772115 - RNA, 11 nt, Human
cacccuggccu

SEQ ID NO: 3772116 - RNA, 16 nt, Human
cacccugggagacaga

SEQ ID NO: 3772117 - RNA, 14 nt, Human
cacccugggcccug

SEQ ID NO: 3772118 - RNA, 17 nt, Human
cacccugggcccugggc

SEQ ID NO: 3772119 - RNA, 22 nt, Human
cacccugggcccugggcuggaa

SEQ ID NO: 3772120 - RNA, 21 nt, Human
cacccugggcucugggagcag

SEQ ID NO: 3772121 - RNA, 19 nt, Human
cacccugggcucugugggc

SEQ ID NO: 3772122 - RNA, 21 nt, Human
cacccugggcucugugggcug

SEQ ID NO: 3772123 - RNA, 17 nt, Human
cacccuggggagaaagu

SEQ ID NO: 3772124 - RNA, 13 nt, Human
cacccuggggccu

SEQ ID NO: 3772125 - RNA, 15 nt, Human
cacccuggggccugg

SEQ ID NO: 3772126 - RNA, 19 nt, Human
cacccuggggccuggaccu

SEQ ID NO: 3772127 - RNA, 21 nt, Human
cacccuggggccuggaccugc

SEQ ID NO: 3772128 - RNA, 22 nt, Human
cacccuggggccuggaccugcc

SEQ ID NO: 3772129 - RNA, 23 nt, Human
cacccugucccccagcucuggug

SEQ ID NO: 3772130 - RNA, 21 nt, Human
cacccugugauggggcccugc

SEQ ID NO: 3772131 - RNA, 17 nt, Human
cacccuguggcccuggc

SEQ ID NO: 3772132 - RNA, 15 nt, Human
cacccuguuccugcu

SEQ ID NO: 3772133 - RNA, 18 nt, Human
cacccuguuccugcugcu

SEQ ID NO: 3772134 - RNA, 21 nt, Human
cacccuguuuggauuuuuaau

SEQ ID NO: 3772135 - RNA, 18 nt, Human
cacccuuaacccaaggag

SEQ ID NO: 3772136 - RNA, 23 nt, Human
cacccuuaacccaaggagcacag

SEQ ID NO: 3772137 - RNA, 16 nt, Human
cacccuuaccaugugc

SEQ ID NO: 3772138 - RNA, 13 nt, Human
cacccuucuccca

SEQ ID NO: 3772139 - RNA, 15 nt, Human
cacccuucucccacu

SEQ ID NO: 3772140 - RNA, 16 nt, Human
cacccuucucccacuc

SEQ ID NO: 3772141 - RNA, 17 nt, Human
cacccuucucccacucu

SEQ ID NO: 3772142 - RNA, 21 nt, Human
cacccuucuuuccucuucccc

SEQ ID NO: 3772143 - RNA, 20 nt, Human
cacccuucuuuucucaugug

SEQ ID NO: 3772144 - RNA, 21 nt, Human
cacccuucuuuucucaugugu

SEQ ID NO: 3772145 - RNA, 19 nt, Human
cacccuuggacaagacaaa

SEQ ID NO: 3772146 - RNA, 17 nt, Human
cacccuuggaggcuguc

SEQ ID NO: 3772147 - RNA, 15 nt, Human
cacccuuggccuguc

SEQ ID NO: 3772148 - RNA, 18 nt, Human
cacccuugguuccuaacu

SEQ ID NO: 3772149 - RNA, 22 nt, Human
cacccuuucuacuuccaagacu

SEQ ID NO: 3772150 - RNA, 19 nt, Human
caccgaaaacguggcugcu

SEQ ID NO: 3772151 - RNA, 21 nt, Human
caccgaaguggacuggccccu

SEQ ID NO: 3772152 - RNA, 20 nt, Human
caccgacuagacacacaaag

SEQ ID NO: 3772153 - RNA, 15 nt, Human
caccgacuagccagg

SEQ ID NO: 3772154 - RNA, 15 nt, Human
caccgacugaaaaua

SEQ ID NO: 3772155 - RNA, 18 nt, Human
caccgagaguagccgaga

SEQ ID NO: 3772156 - RNA, 17 nt, Human
caccgcagacaggacca

SEQ ID NO: 3772157 - RNA, 19 nt, Human
caccgcagucgucgcacag

SEQ ID NO: 3772158 - RNA, 14 nt, Human
caccgcaugccccc

SEQ ID NO: 3772159 - RNA, 15 nt, Human
caccgcaugcccccu

SEQ ID NO: 3772160 - RNA, 16 nt, Human
caccgcaugcccccuc

SEQ ID NO: 3772161 - RNA, 18 nt, Human
caccgccacauggcuucc

SEQ ID NO: 3772162 - RNA, 13 nt, Human
caccgccauggcu

SEQ ID NO: 3772163 - RNA, 16 nt, Human
caccgccauggcuucc

SEQ ID NO: 3772164 - RNA, 22 nt, Human
caccgccauggcuuccaaggug

SEQ ID NO: 3772165 - RNA, 15 nt, Human
caccgcccgucugug

SEQ ID NO: 3772166 - RNA, 23 nt, Human
caccgcccucccuccccagcucc

SEQ ID NO: 3772167 - RNA, 14 nt, Human
caccgccuccuaca

SEQ ID NO: 3772168 - RNA, 16 nt, Human
caccgccucuucccgc

SEQ ID NO: 3772169 - RNA, 16 nt, Human
caccgcuccccagccc

SEQ ID NO: 3772170 - RNA, 21 nt, Human
caccgcuccccagcccagggu

SEQ ID NO: 3772171 - RNA, 23 nt, Human
caccgcuuccggcuccugugcuu

SEQ ID NO: 3772172 - RNA, 19 nt, Human
caccggaccagccuggccc

SEQ ID NO: 3772173 - RNA, 15 nt, Human
caccggauccugggu

SEQ ID NO: 3772174 - RNA, 22 nt, Human
caccggccccauuuacccaacu

SEQ ID NO: 3772175 - RNA, 18 nt, Human
caccggcuggccuggccc

SEQ ID NO: 3772176 - RNA, 14 nt, Human
caccgggcacucag

SEQ ID NO: 3772177 - RNA, 13 nt, Human
caccgggcagggc

SEQ ID NO: 3772178 - RNA, 15 nt, Human
caccgggccacagag

SEQ ID NO: 3772179 - RNA, 12 nt, Human
caccgggccacu

SEQ ID NO: 3772180 - RNA, 19 nt, Human
caccgggccacuccuuccu

SEQ ID NO: 3772181 - RNA, 21 nt, Human
caccgggccacuccuuccugc

SEQ ID NO: 3772182 - RNA, 22 nt, Human
caccggggccugggcaggaggg

SEQ ID NO: 3772183 - RNA, 15 nt, Human
caccgguugcuucug

SEQ ID NO: 3772184 - RNA, 17 nt, Human
caccgguugcuucuggg

SEQ ID NO: 3772185 - RNA, 20 nt, Human
caccguaaagugagcaugcu

SEQ ID NO: 3772186 - RNA, 13 nt, Human
caccguccccucc

SEQ ID NO: 3772187 - RNA, 19 nt, Human
caccguccgcccugcuccu

SEQ ID NO: 3772188 - RNA, 19 nt, Human
caccguggaccuuccugcc

SEQ ID NO: 3772189 - RNA, 20 nt, Human
caccguggaccuuccugcca

SEQ ID NO: 3772190 - RNA, 15 nt, Human
caccguguaaaccaa

SEQ ID NO: 3772191 - RNA, 23 nt, Human
caccgugucaagcugcucugagc

SEQ ID NO: 3772192 - RNA, 22 nt, Human
caccugcccccuucucccacac

SEQ ID NO: 3772193 - RNA, 18 nt, Human
caccugccccucaacucu

SEQ ID NO: 3772194 - RNA, 21 nt, Human
caccugccccucaacucuccu

SEQ ID NO: 3772195 - RNA, 14 nt, Human
caccugcccuaccu

SEQ ID NO: 3772196 - RNA, 17 nt, Human
caccugcccugcccugc

SEQ ID NO: 3772197 - RNA, 18 nt, Human
caccugcccugcccugcc

SEQ ID NO: 3772198 - RNA, 20 nt, Human
caccugcccugcccugccac

SEQ ID NO: 3772199 - RNA, 23 nt, Human
caccugcccugcccugccaccug

SEQ ID NO: 3772200 - RNA, 14 nt, Human
caccugccucagga

SEQ ID NO: 3772201 - RNA, 23 nt, Human
caccugccucggccucccaaagu

SEQ ID NO: 3772202 - RNA, 20 nt, Human
caccugccugcgucuuccgc

SEQ ID NO: 3772203 - RNA, 18 nt, Human
caccugccuggccggcca

SEQ ID NO: 3772204 - RNA, 17 nt, Human
caccugccuguugggcc

SEQ ID NO: 3772205 - RNA, 23 nt, Human
caccugcggugcuaucuccccca

SEQ ID NO: 3772206 - RNA, 13 nt, Human
caccugcucugcu

SEQ ID NO: 3772207 - RNA, 14 nt, Human
caccugcucugcug

SEQ ID NO: 3772208 - RNA, 14 nt, Human
caccugcucuucua

SEQ ID NO: 3772209 - RNA, 13 nt, Human
caccugcuggccc

SEQ ID NO: 3772210 - RNA, 16 nt, Human
caccugcuggccccuc

SEQ ID NO: 3772211 - RNA, 18 nt, Human
caccugcuggccccucac

SEQ ID NO: 3772212 - RNA, 23 nt, Human
caccugcugucuggguggcucac

SEQ ID NO: 3772213 - RNA, 21 nt, Human
caccuggaagcauuuguuucu

SEQ ID NO: 3772214 - RNA, 22 nt, Human
caccuggaagcccucucuggcu

SEQ ID NO: 3772215 - RNA, 20 nt, Human
caccuggaauauauaaccag

SEQ ID NO: 3772216 - RNA, 16 nt, Human
caccuggaccccugca

SEQ ID NO: 3772217 - RNA, 17 nt, Human
caccuggaccccugcau

SEQ ID NO: 3772218 - RNA, 18 nt, Human
caccuggaccccugcauu

SEQ ID NO: 3772219 - RNA, 19 nt, Human
caccuggaccccugcauug

SEQ ID NO: 3772220 - RNA, 17 nt, Human
caccuggcacugcugug

SEQ ID NO: 3772221 - RNA, 18 nt, Human
caccuggcacugcugugc

SEQ ID NO: 3772222 - RNA, 13 nt, Human
caccuggccaccu

SEQ ID NO: 3772223 - RNA, 17 nt, Human
caccuggcccucucuga

SEQ ID NO: 3772224 - RNA, 16 nt, Human
caccuggcccuggggc

SEQ ID NO: 3772225 - RNA, 20 nt, Human
caccuggccucugcacuccc

SEQ ID NO: 3772226 - RNA, 23 nt, Human
caccuggccucugcacuccccug

SEQ ID NO: 3772227 - RNA, 18 nt, Human
caccuggcucucaccucu

SEQ ID NO: 3772228 - RNA, 19 nt, Human
caccuggcucucaccucua

SEQ ID NO: 3772229 - RNA, 12 nt, Human
caccuggcucug

SEQ ID NO: 3772230 - RNA, 19 nt, Human
caccuggcugagguuccuc

SEQ ID NO: 3772231 - RNA, 17 nt, Human
caccugggagaaaucug

SEQ ID NO: 3772232 - RNA, 15 nt, Human
caccugggcaccugg

SEQ ID NO: 3772233 - RNA, 20 nt, Human
caccugggcccuggggccug

SEQ ID NO: 3772234 - RNA, 15 nt, Human
caccuggggaguggg

SEQ ID NO: 3772235 - RNA, 17 nt, Human
caccuggggagugggac

SEQ ID NO: 3772236 - RNA, 14 nt, Human
caccuggggcaguc

SEQ ID NO: 3772237 - RNA, 15 nt, Human
caccuggggcugcug

SEQ ID NO: 3772238 - RNA, 16 nt, Human
caccugggggccuggc

SEQ ID NO: 3772239 - RNA, 10 nt, Human
caccuggggu

SEQ ID NO: 3772240 - RNA, 16 nt, Human
caccugguggccaugc

SEQ ID NO: 3772241 - RNA, 21 nt, Human
caccugguggccaugcuccuc

SEQ ID NO: 3772242 - RNA, 17 nt, Human
caccugguggccucugc

SEQ ID NO: 3772243 - RNA, 16 nt, Human
caccugguuccggaau

SEQ ID NO: 3772244 - RNA, 13 nt, Human
caccuguaaaacu

SEQ ID NO: 3772245 - RNA, 15 nt, Human
caccuguaaaacuuu

SEQ ID NO: 3772246 - RNA, 23 nt, Human
caccuguaaaacuuuauuuuaua

SEQ ID NO: 3772247 - RNA, 16 nt, Human
caccuguaaucccagc

SEQ ID NO: 3772248 - RNA, 20 nt, Human
caccuguaaucccagcacac

SEQ ID NO: 3772249 - RNA, 21 nt, Human
caccuguaaucccagcuacuu

SEQ ID NO: 3772250 - RNA, 12 nt, Human
caccuguacagu

SEQ ID NO: 3772251 - RNA, 14 nt, Human
caccuguacuggag

SEQ ID NO: 3772252 - RNA, 15 nt, Human
caccuguacuggaga

SEQ ID NO: 3772253 - RNA, 18 nt, Human
caccuguagcacuuacug

SEQ ID NO: 3772254 - RNA, 22 nt, Human
caccuguagcacuuacugguag

SEQ ID NO: 3772255 - RNA, 15 nt, Human
caccuguagcagcca

SEQ ID NO: 3772256 - RNA, 15 nt, Human
caccuguagucccag

SEQ ID NO: 3772257 - RNA, 19 nt, Human
caccuguagucccagcuac

SEQ ID NO: 3772258 - RNA, 21 nt, Human
caccuguccccacccuccacu

SEQ ID NO: 3772259 - RNA, 17 nt, Human
caccugucgcccagugc

SEQ ID NO: 3772260 - RNA, 15 nt, Human
caccugucucagccu

SEQ ID NO: 3772261 - RNA, 14 nt, Human
caccugucugcucc

SEQ ID NO: 3772262 - RNA, 13 nt, Human
caccugucugucu

SEQ ID NO: 3772263 - RNA, 14 nt, Human
caccugucugucug

SEQ ID NO: 3772264 - RNA, 17 nt, Human
caccugucuugccuuuu

SEQ ID NO: 3772265 - RNA, 19 nt, Human
caccugugcuucgggcccu

SEQ ID NO: 3772266 - RNA, 22 nt, Human
caccuguggaacauaaaaagga

SEQ ID NO: 3772267 - RNA, 16 nt, Human
caccuguugcuuacaa

SEQ ID NO: 3772268 - RNA, 13 nt, Human
caccuuaaauuaa

SEQ ID NO: 3772269 - RNA, 23 nt, Human
caccuuaauaugcugcaacaaaa

SEQ ID NO: 3772270 - RNA, 18 nt, Human
caccuuaccaacuuucug

SEQ ID NO: 3772271 - RNA, 19 nt, Human
caccuuaccaacuuucugu

SEQ ID NO: 3772272 - RNA, 23 nt, Human
caccuuagacagucccugccaau

SEQ ID NO: 3772273 - RNA, 18 nt, Human
caccuuaggcagggaagu

SEQ ID NO: 3772274 - RNA, 19 nt, Human
caccuuaucuuaaagcacu

SEQ ID NO: 3772275 - RNA, 10 nt, Human
caccuucacc

SEQ ID NO: 3772276 - RNA, 15 nt, Human
caccuuccagcuccu

SEQ ID NO: 3772277 - RNA, 16 nt, Human
caccuuccagcuccug

SEQ ID NO: 3772278 - RNA, 18 nt, Human
caccuuccauuuuccccc

SEQ ID NO: 3772279 - RNA, 12 nt, Human
caccuucccuug

SEQ ID NO: 3772280 - RNA, 17 nt, Human
caccuucccuugccacu

SEQ ID NO: 3772281 - RNA, 19 nt, Human
caccuucccuugccacuuu

SEQ ID NO: 3772282 - RNA, 13 nt, Human
caccuuccucacu

SEQ ID NO: 3772283 - RNA, 23 nt, Human
caccuucguuuacuaugccugug

SEQ ID NO: 3772284 - RNA, 20 nt, Human
caccuucuuauuauauauau

SEQ ID NO: 3772285 - RNA, 17 nt, Human
caccuugaaucugccug

SEQ ID NO: 3772286 - RNA, 15 nt, Human
caccuugacagggca

SEQ ID NO: 3772287 - RNA, 18 nt, Human
caccuugacagggcacac

SEQ ID NO: 3772288 - RNA, 19 nt, Human
caccuugacagggcacacc

SEQ ID NO: 3772289 - RNA, 17 nt, Human
caccuugcaacacacag

SEQ ID NO: 3772290 - RNA, 13 nt, Human
caccuugcagcuc

SEQ ID NO: 3772291 - RNA, 16 nt, Human
caccuuggacauccuc

SEQ ID NO: 3772292 - RNA, 16 nt, Human
caccuuggcugcaggg

SEQ ID NO: 3772293 - RNA, 16 nt, Human
caccuugugccugggg

SEQ ID NO: 3772294 - RNA, 17 nt, Human
caccuugugccuggggu

SEQ ID NO: 3772295 - RNA, 17 nt, Human
caccuugugucuguaca

SEQ ID NO: 3772296 - RNA, 22 nt, Human
caccuuguguguuccaaguuuc

SEQ ID NO: 3772297 - RNA, 14 nt, Human
caccuuguuggagc

SEQ ID NO: 3772298 - RNA, 21 nt, Human
caccuuguuggagccugcagg

SEQ ID NO: 3772299 - RNA, 20 nt, Human
caccuuuaaguagauaagca

SEQ ID NO: 3772300 - RNA, 23 nt, Human
caccuuuauucuggcagaggagg

SEQ ID NO: 3772301 - RNA, 18 nt, Human
caccuuugcacaggaugc

SEQ ID NO: 3772302 - RNA, 15 nt, Human
caccuuuguccccac

SEQ ID NO: 3772303 - RNA, 23 nt, Human
caccuuugugggguuuuuggaga

SEQ ID NO: 3772304 - RNA, 17 nt, Human
caccuuuguuucucccc

SEQ ID NO: 3772305 - RNA, 23 nt, Human
caccuuuuaaauccuguugaaaa

SEQ ID NO: 3772306 - RNA, 17 nt, Human
caccuuuucuugccuga

SEQ ID NO: 3772307 - RNA, 17 nt, Human
caccuuuuuuaaggaaa

SEQ ID NO: 3772308 - RNA, 16 nt, Human
cacgaaacugcccugg

SEQ ID NO: 3772309 - RNA, 20 nt, Human
cacgaaacuuguuauuguga

SEQ ID NO: 3772310 - RNA, 15 nt, Human
cacgaaauguuauuu

SEQ ID NO: 3772311 - RNA, 14 nt, Human
cacgaacccaccug

SEQ ID NO: 3772312 - RNA, 16 nt, Human
cacgaauagacaucaa

SEQ ID NO: 3772313 - RNA, 23 nt, Human
cacgaauuucugugcccuccuga

SEQ ID NO: 3772314 - RNA, 23 nt, Human
cacgaccuaggcaguaggccggu

SEQ ID NO: 3772315 - RNA, 19 nt, Human
cacgacgcccucuccccac

SEQ ID NO: 3772316 - RNA, 16 nt, Human
cacgacugcccggcag

SEQ ID NO: 3772317 - RNA, 23 nt, Human
cacgagcaaagugaagacacugg

SEQ ID NO: 3772318 - RNA, 19 nt, Human
cacgagcaggcuacuguca

SEQ ID NO: 3772319 - RNA, 20 nt, Human
cacgagcuguuuacuaggga

SEQ ID NO: 3772320 - RNA, 12 nt, Human
cacgagggcugg

SEQ ID NO: 3772321 - RNA, 17 nt, Human
cacgaguaagauuaaga

SEQ ID NO: 3772322 - RNA, 18 nt, Human
cacgagucagucgccuuu

SEQ ID NO: 3772323 - RNA, 14 nt, Human
cacgauccugccac

SEQ ID NO: 3772324 - RNA, 17 nt, Human
cacgauguggcccuggc

SEQ ID NO: 3772325 - RNA, 15 nt, Human
cacgcacacacacaa

SEQ ID NO: 3772326 - RNA, 14 nt, Human
cacgcaccucccau

SEQ ID NO: 3772327 - RNA, 15 nt, Human
cacgcaccucccauc

SEQ ID NO: 3772328 - RNA, 12 nt, Human
cacgcaccugcc

SEQ ID NO: 3772329 - RNA, 15 nt, Human
cacgcaccugccuca

SEQ ID NO: 3772330 - RNA, 12 nt, Human
cacgcacgcaca

SEQ ID NO: 3772331 - RNA, 14 nt, Human
cacgcacgcacaca

SEQ ID NO: 3772332 - RNA, 13 nt, Human
cacgcacggcagc

SEQ ID NO: 3772333 - RNA, 17 nt, Human
cacgcacuucgggaggu

SEQ ID NO: 3772334 - RNA, 15 nt, Human
cacgcagccaggaca

SEQ ID NO: 3772335 - RNA, 15 nt, Human
cacgcccauguguga

SEQ ID NO: 3772336 - RNA, 23 nt, Human
cacgcccaugugugagugugugc

SEQ ID NO: 3772337 - RNA, 21 nt, Human
cacuacauucuguuaaucauu

SEQ ID NO: 3772338 - RNA, 17 nt, Human
cacuaccaaaggacacu

SEQ ID NO: 3772339 - RNA, 16 nt, Human
cacuaccccuugauuu

SEQ ID NO: 3772340 - RNA, 17 nt, Human
cacuaccuccucaggga

SEQ ID NO: 3772341 - RNA, 17 nt, Human
cacuacucacagucucu

SEQ ID NO: 3772342 - RNA, 15 nt, Human
cacuacuccucugca

SEQ ID NO: 3772343 - RNA, 14 nt, Human
cacuacucugugcc

SEQ ID NO: 3772344 - RNA, 12 nt, Human
cacuacugcagc

SEQ ID NO: 3772345 - RNA, 21 nt, Human
cacuacugcuaccacaacuau

SEQ ID NO: 3772346 - RNA, 13 nt, Human
cacuacugggugu

SEQ ID NO: 3772347 - RNA, 20 nt, Human
cacuagaaaagcugaucaua

SEQ ID NO: 3772348 - RNA, 15 nt, Human
cacuagaacucucca

SEQ ID NO: 3772349 - RNA, 19 nt, Human
cacuagacaagccagaacu

SEQ ID NO: 3772350 - RNA, 16 nt, Human
cacuagagaaugcaca

SEQ ID NO: 3772351 - RNA, 23 nt, Human
cacuagagaaugcacagauauac

SEQ ID NO: 3772352 - RNA, 14 nt, Human
cacuagccaaaccu

SEQ ID NO: 3772353 - RNA, 16 nt, Human
cacuagccaaaccuca

SEQ ID NO: 3772354 - RNA, 19 nt, Human
cacuagccaaaccucacca

SEQ ID NO: 3772355 - RNA, 19 nt, Human
cacuagcccaaugaaauga

SEQ ID NO: 3772356 - RNA, 14 nt, Human
cacuagccucucca

SEQ ID NO: 3772357 - RNA, 16 nt, Human
cacuagccucuccagg

SEQ ID NO: 3772358 - RNA, 17 nt, Human
cacuagccucuccagga

SEQ ID NO: 3772359 - RNA, 20 nt, Human
cacuagccuuuggcucugga

SEQ ID NO: 3772360 - RNA, 21 nt, Human
cacuagccuuuggcucuggag

SEQ ID NO: 3772361 - RNA, 12 nt, Human
cacuagcucuug

SEQ ID NO: 3772362 - RNA, 16 nt, Human
cacuaggacucugagg

SEQ ID NO: 3772363 - RNA, 17 nt, Human
cacuaggacucugaggc

SEQ ID NO: 3772364 - RNA, 16 nt, Human
cacuaggcacccagcu

SEQ ID NO: 3772365 - RNA, 20 nt, Human
cacuaggcccccacuugccu

SEQ ID NO: 3772366 - RNA, 21 nt, Human
cacuaggcugggugcccacag

SEQ ID NO: 3772367 - RNA, 23 nt, Human
cacuaggcugggugcccacagcc

SEQ ID NO: 3772368 - RNA, 20 nt, Human
cacuagggcagggacaggau

SEQ ID NO: 3772369 - RNA, 18 nt, Human
cacuagggccuuggaaau

SEQ ID NO: 3772370 - RNA, 17 nt, Human
cacuagguucaauuccc

SEQ ID NO: 3772371 - RNA, 17 nt, Human
cacuaguaaguaauuau

SEQ ID NO: 3772372 - RNA, 14 nt, Human
cacuaguauuucua

SEQ ID NO: 3772373 - RNA, 18 nt, Human
cacuauaauguaagcucu

SEQ ID NO: 3772374 - RNA, 16 nt, Human
cacuauaaugugaaau

SEQ ID NO: 3772375 - RNA, 15 nt, Human
cacuauacaaacaaa

SEQ ID NO: 3772376 - RNA, 23 nt, Human
cacuauauaggcaucacauuuuu

SEQ ID NO: 3772377 - RNA, 13 nt, Human
cacuauccaugca

SEQ ID NO: 3772378 - RNA, 19 nt, Human
cacuaucccggcugcccuu

SEQ ID NO: 3772379 - RNA, 14 nt, Human
cacuaucuuucagc

SEQ ID NO: 3772380 - RNA, 21 nt, Human
cacuaugaagauguuucaaaa

SEQ ID NO: 3772381 - RNA, 15 nt, Human
cacuaugcuuuccuu

SEQ ID NO: 3772382 - RNA, 18 nt, Human
cacuauguugcccaggca

SEQ ID NO: 3772383 - RNA, 20 nt, Human
cacuauguugcccaggcagg

SEQ ID NO: 3772384 - RNA, 21 nt, Human
cacuauguugcccaggcaggu

SEQ ID NO: 3772385 - RNA, 22 nt, Human
cacuauuggcugggaguggugg

SEQ ID NO: 3772386 - RNA, 19 nt, Human
cacuauuuaucugugcaaa

SEQ ID NO: 3772387 - RNA, 13 nt, Human
cacuauuuccuuu

SEQ ID NO: 3772388 - RNA, 17 nt, Human
cacuauuuccuuuauaa

SEQ ID NO: 3772389 - RNA, 16 nt, Human
cacuauuuucagaauc

SEQ ID NO: 3772390 - RNA, 18 nt, Human
cacuauuuucagaaucug

SEQ ID NO: 3772391 - RNA, 17 nt, Human
cacuauuuuuauuuaua

SEQ ID NO: 3772392 - RNA, 17 nt, Human
cacucaaaagcugggca

SEQ ID NO: 3772393 - RNA, 20 nt, Human
cacucaaaagcugggcaggu

SEQ ID NO: 3772394 - RNA, 22 nt, Human
cacucaaaggccagaccugcag

SEQ ID NO: 3772395 - RNA, 23 nt, Human
cacucaaaggccagaccugcaga

SEQ ID NO: 3772396 - RNA, 16 nt, Human
cacucaaaucuuaaga

SEQ ID NO: 3772397 - RNA, 14 nt, Human
cacucaacaugagu

SEQ ID NO: 3772398 - RNA, 15 nt, Human
cacucaagaagcagg

SEQ ID NO: 3772399 - RNA, 13 nt, Human
cacucaagcacug

SEQ ID NO: 3772400 - RNA, 16 nt, Human
cacucaagcacugaua

SEQ ID NO: 3772401 - RNA, 16 nt, Human
cacucaaguucaagga

SEQ ID NO: 3772402 - RNA, 18 nt, Human
cacucaaguucaaggacc

SEQ ID NO: 3772403 - RNA, 15 nt, Human
cacucacacagccag

SEQ ID NO: 3772404 - RNA, 18 nt, Human
cacucacacagccaggug

SEQ ID NO: 3772405 - RNA, 12 nt, Human
cacucacacagg

SEQ ID NO: 3772406 - RNA, 22 nt, Human
cacucacacaggacccccuucc

SEQ ID NO: 3772407 - RNA, 17 nt, Human
cacucacagagacacag

SEQ ID NO: 3772408 - RNA, 18 nt, Human
cacucacagagacacagg

SEQ ID NO: 3772409 - RNA, 20 nt, Human
cacucacagagucaaggccu

SEQ ID NO: 3772410 - RNA, 14 nt, Human
cacucacaugacac

SEQ ID NO: 3772411 - RNA, 12 nt, Human
cacucacaugcu

SEQ ID NO: 3772412 - RNA, 23 nt, Human
cacucacaugcuggacaggucug

SEQ ID NO: 3772413 - RNA, 14 nt, Human
cacucaccgaagcc

SEQ ID NO: 3772414 - RNA, 12 nt, Human
cacucaccugca

SEQ ID NO: 3772415 - RNA, 12 nt, Human
cacucacuccug

SEQ ID NO: 3772416 - RNA, 15 nt, Human
cacucacuggcaucu

SEQ ID NO: 3772417 - RNA, 12 nt, Human
cacucagaagac

SEQ ID NO: 3772418 - RNA, 16 nt, Human
cacucagaagacacug

SEQ ID NO: 3772419 - RNA, 18 nt, Human
cacucagaagacacugau

SEQ ID NO: 3772420 - RNA, 14 nt, Human
cacucagaagccug

SEQ ID NO: 3772421 - RNA, 16 nt, Human
cacucagaagccuggg

SEQ ID NO: 3772422 - RNA, 19 nt, Human
cacucagaagccugggggc

SEQ ID NO: 3772423 - RNA, 20 nt, Human
cacucagagacaugcagaga

SEQ ID NO: 3772424 - RNA, 18 nt, Human
cacucagauccuccucau

SEQ ID NO: 3772425 - RNA, 12 nt, Human
cacucagcacaa

SEQ ID NO: 3772426 - RNA, 15 nt, Human
cacucagcacaaggc

SEQ ID NO: 3772427 - RNA, 15 nt, Human
cacucagcaccacuc

SEQ ID NO: 3772428 - RNA, 17 nt, Human
cacucagccacccugag

SEQ ID NO: 3772429 - RNA, 11 nt, Human
cacucagcccc

SEQ ID NO: 3772430 - RNA, 15 nt, Human
cacucagccccuagg

SEQ ID NO: 3772431 - RNA, 18 nt, Human
cacucagcuguccugcag

SEQ ID NO: 3772432 - RNA, 20 nt, Human
cacucagcuguccugcagca

SEQ ID NO: 3772433 - RNA, 22 nt, Human
cacucagcuguccugcagcaaa

SEQ ID NO: 3772434 - RNA, 20 nt, Human
cacucaggcuggaguacagu

SEQ ID NO: 3772435 - RNA, 19 nt, Human
cacucagugcagcaauaua

SEQ ID NO: 3772436 - RNA, 16 nt, Human
cacucaguuuaugcug

SEQ ID NO: 3772437 - RNA, 16 nt, Human
cacucauccccucacu

SEQ ID NO: 3772438 - RNA, 18 nt, Human
cacucaugcauuguccuc

SEQ ID NO: 3772439 - RNA, 17 nt, Human
cacucaugcugaaagcc

SEQ ID NO: 3772440 - RNA, 16 nt, Human
cacucaugugacucuu

SEQ ID NO: 3772441 - RNA, 13 nt, Human
cacucauuccugu

SEQ ID NO: 3772442 - RNA, 15 nt, Human
cacucauugaccuga

SEQ ID NO: 3772443 - RNA, 18 nt, Human
cacucauugaccugaggc

SEQ ID NO: 3772444 - RNA, 12 nt, Human
cacucauuucau

SEQ ID NO: 3772445 - RNA, 22 nt, Human
cacucauuucaucucauuuaag

SEQ ID NO: 3772446 - RNA, 16 nt, Human
cacuccaaccuaaccu

SEQ ID NO: 3772447 - RNA, 16 nt, Human
cacuccaaucugggug

SEQ ID NO: 3772448 - RNA, 22 nt, Human
cacuccacauaagggguuuagu

SEQ ID NO: 3772449 - RNA, 10 nt, Human
cacuccacca

SEQ ID NO: 3772450 - RNA, 23 nt, Human
cacuccagccugagcgacaguga

SEQ ID NO: 3772451 - RNA, 13 nt, Human
cacuccagccugg

SEQ ID NO: 3772452 - RNA, 15 nt, Human
cacuccagccugggg

SEQ ID NO: 3772453 - RNA, 16 nt, Human
cacuccagccugggug

SEQ ID NO: 3772454 - RNA, 12 nt, Human
cacuccagcugg

SEQ ID NO: 3772455 - RNA, 20 nt, Human
cacuccagggacacacagcc

SEQ ID NO: 3772456 - RNA, 21 nt, Human
cacuccagugagacagcucug

SEQ ID NO: 3772457 - RNA, 16 nt, Human
cacuccagugccagca

SEQ ID NO: 3772458 - RNA, 18 nt, Human
cacuccauggagucugga

SEQ ID NO: 3772459 - RNA, 12 nt, Human
cacuccauuccc

SEQ ID NO: 3772460 - RNA, 20 nt, Human
cacucccaagguuggagccc

SEQ ID NO: 3772461 - RNA, 13 nt, Human
cacucccaggcag

SEQ ID NO: 3772462 - RNA, 15 nt, Human
cacucccaggcagcc

SEQ ID NO: 3772463 - RNA, 13 nt, Human
cacuccccaagga

SEQ ID NO: 3772464 - RNA, 14 nt, Human
cacuccccaaggaa

SEQ ID NO: 3772465 - RNA, 20 nt, Human
cacuccccaaggaagagcca

SEQ ID NO: 3772466 - RNA, 14 nt, Human
cacuccccagccag

SEQ ID NO: 3772467 - RNA, 16 nt, Human
cacuccccaugccacg

SEQ ID NO: 3772468 - RNA, 19 nt, Human
cacuccccaugccacguuc

SEQ ID NO: 3772469 - RNA, 21 nt, Human
cacucccccuaaaccccuguc

SEQ ID NO: 3772470 - RNA, 22 nt, Human
cacucccccuaaaccccugucc

SEQ ID NO: 3772471 - RNA, 14 nt, Human
cacuccccugcacu

SEQ ID NO: 3772472 - RNA, 15 nt, Human
cacuccccugcuggg

SEQ ID NO: 3772473 - RNA, 14 nt, Human
cacucccuccagca

SEQ ID NO: 3772474 - RNA, 17 nt, Human
cacucccuccagcacaa

SEQ ID NO: 3772475 - RNA, 19 nt, Human
cacucccuccagcacaaac

SEQ ID NO: 3772476 - RNA, 13 nt, Human
cacucccugcaac

SEQ ID NO: 3772477 - RNA, 14 nt, Human
cacucccuugcugg

SEQ ID NO: 3772478 - RNA, 17 nt, Human
cacucccuugcuggccc

SEQ ID NO: 3772479 - RNA, 18 nt, Human
cacucccuugcuggcccc

SEQ ID NO: 3772480 - RNA, 20 nt, Human
cacucccuugggcucccugu

SEQ ID NO: 3772481 - RNA, 12 nt, Human
cacuccuagaga

SEQ ID NO: 3772482 - RNA, 14 nt, Human
cacuccucccuccg

SEQ ID NO: 3772483 - RNA, 12 nt, Human
cagaugaauaaa

SEQ ID NO: 3772484 - RNA, 20 nt, Human
cagaugacaaaaauucaacu

SEQ ID NO: 3772485 - RNA, 16 nt, Human
cagaugacaagauggu

SEQ ID NO: 3772486 - RNA, 16 nt, Human
cagaugaccccugccc

SEQ ID NO: 3772487 - RNA, 17 nt, Human
cagaugagaaacucuug

SEQ ID NO: 3772488 - RNA, 16 nt, Human
cagaugagaacaaagc

SEQ ID NO: 3772489 - RNA, 17 nt, Human
cagaugagaacaaagcu

SEQ ID NO: 3772490 - RNA, 12 nt, Human
cagaugagcugu

SEQ ID NO: 3772491 - RNA, 22 nt, Human
cagaugaugagaauuucuaaaa

SEQ ID NO: 3772492 - RNA, 18 nt, Human
cagaugcaaagaggcaag

SEQ ID NO: 3772493 - RNA, 14 nt, Human
cagaugcaaugacu

SEQ ID NO: 3772494 - RNA, 16 nt, Human
cagaugcaccagcccu

SEQ ID NO: 3772495 - RNA, 18 nt, Human
cagaugcagagagccauu

SEQ ID NO: 3772496 - RNA, 17 nt, Human
cagaugcagcucuuccu

SEQ ID NO: 3772497 - RNA, 23 nt, Human
cagaugcagcucuuccuggacag

SEQ ID NO: 3772498 - RNA, 20 nt, Human
cagaugccacccuagccaau

SEQ ID NO: 3772499 - RNA, 14 nt, Human
cagaugccagagca

SEQ ID NO: 3772500 - RNA, 13 nt, Human
cagaugccccaga

SEQ ID NO: 3772501 - RNA, 16 nt, Human
cagaugccccagagcu

SEQ ID NO: 3772502 - RNA, 15 nt, Human
cagaugccccuuucu

SEQ ID NO: 3772503 - RNA, 18 nt, Human
cagaugcccgagggaggg

SEQ ID NO: 3772504 - RNA, 18 nt, Human
cagaugcuccaagauucu

SEQ ID NO: 3772505 - RNA, 15 nt, Human
cagaugcugauguuc

SEQ ID NO: 3772506 - RNA, 22 nt, Human
cagaugcugauguucaguguaa

SEQ ID NO: 3772507 - RNA, 23 nt, Human
cagaugcuugcggcaaaaggaaa

SEQ ID NO: 3772508 - RNA, 14 nt, Human
cagauggaaaggag

SEQ ID NO: 3772509 - RNA, 18 nt, Human
cagauggaaauauuuuga

SEQ ID NO: 3772510 - RNA, 18 nt, Human
cagauggaaccgcaggaa

SEQ ID NO: 3772511 - RNA, 22 nt, Human
cagauggaaccgcaggaagcug

SEQ ID NO: 3772512 - RNA, 16 nt, Human
cagauggaaugcugug

SEQ ID NO: 3772513 - RNA, 17 nt, Human
cagauggaaugcugugu

SEQ ID NO: 3772514 - RNA, 21 nt, Human
cagauggaaugcuguguuaaa

SEQ ID NO: 3772515 - RNA, 19 nt, Human
cagauggacuccagccugc

SEQ ID NO: 3772516 - RNA, 22 nt, Human
cagauggauugauaauugcauu

SEQ ID NO: 3772517 - RNA, 23 nt, Human
cagauggauugauaauugcauuc

SEQ ID NO: 3772518 - RNA, 15 nt, Human
cagauggauuugccu

SEQ ID NO: 3772519 - RNA, 13 nt, Human
cagauggcagcuu

SEQ ID NO: 3772520 - RNA, 15 nt, Human
cagauggcagcuuuu

SEQ ID NO: 3772521 - RNA, 22 nt, Human
cagauggcccggaugcugcuuc

SEQ ID NO: 3772522 - RNA, 21 nt, Human
cagauggggcucccgcccgug

SEQ ID NO: 3772523 - RNA, 14 nt, Human
cagaugggggaaag

SEQ ID NO: 3772524 - RNA, 23 nt, Human
cagaugggugcuuggaggaagga

SEQ ID NO: 3772525 - RNA, 15 nt, Human
cagauggucauccag

SEQ ID NO: 3772526 - RNA, 16 nt, Human
cagauggugaagcauu

SEQ ID NO: 3772527 - RNA, 22 nt, Human
cagaugguuuccacauuuagau

SEQ ID NO: 3772528 - RNA, 15 nt, Human
cagauguaauguuuu

SEQ ID NO: 3772529 - RNA, 16 nt, Human
cagauguaauguuuuc

SEQ ID NO: 3772530 - RNA, 23 nt, Human
cagauguaauguuuucuuugcaa

SEQ ID NO: 3772531 - RNA, 24 nt, Human
cagauguaggagggacugucgcug

SEQ ID NO: 3772532 - RNA, 23 nt, Human
cagaugucccuugaugcacagag

SEQ ID NO: 3772533 - RNA, 13 nt, Human
cagaugucuucug

SEQ ID NO: 3772534 - RNA, 17 nt, Human
cagaugucuucugccug

SEQ ID NO: 3772535 - RNA, 17 nt, Human
cagaugugaaccauuaa

SEQ ID NO: 3772536 - RNA, 15 nt, Human
cagaugugcagcaga

SEQ ID NO: 3772537 - RNA, 17 nt, Human
cagaugugcagcagauu

SEQ ID NO: 3772538 - RNA, 19 nt, Human
cagaugugcagcagauugg

SEQ ID NO: 3772539 - RNA, 14 nt, Human
cagauguggagcca

SEQ ID NO: 3772540 - RNA, 15 nt, Human
cagauguggagccag

SEQ ID NO: 3772541 - RNA, 16 nt, Human
cagauguggagccagg

SEQ ID NO: 3772542 - RNA, 19 nt, Human
cagauguggcuacugacau

SEQ ID NO: 3772543 - RNA, 22 nt, Human
cagaugugggccaccauugcaa

SEQ ID NO: 3772544 - RNA, 17 nt, Human
cagauguuaaaauaaau

SEQ ID NO: 3772545 - RNA, 22 nt, Human
cagauguucgguuuuuuuccug

SEQ ID NO: 3772546 - RNA, 19 nt, Human
cagauguucucucccaggg

SEQ ID NO: 3772547 - RNA, 23 nt, Human
cagauguugaaugcccacaggca

SEQ ID NO: 3772548 - RNA, 15 nt, Human
cagauguuuaaaaca

SEQ ID NO: 3772549 - RNA, 16 nt, Human
cagauguuuaaaacac

SEQ ID NO: 3772550 - RNA, 14 nt, Human
cagauguuuccaga

SEQ ID NO: 3772551 - RNA, 16 nt, Human
cagauguuuccagacu

SEQ ID NO: 3772552 - RNA, 14 nt, Human
cagauguuucuuuu

SEQ ID NO: 3772553 - RNA, 17 nt, Human
cagauguuuuacgucug

SEQ ID NO: 3772554 - RNA, 13 nt, Human
cagauuauuuugg

SEQ ID NO: 3772555 - RNA, 19 nt, Human
cagauucacacugucuggu

SEQ ID NO: 3772556 - RNA, 21 nt, Human
cagauucagaaaugaggccau

SEQ ID NO: 3772557 - RNA, 14 nt, Human
cagauucagucuug

SEQ ID NO: 3772558 - RNA, 15 nt, Human
cagauucagucuugc

SEQ ID NO: 3772559 - RNA, 18 nt, Human
cagauucagucuugccuu

SEQ ID NO: 3772560 - RNA, 15 nt, Human
cagauucauuuuucu

SEQ ID NO: 3772561 - RNA, 17 nt, Human
cagauucccagagcaaa

SEQ ID NO: 3772562 - RNA, 14 nt, Human
cagauuccuuccca

SEQ ID NO: 3772563 - RNA, 21 nt, Human
cagauucguggucuuuuccuc

SEQ ID NO: 3772564 - RNA, 18 nt, Human
cagauucuauccucaucu

SEQ ID NO: 3772565 - RNA, 17 nt, Human
cagauucuuuccugagg

SEQ ID NO: 3772566 - RNA, 22 nt, Human
cagauugaguuuucuucuguga

SEQ ID NO: 3772567 - RNA, 13 nt, Human
cagauugcaugug

SEQ ID NO: 3772568 - RNA, 23 nt, Human
cagauugcaugugacucugaagc

SEQ ID NO: 3772569 - RNA, 15 nt, Human
cagauugcugcuucu

SEQ ID NO: 3772570 - RNA, 17 nt, Human
cagauugcuuuugugca

SEQ ID NO: 3772571 - RNA, 12 nt, Human
cagauuggaagg

SEQ ID NO: 3772572 - RNA, 21 nt, Human
cagauuggaaggagacacaga

SEQ ID NO: 3772573 - RNA, 18 nt, Human
cagauuggagaaacccuu

SEQ ID NO: 3772574 - RNA, 14 nt, Human
cagauugucagcuc

SEQ ID NO: 3772575 - RNA, 20 nt, Human
cagauugucuuaauuucuau

SEQ ID NO: 3772576 - RNA, 16 nt, Human
cagauugugccacugc

SEQ ID NO: 3772577 - RNA, 21 nt, Human
cagauuguggaauguuggaua

SEQ ID NO: 3772578 - RNA, 14 nt, Human
cagauuguuaucua

SEQ ID NO: 3772579 - RNA, 13 nt, Human
cagauuguuuccu

SEQ ID NO: 3772580 - RNA, 16 nt, Human
cagauuguuucuauac

SEQ ID NO: 3772581 - RNA, 19 nt, Human
cagauuguuucuauacaaa

SEQ ID NO: 3772582 - RNA, 20 nt, Human
cagauuguuucuauacaaau

SEQ ID NO: 3772583 - RNA, 22 nt, Human
cagauuuagugaaagcuagaga

SEQ ID NO: 3772584 - RNA, 16 nt, Human
cagauuucacucuccu

SEQ ID NO: 3772585 - RNA, 13 nt, Human
cagauuuggaaag

SEQ ID NO: 3772586 - RNA, 18 nt, Human
cagauuuggcuugacaaa

SEQ ID NO: 3772587 - RNA, 15 nt, Human
cagauuugggcugga

SEQ ID NO: 3772588 - RNA, 23 nt, Human
cagauuugugaacucagccaagc

SEQ ID NO: 3772589 - RNA, 16 nt, Human
cagauuuuacaaaaga

SEQ ID NO: 3772590 - RNA, 15 nt, Human
cagauuuuacagagc

SEQ ID NO: 3772591 - RNA, 19 nt, Human
cagauuuuacagagcgcac

SEQ ID NO: 3772592 - RNA, 13 nt, Human
cagauuuuauuau

SEQ ID NO: 3772593 - RNA, 21 nt, Human
cagauuuuauuauguaaaucc

SEQ ID NO: 3772594 - RNA, 16 nt, Human
cagauuuugauagcaa

SEQ ID NO: 3772595 - RNA, 16 nt, Human
cagauuuugcuguaua

SEQ ID NO: 3772596 - RNA, 17 nt, Human
cagauuuugcuguauau

SEQ ID NO: 3772597 - RNA, 18 nt, Human
cagauuuuucggaggccc

SEQ ID NO: 3772598 - RNA, 19 nt, Human
cagauuuuuuacagcugcc

SEQ ID NO: 3772599 - RNA, 22 nt, Human
cagauuuuuuacagcugccugc

SEQ ID NO: 3772600 - RNA, 15 nt, Human
cagcaaaaauauaaa

SEQ ID NO: 3772601 - RNA, 17 nt, Human
cagcaaaaauauuuuau

SEQ ID NO: 3772602 - RNA, 12 nt, Human
cagcaaaaccau

SEQ ID NO: 3772603 - RNA, 15 nt, Human
cagcaaaacuccauc

SEQ ID NO: 3772604 - RNA, 11 nt, Human
cagcaaaccau

SEQ ID NO: 3772605 - RNA, 12 nt, Human
cagcaaaccauu

SEQ ID NO: 3772606 - RNA, 21 nt, Human
cagcaaaccauuuuuaaagua

SEQ ID NO: 3772607 - RNA, 14 nt, Human
cagcaaaccggggc

SEQ ID NO: 3772608 - RNA, 19 nt, Human
cagcaaagagugggcugca

SEQ ID NO: 3772609 - RNA, 14 nt, Human
cagcaaagccccau

SEQ ID NO: 3772610 - RNA, 21 nt, Human
cagcaaagccccaugcuggag

SEQ ID NO: 3772611 - RNA, 23 nt, Human
cagcaaagccccaugcuggagcc

SEQ ID NO: 3772612 - RNA, 15 nt, Human
cagcaaagcccccag

SEQ ID NO: 3772613 - RNA, 18 nt, Human
cagcaaagcccccagagc

SEQ ID NO: 3772614 - RNA, 22 nt, Human
cagcaaagcccccagagcccag

SEQ ID NO: 3772615 - RNA, 15 nt, Human
cagcaacacaaagcu

SEQ ID NO: 3772616 - RNA, 14 nt, Human
cagcaacacaaugu

SEQ ID NO: 3772617 - RNA, 16 nt, Human
cagcaaccagagcacu

SEQ ID NO: 3772618 - RNA, 17 nt, Human
cagcaaccagagcacug

SEQ ID NO: 3772619 - RNA, 18 nt, Human
cagcaaccagagcacugu

SEQ ID NO: 3772620 - RNA, 21 nt, Human
cagcaaccagagcacuguaua

SEQ ID NO: 3772621 - RNA, 18 nt, Human
cagcaaccuguaagacug

SEQ ID NO: 3772622 - RNA, 21 nt, Human
cagcaacgaucacaaaugacu

SEQ ID NO: 3772623 - RNA, 23 nt, Human
cagcaacuaucagacuaagccag

SEQ ID NO: 3772624 - RNA, 13 nt, Human
cagcaacugaaua

SEQ ID NO: 3772625 - RNA, 22 nt, Human
cagcaacuucuucuccaucccu

SEQ ID NO: 3772626 - RNA, 15 nt, Human
cagcaacuugucuuu

SEQ ID NO: 3772627 - RNA, 21 nt, Human
cagccccaucccaaacccuuc

SEQ ID NO: 3772628 - RNA, 14 nt, Human
cagccccauucugc

SEQ ID NO: 3772629 - RNA, 20 nt, Human
cagccccauucugccugccc

SEQ ID NO: 3772630 - RNA, 22 nt, Human
cagccccauucugccugcccag

SEQ ID NO: 3772631 - RNA, 13 nt, Human
cagcccccacagu

SEQ ID NO: 3772632 - RNA, 21 nt, Human
cagcccccacagugcugucug

SEQ ID NO: 3772633 - RNA, 17 nt, Human
cagcccccacauccugu

SEQ ID NO: 3772634 - RNA, 18 nt, Human
cagcccccagcucccacc

SEQ ID NO: 3772635 - RNA, 21 nt, Human
cagcccccagcucccaccucc

SEQ ID NO: 3772636 - RNA, 19 nt, Human
cagcccccuaagagagcac

SEQ ID NO: 3772637 - RNA, 21 nt, Human
cagcccccugaccacucagag

SEQ ID NO: 3772638 - RNA, 16 nt, Human
cagccccgacuccagc

SEQ ID NO: 3772639 - RNA, 17 nt, Human
cagccccgacuccagcc

SEQ ID NO: 3772640 - RNA, 18 nt, Human
cagccccgacuccagcca

SEQ ID NO: 3772641 - RNA, 21 nt, Human
cagccccgacuccagccagcg

SEQ ID NO: 3772642 - RNA, 17 nt, Human
cagccccgagcuguccc

SEQ ID NO: 3772643 - RNA, 17 nt, Human
cagccccggcccugggc

SEQ ID NO: 3772644 - RNA, 18 nt, Human
cagccccgguggcugggc

SEQ ID NO: 3772645 - RNA, 20 nt, Human
cagccccgguggcugggcag

SEQ ID NO: 3772646 - RNA, 13 nt, Human
cagccccuagaaa

SEQ ID NO: 3772647 - RNA, 16 nt, Human
cagccccuagaaaccc

SEQ ID NO: 3772648 - RNA, 16 nt, Human
cagccccuagcccagg

SEQ ID NO: 3772649 - RNA, 23 nt, Human
cagccccuagcccaggagagaga

SEQ ID NO: 3772650 - RNA, 24 nt, Human
cagccccuagcccaggagagagaa

SEQ ID NO: 3772651 - RNA, 11 nt, Human
cagccccuccc

SEQ ID NO: 3772652 - RNA, 14 nt, Human
cagccccucccacc

SEQ ID NO: 3772653 - RNA, 15 nt, Human
cagccccuccucugc

SEQ ID NO: 3772654 - RNA, 16 nt, Human
cagccccucuggucgc

SEQ ID NO: 3772655 - RNA, 18 nt, Human
cagccccucuggucgcuc

SEQ ID NO: 3772656 - RNA, 22 nt, Human
cagccccucuggucgcuccugc

SEQ ID NO: 3772657 - RNA, 21 nt, Human
cagccccucuugccccccacc

SEQ ID NO: 3772658 - RNA, 18 nt, Human
cagccccucuuggagaag

SEQ ID NO: 3772659 - RNA, 20 nt, Human
cagccccucuuggagaaguc

SEQ ID NO: 3772660 - RNA, 24 nt, Human
cagccccucuuggagaagucucag

SEQ ID NO: 3772661 - RNA, 19 nt, Human
cagccccugauccugugaa

SEQ ID NO: 3772662 - RNA, 20 nt, Human
cagccccugauccugugaag

SEQ ID NO: 3772663 - RNA, 21 nt, Human
cagccccugauccugugaagu

SEQ ID NO: 3772664 - RNA, 13 nt, Human
cagccccugcaca

SEQ ID NO: 3772665 - RNA, 19 nt, Human
cagccccugccccagccca

SEQ ID NO: 3772666 - RNA, 23 nt, Human
cagccccugccccucaugccaac

SEQ ID NO: 3772667 - RNA, 14 nt, Human
cagccccuggaugc

SEQ ID NO: 3772668 - RNA, 19 nt, Human
cagccccuucugacccaug

SEQ ID NO: 3772669 - RNA, 24 nt, Human
cagccccuucugacccaugcugcc

SEQ ID NO: 3772670 - RNA, 18 nt, Human
cagccccuugagaaaccu

SEQ ID NO: 3772671 - RNA, 15 nt, Human
cagccccuuuccaaa

SEQ ID NO: 3772672 - RNA, 15 nt, Human
cagccccuuucccuu

SEQ ID NO: 3772673 - RNA, 24 nt, Human
cagcccgauccuccccuggacucc

SEQ ID NO: 3772674 - RNA, 16 nt, Human
cagcccgcacaccugc

SEQ ID NO: 3772675 - RNA, 22 nt, Human
cagcccgcaucagcugcucaga

SEQ ID NO: 3772676 - RNA, 19 nt, Human
cagcccgcccacuggguaa

SEQ ID NO: 3772677 - RNA, 16 nt, Human
cagcccgcugagugga

SEQ ID NO: 3772678 - RNA, 17 nt, Human
cagcccggccgcuccac

SEQ ID NO: 3772679 - RNA, 12 nt, Human
cagcccggccug

SEQ ID NO: 3772680 - RNA, 23 nt, Human
cagcccggccugcucccagcagc

SEQ ID NO: 3772681 - RNA, 21 nt, Human
cagcccggcgccaccauccug

SEQ ID NO: 3772682 - RNA, 13 nt, Human
cagcccggcuggu

SEQ ID NO: 3772683 - RNA, 19 nt, Human
cagcccgggagccuaggac

SEQ ID NO: 3772684 - RNA, 20 nt, Human
cagcccgggagccuaggacc

SEQ ID NO: 3772685 - RNA, 14 nt, Human
cagcccgggcucug

SEQ ID NO: 3772686 - RNA, 19 nt, Human
cagcccgggcucugccucc

SEQ ID NO: 3772687 - RNA, 20 nt, Human
cagcccgggcucugccuccc

SEQ ID NO: 3772688 - RNA, 21 nt, Human
cagcccgggcucugccuccca

SEQ ID NO: 3772689 - RNA, 15 nt, Human
cagcccguguggccc

SEQ ID NO: 3772690 - RNA, 18 nt, Human
cagcccguguggccccuu

SEQ ID NO: 3772691 - RNA, 20 nt, Human
cagcccguguggccccuuca

SEQ ID NO: 3772692 - RNA, 14 nt, Human
cagcccuaaacauc

SEQ ID NO: 3772693 - RNA, 21 nt, Human
cagcccuaaaucuagacucaa

SEQ ID NO: 3772694 - RNA, 21 nt, Human
cagcccuaaggaucucucagg

SEQ ID NO: 3772695 - RNA, 16 nt, Human
cagcccuagagccugc

SEQ ID NO: 3772696 - RNA, 18 nt, Human
cagcccuagagccugccu

SEQ ID NO: 3772697 - RNA, 20 nt, Human
cagcccuagagccugccugg

SEQ ID NO: 3772698 - RNA, 20 nt, Human
cagcccuauggauguggggu

SEQ ID NO: 3772699 - RNA, 18 nt, Human
cagcccucaauugugaaa

SEQ ID NO: 3772700 - RNA, 13 nt, Human
cagcccucacccc

SEQ ID NO: 3772701 - RNA, 14 nt, Human
cagcccucaccccu

SEQ ID NO: 3772702 - RNA, 13 nt, Human
cagcccucagaau

SEQ ID NO: 3772703 - RNA, 13 nt, Human
cagcccucauccc

SEQ ID NO: 3772704 - RNA, 17 nt, Human
cagcccucccugccccu

SEQ ID NO: 3772705 - RNA, 18 nt, Human
cagcccucccuguccucc

SEQ ID NO: 3772706 - RNA, 12 nt, Human
cagcccuccuca

SEQ ID NO: 3772707 - RNA, 18 nt, Human
cagcccucucacuguguc

SEQ ID NO: 3772708 - RNA, 16 nt, Human
cagcccugacccugug

SEQ ID NO: 3772709 - RNA, 23 nt, Human
cagcccugaggacagaugccucc

SEQ ID NO: 3772710 - RNA, 12 nt, Human
cagcccugaggu

SEQ ID NO: 3772711 - RNA, 23 nt, Human
cagcccugcaccaugcugcuggg

SEQ ID NO: 3772712 - RNA, 16 nt, Human
cagcccugcagagggc

SEQ ID NO: 3772713 - RNA, 13 nt, Human
cagcccugccugg

SEQ ID NO: 3772714 - RNA, 16 nt, Human
cagcccugccuggagg

SEQ ID NO: 3772715 - RNA, 12 nt, Human
cagcccugcugg

SEQ ID NO: 3772716 - RNA, 11 nt, Human
cagcccugcuu

SEQ ID NO: 3772717 - RNA, 20 nt, Human
cagcccugcuuugggcugcc

SEQ ID NO: 3772718 - RNA, 23 nt, Human
cagcccugcuuugggcugcccug

SEQ ID NO: 3772719 - RNA, 12 nt, Human
cagcccuggagg

SEQ ID NO: 3772720 - RNA, 21 nt, Human
cagcccuggcagggggcaugc

SEQ ID NO: 3772721 - RNA, 12 nt, Human
cagcccuggccc

SEQ ID NO: 3772722 - RNA, 12 nt, Human
cagcccuggcuc

SEQ ID NO: 3772723 - RNA, 16 nt, Human
cagcccuggcugaagg

SEQ ID NO: 3772724 - RNA, 17 nt, Human
cagcccuggcugaagga

SEQ ID NO: 3772725 - RNA, 17 nt, Human
cagcccugggccccacc

SEQ ID NO: 3772726 - RNA, 18 nt, Human
cagcccugggccccacca

SEQ ID NO: 3772727 - RNA, 22 nt, Human
cagcccugggccccaccaccua

SEQ ID NO: 3772728 - RNA, 16 nt, Human
cagcccuggucucagc

SEQ ID NO: 3772729 - RNA, 19 nt, Human
cagcccuggucucagcagc

SEQ ID NO: 3772730 - RNA, 17 nt, Human
cagcccugucagcauga

SEQ ID NO: 3772731 - RNA, 21 nt, Human
cagcccugucagcaugaauuu

SEQ ID NO: 3772732 - RNA, 18 nt, Human
cagcccugucagugcagc

SEQ ID NO: 3772733 - RNA, 21 nt, Human
cagcccugucagugcagcccg

SEQ ID NO: 3772734 - RNA, 16 nt, Human
cagcccuuagcaggga

SEQ ID NO: 3772735 - RNA, 17 nt, Human
cagcccuuccucugcuc

SEQ ID NO: 3772736 - RNA, 15 nt, Human
cagcccuucuuucca

SEQ ID NO: 3772737 - RNA, 20 nt, Human
cagcccuugagggagaacuu

SEQ ID NO: 3772738 - RNA, 14 nt, Human
cagcccuugcuugu

SEQ ID NO: 3772739 - RNA, 12 nt, Human
cagcccuuggcc

SEQ ID NO: 3772740 - RNA, 13 nt, Human
cagcccuuggcca

SEQ ID NO: 3772741 - RNA, 16 nt, Human
cagcccuuuugucucu

SEQ ID NO: 3772742 - RNA, 23 nt, Human
cagcccuuuuguugagccaggcc

SEQ ID NO: 3772743 - RNA, 22 nt, Human
cagccgacccccucucccugca

SEQ ID NO: 3772744 - RNA, 19 nt, Human
cagccgagauagccaaggc

SEQ ID NO: 3772745 - RNA, 19 nt, Human
cagccgagcaggaggccua

SEQ ID NO: 3772746 - RNA, 12 nt, Human
cagccgagccgg

SEQ ID NO: 3772747 - RNA, 17 nt, Human
cagccgagccgggccug

SEQ ID NO: 3772748 - RNA, 14 nt, Human
cagccgagcucgug

SEQ ID NO: 3772749 - RNA, 23 nt, Human
cagccgagcucguguauccuggg

SEQ ID NO: 3772750 - RNA, 14 nt, Human
cagccgccacaucc

SEQ ID NO: 3772751 - RNA, 23 nt, Human
cagccgccacauccccgcuggcu

SEQ ID NO: 3772752 - RNA, 19 nt, Human
cagccgccauugccaccag

SEQ ID NO: 3772753 - RNA, 20 nt, Human
cagccgccccaucugcccca

SEQ ID NO: 3772754 - RNA, 19 nt, Human
cagccgccuuaagcugauc

SEQ ID NO: 3772755 - RNA, 16 nt, Human
cagccgcuccugucug

SEQ ID NO: 3772756 - RNA, 19 nt, Human
cagccgcuccugucugcca

SEQ ID NO: 3772757 - RNA, 22 nt, Human
cagccgcuccugucugccagcc

SEQ ID NO: 3772758 - RNA, 23 nt, Human
cagccgcuccugucugccagcca

SEQ ID NO: 3772759 - RNA, 19 nt, Human
cagccgcucggaggcccca

SEQ ID NO: 3772760 - RNA, 20 nt, Human
cagccgcucggaggccccaa

SEQ ID NO: 3772761 - RNA, 17 nt, Human
cagccgcucuccugcca

SEQ ID NO: 3772762 - RNA, 13 nt, Human
cagccgcugcccg

SEQ ID NO: 3772763 - RNA, 15 nt, Human
cagccgcugcccggc

SEQ ID NO: 3772764 - RNA, 22 nt, Human
cagccgcugcccggcgcccucu

SEQ ID NO: 3772765 - RNA, 21 nt, Human
cagccgcuuggcgaugccagc

SEQ ID NO: 3772766 - RNA, 13 nt, Human
cagccggcacagg

SEQ ID NO: 3772767 - RNA, 18 nt, Human
cagccggcacagggucug

SEQ ID NO: 3772768 - RNA, 14 nt, Human
cagccggccucucu

SEQ ID NO: 3772769 - RNA, 18 nt, Human
cagccggccucucuggcc

SEQ ID NO: 3772770 - RNA, 23 nt, Human
cagccggccucucuggccuccca

SEQ ID NO: 3772771 - RNA, 19 nt, Human
cagggucccugguggcagc

SEQ ID NO: 3772772 - RNA, 12 nt, Human
caggguccugcu

SEQ ID NO: 3772773 - RNA, 20 nt, Human
caggguccugcuauuuccca

SEQ ID NO: 3772774 - RNA, 14 nt, Human
caggguccugggag

SEQ ID NO: 3772775 - RNA, 18 nt, Human
caggguccuguagcccua

SEQ ID NO: 3772776 - RNA, 19 nt, Human
caggguccuuuugacacug

SEQ ID NO: 3772777 - RNA, 21 nt, Human
caggguccuuuugacacugcu

SEQ ID NO: 3772778 - RNA, 18 nt, Human
cagggucucucccucagg

SEQ ID NO: 3772779 - RNA, 13 nt, Human
cagggucucugcu

SEQ ID NO: 3772780 - RNA, 17 nt, Human
cagggucucugcugccg

SEQ ID NO: 3772781 - RNA, 14 nt, Human
cagggucugcucuu

SEQ ID NO: 3772782 - RNA, 22 nt, Human
cagggucugcucuuucucugcc

SEQ ID NO: 3772783 - RNA, 16 nt, Human
cagggucugggcagga

SEQ ID NO: 3772784 - RNA, 15 nt, Human
cagggugagagcugc

SEQ ID NO: 3772785 - RNA, 21 nt, Human
cagggugagagcugcucugga

SEQ ID NO: 3772786 - RNA, 15 nt, Human
cagggugcagcccaa

SEQ ID NO: 3772787 - RNA, 23 nt, Human
cagggugcagcccaaucugccag

SEQ ID NO: 3772788 - RNA, 22 nt, Human
cagggugcccagaacuucccug

SEQ ID NO: 3772789 - RNA, 18 nt, Human
caggguggagugcagugg

SEQ ID NO: 3772790 - RNA, 20 nt, Human
cagggugggauggaggagaa

SEQ ID NO: 3772791 - RNA, 13 nt, Human
cagggugggccuc

SEQ ID NO: 3772792 - RNA, 16 nt, Human
caggguggugcuggga

SEQ ID NO: 3772793 - RNA, 19 nt, Human
caggguggugcugggacug

SEQ ID NO: 3772794 - RNA, 23 nt, Human
cagggugucugcccccuccugag

SEQ ID NO: 3772795 - RNA, 24 nt, Human
cagggugucugcccccuccugagu

SEQ ID NO: 3772796 - RNA, 20 nt, Human
cagggugugagcgccacauc

SEQ ID NO: 3772797 - RNA, 20 nt, Human
caggguucccccagcccugu

SEQ ID NO: 3772798 - RNA, 20 nt, Human
caggguucuccucuccccuc

SEQ ID NO: 3772799 - RNA, 20 nt, Human
caggguugaccccagaggau

SEQ ID NO: 3772800 - RNA, 18 nt, Human
caggguugaucacacucu

SEQ ID NO: 3772801 - RNA, 13 nt, Human
caggguugggccc

SEQ ID NO: 3772802 - RNA, 21 nt, Human
caggguugggcccagaucugg

SEQ ID NO: 3772803 - RNA, 18 nt, Human
caggguuggugugcugag

SEQ ID NO: 3772804 - RNA, 19 nt, Human
caggguuuaucuuuugaga

SEQ ID NO: 3772805 - RNA, 16 nt, Human
caggguuuuaacuuug

SEQ ID NO: 3772806 - RNA, 17 nt, Human
caggguuuuaacuuugu

SEQ ID NO: 3772807 - RNA, 16 nt, Human
caggguuuuaucucug

SEQ ID NO: 3772808 - RNA, 16 nt, Human
caggguuuugccaugu

SEQ ID NO: 3772809 - RNA, 19 nt, Human
caggguuuuuaccugucac

SEQ ID NO: 3772810 - RNA, 15 nt, Human
cagguaaaacagggc

SEQ ID NO: 3772811 - RNA, 14 nt, Human
cagguaacaggcag

SEQ ID NO: 3772812 - RNA, 16 nt, Human
cagguaacaggcagau

SEQ ID NO: 3772813 - RNA, 20 nt, Human
cagguaacaggcagauacag

SEQ ID NO: 3772814 - RNA, 17 nt, Human
cagguaaugagggacug

SEQ ID NO: 3772815 - RNA, 20 nt, Human
cagguaaugagggacuggaa

SEQ ID NO: 3772816 - RNA, 18 nt, Human
cagguaccagcugcgcuu

SEQ ID NO: 3772817 - RNA, 21 nt, Human
cagguaccagcugcgcuugcu

SEQ ID NO: 3772818 - RNA, 20 nt, Human
cagguaccccagcucugcuu

SEQ ID NO: 3772819 - RNA, 22 nt, Human
cagguaccuugaccuuuguaca

SEQ ID NO: 3772820 - RNA, 15 nt, Human
cagguacgcacagac

SEQ ID NO: 3772821 - RNA, 12 nt, Human
cagguacuuugu

SEQ ID NO: 3772822 - RNA, 13 nt, Human
cagguacuuuguc

SEQ ID NO: 3772823 - RNA, 19 nt, Human
cagguagaccugucuccug

SEQ ID NO: 3772824 - RNA, 21 nt, Human
cagguagaccugucuccuggc

SEQ ID NO: 3772825 - RNA, 21 nt, Human
cagguagcauagcucuguaca

SEQ ID NO: 3772826 - RNA, 18 nt, Human
cagguagcugccccuggc

SEQ ID NO: 3772827 - RNA, 19 nt, Human
cagguagcugccccuggcu

SEQ ID NO: 3772828 - RNA, 14 nt, Human
cagguaggaggcaa

SEQ ID NO: 3772829 - RNA, 14 nt, Human
cagguaggccaagg

SEQ ID NO: 3772830 - RNA, 18 nt, Human
cagguaggggccccucuc

SEQ ID NO: 3772831 - RNA, 19 nt, Human
cagguaggggccccucuca

SEQ ID NO: 3772832 - RNA, 22 nt, Human
cagguaggggccccucucagcc

SEQ ID NO: 3772833 - RNA, 23 nt, Human
cagguaggggccccucucagccc

SEQ ID NO: 3772834 - RNA, 17 nt, Human
cagguauagacuccuga

SEQ ID NO: 3772835 - RNA, 18 nt, Human
cagguauauacuuugaaa

SEQ ID NO: 3772836 - RNA, 22 nt, Human
cagguauauacuuugaaaggag

SEQ ID NO: 3772837 - RNA, 14 nt, Human
cagguaucuccagg

SEQ ID NO: 3772838 - RNA, 20 nt, Human
cagguaugaccuucuaggaa

SEQ ID NO: 3772839 - RNA, 14 nt, Human
caggucaacagaau

SEQ ID NO: 3772840 - RNA, 16 nt, Human
caggucaacagaauga

SEQ ID NO: 3772841 - RNA, 18 nt, Human
caggucaacagaaugaaa

SEQ ID NO: 3772842 - RNA, 22 nt, Human
caggucaacagaaugaaaaaug

SEQ ID NO: 3772843 - RNA, 16 nt, Human
caggucagccacuguu

SEQ ID NO: 3772844 - RNA, 18 nt, Human
caggucaggggugacaca

SEQ ID NO: 3772845 - RNA, 19 nt, Human
caggucaucuccuuucauc

SEQ ID NO: 3772846 - RNA, 18 nt, Human
cagguccaaugagcuuuc

SEQ ID NO: 3772847 - RNA, 16 nt, Human
cagguccagcucugga

SEQ ID NO: 3772848 - RNA, 17 nt, Human
cagguccagcucuggag

SEQ ID NO: 3772849 - RNA, 16 nt, Human
cagguccaggcugugu

SEQ ID NO: 3772850 - RNA, 21 nt, Human
caggucccaaauggcccuggg

SEQ ID NO: 3772851 - RNA, 18 nt, Human
caggucccaccuccagcc

SEQ ID NO: 3772852 - RNA, 20 nt, Human
caggucccaccuccagcccg

SEQ ID NO: 3772853 - RNA, 11 nt, Human
caggucccuaa

SEQ ID NO: 3772854 - RNA, 14 nt, Human
caggucccuaauaa

SEQ ID NO: 3772855 - RNA, 21 nt, Human
caggucccuaauaaagcugug

SEQ ID NO: 3772856 - RNA, 22 nt, Human
caggucccuaauaaagcugugu

SEQ ID NO: 3772857 - RNA, 16 nt, Human
caggucccucucauuu

SEQ ID NO: 3772858 - RNA, 15 nt, Human
cagguccucagagaa

SEQ ID NO: 3772859 - RNA, 21 nt, Human
cagguccucugauacccagag

SEQ ID NO: 3772860 - RNA, 22 nt, Human
cagguccucugauacccagagc

SEQ ID NO: 3772861 - RNA, 12 nt, Human
cagguccugcuc

SEQ ID NO: 3772862 - RNA, 18 nt, Human
cagguccugguggggcag

SEQ ID NO: 3772863 - RNA, 19 nt, Human
cagguccugguggggcagc

SEQ ID NO: 3772864 - RNA, 15 nt, Human
caggucgggcucagc

SEQ ID NO: 3772865 - RNA, 21 nt, Human
caggucuaccccucccggccc

SEQ ID NO: 3772866 - RNA, 14 nt, Human
caggucucacgggc

SEQ ID NO: 3772867 - RNA, 12 nt, Human
caggucucccac

SEQ ID NO: 3772868 - RNA, 20 nt, Human
caggucucccacgugggaga

SEQ ID NO: 3772869 - RNA, 11 nt, Human
caggucuccuc

SEQ ID NO: 3772870 - RNA, 13 nt, Human
caggucuccucuu

SEQ ID NO: 3772871 - RNA, 15 nt, Human
caggucuccucuuaa

SEQ ID NO: 3772872 - RNA, 18 nt, Human
caggucuugaacuccugg

SEQ ID NO: 3772873 - RNA, 23 nt, Human
caggucuugaacuccuggccuca

SEQ ID NO: 3772874 - RNA, 20 nt, Human
caggucuuggagcugagccu

SEQ ID NO: 3772875 - RNA, 14 nt, Human
caggucuuuccuaa

SEQ ID NO: 3772876 - RNA, 17 nt, Human
caggugaaaauguucau

SEQ ID NO: 3772877 - RNA, 16 nt, Human
caggugaaacccaguc

SEQ ID NO: 3772878 - RNA, 20 nt, Human
caggugaagcaccaagcuca

SEQ ID NO: 3772879 - RNA, 19 nt, Human
caggugaaggaggcuccag

SEQ ID NO: 3772880 - RNA, 14 nt, Human
caggugacagugag

SEQ ID NO: 3772881 - RNA, 17 nt, Human
caggugaccuucuggga

SEQ ID NO: 3772882 - RNA, 13 nt, Human
caggugagaagca

SEQ ID NO: 3772883 - RNA, 18 nt, Human
caggugaggucagcacau

SEQ ID NO: 3772884 - RNA, 21 nt, Human
caggugaggucagcacaucuc

SEQ ID NO: 3772885 - RNA, 16 nt, Human
caggugaggucuguuc

SEQ ID NO: 3772886 - RNA, 20 nt, Human
caggugauccacccaccuca

SEQ ID NO: 3772887 - RNA, 20 nt, Human
caggugauguuaguguuuua

SEQ ID NO: 3772888 - RNA, 21 nt, Human
caggugauuggaccaggccau

SEQ ID NO: 3772889 - RNA, 15 nt, Human
caggugcacaagcuc

SEQ ID NO: 3772890 - RNA, 18 nt, Human
caggugcacaagcuccaa

SEQ ID NO: 3772891 - RNA, 20 nt, Human
caggugcacaagcuccaagc

SEQ ID NO: 3772892 - RNA, 13 nt, Human
caggugcagagga

SEQ ID NO: 3772893 - RNA, 14 nt, Human
caggugcagccaga

SEQ ID NO: 3772894 - RNA, 16 nt, Human
caggugcagccagagg

SEQ ID NO: 3772895 - RNA, 18 nt, Human
caggugcagcccccacug

SEQ ID NO: 3772896 - RNA, 20 nt, Human
caggugcagcccccacugcc

SEQ ID NO: 3772897 - RNA, 13 nt, Human
caggugcaguggc

SEQ ID NO: 3772898 - RNA, 23 nt, Human
caggugccagccugaggcagcca

SEQ ID NO: 3772899 - RNA, 22 nt, Human
caggugcccagcuauaccugug

SEQ ID NO: 3772900 - RNA, 11 nt, Human
caggugccucc

SEQ ID NO: 3772901 - RNA, 12 nt, Human
caggugccucca

SEQ ID NO: 3772902 - RNA, 18 nt, Human
caggugccuccaggugug

SEQ ID NO: 3772903 - RNA, 20 nt, Human
caggugcuaauuuguuuugg

SEQ ID NO: 3772904 - RNA, 21 nt, Human
caggugcuacacccuuuucca

SEQ ID NO: 3772905 - RNA, 18 nt, Human
caggugcuaggaacacuc

SEQ ID NO: 3772906 - RNA, 15 nt, Human
caggugcuauuguua

SEQ ID NO: 3772907 - RNA, 19 nt, Human
caggugcucaauaaaugau

SEQ ID NO: 3772908 - RNA, 13 nt, Human
caggugcugccau

SEQ ID NO: 3772909 - RNA, 16 nt, Human
caggugcugcuacccu

SEQ ID NO: 3772910 - RNA, 23 nt, Human
caggugcugcuacccucccugcu

SEQ ID NO: 3772911 - RNA, 13 nt, Human
caggugcugcugc

SEQ ID NO: 3772912 - RNA, 19 nt, Human
caggugcuggagcacuggg

SEQ ID NO: 3772913 - RNA, 13 nt, Human
caggugcuggggc

SEQ ID NO: 3772914 - RNA, 16 nt, Human
cagguggaaggcagac

SEQ ID NO: 3772915 - RNA, 20 nt, Human
cagugagaugagggaugggc

SEQ ID NO: 3772916 - RNA, 20 nt, Human
cagugagauuacagaggaag

SEQ ID NO: 3772917 - RNA, 24 nt, Human
cagugagccgagauugcaccacug

SEQ ID NO: 3772918 - RNA, 16 nt, Human
cagugagcgcuugggc

SEQ ID NO: 3772919 - RNA, 17 nt, Human
cagugagcggagaucgc

SEQ ID NO: 3772920 - RNA, 23 nt, Human
cagugagcuggagauacuugguc

SEQ ID NO: 3772921 - RNA, 22 nt, Human
cagugagcuuggaaaggaccag

SEQ ID NO: 3772922 - RNA, 14 nt, Human
cagugaggcucugc

SEQ ID NO: 3772923 - RNA, 16 nt, Human
cagugaggcucugccc

SEQ ID NO: 3772924 - RNA, 19 nt, Human
cagugaggcucugcccuug

SEQ ID NO: 3772925 - RNA, 16 nt, Human
cagugagggucuucuu

SEQ ID NO: 3772926 - RNA, 23 nt, Human
cagugagggucuucuuacaugca

SEQ ID NO: 3772927 - RNA, 17 nt, Human
cagugagguccuggggg

SEQ ID NO: 3772928 - RNA, 19 nt, Human
cagugagguccugggggcc

SEQ ID NO: 3772929 - RNA, 15 nt, Human
cagugaggugcccag

SEQ ID NO: 3772930 - RNA, 16 nt, Human
cagugaggugcccagc

SEQ ID NO: 3772931 - RNA, 19 nt, Human
cagugagucgaggacaggg

SEQ ID NO: 3772932 - RNA, 20 nt, Human
cagugauauggcagaagaca

SEQ ID NO: 3772933 - RNA, 15 nt, Human
cagugauauucuuug

SEQ ID NO: 3772934 - RNA, 18 nt, Human
cagugauauucuuuguua

SEQ ID NO: 3772935 - RNA, 15 nt, Human
cagugaucuccauau

SEQ ID NO: 3772936 - RNA, 18 nt, Human
cagugaugcuggaugcuc

SEQ ID NO: 3772937 - RNA, 20 nt, Human
cagugaugcuggaugcuccu

SEQ ID NO: 3772938 - RNA, 22 nt, Human
cagugaugugccuaaauaaguu

SEQ ID NO: 3772939 - RNA, 21 nt, Human
cagugauuaaggucucucuuu

SEQ ID NO: 3772940 - RNA, 18 nt, Human
cagugauuaccagggacu

SEQ ID NO: 3772941 - RNA, 14 nt, Human
cagugauuagcacu

SEQ ID NO: 3772942 - RNA, 18 nt, Human
cagugauucgagcuauau

SEQ ID NO: 3772943 - RNA, 14 nt, Human
cagugauuuuuauc

SEQ ID NO: 3772944 - RNA, 17 nt, Human
cagugauuuuuauccaa

SEQ ID NO: 3772945 - RNA, 22 nt, Human
cagugauuuuuuucuuguaauu

SEQ ID NO: 3772946 - RNA, 18 nt, Human
cagugauuuuuuuuuaga

SEQ ID NO: 3772947 - RNA, 14 nt, Human
cagugcaacacugg

SEQ ID NO: 3772948 - RNA, 15 nt, Human
cagugcaaccucugc

SEQ ID NO: 3772949 - RNA, 14 nt, Human
cagugcaagaagga

SEQ ID NO: 3772950 - RNA, 18 nt, Human
cagugcaagagacucugg

SEQ ID NO: 3772951 - RNA, 19 nt, Human
cagugcaagagacucuggc

SEQ ID NO: 3772952 - RNA, 21 nt, Human
cagugcaagagacucuggccu

SEQ ID NO: 3772953 - RNA, 24 nt, Human
cagugcaagagacucuggccucca

SEQ ID NO: 3772954 - RNA, 15 nt, Human
cagugcacccacucu

SEQ ID NO: 3772955 - RNA, 15 nt, Human
cagugcaccugggac

SEQ ID NO: 3772956 - RNA, 22 nt, Human
cagugcacuaauguguaagaca

SEQ ID NO: 3772957 - RNA, 14 nt, Human
cagugcacugaaag

SEQ ID NO: 3772958 - RNA, 16 nt, Human
cagugcagagccuucu

SEQ ID NO: 3772959 - RNA, 19 nt, Human
cagugcagagccuucucag

SEQ ID NO: 3772960 - RNA, 20 nt, Human
cagugcagcaaccagagcac

SEQ ID NO: 3772961 - RNA, 23 nt, Human
cagugcagcaaccagagcacugu

SEQ ID NO: 3772962 - RNA, 13 nt, Human
cagugcagcaaua

SEQ ID NO: 3772963 - RNA, 14 nt, Human
cagugcaggcacag

SEQ ID NO: 3772964 - RNA, 17 nt, Human
cagugcagggcaaaaua

SEQ ID NO: 3772965 - RNA, 14 nt, Human
cagugcaguauaga

SEQ ID NO: 3772966 - RNA, 22 nt, Human
cagugcaguuugguguguccuc

SEQ ID NO: 3772967 - RNA, 21 nt, Human
cagugcauaguuguagacaaa

SEQ ID NO: 3772968 - RNA, 18 nt, Human
cagugcauauuccuuucu

SEQ ID NO: 3772969 - RNA, 17 nt, Human
cagugcaugcugucccu

SEQ ID NO: 3772970 - RNA, 19 nt, Human
cagugcaugcugucccuua

SEQ ID NO: 3772971 - RNA, 22 nt, Human
cagugcaugcugucccuuacgu

SEQ ID NO: 3772972 - RNA, 15 nt, Human
cagugcaugguggcc

SEQ ID NO: 3772973 - RNA, 20 nt, Human
cagugcaugguggccagagg

SEQ ID NO: 3772974 - RNA, 16 nt, Human
cagugccaacuguggc

SEQ ID NO: 3772975 - RNA, 19 nt, Human
cagugccaacuguggcugg

SEQ ID NO: 3772976 - RNA, 20 nt, Human
cagugccaacuguggcuggu

SEQ ID NO: 3772977 - RNA, 23 nt, Human
cagugccaagcacagugccugca

SEQ ID NO: 3772978 - RNA, 13 nt, Human
cagugccaaggac

SEQ ID NO: 3772979 - RNA, 16 nt, Human
cagugccauugucuuu

SEQ ID NO: 3772980 - RNA, 17 nt, Human
cagugccauugucuuua

SEQ ID NO: 3772981 - RNA, 22 nt, Human
cagugcccacaggaucagucug

SEQ ID NO: 3772982 - RNA, 11 nt, Human
cagugcccagg

SEQ ID NO: 3772983 - RNA, 13 nt, Human
cagugcccagggc

SEQ ID NO: 3772984 - RNA, 13 nt, Human
cagugcccaggug

SEQ ID NO: 3772985 - RNA, 22 nt, Human
cagugcccagguggcuguggaa

SEQ ID NO: 3772986 - RNA, 13 nt, Human
cagugcccuccag

SEQ ID NO: 3772987 - RNA, 15 nt, Human
cagugcccugagcca

SEQ ID NO: 3772988 - RNA, 16 nt, Human
cagugcccugagccag

SEQ ID NO: 3772989 - RNA, 18 nt, Human
cagugccgccgccucgcc

SEQ ID NO: 3772990 - RNA, 19 nt, Human
cagugccgccgccucgccc

SEQ ID NO: 3772991 - RNA, 15 nt, Human
cagugccuaaaauaa

SEQ ID NO: 3772992 - RNA, 15 nt, Human
cagugccuauugaua

SEQ ID NO: 3772993 - RNA, 22 nt, Human
cagugccucucccugcugcucc

SEQ ID NO: 3772994 - RNA, 12 nt, Human
cagugccugcug

SEQ ID NO: 3772995 - RNA, 14 nt, Human
cagugccugggaau

SEQ ID NO: 3772996 - RNA, 21 nt, Human
cagugccuuauggaacacucu

SEQ ID NO: 3772997 - RNA, 15 nt, Human
cagugccuucaauaa

SEQ ID NO: 3772998 - RNA, 16 nt, Human
cagugccuucaauaaa

SEQ ID NO: 3772999 - RNA, 15 nt, Human
cagugccuuccauaa

SEQ ID NO: 3773000 - RNA, 16 nt, Human
cagugcgggugcagac

SEQ ID NO: 3773001 - RNA, 17 nt, Human
cagugcuaaaaauggga

SEQ ID NO: 3773002 - RNA, 21 nt, Human
cagugcuagugagcugggcau

SEQ ID NO: 3773003 - RNA, 12 nt, Human
cagugcucaccc

SEQ ID NO: 3773004 - RNA, 13 nt, Human
cagugcucaccca

SEQ ID NO: 3773005 - RNA, 18 nt, Human
cagugcucacccacacca

SEQ ID NO: 3773006 - RNA, 15 nt, Human
cagugcucgcuguug

SEQ ID NO: 3773007 - RNA, 16 nt, Human
cagugcucgcuguugc

SEQ ID NO: 3773008 - RNA, 17 nt, Human
cagugcucgcuguugcu

SEQ ID NO: 3773009 - RNA, 14 nt, Human
cagugcucuuuucu

SEQ ID NO: 3773010 - RNA, 23 nt, Human
cagugcugaccagacagccuccc

SEQ ID NO: 3773011 - RNA, 15 nt, Human
cagugcugcagcucc

SEQ ID NO: 3773012 - RNA, 15 nt, Human
cagugcuguacuuga

SEQ ID NO: 3773013 - RNA, 19 nt, Human
cagugcugucugaucugug

SEQ ID NO: 3773014 - RNA, 22 nt, Human
cagugcugugcugugcuauggu

SEQ ID NO: 3773015 - RNA, 12 nt, Human
cagugcuguggc

SEQ ID NO: 3773016 - RNA, 13 nt, Human
cagugcuguggcc

SEQ ID NO: 3773017 - RNA, 18 nt, Human
cagugcuguggccugggc

SEQ ID NO: 3773018 - RNA, 20 nt, Human
cagugcuugaguuuggggaa

SEQ ID NO: 3773019 - RNA, 19 nt, Human
cagugcuugauugcgugga

SEQ ID NO: 3773020 - RNA, 14 nt, Human
cagugcuugccaca

SEQ ID NO: 3773021 - RNA, 15 nt, Human
cagugcuuggcccag

SEQ ID NO: 3773022 - RNA, 16 nt, Human
cagugcuuuaauggca

SEQ ID NO: 3773023 - RNA, 18 nt, Human
caguggacuuuccacccc

SEQ ID NO: 3773024 - RNA, 14 nt, Human
caguggagaauuau

SEQ ID NO: 3773025 - RNA, 16 nt, Human
caguggagcccaggag

SEQ ID NO: 3773026 - RNA, 17 nt, Human
caguggaucacaaagug

SEQ ID NO: 3773027 - RNA, 14 nt, Human
caguggauuaauua

SEQ ID NO: 3773028 - RNA, 16 nt, Human
caguggauugcauuuc

SEQ ID NO: 3773029 - RNA, 12 nt, Human
caguggcagcug

SEQ ID NO: 3773030 - RNA, 13 nt, Human
caguggcagcugc

SEQ ID NO: 3773031 - RNA, 15 nt, Human
caguggcagcugcuu

SEQ ID NO: 3773032 - RNA, 13 nt, Human
caguggcaggcag

SEQ ID NO: 3773033 - RNA, 14 nt, Human
caguggcaggcaga

SEQ ID NO: 3773034 - RNA, 16 nt, Human
caguggcagggcacag

SEQ ID NO: 3773035 - RNA, 16 nt, Human
caguggcauggcucca

SEQ ID NO: 3773036 - RNA, 18 nt, Human
caguggccuacaaaucag

SEQ ID NO: 3773037 - RNA, 16 nt, Human
caguggccucaacccu

SEQ ID NO: 3773038 - RNA, 22 nt, Human
caguggccucaacccucccuca

SEQ ID NO: 3773039 - RNA, 23 nt, Human
caguggccucaacccucccucag

SEQ ID NO: 3773040 - RNA, 18 nt, Human
caguggccuuaccccugc

SEQ ID NO: 3773041 - RNA, 17 nt, Human
caguggccuuccccagc

SEQ ID NO: 3773042 - RNA, 21 nt, Human
caguggcgugaucucagcuca

SEQ ID NO: 3773043 - RNA, 20 nt, Human
caguggcucacgccuaugau

SEQ ID NO: 3773044 - RNA, 18 nt, Human
caguggcugguccagggc

SEQ ID NO: 3773045 - RNA, 20 nt, Human
caguggcugguccagggcua

SEQ ID NO: 3773046 - RNA, 13 nt, Human
caguggcugucac

SEQ ID NO: 3773047 - RNA, 15 nt, Human
cagugggagauguua

SEQ ID NO: 3773048 - RNA, 18 nt, Human
cagugggagcugccuguu

SEQ ID NO: 3773049 - RNA, 11 nt, Human
cagugggaggg

SEQ ID NO: 3773050 - RNA, 14 nt, Human
cagugggaggggca

SEQ ID NO: 3773051 - RNA, 19 nt, Human
cagugggaggggcaggcug

SEQ ID NO: 3773052 - RNA, 20 nt, Human
cagugggaggggcaggcuga

SEQ ID NO: 3773053 - RNA, 18 nt, Human
cagugggauuugguaaug

SEQ ID NO: 3773054 - RNA, 15 nt, Human
cagugggccuggcca

SEQ ID NO: 3773055 - RNA, 13 nt, Human
caguggggcagag

SEQ ID NO: 3773056 - RNA, 15 nt, Human
caguggggcagucau

SEQ ID NO: 3773057 - RNA, 21 nt, Human
caguggggccugaggcuccuu

SEQ ID NO: 3773058 - RNA, 15 nt, Human
caguggggccugugg

SEQ ID NO: 3773059 - RNA, 18 nt, Human
caguggggcucucugagu

SEQ ID NO: 3773060 - RNA, 20 nt, Human
caugcuacacacugcauguu

SEQ ID NO: 3773061 - RNA, 14 nt, Human
caugcucaaugaaa

SEQ ID NO: 3773062 - RNA, 18 nt, Human
caugcucaucugcugguc

SEQ ID NO: 3773063 - RNA, 17 nt, Human
caugcuccucacugccc

SEQ ID NO: 3773064 - RNA, 20 nt, Human
caugcuccucacugcccgca

SEQ ID NO: 3773065 - RNA, 19 nt, Human
caugcuccucuuccccaga

SEQ ID NO: 3773066 - RNA, 13 nt, Human
caugcucucugca

SEQ ID NO: 3773067 - RNA, 16 nt, Human
caugcucugcaaaagg

SEQ ID NO: 3773068 - RNA, 16 nt, Human
caugcucuuagaaaau

SEQ ID NO: 3773069 - RNA, 16 nt, Human
caugcugaagccaaag

SEQ ID NO: 3773070 - RNA, 18 nt, Human
caugcugaagggaccuug

SEQ ID NO: 3773071 - RNA, 19 nt, Human
caugcugacuguccucucc

SEQ ID NO: 3773072 - RNA, 21 nt, Human
caugcugacuuucauuucuug

SEQ ID NO: 3773073 - RNA, 15 nt, Human
caugcugaggccugg

SEQ ID NO: 3773074 - RNA, 14 nt, Human
caugcugagucucc

SEQ ID NO: 3773075 - RNA, 20 nt, Human
caugcugagucucccaaggc

SEQ ID NO: 3773076 - RNA, 22 nt, Human
caugcugccaauauccuaauaa

SEQ ID NO: 3773077 - RNA, 16 nt, Human
caugcugccccugccu

SEQ ID NO: 3773078 - RNA, 14 nt, Human
caugcugccuccag

SEQ ID NO: 3773079 - RNA, 22 nt, Human
caugcugcuggggaagacagug

SEQ ID NO: 3773080 - RNA, 12 nt, Human
caugcugcuuua

SEQ ID NO: 3773081 - RNA, 13 nt, Human
caugcugcuuuaa

SEQ ID NO: 3773082 - RNA, 20 nt, Human
caugcugcuuuaauugugaa

SEQ ID NO: 3773083 - RNA, 18 nt, Human
caugcuggaaccugcaaa

SEQ ID NO: 3773084 - RNA, 12 nt, Human
caugcuggagcc

SEQ ID NO: 3773085 - RNA, 22 nt, Human
caugcuggagccuguguaacag

SEQ ID NO: 3773086 - RNA, 13 nt, Human
caugcuggccagc

SEQ ID NO: 3773087 - RNA, 22 nt, Human
caugcuggcucccagggccaug

SEQ ID NO: 3773088 - RNA, 13 nt, Human
caugcugggauuu

SEQ ID NO: 3773089 - RNA, 14 nt, Human
caugcugggauuuc

SEQ ID NO: 3773090 - RNA, 17 nt, Human
caugcuggguucugcac

SEQ ID NO: 3773091 - RNA, 16 nt, Human
caugcuguacauacuu

SEQ ID NO: 3773092 - RNA, 13 nt, Human
caugcugucccuu

SEQ ID NO: 3773093 - RNA, 15 nt, Human
caugcugucccuuac

SEQ ID NO: 3773094 - RNA, 22 nt, Human
caugcugucccuuacgugaguc

SEQ ID NO: 3773095 - RNA, 18 nt, Human
caugcugucuggcacagc

SEQ ID NO: 3773096 - RNA, 20 nt, Human
caugcugucuggcacagccu

SEQ ID NO: 3773097 - RNA, 12 nt, Human
caugcuguguaa

SEQ ID NO: 3773098 - RNA, 14 nt, Human
caugcuguuauuua

SEQ ID NO: 3773099 - RNA, 15 nt, Human
caugcuguucaugaa

SEQ ID NO: 3773100 - RNA, 18 nt, Human
caugcuguucaugaaaga

SEQ ID NO: 3773101 - RNA, 17 nt, Human
caugcuguugauugcua

SEQ ID NO: 3773102 - RNA, 20 nt, Human
caugcuguugauugcuaaau

SEQ ID NO: 3773103 - RNA, 14 nt, Human
caugcuuaaauuuu

SEQ ID NO: 3773104 - RNA, 17 nt, Human
caugcuuagcagucccc

SEQ ID NO: 3773105 - RNA, 16 nt, Human
caugcuuagucacugc

SEQ ID NO: 3773106 - RNA, 17 nt, Human
caugcuuagucacugcc

SEQ ID NO: 3773107 - RNA, 18 nt, Human
caugcuuagucacugccu

SEQ ID NO: 3773108 - RNA, 15 nt, Human
caugcuuaugacaau

SEQ ID NO: 3773109 - RNA, 15 nt, Human
caugcuucccuuucc

SEQ ID NO: 3773110 - RNA, 22 nt, Human
caugcuucucaucuugugaaau

SEQ ID NO: 3773111 - RNA, 14 nt, Human
caugcuucuuccuu

SEQ ID NO: 3773112 - RNA, 14 nt, Human
caugcuugaugguu

SEQ ID NO: 3773113 - RNA, 19 nt, Human
caugcuugugaaaaugugu

SEQ ID NO: 3773114 - RNA, 13 nt, Human
caugcuuguguua

SEQ ID NO: 3773115 - RNA, 17 nt, Human
caugcuuuccauauuuu

SEQ ID NO: 3773116 - RNA, 15 nt, Human
cauggaaaaaugcca

SEQ ID NO: 3773117 - RNA, 13 nt, Human
cauggaaauauua

SEQ ID NO: 3773118 - RNA, 15 nt, Human
cauggaaaucagcca

SEQ ID NO: 3773119 - RNA, 18 nt, Human
cauggaaaugaagcaggg

SEQ ID NO: 3773120 - RNA, 21 nt, Human
cauggaaauuuaaagcagguu

SEQ ID NO: 3773121 - RNA, 23 nt, Human
cauggaacacaaacacauuguua

SEQ ID NO: 3773122 - RNA, 19 nt, Human
cauggaacgcguugaaauu

SEQ ID NO: 3773123 - RNA, 20 nt, Human
cauggaacgcguugaaauug

SEQ ID NO: 3773124 - RNA, 17 nt, Human
cauggaacucauuccug

SEQ ID NO: 3773125 - RNA, 13 nt, Human
cauggaagauuga

SEQ ID NO: 3773126 - RNA, 14 nt, Human
cauggaagggaaga

SEQ ID NO: 3773127 - RNA, 16 nt, Human
cauggaauaacaugua

SEQ ID NO: 3773128 - RNA, 15 nt, Human
cauggaaugaggguu

SEQ ID NO: 3773129 - RNA, 19 nt, Human
cauggaauggacauccugu

SEQ ID NO: 3773130 - RNA, 17 nt, Human
cauggacaauggaccgg

SEQ ID NO: 3773131 - RNA, 18 nt, Human
cauggacaauggaccgga

SEQ ID NO: 3773132 - RNA, 20 nt, Human
cauggacaauggaccggaga

SEQ ID NO: 3773133 - RNA, 22 nt, Human
cauggacaccccuuauccagga

SEQ ID NO: 3773134 - RNA, 23 nt, Human
cauggacaccccuuauccaggac

SEQ ID NO: 3773135 - RNA, 16 nt, Human
cauggacacuacaccc

SEQ ID NO: 3773136 - RNA, 21 nt, Human
cauggacacuacacccagcaa

SEQ ID NO: 3773137 - RNA, 23 nt, Human
cauggacacuacacccagcaaua

SEQ ID NO: 3773138 - RNA, 12 nt, Human
cauggacacucc

SEQ ID NO: 3773139 - RNA, 18 nt, Human
cauggacacuccagugcc

SEQ ID NO: 3773140 - RNA, 19 nt, Human
cauggacacuccagugcca

SEQ ID NO: 3773141 - RNA, 17 nt, Human
cauggacagaagaaggc

SEQ ID NO: 3773142 - RNA, 14 nt, Human
cauggacagaauuu

SEQ ID NO: 3773143 - RNA, 16 nt, Human
cauggacaggcuggcu

SEQ ID NO: 3773144 - RNA, 18 nt, Human
cauggacaugaucuucuu

SEQ ID NO: 3773145 - RNA, 19 nt, Human
cauggacguucggggcaug

SEQ ID NO: 3773146 - RNA, 23 nt, Human
cauggacucuguccugaaggccu

SEQ ID NO: 3773147 - RNA, 15 nt, Human
cauggacuucacaua

SEQ ID NO: 3773148 - RNA, 15 nt, Human
cauggacuuccacug

SEQ ID NO: 3773149 - RNA, 17 nt, Human
cauggacuucuggaugc

SEQ ID NO: 3773150 - RNA, 13 nt, Human
cauggacuuguau

SEQ ID NO: 3773151 - RNA, 13 nt, Human
cauggacuuuaua

SEQ ID NO: 3773152 - RNA, 14 nt, Human
cauggagaaacccu

SEQ ID NO: 3773153 - RNA, 13 nt, Human
cauggagaaagcu

SEQ ID NO: 3773154 - RNA, 18 nt, Human
cauggagaaagcugacuu

SEQ ID NO: 3773155 - RNA, 20 nt, Human
cauggagaaagcugacuugg

SEQ ID NO: 3773156 - RNA, 21 nt, Human
cauggagaaagcugacuuggc

SEQ ID NO: 3773157 - RNA, 22 nt, Human
cauggagaaagcugacuuggcu

SEQ ID NO: 3773158 - RNA, 19 nt, Human
cauggagaacagugauuuu

SEQ ID NO: 3773159 - RNA, 15 nt, Human
cauggagaagcagaa

SEQ ID NO: 3773160 - RNA, 14 nt, Human
cauggagccagcuc

SEQ ID NO: 3773161 - RNA, 17 nt, Human
cauggagccagcucccu

SEQ ID NO: 3773162 - RNA, 15 nt, Human
cauggagccccagcc

SEQ ID NO: 3773163 - RNA, 16 nt, Human
cauggagccccagccc

SEQ ID NO: 3773164 - RNA, 17 nt, Human
cauggagccccagcccc

SEQ ID NO: 3773165 - RNA, 12 nt, Human
cauggagcuggc

SEQ ID NO: 3773166 - RNA, 15 nt, Human
cauggagcugggcua

SEQ ID NO: 3773167 - RNA, 22 nt, Human
cauggaggagcuugggggauga

SEQ ID NO: 3773168 - RNA, 19 nt, Human
cauggaggcacacagcugc

SEQ ID NO: 3773169 - RNA, 20 nt, Human
cauggaggcacacagcugca

SEQ ID NO: 3773170 - RNA, 13 nt, Human
cauggagguucua

SEQ ID NO: 3773171 - RNA, 16 nt, Human
cauggagguucuaagg

SEQ ID NO: 3773172 - RNA, 16 nt, Human
cauggaguauauguca

SEQ ID NO: 3773173 - RNA, 13 nt, Human
cauggaguggcag

SEQ ID NO: 3773174 - RNA, 15 nt, Human
cauggaguggcagcc

SEQ ID NO: 3773175 - RNA, 19 nt, Human
cauggaguggcagcccagc

SEQ ID NO: 3773176 - RNA, 23 nt, Human
cauggaguggcagcccagccagc

SEQ ID NO: 3773177 - RNA, 20 nt, Human
cauggaguguguauuguucc

SEQ ID NO: 3773178 - RNA, 21 nt, Human
cauggaguguguauuguuccc

SEQ ID NO: 3773179 - RNA, 14 nt, Human
cauggaguugugau

SEQ ID NO: 3773180 - RNA, 18 nt, Human
cauggauauaguuuuacu

SEQ ID NO: 3773181 - RNA, 14 nt, Human
cauggauggaaaac

SEQ ID NO: 3773182 - RNA, 12 nt, Human
cauggauguuuu

SEQ ID NO: 3773183 - RNA, 12 nt, Human
cauggauuucuu

SEQ ID NO: 3773184 - RNA, 14 nt, Human
cauggauuuuccag

SEQ ID NO: 3773185 - RNA, 18 nt, Human
cauggcacuugcaucugu

SEQ ID NO: 3773186 - RNA, 13 nt, Human
cauggcagaaggc

SEQ ID NO: 3773187 - RNA, 20 nt, Human
cauggcagauguaggaggga

SEQ ID NO: 3773188 - RNA, 15 nt, Human
cauggcagcccucgg

SEQ ID NO: 3773189 - RNA, 13 nt, Human
cauggcagggggc

SEQ ID NO: 3773190 - RNA, 17 nt, Human
cauggcagggggcugcu

SEQ ID NO: 3773191 - RNA, 18 nt, Human
cauggcagggggcugcug

SEQ ID NO: 3773192 - RNA, 13 nt, Human
cauggcauauuuu

SEQ ID NO: 3773193 - RNA, 15 nt, Human
cauggcauauuuuuc

SEQ ID NO: 3773194 - RNA, 19 nt, Human
cauggcaucaccuccacca

SEQ ID NO: 3773195 - RNA, 22 nt, Human
cauggcauccuccagccccugu

SEQ ID NO: 3773196 - RNA, 18 nt, Human
cauggcaugcuuaaauuu

SEQ ID NO: 3773197 - RNA, 21 nt, Human
cauggcaugguuuugugccau

SEQ ID NO: 3773198 - RNA, 19 nt, Human
cauggccacacugugacac

SEQ ID NO: 3773199 - RNA, 22 nt, Human
cauggccacuugggucuucccu

SEQ ID NO: 3773200 - RNA, 14 nt, Human
cauggccagcugga

SEQ ID NO: 3773201 - RNA, 14 nt, Human
cauggccagguggc

SEQ ID NO: 3773202 - RNA, 15 nt, Human
cauggcccucauuaa

SEQ ID NO: 3773203 - RNA, 22 nt, Human
cauggcccucauuaaugacacu

SEQ ID NO: 3773204 - RNA, 17 nt, Human
cauggcccugagcgagu

SEQ ID NO: 3773205 - RNA, 13 nt, Human
cauggcccugggc

SEQ ID NO: 3773206 - RNA, 18 nt, Human
cauuagguuguccuagaa

SEQ ID NO: 3773207 - RNA, 16 nt, Human
cauuaguaaaugucuu

SEQ ID NO: 3773208 - RNA, 18 nt, Human
cauuaguaaaugucuuug

SEQ ID NO: 3773209 - RNA, 14 nt, Human
cauuaguacuuuau

SEQ ID NO: 3773210 - RNA, 22 nt, Human
cauuagucucagugaagacuau

SEQ ID NO: 3773211 - RNA, 13 nt, Human
cauuaguuuugaa

SEQ ID NO: 3773212 - RNA, 18 nt, Human
cauuauaaccuuaauuua

SEQ ID NO: 3773213 - RNA, 13 nt, Human
cauuauaaugaau

SEQ ID NO: 3773214 - RNA, 17 nt, Human
cauuauauagcaguaaa

SEQ ID NO: 3773215 - RNA, 12 nt, Human
cauuauauuuau

SEQ ID NO: 3773216 - RNA, 14 nt, Human
cauuaucaugugua

SEQ ID NO: 3773217 - RNA, 21 nt, Human
cauuaucgagcagcauuuuau

SEQ ID NO: 3773218 - RNA, 20 nt, Human
cauuaucgccuuuugacagc

SEQ ID NO: 3773219 - RNA, 18 nt, Human
cauuaucgggagcagugu

SEQ ID NO: 3773220 - RNA, 20 nt, Human
cauuaucgggagcagugucu

SEQ ID NO: 3773221 - RNA, 21 nt, Human
cauuaucgggagcagugucuu

SEQ ID NO: 3773222 - RNA, 23 nt, Human
cauuaucgggagcagugucuucc

SEQ ID NO: 3773223 - RNA, 12 nt, Human
cauuaucuagau

SEQ ID NO: 3773224 - RNA, 12 nt, Human
cauuaucucaaa

SEQ ID NO: 3773225 - RNA, 21 nt, Human
cauuaugaugugggucaagga

SEQ ID NO: 3773226 - RNA, 22 nt, Human
cauuaugaugugggucaaggaa

SEQ ID NO: 3773227 - RNA, 13 nt, Human
cauuaugaugugu

SEQ ID NO: 3773228 - RNA, 14 nt, Human
cauuaugauucuuu

SEQ ID NO: 3773229 - RNA, 21 nt, Human
cauuauggguuaggcauuaau

SEQ ID NO: 3773230 - RNA, 22 nt, Human
cauuauguccacuguguauaga

SEQ ID NO: 3773231 - RNA, 12 nt, Human
cauuaugugugc

SEQ ID NO: 3773232 - RNA, 14 nt, Human
cauuauguuaauau

SEQ ID NO: 3773233 - RNA, 16 nt, Human
cauuauguuaauauuu

SEQ ID NO: 3773234 - RNA, 17 nt, Human
cauuauuaaauuguaaa

SEQ ID NO: 3773235 - RNA, 19 nt, Human
cauuauuaguacugcucuu

SEQ ID NO: 3773236 - RNA, 15 nt, Human
cauuauucaaaguug

SEQ ID NO: 3773237 - RNA, 16 nt, Human
cauuauucaaaguugc

SEQ ID NO: 3773238 - RNA, 13 nt, Human
cauuauucauuua

SEQ ID NO: 3773239 - RNA, 16 nt, Human
cauuauucauuuagug

SEQ ID NO: 3773240 - RNA, 22 nt, Human
cauuauucucugcuauauauaa

SEQ ID NO: 3773241 - RNA, 18 nt, Human
cauuauucucuuuuaucu

SEQ ID NO: 3773242 - RNA, 22 nt, Human
cauuauuuauucagcuucauuu

SEQ ID NO: 3773243 - RNA, 13 nt, Human
cauuauuugcaug

SEQ ID NO: 3773244 - RNA, 12 nt, Human
cauuauuuuauu

SEQ ID NO: 3773245 - RNA, 23 nt, Human
cauucaaaauaggguauauuuuc

SEQ ID NO: 3773246 - RNA, 13 nt, Human
cauucaaauuugu

SEQ ID NO: 3773247 - RNA, 15 nt, Human
cauucaaauuugucu

SEQ ID NO: 3773248 - RNA, 12 nt, Human
cauucaacaaga

SEQ ID NO: 3773249 - RNA, 18 nt, Human
cauucaacagagacugaa

SEQ ID NO: 3773250 - RNA, 17 nt, Human
cauucaacccuggagag

SEQ ID NO: 3773251 - RNA, 16 nt, Human
cauucaagucagcucu

SEQ ID NO: 3773252 - RNA, 17 nt, Human
cauucaaguguaaaaua

SEQ ID NO: 3773253 - RNA, 21 nt, Human
cauucaaguguaaaauauuuu

SEQ ID NO: 3773254 - RNA, 22 nt, Human
cauucaaguguaaaauauuuug

SEQ ID NO: 3773255 - RNA, 21 nt, Human
cauucaauaagcaucaaacuc

SEQ ID NO: 3773256 - RNA, 22 nt, Human
cauucaauaagcaucaaacucu

SEQ ID NO: 3773257 - RNA, 13 nt, Human
cauucaauguuua

SEQ ID NO: 3773258 - RNA, 20 nt, Human
cauucaauuuauucaagaaa

SEQ ID NO: 3773259 - RNA, 21 nt, Human
cauucaauuuauucaagaaaa

SEQ ID NO: 3773260 - RNA, 23 nt, Human
cauucacaguucuuugggccaga

SEQ ID NO: 3773261 - RNA, 15 nt, Human
cauucaccugcccca

SEQ ID NO: 3773262 - RNA, 16 nt, Human
cauucaccugccccaa

SEQ ID NO: 3773263 - RNA, 19 nt, Human
cauucaccugccccaacuc

SEQ ID NO: 3773264 - RNA, 16 nt, Human
cauucacucuuccaga

SEQ ID NO: 3773265 - RNA, 20 nt, Human
cauucacuucacugugcugu

SEQ ID NO: 3773266 - RNA, 13 nt, Human
cauucacuucucu

SEQ ID NO: 3773267 - RNA, 15 nt, Human
cauucacuugcauuu

SEQ ID NO: 3773268 - RNA, 18 nt, Human
cauucacuugcauuucuu

SEQ ID NO: 3773269 - RNA, 13 nt, Human
cauucagaacacc

SEQ ID NO: 3773270 - RNA, 21 nt, Human
cauucagaacaccaagacuug

SEQ ID NO: 3773271 - RNA, 15 nt, Human
cauucagagagcagc

SEQ ID NO: 3773272 - RNA, 15 nt, Human
cauucagcaagacaa

SEQ ID NO: 3773273 - RNA, 21 nt, Human
cauucagcugagguucauuac

SEQ ID NO: 3773274 - RNA, 15 nt, Human
cauucaggaaccugg

SEQ ID NO: 3773275 - RNA, 13 nt, Human
cauucaggaauuc

SEQ ID NO: 3773276 - RNA, 16 nt, Human
cauucaggagcuuccu

SEQ ID NO: 3773277 - RNA, 21 nt, Human
cauucagugauuacugucaag

SEQ ID NO: 3773278 - RNA, 19 nt, Human
cauucauaaaccuugucua

SEQ ID NO: 3773279 - RNA, 17 nt, Human
cauucauauuacaauau

SEQ ID NO: 3773280 - RNA, 17 nt, Human
cauucauggaccacugu

SEQ ID NO: 3773281 - RNA, 15 nt, Human
cauucauuuuauauu

SEQ ID NO: 3773282 - RNA, 20 nt, Human
cauucauuuuauauugaaaa

SEQ ID NO: 3773283 - RNA, 22 nt, Human
cauucauuuuauauugaaaaaa

SEQ ID NO: 3773284 - RNA, 23 nt, Human
cauucauuuuauauugaaaaaaa

SEQ ID NO: 3773285 - RNA, 13 nt, Human
cauucauuuuuau

SEQ ID NO: 3773286 - RNA, 15 nt, Human
cauuccaaaacgaag

SEQ ID NO: 3773287 - RNA, 16 nt, Human
cauuccaaagaacagc

SEQ ID NO: 3773288 - RNA, 16 nt, Human
cauuccaaagcuuuau

SEQ ID NO: 3773289 - RNA, 14 nt, Human
cauuccaacaaagg

SEQ ID NO: 3773290 - RNA, 21 nt, Human
cauuccaacucguauagcaug

SEQ ID NO: 3773291 - RNA, 21 nt, Human
cauuccaagaauagcaucugu

SEQ ID NO: 3773292 - RNA, 17 nt, Human
cauuccaccuucccaug

SEQ ID NO: 3773293 - RNA, 14 nt, Human
cauuccagaggaag

SEQ ID NO: 3773294 - RNA, 13 nt, Human
cauuccagccccu

SEQ ID NO: 3773295 - RNA, 19 nt, Human
cauuccagccccucugguc

SEQ ID NO: 3773296 - RNA, 17 nt, Human
cauuccaggcagccucu

SEQ ID NO: 3773297 - RNA, 15 nt, Human
cauuccaugugccca

SEQ ID NO: 3773298 - RNA, 14 nt, Human
cauuccauucugga

SEQ ID NO: 3773299 - RNA, 13 nt, Human
cauuccauugccu

SEQ ID NO: 3773300 - RNA, 21 nt, Human
cauuccauugccuagcucuuu

SEQ ID NO: 3773301 - RNA, 17 nt, Human
cauucccagcucuaccc

SEQ ID NO: 3773302 - RNA, 15 nt, Human
cauuccccagccucu

SEQ ID NO: 3773303 - RNA, 15 nt, Human
cauuccccaggaggc

SEQ ID NO: 3773304 - RNA, 19 nt, Human
cauuccccaggaggccagc

SEQ ID NO: 3773305 - RNA, 20 nt, Human
cauucccgcagugggagcaa

SEQ ID NO: 3773306 - RNA, 13 nt, Human
cauucccucccau

SEQ ID NO: 3773307 - RNA, 21 nt, Human
cauucccucucaucucaggua

SEQ ID NO: 3773308 - RNA, 10 nt, Human
cauucccugg

SEQ ID NO: 3773309 - RNA, 12 nt, Human
cauucccuggga

SEQ ID NO: 3773310 - RNA, 23 nt, Human
cauuccuaacacagcauguguau

SEQ ID NO: 3773311 - RNA, 13 nt, Human
cauuccucaggga

SEQ ID NO: 3773312 - RNA, 23 nt, Human
cauuccucagggacagagacacc

SEQ ID NO: 3773313 - RNA, 21 nt, Human
cauuccucaugaauguaaauu

SEQ ID NO: 3773314 - RNA, 18 nt, Human
cauuccucccauucaaga

SEQ ID NO: 3773315 - RNA, 19 nt, Human
cauuccucccauucaagau

SEQ ID NO: 3773316 - RNA, 17 nt, Human
cauuccugaagaaccag

SEQ ID NO: 3773317 - RNA, 20 nt, Human
cauuccugaagaaccagucc

SEQ ID NO: 3773318 - RNA, 14 nt, Human
cauuccugaugcuu

SEQ ID NO: 3773319 - RNA, 19 nt, Human
cauuccugaugcuucuuca

SEQ ID NO: 3773320 - RNA, 15 nt, Human
cauuccuggagcccg

SEQ ID NO: 3773321 - RNA, 17 nt, Human
cauuccuggagcccgag

SEQ ID NO: 3773322 - RNA, 18 nt, Human
cauuccuggagcccgagg

SEQ ID NO: 3773323 - RNA, 14 nt, Human
cauuccugggcaca

SEQ ID NO: 3773324 - RNA, 16 nt, Human
cauuccugggcacagu

SEQ ID NO: 3773325 - RNA, 19 nt, Human
cauuccugguacccagcca

SEQ ID NO: 3773326 - RNA, 12 nt, Human
cauuccuuccca

SEQ ID NO: 3773327 - RNA, 15 nt, Human
cauuccuucccagag

SEQ ID NO: 3773328 - RNA, 14 nt, Human
cauuccuucuuuga

SEQ ID NO: 3773329 - RNA, 23 nt, Human
cauuccuucuuugauaauguuaa

SEQ ID NO: 3773330 - RNA, 15 nt, Human
cauuccuugauaaug

SEQ ID NO: 3773331 - RNA, 15 nt, Human
cauuccuugcugaaa

SEQ ID NO: 3773332 - RNA, 18 nt, Human
cauucgcgcucugcucag

SEQ ID NO: 3773333 - RNA, 15 nt, Human
cauucggcucccugg

SEQ ID NO: 3773334 - RNA, 19 nt, Human
cauucggcucccuggagcc

SEQ ID NO: 3773335 - RNA, 16 nt, Human
cauucgguguggugca

SEQ ID NO: 3773336 - RNA, 17 nt, Human
cauucguacauaauacu

SEQ ID NO: 3773337 - RNA, 16 nt, Human
cauucuacuugcucug

SEQ ID NO: 3773338 - RNA, 20 nt, Human
cauucuacuugcucuggacc

SEQ ID NO: 3773339 - RNA, 23 nt, Human
cauucuacuugcucuggaccugc

SEQ ID NO: 3773340 - RNA, 18 nt, Human
cauucuagguuugcaaga

SEQ ID NO: 3773341 - RNA, 14 nt, Human
cauucuaucuacug

SEQ ID NO: 3773342 - RNA, 13 nt, Human
cauucuauugccu

SEQ ID NO: 3773343 - RNA, 14 nt, Human
cauucuauugccuu

SEQ ID NO: 3773344 - RNA, 22 nt, Human
cauucuauugccuucuuugaag

SEQ ID NO: 3773345 - RNA, 17 nt, Human
cauucuauuuuagaaua

SEQ ID NO: 3773346 - RNA, 14 nt, Human
cauucucaagcccu

SEQ ID NO: 3773347 - RNA, 21 nt, Human
cauucucaagggacguccucc

SEQ ID NO: 3773348 - RNA, 16 nt, Human
cauucucaggcaccag

SEQ ID NO: 3773349 - RNA, 17 nt, Human
cauucucaggcaccagu

SEQ ID NO: 3773350 - RNA, 15 nt, Human
cauucucaguuuuuc

SEQ ID NO: 3773351 - RNA, 23 nt, Human
cggucucggaucaggcucccagg

SEQ ID NO: 3773352 - RNA, 19 nt, Human
cggucugcaagucagagga

SEQ ID NO: 3773353 - RNA, 21 nt, Human
cggucuguucuguuucaaggc

SEQ ID NO: 3773354 - RNA, 15 nt, Human
cggugaauggcuuug

SEQ ID NO: 3773355 - RNA, 22 nt, Human
cggugaauggcuuuguauagaa

SEQ ID NO: 3773356 - RNA, 21 nt, Human
cggugacaaagauggcucaga

SEQ ID NO: 3773357 - RNA, 23 nt, Human
cggugcauacacccccaccuccu

SEQ ID NO: 3773358 - RNA, 14 nt, Human
cggugcccaagcca

SEQ ID NO: 3773359 - RNA, 20 nt, Human
cggugccuggguggggcugc

SEQ ID NO: 3773360 - RNA, 17 nt, Human
cggugccuuuauuucca

SEQ ID NO: 3773361 - RNA, 21 nt, Human
cggugccuuuauuuccacugu

SEQ ID NO: 3773362 - RNA, 22 nt, Human
cggugccuuuuuucacggaagu

SEQ ID NO: 3773363 - RNA, 21 nt, Human
cggugcuaucucccccagccc

SEQ ID NO: 3773364 - RNA, 23 nt, Human
cggugcuaucucccccagcccca

SEQ ID NO: 3773365 - RNA, 13 nt, Human
cggugcuccaggc

SEQ ID NO: 3773366 - RNA, 14 nt, Human
cggugcuccaggca

SEQ ID NO: 3773367 - RNA, 22 nt, Human
cggugcuguccucagguggcca

SEQ ID NO: 3773368 - RNA, 18 nt, Human
cggugcugugagggaggg

SEQ ID NO: 3773369 - RNA, 19 nt, Human
cggugcugugagggagggg

SEQ ID NO: 3773370 - RNA, 16 nt, Human
cgguggacccagacac

SEQ ID NO: 3773371 - RNA, 14 nt, Human
cgguggaggccagg

SEQ ID NO: 3773372 - RNA, 16 nt, Human
cgguggcccugucccu

SEQ ID NO: 3773373 - RNA, 20 nt, Human
cgguggcugacaccuguaau

SEQ ID NO: 3773374 - RNA, 12 nt, Human
cgguggcugggc

SEQ ID NO: 3773375 - RNA, 21 nt, Human
cgguggcugggcagagcugca

SEQ ID NO: 3773376 - RNA, 18 nt, Human
cggugggacccccguggg

SEQ ID NO: 3773377 - RNA, 16 nt, Human
cggugggacucguggc

SEQ ID NO: 3773378 - RNA, 22 nt, Human
cggugggacucguggcugucaa

SEQ ID NO: 3773379 - RNA, 15 nt, Human
cggugggcacccacc

SEQ ID NO: 3773380 - RNA, 18 nt, Human
cggugggcacccacccug

SEQ ID NO: 3773381 - RNA, 13 nt, Human
cggugggccuggu

SEQ ID NO: 3773382 - RNA, 18 nt, Human
cggugggccuugcugggg

SEQ ID NO: 3773383 - RNA, 19 nt, Human
cggugggccuuguccccug

SEQ ID NO: 3773384 - RNA, 11 nt, Human
cggugggggua

SEQ ID NO: 3773385 - RNA, 22 nt, Human
cgguggggguagggggcuggag

SEQ ID NO: 3773386 - RNA, 17 nt, Human
cggugguaccaggucuc

SEQ ID NO: 3773387 - RNA, 22 nt, Human
cggugguuguuggggcuucuug

SEQ ID NO: 3773388 - RNA, 15 nt, Human
cgguguccauuuaua

SEQ ID NO: 3773389 - RNA, 21 nt, Human
cgguguccauuuauagaauaa

SEQ ID NO: 3773390 - RNA, 14 nt, Human
cgguguccccacca

SEQ ID NO: 3773391 - RNA, 22 nt, Human
cgguguccccaccaucugcugu

SEQ ID NO: 3773392 - RNA, 14 nt, Human
cgguguccccagag

SEQ ID NO: 3773393 - RNA, 11 nt, Human
cggugucucuc

SEQ ID NO: 3773394 - RNA, 15 nt, Human
cggugucuuguucug

SEQ ID NO: 3773395 - RNA, 13 nt, Human
cgguguggagaag

SEQ ID NO: 3773396 - RNA, 16 nt, Human
cggugugggcuguguc

SEQ ID NO: 3773397 - RNA, 18 nt, Human
cgguguggugcaguguga

SEQ ID NO: 3773398 - RNA, 20 nt, Human
cgguguggugcagugugaaa

SEQ ID NO: 3773399 - RNA, 23 nt, Human
cgguguuuaagacauuuuuggaa

SEQ ID NO: 3773400 - RNA, 14 nt, Human
cgguuaacaaauaa

SEQ ID NO: 3773401 - RNA, 18 nt, Human
cgguuauaaaaaaugguu

SEQ ID NO: 3773402 - RNA, 20 nt, Human
cgguuaugaaauucaccccc

SEQ ID NO: 3773403 - RNA, 15 nt, Human
cgguucaccagccuc

SEQ ID NO: 3773404 - RNA, 22 nt, Human
cgguucacucuucucagccacu

SEQ ID NO: 3773405 - RNA, 20 nt, Human
cgguucaggaaaauugaaug

SEQ ID NO: 3773406 - RNA, 13 nt, Human
cgguucaguguuu

SEQ ID NO: 3773407 - RNA, 19 nt, Human
cgguuccacgucccccugg

SEQ ID NO: 3773408 - RNA, 19 nt, Human
cgguuccucguucucccug

SEQ ID NO: 3773409 - RNA, 21 nt, Human
cgguugaguuuugacugcuug

SEQ ID NO: 3773410 - RNA, 13 nt, Human
cgguuuccaggga

SEQ ID NO: 3773411 - RNA, 18 nt, Human
cgguuucgaagucauuaa

SEQ ID NO: 3773412 - RNA, 11 nt, Human
cgguuucucca

SEQ ID NO: 3773413 - RNA, 19 nt, Human
cgguuucuuuuuaaguaau

SEQ ID NO: 3773414 - RNA, 21 nt, Human
cgguuuggggagcagagacac

SEQ ID NO: 3773415 - RNA, 15 nt, Human
cgguuuuuuuccugu

SEQ ID NO: 3773416 - RNA, 16 nt, Human
cguaaaaacugaaguu

SEQ ID NO: 3773417 - RNA, 12 nt, Human
cguaaaauggug

SEQ ID NO: 3773418 - RNA, 23 nt, Human
cguaaagguuuauuuuucuguua

SEQ ID NO: 3773419 - RNA, 14 nt, Human
cguaaaguacuugu

SEQ ID NO: 3773420 - RNA, 14 nt, Human
cguaaccagccaga

SEQ ID NO: 3773421 - RNA, 23 nt, Human
cguaaccagccagauccucuugg

SEQ ID NO: 3773422 - RNA, 14 nt, Human
cguaagcacuguuu

SEQ ID NO: 3773423 - RNA, 14 nt, Human
cguaaguacagaga

SEQ ID NO: 3773424 - RNA, 13 nt, Human
cguaauaagguuu

SEQ ID NO: 3773425 - RNA, 15 nt, Human
cguaauaagguuuua

SEQ ID NO: 3773426 - RNA, 23 nt, Human
cguaauaagguuuuaauuuagua

SEQ ID NO: 3773427 - RNA, 13 nt, Human
cguaaugcuuaga

SEQ ID NO: 3773428 - RNA, 14 nt, Human
cguaauucuuauuc

SEQ ID NO: 3773429 - RNA, 18 nt, Human
cguacaaguaguucugua

SEQ ID NO: 3773430 - RNA, 22 nt, Human
cguacaaguaguucuguauuug

SEQ ID NO: 3773431 - RNA, 13 nt, Human
cguacacauuuua

SEQ ID NO: 3773432 - RNA, 17 nt, Human
cguacaggcuggcgcag

SEQ ID NO: 3773433 - RNA, 16 nt, Human
cguacauaauacugaa

SEQ ID NO: 3773434 - RNA, 15 nt, Human
cguaccccacccuca

SEQ ID NO: 3773435 - RNA, 13 nt, Human
cguacuugugauu

SEQ ID NO: 3773436 - RNA, 18 nt, Human
cguagaaguuuuuguacu

SEQ ID NO: 3773437 - RNA, 22 nt, Human
cguagaaucuguguagacgaag

SEQ ID NO: 3773438 - RNA, 14 nt, Human
cguagaugauuuca

SEQ ID NO: 3773439 - RNA, 20 nt, Human
cguagccaaggugggcugag

SEQ ID NO: 3773440 - RNA, 20 nt, Human
cguagcgugcccgugugcau

SEQ ID NO: 3773441 - RNA, 13 nt, Human
cguagcuugucug

SEQ ID NO: 3773442 - RNA, 21 nt, Human
cguaguguagauuuguuuugu

SEQ ID NO: 3773443 - RNA, 14 nt, Human
cguauagaagucuu

SEQ ID NO: 3773444 - RNA, 21 nt, Human
cguaucuccggcucccagccu

SEQ ID NO: 3773445 - RNA, 21 nt, Human
cguaugaaaaugaguugugaa

SEQ ID NO: 3773446 - RNA, 20 nt, Human
cguaugaguuagaauaauaa

SEQ ID NO: 3773447 - RNA, 15 nt, Human
cguauggcuuuauuu

SEQ ID NO: 3773448 - RNA, 21 nt, Human
cguauuuaauagcaaagaauu

SEQ ID NO: 3773449 - RNA, 23 nt, Human
cguauuuaauagcaaagaauuga

SEQ ID NO: 3773450 - RNA, 20 nt, Human
cguauuuuaaaagccacaua

SEQ ID NO: 3773451 - RNA, 21 nt, Human
cgucaacguuguacuguaugu

SEQ ID NO: 3773452 - RNA, 18 nt, Human
cgucaccacgacuggcca

SEQ ID NO: 3773453 - RNA, 18 nt, Human
cgucaccaucucaggcca

SEQ ID NO: 3773454 - RNA, 12 nt, Human
cgucaccucaga

SEQ ID NO: 3773455 - RNA, 12 nt, Human
cgucagccucca

SEQ ID NO: 3773456 - RNA, 13 nt, Human
cgucagccuccag

SEQ ID NO: 3773457 - RNA, 20 nt, Human
cgucagccuccagccucugu

SEQ ID NO: 3773458 - RNA, 16 nt, Human
cgucaggguuggugug

SEQ ID NO: 3773459 - RNA, 20 nt, Human
cgucaggguuggugugcuga

SEQ ID NO: 3773460 - RNA, 22 nt, Human
cgucagucuuuuucuguuguaa

SEQ ID NO: 3773461 - RNA, 14 nt, Human
cgucaucuaguuuu

SEQ ID NO: 3773462 - RNA, 22 nt, Human
cgucaugaggagauucugccuu

SEQ ID NO: 3773463 - RNA, 22 nt, Human
cguccacgugcguguuuucuga

SEQ ID NO: 3773464 - RNA, 19 nt, Human
cguccaggagccugugccu

SEQ ID NO: 3773465 - RNA, 21 nt, Human
cguccaggccgcgcccuuucc

SEQ ID NO: 3773466 - RNA, 23 nt, Human
cguccaucacguuagcuguccca

SEQ ID NO: 3773467 - RNA, 15 nt, Human
cgucccaagauguug

SEQ ID NO: 3773468 - RNA, 21 nt, Human
cguccccucccccaccccugc

SEQ ID NO: 3773469 - RNA, 15 nt, Human
cguccgcccugcucc

SEQ ID NO: 3773470 - RNA, 15 nt, Human
cguccgcgcgccagc

SEQ ID NO: 3773471 - RNA, 20 nt, Human
cguccggcaguucugggugc

SEQ ID NO: 3773472 - RNA, 20 nt, Human
cguccucaccccuguccuca

SEQ ID NO: 3773473 - RNA, 22 nt, Human
cguccucaccccuguccucacu

SEQ ID NO: 3773474 - RNA, 13 nt, Human
cguccucccccug

SEQ ID NO: 3773475 - RNA, 16 nt, Human
cguccucccccugcca

SEQ ID NO: 3773476 - RNA, 17 nt, Human
cguccucccccugccag

SEQ ID NO: 3773477 - RNA, 14 nt, Human
cguccucccgggcc

SEQ ID NO: 3773478 - RNA, 18 nt, Human
cguccucccgggcccucc

SEQ ID NO: 3773479 - RNA, 18 nt, Human
cguccuccguccauauca

SEQ ID NO: 3773480 - RNA, 14 nt, Human
cguccuccucugug

SEQ ID NO: 3773481 - RNA, 14 nt, Human
cguccugccaccug

SEQ ID NO: 3773482 - RNA, 14 nt, Human
cguccugucagugc

SEQ ID NO: 3773483 - RNA, 20 nt, Human
cguccuuacuccugugggag

SEQ ID NO: 3773484 - RNA, 15 nt, Human
cgucgacguagaacc

SEQ ID NO: 3773485 - RNA, 16 nt, Human
cgucgcacagucucuc

SEQ ID NO: 3773486 - RNA, 15 nt, Human
cgucgcccucccagg

SEQ ID NO: 3773487 - RNA, 18 nt, Human
cgucggggggacagcucc

SEQ ID NO: 3773488 - RNA, 15 nt, Human
cgucgguccuggugc

SEQ ID NO: 3773489 - RNA, 15 nt, Human
cgucggucugugccc

SEQ ID NO: 3773490 - RNA, 17 nt, Human
cgucuaaccacagcucc

SEQ ID NO: 3773491 - RNA, 19 nt, Human
cgucuaaccacagcuccuu

SEQ ID NO: 3773492 - RNA, 19 nt, Human
cgucuaagucaugagcuga

SEQ ID NO: 3773493 - RNA, 15 nt, Human
cgucuacccugggau

SEQ ID NO: 3773494 - RNA, 16 nt, Human
cgucuaccugaggggc

SEQ ID NO: 3773495 - RNA, 17 nt, Human
cgucucaaccccucaca

SEQ ID NO: 3773496 - RNA, 14 nt, Human
cgucuccagcugcu

SEQ ID NO: 3773497 - RNA, 21 nt, Human
cgucuccaggggcugcuuccu

SEQ ID NO: 3773498 - RNA, 18 nt, Human
cgucucccaucuuaacuc

SEQ ID NO: 3773499 - RNA, 24 nt, Human
cgucucccccaacagcuggacccu

SEQ ID NO: 3773500 - RNA, 23 nt, Human
cgucucucucccauggagcccca

SEQ ID NO: 3773501 - RNA, 21 nt, Human
cgucucuuuuacccuggcccc

SEQ ID NO: 3773502 - RNA, 24 nt, Human
cgucuggaggggccccugcuucuc

SEQ ID NO: 3773503 - RNA, 17 nt, Human
cgucugggguucagccc

SEQ ID NO: 3773504 - RNA, 18 nt, Human
cgucugggguucagcccc

SEQ ID NO: 3773505 - RNA, 12 nt, Human
cgucuggguggc

SEQ ID NO: 3773506 - RNA, 15 nt, Human
cgucuguccaucugc

SEQ ID NO: 3773507 - RNA, 19 nt, Human
cgucuguggcuuucagccu

SEQ ID NO: 3773508 - RNA, 11 nt, Human
cgucugugugc

SEQ ID NO: 3773509 - RNA, 21 nt, Human
cgucugugugugaccccuccu

SEQ ID NO: 3773510 - RNA, 14 nt, Human
cgucuguucccccu

SEQ ID NO: 3773511 - RNA, 13 nt, Human
cgucuucagccua

SEQ ID NO: 3773512 - RNA, 19 nt, Human
cgucuuccgccccugccug

SEQ ID NO: 3773513 - RNA, 20 nt, Human
cgucuuccgccccugccugc

SEQ ID NO: 3773514 - RNA, 16 nt, Human
cgucuuccgucucccc

SEQ ID NO: 3773515 - RNA, 17 nt, Human
cgucuuccgucuccccc

SEQ ID NO: 3773516 - RNA, 22 nt, Human
cgucuugguguaauuugaagau

SEQ ID NO: 3773517 - RNA, 18 nt, Human
cgugaaaacggagcugaa

SEQ ID NO: 3773518 - RNA, 17 nt, Human
cgugaacccaggaggcg

SEQ ID NO: 3773519 - RNA, 16 nt, Human
cgugaagauacuuugu

SEQ ID NO: 3773520 - RNA, 17 nt, Human
cgugaagauacuuugua

SEQ ID NO: 3773521 - RNA, 18 nt, Human
cgugaagauacuuuguau

SEQ ID NO: 3773522 - RNA, 18 nt, Human
cgugaaugggugcccaca

SEQ ID NO: 3773523 - RNA, 19 nt, Human
cgugacaauaaaacauuaa

SEQ ID NO: 3773524 - RNA, 23 nt, Human
cgugaccaacuagacauucuguc

SEQ ID NO: 3773525 - RNA, 14 nt, Human
cgugacccucugcu

SEQ ID NO: 3773526 - RNA, 20 nt, Human
cgugaccggacuuuucugca

SEQ ID NO: 3773527 - RNA, 12 nt, Human
cgugaccugguc

SEQ ID NO: 3773528 - RNA, 16 nt, Human
cgugacgcugaauaaa

SEQ ID NO: 3773529 - RNA, 14 nt, Human
cgugacucacccaa

SEQ ID NO: 3773530 - RNA, 16 nt, Human
cgugacugccccaacu

SEQ ID NO: 3773531 - RNA, 22 nt, Human
cgugacugccccaacuccugga

SEQ ID NO: 3773532 - RNA, 13 nt, Human
cgugagaccugcc

SEQ ID NO: 3773533 - RNA, 16 nt, Human
cgugagaccugccccu

SEQ ID NO: 3773534 - RNA, 14 nt, Human
cgugagccacugca

SEQ ID NO: 3773535 - RNA, 13 nt, Human
cgugagccaggua

SEQ ID NO: 3773536 - RNA, 20 nt, Human
cgugagcgccugugcacaca

SEQ ID NO: 3773537 - RNA, 16 nt, Human
cgugaggucccaggaa

SEQ ID NO: 3773538 - RNA, 19 nt, Human
cgugagugaaccaucauua

SEQ ID NO: 3773539 - RNA, 19 nt, Human
cgugagugucucuugucua

SEQ ID NO: 3773540 - RNA, 20 nt, Human
cgugaguucucagggcuccu

SEQ ID NO: 3773541 - RNA, 21 nt, Human
cgugaguucucagggcuccug

SEQ ID NO: 3773542 - RNA, 13 nt, Human
cgugauacauuug

SEQ ID NO: 3773543 - RNA, 13 nt, Human
cgugauccacccg

SEQ ID NO: 3773544 - RNA, 15 nt, Human
cgugaucucagcuca

SEQ ID NO: 3773545 - RNA, 23 nt, Human
cgugauguaggguaaggugccuu

SEQ ID NO: 3773546 - RNA, 18 nt, Human
cgugcaaaacaugcuacc

SEQ ID NO: 3773547 - RNA, 21 nt, Human
cgugcaguggugcgaucuggg

SEQ ID NO: 3773548 - RNA, 14 nt, Human
cgugcauaccacuu

SEQ ID NO: 3773549 - RNA, 19 nt, Human
cgugcauaccacuuuuguu

SEQ ID NO: 3773550 - RNA, 23 nt, Human
cgugcauaccacuuuuguucuug

SEQ ID NO: 3773551 - RNA, 16 nt, Human
cgugcauguguguuca

SEQ ID NO: 3773552 - RNA, 23 nt, Human
cgugcauuagcacagauuuuaau

SEQ ID NO: 3773553 - RNA, 21 nt, Human
cgugcauuggaagaccccacc

SEQ ID NO: 3773554 - RNA, 21 nt, Human
cgugcauugugcuucuuucuu

SEQ ID NO: 3773555 - RNA, 18 nt, Human
cgugccaaagucucccuu

SEQ ID NO: 3773556 - RNA, 19 nt, Human
cgugccaggcccggggcug

SEQ ID NO: 3773557 - RNA, 22 nt, Human
cgugccagucgcgcugccugug

SEQ ID NO: 3773558 - RNA, 13 nt, Human
cgugccccugcug

SEQ ID NO: 3773559 - RNA, 15 nt, Human
cgugccccugcugcu

SEQ ID NO: 3773560 - RNA, 10 nt, Human
cgugcccucu

SEQ ID NO: 3773561 - RNA, 12 nt, Human
cgugcccucugu

SEQ ID NO: 3773562 - RNA, 15 nt, Human
cgugccgccugcacu

SEQ ID NO: 3773563 - RNA, 16 nt, Human
cgugccgccugcacuc

SEQ ID NO: 3773564 - RNA, 17 nt, Human
cgugccuccaccaccac

SEQ ID NO: 3773565 - RNA, 18 nt, Human
cgugccuccaccaccacu

SEQ ID NO: 3773566 - RNA, 20 nt, Human
cgugccuccaccaccacugg

SEQ ID NO: 3773567 - RNA, 23 nt, Human
cgugccuccuuccaccucccucc

SEQ ID NO: 3773568 - RNA, 12 nt, Human
cgugccuggcca

SEQ ID NO: 3773569 - RNA, 17 nt, Human
cgugccuggccacgccc

SEQ ID NO: 3773570 - RNA, 16 nt, Human
cgugccuuuugcaccc

SEQ ID NO: 3773571 - RNA, 17 nt, Human
cgugccuuuugcacccc

SEQ ID NO: 3773572 - RNA, 20 nt, Human
cgugccuuuugcaccccucc

SEQ ID NO: 3773573 - RNA, 23 nt, Human
cgugccuuuugcaccccucccau

SEQ ID NO: 3773574 - RNA, 19 nt, Human
cgugcguguuuucugacug

SEQ ID NO: 3773575 - RNA, 14 nt, Human
cgugcuaaauuuuc

SEQ ID NO: 3773576 - RNA, 12 nt, Human
cgugcuaaggac

SEQ ID NO: 3773577 - RNA, 15 nt, Human
cgugcuaaggacuug

SEQ ID NO: 3773578 - RNA, 17 nt, Human
cgugcuccagccuggcu

SEQ ID NO: 3773579 - RNA, 17 nt, Human
cgugcugacagcugcuc

SEQ ID NO: 3773580 - RNA, 12 nt, Human
cgugcugggcag

SEQ ID NO: 3773581 - RNA, 15 nt, Human
cgugcugggcggcug

SEQ ID NO: 3773582 - RNA, 22 nt, Human
cgugcuuguuugcucaccuggg

SEQ ID NO: 3773583 - RNA, 15 nt, Human
cguggaaagggugcu

SEQ ID NO: 3773584 - RNA, 19 nt, Human
cguggaaccucugucucau

SEQ ID NO: 3773585 - RNA, 22 nt, Human
cguggaaugcccuucacuguca

SEQ ID NO: 3773586 - RNA, 13 nt, Human
cguggacucugca

SEQ ID NO: 3773587 - RNA, 16 nt, Human
cguggacucugcacau

SEQ ID NO: 3773588 - RNA, 20 nt, Human
cguggagaaucacaggcugg

SEQ ID NO: 3773589 - RNA, 23 nt, Human
cguggagaaucacaggcugggcu

SEQ ID NO: 3773590 - RNA, 20 nt, Human
cguggagagcuggugcccgg

SEQ ID NO: 3773591 - RNA, 12 nt, Human
cguggagaggga

SEQ ID NO: 3773592 - RNA, 21 nt, Human
cguggagagggaugaggugcu

SEQ ID NO: 3773593 - RNA, 15 nt, Human
cguggagccagggag

SEQ ID NO: 3773594 - RNA, 20 nt, Human
cguggagcuuaagccacugc

SEQ ID NO: 3773595 - RNA, 22 nt, Human
cguggaggaaugcucccccauc

SEQ ID NO: 3773596 - RNA, 16 nt, Human
cguggaggagcagugc

SEQ ID NO: 3773597 - RNA, 13 nt, Human
cguggaggcugcu

SEQ ID NO: 3773598 - RNA, 15 nt, Human
cguggagggaggccc

SEQ ID NO: 3773599 - RNA, 20 nt, Human
cguggagggaggccccaggg

SEQ ID NO: 3773600 - RNA, 18 nt, Human
cguggagggguaggggcu

SEQ ID NO: 3773601 - RNA, 19 nt, Human
cguggagggguaggggcug

SEQ ID NO: 3773602 - RNA, 13 nt, Human
cguggauuaaacu

SEQ ID NO: 3773603 - RNA, 13 nt, Human
cguggcaaauaua

SEQ ID NO: 3773604 - RNA, 14 nt, Human
cguggcaccuccuc

SEQ ID NO: 3773605 - RNA, 22 nt, Human
cguggcagauaaucagccucuu

SEQ ID NO: 3773606 - RNA, 16 nt, Human
cguggcauguggccug

SEQ ID NO: 3773607 - RNA, 16 nt, Human
cguggccaucccugug

SEQ ID NO: 3773608 - RNA, 16 nt, Human
cguggccccagccugg

SEQ ID NO: 3773609 - RNA, 17 nt, Human
cguggccccagccuggc

SEQ ID NO: 3773610 - RNA, 20 nt, Human
cguggccccagccuggccca

SEQ ID NO: 3773611 - RNA, 16 nt, Human
cguggccucuugagca

SEQ ID NO: 3773612 - RNA, 13 nt, Human
cguggccuuguuc

SEQ ID NO: 3773613 - RNA, 20 nt, Human
cguggccuuguucugucacc

SEQ ID NO: 3773614 - RNA, 14 nt, Human
cguggcucagccag

SEQ ID NO: 3773615 - RNA, 14 nt, Human
cguggcucugcugg

SEQ ID NO: 3773616 - RNA, 15 nt, Human
cguggcucugcuggc

SEQ ID NO: 3773617 - RNA, 18 nt, Human
cguggcugcugugggaaa

SEQ ID NO: 3773618 - RNA, 12 nt, Human
cguggcugcuuc

SEQ ID NO: 3773619 - RNA, 17 nt, Human
cguggcugcuucaagga

SEQ ID NO: 3773620 - RNA, 23 nt, Human
cguggcuguggcauccagagucc

SEQ ID NO: 3773621 - RNA, 23 nt, Human
cgugggaaccccccucccaccca

SEQ ID NO: 3773622 - RNA, 22 nt, Human
cgugggaggcgggaguggagug

SEQ ID NO: 3773623 - RNA, 14 nt, Human
cgugggcauugucu

SEQ ID NO: 3773624 - RNA, 21 nt, Human
cgugggccccacccucgggga

SEQ ID NO: 3773625 - RNA, 17 nt, Human
cgugggcggcagagagg

SEQ ID NO: 3773626 - RNA, 17 nt, Human
cgugggcggggccuugc

SEQ ID NO: 3773627 - RNA, 20 nt, Human
cgugggcuccccucuuccuc

SEQ ID NO: 3773628 - RNA, 20 nt, Human
cguggggcagcacagagagg

SEQ ID NO: 3773629 - RNA, 15 nt, Human
cguggggcagggagc

SEQ ID NO: 3773630 - RNA, 22 nt, Human
cguggggcagggagcugggccc

SEQ ID NO: 3773631 - RNA, 11 nt, Human
cgugggucaga

SEQ ID NO: 3773632 - RNA, 12 nt, Human
cgugggucagaa

SEQ ID NO: 3773633 - RNA, 14 nt, Human
cgugggucagaaga

SEQ ID NO: 3773634 - RNA, 19 nt, Human
cguggguccugaggccugc

SEQ ID NO: 3773635 - RNA, 20 nt, Human
cgugggucuguuuuccuuuc

SEQ ID NO: 3773636 - RNA, 13 nt, Human
cgugggugugugc

SEQ ID NO: 3773637 - RNA, 23 nt, Human
cguggguguguguagccaagguc

SEQ ID NO: 3773638 - RNA, 15 nt, Human
cgugguaugucugcc

SEQ ID NO: 3773639 - RNA, 15 nt, Human
cguggucaagcacuc

SEQ ID NO: 3773640 - RNA, 16 nt, Human
cguggucccugaggau

SEQ ID NO: 3773641 - RNA, 21 nt, Human
cguggugaucaauuaaaugua

SEQ ID NO: 3773642 - RNA, 21 nt, Human
cgugguggaagaggggacagg

SEQ ID NO: 3773643 - RNA, 14 nt, Human
cgugguggacaugc

SEQ ID NO: 3773644 - RNA, 15 nt, Human
cgugguggucccugg

SEQ ID NO: 3773645 - RNA, 23 nt, Human
cgugguugaguggggggaacgcc

SEQ ID NO: 3773646 - RNA, 12 nt, Human
cguguaaaccaa

SEQ ID NO: 3773647 - RNA, 15 nt, Human
cguguaaaccaaagc

SEQ ID NO: 3773648 - RNA, 10 nt, Human
cguguacaua

SEQ ID NO: 3773649 - RNA, 15 nt, Human
cguguauccuggggc

SEQ ID NO: 3773650 - RNA, 16 nt, Human
cguguauccuggggcu

SEQ ID NO: 3773651 - RNA, 15 nt, Human
cgugucaagcugcuc

SEQ ID NO: 3773652 - RNA, 13 nt, Human
cguguccccgggg

SEQ ID NO: 3773653 - RNA, 22 nt, Human
cguguccccuauccuacuuccc

SEQ ID NO: 3773654 - RNA, 18 nt, Human
cguguccccugacagggc

SEQ ID NO: 3773655 - RNA, 15 nt, Human
cgugucgugggugug

SEQ ID NO: 3773656 - RNA, 12 nt, Human
cgugucugaauc

SEQ ID NO: 3773657 - RNA, 14 nt, Human
cgugucuguauuua

SEQ ID NO: 3773658 - RNA, 21 nt, Human
cgugugagaagugaaugcugg

SEQ ID NO: 3773659 - RNA, 23 nt, Human
cgugugagaagugaaugcuggga

SEQ ID NO: 3773660 - RNA, 15 nt, Human
cgugugauuuuucug

SEQ ID NO: 3773661 - RNA, 12 nt, Human
cgugugcugugu

SEQ ID NO: 3773662 - RNA, 23 nt, Human
cgugugggagaccggccugccag

SEQ ID NO: 3773663 - RNA, 21 nt, Human
cguguguggguggauauaaau

SEQ ID NO: 3773664 - RNA, 22 nt, Human
cguguguggguggauauaaaua

SEQ ID NO: 3773665 - RNA, 20 nt, Human
cgugugugugcguccugucg

SEQ ID NO: 3773666 - RNA, 15 nt, Human
cguguguucuaucca

SEQ ID NO: 3773667 - RNA, 15 nt, Human
cguguuaugacucca

SEQ ID NO: 3773668 - RNA, 15 nt, Human
cguguuccccucuug

SEQ ID NO: 3773669 - RNA, 13 nt, Human
cguguucucagag

SEQ ID NO: 3773670 - RNA, 18 nt, Human
cguguuugucucuucugg

SEQ ID NO: 3773671 - RNA, 13 nt, Human
cguuaaaauacca

SEQ ID NO: 3773672 - RNA, 20 nt, Human
cguuaagggaaggaacucug

SEQ ID NO: 3773673 - RNA, 22 nt, Human
cguuacucagggcuccucccag

SEQ ID NO: 3773674 - RNA, 14 nt, Human
cguuagaggaaaaa

SEQ ID NO: 3773675 - RNA, 17 nt, Human
cguuagaggaaaaauau

SEQ ID NO: 3773676 - RNA, 18 nt, Human
cguuaggauacugccucc

SEQ ID NO: 3773677 - RNA, 17 nt, Human
cguuagggaagagaaac

SEQ ID NO: 3773678 - RNA, 23 nt, Human
cguuaucuaauagggcaauuaau

SEQ ID NO: 3773679 - RNA, 21 nt, Human
cguucauggaacgcguugaaa

SEQ ID NO: 3773680 - RNA, 21 nt, Human
cguuccaccccaagagaacuc

SEQ ID NO: 3773681 - RNA, 22 nt, Human
cguuccgggcaaaugccagggc

SEQ ID NO: 3773682 - RNA, 16 nt, Human
cguuccuuucuuuucc

SEQ ID NO: 3773683 - RNA, 15 nt, Human
cguucucacacccac

SEQ ID NO: 3773684 - RNA, 17 nt, Human
cguucugcuggccugga

SEQ ID NO: 3773685 - RNA, 12 nt, Human
cguucugugcac

SEQ ID NO: 3773686 - RNA, 19 nt, Human
cguucuuaggcugcuggga

SEQ ID NO: 3773687 - RNA, 13 nt, Human
cguucuuguucug

SEQ ID NO: 3773688 - RNA, 23 nt, Human
cguugaaauuguaauuauaucug

SEQ ID NO: 3773689 - RNA, 18 nt, Human
cguugauguuggcuggga

SEQ ID NO: 3773690 - RNA, 16 nt, Human
cguuggagaagcccgu

SEQ ID NO: 3773691 - RNA, 17 nt, Human
cguuggcuagauuaacc

SEQ ID NO: 3773692 - RNA, 14 nt, Human
cguugguccagagc

SEQ ID NO: 3773693 - RNA, 21 nt, Human
cguuguaaaauauagcuguac

SEQ ID NO: 3773694 - RNA, 24 nt, Human
cguuguaaaauauagcuguacaaa

SEQ ID NO: 3773695 - RNA, 13 nt, Human
cguugucucccug

SEQ ID NO: 3773696 - RNA, 18 nt, Human
cguugucucccuggcccu

SEQ ID NO: 3773697 - RNA, 18 nt, Human
cguuguguuuuuuaagau

SEQ ID NO: 3773698 - RNA, 18 nt, Human
cguuguuuacuuaaagau

SEQ ID NO: 3773699 - RNA, 19 nt, Human
cguuuaaaguguauuauaa

SEQ ID NO: 3773700 - RNA, 23 nt, Human
cguuuaaaguguauuauaacagu

SEQ ID NO: 3773701 - RNA, 13 nt, Human
cguuuaaaguucu

SEQ ID NO: 3773702 - RNA, 22 nt, Human
cguuuaagacuguaaugaaucu

SEQ ID NO: 3773703 - RNA, 21 nt, Human
cguuuaaggugagcauaaauc

SEQ ID NO: 3773704 - RNA, 13 nt, Human
cguuuaaugaaug

SEQ ID NO: 3773705 - RNA, 14 nt, Human
cguuuaaugaaugc

SEQ ID NO: 3773706 - RNA, 18 nt, Human
cguuuaaugaaugcuuaa

SEQ ID NO: 3773707 - RNA, 16 nt, Human
cguuuacauuuuagac

SEQ ID NO: 3773708 - RNA, 17 nt, Human
cguuuaccuagaagaag

SEQ ID NO: 3773709 - RNA, 17 nt, Human
cguuuacuaugccugug

SEQ ID NO: 3773710 - RNA, 13 nt, Human
cguuuagaccaag

SEQ ID NO: 3773711 - RNA, 18 nt, Human
cguuuagcugacaaaaua

SEQ ID NO: 3773712 - RNA, 14 nt, Human
cguuuauuuucaag

SEQ ID NO: 3773713 - RNA, 22 nt, Human
cguuucagcgacuccguuggcc

SEQ ID NO: 3773714 - RNA, 20 nt, Human
cguuuccugagaagugucua

SEQ ID NO: 3773715 - RNA, 14 nt, Human
cguuuccuuuguug

SEQ ID NO: 3773716 - RNA, 17 nt, Human
cguuugaccuuuuaugu

SEQ ID NO: 3773717 - RNA, 21 nt, Human
cguuugagaagaaaacaucua

SEQ ID NO: 3773718 - RNA, 20 nt, Human
cguuugcccaaaucugccua

SEQ ID NO: 3773719 - RNA, 18 nt, Human
cguuuggugcuucucaga

SEQ ID NO: 3773720 - RNA, 20 nt, Human
cguuuguguucuguuuuguu

SEQ ID NO: 3773721 - RNA, 12 nt, Human
cguuuguuuguu

SEQ ID NO: 3773722 - RNA, 13 nt, Human
cguuuuaaaaaag

SEQ ID NO: 3773723 - RNA, 13 nt, Human
cguuuuaaggacu

SEQ ID NO: 3773724 - RNA, 23 nt, Human
cguuuuaaggacugacugaggca

SEQ ID NO: 3773725 - RNA, 12 nt, Human
cguuuucuaauu

SEQ ID NO: 3773726 - RNA, 17 nt, Human
cguuuucuaauugcuua

SEQ ID NO: 3773727 - RNA, 15 nt, Human
cguuuucuguuugga

SEQ ID NO: 3773728 - RNA, 14 nt, Human
cguuuucuuaaagu

SEQ ID NO: 3773729 - RNA, 23 nt, Human
cguuuuuauaaaaaauggugccu

SEQ ID NO: 3773730 - RNA, 13 nt, Human
cguuuuuccuuua

SEQ ID NO: 3773731 - RNA, 16 nt, Human
cguuuuugguggaguc

SEQ ID NO: 3773732 - RNA, 21 nt, Human
cguuuuuguauuuucaugaaa

SEQ ID NO: 3773733 - RNA, 16 nt, Human
cguuuuuuccucagug

SEQ ID NO: 3773734 - RNA, 20 nt, Human
cguuuuuuuuuuguuuguug

SEQ ID NO: 3773735 - RNA, 16 nt, Human
cuaaaaaacaaaacaa

SEQ ID NO: 3773736 - RNA, 21 nt, Human
cuaaaaagaaggaaaaugauc

SEQ ID NO: 3773737 - RNA, 16 nt, Human
cuaaaaagauuagcaa

SEQ ID NO: 3773738 - RNA, 12 nt, Human
cuaaaaagcaac

SEQ ID NO: 3773739 - RNA, 13 nt, Human
cuaaaaaguauaa

SEQ ID NO: 3773740 - RNA, 16 nt, Human
cuaaaaaguauaaaau

SEQ ID NO: 3773741 - RNA, 11 nt, Human
cuaaaaauaaa

SEQ ID NO: 3773742 - RNA, 11 nt, Human
cuaaaaauaau

SEQ ID NO: 3773743 - RNA, 21 nt, Human
cuaaaaauagacuuaaaucuc

SEQ ID NO: 3773744 - RNA, 13 nt, Human
cuaaaaauccaga

SEQ ID NO: 3773745 - RNA, 22 nt, Human
cuaaaaaugcaaaaaaaauuag

SEQ ID NO: 3773746 - RNA, 13 nt, Human
cuaaaaaugcaac

SEQ ID NO: 3773747 - RNA, 14 nt, Human
cuaaaaauuggugu

SEQ ID NO: 3773748 - RNA, 20 nt, Human
cuaaaacaaaagcucaucca

SEQ ID NO: 3773749 - RNA, 17 nt, Human
cuaaaacaacagaugua

SEQ ID NO: 3773750 - RNA, 22 nt, Human
cuaaaaccugagcuagaagcug

SEQ ID NO: 3773751 - RNA, 16 nt, Human
cuaaaacuaaauagca

SEQ ID NO: 3773752 - RNA, 17 nt, Human
cuaaaacucuuucggua

SEQ ID NO: 3773753 - RNA, 17 nt, Human
cuaaaacuguacuuuga

SEQ ID NO: 3773754 - RNA, 20 nt, Human
cuaaaagaauauucagagaa

SEQ ID NO: 3773755 - RNA, 22 nt, Human
cuaaaagacuucccuaacacuu

SEQ ID NO: 3773756 - RNA, 15 nt, Human
cuaaaagauccuuuu

SEQ ID NO: 3773757 - RNA, 22 nt, Human
cuaaaagcaaaauaaaaacuau

SEQ ID NO: 3773758 - RNA, 13 nt, Human
cuaaaaggcccag

SEQ ID NO: 3773759 - RNA, 14 nt, Human
cuaaaaggcccaga

SEQ ID NO: 3773760 - RNA, 14 nt, Human
cuaaaaguaaacau

SEQ ID NO: 3773761 - RNA, 19 nt, Human
cuaaaagugggcuugauuc

SEQ ID NO: 3773762 - RNA, 23 nt, Human
cuaaaagugggcuugauucugca

SEQ ID NO: 3773763 - RNA, 17 nt, Human
cuaaaauaauuuuguaa

SEQ ID NO: 3773764 - RNA, 18 nt, Human
cuaaaauaauuuuguaau

SEQ ID NO: 3773765 - RNA, 22 nt, Human
cuaaaauacauuuaaaacuuac

SEQ ID NO: 3773766 - RNA, 19 nt, Human
cuaaaauagccacuuaccu

SEQ ID NO: 3773767 - RNA, 23 nt, Human
cuaaaauauuuauuuuuuuuaag

SEQ ID NO: 3773768 - RNA, 21 nt, Human
cuaaaaucuuauaguucuagg

SEQ ID NO: 3773769 - RNA, 22 nt, Human
cuaaaaucuuauaguucuaggc

SEQ ID NO: 3773770 - RNA, 14 nt, Human
cuaaaaucuuggaa

SEQ ID NO: 3773771 - RNA, 16 nt, Human
cuaaaaucuuggaagu

SEQ ID NO: 3773772 - RNA, 21 nt, Human
cuaaaauggacuguggugacu

SEQ ID NO: 3773773 - RNA, 20 nt, Human
cuaaaaugugauguucuaag

SEQ ID NO: 3773774 - RNA, 21 nt, Human
cuaaaaugugauguucuaagg

SEQ ID NO: 3773775 - RNA, 13 nt, Human
cuaaaauguucua

SEQ ID NO: 3773776 - RNA, 17 nt, Human
cuaaaauguuuucagcu

SEQ ID NO: 3773777 - RNA, 19 nt, Human
cuaaaauugaguucuuccu

SEQ ID NO: 3773778 - RNA, 13 nt, Human
cuaaaauuugaag

SEQ ID NO: 3773779 - RNA, 23 nt, Human
cuaaaauuugcccucccaucccg

SEQ ID NO: 3773780 - RNA, 15 nt, Human
cuaaacaaaaaaagg

SEQ ID NO: 3773781 - RNA, 19 nt, Human
cuaaacaagaaucagucua

SEQ ID NO: 3773782 - RNA, 19 nt, Human
cuaaacaaugcugauuugg

SEQ ID NO: 3773783 - RNA, 16 nt, Human
cuaaacacugcgcuuu

SEQ ID NO: 3773784 - RNA, 16 nt, Human
cuaaacagacuauuua

SEQ ID NO: 3773785 - RNA, 18 nt, Human
cuaaacagacuauuuaac

SEQ ID NO: 3773786 - RNA, 17 nt, Human
cuaaacagauauaaaug

SEQ ID NO: 3773787 - RNA, 19 nt, Human
cuaaacccaauccaaaugg

SEQ ID NO: 3773788 - RNA, 19 nt, Human
cuaaaccuuaguacugagu

SEQ ID NO: 3773789 - RNA, 16 nt, Human
cuaaacggauuccaaa

SEQ ID NO: 3773790 - RNA, 19 nt, Human
cuaaacguaagcacuguuu

SEQ ID NO: 3773791 - RNA, 20 nt, Human
cuaaacguguauguuuuuca

SEQ ID NO: 3773792 - RNA, 22 nt, Human
cuaaacguguauguuuuucagu

SEQ ID NO: 3773793 - RNA, 15 nt, Human
cuaaacuaagaugug

SEQ ID NO: 3773794 - RNA, 15 nt, Human
cuaaacuaucuuuuu

SEQ ID NO: 3773795 - RNA, 17 nt, Human
cuaaacucauuuauaaa

SEQ ID NO: 3773796 - RNA, 19 nt, Human
cuaaacuccaaacauccuc

SEQ ID NO: 3773797 - RNA, 22 nt, Human
cuaaacuccuuccuggccugag

SEQ ID NO: 3773798 - RNA, 16 nt, Human
cuaaacucugaauaag

SEQ ID NO: 3773799 - RNA, 11 nt, Human
cuaaacugcau

SEQ ID NO: 3773800 - RNA, 21 nt, Human
cuaaacugcccccucugcccu

SEQ ID NO: 3773801 - RNA, 14 nt, Human
cuaaacuggagacu

SEQ ID NO: 3773802 - RNA, 17 nt, Human
cuaaacuggagacugug

SEQ ID NO: 3773803 - RNA, 20 nt, Human
cuaaacuuccccaucuucua

SEQ ID NO: 3773804 - RNA, 13 nt, Human
cuaaacuuuucug

SEQ ID NO: 3773805 - RNA, 15 nt, Human
cuaaacuuuucugau

SEQ ID NO: 3773806 - RNA, 16 nt, Human
cuaaacuuuucugaua

SEQ ID NO: 3773807 - RNA, 17 nt, Human
cuaaagaaguuugaaca

SEQ ID NO: 3773808 - RNA, 16 nt, Human
cuaaagaccaaacuuc

SEQ ID NO: 3773809 - RNA, 18 nt, Human
cuaaagagagaauguaga

SEQ ID NO: 3773810 - RNA, 19 nt, Human
cuaaagagcacuuacugua

SEQ ID NO: 3773811 - RNA, 15 nt, Human
cuaaagagcccuugc

SEQ ID NO: 3773812 - RNA, 17 nt, Human
cuaaagagcccuugccu

SEQ ID NO: 3773813 - RNA, 18 nt, Human
cuaaagagcccuugccuc

SEQ ID NO: 3773814 - RNA, 18 nt, Human
cuaaagaguuuauuuuaa

SEQ ID NO: 3773815 - RNA, 18 nt, Human
cuaaagauagaguaaaaa

SEQ ID NO: 3773816 - RNA, 20 nt, Human
cuaaagauggaguuucuaag

SEQ ID NO: 3773817 - RNA, 23 nt, Human
cuaaagauggaguuucuaagguc

SEQ ID NO: 3773818 - RNA, 18 nt, Human
cuaaagauucuauaguuc

SEQ ID NO: 3773819 - RNA, 20 nt, Human
cuaaagauucuauaguucua

SEQ ID NO: 3773820 - RNA, 15 nt, Human
cuaaagcaauagaaa

SEQ ID NO: 3773821 - RNA, 14 nt, Human
cuaaagcagccagc

SEQ ID NO: 3773822 - RNA, 18 nt, Human
cuaaagcaguggacacca

SEQ ID NO: 3773823 - RNA, 19 nt, Human
cuaaagcaugaaaugugaa

SEQ ID NO: 3773824 - RNA, 18 nt, Human
cuaaagccaaacauauau

SEQ ID NO: 3773825 - RNA, 17 nt, Human
cuaaagcccaaccuccu

SEQ ID NO: 3773826 - RNA, 13 nt, Human
cuaaaggaguuua

SEQ ID NO: 3773827 - RNA, 15 nt, Human
cuaaagguccacagg

SEQ ID NO: 3773828 - RNA, 16 nt, Human
cuaaagguguauuuaa

SEQ ID NO: 3773829 - RNA, 20 nt, Human
cuaaagguguugucccuucu

SEQ ID NO: 3773830 - RNA, 14 nt, Human
cuaaaguaauuggu

SEQ ID NO: 3773831 - RNA, 15 nt, Human
cuaaaguaugaagca

SEQ ID NO: 3773832 - RNA, 16 nt, Human
cuaaaguauguaaagu

SEQ ID NO: 3773833 - RNA, 23 nt, Human
cuaaaguccuuugagcuccuggg

SEQ ID NO: 3773834 - RNA, 21 nt, Human
cuaaagugaugggcuuucucu

SEQ ID NO: 3773835 - RNA, 22 nt, Human
cuaaaguguauuuuuuuacuaa

SEQ ID NO: 3773836 - RNA, 11 nt, Human
cuaaaguuaua

SEQ ID NO: 3773837 - RNA, 14 nt, Human
cuaaaguucuaaga

SEQ ID NO: 3773838 - RNA, 15 nt, Human
cuaaaguucuaagau

SEQ ID NO: 3773839 - RNA, 18 nt, Human
cuaaauaaaaguuuuaca

SEQ ID NO: 3773840 - RNA, 20 nt, Human
cuaaauaaaaguuuuacaaa

SEQ ID NO: 3773841 - RNA, 20 nt, Human
cuaaauaaaauauaauuguu

SEQ ID NO: 3773842 - RNA, 15 nt, Human
cuaaauaaaaugcua

SEQ ID NO: 3773843 - RNA, 19 nt, Human
cuaaauaaaaugcuagguu

SEQ ID NO: 3773844 - RNA, 15 nt, Human
cuaaauaaaauuugu

SEQ ID NO: 3773845 - RNA, 20 nt, Human
cuaaauaaaauuuguugcau

SEQ ID NO: 3773846 - RNA, 20 nt, Human
cuaaauaaacacauagauuc

SEQ ID NO: 3773847 - RNA, 18 nt, Human
cuaaauaagaaaauaaca

SEQ ID NO: 3773848 - RNA, 20 nt, Human
cuaaauaaucuuacucuaga

SEQ ID NO: 3773849 - RNA, 15 nt, Human
cuaaauagcauguau

SEQ ID NO: 3773850 - RNA, 23 nt, Human
cuaaauagcauguauugugucuu

SEQ ID NO: 3773851 - RNA, 20 nt, Human
cuaaauauauuuuaagacga

SEQ ID NO: 3773852 - RNA, 16 nt, Human
cuaaauauggacugcu

SEQ ID NO: 3773853 - RNA, 23 nt, Human
cuaaauauucagaaucuuuguua

SEQ ID NO: 3773854 - RNA, 13 nt, Human
cuaaauauuuccu

SEQ ID NO: 3773855 - RNA, 16 nt, Human
cuaaauccauuuggaa

SEQ ID NO: 3773856 - RNA, 17 nt, Human
cuaaauccuuuacuguu

SEQ ID NO: 3773857 - RNA, 16 nt, Human
cuaaaucuagacucaa

SEQ ID NO: 3773858 - RNA, 12 nt, Human
cuaaaucuauuu

SEQ ID NO: 3773859 - RNA, 19 nt, Human
cuaaaucuauuuauuaaua

SEQ ID NO: 3773860 - RNA, 20 nt, Human
cuaaaucuccaaaauaaaac

SEQ ID NO: 3773861 - RNA, 16 nt, Human
cuaaaucuccuauuuu

SEQ ID NO: 3773862 - RNA, 17 nt, Human
cuaaaucuccuauuuuu

SEQ ID NO: 3773863 - RNA, 13 nt, Human
cuaaaugcccugc

SEQ ID NO: 3773864 - RNA, 19 nt, Human
cuaaaugccuuagaaaugu

SEQ ID NO: 3773865 - RNA, 15 nt, Human
cuaaaugcugaaaaa

SEQ ID NO: 3773866 - RNA, 18 nt, Human
cuaaauggucgcccagga

SEQ ID NO: 3773867 - RNA, 17 nt, Human
cuaaauguaagaaucau

SEQ ID NO: 3773868 - RNA, 13 nt, Human
cuaaauguuaaag

SEQ ID NO: 3773869 - RNA, 14 nt, Human
cuaaauguuaaaga

SEQ ID NO: 3773870 - RNA, 16 nt, Human
cuaaauguuaaagaug

SEQ ID NO: 3773871 - RNA, 23 nt, Human
cuaaauguuaaagauguagcaaa

SEQ ID NO: 3773872 - RNA, 16 nt, Human
cuaaauguugaaagau

SEQ ID NO: 3773873 - RNA, 21 nt, Human
cuaaauguuuggcauguaaau

SEQ ID NO: 3773874 - RNA, 22 nt, Human
cuaaauuauaguguagaaaaga

SEQ ID NO: 3773875 - RNA, 14 nt, Human
cuaaauuauuuacu

SEQ ID NO: 3773876 - RNA, 16 nt, Human
cuaaauucaugcugcu

SEQ ID NO: 3773877 - RNA, 21 nt, Human
cuaaauucuuuauuucuguca

SEQ ID NO: 3773878 - RNA, 14 nt, Human
cuaaauugaauaau

SEQ ID NO: 3773879 - RNA, 23 nt, Human
cuaaauugacacuuaaaaauggu

SEQ ID NO: 3773880 - RNA, 17 nt, Human
cuaaauugauguugaug

SEQ ID NO: 3773881 - RNA, 15 nt, Human
cuaaauuuaaauuua

SEQ ID NO: 3773882 - RNA, 17 nt, Human
cuaaauuuaaauuuaaa

SEQ ID NO: 3773883 - RNA, 13 nt, Human
cuaaauuuaaugc

SEQ ID NO: 3773884 - RNA, 17 nt, Human
cuaaauuuaaugcugcc

SEQ ID NO: 3773885 - RNA, 18 nt, Human
cuaaauuuaaugcugccu

SEQ ID NO: 3773886 - RNA, 18 nt, Human
cuaaauuuauuauuuaaa

SEQ ID NO: 3773887 - RNA, 14 nt, Human
cuaaauuuuaagug

SEQ ID NO: 3773888 - RNA, 13 nt, Human
cuaaauuuuauau

SEQ ID NO: 3773889 - RNA, 15 nt, Human
cuaaauuuuauaucu

SEQ ID NO: 3773890 - RNA, 15 nt, Human
cuaaauuuucugaaa

SEQ ID NO: 3773891 - RNA, 16 nt, Human
cuaaauuuucugaaac

SEQ ID NO: 3773892 - RNA, 16 nt, Human
cuaacaaaagaugaaa

SEQ ID NO: 3773893 - RNA, 17 nt, Human
cuaacaaaagaugaaag

SEQ ID NO: 3773894 - RNA, 19 nt, Human
cuaacaaaagaugaaagca

SEQ ID NO: 3773895 - RNA, 20 nt, Human
cuaacaacauuguagccuca

SEQ ID NO: 3773896 - RNA, 16 nt, Human
cuaacaaccaaagacu

SEQ ID NO: 3773897 - RNA, 15 nt, Human
cuaacacacagcucc

SEQ ID NO: 3773898 - RNA, 14 nt, Human
cuaacacccagucu

SEQ ID NO: 3773899 - RNA, 17 nt, Human
cuaacacucagaagccu

SEQ ID NO: 3773900 - RNA, 19 nt, Human
cuaacacucagaagccugg

SEQ ID NO: 3773901 - RNA, 13 nt, Human
cuaacacuggccc

SEQ ID NO: 3773902 - RNA, 15 nt, Human
cuaacacuggccccu

SEQ ID NO: 3773903 - RNA, 16 nt, Human
cuaacacuggccccua

SEQ ID NO: 3773904 - RNA, 17 nt, Human
cuaacagcucaggaucu

SEQ ID NO: 3773905 - RNA, 15 nt, Human
cuaacagggaaggca

SEQ ID NO: 3773906 - RNA, 22 nt, Human
cuaacauauaauguuguuauuu

SEQ ID NO: 3773907 - RNA, 23 nt, Human
cuaacauauaauguuguuauuua

SEQ ID NO: 3773908 - RNA, 12 nt, Human
cuaacaucagaa

SEQ ID NO: 3773909 - RNA, 17 nt, Human
cuaacauggaaguacua

SEQ ID NO: 3773910 - RNA, 22 nt, Human
cuaacauggugaaaccccgucu

SEQ ID NO: 3773911 - RNA, 17 nt, Human
cuaacauuauauugcaa

SEQ ID NO: 3773912 - RNA, 20 nt, Human
cuaacauuauauugcaauga

SEQ ID NO: 3773913 - RNA, 22 nt, Human
cuaacauuauauugcaaugaag

SEQ ID NO: 3773914 - RNA, 15 nt, Human
cuaacauuauuuauu

SEQ ID NO: 3773915 - RNA, 21 nt, Human
cuaacauuuuaaauaaaagaa

SEQ ID NO: 3773916 - RNA, 21 nt, Human
cuaacauuuuugauaaagccu

SEQ ID NO: 3773917 - RNA, 21 nt, Human
cuaaccaaaagacaccagcca

SEQ ID NO: 3773918 - RNA, 13 nt, Human
cuaaccaaaugca

SEQ ID NO: 3773919 - RNA, 15 nt, Human
cuaaccaagaggcug

SEQ ID NO: 3773920 - RNA, 16 nt, Human
cuaaccaagaggcugg

SEQ ID NO: 3773921 - RNA, 17 nt, Human
cuaaccaagaggcuggu

SEQ ID NO: 3773922 - RNA, 15 nt, Human
cuaaccaagcugagu

SEQ ID NO: 3773923 - RNA, 20 nt, Human
cuaaccaagcugaguuuccu

SEQ ID NO: 3773924 - RNA, 12 nt, Human
cuaaccaaguuc

SEQ ID NO: 3773925 - RNA, 14 nt, Human
cuaaccacacagcc

SEQ ID NO: 3773926 - RNA, 17 nt, Human
cuaaccacgcuggaccu

SEQ ID NO: 3773927 - RNA, 20 nt, Human
cuaaccacgucugucuucac

SEQ ID NO: 3773928 - RNA, 22 nt, Human
cuaaccccaacgcacaggaaaa

SEQ ID NO: 3773929 - RNA, 13 nt, Human
cuaaccccaggcc

SEQ ID NO: 3773930 - RNA, 23 nt, Human
cuaacccuauacuguaguauucu

SEQ ID NO: 3773931 - RNA, 19 nt, Human
cuaacccuuaucaccagcu

SEQ ID NO: 3773932 - RNA, 22 nt, Human
cuaacccuuugugugcucucca

SEQ ID NO: 3773933 - RNA, 23 nt, Human
cuaacccuuugugugcucuccau

SEQ ID NO: 3773934 - RNA, 15 nt, Human
cuaaccucaucuucu

SEQ ID NO: 3773935 - RNA, 16 nt, Human
cuaaccucgcccucuc

SEQ ID NO: 3773936 - RNA, 21 nt, Human
cuaaccugaccgugggcgggg

SEQ ID NO: 3773937 - RNA, 17 nt, Human
cuaaccuggguucccuu

SEQ ID NO: 3773938 - RNA, 15 nt, Human
cuaaccugugucugc

SEQ ID NO: 3773939 - RNA, 14 nt, Human
cuaaccuugaaugc

SEQ ID NO: 3773940 - RNA, 17 nt, Human
cuaaccuugaaugcugc

SEQ ID NO: 3773941 - RNA, 19 nt, Human
cuaaccuugaaugcugcca

SEQ ID NO: 3773942 - RNA, 20 nt, Human
cuaaccuugaaugcugccag

SEQ ID NO: 3773943 - RNA, 16 nt, Human
cuaaccuugccuggua

SEQ ID NO: 3773944 - RNA, 17 nt, Human
cuaaccuugccugguac

SEQ ID NO: 3773945 - RNA, 22 nt, Human
cuaacgccugagcccagggagg

SEQ ID NO: 3773946 - RNA, 19 nt, Human
cuaacggugcucagggggc

SEQ ID NO: 3773947 - RNA, 15 nt, Human
cuaacguaaauacac

SEQ ID NO: 3773948 - RNA, 17 nt, Human
cuaacguugagccccug

SEQ ID NO: 3773949 - RNA, 13 nt, Human
cuaacuaaacucu

SEQ ID NO: 3773950 - RNA, 20 nt, Human
cuaacuacaaagguuuaaau

SEQ ID NO: 3773951 - RNA, 15 nt, Human
cuaacuagacaccaa

SEQ ID NO: 3773952 - RNA, 21 nt, Human
cuaacuagagcagcccuggag

SEQ ID NO: 3773953 - RNA, 20 nt, Human
cuaacucaaauacacauuug

SEQ ID NO: 3773954 - RNA, 20 nt, Human
cuaacucauacugugcugga

SEQ ID NO: 3773955 - RNA, 17 nt, Human
cuaacucugauguaaau

SEQ ID NO: 3773956 - RNA, 17 nt, Human
cuaacucuucuuucauu

SEQ ID NO: 3773957 - RNA, 16 nt, Human
cuaacugaacuuugaa

SEQ ID NO: 3773958 - RNA, 20 nt, Human
cuaacugcuacaaauacucu

SEQ ID NO: 3773959 - RNA, 13 nt, Human
cuaacuguaaauc

SEQ ID NO: 3773960 - RNA, 15 nt, Human
cuaacuguaaaucau

SEQ ID NO: 3773961 - RNA, 18 nt, Human
cuaacuguaaaucauguu

SEQ ID NO: 3773962 - RNA, 16 nt, Human
cuaacuguauauuugu

SEQ ID NO: 3773963 - RNA, 20 nt, Human
cuaacugugcucaagagguu

SEQ ID NO: 3773964 - RNA, 14 nt, Human
cuaacuugcuuaaa

SEQ ID NO: 3773965 - RNA, 21 nt, Human
cuaacuuggagccccagugcc

SEQ ID NO: 3773966 - RNA, 22 nt, Human
cuaacuuggagccccagugcca

SEQ ID NO: 3773967 - RNA, 14 nt, Human
cuaacuugucuuug

SEQ ID NO: 3773968 - RNA, 22 nt, Human
cuaacuugucuuuggacccuga

SEQ ID NO: 3773969 - RNA, 16 nt, Human
cuaacuuuccuucauu

SEQ ID NO: 3773970 - RNA, 19 nt, Human
cuaacuuuucaaugacauu

SEQ ID NO: 3773971 - RNA, 14 nt, Human
cuaagaaaagauuu

SEQ ID NO: 3773972 - RNA, 22 nt, Human
cuaagaaaagccuaaucacagu

SEQ ID NO: 3773973 - RNA, 20 nt, Human
cuaagaaacauuuauauuga

SEQ ID NO: 3773974 - RNA, 21 nt, Human
cuaagaaacauuuauauugau

SEQ ID NO: 3773975 - RNA, 16 nt, Human
cuaagaaacuuaaauu

SEQ ID NO: 3773976 - RNA, 16 nt, Human
cuaagaaacuuuugua

SEQ ID NO: 3773977 - RNA, 12 nt, Human
cuaagaaagaac

SEQ ID NO: 3773978 - RNA, 20 nt, Human
cuaagaaagaggagugcuug

SEQ ID NO: 3773979 - RNA, 20 nt, Human
cuaagaaauaaaacuguuaa

SEQ ID NO: 3773980 - RNA, 21 nt, Human
cuaagaaauaucugugaaaua

SEQ ID NO: 3773981 - RNA, 22 nt, Human
cuaagaaauaucugugaaauau

SEQ ID NO: 3773982 - RNA, 20 nt, Human
cuaagaaauaugugagauuu

SEQ ID NO: 3773983 - RNA, 22 nt, Human
cuaagaaaucaaguaaugaauc

SEQ ID NO: 3773984 - RNA, 20 nt, Human
cuaagaacaaaagaagcagc

SEQ ID NO: 3773985 - RNA, 15 nt, Human
cuaagaaccuggaac

SEQ ID NO: 3773986 - RNA, 20 nt, Human
cuaagaauacagcuuucuga

SEQ ID NO: 3773987 - RNA, 17 nt, Human
cuaagaauuuuuuauuu

SEQ ID NO: 3773988 - RNA, 16 nt, Human
cuaagacucaaauguu

SEQ ID NO: 3773989 - RNA, 21 nt, Human
cuaagacucaaauguucuaag

SEQ ID NO: 3773990 - RNA, 22 nt, Human
cuaagacugugacaacugucua

SEQ ID NO: 3773991 - RNA, 17 nt, Human
cuaagacuuacucuaag

SEQ ID NO: 3773992 - RNA, 15 nt, Human
cuaagacuuuacuua

SEQ ID NO: 3773993 - RNA, 19 nt, Human
cuaagagaaguagaaauca

SEQ ID NO: 3773994 - RNA, 14 nt, Human
cuaagagagaauga

SEQ ID NO: 3773995 - RNA, 18 nt, Human
cuaagagauucugauuug

SEQ ID NO: 3773996 - RNA, 16 nt, Human
cuaagagcuagcgcug

SEQ ID NO: 3773997 - RNA, 11 nt, Human
cuaagaggcug

SEQ ID NO: 3773998 - RNA, 12 nt, Human
cuaagaggcugc

SEQ ID NO: 3773999 - RNA, 14 nt, Human
cuaagaggcugccc

SEQ ID NO: 3774000 - RNA, 22 nt, Human
cuaagagugcugggcauuuuua

SEQ ID NO: 3774001 - RNA, 12 nt, Human
cuaagagugucc

SEQ ID NO: 3774002 - RNA, 18 nt, Human
cuaagauauacuuguuuu

SEQ ID NO: 3774003 - RNA, 22 nt, Human
cuaagauauacuuguuuuugua

SEQ ID NO: 3774004 - RNA, 18 nt, Human
cuaagaucgguuaacaaa

SEQ ID NO: 3774005 - RNA, 15 nt, Human
cuaagaugacauugc

SEQ ID NO: 3774006 - RNA, 20 nt, Human
cuaagaugacauugcuaaga

SEQ ID NO: 3774007 - RNA, 11 nt, Human
cuaagaugcuc

SEQ ID NO: 3774008 - RNA, 20 nt, Human
cuaagaugugauauucuaag

SEQ ID NO: 3774009 - RNA, 13 nt, Human
cuaagauguuaua

SEQ ID NO: 3774010 - RNA, 19 nt, Human
cuaagauguuauauuuuuc

SEQ ID NO: 3774011 - RNA, 22 nt, Human
cuaagauuacaaaucagaaguc

SEQ ID NO: 3774012 - RNA, 14 nt, Human
cuaagauucuaaag

SEQ ID NO: 3774013 - RNA, 15 nt, Human
cuaagauucuaauga

SEQ ID NO: 3774014 - RNA, 21 nt, Human
cuaagauucuaaugaugauca

SEQ ID NO: 3774015 - RNA, 18 nt, Human
cuaagauucuagaucaga

SEQ ID NO: 3774016 - RNA, 22 nt, Human
cuaagauucuagaucagaugcu

SEQ ID NO: 3774017 - RNA, 20 nt, Human
cuaagauuuauuuuguuaaa

SEQ ID NO: 3774018 - RNA, 14 nt, Human
cuaagcaaaaugug

SEQ ID NO: 3774019 - RNA, 16 nt, Human
cuaagcaacuaggccu

SEQ ID NO: 3774020 - RNA, 23 nt, Human
cuaagcacgggccauaugaauaa

SEQ ID NO: 3774021 - RNA, 19 nt, Human
cuaagcagaaagugccuuu

SEQ ID NO: 3774022 - RNA, 21 nt, Human
cuaagcagaaagugccuuuca

SEQ ID NO: 3774023 - RNA, 12 nt, Human
cuaagcagagga

SEQ ID NO: 3774024 - RNA, 13 nt, Human
cuaagcagaggag

SEQ ID NO: 3774025 - RNA, 15 nt, Human
cuaagcagaggaggg

SEQ ID NO: 3774026 - RNA, 18 nt, Human
cuaagcagaggaggggcc

SEQ ID NO: 3774027 - RNA, 17 nt, Human
cuaagcagcuuauuguu

SEQ ID NO: 3774028 - RNA, 19 nt, Human
cuaagccccagcaagcaau

SEQ ID NO: 3774029 - RNA, 20 nt, Human
cuaagccuaccugcucucca

SEQ ID NO: 3774030 - RNA, 23 nt, Human
cuaagccuaccugcucuccaagu

SEQ ID NO: 3774031 - RNA, 17 nt, Human
cuaagccugaaggggcg

SEQ ID NO: 3774032 - RNA, 14 nt, Human
cuaagccuguggcu

SEQ ID NO: 3774033 - RNA, 17 nt, Human
cuaagccuuuccauaag

SEQ ID NO: 3774034 - RNA, 23 nt, Human
cuaagcgcuagaggaagcagcca

SEQ ID NO: 3774035 - RNA, 21 nt, Human
cuaagcuauucaguaauaacu

SEQ ID NO: 3774036 - RNA, 22 nt, Human
cuaagcuauucaguaauaacuc

SEQ ID NO: 3774037 - RNA, 12 nt, Human
cuaagcugcagc

SEQ ID NO: 3774038 - RNA, 22 nt, Human
cuaagcuggagugcuuaucccu

SEQ ID NO: 3774039 - RNA, 21 nt, Human
cuaagcuucacuguaaaauaa

SEQ ID NO: 3774040 - RNA, 11 nt, Human
cuaaggacuug

SEQ ID NO: 3774041 - RNA, 23 nt, Human
cuaaggaguguagcaacuacagu

SEQ ID NO: 3774042 - RNA, 20 nt, Human
cuaaggaugcuaaaccuuag

SEQ ID NO: 3774043 - RNA, 20 nt, Human
cuaaggaugucacagggcca

SEQ ID NO: 3774044 - RNA, 19 nt, Human
cuaaggauuagucccuggc

SEQ ID NO: 3774045 - RNA, 20 nt, Human
cuaaggcacccacaaauaaa

SEQ ID NO: 3774046 - RNA, 22 nt, Human
cuaaggcaucuaucugugcuag

SEQ ID NO: 3774047 - RNA, 16 nt, Human
cuaaggcguggagcug

SEQ ID NO: 3774048 - RNA, 17 nt, Human
cuaaggcguggagcugc

SEQ ID NO: 3774049 - RNA, 18 nt, Human
cuaaggcguggagcugcc

SEQ ID NO: 3774050 - RNA, 21 nt, Human
cuaaggcguggagcugccuga

SEQ ID NO: 3774051 - RNA, 21 nt, Human
cuaaggcucuaugagucuaga

SEQ ID NO: 3774052 - RNA, 17 nt, Human
cuaagggaagacauuuc

SEQ ID NO: 3774053 - RNA, 12 nt, Human
cuaaggggcccg

SEQ ID NO: 3774054 - RNA, 22 nt, Human
cuaaggggcccggccagccaug

SEQ ID NO: 3774055 - RNA, 21 nt, Human
cuaagggucgaaagcucuaga

SEQ ID NO: 3774056 - RNA, 18 nt, Human
cuaagggugggugcucag

SEQ ID NO: 3774057 - RNA, 19 nt, Human
cuaaggucauuaccacagg

SEQ ID NO: 3774058 - RNA, 17 nt, Human
cuaagguggauuuucau

SEQ ID NO: 3774059 - RNA, 12 nt, Human
cuaagguucuaa

SEQ ID NO: 3774060 - RNA, 16 nt, Human
cuaagguucuaaggcc

SEQ ID NO: 3774061 - RNA, 14 nt, Human
cuaagguucucaua

SEQ ID NO: 3774062 - RNA, 18 nt, Human
cuaaguaaaaccacagca

SEQ ID NO: 3774063 - RNA, 15 nt, Human
cuaaguaaauacaau

SEQ ID NO: 3774064 - RNA, 16 nt, Human
cuaaguaaauacaauu

SEQ ID NO: 3774065 - RNA, 19 nt, Human
cuaaguaaaucucuucugu

SEQ ID NO: 3774066 - RNA, 23 nt, Human
cuaaguaaaucucuucuguguuu

SEQ ID NO: 3774067 - RNA, 19 nt, Human
cuaaguacacaauaagcaa

SEQ ID NO: 3774068 - RNA, 20 nt, Human
cuaaguacacaauaagcaaa

SEQ ID NO: 3774069 - RNA, 21 nt, Human
cuaaguacuguaauaauaccu

SEQ ID NO: 3774070 - RNA, 18 nt, Human
cuaaguauuaaaacauug

SEQ ID NO: 3774071 - RNA, 13 nt, Human
cuaaguauuuccc

SEQ ID NO: 3774072 - RNA, 16 nt, Human
cuaaguauuucccagc

SEQ ID NO: 3774073 - RNA, 18 nt, Human
cuaagucauguauguuuc

SEQ ID NO: 3774074 - RNA, 21 nt, Human
cuaaguccaguccaguccuau

SEQ ID NO: 3774075 - RNA, 19 nt, Human
cuaaguccaguguuucuuu

SEQ ID NO: 3774076 - RNA, 15 nt, Human
cuaagucccugcccc

SEQ ID NO: 3774077 - RNA, 17 nt, Human
cuaagucccugcccccu

SEQ ID NO: 3774078 - RNA, 13 nt, Human
cuaagucucugug

SEQ ID NO: 3774079 - RNA, 18 nt, Human
cuaagucucuuuuuuaca

SEQ ID NO: 3774080 - RNA, 16 nt, Human
cuaagugacauuugua

SEQ ID NO: 3774081 - RNA, 13 nt, Human
cuaagugauauaa

SEQ ID NO: 3774082 - RNA, 14 nt, Human
cuaagugauauaaa

SEQ ID NO: 3774083 - RNA, 23 nt, Human
cuaagugauccucccaccucagc

SEQ ID NO: 3774084 - RNA, 23 nt, Human
cuaagugggcauugccaugugga

SEQ ID NO: 3774085 - RNA, 17 nt, Human
cuaaguuaauuuaaagu

SEQ ID NO: 3774086 - RNA, 17 nt, Human
cuaaguuauaagacucu

SEQ ID NO: 3774087 - RNA, 21 nt, Human
cuaaguuauaagacucucaca

SEQ ID NO: 3774088 - RNA, 16 nt, Human
cuaaguuauaguauau

SEQ ID NO: 3774089 - RNA, 14 nt, Human
cuaaguucacauua

SEQ ID NO: 3774090 - RNA, 20 nt, Human
cuaaguucuuagauaucuuu

SEQ ID NO: 3774091 - RNA, 13 nt, Human
cuaaguuucaguu

SEQ ID NO: 3774092 - RNA, 12 nt, Human
cuaaguuucuaa

SEQ ID NO: 3774093 - RNA, 22 nt, Human
cuaaguuucuaagauucuaaag

SEQ ID NO: 3774094 - RNA, 14 nt, Human
cuaauaaaaaggug

SEQ ID NO: 3774095 - RNA, 12 nt, Human
cuaauaaaacug

SEQ ID NO: 3774096 - RNA, 20 nt, Human
cuaauaaaacugaugugaaa

SEQ ID NO: 3774097 - RNA, 13 nt, Human
cuaauaaaagcau

SEQ ID NO: 3774098 - RNA, 14 nt, Human
cuaauaaaauauca

SEQ ID NO: 3774099 - RNA, 23 nt, Human
cuaauaaaauaucauucagcaac

SEQ ID NO: 3774100 - RNA, 20 nt, Human
cuaauaaaauauuuucugug

SEQ ID NO: 3774101 - RNA, 17 nt, Human
cuaauaaacuaauaauu

SEQ ID NO: 3774102 - RNA, 12 nt, Human
cuaauaaagcug

SEQ ID NO: 3774103 - RNA, 17 nt, Human
cuaauaagcuaguugaa

SEQ ID NO: 3774104 - RNA, 20 nt, Human
cuaauaaucuuguuucugaa

SEQ ID NO: 3774105 - RNA, 16 nt, Human
cuaauaauuucuaaug

SEQ ID NO: 3774106 - RNA, 21 nt, Human
cuaauacagccccuuuucccu

SEQ ID NO: 3774107 - RNA, 19 nt, Human
cuaauacauuaaagcaguc

SEQ ID NO: 3774108 - RNA, 18 nt, Human
cuaauagaaaaguauguu

SEQ ID NO: 3774109 - RNA, 13 nt, Human
cuaauagaacuca

SEQ ID NO: 3774110 - RNA, 21 nt, Human
cuaauagaauaaaggcaguuu

SEQ ID NO: 3774111 - RNA, 23 nt, Human
cuaauagaauaaaggcaguuuuc

SEQ ID NO: 3774112 - RNA, 23 nt, Human
cuaauagacaauuuauuauggca

SEQ ID NO: 3774113 - RNA, 18 nt, Human
cuaauagugaucaagaag

SEQ ID NO: 3774114 - RNA, 22 nt, Human
cuaauauaaguuucuuugcuuc

SEQ ID NO: 3774115 - RNA, 17 nt, Human
cuaauauacaggguagc

SEQ ID NO: 3774116 - RNA, 15 nt, Human
cuaauauauuuaaaa

SEQ ID NO: 3774117 - RNA, 16 nt, Human
cuaauauauuuaaaaa

SEQ ID NO: 3774118 - RNA, 15 nt, Human
cuaauaucaaaugca

SEQ ID NO: 3774119 - RNA, 22 nt, Human
cuaauauccacuuguccaugug

SEQ ID NO: 3774120 - RNA, 19 nt, Human
cuaauaugaugacuguuuu

SEQ ID NO: 3774121 - RNA, 13 nt, Human
cuaauauggcaaa

SEQ ID NO: 3774122 - RNA, 17 nt, Human
cuaauauuuauugcuuu

SEQ ID NO: 3774123 - RNA, 18 nt, Human
cuaauauuuauugcuuua

SEQ ID NO: 3774124 - RNA, 13 nt, Human
cuaauauuuuccu

SEQ ID NO: 3774125 - RNA, 16 nt, Human
cuaaucaaagccaggg

SEQ ID NO: 3774126 - RNA, 17 nt, Human
cuaaucagaaauuuuua

SEQ ID NO: 3774127 - RNA, 23 nt, Human
cuaaucagaaauuuuuaucaguu

SEQ ID NO: 3774128 - RNA, 19 nt, Human
cuaaucagcauucucacuc

SEQ ID NO: 3774129 - RNA, 20 nt, Human
cuaaucaggcugaggugucu

SEQ ID NO: 3774130 - RNA, 21 nt, Human
cuaaucagggaggucauuuug

SEQ ID NO: 3774131 - RNA, 17 nt, Human
cuaaucagugucucaca

SEQ ID NO: 3774132 - RNA, 21 nt, Human
cuaaucagugucucacacugg

SEQ ID NO: 3774133 - RNA, 16 nt, Human
cuaaucauccaaugcu

SEQ ID NO: 3774134 - RNA, 20 nt, Human
cuaauccaggcagauccagg

SEQ ID NO: 3774135 - RNA, 18 nt, Human
cuaaucccgauucacccu

SEQ ID NO: 3774136 - RNA, 20 nt, Human
cuaaucccugggcauugcuu

SEQ ID NO: 3774137 - RNA, 21 nt, Human
cuaaucccugggcauugcuuu

SEQ ID NO: 3774138 - RNA, 16 nt, Human
cuaauccucuuuuucu

SEQ ID NO: 3774139 - RNA, 19 nt, Human
cuaaucuagauaucgacuu

SEQ ID NO: 3774140 - RNA, 18 nt, Human
cuaaucuauggucgggag

SEQ ID NO: 3774141 - RNA, 17 nt, Human
cuaaucuauuggguuca

SEQ ID NO: 3774142 - RNA, 15 nt, Human
cuaaucucauaccuc

SEQ ID NO: 3774143 - RNA, 22 nt, Human
cuaaucugcuaugcuugaaugc

SEQ ID NO: 3774144 - RNA, 13 nt, Human
cuaaucuguaggg

SEQ ID NO: 3774145 - RNA, 22 nt, Human
cuaaucuguagggcuggaccua

SEQ ID NO: 3774146 - RNA, 18 nt, Human
cuaaucugugcuguuuca

SEQ ID NO: 3774147 - RNA, 18 nt, Human
cuaaucuuauucauuuuc

SEQ ID NO: 3774148 - RNA, 16 nt, Human
cuaaucuugugaaaau

SEQ ID NO: 3774149 - RNA, 19 nt, Human
cuaaucuugugaaaauaau

SEQ ID NO: 3774150 - RNA, 20 nt, Human
cuaaugaaagugaugacaua

SEQ ID NO: 3774151 - RNA, 23 nt, Human
cuaaugacaugccuauaugagaa

SEQ ID NO: 3774152 - RNA, 18 nt, Human
cuaaugaggagagaaaau

SEQ ID NO: 3774153 - RNA, 19 nt, Human
cuaaugaggagagaaaaua

SEQ ID NO: 3774154 - RNA, 21 nt, Human
cuaaugaggagagaaaauaua

SEQ ID NO: 3774155 - RNA, 19 nt, Human
cuaaugaguuucuuuuaua

SEQ ID NO: 3774156 - RNA, 13 nt, Human
cuaaugauggccc

SEQ ID NO: 3774157 - RNA, 22 nt, Human
cuaaugcgcaggcuggcccugc

SEQ ID NO: 3774158 - RNA, 12 nt, Human
cuaaugcuccuu

SEQ ID NO: 3774159 - RNA, 21 nt, Human
cuaauggauuauaaucagaau

SEQ ID NO: 3774160 - RNA, 18 nt, Human
cuaauggcaugagaaaua

SEQ ID NO: 3774161 - RNA, 14 nt, Human
cuaauguaaaauga

SEQ ID NO: 3774162 - RNA, 16 nt, Human
cuaauguacugcauau

SEQ ID NO: 3774163 - RNA, 15 nt, Human
cuaauguauuuuauu

SEQ ID NO: 3774164 - RNA, 18 nt, Human
cuaaugucuguaucacuc

SEQ ID NO: 3774165 - RNA, 22 nt, Human
cuaauguuggcagaugcagcuc

SEQ ID NO: 3774166 - RNA, 16 nt, Human
cuaauguuuaagcaga

SEQ ID NO: 3774167 - RNA, 20 nt, Human
cuaauguuuaagcagaauug

SEQ ID NO: 3774168 - RNA, 20 nt, Human
cuaauguuuaugagccagac

SEQ ID NO: 3774169 - RNA, 16 nt, Human
cuaauguuugcauaua

SEQ ID NO: 3774170 - RNA, 15 nt, Human
cuaauuaacauauaa

SEQ ID NO: 3774171 - RNA, 17 nt, Human
cuaauuaaccuuacuaa

SEQ ID NO: 3774172 - RNA, 21 nt, Human
cuaauuaauauauuaaaauuc

SEQ ID NO: 3774173 - RNA, 16 nt, Human
cuaauuaaucuggaau

SEQ ID NO: 3774174 - RNA, 19 nt, Human
cuaauuaauuguaaucuga

SEQ ID NO: 3774175 - RNA, 14 nt, Human
cuaauuaauuucag

SEQ ID NO: 3774176 - RNA, 17 nt, Human
cuaauuaauuucaguaa

SEQ ID NO: 3774177 - RNA, 20 nt, Human
cuaauuacgauaaggaagaa

SEQ ID NO: 3774178 - RNA, 18 nt, Human
cuaauuaggguacauuua

SEQ ID NO: 3774179 - RNA, 17 nt, Human
cuaauuauguagcucuu

SEQ ID NO: 3774180 - RNA, 14 nt, Human
cuaauuauuuaauu

SEQ ID NO: 3774181 - RNA, 16 nt, Human
cuaauucacagugcuc

SEQ ID NO: 3774182 - RNA, 22 nt, Human
cuaauucacagugcucuuuucu

SEQ ID NO: 3774183 - RNA, 10 nt, Human
cuaauucaua

SEQ ID NO: 3774184 - RNA, 14 nt, Human
cuaauuccacagcu

SEQ ID NO: 3774185 - RNA, 14 nt, Human
cuaauucccagagu

SEQ ID NO: 3774186 - RNA, 18 nt, Human
cuaauucccauuuugcaa

SEQ ID NO: 3774187 - RNA, 19 nt, Human
cuaauucccauuuugcaaa

SEQ ID NO: 3774188 - RNA, 21 nt, Human
cuaauucccauuuugcaaaau

SEQ ID NO: 3774189 - RNA, 17 nt, Human
cuaauucgaugaaggcu

SEQ ID NO: 3774190 - RNA, 16 nt, Human
cuaauucuauuaaagu

SEQ ID NO: 3774191 - RNA, 18 nt, Human
cuaauucuuacacugccu

SEQ ID NO: 3774192 - RNA, 17 nt, Human
cuaauucuuugcaaaaa

SEQ ID NO: 3774193 - RNA, 12 nt, Human
cuaauugacuuu

SEQ ID NO: 3774194 - RNA, 13 nt, Human
cuaauugacuuua

SEQ ID NO: 3774195 - RNA, 16 nt, Human
cuaauugcaucucaaa

SEQ ID NO: 3774196 - RNA, 20 nt, Human
cuaauugcaucucaaaauua

SEQ ID NO: 3774197 - RNA, 18 nt, Human
cuaauugcuguugaaagc

SEQ ID NO: 3774198 - RNA, 21 nt, Human
cuaauuggaagaaauuccugu

SEQ ID NO: 3774199 - RNA, 23 nt, Human
cuaauugggaguccaggcacagg

SEQ ID NO: 3774200 - RNA, 13 nt, Human
cuaauuguauaac

SEQ ID NO: 3774201 - RNA, 17 nt, Human
cuaauuguauaacaggu

SEQ ID NO: 3774202 - RNA, 19 nt, Human
cuaauuguauaacagguua

SEQ ID NO: 3774203 - RNA, 14 nt, Human
cuaauuuaaaaaau

SEQ ID NO: 3774204 - RNA, 11 nt, Human
cuaauuuaaca

SEQ ID NO: 3774205 - RNA, 17 nt, Human
cuaauuuauaaaaaggu

SEQ ID NO: 3774206 - RNA, 23 nt, Human
cuaauuuauccugaaauuucaga

SEQ ID NO: 3774207 - RNA, 21 nt, Human
cuaauuuaucuugucucuggg

SEQ ID NO: 3774208 - RNA, 14 nt, Human
cuaauuuauuuugu

SEQ ID NO: 3774209 - RNA, 16 nt, Human
cuaauuucccuucuug

SEQ ID NO: 3774210 - RNA, 15 nt, Human
cuaauuucuccuccc

SEQ ID NO: 3774211 - RNA, 13 nt, Human
cuaauuugcauua

SEQ ID NO: 3774212 - RNA, 14 nt, Human
cuaauuugcauuaa

SEQ ID NO: 3774213 - RNA, 22 nt, Human
cuaauuugcauuaaauucacaa

SEQ ID NO: 3774214 - RNA, 20 nt, Human
cuaauuuuacacauuagauu

SEQ ID NO: 3774215 - RNA, 23 nt, Human
cuaauuuuuaagaaauuuugccu

SEQ ID NO: 3774216 - RNA, 14 nt, Human
cuaauuuuuguaau

SEQ ID NO: 3774217 - RNA, 19 nt, Human
cuaauuuuuguauuauuuu

SEQ ID NO: 3774218 - RNA, 20 nt, Human
cuaauuuuuguauuuuuagu

SEQ ID NO: 3774219 - RNA, 13 nt, Human
cuaauuuuuuugu

SEQ ID NO: 3774220 - RNA, 16 nt, Human
cuacaaaaacacagca

SEQ ID NO: 3774221 - RNA, 19 nt, Human
cuacaaaaagcauaaaaau

SEQ ID NO: 3774222 - RNA, 21 nt, Human
cuacaaaaccugauguuaaaa

SEQ ID NO: 3774223 - RNA, 13 nt, Human
cuacaaacaaaau

SEQ ID NO: 3774224 - RNA, 20 nt, Human
cuacaaacaaaauuucuauu

SEQ ID NO: 3774225 - RNA, 14 nt, Human
cuacaaagaagaca

SEQ ID NO: 3774226 - RNA, 16 nt, Human
cuacaaagaagacaug

SEQ ID NO: 3774227 - RNA, 18 nt, Human
cuacaaagaagacauguu

SEQ ID NO: 3774228 - RNA, 21 nt, Human
cuacaaagguuuaaaugaaca

SEQ ID NO: 3774229 - RNA, 22 nt, Human
cuacaaagguuuaaaugaacaa

SEQ ID NO: 3774230 - RNA, 18 nt, Human
cuacaaccaagcucucug

SEQ ID NO: 3774231 - RNA, 15 nt, Human
cuacaagacacagug

SEQ ID NO: 3774232 - RNA, 18 nt, Human
cuacaagagcagccugug

SEQ ID NO: 3774233 - RNA, 20 nt, Human
cuacaagagcagccuguggc

SEQ ID NO: 3774234 - RNA, 23 nt, Human
cuacaagagcagccuguggcauc

SEQ ID NO: 3774235 - RNA, 12 nt, Human
cuacaaggccua

SEQ ID NO: 3774236 - RNA, 13 nt, Human
cuacaaucucuuu

SEQ ID NO: 3774237 - RNA, 13 nt, Human
cuacaaugugaac

SEQ ID NO: 3774238 - RNA, 22 nt, Human
cuacaauuaauaguuugucuau

SEQ ID NO: 3774239 - RNA, 18 nt, Human
cuacacaccuaacuuaug

SEQ ID NO: 3774240 - RNA, 13 nt, Human
cuacacaggacag

SEQ ID NO: 3774241 - RNA, 21 nt, Human
cuacacagugggaacucugac

SEQ ID NO: 3774242 - RNA, 22 nt, Human
cuacacagugggaacucugaca

SEQ ID NO: 3774243 - RNA, 23 nt, Human
cuacacagugggaacucugacaa

SEQ ID NO: 3774244 - RNA, 21 nt, Human
cuacacauauguauuccugau

SEQ ID NO: 3774245 - RNA, 13 nt, Human
cuacacauuuuua

SEQ ID NO: 3774246 - RNA, 14 nt, Human
cuacacauuuuuaa

SEQ ID NO: 3774247 - RNA, 16 nt, Human
cuacaccacacacaac

SEQ ID NO: 3774248 - RNA, 19 nt, Human
cuacaccacacacaacagc

SEQ ID NO: 3774249 - RNA, 18 nt, Human
cuacaccacucuggcagc

SEQ ID NO: 3774250 - RNA, 16 nt, Human
cuacacccagcaauag

SEQ ID NO: 3774251 - RNA, 16 nt, Human
cuacacccuuuuccag

SEQ ID NO: 3774252 - RNA, 14 nt, Human
cuacaccuaacuca

SEQ ID NO: 3774253 - RNA, 12 nt, Human
cuacaccuggcu

SEQ ID NO: 3774254 - RNA, 13 nt, Human
cuacaccuggcug

SEQ ID NO: 3774255 - RNA, 18 nt, Human
cuacaccuuucuccuuug

SEQ ID NO: 3774256 - RNA, 23 nt, Human
cuacacgagauacagaauuuuau

SEQ ID NO: 3774257 - RNA, 19 nt, Human
cuacacucuccugggcccc

SEQ ID NO: 3774258 - RNA, 21 nt, Human
cuacacucuccugggccccuc

SEQ ID NO: 3774259 - RNA, 23 nt, Human
cuacacucuuguaauaaaauguc

SEQ ID NO: 3774260 - RNA, 15 nt, Human
cuacacugacacugg

SEQ ID NO: 3774261 - RNA, 14 nt, Human
cuacacugcaauca

SEQ ID NO: 3774262 - RNA, 21 nt, Human
cuacacugcaaucauauguga

SEQ ID NO: 3774263 - RNA, 20 nt, Human
cuacacugugaacuugggga

SEQ ID NO: 3774264 - RNA, 13 nt, Human
cuacacugugcug

SEQ ID NO: 3774265 - RNA, 15 nt, Human
cuacagaaaaaccuu

SEQ ID NO: 3774266 - RNA, 15 nt, Human
cuacagaccugcuuu

SEQ ID NO: 3774267 - RNA, 23 nt, Human
cuacagaccugcuuuuugaaaug

SEQ ID NO: 3774268 - RNA, 10 nt, Human
cuacagagaa

SEQ ID NO: 3774269 - RNA, 11 nt, Human
cuacagagaaa

SEQ ID NO: 3774270 - RNA, 17 nt, Human
cuacagagaaaccagcu

SEQ ID NO: 3774271 - RNA, 18 nt, Human
cuacagagaaaccagcuu

SEQ ID NO: 3774272 - RNA, 19 nt, Human
cuacagagaaaccagcuuc

SEQ ID NO: 3774273 - RNA, 21 nt, Human
cuacagagaaaccagcuuccu

SEQ ID NO: 3774274 - RNA, 12 nt, Human
cuacagagaagc

SEQ ID NO: 3774275 - RNA, 21 nt, Human
cuacagagccgagcaauauuu

SEQ ID NO: 3774276 - RNA, 15 nt, Human
cuacagaggccaugg

SEQ ID NO: 3774277 - RNA, 17 nt, Human
cuacagaggccaugggc

SEQ ID NO: 3774278 - RNA, 20 nt, Human
cuacagaggucucugccggc

SEQ ID NO: 3774279 - RNA, 23 nt, Human
cuacagaggucucugccggcucu

SEQ ID NO: 3774280 - RNA, 22 nt, Human
cuacagauagagaguuguugug

SEQ ID NO: 3774281 - RNA, 14 nt, Human
cuacagauagucaa

SEQ ID NO: 3774282 - RNA, 14 nt, Human
cuacagaugaguca

SEQ ID NO: 3774283 - RNA, 23 nt, Human
cuacagaugauagaggauuuuau

SEQ ID NO: 3774284 - RNA, 15 nt, Human
cuacagcacuacugg

SEQ ID NO: 3774285 - RNA, 19 nt, Human
cuacagcacuacugggugu

SEQ ID NO: 3774286 - RNA, 18 nt, Human
cuacagccucagaaacca

SEQ ID NO: 3774287 - RNA, 18 nt, Human
cuacagccuugucccccu

SEQ ID NO: 3774288 - RNA, 18 nt, Human
cuacagcuaaucagcauu

SEQ ID NO: 3774289 - RNA, 11 nt, Human
cuacagcucuu

SEQ ID NO: 3774290 - RNA, 17 nt, Human
cuacagcuggggugcag

SEQ ID NO: 3774291 - RNA, 22 nt, Human
cuacagcuggggugcagggaug

SEQ ID NO: 3774292 - RNA, 20 nt, Human
cuacagcuuucuugcucccu

SEQ ID NO: 3774293 - RNA, 23 nt, Human
cuacagcuuucuugcucccuuca

SEQ ID NO: 3774294 - RNA, 19 nt, Human
cuacagcuuugaucccuga

SEQ ID NO: 3774295 - RNA, 18 nt, Human
cuacagcuuugugacugu

SEQ ID NO: 3774296 - RNA, 18 nt, Human
cuacaggaagcaccccau

SEQ ID NO: 3774297 - RNA, 18 nt, Human
cuacaggagagggaagag

SEQ ID NO: 3774298 - RNA, 17 nt, Human
cuacaggcacccaccau

SEQ ID NO: 3774299 - RNA, 20 nt, Human
cuacaggcagucucucucuu

SEQ ID NO: 3774300 - RNA, 12 nt, Human
cuacaggccuca

SEQ ID NO: 3774301 - RNA, 21 nt, Human
cuacaggcgugagccaccaug

SEQ ID NO: 3774302 - RNA, 11 nt, Human
cuacagggccg

SEQ ID NO: 3774303 - RNA, 18 nt, Human
cuacaggggaagguggcc

SEQ ID NO: 3774304 - RNA, 20 nt, Human
cuacagggggucuggcuggu

SEQ ID NO: 3774305 - RNA, 22 nt, Human
cuacagggggucuggcuggugu

SEQ ID NO: 3774306 - RNA, 23 nt, Human
cuacagggggucuggcugguguu

SEQ ID NO: 3774307 - RNA, 17 nt, Human
cuacaggguccaacaua

SEQ ID NO: 3774308 - RNA, 18 nt, Human
cuacagguuacaacagau

SEQ ID NO: 3774309 - RNA, 13 nt, Human
cuacaguaauaaa

SEQ ID NO: 3774310 - RNA, 18 nt, Human
cuacaguccucccaucuc

SEQ ID NO: 3774311 - RNA, 11 nt, Human
cuacagugcca

SEQ ID NO: 3774312 - RNA, 17 nt, Human
cuacaguguacagucuu

SEQ ID NO: 3774313 - RNA, 20 nt, Human
cuacaguuggaaauccaucc

SEQ ID NO: 3774314 - RNA, 17 nt, Human
cuacaguuuuaacugug

SEQ ID NO: 3774315 - RNA, 20 nt, Human
cuacaguuuuaacuguggau

SEQ ID NO: 3774316 - RNA, 14 nt, Human
cuacaguuuuuccu

SEQ ID NO: 3774317 - RNA, 17 nt, Human
cuacauaaacugacuuu

SEQ ID NO: 3774318 - RNA, 22 nt, Human
cuacauaaacugacuuuauccu

SEQ ID NO: 3774319 - RNA, 18 nt, Human
cuacauacuauggaauuu

SEQ ID NO: 3774320 - RNA, 23 nt, Human
cuacauacuuucauccugacucu

SEQ ID NO: 3774321 - RNA, 16 nt, Human
cuacauaucccuucca

SEQ ID NO: 3774322 - RNA, 17 nt, Human
cuacauaucccuuccag

SEQ ID NO: 3774323 - RNA, 21 nt, Human
cuacauaucccuuccagaugg

SEQ ID NO: 3774324 - RNA, 17 nt, Human
cuacaucgcccuccaca

SEQ ID NO: 3774325 - RNA, 14 nt, Human
cuacaucuucugcc

SEQ ID NO: 3774326 - RNA, 10 nt, Human
cuacaugaaa

SEQ ID NO: 3774327 - RNA, 15 nt, Human
cuacaugaaacagaa

SEQ ID NO: 3774328 - RNA, 16 nt, Human
cuacaugaaacagaaa

SEQ ID NO: 3774329 - RNA, 13 nt, Human
cuacaugagaaca

SEQ ID NO: 3774330 - RNA, 14 nt, Human
cuacaugagaacaa

SEQ ID NO: 3774331 - RNA, 14 nt, Human
cuacaugcagccca

SEQ ID NO: 3774332 - RNA, 15 nt, Human
cuacaugcagcccau

SEQ ID NO: 3774333 - RNA, 21 nt, Human
cuacaugcagcccaugcccac

SEQ ID NO: 3774334 - RNA, 15 nt, Human
cuacaugcugggguc

SEQ ID NO: 3774335 - RNA, 18 nt, Human
cuacauguauugcacauu

SEQ ID NO: 3774336 - RNA, 18 nt, Human
cuacauuaaacaugacuc

SEQ ID NO: 3774337 - RNA, 22 nt, Human
cuacauuauaaaugucucuuua

SEQ ID NO: 3774338 - RNA, 14 nt, Human
cuacauuuccgcca

SEQ ID NO: 3774339 - RNA, 14 nt, Human
cuacauuuuaacau

SEQ ID NO: 3774340 - RNA, 12 nt, Human
cuaccaaaaugg

SEQ ID NO: 3774341 - RNA, 16 nt, Human
cuaccaaccuguucaa

SEQ ID NO: 3774342 - RNA, 12 nt, Human
cuaccaacugga

SEQ ID NO: 3774343 - RNA, 13 nt, Human
cuaccaacuuuca

SEQ ID NO: 3774344 - RNA, 14 nt, Human
cuaccaaugcaugc

SEQ ID NO: 3774345 - RNA, 19 nt, Human
cuaccaaugccaagauaau

SEQ ID NO: 3774346 - RNA, 18 nt, Human
cuaccaccagcugugucc

SEQ ID NO: 3774347 - RNA, 19 nt, Human
cuaccaccagcugugucca

SEQ ID NO: 3774348 - RNA, 17 nt, Human
cuaccaccccuuccugu

SEQ ID NO: 3774349 - RNA, 17 nt, Human
cuaccaccuccccagcc

SEQ ID NO: 3774350 - RNA, 21 nt, Human
cuaccacggccuccuuuccgu

SEQ ID NO: 3774351 - RNA, 17 nt, Human
cuaccacuccugccaag

SEQ ID NO: 3774352 - RNA, 18 nt, Human
cuaccagauaacugagga

SEQ ID NO: 3774353 - RNA, 20 nt, Human
cuaccagcgcccgcugggcu

SEQ ID NO: 3774354 - RNA, 21 nt, Human
cuaccagcgcccgcugggcug

SEQ ID NO: 3774355 - RNA, 12 nt, Human
cuaccaggaaag

SEQ ID NO: 3774356 - RNA, 13 nt, Human
cuaccaguauuua

SEQ ID NO: 3774357 - RNA, 20 nt, Human
cuaccaguauuuagaagcca

SEQ ID NO: 3774358 - RNA, 21 nt, Human
cuaccagugcaggcuggccag

SEQ ID NO: 3774359 - RNA, 15 nt, Human
cuaccaucagggaca

SEQ ID NO: 3774360 - RNA, 18 nt, Human
cuaccaucagggacagga

SEQ ID NO: 3774361 - RNA, 18 nt, Human
cuaccauccccuguagag

SEQ ID NO: 3774362 - RNA, 14 nt, Human
cucacagcagugag

SEQ ID NO: 3774363 - RNA, 18 nt, Human
cucacagcagugagacug

SEQ ID NO: 3774364 - RNA, 19 nt, Human
cucacagcagugagacugg

SEQ ID NO: 3774365 - RNA, 11 nt, Human
cucacagccuc

SEQ ID NO: 3774366 - RNA, 15 nt, Human
cucacagccucugac

SEQ ID NO: 3774367 - RNA, 16 nt, Human
cucacagccucugacc

SEQ ID NO: 3774368 - RNA, 15 nt, Human
cucacagcuaugcaa

SEQ ID NO: 3774369 - RNA, 16 nt, Human
cucacaguaacccaaa

SEQ ID NO: 3774370 - RNA, 22 nt, Human
cucacaguccuuaccagcagag

SEQ ID NO: 3774371 - RNA, 23 nt, Human
cucacaguccuuaccagcagagc

SEQ ID NO: 3774372 - RNA, 22 nt, Human
cucacagugaacacucaguggc

SEQ ID NO: 3774373 - RNA, 12 nt, Human
cucacagugacc

SEQ ID NO: 3774374 - RNA, 16 nt, Human
cucacagugacccuuc

SEQ ID NO: 3774375 - RNA, 19 nt, Human
cucacagugacccuuccca

SEQ ID NO: 3774376 - RNA, 18 nt, Human
cucacagugggagccagg

SEQ ID NO: 3774377 - RNA, 22 nt, Human
cucacagugggagccagggcug

SEQ ID NO: 3774378 - RNA, 13 nt, Human
cucacaguuccuc

SEQ ID NO: 3774379 - RNA, 18 nt, Human
cucacaguuccucgcccu

SEQ ID NO: 3774380 - RNA, 19 nt, Human
cucacaguuccucgcccug

SEQ ID NO: 3774381 - RNA, 23 nt, Human
cucacaguuccucgcccuggguc

SEQ ID NO: 3774382 - RNA, 21 nt, Human
cucacaugcuggacaggucug

SEQ ID NO: 3774383 - RNA, 21 nt, Human
cucacauggugcuacgccugc

SEQ ID NO: 3774384 - RNA, 16 nt, Human
cucacauuacacacac

SEQ ID NO: 3774385 - RNA, 14 nt, Human
cucacauuuuuaua

SEQ ID NO: 3774386 - RNA, 16 nt, Human
cucaccagaauuauuu

SEQ ID NO: 3774387 - RNA, 23 nt, Human
cucaccagccccacugccagcag

SEQ ID NO: 3774388 - RNA, 18 nt, Human
cucaccagccccagugcc

SEQ ID NO: 3774389 - RNA, 13 nt, Human
cucaccagcugca

SEQ ID NO: 3774390 - RNA, 15 nt, Human
cucaccagcugcaaa

SEQ ID NO: 3774391 - RNA, 16 nt, Human
cucaccagcugcaaag

SEQ ID NO: 3774392 - RNA, 19 nt, Human
cucaccaggcagccucugg

SEQ ID NO: 3774393 - RNA, 20 nt, Human
cucaccaggcagccucuggg

SEQ ID NO: 3774394 - RNA, 14 nt, Human
cucaccaggggcag

SEQ ID NO: 3774395 - RNA, 20 nt, Human
cucaccaggggcaggcacag

SEQ ID NO: 3774396 - RNA, 21 nt, Human
cucaccaggggcaggcacagc

SEQ ID NO: 3774397 - RNA, 23 nt, Human
cucaccaggggcaggcacagcac

SEQ ID NO: 3774398 - RNA, 24 nt, Human
cucaccaguguccccuccacuguc

SEQ ID NO: 3774399 - RNA, 22 nt, Human
cucacccacuuuggccuccguu

SEQ ID NO: 3774400 - RNA, 13 nt, Human
cucacccagugcc

SEQ ID NO: 3774401 - RNA, 15 nt, Human
cucacccauccuaga

SEQ ID NO: 3774402 - RNA, 16 nt, Human
cucacccaugugccaa

SEQ ID NO: 3774403 - RNA, 13 nt, Human
cucaccccagccc

SEQ ID NO: 3774404 - RNA, 19 nt, Human
cucaccccaucccacaccc

SEQ ID NO: 3774405 - RNA, 21 nt, Human
cucaccccaucccacacccug

SEQ ID NO: 3774406 - RNA, 19 nt, Human
cucacccccagcuuugcua

SEQ ID NO: 3774407 - RNA, 14 nt, Human
cucacccccucacc

SEQ ID NO: 3774408 - RNA, 18 nt, Human
cucacccccucccacccc

SEQ ID NO: 3774409 - RNA, 13 nt, Human
cucacccccucgg

SEQ ID NO: 3774410 - RNA, 17 nt, Human
cucacccccuucuccau

SEQ ID NO: 3774411 - RNA, 18 nt, Human
cucaccccgaggcccugc

SEQ ID NO: 3774412 - RNA, 17 nt, Human
cucaccccugcccuggg

SEQ ID NO: 3774413 - RNA, 18 nt, Human
cucaccccugcccuggga

SEQ ID NO: 3774414 - RNA, 21 nt, Human
cucaccccugguucucaucuu

SEQ ID NO: 3774415 - RNA, 15 nt, Human
cucaccccuguccuc

SEQ ID NO: 3774416 - RNA, 20 nt, Human
cucaccccuguccucacugc

SEQ ID NO: 3774417 - RNA, 15 nt, Human
cucaccgcagucguc

SEQ ID NO: 3774418 - RNA, 17 nt, Human
cucaccuaacucauacu

SEQ ID NO: 3774419 - RNA, 14 nt, Human
cucaccuagagcca

SEQ ID NO: 3774420 - RNA, 18 nt, Human
cucaccuagagccagacc

SEQ ID NO: 3774421 - RNA, 20 nt, Human
cucaccuagagccagaccaa

SEQ ID NO: 3774422 - RNA, 19 nt, Human
cucaccuauccacacaaca

SEQ ID NO: 3774423 - RNA, 14 nt, Human
cucaccucaugccc

SEQ ID NO: 3774424 - RNA, 16 nt, Human
cucaccucccccaucu

SEQ ID NO: 3774425 - RNA, 15 nt, Human
cucaccucuacccaa

SEQ ID NO: 3774426 - RNA, 22 nt, Human
cucaccucuagguccccauacu

SEQ ID NO: 3774427 - RNA, 14 nt, Human
cucaccucucccuu

SEQ ID NO: 3774428 - RNA, 15 nt, Human
cucaccucucccuug

SEQ ID NO: 3774429 - RNA, 14 nt, Human
cucaccucugccuc

SEQ ID NO: 3774430 - RNA, 15 nt, Human
cucaccucugccuca

SEQ ID NO: 3774431 - RNA, 21 nt, Human
cucaccucuggacuggcuaga

SEQ ID NO: 3774432 - RNA, 16 nt, Human
cucaccugccccucaa

SEQ ID NO: 3774433 - RNA, 15 nt, Human
cucaccugcuggccc

SEQ ID NO: 3774434 - RNA, 21 nt, Human
cucaccugcuggccccucacc

SEQ ID NO: 3774435 - RNA, 19 nt, Human
cucaccugggcaccugggg

SEQ ID NO: 3774436 - RNA, 21 nt, Human
cucaccuggggcugcuggccu

SEQ ID NO: 3774437 - RNA, 14 nt, Human
cucaccuguacucu

SEQ ID NO: 3774438 - RNA, 15 nt, Human
cucaccuguugcuua

SEQ ID NO: 3774439 - RNA, 22 nt, Human
cucaccuugugcuggggacagg

SEQ ID NO: 3774440 - RNA, 15 nt, Human
cucacgcaccuccca

SEQ ID NO: 3774441 - RNA, 16 nt, Human
cucacgcaccucccau

SEQ ID NO: 3774442 - RNA, 19 nt, Human
cucacgcaccucccauccu

SEQ ID NO: 3774443 - RNA, 20 nt, Human
cucacgccuaugaucccagc

SEQ ID NO: 3774444 - RNA, 21 nt, Human
cucacgccuguaaucccagca

SEQ ID NO: 3774445 - RNA, 22 nt, Human
cucacgccuguaaucccagcau

SEQ ID NO: 3774446 - RNA, 21 nt, Human
cucacgccuguaauuccagca

SEQ ID NO: 3774447 - RNA, 17 nt, Human
cucacgcuccuuucuga

SEQ ID NO: 3774448 - RNA, 21 nt, Human
cucacgggcaugggcacuccc

SEQ ID NO: 3774449 - RNA, 16 nt, Human
cucacguccagguuca

SEQ ID NO: 3774450 - RNA, 13 nt, Human
cucacguguguga

SEQ ID NO: 3774451 - RNA, 15 nt, Human
cucacuaauucauua

SEQ ID NO: 3774452 - RNA, 17 nt, Human
cucacuaauuuuuguau

SEQ ID NO: 3774453 - RNA, 23 nt, Human
cucacuaauuuuuguauuauuuu

SEQ ID NO: 3774454 - RNA, 20 nt, Human
cucacuacccuauucucucu

SEQ ID NO: 3774455 - RNA, 16 nt, Human
cucacuaccuccucag

SEQ ID NO: 3774456 - RNA, 13 nt, Human
cucacuaggcuuc

SEQ ID NO: 3774457 - RNA, 15 nt, Human
cucacuauggugcca

SEQ ID NO: 3774458 - RNA, 19 nt, Human
cucacuauguugcccaggc

SEQ ID NO: 3774459 - RNA, 18 nt, Human
cucacucaaguucaagga

SEQ ID NO: 3774460 - RNA, 19 nt, Human
cucacucaaguucaaggac

SEQ ID NO: 3774461 - RNA, 16 nt, Human
cucacucacagaguca

SEQ ID NO: 3774462 - RNA, 21 nt, Human
cucacucagaaguccagaguc

SEQ ID NO: 3774463 - RNA, 14 nt, Human
cucacucagcacca

SEQ ID NO: 3774464 - RNA, 12 nt, Human
cucacucagcca

SEQ ID NO: 3774465 - RNA, 18 nt, Human
cucacucagccacccuga

SEQ ID NO: 3774466 - RNA, 21 nt, Human
cucacucagccacccugaguu

SEQ ID NO: 3774467 - RNA, 14 nt, Human
cucacuccaccacc

SEQ ID NO: 3774468 - RNA, 12 nt, Human
cucacuccccag

SEQ ID NO: 3774469 - RNA, 20 nt, Human
cucacuccccagccugggcc

SEQ ID NO: 3774470 - RNA, 20 nt, Human
cucacuccccuccuuuccca

SEQ ID NO: 3774471 - RNA, 19 nt, Human
cucacuccuaccugguaau

SEQ ID NO: 3774472 - RNA, 20 nt, Human
cucacuccugagaccccugg

SEQ ID NO: 3774473 - RNA, 18 nt, Human
cucacuccuuuuaaagaa

SEQ ID NO: 3774474 - RNA, 10 nt, Human
cucacucuca

SEQ ID NO: 3774475 - RNA, 14 nt, Human
cucacucucaggaa

SEQ ID NO: 3774476 - RNA, 11 nt, Human
cucacucugcc

SEQ ID NO: 3774477 - RNA, 13 nt, Human
cucacucugccag

SEQ ID NO: 3774478 - RNA, 19 nt, Human
cucacucugcuaccuugcc

SEQ ID NO: 3774479 - RNA, 22 nt, Human
cucacucugcuaccuugcccca

SEQ ID NO: 3774480 - RNA, 15 nt, Human
cucacucuggccuca

SEQ ID NO: 3774481 - RNA, 13 nt, Human
cucacucugggcu

SEQ ID NO: 3774482 - RNA, 13 nt, Human
cucacucugucgc

SEQ ID NO: 3774483 - RNA, 13 nt, Human
cucacugaaaaca

SEQ ID NO: 3774484 - RNA, 16 nt, Human
cucacugaagccugcg

SEQ ID NO: 3774485 - RNA, 12 nt, Human
cucacugcagcc

SEQ ID NO: 3774486 - RNA, 22 nt, Human
cucacugccaggccagccuccg

SEQ ID NO: 3774487 - RNA, 22 nt, Human
cucacugccaugccagcuuauc

SEQ ID NO: 3774488 - RNA, 19 nt, Human
cucacugcccgcacacccu

SEQ ID NO: 3774489 - RNA, 14 nt, Human
cucacugccucccc

SEQ ID NO: 3774490 - RNA, 23 nt, Human
cucacugcuaagaauauuugaau

SEQ ID NO: 3774491 - RNA, 12 nt, Human
cucacugcucaa

SEQ ID NO: 3774492 - RNA, 20 nt, Human
cucacugcucccugaagcca

SEQ ID NO: 3774493 - RNA, 20 nt, Human
cucacuggcagccccagcac

SEQ ID NO: 3774494 - RNA, 16 nt, Human
cucacuggccaucccu

SEQ ID NO: 3774495 - RNA, 19 nt, Human
cucacuggcucuccuggcc

SEQ ID NO: 3774496 - RNA, 20 nt, Human
cucacugggguccuggggcc

SEQ ID NO: 3774497 - RNA, 12 nt, Human
cucacugugauc

SEQ ID NO: 3774498 - RNA, 22 nt, Human
cucacugugaucaauauuuuua

SEQ ID NO: 3774499 - RNA, 24 nt, Human
cucacugugggaaggccagcugcc

SEQ ID NO: 3774500 - RNA, 12 nt, Human
cucacuguuccc

SEQ ID NO: 3774501 - RNA, 16 nt, Human
cucacuguugcccagg

SEQ ID NO: 3774502 - RNA, 17 nt, Human
cucacuguugcccaggc

SEQ ID NO: 3774503 - RNA, 20 nt, Human
cucacuguugcccaggcugg

SEQ ID NO: 3774504 - RNA, 19 nt, Human
cucacuguuuguuuuuauu

SEQ ID NO: 3774505 - RNA, 18 nt, Human
cucacuuccauacagcuc

SEQ ID NO: 3774506 - RNA, 20 nt, Human
cucacuuggucugccaggcc

SEQ ID NO: 3774507 - RNA, 20 nt, Human
cucacuuuccuccugaggcu

SEQ ID NO: 3774508 - RNA, 21 nt, Human
cucacuuuuaaugaacaaaug

SEQ ID NO: 3774509 - RNA, 12 nt, Human
cucacuuuuccc

SEQ ID NO: 3774510 - RNA, 21 nt, Human
cucacuuuuuuuuuuuguuug

SEQ ID NO: 3774511 - RNA, 23 nt, Human
cucagaaaacaaggaugaauuaa

SEQ ID NO: 3774512 - RNA, 21 nt, Human
cucagaaacacuggggcuggc

SEQ ID NO: 3774513 - RNA, 10 nt, Human
cucagaaagu

SEQ ID NO: 3774514 - RNA, 17 nt, Human
cucagaaagugccugac

SEQ ID NO: 3774515 - RNA, 18 nt, Human
cucagaaagugccugaca

SEQ ID NO: 3774516 - RNA, 17 nt, Human
cucagaaauuuuuauuu

SEQ ID NO: 3774517 - RNA, 14 nt, Human
cucagaacccuugg

SEQ ID NO: 3774518 - RNA, 22 nt, Human
cucagaacugucggaggaaaga

SEQ ID NO: 3774519 - RNA, 20 nt, Human
cucagaacuugcugcugucu

SEQ ID NO: 3774520 - RNA, 22 nt, Human
cucagaagacacugaugggcaa

SEQ ID NO: 3774521 - RNA, 14 nt, Human
cucagaagccugag

SEQ ID NO: 3774522 - RNA, 16 nt, Human
cucagaagccugaggc

SEQ ID NO: 3774523 - RNA, 17 nt, Human
cucagaagccugaggcu

SEQ ID NO: 3774524 - RNA, 16 nt, Human
cucagaagccuggggg

SEQ ID NO: 3774525 - RNA, 12 nt, Human
cucagaaggcuu

SEQ ID NO: 3774526 - RNA, 19 nt, Human
cucagaagguauuccuuuu

SEQ ID NO: 3774527 - RNA, 11 nt, Human
cucagaaguaa

SEQ ID NO: 3774528 - RNA, 12 nt, Human
cucagaaguaaa

SEQ ID NO: 3774529 - RNA, 19 nt, Human
cucagaaguuucuucuuua

SEQ ID NO: 3774530 - RNA, 16 nt, Human
cucagaaucucaaaua

SEQ ID NO: 3774531 - RNA, 17 nt, Human
cucagaauguaaaagaa

SEQ ID NO: 3774532 - RNA, 20 nt, Human
cucagacauguuuuccguga

SEQ ID NO: 3774533 - RNA, 15 nt, Human
cucagaccgucuucc

SEQ ID NO: 3774534 - RNA, 22 nt, Human
cucagaccgucuuccuccaacc

SEQ ID NO: 3774535 - RNA, 17 nt, Human
cucagacucauacagaa

SEQ ID NO: 3774536 - RNA, 16 nt, Human
cucagacugcacccag

SEQ ID NO: 3774537 - RNA, 21 nt, Human
cucagacugcacccaggaggg

SEQ ID NO: 3774538 - RNA, 22 nt, Human
cucagacuuuggaaaaugcauu

SEQ ID NO: 3774539 - RNA, 19 nt, Human
cucagagaaaaaugcuccc

SEQ ID NO: 3774540 - RNA, 20 nt, Human
cucagagaaaaaugcucccc

SEQ ID NO: 3774541 - RNA, 23 nt, Human
cucagagaaaagagauugagaug

SEQ ID NO: 3774542 - RNA, 21 nt, Human
cucagagaccugaagugugca

SEQ ID NO: 3774543 - RNA, 18 nt, Human
cucagagagggugggagu

SEQ ID NO: 3774544 - RNA, 19 nt, Human
cucagagagggugggagug

SEQ ID NO: 3774545 - RNA, 14 nt, Human
cucagagccccgca

SEQ ID NO: 3774546 - RNA, 18 nt, Human
cucagaggacccuuucca

SEQ ID NO: 3774547 - RNA, 19 nt, Human
cucagaggacccuuuccag

SEQ ID NO: 3774548 - RNA, 12 nt, Human
cucagaggcccc

SEQ ID NO: 3774549 - RNA, 22 nt, Human
cucagaggccccaauaccccau

SEQ ID NO: 3774550 - RNA, 23 nt, Human
cucagaggccccaauaccccaug

SEQ ID NO: 3774551 - RNA, 17 nt, Human
cucagaggcgcacugug

SEQ ID NO: 3774552 - RNA, 19 nt, Human
cucagagggggacugcugc

SEQ ID NO: 3774553 - RNA, 18 nt, Human
cucagaguauggagcuca

SEQ ID NO: 3774554 - RNA, 17 nt, Human
cucagagucggaacgga

SEQ ID NO: 3774555 - RNA, 16 nt, Human
cucagagugguggggg

SEQ ID NO: 3774556 - RNA, 16 nt, Human
cucagauauuugcacc

SEQ ID NO: 3774557 - RNA, 18 nt, Human
cucagaucacuacugcag

SEQ ID NO: 3774558 - RNA, 20 nt, Human
cucagaucacuacugcaguc

SEQ ID NO: 3774559 - RNA, 21 nt, Human
cucagaucaguguaccauuug

SEQ ID NO: 3774560 - RNA, 13 nt, Human
cucagauccaggg

SEQ ID NO: 3774561 - RNA, 15 nt, Human
cucagauccagggac

SEQ ID NO: 3774562 - RNA, 16 nt, Human
cucagauccagggaca

SEQ ID NO: 3774563 - RNA, 18 nt, Human
cucagauccagggacaga

SEQ ID NO: 3774564 - RNA, 22 nt, Human
cucagauccagggacagaggcc

SEQ ID NO: 3774565 - RNA, 20 nt, Human
cucagaucccacuuuugcca

SEQ ID NO: 3774566 - RNA, 15 nt, Human
cucagauccuuguuu

SEQ ID NO: 3774567 - RNA, 17 nt, Human
cucagauccuuguuuca

SEQ ID NO: 3774568 - RNA, 18 nt, Human
cucagaucugucugauag

SEQ ID NO: 3774569 - RNA, 13 nt, Human
cucagaugcucaa

SEQ ID NO: 3774570 - RNA, 14 nt, Human
cucagaugcucaaa

SEQ ID NO: 3774571 - RNA, 15 nt, Human
cucagauggcagcuu

SEQ ID NO: 3774572 - RNA, 14 nt, Human
cucagauuccuucc

SEQ ID NO: 3774573 - RNA, 20 nt, Human
cucagauuccuucccaugga

SEQ ID NO: 3774574 - RNA, 15 nt, Human
cucagauuguaauau

SEQ ID NO: 3774575 - RNA, 13 nt, Human
cucagauuuuauu

SEQ ID NO: 3774576 - RNA, 14 nt, Human
cucagauuuuuccu

SEQ ID NO: 3774577 - RNA, 19 nt, Human
cucagcaaaagaugcuucu

SEQ ID NO: 3774578 - RNA, 13 nt, Human
cucagcaagcccu

SEQ ID NO: 3774579 - RNA, 13 nt, Human
cucagcaaggcca

SEQ ID NO: 3774580 - RNA, 22 nt, Human
cucagcaaggccaccucuuccu

SEQ ID NO: 3774581 - RNA, 20 nt, Human
cucagcacccccuucucugc

SEQ ID NO: 3774582 - RNA, 13 nt, Human
cucagcaccccuu

SEQ ID NO: 3774583 - RNA, 20 nt, Human
cucagcaccccuuccaugug

SEQ ID NO: 3774584 - RNA, 13 nt, Human
cucagcacugccu

SEQ ID NO: 3774585 - RNA, 21 nt, Human
cucagcacugccugcucccau

SEQ ID NO: 3774586 - RNA, 14 nt, Human
cucagcacuuggcc

SEQ ID NO: 3774587 - RNA, 11 nt, Human
cucagcagagu

SEQ ID NO: 3774588 - RNA, 12 nt, Human
cucagcagagug

SEQ ID NO: 3774589 - RNA, 13 nt, Human
cucagcagagugc

SEQ ID NO: 3774590 - RNA, 16 nt, Human
cucagcagagugcuuu

SEQ ID NO: 3774591 - RNA, 12 nt, Human
cucagcagcccu

SEQ ID NO: 3774592 - RNA, 15 nt, Human
cucagcagcccuccu

SEQ ID NO: 3774593 - RNA, 16 nt, Human
cucagcagcccuccuc

SEQ ID NO: 3774594 - RNA, 19 nt, Human
cucagcagcccuccucacc

SEQ ID NO: 3774595 - RNA, 21 nt, Human
cucagcagcccuccucacccc

SEQ ID NO: 3774596 - RNA, 23 nt, Human
cucagcagccgccuuaagcugau

SEQ ID NO: 3774597 - RNA, 20 nt, Human
cucagcagcgaccaccccug

SEQ ID NO: 3774598 - RNA, 23 nt, Human
cucagcagcgaccaccccugccu

SEQ ID NO: 3774599 - RNA, 14 nt, Human
cucagcauauuugu

SEQ ID NO: 3774600 - RNA, 15 nt, Human
cucagcauuucuuuu

SEQ ID NO: 3774601 - RNA, 14 nt, Human
cucagccaagcaca

SEQ ID NO: 3774602 - RNA, 16 nt, Human
cucagccaagcacagu

SEQ ID NO: 3774603 - RNA, 17 nt, Human
cucagccacacccaggc

SEQ ID NO: 3774604 - RNA, 19 nt, Human
cucagccacacccaggcac

SEQ ID NO: 3774605 - RNA, 12 nt, Human
cucagccagccu

SEQ ID NO: 3774606 - RNA, 13 nt, Human
cucagccagccuc

SEQ ID NO: 3774607 - RNA, 19 nt, Human
cucagcccacauagugaug

SEQ ID NO: 3774608 - RNA, 21 nt, Human
cucagcccacauagugauggu

SEQ ID NO: 3774609 - RNA, 19 nt, Human
cucagcccaccccccucau

SEQ ID NO: 3774610 - RNA, 13 nt, Human
cucagcccagaag

SEQ ID NO: 3774611 - RNA, 20 nt, Human
cucagcccagaagaaaauuc

SEQ ID NO: 3774612 - RNA, 22 nt, Human
cucagccccaccccagggcagc

SEQ ID NO: 3774613 - RNA, 11 nt, Human
cucagccccuc

SEQ ID NO: 3774614 - RNA, 16 nt, Human
cucagccccucuugcc

SEQ ID NO: 3774615 - RNA, 16 nt, Human
cucagccccuuucccu

SEQ ID NO: 3774616 - RNA, 11 nt, Human
cucagcccuga

SEQ ID NO: 3774617 - RNA, 13 nt, Human
cucagcccugacc

SEQ ID NO: 3774618 - RNA, 15 nt, Human
cucagcccugacccu

SEQ ID NO: 3774619 - RNA, 17 nt, Human
cucagcccugacccugu

SEQ ID NO: 3774620 - RNA, 12 nt, Human
cucagcccugga

SEQ ID NO: 3774621 - RNA, 18 nt, Human
cucagcccuggaggugcc

SEQ ID NO: 3774622 - RNA, 20 nt, Human
cucagcccuggaggugccag

SEQ ID NO: 3774623 - RNA, 13 nt, Human
cucagcccugggc

SEQ ID NO: 3774624 - RNA, 11 nt, Human
cucagcccugu

SEQ ID NO: 3774625 - RNA, 20 nt, Human
cucagccucaauaagccuug

SEQ ID NO: 3774626 - RNA, 13 nt, Human
cucagccucccaa

SEQ ID NO: 3774627 - RNA, 15 nt, Human
cucagccucccaaag

SEQ ID NO: 3774628 - RNA, 21 nt, Human
cucagccucccaaagugcugg

SEQ ID NO: 3774629 - RNA, 22 nt, Human
cucagccucccaaagugcuggg

SEQ ID NO: 3774630 - RNA, 18 nt, Human
cucagccucccaaguaac

SEQ ID NO: 3774631 - RNA, 12 nt, Human
cucagccucccg

SEQ ID NO: 3774632 - RNA, 13 nt, Human
cucagccucccga

SEQ ID NO: 3774633 - RNA, 14 nt, Human
cucagccucccgag

SEQ ID NO: 3774634 - RNA, 12 nt, Human
cucagccuccug

SEQ ID NO: 3774635 - RNA, 15 nt, Human
cucagccucuccccu

SEQ ID NO: 3774636 - RNA, 16 nt, Human
cucagccucucgaagu

SEQ ID NO: 3774637 - RNA, 13 nt, Human
cucagccugcaca

SEQ ID NO: 3774638 - RNA, 17 nt, Human
cucagccugcugcccag

SEQ ID NO: 3774639 - RNA, 13 nt, Human
cucagccuggcca

SEQ ID NO: 3774640 - RNA, 16 nt, Human
cucagccuggccagac

SEQ ID NO: 3774641 - RNA, 17 nt, Human
cucagccuggccagaca

SEQ ID NO: 3774642 - RNA, 11 nt, Human
cucagccuggg

SEQ ID NO: 3774643 - RNA, 14 nt, Human
cucagccugggaca

SEQ ID NO: 3774644 - RNA, 18 nt, Human
cucagccugugcugcccg

SEQ ID NO: 3774645 - RNA, 17 nt, Human
cucagccuugccagaga

SEQ ID NO: 3774646 - RNA, 14 nt, Human
cucagcgcggcccu

SEQ ID NO: 3774647 - RNA, 16 nt, Human
cucagcgcggcccucc

SEQ ID NO: 3774648 - RNA, 13 nt, Human
cucagcggggaca

SEQ ID NO: 3774649 - RNA, 18 nt, Human
cucagcggggacagcucc

SEQ ID NO: 3774650 - RNA, 19 nt, Human
cucagcggggacagcuccu

SEQ ID NO: 3774651 - RNA, 23 nt, Human
cucagcggggacagcuccuucug

SEQ ID NO: 3774652 - RNA, 20 nt, Human
cucagcucacugcaaccucc

SEQ ID NO: 3774653 - RNA, 16 nt, Human
cucagcucagcgccag

SEQ ID NO: 3774654 - RNA, 17 nt, Human
cucagcucagcgccagc

SEQ ID NO: 3774655 - RNA, 19 nt, Human
cucagcucccaaggcucug

SEQ ID NO: 3774656 - RNA, 18 nt, Human
cucagcucccauuucuac

SEQ ID NO: 3774657 - RNA, 12 nt, Human
cucagcucccca

SEQ ID NO: 3774658 - RNA, 14 nt, Human
cucagcucccccug

SEQ ID NO: 3774659 - RNA, 16 nt, Human
cucagcucccccuguc

SEQ ID NO: 3774660 - RNA, 16 nt, Human
cucagcucggcucagc

SEQ ID NO: 3774661 - RNA, 20 nt, Human
cucagcucucaguugcagcc

SEQ ID NO: 3774662 - RNA, 12 nt, Human
cucagcucuggc

SEQ ID NO: 3774663 - RNA, 13 nt, Human
cucagcucuggcu

SEQ ID NO: 3774664 - RNA, 12 nt, Human
cucagcucuggg

SEQ ID NO: 3774665 - RNA, 11 nt, Human
cucagcugcau

SEQ ID NO: 3774666 - RNA, 16 nt, Human
cucagcugccucacuu

SEQ ID NO: 3774667 - RNA, 15 nt, Human
cucagcugcuucucc

SEQ ID NO: 3774668 - RNA, 16 nt, Human
cucagcugcuucuccc

SEQ ID NO: 3774669 - RNA, 18 nt, Human
cucagcugucaaggcuca

SEQ ID NO: 3774670 - RNA, 16 nt, Human
cucagcuguccugcag

SEQ ID NO: 3774671 - RNA, 20 nt, Human
cucagcuuaucucuuuuaua

SEQ ID NO: 3774672 - RNA, 16 nt, Human
cucagcuuccuaccca

SEQ ID NO: 3774673 - RNA, 16 nt, Human
cucagcuucuccugug

SEQ ID NO: 3774674 - RNA, 21 nt, Human
cucagcuuugagaagccuuca

SEQ ID NO: 3774675 - RNA, 20 nt, Human
cucaggaaagaauagaaaga

SEQ ID NO: 3774676 - RNA, 19 nt, Human
cucaggaaaugcugaccca

SEQ ID NO: 3774677 - RNA, 15 nt, Human
cucaggaacuagacu

SEQ ID NO: 3774678 - RNA, 13 nt, Human
cucaggaagaaca

SEQ ID NO: 3774679 - RNA, 15 nt, Human
cucaggaagccccca

SEQ ID NO: 3774680 - RNA, 14 nt, Human
cucaggacacaggc

SEQ ID NO: 3774681 - RNA, 18 nt, Human
cucaggacacaggccugu

SEQ ID NO: 3774682 - RNA, 12 nt, Human
cucaggacagau

SEQ ID NO: 3774683 - RNA, 13 nt, Human
cucaggacccucg

SEQ ID NO: 3774684 - RNA, 15 nt, Human
cucaggacccucgcu

SEQ ID NO: 3774685 - RNA, 22 nt, Human
cucaggaccugggaccuccccu

SEQ ID NO: 3774686 - RNA, 14 nt, Human
cucaggacucagaa

SEQ ID NO: 3774687 - RNA, 14 nt, Human
cucaggacuccagc

SEQ ID NO: 3774688 - RNA, 15 nt, Human
cucaggacuccucuc

SEQ ID NO: 3774689 - RNA, 16 nt, Human
cucaggacuccucucc

SEQ ID NO: 3774690 - RNA, 15 nt, Human
cucaggacugggagc

SEQ ID NO: 3774691 - RNA, 23 nt, Human
cucaggagccgaagcccaggggc

SEQ ID NO: 3774692 - RNA, 16 nt, Human
cucaggagccucugcu

SEQ ID NO: 3774693 - RNA, 16 nt, Human
cucaggagccugugac

SEQ ID NO: 3774694 - RNA, 14 nt, Human
cucaggaggcugag

SEQ ID NO: 3774695 - RNA, 18 nt, Human
cucaggaggcugaggcag

SEQ ID NO: 3774696 - RNA, 23 nt, Human
cucaggaggcugaggcaggagga

SEQ ID NO: 3774697 - RNA, 16 nt, Human
cucaggaggcugaggg

SEQ ID NO: 3774698 - RNA, 21 nt, Human
cucaggaugagggaaaagaaa

SEQ ID NO: 3774699 - RNA, 20 nt, Human
cucaggauuuaaaaacugga

SEQ ID NO: 3774700 - RNA, 21 nt, Human
cucaggcaaggucuggccuca

SEQ ID NO: 3774701 - RNA, 13 nt, Human
cucaggcacacag

SEQ ID NO: 3774702 - RNA, 16 nt, Human
cucaggcacacagcua

SEQ ID NO: 3774703 - RNA, 19 nt, Human
cucaggcacuagccuuugg

SEQ ID NO: 3774704 - RNA, 14 nt, Human
cucaggcagcucaa

SEQ ID NO: 3774705 - RNA, 17 nt, Human
cucaggcaucauuccac

SEQ ID NO: 3774706 - RNA, 22 nt, Human
cucaggcauggaugaauaaaug

SEQ ID NO: 3774707 - RNA, 20 nt, Human
cucaggccaaacucaccugc

SEQ ID NO: 3774708 - RNA, 21 nt, Human
cucaggccaaacucaccugcc

SEQ ID NO: 3774709 - RNA, 13 nt, Human
cucaggccaccug

SEQ ID NO: 3774710 - RNA, 19 nt, Human
cucaggccaccugcccccu

SEQ ID NO: 3774711 - RNA, 22 nt, Human
cucaggccagcugcuugggcuu

SEQ ID NO: 3774712 - RNA, 23 nt, Human
cucaggccggcagccccagccug

SEQ ID NO: 3774713 - RNA, 24 nt, Human
cucaggccggcagccccagccugc

SEQ ID NO: 3774714 - RNA, 14 nt, Human
cucaggcucugccc

SEQ ID NO: 3774715 - RNA, 16 nt, Human
cucaggcucugcccug

SEQ ID NO: 3774716 - RNA, 19 nt, Human
cucaggcucugcccugccc

SEQ ID NO: 3774717 - RNA, 22 nt, Human
cucaggcucugcccugcccuag

SEQ ID NO: 3774718 - RNA, 15 nt, Human
cucaggcugccugag

SEQ ID NO: 3774719 - RNA, 21 nt, Human
cucaggcugccugagucguga

SEQ ID NO: 3774720 - RNA, 13 nt, Human
cucaggcugcugg

SEQ ID NO: 3774721 - RNA, 15 nt, Human
cucaggcugcuggag

SEQ ID NO: 3774722 - RNA, 16 nt, Human
cucaggcugcuggagg

SEQ ID NO: 3774723 - RNA, 17 nt, Human
cucaggcuggugggagg

SEQ ID NO: 3774724 - RNA, 15 nt, Human
cucaggcuugaaaug

SEQ ID NO: 3774725 - RNA, 20 nt, Human
cucagggaaaagcagcucuc

SEQ ID NO: 3774726 - RNA, 23 nt, Human
cucagggaaaagcagcucucccc

SEQ ID NO: 3774727 - RNA, 13 nt, Human
cucagggaaagca

SEQ ID NO: 3774728 - RNA, 14 nt, Human
cucagggaagccca

SEQ ID NO: 3774729 - RNA, 15 nt, Human
cucagggaagcccag

SEQ ID NO: 3774730 - RNA, 23 nt, Human
cucagggaagcccagcuccaggg

SEQ ID NO: 3774731 - RNA, 19 nt, Human
cucagggacagagacaccu

SEQ ID NO: 3774732 - RNA, 21 nt, Human
cucagggacagagacaccugc

SEQ ID NO: 3774733 - RNA, 16 nt, Human
cucagggacagagcca

SEQ ID NO: 3774734 - RNA, 21 nt, Human
cucagggacucaucuuucccu

SEQ ID NO: 3774735 - RNA, 19 nt, Human
cucagggagcagggaaggc

SEQ ID NO: 3774736 - RNA, 15 nt, Human
cucagggcagccugc

SEQ ID NO: 3774737 - RNA, 20 nt, Human
cucagggcagcgccaggcug

SEQ ID NO: 3774738 - RNA, 16 nt, Human
cucagggccaggccuc

SEQ ID NO: 3774739 - RNA, 21 nt, Human
cucagggccaggccucucccu

SEQ ID NO: 3774740 - RNA, 13 nt, Human
cucagggccaugc

SEQ ID NO: 3774741 - RNA, 17 nt, Human
cucagggccaugcugag

SEQ ID NO: 3774742 - RNA, 18 nt, Human
cucagggccaugcugagg

SEQ ID NO: 3774743 - RNA, 20 nt, Human
cucagggccaugcugaggcc

SEQ ID NO: 3774744 - RNA, 16 nt, Human
cucagggccccagcac

SEQ ID NO: 3774745 - RNA, 16 nt, Human
cucagggccuggcuca

SEQ ID NO: 3774746 - RNA, 18 nt, Human
cucagggccuggcucagg

SEQ ID NO: 3774747 - RNA, 20 nt, Human
cucagggccuggcucaggug

SEQ ID NO: 3774748 - RNA, 15 nt, Human
cucagggccuggucg

SEQ ID NO: 3774749 - RNA, 13 nt, Human
cucagggcuccca

SEQ ID NO: 3774750 - RNA, 15 nt, Human
cucagggcuccuccc

SEQ ID NO: 3774751 - RNA, 18 nt, Human
cucagggcuccucccagc

SEQ ID NO: 3774752 - RNA, 22 nt, Human
cucagggcuccugccuucuguc

SEQ ID NO: 3774753 - RNA, 15 nt, Human
cucagggcuccuugu

SEQ ID NO: 3774754 - RNA, 16 nt, Human
cucagggcugacacgu

SEQ ID NO: 3774755 - RNA, 18 nt, Human
cucaggggaaaacuguua

SEQ ID NO: 3774756 - RNA, 21 nt, Human
cucaggggcccuggagcagcc

SEQ ID NO: 3774757 - RNA, 21 nt, Human
cucaggggucugagcuccagc

SEQ ID NO: 3774758 - RNA, 17 nt, Human
cucaggguauugcuugc

SEQ ID NO: 3774759 - RNA, 21 nt, Human
cucagggucccugguggcagc

SEQ ID NO: 3774760 - RNA, 18 nt, Human
cucagggucucugcugcc

SEQ ID NO: 3774761 - RNA, 16 nt, Human
cucagggugcagaggu

SEQ ID NO: 3774762 - RNA, 24 nt, Human
cucagguaaucgaccugccucggc

SEQ ID NO: 3774763 - RNA, 20 nt, Human
cucagguacuucucucuccu

SEQ ID NO: 3774764 - RNA, 15 nt, Human
cucagguacuuguaa

SEQ ID NO: 3774765 - RNA, 19 nt, Human
cucaggucacauaaaacuu

SEQ ID NO: 3774766 - RNA, 17 nt, Human
cucaggucccugcaggg

SEQ ID NO: 3774767 - RNA, 18 nt, Human
cucaggucccugcagggc

SEQ ID NO: 3774768 - RNA, 13 nt, Human
cucaggucugagu

SEQ ID NO: 3774769 - RNA, 15 nt, Human
cucaggugcuggggc

SEQ ID NO: 3774770 - RNA, 22 nt, Human
cucaggugcuggggccugguuc

SEQ ID NO: 3774771 - RNA, 14 nt, Human
cucaggugcugucc

SEQ ID NO: 3774772 - RNA, 12 nt, Human
cucagguggcca

SEQ ID NO: 3774773 - RNA, 22 nt, Human
cucagguggccagccuggaucu

SEQ ID NO: 3774774 - RNA, 13 nt, Human
cucagguggccau

SEQ ID NO: 3774775 - RNA, 15 nt, Human
cucagguggccaugc

SEQ ID NO: 3774776 - RNA, 17 nt, Human
cucaggugucccugcac

SEQ ID NO: 3774777 - RNA, 20 nt, Human
cucagguuccuauggcuggc

SEQ ID NO: 3774778 - RNA, 14 nt, Human
cucagguugucuga

SEQ ID NO: 3774779 - RNA, 18 nt, Human
cucaguaauuuagaaauc

SEQ ID NO: 3774780 - RNA, 19 nt, Human
cucaguaauuuagaaauca

SEQ ID NO: 3774781 - RNA, 22 nt, Human
cucaguaauuuagaaaucauuu

SEQ ID NO: 3774782 - RNA, 13 nt, Human
cucaguaccccau

SEQ ID NO: 3774783 - RNA, 18 nt, Human
cucaguacuuuggaggcc

SEQ ID NO: 3774784 - RNA, 19 nt, Human
cucaguacuuuggaggccc

SEQ ID NO: 3774785 - RNA, 21 nt, Human
cucaguacuuuggaggccccu

SEQ ID NO: 3774786 - RNA, 23 nt, Human
cucaguacuuuggaggccccuau

SEQ ID NO: 3774787 - RNA, 16 nt, Human
cucaguagucccugca

SEQ ID NO: 3774788 - RNA, 15 nt, Human
cucagucaugcauaa

SEQ ID NO: 3774789 - RNA, 18 nt, Human
cucagucaugcauaaaua

SEQ ID NO: 3774790 - RNA, 18 nt, Human
cucagucauuagacuccu

SEQ ID NO: 3774791 - RNA, 16 nt, Human
cucaguccaccugagc

SEQ ID NO: 3774792 - RNA, 18 nt, Human
cucaguccaccugagcug

SEQ ID NO: 3774793 - RNA, 15 nt, Human
cucaguccauagcag

SEQ ID NO: 3774794 - RNA, 12 nt, Human
cucagucccaaa

SEQ ID NO: 3774795 - RNA, 21 nt, Human
cucagucccaaauccuuccca

SEQ ID NO: 3774796 - RNA, 14 nt, Human
cucaguccuccccu

SEQ ID NO: 3774797 - RNA, 19 nt, Human
cucaguccuccccucacag

SEQ ID NO: 3774798 - RNA, 13 nt, Human
cucagucucagga

SEQ ID NO: 3774799 - RNA, 17 nt, Human
cucagucucucuucucu

SEQ ID NO: 3774800 - RNA, 19 nt, Human
cucagucucucuucucucc

SEQ ID NO: 3774801 - RNA, 13 nt, Human
cucagucuucccu

SEQ ID NO: 3774802 - RNA, 22 nt, Human
cucagucuucccuagggcuggg

SEQ ID NO: 3774803 - RNA, 23 nt, Human
cucagucuucccuagggcugggu

SEQ ID NO: 3774804 - RNA, 19 nt, Human
cucagugaaguugcugcuu

SEQ ID NO: 3774805 - RNA, 19 nt, Human
cucagugacccuggcuccu

SEQ ID NO: 3774806 - RNA, 20 nt, Human
cucagugacccuggcuccuu

SEQ ID NO: 3774807 - RNA, 17 nt, Human
cucagugcaaccucugc

SEQ ID NO: 3774808 - RNA, 22 nt, Human
cucagugcaaccucugcuuccc

SEQ ID NO: 3774809 - RNA, 12 nt, Human
cucagugcagau

SEQ ID NO: 3774810 - RNA, 15 nt, Human
cucagugcagaugga

SEQ ID NO: 3774811 - RNA, 14 nt, Human
cucagugcagcaau

SEQ ID NO: 3774812 - RNA, 22 nt, Human
cucagugccaacuguggcuggu

SEQ ID NO: 3774813 - RNA, 13 nt, Human
cucagugccacua

SEQ ID NO: 3774814 - RNA, 15 nt, Human
cucagugcccuccag

SEQ ID NO: 3774815 - RNA, 16 nt, Human
cucaguggacuuucca

SEQ ID NO: 3774816 - RNA, 14 nt, Human
cucagugucauuua

SEQ ID NO: 3774817 - RNA, 17 nt, Human
cucagugucauuuauga

SEQ ID NO: 3774818 - RNA, 23 nt, Human
cucaguuacacaaaggaccucag

SEQ ID NO: 3774819 - RNA, 21 nt, Human
cucaguucagaaucacuucug

SEQ ID NO: 3774820 - RNA, 14 nt, Human
cucaguucccuugg

SEQ ID NO: 3774821 - RNA, 17 nt, Human
cucaguucccuuggccu

SEQ ID NO: 3774822 - RNA, 18 nt, Human
cucaguucccuuggccuc

SEQ ID NO: 3774823 - RNA, 20 nt, Human
cucaguucccuuggccucag

SEQ ID NO: 3774824 - RNA, 14 nt, Human
cucaguuggaaaua

SEQ ID NO: 3774825 - RNA, 11 nt, Human
cucaguuguag

SEQ ID NO: 3774826 - RNA, 21 nt, Human
cucaguuguagaauguauugu

SEQ ID NO: 3774827 - RNA, 20 nt, Human
cucaguugugacuaacuaga

SEQ ID NO: 3774828 - RNA, 21 nt, Human
cucaguugugcagcuuuuggu

SEQ ID NO: 3774829 - RNA, 15 nt, Human
cucaguuuaauccuu

SEQ ID NO: 3774830 - RNA, 21 nt, Human
cucaguuuaauccuucuaguu

SEQ ID NO: 3774831 - RNA, 18 nt, Human
cucaguuuuaucauuuuc

SEQ ID NO: 3774832 - RNA, 17 nt, Human
cucauaacggaucagaa

SEQ ID NO: 3774833 - RNA, 19 nt, Human
cucauaacggaucagaaau

SEQ ID NO: 3774834 - RNA, 14 nt, Human
cucauaacuugaga

SEQ ID NO: 3774835 - RNA, 17 nt, Human
cucauaacuugagaccu

SEQ ID NO: 3774836 - RNA, 18 nt, Human
cucauaauagacuuccca

SEQ ID NO: 3774837 - RNA, 13 nt, Human
cucauaaugugaa

SEQ ID NO: 3774838 - RNA, 13 nt, Human
cucauaauuuaua

SEQ ID NO: 3774839 - RNA, 15 nt, Human
cucauaauuuauaca

SEQ ID NO: 3774840 - RNA, 15 nt, Human
cucauacccaccccc

SEQ ID NO: 3774841 - RNA, 18 nt, Human
cucauacccacccccacc

SEQ ID NO: 3774842 - RNA, 16 nt, Human
cucauacccucccucc

SEQ ID NO: 3774843 - RNA, 21 nt, Human
cucauacuacauugaguagac

SEQ ID NO: 3774844 - RNA, 14 nt, Human
cucauagacacuga

SEQ ID NO: 3774845 - RNA, 16 nt, Human
cucauagcauuaacua

SEQ ID NO: 3774846 - RNA, 18 nt, Human
cucauagcauuaacuaau

SEQ ID NO: 3774847 - RNA, 20 nt, Human
cucauagccccggugugcgg

SEQ ID NO: 3774848 - RNA, 17 nt, Human
cucauagcccucacccu

SEQ ID NO: 3774849 - RNA, 20 nt, Human
cucauagcccucacccuggg

SEQ ID NO: 3774850 - RNA, 21 nt, Human
cucauagcccucacccugggg

SEQ ID NO: 3774851 - RNA, 15 nt, Human
cucauagguuaaaaa

SEQ ID NO: 3774852 - RNA, 22 nt, Human
cucauagguuaaaaaaaaaagu

SEQ ID NO: 3774853 - RNA, 19 nt, Human
cucauagguugagcaauuu

SEQ ID NO: 3774854 - RNA, 18 nt, Human
cucauaguaugguggcug

SEQ ID NO: 3774855 - RNA, 17 nt, Human
cucauauaauuauaugu

SEQ ID NO: 3774856 - RNA, 21 nt, Human
cucauaucaacuuagucaaua

SEQ ID NO: 3774857 - RNA, 13 nt, Human
cucauauggccca

SEQ ID NO: 3774858 - RNA, 22 nt, Human
cucauauuccugcagccuggag

SEQ ID NO: 3774859 - RNA, 24 nt, Human
cucauauuccugcagccuggaggc

SEQ ID NO: 3774860 - RNA, 15 nt, Human
cucauauuuaaagac

SEQ ID NO: 3774861 - RNA, 12 nt, Human
cucauauuuccc

SEQ ID NO: 3774862 - RNA, 21 nt, Human
cucauauuuuguauauaucug

SEQ ID NO: 3774863 - RNA, 16 nt, Human
cucaucaacugaauga

SEQ ID NO: 3774864 - RNA, 18 nt, Human
cucaucaauggggccagu

SEQ ID NO: 3774865 - RNA, 14 nt, Human
cucaucacacacau

SEQ ID NO: 3774866 - RNA, 15 nt, Human
cucaucacuggauga

SEQ ID NO: 3774867 - RNA, 16 nt, Human
cucaucacuguggcug

SEQ ID NO: 3774868 - RNA, 20 nt, Human
cucaucagaaacaauuucug

SEQ ID NO: 3774869 - RNA, 13 nt, Human
cucaucaggauga

SEQ ID NO: 3774870 - RNA, 22 nt, Human
cucaucaggaugaacccaggac

SEQ ID NO: 3774871 - RNA, 14 nt, Human
cucaucauucucug

SEQ ID NO: 3774872 - RNA, 19 nt, Human
cucaucauucucugucuca

SEQ ID NO: 3774873 - RNA, 22 nt, Human
cucaucauucucugucucaucc

SEQ ID NO: 3774874 - RNA, 20 nt, Human
cucauccaaacaauuuaaaa

SEQ ID NO: 3774875 - RNA, 16 nt, Human
cucauccagggcucug

SEQ ID NO: 3774876 - RNA, 19 nt, Human
cucaucccacgcacuccau

SEQ ID NO: 3774877 - RNA, 21 nt, Human
cucaucccaugagacccuggu

SEQ ID NO: 3774878 - RNA, 14 nt, Human
cucauccccagggg

SEQ ID NO: 3774879 - RNA, 16 nt, Human
cucaucccguguucuc

SEQ ID NO: 3774880 - RNA, 13 nt, Human
cucauccuccagu

SEQ ID NO: 3774881 - RNA, 22 nt, Human
cucauccuccaguaccuugcuu

SEQ ID NO: 3774882 - RNA, 13 nt, Human
cucauccuccugg

SEQ ID NO: 3774883 - RNA, 16 nt, Human
cucauccuccuucuuc

SEQ ID NO: 3774884 - RNA, 14 nt, Human
cucauccugaacag

SEQ ID NO: 3774885 - RNA, 16 nt, Human
cucauccuuguauaaa

SEQ ID NO: 3774886 - RNA, 18 nt, Human
cucaucuaucucaauccu

SEQ ID NO: 3774887 - RNA, 19 nt, Human
cucaucuaugaggaaaggu

SEQ ID NO: 3774888 - RNA, 17 nt, Human
cucaucuccccaucauu

SEQ ID NO: 3774889 - RNA, 22 nt, Human
cucaucucuaacagcucaggau

SEQ ID NO: 3774890 - RNA, 23 nt, Human
cucaucucuaacagcucaggauc

SEQ ID NO: 3774891 - RNA, 20 nt, Human
cucaucucuuagcuccccuc

SEQ ID NO: 3774892 - RNA, 22 nt, Human
cucaucucuuagcuccccucca

SEQ ID NO: 3774893 - RNA, 15 nt, Human
cucaucucuucuuuu

SEQ ID NO: 3774894 - RNA, 13 nt, Human
cucaucugcaaaa

SEQ ID NO: 3774895 - RNA, 14 nt, Human
cucaucugcacccu

SEQ ID NO: 3774896 - RNA, 18 nt, Human
cucaucugcacccuucuu

SEQ ID NO: 3774897 - RNA, 12 nt, Human
cucaucugcuca

SEQ ID NO: 3774898 - RNA, 17 nt, Human
cucaucugcucagcagc

SEQ ID NO: 3774899 - RNA, 13 nt, Human
cucaucugcuggu

SEQ ID NO: 3774900 - RNA, 14 nt, Human
cucaucugcugguc

SEQ ID NO: 3774901 - RNA, 15 nt, Human
cucaucugcuggucc

SEQ ID NO: 3774902 - RNA, 12 nt, Human
cucaucugugau

SEQ ID NO: 3774903 - RNA, 17 nt, Human
cucaucuucuucaccau

SEQ ID NO: 3774904 - RNA, 13 nt, Human
cucaucuugugaa

SEQ ID NO: 3774905 - RNA, 15 nt, Human
cucaucuuucccucc

SEQ ID NO: 3774906 - RNA, 18 nt, Human
cucaucuuucccuccuug

SEQ ID NO: 3774907 - RNA, 21 nt, Human
cucaugaaccucaagcugcau

SEQ ID NO: 3774908 - RNA, 16 nt, Human
cucaugaauguaaauu

SEQ ID NO: 3774909 - RNA, 21 nt, Human
cucaugaauguaaauuuguac

SEQ ID NO: 3774910 - RNA, 19 nt, Human
cucaugaggggagaggaga

SEQ ID NO: 3774911 - RNA, 22 nt, Human
cucaugaggggcccgagcagaa

SEQ ID NO: 3774912 - RNA, 23 nt, Human
cucaugauagaaggcuaugggga

SEQ ID NO: 3774913 - RNA, 15 nt, Human
cucaugcagccguga

SEQ ID NO: 3774914 - RNA, 20 nt, Human
cucaugcauagucccagcua

SEQ ID NO: 3774915 - RNA, 14 nt, Human
cucaugcaucucca

SEQ ID NO: 3774916 - RNA, 22 nt, Human
cucaugcaucuccaccugcucc

SEQ ID NO: 3774917 - RNA, 16 nt, Human
cucaugcauuguccuc

SEQ ID NO: 3774918 - RNA, 21 nt, Human
cucaugcccacccccugcccu

SEQ ID NO: 3774919 - RNA, 22 nt, Human
cucaugcccacccccugcccug

SEQ ID NO: 3774920 - RNA, 17 nt, Human
cucaugcccccuuucag

SEQ ID NO: 3774921 - RNA, 16 nt, Human
cucaugccccuggcug

SEQ ID NO: 3774922 - RNA, 17 nt, Human
cucaugccccuggcugg

SEQ ID NO: 3774923 - RNA, 22 nt, Human
cucaugcugccaauauccuaau

SEQ ID NO: 3774924 - RNA, 15 nt, Human
cucauggccccucug

SEQ ID NO: 3774925 - RNA, 15 nt, Human
cucaugggccccucu

SEQ ID NO: 3774926 - RNA, 14 nt, Human
cucauggguggcac

SEQ ID NO: 3774927 - RNA, 17 nt, Human
cucaugguccccauggc

SEQ ID NO: 3774928 - RNA, 16 nt, Human
cucauguaucaucugg

SEQ ID NO: 3774929 - RNA, 18 nt, Human
cucaugugacucuuucca

SEQ ID NO: 3774930 - RNA, 23 nt, Human
cucauguuaaauaggcggggcuu

SEQ ID NO: 3774931 - RNA, 14 nt, Human
cucauguucuuaau

SEQ ID NO: 3774932 - RNA, 17 nt, Human
cucauguugaaacuuua

SEQ ID NO: 3774933 - RNA, 23 nt, Human
cucauguugaagccacugccuuc

SEQ ID NO: 3774934 - RNA, 13 nt, Human
cucauguuuauga

SEQ ID NO: 3774935 - RNA, 17 nt, Human
cucauuaaaagaauauc

SEQ ID NO: 3774936 - RNA, 15 nt, Human
cucauuaaacuuuuu

SEQ ID NO: 3774937 - RNA, 16 nt, Human
cucauuacggcuccuc

SEQ ID NO: 3774938 - RNA, 18 nt, Human
cucauuacugggccuuag

SEQ ID NO: 3774939 - RNA, 19 nt, Human
cucauuagaauuaccauuu

SEQ ID NO: 3774940 - RNA, 12 nt, Human
cucauuagacug

SEQ ID NO: 3774941 - RNA, 21 nt, Human
cucauuagcauuuugcuaaau

SEQ ID NO: 3774942 - RNA, 23 nt, Human
cucauuaggcaugguuuugggcu

SEQ ID NO: 3774943 - RNA, 23 nt, Human
cuccacucagcuguccugcagca

SEQ ID NO: 3774944 - RNA, 16 nt, Human
cuccacucaugugacu

SEQ ID NO: 3774945 - RNA, 22 nt, Human
cuccacucaugugacucuuucc

SEQ ID NO: 3774946 - RNA, 14 nt, Human
cuccacucccacuu

SEQ ID NO: 3774947 - RNA, 14 nt, Human
cuccacuccuuccu

SEQ ID NO: 3774948 - RNA, 15 nt, Human
cuccacucuccccca

SEQ ID NO: 3774949 - RNA, 19 nt, Human
cuccacucucuaccagaua

SEQ ID NO: 3774950 - RNA, 17 nt, Human
cuccacucugaguccca

SEQ ID NO: 3774951 - RNA, 12 nt, Human
cuccacugcccu

SEQ ID NO: 3774952 - RNA, 11 nt, Human
cuccacugccu

SEQ ID NO: 3774953 - RNA, 15 nt, Human
cuccacugccuucga

SEQ ID NO: 3774954 - RNA, 13 nt, Human
cuccacuggaugg

SEQ ID NO: 3774955 - RNA, 23 nt, Human
cuccacuggccggagucagugcc

SEQ ID NO: 3774956 - RNA, 13 nt, Human
cuccacuggcucc

SEQ ID NO: 3774957 - RNA, 9 nt, Human
cuccacugu

SEQ ID NO: 3774958 - RNA, 12 nt, Human
cuccacugucac

SEQ ID NO: 3774959 - RNA, 13 nt, Human
cuccacugucacc

SEQ ID NO: 3774960 - RNA, 17 nt, Human
cuccacugugccuuugc

SEQ ID NO: 3774961 - RNA, 17 nt, Human
cuccacuuggcauuagc

SEQ ID NO: 3774962 - RNA, 13 nt, Human
cuccacuuggucu

SEQ ID NO: 3774963 - RNA, 16 nt, Human
cuccacuuucuagcca

SEQ ID NO: 3774964 - RNA, 15 nt, Human
cuccacuuuguugga

SEQ ID NO: 3774965 - RNA, 19 nt, Human
cuccagaaaugucccuuuc

SEQ ID NO: 3774966 - RNA, 14 nt, Human
cuccagaagauagc

SEQ ID NO: 3774967 - RNA, 14 nt, Human
cuccagaagccucu

SEQ ID NO: 3774968 - RNA, 15 nt, Human
cuccagaagccucug

SEQ ID NO: 3774969 - RNA, 16 nt, Human
cuccagaagccucugg

SEQ ID NO: 3774970 - RNA, 21 nt, Human
cuccagaaucuaaagccagug

SEQ ID NO: 3774971 - RNA, 15 nt, Human
cuccagaauuuccca

SEQ ID NO: 3774972 - RNA, 16 nt, Human
cuccagacccccaccc

SEQ ID NO: 3774973 - RNA, 18 nt, Human
cuccagacccccaccccu

SEQ ID NO: 3774974 - RNA, 15 nt, Human
cuccagaccccuggc

SEQ ID NO: 3774975 - RNA, 19 nt, Human
cuccagaccccuggcuuuu

SEQ ID NO: 3774976 - RNA, 12 nt, Human
cuccagaccuga

SEQ ID NO: 3774977 - RNA, 23 nt, Human
cuccagaccugauccuggaggcc

SEQ ID NO: 3774978 - RNA, 20 nt, Human
cuccagacguaggggagggg

SEQ ID NO: 3774979 - RNA, 18 nt, Human
cuccagacucucugugaa

SEQ ID NO: 3774980 - RNA, 21 nt, Human
cuccagagcugcggugucucc

SEQ ID NO: 3774981 - RNA, 20 nt, Human
cuccagagggcacucugcuu

SEQ ID NO: 3774982 - RNA, 21 nt, Human
cuccagagggcacucugcuug

SEQ ID NO: 3774983 - RNA, 20 nt, Human
cuccagaguggggaugacau

SEQ ID NO: 3774984 - RNA, 17 nt, Human
cuccagaugcagggcag

SEQ ID NO: 3774985 - RNA, 20 nt, Human
cuccagauuuuucggaggcc

SEQ ID NO: 3774986 - RNA, 23 nt, Human
cuccagauuuuucggaggcccca

SEQ ID NO: 3774987 - RNA, 16 nt, Human
cuccagcaacacagcc

SEQ ID NO: 3774988 - RNA, 18 nt, Human
cuccagcaacacagccug

SEQ ID NO: 3774989 - RNA, 21 nt, Human
cuccagcaacuucuucuccau

SEQ ID NO: 3774990 - RNA, 11 nt, Human
cuccagcacaa

SEQ ID NO: 3774991 - RNA, 18 nt, Human
cuccagcaccauccgcca

SEQ ID NO: 3774992 - RNA, 21 nt, Human
cuccagccaaccccuguggag

SEQ ID NO: 3774993 - RNA, 12 nt, Human
cuccagccagca

SEQ ID NO: 3774994 - RNA, 20 nt, Human
cuccagccagcgccucccuc

SEQ ID NO: 3774995 - RNA, 13 nt, Human
cuccagcccacgu

SEQ ID NO: 3774996 - RNA, 19 nt, Human
cuccagccccucuuggaga

SEQ ID NO: 3774997 - RNA, 21 nt, Human
cuccagccccucuuggagaag

SEQ ID NO: 3774998 - RNA, 12 nt, Human
cuccagccccug

SEQ ID NO: 3774999 - RNA, 14 nt, Human
cuccagccccugga

SEQ ID NO: 3775000 - RNA, 16 nt, Human
cuccagccccuggaug

SEQ ID NO: 3775001 - RNA, 16 nt, Human
cuccagccccuguccc

SEQ ID NO: 3775002 - RNA, 17 nt, Human
cuccagccccuguccca

SEQ ID NO: 3775003 - RNA, 21 nt, Human
cuccagccccuucucagaauc

SEQ ID NO: 3775004 - RNA, 22 nt, Human
cuccagccccuucucagaaucu

SEQ ID NO: 3775005 - RNA, 14 nt, Human
cuccagccccuuuc

SEQ ID NO: 3775006 - RNA, 18 nt, Human
cuccagccccuuuccaaa

SEQ ID NO: 3775007 - RNA, 15 nt, Human
cuccagcccgggagc

SEQ ID NO: 3775008 - RNA, 14 nt, Human
cuccagccucagcu

SEQ ID NO: 3775009 - RNA, 11 nt, Human
cuccagccucu

SEQ ID NO: 3775010 - RNA, 17 nt, Human
cuccagccucuguuccc

SEQ ID NO: 3775011 - RNA, 11 nt, Human
cuccagccuga

SEQ ID NO: 3775012 - RNA, 12 nt, Human
cuccagccugaa

SEQ ID NO: 3775013 - RNA, 14 nt, Human
cuccagccugagca

SEQ ID NO: 3775014 - RNA, 23 nt, Human
cuccagccugcccaagcccaggc

SEQ ID NO: 3775015 - RNA, 19 nt, Human
cuccagccugccuggcagg

SEQ ID NO: 3775016 - RNA, 21 nt, Human
cuccagccuggacccccagcu

SEQ ID NO: 3775017 - RNA, 22 nt, Human
cuccagccuggacccccagcuu

SEQ ID NO: 3775018 - RNA, 12 nt, Human
cuccagccuggc

SEQ ID NO: 3775019 - RNA, 13 nt, Human
cuccagccuggcu

SEQ ID NO: 3775020 - RNA, 13 nt, Human
cuccagcggcccu

SEQ ID NO: 3775021 - RNA, 15 nt, Human
cuccagcggcccugu

SEQ ID NO: 3775022 - RNA, 18 nt, Human
cuccagcgucagcugcuc

SEQ ID NO: 3775023 - RNA, 23 nt, Human
cuccagcgucagcugcucccugg

SEQ ID NO: 3775024 - RNA, 20 nt, Human
cuccagcgucaucggacucu

SEQ ID NO: 3775025 - RNA, 18 nt, Human
cuccagcucaccagcccc

SEQ ID NO: 3775026 - RNA, 22 nt, Human
cuccagcucagaacccagggcu

SEQ ID NO: 3775027 - RNA, 13 nt, Human
cuccagcucagca

SEQ ID NO: 3775028 - RNA, 14 nt, Human
cuccagcucagcag

SEQ ID NO: 3775029 - RNA, 15 nt, Human
cuccagcucccugug

SEQ ID NO: 3775030 - RNA, 22 nt, Human
cuccagcucccugugcccccag

SEQ ID NO: 3775031 - RNA, 11 nt, Human
cuccagcuccu

SEQ ID NO: 3775032 - RNA, 14 nt, Human
cuccagcugcacca

SEQ ID NO: 3775033 - RNA, 13 nt, Human
cuccagcugcccc

SEQ ID NO: 3775034 - RNA, 22 nt, Human
cuccagcuggccgggagccuga

SEQ ID NO: 3775035 - RNA, 20 nt, Human
cuccagcugggcucugcaau

SEQ ID NO: 3775036 - RNA, 19 nt, Human
cuccagcuggguuggaaaa

SEQ ID NO: 3775037 - RNA, 13 nt, Human
cuccagcuucccg

SEQ ID NO: 3775038 - RNA, 19 nt, Human
cuccagcuucugguacucu

SEQ ID NO: 3775039 - RNA, 21 nt, Human
cuccagcuucugguacucucc

SEQ ID NO: 3775040 - RNA, 12 nt, Human
cuccagcuugug

SEQ ID NO: 3775041 - RNA, 21 nt, Human
cuccagcuuguggagccccac

SEQ ID NO: 3775042 - RNA, 15 nt, Human
cuccagcuuuccugu

SEQ ID NO: 3775043 - RNA, 12 nt, Human
cuccaggaacca

SEQ ID NO: 3775044 - RNA, 15 nt, Human
cuccaggaagaaaga

SEQ ID NO: 3775045 - RNA, 21 nt, Human
cuccaggaaggggcuggacug

SEQ ID NO: 3775046 - RNA, 13 nt, Human
cuccaggagagga

SEQ ID NO: 3775047 - RNA, 11 nt, Human
cuccaggagca

SEQ ID NO: 3775048 - RNA, 23 nt, Human
cuccaggagcagccacauuccug

SEQ ID NO: 3775049 - RNA, 11 nt, Human
cuccaggagcu

SEQ ID NO: 3775050 - RNA, 19 nt, Human
cuccaggauugaagagcau

SEQ ID NO: 3775051 - RNA, 11 nt, Human
cuccaggcagg

SEQ ID NO: 3775052 - RNA, 22 nt, Human
cuccaggcauuuagcccucaca

SEQ ID NO: 3775053 - RNA, 20 nt, Human
cuccaggccacauggggcug

SEQ ID NO: 3775054 - RNA, 11 nt, Human
cuccaggccca

SEQ ID NO: 3775055 - RNA, 16 nt, Human
cuccaggcccaaggcu

SEQ ID NO: 3775056 - RNA, 17 nt, Human
cuccaggcccaaggcuc

SEQ ID NO: 3775057 - RNA, 22 nt, Human
cuccaggcccaaggcucccgga

SEQ ID NO: 3775058 - RNA, 16 nt, Human
cuccaggcccgucugu

SEQ ID NO: 3775059 - RNA, 19 nt, Human
cuccaggcccgucugucca

SEQ ID NO: 3775060 - RNA, 13 nt, Human
cuccaggccugcc

SEQ ID NO: 3775061 - RNA, 20 nt, Human
cuccaggccugccucccacu

SEQ ID NO: 3775062 - RNA, 13 nt, Human
cuccaggcgccgg

SEQ ID NO: 3775063 - RNA, 14 nt, Human
cuccaggcgccggc

SEQ ID NO: 3775064 - RNA, 23 nt, Human
cuccaggcuccuuuagcgcccag

SEQ ID NO: 3775065 - RNA, 22 nt, Human
cuccaggcuguaucccaugagc

SEQ ID NO: 3775066 - RNA, 23 nt, Human
cuccaggcuguaucccaugagcc

SEQ ID NO: 3775067 - RNA, 17 nt, Human
cuccaggcugucuuuca

SEQ ID NO: 3775068 - RNA, 15 nt, Human
cuccaggcuuuccca

SEQ ID NO: 3775069 - RNA, 22 nt, Human
cuccagggaauccaagccucca

SEQ ID NO: 3775070 - RNA, 18 nt, Human
cuccagggacacacagcc

SEQ ID NO: 3775071 - RNA, 23 nt, Human
cuccagggacagcaacuaucaga

SEQ ID NO: 3775072 - RNA, 18 nt, Human
cuccagggagauuuugag

SEQ ID NO: 3775073 - RNA, 14 nt, Human
cuccagggaguccc

SEQ ID NO: 3775074 - RNA, 20 nt, Human
cuccagggaguccccucccc

SEQ ID NO: 3775075 - RNA, 21 nt, Human
cuccagggaguccccuccccg

SEQ ID NO: 3775076 - RNA, 10 nt, Human
cuccagggcu

SEQ ID NO: 3775077 - RNA, 12 nt, Human
cuccagggcugg

SEQ ID NO: 3775078 - RNA, 13 nt, Human
cuccagggcugga

SEQ ID NO: 3775079 - RNA, 15 nt, Human
cuccagggcuggacu

SEQ ID NO: 3775080 - RNA, 16 nt, Human
cuccagggcuggacug

SEQ ID NO: 3775081 - RNA, 18 nt, Human
cuccagggcuggacugag

SEQ ID NO: 3775082 - RNA, 19 nt, Human
cuccagggcuggacugagg

SEQ ID NO: 3775083 - RNA, 22 nt, Human
cuccaggggcugcuuccuccug

SEQ ID NO: 3775084 - RNA, 12 nt, Human
cuccagguaccu

SEQ ID NO: 3775085 - RNA, 19 nt, Human
cuccagguaccuugaccuu

SEQ ID NO: 3775086 - RNA, 20 nt, Human
cuccagguaccuugaccuuu

SEQ ID NO: 3775087 - RNA, 17 nt, Human
cuccaggucagcugccc

SEQ ID NO: 3775088 - RNA, 17 nt, Human
cuccaggucucacgggc

SEQ ID NO: 3775089 - RNA, 16 nt, Human
cucccagguaccagcu

SEQ ID NO: 3775090 - RNA, 18 nt, Human
cucccaggugcagccaga

SEQ ID NO: 3775091 - RNA, 23 nt, Human
cucccaggugcagccagaggcac

SEQ ID NO: 3775092 - RNA, 22 nt, Human
cucccagguguuaacauuccaa

SEQ ID NO: 3775093 - RNA, 20 nt, Human
cucccaguccaaauguccuc

SEQ ID NO: 3775094 - RNA, 19 nt, Human
cucccagugucuuccugug

SEQ ID NO: 3775095 - RNA, 20 nt, Human
cucccagugucuuccugugg

SEQ ID NO: 3775096 - RNA, 17 nt, Human
cucccaguuaugaauca

SEQ ID NO: 3775097 - RNA, 14 nt, Human
cucccaucacccgc

SEQ ID NO: 3775098 - RNA, 16 nt, Human
cucccauccccuggac

SEQ ID NO: 3775099 - RNA, 16 nt, Human
cucccauccugugugu

SEQ ID NO: 3775100 - RNA, 12 nt, Human
cucccaucuggg

SEQ ID NO: 3775101 - RNA, 20 nt, Human
cucccaucugggaguccccu

SEQ ID NO: 3775102 - RNA, 22 nt, Human
cucccaucugggaguccccuuu

SEQ ID NO: 3775103 - RNA, 14 nt, Human
cucccaucugugaa

SEQ ID NO: 3775104 - RNA, 15 nt, Human
cucccaucugugaaa

SEQ ID NO: 3775105 - RNA, 20 nt, Human
cucccaucuuaacucuuugc

SEQ ID NO: 3775106 - RNA, 19 nt, Human
cucccauggagccccagcc

SEQ ID NO: 3775107 - RNA, 20 nt, Human
cucccauggagccccagccc

SEQ ID NO: 3775108 - RNA, 23 nt, Human
cucccauggagccccagcccccu

SEQ ID NO: 3775109 - RNA, 19 nt, Human
cucccauuaggacaaucag

SEQ ID NO: 3775110 - RNA, 15 nt, Human
cucccauucaagauu

SEQ ID NO: 3775111 - RNA, 19 nt, Human
cucccauucacucuuccag

SEQ ID NO: 3775112 - RNA, 15 nt, Human
cucccauuccugaag

SEQ ID NO: 3775113 - RNA, 17 nt, Human
cucccauuccugaagaa

SEQ ID NO: 3775114 - RNA, 19 nt, Human
cucccauuccugaagaacc

SEQ ID NO: 3775115 - RNA, 21 nt, Human
cuccccaaaggcuuugcccug

SEQ ID NO: 3775116 - RNA, 16 nt, Human
cuccccaaagggugug

SEQ ID NO: 3775117 - RNA, 19 nt, Human
cuccccaacccuagguucc

SEQ ID NO: 3775118 - RNA, 15 nt, Human
cuccccaacccugcc

SEQ ID NO: 3775119 - RNA, 17 nt, Human
cuccccaacccugcccc

SEQ ID NO: 3775120 - RNA, 18 nt, Human
cuccccaaggaagagcca

SEQ ID NO: 3775121 - RNA, 23 nt, Human
cuccccaaggcccccugccugcc

SEQ ID NO: 3775122 - RNA, 20 nt, Human
cuccccaaugagacuugccu

SEQ ID NO: 3775123 - RNA, 22 nt, Human
cuccccaaugagacuugccuuc

SEQ ID NO: 3775124 - RNA, 21 nt, Human
cuccccacacuaaccuggguu

SEQ ID NO: 3775125 - RNA, 15 nt, Human
cuccccacagcgucc

SEQ ID NO: 3775126 - RNA, 20 nt, Human
cuccccaccaccccagcugc

SEQ ID NO: 3775127 - RNA, 14 nt, Human
cuccccacccgccc

SEQ ID NO: 3775128 - RNA, 23 nt, Human
cuccccaccuucaauuccugggc

SEQ ID NO: 3775129 - RNA, 16 nt, Human
cuccccacgagggcug

SEQ ID NO: 3775130 - RNA, 17 nt, Human
cuccccacggccgcucc

SEQ ID NO: 3775131 - RNA, 13 nt, Human
cuccccacucugc

SEQ ID NO: 3775132 - RNA, 16 nt, Human
cuccccacucugcucu

SEQ ID NO: 3775133 - RNA, 16 nt, Human
cuccccacugccuacu

SEQ ID NO: 3775134 - RNA, 19 nt, Human
cuccccacugccuacugca

SEQ ID NO: 3775135 - RNA, 14 nt, Human
cuccccagaauuca

SEQ ID NO: 3775136 - RNA, 20 nt, Human
cuccccagcaagugagagcu

SEQ ID NO: 3775137 - RNA, 16 nt, Human
cuccccagcagguggg

SEQ ID NO: 3775138 - RNA, 21 nt, Human
cuccccagcauuccagccccu

SEQ ID NO: 3775139 - RNA, 11 nt, Human
cuccccagccc

SEQ ID NO: 3775140 - RNA, 13 nt, Human
cuccccagcccag

SEQ ID NO: 3775141 - RNA, 16 nt, Human
cuccccagcccagaga

SEQ ID NO: 3775142 - RNA, 22 nt, Human
cuccccagccccuagcccagga

SEQ ID NO: 3775143 - RNA, 12 nt, Human
cuccccagccug

SEQ ID NO: 3775144 - RNA, 13 nt, Human
cuccccagccugc

SEQ ID NO: 3775145 - RNA, 14 nt, Human
cuccccagccugcg

SEQ ID NO: 3775146 - RNA, 16 nt, Human
cuccccagccugcgcc

SEQ ID NO: 3775147 - RNA, 16 nt, Human
cuccccagcucccagg

SEQ ID NO: 3775148 - RNA, 21 nt, Human
cuccccaggaauuugggaccc

SEQ ID NO: 3775149 - RNA, 14 nt, Human
cuccccagggaagc

SEQ ID NO: 3775150 - RNA, 21 nt, Human
cuccccaggguucaguccuca

SEQ ID NO: 3775151 - RNA, 19 nt, Human
cuccccagguccagcucug

SEQ ID NO: 3775152 - RNA, 21 nt, Human
cuccccagguccagcucugga

SEQ ID NO: 3775153 - RNA, 22 nt, Human
cuccccagucucucuuaaaguu

SEQ ID NO: 3775154 - RNA, 14 nt, Human
cuccccaucccaug

SEQ ID NO: 3775155 - RNA, 19 nt, Human
cuccccaugauguuuagaa

SEQ ID NO: 3775156 - RNA, 12 nt, Human
cuccccauggag

SEQ ID NO: 3775157 - RNA, 17 nt, Human
cuccccauggagccagc

SEQ ID NO: 3775158 - RNA, 21 nt, Human
cuccccaugugccugcaccag

SEQ ID NO: 3775159 - RNA, 20 nt, Human
cuccccauguguccugguuc

SEQ ID NO: 3775160 - RNA, 19 nt, Human
cuccccauuucccaucugc

SEQ ID NO: 3775161 - RNA, 21 nt, Human
cucccccagcaaagcccccag

SEQ ID NO: 3775162 - RNA, 16 nt, Human
cucccccagccacucc

SEQ ID NO: 3775163 - RNA, 13 nt, Human
cucccccauccua

SEQ ID NO: 3775164 - RNA, 15 nt, Human
cucccccauccuccc

SEQ ID NO: 3775165 - RNA, 13 nt, Human
cuccccccacugc

SEQ ID NO: 3775166 - RNA, 16 nt, Human
cuccccccacugcagg

SEQ ID NO: 3775167 - RNA, 13 nt, Human
cucccccccaugc

SEQ ID NO: 3775168 - RNA, 15 nt, Human
cucccccccaugcac

SEQ ID NO: 3775169 - RNA, 16 nt, Human
cuccccccccccucca

SEQ ID NO: 3775170 - RNA, 14 nt, Human
cucccccccggggc

SEQ ID NO: 3775171 - RNA, 15 nt, Human
cucccccccggggcu

SEQ ID NO: 3775172 - RNA, 18 nt, Human
cucccccccggggcuggg

SEQ ID NO: 3775173 - RNA, 17 nt, Human
cuccccccgccugccac

SEQ ID NO: 3775174 - RNA, 23 nt, Human
cuccccccuccucugaaacagcu

SEQ ID NO: 3775175 - RNA, 18 nt, Human
cucccccgggaggggccc

SEQ ID NO: 3775176 - RNA, 21 nt, Human
cucccccgggaggggcccgcu

SEQ ID NO: 3775177 - RNA, 13 nt, Human
cucccccuccuuc

SEQ ID NO: 3775178 - RNA, 17 nt, Human
cucccccuccuucccag

SEQ ID NO: 3775179 - RNA, 17 nt, Human
cucccccugccagugcc

SEQ ID NO: 3775180 - RNA, 11 nt, Human
cucccccuggg

SEQ ID NO: 3775181 - RNA, 19 nt, Human
cucccccuguccccucagc

SEQ ID NO: 3775182 - RNA, 14 nt, Human
cucccccuuuuccc

SEQ ID NO: 3775183 - RNA, 17 nt, Human
cuccccgauaaagaaug

SEQ ID NO: 3775184 - RNA, 16 nt, Human
cuccccgccuguuccc

SEQ ID NO: 3775185 - RNA, 15 nt, Human
cuccccgccuuccgc

SEQ ID NO: 3775186 - RNA, 23 nt, Human
cuccccggcaugagacucagugc

SEQ ID NO: 3775187 - RNA, 16 nt, Human
cuccccuaaagccuca

SEQ ID NO: 3775188 - RNA, 16 nt, Human
cuccccuaaugccugc

SEQ ID NO: 3775189 - RNA, 18 nt, Human
cuccccuauccacccagc

SEQ ID NO: 3775190 - RNA, 18 nt, Human
cuccccucaaagucugca

SEQ ID NO: 3775191 - RNA, 13 nt, Human
cuccccucaagga

SEQ ID NO: 3775192 - RNA, 14 nt, Human
cuccccucacagcc

SEQ ID NO: 3775193 - RNA, 18 nt, Human
cuccccucacagccucug

SEQ ID NO: 3775194 - RNA, 13 nt, Human
cuccccucagccu

SEQ ID NO: 3775195 - RNA, 15 nt, Human
cuccccucagccucu

SEQ ID NO: 3775196 - RNA, 16 nt, Human
cuccccucagccucuc

SEQ ID NO: 3775197 - RNA, 14 nt, Human
cuccccuccagccu

SEQ ID NO: 3775198 - RNA, 13 nt, Human
cuccccuccccug

SEQ ID NO: 3775199 - RNA, 16 nt, Human
cuccccuccccugcug

SEQ ID NO: 3775200 - RNA, 17 nt, Human
cuccccuccccugcugc

SEQ ID NO: 3775201 - RNA, 15 nt, Human
cuccccuccuugccu

SEQ ID NO: 3775202 - RNA, 16 nt, Human
cuccccuccuugccuc

SEQ ID NO: 3775203 - RNA, 22 nt, Human
cuccccuccuugccuccugugu

SEQ ID NO: 3775204 - RNA, 16 nt, Human
cuccccuccuuuccca

SEQ ID NO: 3775205 - RNA, 13 nt, Human
cuccccucugaaa

SEQ ID NO: 3775206 - RNA, 17 nt, Human
cuccccugaccugugag

SEQ ID NO: 3775207 - RNA, 12 nt, Human
cuccccugagga

SEQ ID NO: 3775208 - RNA, 21 nt, Human
cuccccugcacuggaguccag

SEQ ID NO: 3775209 - RNA, 18 nt, Human
cuccccugcagcccuggc

SEQ ID NO: 3775210 - RNA, 12 nt, Human
cuccccugccac

SEQ ID NO: 3775211 - RNA, 15 nt, Human
cuccccugccagggc

SEQ ID NO: 3775212 - RNA, 17 nt, Human
cuccccugcccccugca

SEQ ID NO: 3775213 - RNA, 12 nt, Human
cuccccugcccu

SEQ ID NO: 3775214 - RNA, 14 nt, Human
cuccccugcccugg

SEQ ID NO: 3775215 - RNA, 12 nt, Human
cuccccugccuu

SEQ ID NO: 3775216 - RNA, 13 nt, Human
cuccccugccuug

SEQ ID NO: 3775217 - RNA, 16 nt, Human
cuccccugcugaaggu

SEQ ID NO: 3775218 - RNA, 14 nt, Human
cuccccuggacucc

SEQ ID NO: 3775219 - RNA, 21 nt, Human
cuccccuggagggggaauggc

SEQ ID NO: 3775220 - RNA, 23 nt, Human
cuccccuggggacagcaagggcu

SEQ ID NO: 3775221 - RNA, 18 nt, Human
cuccccugugccagccca

SEQ ID NO: 3775222 - RNA, 21 nt, Human
cuccccuguuccccucucccu

SEQ ID NO: 3775223 - RNA, 21 nt, Human
cuccccuguuucaaucacugu

SEQ ID NO: 3775224 - RNA, 14 nt, Human
cuccccuuccauuu

SEQ ID NO: 3775225 - RNA, 16 nt, Human
cuccccuuccauuucu

SEQ ID NO: 3775226 - RNA, 18 nt, Human
cuccccuucccagggcaa

SEQ ID NO: 3775227 - RNA, 17 nt, Human
cuccccuuccccuuccu

SEQ ID NO: 3775228 - RNA, 23 nt, Human
cuccccuuccccuuccuucuuug

SEQ ID NO: 3775229 - RNA, 16 nt, Human
cuccccuucccugcaa

SEQ ID NO: 3775230 - RNA, 14 nt, Human
cuccccuugccagc

SEQ ID NO: 3775231 - RNA, 13 nt, Human
cuccccuugggcg

SEQ ID NO: 3775232 - RNA, 15 nt, Human
cuccccuugggcggc

SEQ ID NO: 3775233 - RNA, 18 nt, Human
cucccgaauagcugggac

SEQ ID NO: 3775234 - RNA, 24 nt, Human
cucccgagcuccucuuccaugcug

SEQ ID NO: 3775235 - RNA, 22 nt, Human
cucuggaccaacccuguuuccu

SEQ ID NO: 3775236 - RNA, 14 nt, Human
cucuggaccagccu

SEQ ID NO: 3775237 - RNA, 16 nt, Human
cucuggacggcaggcu

SEQ ID NO: 3775238 - RNA, 23 nt, Human
cucuggacggcaggcucacugcc

SEQ ID NO: 3775239 - RNA, 16 nt, Human
cucuggacucuaaaga

SEQ ID NO: 3775240 - RNA, 13 nt, Human
cucuggacuggcu

SEQ ID NO: 3775241 - RNA, 19 nt, Human
cucuggacuggcuagaguc

SEQ ID NO: 3775242 - RNA, 23 nt, Human
cucuggacuuucucuaauaauaa

SEQ ID NO: 3775243 - RNA, 21 nt, Human
cucuggagaaagggcccuggg

SEQ ID NO: 3775244 - RNA, 15 nt, Human
cucuggagacagccc

SEQ ID NO: 3775245 - RNA, 18 nt, Human
cucuggagacagccccag

SEQ ID NO: 3775246 - RNA, 14 nt, Human
cucuggagcauuuc

SEQ ID NO: 3775247 - RNA, 16 nt, Human
cucuggagccaccugu

SEQ ID NO: 3775248 - RNA, 20 nt, Human
cucuggagccaccuguccca

SEQ ID NO: 3775249 - RNA, 15 nt, Human
cucuggagccagccg

SEQ ID NO: 3775250 - RNA, 15 nt, Human
cucuggagcccacug

SEQ ID NO: 3775251 - RNA, 19 nt, Human
cucuggagcccacuguacu

SEQ ID NO: 3775252 - RNA, 15 nt, Human
cucuggaggggaggg

SEQ ID NO: 3775253 - RNA, 16 nt, Human
cucuggaggggagggg

SEQ ID NO: 3775254 - RNA, 19 nt, Human
cucuggagggguguggcuc

SEQ ID NO: 3775255 - RNA, 21 nt, Human
cucuggagggguguggcuccu

SEQ ID NO: 3775256 - RNA, 12 nt, Human
cucuggaguggc

SEQ ID NO: 3775257 - RNA, 20 nt, Human
cucuggaguggccacuaagc

SEQ ID NO: 3775258 - RNA, 19 nt, Human
cucuggaugccugauugcc

SEQ ID NO: 3775259 - RNA, 23 nt, Human
cucuggaugccugauugccaagc

SEQ ID NO: 3775260 - RNA, 16 nt, Human
cucuggauggcaccag

SEQ ID NO: 3775261 - RNA, 20 nt, Human
cucuggauggcaccagaggc

SEQ ID NO: 3775262 - RNA, 16 nt, Human
cucuggauucagccuu

SEQ ID NO: 3775263 - RNA, 17 nt, Human
cucuggauucagccuuc

SEQ ID NO: 3775264 - RNA, 13 nt, Human
cucuggcagcacc

SEQ ID NO: 3775265 - RNA, 23 nt, Human
cucuggcagcaccgccucuuccc

SEQ ID NO: 3775266 - RNA, 13 nt, Human
cucuggcagccac

SEQ ID NO: 3775267 - RNA, 14 nt, Human
cucuggcagcucag

SEQ ID NO: 3775268 - RNA, 18 nt, Human
cucuggcagcucagagag

SEQ ID NO: 3775269 - RNA, 20 nt, Human
cucuggcauuagaauuauuu

SEQ ID NO: 3775270 - RNA, 14 nt, Human
cucuggcccuggcc

SEQ ID NO: 3775271 - RNA, 17 nt, Human
cucuggccucccacccg

SEQ ID NO: 3775272 - RNA, 11 nt, Human
cucuggccucu

SEQ ID NO: 3775273 - RNA, 15 nt, Human
cucuggccucuguca

SEQ ID NO: 3775274 - RNA, 21 nt, Human
cucuggccuucggccuccauc

SEQ ID NO: 3775275 - RNA, 16 nt, Human
cucuggccuuuuccua

SEQ ID NO: 3775276 - RNA, 14 nt, Human
cucuggcuagaggc

SEQ ID NO: 3775277 - RNA, 21 nt, Human
cucuggcuagaggccagcccc

SEQ ID NO: 3775278 - RNA, 15 nt, Human
cucuggcucacagac

SEQ ID NO: 3775279 - RNA, 22 nt, Human
cucuggcuccagcuggccggga

SEQ ID NO: 3775280 - RNA, 15 nt, Human
cucuggcucuacaca

SEQ ID NO: 3775281 - RNA, 12 nt, Human
cucuggcucuca

SEQ ID NO: 3775282 - RNA, 13 nt, Human
cucuggcucucau

SEQ ID NO: 3775283 - RNA, 18 nt, Human
cucuggcugaacccugug

SEQ ID NO: 3775284 - RNA, 13 nt, Human
cucuggcuggcua

SEQ ID NO: 3775285 - RNA, 23 nt, Human
cucuggcuggcuaacuggaagca

SEQ ID NO: 3775286 - RNA, 13 nt, Human
cucuggcugggga

SEQ ID NO: 3775287 - RNA, 20 nt, Human
cucuggcuguaaggcucuag

SEQ ID NO: 3775288 - RNA, 13 nt, Human
cucuggcuuccag

SEQ ID NO: 3775289 - RNA, 21 nt, Human
cucuggcuuggccacagccag

SEQ ID NO: 3775290 - RNA, 16 nt, Human
cucuggcuuggccuau

SEQ ID NO: 3775291 - RNA, 10 nt, Human
cucuggcuuu

SEQ ID NO: 3775292 - RNA, 16 nt, Human
cucuggcuuuuggaag

SEQ ID NO: 3775293 - RNA, 18 nt, Human
cucugggaaccucccaga

SEQ ID NO: 3775294 - RNA, 17 nt, Human
cucugggagaggauuuu

SEQ ID NO: 3775295 - RNA, 18 nt, Human
cucugggauuuaugcuca

SEQ ID NO: 3775296 - RNA, 19 nt, Human
cucugggauuuaugcucau

SEQ ID NO: 3775297 - RNA, 22 nt, Human
cucugggauuuaugcucaugaa

SEQ ID NO: 3775298 - RNA, 16 nt, Human
cucugggcuggaugag

SEQ ID NO: 3775299 - RNA, 19 nt, Human
cucugggcuggaugagcuc

SEQ ID NO: 3775300 - RNA, 20 nt, Human
cucugggcuggaugagcucc

SEQ ID NO: 3775301 - RNA, 17 nt, Human
cucuggggccacacaga

SEQ ID NO: 3775302 - RNA, 20 nt, Human
cucuggggccacacagaaac

SEQ ID NO: 3775303 - RNA, 22 nt, Human
cucuggggcucuaggguugcug

SEQ ID NO: 3775304 - RNA, 17 nt, Human
cucugggucaguggucc

SEQ ID NO: 3775305 - RNA, 16 nt, Human
cucuggguccuuccug

SEQ ID NO: 3775306 - RNA, 17 nt, Human
cucuggguccuuccuga

SEQ ID NO: 3775307 - RNA, 21 nt, Human
cucuggguccuuccugaaacu

SEQ ID NO: 3775308 - RNA, 22 nt, Human
cucugguacaauuucuuuuggu

SEQ ID NO: 3775309 - RNA, 15 nt, Human
cucugguccauagag

SEQ ID NO: 3775310 - RNA, 16 nt, Human
cucugguccauagaga

SEQ ID NO: 3775311 - RNA, 16 nt, Human
cucuggucgcuccugc

SEQ ID NO: 3775312 - RNA, 18 nt, Human
cucuggucgcuccugccc

SEQ ID NO: 3775313 - RNA, 19 nt, Human
cucuggugacaccagccuu

SEQ ID NO: 3775314 - RNA, 20 nt, Human
cucuggugacaccagccuuu

SEQ ID NO: 3775315 - RNA, 16 nt, Human
cucuggugauaaggac

SEQ ID NO: 3775316 - RNA, 17 nt, Human
cucuggugauaaggaca

SEQ ID NO: 3775317 - RNA, 19 nt, Human
cucuggugauaaggacaug

SEQ ID NO: 3775318 - RNA, 17 nt, Human
cucugguuguuucuguu

SEQ ID NO: 3775319 - RNA, 23 nt, Human
cucugguuguuucuguuccaaau

SEQ ID NO: 3775320 - RNA, 16 nt, Human
cucugguuuaauuaca

SEQ ID NO: 3775321 - RNA, 22 nt, Human
cucugguuuggggcgaggcaga

SEQ ID NO: 3775322 - RNA, 23 nt, Human
cucuguaaaaacacugaaaaauu

SEQ ID NO: 3775323 - RNA, 15 nt, Human
cucuguaaagcuaaa

SEQ ID NO: 3775324 - RNA, 23 nt, Human
cucuguaaguagaugcauuuggg

SEQ ID NO: 3775325 - RNA, 14 nt, Human
cucuguacagagcc

SEQ ID NO: 3775326 - RNA, 15 nt, Human
cucuguacagagccc

SEQ ID NO: 3775327 - RNA, 16 nt, Human
cucuguacagagccca

SEQ ID NO: 3775328 - RNA, 18 nt, Human
cucuguacauauuagcga

SEQ ID NO: 3775329 - RNA, 12 nt, Human
cucuguacuuuu

SEQ ID NO: 3775330 - RNA, 13 nt, Human
cucuguagccuaa

SEQ ID NO: 3775331 - RNA, 22 nt, Human
cucuguagggaacucugggguc

SEQ ID NO: 3775332 - RNA, 13 nt, Human
cucuguauauaua

SEQ ID NO: 3775333 - RNA, 22 nt, Human
cucuguaucaggacccagagga

SEQ ID NO: 3775334 - RNA, 19 nt, Human
cucugucacccuuguccuu

SEQ ID NO: 3775335 - RNA, 23 nt, Human
cucugucagaugggaagacauga

SEQ ID NO: 3775336 - RNA, 16 nt, Human
cucugucagucacagc

SEQ ID NO: 3775337 - RNA, 16 nt, Human
cucugucauaucuuca

SEQ ID NO: 3775338 - RNA, 14 nt, Human
cucuguccaggcac

SEQ ID NO: 3775339 - RNA, 22 nt, Human
cucuguccagggcccugagcuc

SEQ ID NO: 3775340 - RNA, 20 nt, Human
cucugucccauucccuggga

SEQ ID NO: 3775341 - RNA, 21 nt, Human
cucugucccauucccugggau

SEQ ID NO: 3775342 - RNA, 17 nt, Human
cucuguccccagccugg

SEQ ID NO: 3775343 - RNA, 15 nt, Human
cucuguccccuucuc

SEQ ID NO: 3775344 - RNA, 17 nt, Human
cucuguccccuucucuc

SEQ ID NO: 3775345 - RNA, 18 nt, Human
cucuguccccuucucuca

SEQ ID NO: 3775346 - RNA, 15 nt, Human
cucugucccuugcug

SEQ ID NO: 3775347 - RNA, 12 nt, Human
cucuguccugaa

SEQ ID NO: 3775348 - RNA, 13 nt, Human
cucuguccugacu

SEQ ID NO: 3775349 - RNA, 16 nt, Human
cucuguccugcuucug

SEQ ID NO: 3775350 - RNA, 22 nt, Human
cucuguccugggagugagcugg

SEQ ID NO: 3775351 - RNA, 13 nt, Human
cucugucgcccag

SEQ ID NO: 3775352 - RNA, 17 nt, Human
cucugucgcccagucug

SEQ ID NO: 3775353 - RNA, 18 nt, Human
cucugucgcccagucugg

SEQ ID NO: 3775354 - RNA, 20 nt, Human
cucugucgcccaugcuggag

SEQ ID NO: 3775355 - RNA, 15 nt, Human
cucugucuaccaucu

SEQ ID NO: 3775356 - RNA, 16 nt, Human
cucugucuaccugguc

SEQ ID NO: 3775357 - RNA, 20 nt, Human
cucugucuaccuggucuggu

SEQ ID NO: 3775358 - RNA, 18 nt, Human
cucugucuagcaugccaa

SEQ ID NO: 3775359 - RNA, 19 nt, Human
cucugucuagcaugccaac

SEQ ID NO: 3775360 - RNA, 19 nt, Human
cucugucucaaaaauaaau

SEQ ID NO: 3775361 - RNA, 14 nt, Human
cucugucucauccu

SEQ ID NO: 3775362 - RNA, 22 nt, Human
cucugucucauccuccuggaac

SEQ ID NO: 3775363 - RNA, 20 nt, Human
cucugucucaugugugcucu

SEQ ID NO: 3775364 - RNA, 17 nt, Human
cucugucugcccuucac

SEQ ID NO: 3775365 - RNA, 20 nt, Human
cucugucuggcaaugccaca

SEQ ID NO: 3775366 - RNA, 17 nt, Human
cucugucuucuggacug

SEQ ID NO: 3775367 - RNA, 15 nt, Human
cucugucuuguguuu

SEQ ID NO: 3775368 - RNA, 15 nt, Human
cucugugaccaaugu

SEQ ID NO: 3775369 - RNA, 17 nt, Human
cucugugaccaaugucu

SEQ ID NO: 3775370 - RNA, 23 nt, Human
cucugugacccacuucucaucac

SEQ ID NO: 3775371 - RNA, 19 nt, Human
cucugugaccucaggcacu

SEQ ID NO: 3775372 - RNA, 11 nt, Human
cucugugagaa

SEQ ID NO: 3775373 - RNA, 22 nt, Human
cucugugagaagguuuauuguu

SEQ ID NO: 3775374 - RNA, 18 nt, Human
cucugugagacucgagaa

SEQ ID NO: 3775375 - RNA, 17 nt, Human
cucugugagggugcuga

SEQ ID NO: 3775376 - RNA, 20 nt, Human
cucugugcagucacuggagg

SEQ ID NO: 3775377 - RNA, 14 nt, Human
cucugugccagagc

SEQ ID NO: 3775378 - RNA, 15 nt, Human
cucugugccagagcc

SEQ ID NO: 3775379 - RNA, 10 nt, Human
cucuucugaa

SEQ ID NO: 3775380 - RNA, 17 nt, Human
cucuucugacgugccuu

SEQ ID NO: 3775381 - RNA, 18 nt, Human
cucuucugcuccacccuu

SEQ ID NO: 3775382 - RNA, 14 nt, Human
cucuucuggaaugg

SEQ ID NO: 3775383 - RNA, 14 nt, Human
cucuucuggcucaa

SEQ ID NO: 3775384 - RNA, 21 nt, Human
cucuucuggggcaggcugggc

SEQ ID NO: 3775385 - RNA, 18 nt, Human
cucuucuggguuccuucc

SEQ ID NO: 3775386 - RNA, 16 nt, Human
cucuucugugggugac

SEQ ID NO: 3775387 - RNA, 23 nt, Human
cucuucugugggugacccagguc

SEQ ID NO: 3775388 - RNA, 18 nt, Human
cucuucuuaauguacaua

SEQ ID NO: 3775389 - RNA, 13 nt, Human
cucuucuuagccu

SEQ ID NO: 3775390 - RNA, 17 nt, Human
cucuucuucuucagaag

SEQ ID NO: 3775391 - RNA, 15 nt, Human
cucuucuugaaauuu

SEQ ID NO: 3775392 - RNA, 21 nt, Human
cucuucuuggggcccagugca

SEQ ID NO: 3775393 - RNA, 16 nt, Human
cucuugaacugagcuu

SEQ ID NO: 3775394 - RNA, 17 nt, Human
cucuugaacugagcuug

SEQ ID NO: 3775395 - RNA, 14 nt, Human
cucuugaccaggcu

SEQ ID NO: 3775396 - RNA, 16 nt, Human
cucuugacccugcacc

SEQ ID NO: 3775397 - RNA, 19 nt, Human
cucuugacccugcacccuc

SEQ ID NO: 3775398 - RNA, 16 nt, Human
cucuugagccugggag

SEQ ID NO: 3775399 - RNA, 16 nt, Human
cucuugagccuugaac

SEQ ID NO: 3775400 - RNA, 23 nt, Human
cucuugagccuugaacuuugacc

SEQ ID NO: 3775401 - RNA, 16 nt, Human
cucuugagcuggccuc

SEQ ID NO: 3775402 - RNA, 13 nt, Human
cucuugaguuguu

SEQ ID NO: 3775403 - RNA, 16 nt, Human
cucuugaguuguuuuu

SEQ ID NO: 3775404 - RNA, 18 nt, Human
cucuugaguuguuuuugu

SEQ ID NO: 3775405 - RNA, 21 nt, Human
cucuugaguuguuuuuguaua

SEQ ID NO: 3775406 - RNA, 23 nt, Human
cucuugaguuugucgcucaugug

SEQ ID NO: 3775407 - RNA, 18 nt, Human
cucuugauaccccccucu

SEQ ID NO: 3775408 - RNA, 21 nt, Human
cucuugauuauccauauugag

SEQ ID NO: 3775409 - RNA, 13 nt, Human
cucuugauuuuca

SEQ ID NO: 3775410 - RNA, 20 nt, Human
cucuugcacagucacugcuc

SEQ ID NO: 3775411 - RNA, 16 nt, Human
cucuugcaccaaauua

SEQ ID NO: 3775412 - RNA, 12 nt, Human
cucuugcacccg

SEQ ID NO: 3775413 - RNA, 22 nt, Human
cucuugccacugccucuuccuc

SEQ ID NO: 3775414 - RNA, 20 nt, Human
cucuugcccauccugacuga

SEQ ID NO: 3775415 - RNA, 12 nt, Human
cucuugccccaa

SEQ ID NO: 3775416 - RNA, 14 nt, Human
cucuugccccaacc

SEQ ID NO: 3775417 - RNA, 12 nt, Human
cucuugcccccc

SEQ ID NO: 3775418 - RNA, 20 nt, Human
cucuugccucaaccucccaa

SEQ ID NO: 3775419 - RNA, 19 nt, Human
cucuugccucagcuucccc

SEQ ID NO: 3775420 - RNA, 14 nt, Human
cucuugcuaaucag

SEQ ID NO: 3775421 - RNA, 20 nt, Human
cucuugcucaaaaaucuguu

SEQ ID NO: 3775422 - RNA, 12 nt, Human
cucuugcucuuu

SEQ ID NO: 3775423 - RNA, 15 nt, Human
cucuugcucuuucua

SEQ ID NO: 3775424 - RNA, 17 nt, Human
cucuugcugucucugcu

SEQ ID NO: 3775425 - RNA, 22 nt, Human
cucuugcuugugggacuagccu

SEQ ID NO: 3775426 - RNA, 17 nt, Human
cucuuggaaaaagugau

SEQ ID NO: 3775427 - RNA, 13 nt, Human
cucuuggagaagu

SEQ ID NO: 3775428 - RNA, 14 nt, Human
cucuuggagccugc

SEQ ID NO: 3775429 - RNA, 17 nt, Human
cucuuggcuggacccag

SEQ ID NO: 3775430 - RNA, 21 nt, Human
cucuugggaacugaacucacu

SEQ ID NO: 3775431 - RNA, 20 nt, Human
cucuugggcaauauucucug

SEQ ID NO: 3775432 - RNA, 18 nt, Human
cucuugggcugagacugg

SEQ ID NO: 3775433 - RNA, 19 nt, Human
cucuuggguucaagcgauu

SEQ ID NO: 3775434 - RNA, 21 nt, Human
cucuuggguucaagcgauucu

SEQ ID NO: 3775435 - RNA, 13 nt, Human
cucuugguccugc

SEQ ID NO: 3775436 - RNA, 17 nt, Human
cucuugguccugcugca

SEQ ID NO: 3775437 - RNA, 17 nt, Human
cucuugguguuaaaaca

SEQ ID NO: 3775438 - RNA, 22 nt, Human
cucuugguguuaaaacacuucu

SEQ ID NO: 3775439 - RNA, 23 nt, Human
cucuuguaaauaaagcccuggga

SEQ ID NO: 3775440 - RNA, 14 nt, Human
cucuuguaagauuu

SEQ ID NO: 3775441 - RNA, 18 nt, Human
cucuuguaagauuuugaa

SEQ ID NO: 3775442 - RNA, 21 nt, Human
cucuuguaauccgaaucucuu

SEQ ID NO: 3775443 - RNA, 21 nt, Human
cucuuguccucaguccauuua

SEQ ID NO: 3775444 - RNA, 22 nt, Human
cucuuguccucaguccauuuau

SEQ ID NO: 3775445 - RNA, 13 nt, Human
cucuugucucccc

SEQ ID NO: 3775446 - RNA, 22 nt, Human
cucuugucuggcaaaagaaaaa

SEQ ID NO: 3775447 - RNA, 12 nt, Human
cucuugugauuu

SEQ ID NO: 3775448 - RNA, 14 nt, Human
cucuugugauuucu

SEQ ID NO: 3775449 - RNA, 22 nt, Human
cucuugugauuucuuuaaaaga

SEQ ID NO: 3775450 - RNA, 13 nt, Human
cucuuguggaugu

SEQ ID NO: 3775451 - RNA, 20 nt, Human
cucuuguucuuacuuuccug

SEQ ID NO: 3775452 - RNA, 19 nt, Human
cucuuguuuuuauuaauuu

SEQ ID NO: 3775453 - RNA, 23 nt, Human
cucuuuaaaaggaaagaaaacau

SEQ ID NO: 3775454 - RNA, 16 nt, Human
cucuuuaacucaggac

SEQ ID NO: 3775455 - RNA, 22 nt, Human
cucuuuaacucaggacuccagc

SEQ ID NO: 3775456 - RNA, 15 nt, Human
cucuuuaacuucucg

SEQ ID NO: 3775457 - RNA, 19 nt, Human
cucuuuaacuuguaauaaa

SEQ ID NO: 3775458 - RNA, 16 nt, Human
cucuuuaaucuucagu

SEQ ID NO: 3775459 - RNA, 20 nt, Human
cucuuuaaugucacaggcag

SEQ ID NO: 3775460 - RNA, 15 nt, Human
cucuuuagaguuaga

SEQ ID NO: 3775461 - RNA, 21 nt, Human
cucuuuagaguuagacuguug

SEQ ID NO: 3775462 - RNA, 14 nt, Human
cucuuuauacagcu

SEQ ID NO: 3775463 - RNA, 13 nt, Human
cucuuuauagugc

SEQ ID NO: 3775464 - RNA, 14 nt, Human
cucuuuauuccuag

SEQ ID NO: 3775465 - RNA, 21 nt, Human
cucuuuauuccuaguugguga

SEQ ID NO: 3775466 - RNA, 14 nt, Human
cucuuuauugucug

SEQ ID NO: 3775467 - RNA, 20 nt, Human
cucuuuauugucuguaaauc

SEQ ID NO: 3775468 - RNA, 14 nt, Human
cucuuucacauugu

SEQ ID NO: 3775469 - RNA, 15 nt, Human
cucuuucacauuguu

SEQ ID NO: 3775470 - RNA, 16 nt, Human
cucuuucacauuguuu

SEQ ID NO: 3775471 - RNA, 11 nt, Human
cucuuucagcu

SEQ ID NO: 3775472 - RNA, 12 nt, Human
cucuuucagcuc

SEQ ID NO: 3775473 - RNA, 11 nt, Human
cucuuucagug

SEQ ID NO: 3775474 - RNA, 13 nt, Human
cucuuucauccac

SEQ ID NO: 3775475 - RNA, 17 nt, Human
cucuuucccacccagcc

SEQ ID NO: 3775476 - RNA, 19 nt, Human
cucuuucccacccagccug

SEQ ID NO: 3775477 - RNA, 16 nt, Human
cucuuucccuaggaaa

SEQ ID NO: 3775478 - RNA, 13 nt, Human
cucuuucccuucc

SEQ ID NO: 3775479 - RNA, 23 nt, Human
cucuuucccuuccaguuuauucc

SEQ ID NO: 3775480 - RNA, 16 nt, Human
cucuuuccuccuucca

SEQ ID NO: 3775481 - RNA, 22 nt, Human
cucuuuccuguuguuguuaaug

SEQ ID NO: 3775482 - RNA, 11 nt, Human
cucuuuccuug

SEQ ID NO: 3775483 - RNA, 13 nt, Human
cucuuuccuugcu

SEQ ID NO: 3775484 - RNA, 15 nt, Human
cucuuucucucccca

SEQ ID NO: 3775485 - RNA, 19 nt, Human
cucuuucucuccuuucuuu

SEQ ID NO: 3775486 - RNA, 12 nt, Human
cucuuucucugc

SEQ ID NO: 3775487 - RNA, 13 nt, Human
cucuuucucugcc

SEQ ID NO: 3775488 - RNA, 15 nt, Human
cucuuucucugccag

SEQ ID NO: 3775489 - RNA, 18 nt, Human
cucuuucucugccaguga

SEQ ID NO: 3775490 - RNA, 12 nt, Human
cucuuucucuuu

SEQ ID NO: 3775491 - RNA, 16 nt, Human
cucuuucugagugccu

SEQ ID NO: 3775492 - RNA, 17 nt, Human
cucuuucugagugccuu

SEQ ID NO: 3775493 - RNA, 14 nt, Human
cucuuucuguauau

SEQ ID NO: 3775494 - RNA, 15 nt, Human
cucuuucuguauaua

SEQ ID NO: 3775495 - RNA, 13 nt, Human
cucuuucuuccuu

SEQ ID NO: 3775496 - RNA, 17 nt, Human
cucuuucuuucaauaaa

SEQ ID NO: 3775497 - RNA, 13 nt, Human
cucuuugaaacaa

SEQ ID NO: 3775498 - RNA, 14 nt, Human
cucuuugaaugaca

SEQ ID NO: 3775499 - RNA, 23 nt, Human
cucuuugacaauuccuagauaaa

SEQ ID NO: 3775500 - RNA, 12 nt, Human
cucuuugagaaa

SEQ ID NO: 3775501 - RNA, 16 nt, Human
cucuuugauuauuugc

SEQ ID NO: 3775502 - RNA, 12 nt, Human
cucuuugccuca

SEQ ID NO: 3775503 - RNA, 13 nt, Human
cucuuugccucaa

SEQ ID NO: 3775504 - RNA, 13 nt, Human
cucuuugcugcag

SEQ ID NO: 3775505 - RNA, 17 nt, Human
cucuuugcugcagagaa

SEQ ID NO: 3775506 - RNA, 12 nt, Human
cucuuugcuuug

SEQ ID NO: 3775507 - RNA, 13 nt, Human
cucuuugcuuugc

SEQ ID NO: 3775508 - RNA, 18 nt, Human
cucuuugcuuugcuuucu

SEQ ID NO: 3775509 - RNA, 22 nt, Human
cucuuugcuuugcuuucugcuc

SEQ ID NO: 3775510 - RNA, 15 nt, Human
cucuuuggcagucua

SEQ ID NO: 3775511 - RNA, 18 nt, Human
cucuuuggcuccccugua

SEQ ID NO: 3775512 - RNA, 20 nt, Human
cucuuugggaauguuugucu

SEQ ID NO: 3775513 - RNA, 18 nt, Human
cucuuugggccuggcucc

SEQ ID NO: 3775514 - RNA, 17 nt, Human
cucuuuggggucagcca

SEQ ID NO: 3775515 - RNA, 16 nt, Human
cucuuugucuaaaaca

SEQ ID NO: 3775516 - RNA, 20 nt, Human
cucuuuguggcagaaguguu

SEQ ID NO: 3775517 - RNA, 20 nt, Human
cucuuuguggggcuuggcgu

SEQ ID NO: 3775518 - RNA, 18 nt, Human
cucuuuguuauuugaaaa

SEQ ID NO: 3775519 - RNA, 20 nt, Human
cucuuuguuuugugucucuu

SEQ ID NO: 3775520 - RNA, 14 nt, Human
cucuuuuacccugg

SEQ ID NO: 3775521 - RNA, 20 nt, Human
cucuuuuacccuggccccuc

SEQ ID NO: 3775522 - RNA, 14 nt, Human
cucuuuucaaaaca

SEQ ID NO: 3775523 - RNA, 14 nt, Human
cucuuuucaaugug

SEQ ID NO: 3775524 - RNA, 23 nt, Human
cucuuuuccacuccauugucgua

SEQ ID NO: 3775525 - RNA, 23 nt, Human
cugaagauauaacuauugcccag

SEQ ID NO: 3775526 - RNA, 16 nt, Human
cugaagaugaucauuu

SEQ ID NO: 3775527 - RNA, 22 nt, Human
cugaagaugcagcaaaauguga

SEQ ID NO: 3775528 - RNA, 16 nt, Human
cugaagaugcagcuca

SEQ ID NO: 3775529 - RNA, 15 nt, Human
cugaagcagccucuc

SEQ ID NO: 3775530 - RNA, 16 nt, Human
cugaagcagccucucc

SEQ ID NO: 3775531 - RNA, 21 nt, Human
cugaagcagguucccaagcuc

SEQ ID NO: 3775532 - RNA, 14 nt, Human
cugaagccagcugc

SEQ ID NO: 3775533 - RNA, 14 nt, Human
cugaagccauuguc

SEQ ID NO: 3775534 - RNA, 21 nt, Human
cugaagcccucccagguguua

SEQ ID NO: 3775535 - RNA, 18 nt, Human
cugaagccgccaggaccg

SEQ ID NO: 3775536 - RNA, 21 nt, Human
cugaagcuaucguaaaauuaa

SEQ ID NO: 3775537 - RNA, 20 nt, Human
cugaagcugacgaacuucca

SEQ ID NO: 3775538 - RNA, 18 nt, Human
cugaagcugccugcuuuu

SEQ ID NO: 3775539 - RNA, 14 nt, Human
cugaagcuuauuaa

SEQ ID NO: 3775540 - RNA, 23 nt, Human
cugaagcuuauuaaugcuaaggg

SEQ ID NO: 3775541 - RNA, 18 nt, Human
cugaagcuuuaccagcug

SEQ ID NO: 3775542 - RNA, 17 nt, Human
cugaaggaaaaacacaa

SEQ ID NO: 3775543 - RNA, 19 nt, Human
cugaaggacacuuccugcc

SEQ ID NO: 3775544 - RNA, 20 nt, Human
cugaaggacauugcggacag

SEQ ID NO: 3775545 - RNA, 23 nt, Human
cugaaggacauugcggacagcca

SEQ ID NO: 3775546 - RNA, 12 nt, Human
cugaaggacugu

SEQ ID NO: 3775547 - RNA, 21 nt, Human
cugaaggacugugacaggcag

SEQ ID NO: 3775548 - RNA, 16 nt, Human
cugaaggagauuuucc

SEQ ID NO: 3775549 - RNA, 21 nt, Human
cugaaggagauuuuccuuccu

SEQ ID NO: 3775550 - RNA, 13 nt, Human
cugaaggagcccc

SEQ ID NO: 3775551 - RNA, 15 nt, Human
cugaaggaggccacc

SEQ ID NO: 3775552 - RNA, 18 nt, Human
cugaaggaggccaccucc

SEQ ID NO: 3775553 - RNA, 18 nt, Human
cugaaggcagcauguaua

SEQ ID NO: 3775554 - RNA, 19 nt, Human
cugaaggcuaaaaagcaac

SEQ ID NO: 3775555 - RNA, 17 nt, Human
cugaagggaaucacauc

SEQ ID NO: 3775556 - RNA, 20 nt, Human
cugaagggcauucuuuccca

SEQ ID NO: 3775557 - RNA, 19 nt, Human
cugaaggggccaugauggc

SEQ ID NO: 3775558 - RNA, 15 nt, Human
cugaagggggcggcc

SEQ ID NO: 3775559 - RNA, 20 nt, Human
cugaagggggcggccuauga

SEQ ID NO: 3775560 - RNA, 16 nt, Human
cugaagggguuuucuu

SEQ ID NO: 3775561 - RNA, 18 nt, Human
cugaagggguuuucuuga

SEQ ID NO: 3775562 - RNA, 21 nt, Human
cugaaggguugacuuuaccca

SEQ ID NO: 3775563 - RNA, 22 nt, Human
cugaaggugaaacauuuucucc

SEQ ID NO: 3775564 - RNA, 15 nt, Human
cugaagguugaagag

SEQ ID NO: 3775565 - RNA, 21 nt, Human
cugaaguaaaacaaacaauac

SEQ ID NO: 3775566 - RNA, 17 nt, Human
cugaagucacacaguga

SEQ ID NO: 3775567 - RNA, 18 nt, Human
cugaagucacacagugag

SEQ ID NO: 3775568 - RNA, 21 nt, Human
cugaagucacacagugagucg

SEQ ID NO: 3775569 - RNA, 15 nt, Human
cugaagucacugcac

SEQ ID NO: 3775570 - RNA, 22 nt, Human
cugaagucccagauacuugggg

SEQ ID NO: 3775571 - RNA, 13 nt, Human
cugaagucugaaa

SEQ ID NO: 3775572 - RNA, 17 nt, Human
cugaagucuuuguacag

SEQ ID NO: 3775573 - RNA, 20 nt, Human
cugaagucuuuguacagaca

SEQ ID NO: 3775574 - RNA, 13 nt, Human
cugaagugaaacu

SEQ ID NO: 3775575 - RNA, 18 nt, Human
cugaagugagcacagccu

SEQ ID NO: 3775576 - RNA, 14 nt, Human
cugaagugcaucca

SEQ ID NO: 3775577 - RNA, 22 nt, Human
cugaagugcauccaaaggugcu

SEQ ID NO: 3775578 - RNA, 15 nt, Human
cugaaguggacucuu

SEQ ID NO: 3775579 - RNA, 16 nt, Human
cugaaguuaacagaga

SEQ ID NO: 3775580 - RNA, 17 nt, Human
cugaaguuauauuuccu

SEQ ID NO: 3775581 - RNA, 14 nt, Human
cugaaguucaccau

SEQ ID NO: 3775582 - RNA, 19 nt, Human
cugaaguucagccacccug

SEQ ID NO: 3775583 - RNA, 20 nt, Human
cugaaguucugccucugaug

SEQ ID NO: 3775584 - RNA, 23 nt, Human
cugaaguucugccucugauguau

SEQ ID NO: 3775585 - RNA, 22 nt, Human
cugaaguuggagugaguguggc

SEQ ID NO: 3775586 - RNA, 13 nt, Human
cugaaguuucaca

SEQ ID NO: 3775587 - RNA, 21 nt, Human
cugaaguuugauaaauagugu

SEQ ID NO: 3775588 - RNA, 12 nt, Human
cugaauaaaugu

SEQ ID NO: 3775589 - RNA, 16 nt, Human
cugaauacaaagugau

SEQ ID NO: 3775590 - RNA, 18 nt, Human
cugaauacauucugcuuu

SEQ ID NO: 3775591 - RNA, 18 nt, Human
cugaauaccacucuguaa

SEQ ID NO: 3775592 - RNA, 20 nt, Human
cugaauaccacucuguaauu

SEQ ID NO: 3775593 - RNA, 16 nt, Human
cugaauaccaguggag

SEQ ID NO: 3775594 - RNA, 20 nt, Human
cugaauaccucuuugaaaga

SEQ ID NO: 3775595 - RNA, 15 nt, Human
cugaauagaaauggg

SEQ ID NO: 3775596 - RNA, 23 nt, Human
cugaauagcucccagauuucagu

SEQ ID NO: 3775597 - RNA, 23 nt, Human
cugaauaggcgaucacaacgugc

SEQ ID NO: 3775598 - RNA, 21 nt, Human
cugaauauuuauauuucacua

SEQ ID NO: 3775599 - RNA, 17 nt, Human
cugaauccaaaagaaaa

SEQ ID NO: 3775600 - RNA, 19 nt, Human
cugaauccaaaagaaaaac

SEQ ID NO: 3775601 - RNA, 20 nt, Human
cugaaucccccuugccaccc

SEQ ID NO: 3775602 - RNA, 21 nt, Human
cugaaucccccuugccacccc

SEQ ID NO: 3775603 - RNA, 17 nt, Human
cugaaucugcuaccaaa

SEQ ID NO: 3775604 - RNA, 15 nt, Human
cugaaucuguacaga

SEQ ID NO: 3775605 - RNA, 19 nt, Human
cugaaugaaacccccacac

SEQ ID NO: 3775606 - RNA, 22 nt, Human
cugaaugaaccuucuggccucc

SEQ ID NO: 3775607 - RNA, 20 nt, Human
cugaaugaggucagcauguc

SEQ ID NO: 3775608 - RNA, 21 nt, Human
cugaaugccgcgaugggucag

SEQ ID NO: 3775609 - RNA, 22 nt, Human
cugaaugccucaaugugaccag

SEQ ID NO: 3775610 - RNA, 17 nt, Human
cugaaugccuccugugg

SEQ ID NO: 3775611 - RNA, 18 nt, Human
cugaaugccuccuguggg

SEQ ID NO: 3775612 - RNA, 19 nt, Human
cugaaugccuccugugggg

SEQ ID NO: 3775613 - RNA, 20 nt, Human
cugaaugccuccugugggga

SEQ ID NO: 3775614 - RNA, 13 nt, Human
cugaaugcuucua

SEQ ID NO: 3775615 - RNA, 15 nt, Human
cugaaugcuucuaag

SEQ ID NO: 3775616 - RNA, 16 nt, Human
cugaaugguccagggu

SEQ ID NO: 3775617 - RNA, 13 nt, Human
cugaauguaauuu

SEQ ID NO: 3775618 - RNA, 15 nt, Human
cugaauguaauuugu

SEQ ID NO: 3775619 - RNA, 18 nt, Human
cugaauguaauuugugua

SEQ ID NO: 3775620 - RNA, 15 nt, Human
cugaauguauguaaa

SEQ ID NO: 3775621 - RNA, 14 nt, Human
cugaauguucugac

SEQ ID NO: 3775622 - RNA, 19 nt, Human
cugaauguucugacauuaa

SEQ ID NO: 3775623 - RNA, 15 nt, Human
cugaauguugggacu

SEQ ID NO: 3775624 - RNA, 15 nt, Human
cugaauguuuuucua

SEQ ID NO: 3775625 - RNA, 16 nt, Human
cugaauuaauuaauuu

SEQ ID NO: 3775626 - RNA, 17 nt, Human
cugaauuaguccuugcu

SEQ ID NO: 3775627 - RNA, 18 nt, Human
cugaauuaguccuugcuu

SEQ ID NO: 3775628 - RNA, 20 nt, Human
cugaauuaguccuugcuugg

SEQ ID NO: 3775629 - RNA, 14 nt, Human
cugaauuauaagag

SEQ ID NO: 3775630 - RNA, 18 nt, Human
cugaauuaucuauuucau

SEQ ID NO: 3775631 - RNA, 17 nt, Human
cugaauucuauuugcug

SEQ ID NO: 3775632 - RNA, 23 nt, Human
cugaauucuauuugcugggcuuu

SEQ ID NO: 3775633 - RNA, 18 nt, Human
cugaauuuaaauagcuuu

SEQ ID NO: 3775634 - RNA, 14 nt, Human
cugaauuuaucuuu

SEQ ID NO: 3775635 - RNA, 16 nt, Human
cugaauuuaucuuuga

SEQ ID NO: 3775636 - RNA, 20 nt, Human
cugaauuuaucuuugauaac

SEQ ID NO: 3775637 - RNA, 14 nt, Human
cugaauuucuuuug

SEQ ID NO: 3775638 - RNA, 14 nt, Human
cugaauuugcaaag

SEQ ID NO: 3775639 - RNA, 16 nt, Human
cugaauuugcaaagua

SEQ ID NO: 3775640 - RNA, 19 nt, Human
cugaauuugcaaaguacug

SEQ ID NO: 3775641 - RNA, 18 nt, Human
cugaauuugcccugggaa

SEQ ID NO: 3775642 - RNA, 12 nt, Human
cugaauuuggag

SEQ ID NO: 3775643 - RNA, 13 nt, Human
cugaauuuucaca

SEQ ID NO: 3775644 - RNA, 20 nt, Human
cugaauuuuggggauuuuca

SEQ ID NO: 3775645 - RNA, 12 nt, Human
cugaauuuuuaa

SEQ ID NO: 3775646 - RNA, 18 nt, Human
cugaauuuuuaaacaagu

SEQ ID NO: 3775647 - RNA, 21 nt, Human
cugaauuuuuaaacaaguauu

SEQ ID NO: 3775648 - RNA, 16 nt, Human
cugaauuuuuuuguaa

SEQ ID NO: 3775649 - RNA, 18 nt, Human
cugaauuuuuuuguaaua

SEQ ID NO: 3775650 - RNA, 23 nt, Human
cugaauuuuuuuguaauaagcaa

SEQ ID NO: 3775651 - RNA, 15 nt, Human
cugacaaaucaaguu

SEQ ID NO: 3775652 - RNA, 14 nt, Human
cugacaaauuuuaa

SEQ ID NO: 3775653 - RNA, 17 nt, Human
cugacaaauuuuaauua

SEQ ID NO: 3775654 - RNA, 22 nt, Human
cugacaacauuucuauagccaa

SEQ ID NO: 3775655 - RNA, 22 nt, Human
cugacaaccaccgcuccccagc

SEQ ID NO: 3775656 - RNA, 18 nt, Human
cugacaaccauuaaaguc

SEQ ID NO: 3775657 - RNA, 13 nt, Human
cugacaagcucca

SEQ ID NO: 3775658 - RNA, 22 nt, Human
cugacaagggcugaccugccuc

SEQ ID NO: 3775659 - RNA, 19 nt, Human
cugacacaaaccugccugg

SEQ ID NO: 3775660 - RNA, 12 nt, Human
cugacacaaagg

SEQ ID NO: 3775661 - RNA, 19 nt, Human
cugacacacagcucugucc

SEQ ID NO: 3775662 - RNA, 20 nt, Human
cugacacacagcucuguccu

SEQ ID NO: 3775663 - RNA, 21 nt, Human
cugacacaccugcagccuccc

SEQ ID NO: 3775664 - RNA, 13 nt, Human
cugacacacuaac

SEQ ID NO: 3775665 - RNA, 18 nt, Human
cugacacaggaugaaggc

SEQ ID NO: 3775666 - RNA, 21 nt, Human
cugacacaugcugaacaucac

SEQ ID NO: 3775667 - RNA, 13 nt, Human
cugacacccaugu

SEQ ID NO: 3775668 - RNA, 21 nt, Human
cugacacccuucucccacucu

SEQ ID NO: 3775669 - RNA, 22 nt, Human
cugacuauucuugauguaaaau

SEQ ID NO: 3775670 - RNA, 17 nt, Human
cugacucacaagaagac

SEQ ID NO: 3775671 - RNA, 12 nt, Human
cugacucagggc

SEQ ID NO: 3775672 - RNA, 14 nt, Human
cugacucagggcuc

SEQ ID NO: 3775673 - RNA, 18 nt, Human
cugacucagggcuccugg

SEQ ID NO: 3775674 - RNA, 16 nt, Human
cugacucauucugaag

SEQ ID NO: 3775675 - RNA, 21 nt, Human
cugacucccaaagagcugccu

SEQ ID NO: 3775676 - RNA, 22 nt, Human
cugacucccaaagagcugccua

SEQ ID NO: 3775677 - RNA, 20 nt, Human
cugacuccuaccugcccugg

SEQ ID NO: 3775678 - RNA, 21 nt, Human
cugacuccuaccugcccugga

SEQ ID NO: 3775679 - RNA, 15 nt, Human
cugacuccuuagaga

SEQ ID NO: 3775680 - RNA, 15 nt, Human
cugacucgguuucuc

SEQ ID NO: 3775681 - RNA, 18 nt, Human
cugacucgguuucuccaa

SEQ ID NO: 3775682 - RNA, 20 nt, Human
cugacucgucugacugugug

SEQ ID NO: 3775683 - RNA, 21 nt, Human
cugacucgucugacugugugu

SEQ ID NO: 3775684 - RNA, 13 nt, Human
cugacucucugug

SEQ ID NO: 3775685 - RNA, 18 nt, Human
cugacucucugugaccug

SEQ ID NO: 3775686 - RNA, 14 nt, Human
cugacucugaaauc

SEQ ID NO: 3775687 - RNA, 17 nt, Human
cugacucugaaaucuga

SEQ ID NO: 3775688 - RNA, 20 nt, Human
cugacucugcccccugcugg

SEQ ID NO: 3775689 - RNA, 14 nt, Human
cugacucuucccca

SEQ ID NO: 3775690 - RNA, 11 nt, Human
cugacugaggc

SEQ ID NO: 3775691 - RNA, 14 nt, Human
cugacugaggcagu

SEQ ID NO: 3775692 - RNA, 19 nt, Human
cugacugauguugagggaa

SEQ ID NO: 3775693 - RNA, 15 nt, Human
cugacugccaagcca

SEQ ID NO: 3775694 - RNA, 18 nt, Human
cugacugccaagccaugg

SEQ ID NO: 3775695 - RNA, 22 nt, Human
cugacuggugcuauaggcugga

SEQ ID NO: 3775696 - RNA, 20 nt, Human
cugacugguuaacagcaguc

SEQ ID NO: 3775697 - RNA, 19 nt, Human
cugacuguaacauauucug

SEQ ID NO: 3775698 - RNA, 13 nt, Human
cugacuguagcuu

SEQ ID NO: 3775699 - RNA, 18 nt, Human
cugacugucacaacuccu

SEQ ID NO: 3775700 - RNA, 13 nt, Human
cugacuguccucu

SEQ ID NO: 3775701 - RNA, 16 nt, Human
cugacuguuuucucuu

SEQ ID NO: 3775702 - RNA, 19 nt, Human
cugacuucaggggcugccc

SEQ ID NO: 3775703 - RNA, 23 nt, Human
cugacuucaucucccaccuagca

SEQ ID NO: 3775704 - RNA, 22 nt, Human
cugacuucauggaauggacauc

SEQ ID NO: 3775705 - RNA, 16 nt, Human
cugacuucuaaguaaa

SEQ ID NO: 3775706 - RNA, 12 nt, Human
cugacuucugcc

SEQ ID NO: 3775707 - RNA, 13 nt, Human
cugacuucugccu

SEQ ID NO: 3775708 - RNA, 14 nt, Human
cugacuucugccug

SEQ ID NO: 3775709 - RNA, 18 nt, Human
cugacuucugccuggaga

SEQ ID NO: 3775710 - RNA, 12 nt, Human
cugacuugggga

SEQ ID NO: 3775711 - RNA, 15 nt, Human
cugacuuguuugucu

SEQ ID NO: 3775712 - RNA, 13 nt, Human
cugacuuuacacu

SEQ ID NO: 3775713 - RNA, 16 nt, Human
cugacuuugcucuuuc

SEQ ID NO: 3775714 - RNA, 18 nt, Human
cugacuuugcucuuucuu

SEQ ID NO: 3775715 - RNA, 21 nt, Human
cugacuuuuaaugucauuugu

SEQ ID NO: 3775716 - RNA, 22 nt, Human
cugagaaaacgaaacugcucua

SEQ ID NO: 3775717 - RNA, 10 nt, Human
cugagaaaag

SEQ ID NO: 3775718 - RNA, 13 nt, Human
cugagaaaagaac

SEQ ID NO: 3775719 - RNA, 20 nt, Human
cugagaaagacuauucaaac

SEQ ID NO: 3775720 - RNA, 14 nt, Human
cugagaaauuuaua

SEQ ID NO: 3775721 - RNA, 17 nt, Human
cugagaacacugugaaa

SEQ ID NO: 3775722 - RNA, 17 nt, Human
cugagaacccugcgugg

SEQ ID NO: 3775723 - RNA, 18 nt, Human
cugagaacccugcguggg

SEQ ID NO: 3775724 - RNA, 22 nt, Human
cugagaacccugcguggggaca

SEQ ID NO: 3775725 - RNA, 18 nt, Human
cugagaaccuggccuuca

SEQ ID NO: 3775726 - RNA, 19 nt, Human
cugagaaccuggccuucag

SEQ ID NO: 3775727 - RNA, 16 nt, Human
cugagaacuccugacu

SEQ ID NO: 3775728 - RNA, 23 nt, Human
cugagaagagagaucaaauggaa

SEQ ID NO: 3775729 - RNA, 16 nt, Human
cugagaagcucugaag

SEQ ID NO: 3775730 - RNA, 14 nt, Human
cugagaagcugcuc

SEQ ID NO: 3775731 - RNA, 15 nt, Human
cugagaagcugcucc

SEQ ID NO: 3775732 - RNA, 16 nt, Human
cugagaaggggaggac

SEQ ID NO: 3775733 - RNA, 21 nt, Human
cugagaaggggaggaccucug

SEQ ID NO: 3775734 - RNA, 23 nt, Human
cugagaagguccuuaaugauccg

SEQ ID NO: 3775735 - RNA, 15 nt, Human
cugagaauaagaaag

SEQ ID NO: 3775736 - RNA, 15 nt, Human
cugagaauagaagga

SEQ ID NO: 3775737 - RNA, 16 nt, Human
cugagaauagaaggaa

SEQ ID NO: 3775738 - RNA, 16 nt, Human
cugagaaucagacuga

SEQ ID NO: 3775739 - RNA, 20 nt, Human
cugagacaaauggaggccug

SEQ ID NO: 3775740 - RNA, 18 nt, Human
cugagacagcccgggcuc

SEQ ID NO: 3775741 - RNA, 21 nt, Human
cugagacagcccgggcucugc

SEQ ID NO: 3775742 - RNA, 23 nt, Human
cugagacagcccgggcucugccu

SEQ ID NO: 3775743 - RNA, 13 nt, Human
cugagacaggaga

SEQ ID NO: 3775744 - RNA, 16 nt, Human
cugagacagugaauuu

SEQ ID NO: 3775745 - RNA, 22 nt, Human
cugagaccaaggcuuucucuac

SEQ ID NO: 3775746 - RNA, 14 nt, Human
cugagacccaggac

SEQ ID NO: 3775747 - RNA, 16 nt, Human
cugagacgucaugagg

SEQ ID NO: 3775748 - RNA, 18 nt, Human
cugagacuaaucuuauuc

SEQ ID NO: 3775749 - RNA, 17 nt, Human
cugagacucagacagga

SEQ ID NO: 3775750 - RNA, 15 nt, Human
cugagacuccagacc

SEQ ID NO: 3775751 - RNA, 18 nt, Human
cugagacuccagaccuga

SEQ ID NO: 3775752 - RNA, 19 nt, Human
cugagacuccggggagcgc

SEQ ID NO: 3775753 - RNA, 21 nt, Human
cugagacuuucagugcacugu

SEQ ID NO: 3775754 - RNA, 19 nt, Human
cugagacuuucuuucugua

SEQ ID NO: 3775755 - RNA, 18 nt, Human
cugagagaauuggcucaa

SEQ ID NO: 3775756 - RNA, 17 nt, Human
cugagagacccaaggag

SEQ ID NO: 3775757 - RNA, 20 nt, Human
cugagagacccaaggaggaa

SEQ ID NO: 3775758 - RNA, 18 nt, Human
cugagagacuuuuaauca

SEQ ID NO: 3775759 - RNA, 14 nt, Human
cugagagaggccau

SEQ ID NO: 3775760 - RNA, 21 nt, Human
cugagagaggccauucuuucc

SEQ ID NO: 3775761 - RNA, 19 nt, Human
cugagagaggcuaaaaugu

SEQ ID NO: 3775762 - RNA, 20 nt, Human
cugagagaggcuaaaauguu

SEQ ID NO: 3775763 - RNA, 23 nt, Human
cugagagaggcuaaaauguuuuc

SEQ ID NO: 3775764 - RNA, 24 nt, Human
cugagagaguggcauuggcagcag

SEQ ID NO: 3775765 - RNA, 19 nt, Human
cugagagaugcagaaauau

SEQ ID NO: 3775766 - RNA, 17 nt, Human
cugagagcaaagugacc

SEQ ID NO: 3775767 - RNA, 22 nt, Human
cugagagcaucaggccuagagg

SEQ ID NO: 3775768 - RNA, 13 nt, Human
cugagagccccag

SEQ ID NO: 3775769 - RNA, 14 nt, Human
cugagagccccagc

SEQ ID NO: 3775770 - RNA, 15 nt, Human
cugagagccccagcu

SEQ ID NO: 3775771 - RNA, 17 nt, Human
cugagaggacagagaga

SEQ ID NO: 3775772 - RNA, 12 nt, Human
cugagaggcagg

SEQ ID NO: 3775773 - RNA, 14 nt, Human
cugagaggcaggca

SEQ ID NO: 3775774 - RNA, 17 nt, Human
cugagaggcaggcauag

SEQ ID NO: 3775775 - RNA, 14 nt, Human
cugagagucuagau

SEQ ID NO: 3775776 - RNA, 22 nt, Human
cugagagucuagauucucuggc

SEQ ID NO: 3775777 - RNA, 15 nt, Human
cugagagugucucug

SEQ ID NO: 3775778 - RNA, 15 nt, Human
cugagaguuuaguug

SEQ ID NO: 3775779 - RNA, 23 nt, Human
cugagauaugaacauauuguuga

SEQ ID NO: 3775780 - RNA, 14 nt, Human
cugagauccccuga

SEQ ID NO: 3775781 - RNA, 21 nt, Human
cugagauccccugagccccag

SEQ ID NO: 3775782 - RNA, 17 nt, Human
cugagauccuggacuga

SEQ ID NO: 3775783 - RNA, 19 nt, Human
cugagaucgugcuacugca

SEQ ID NO: 3775784 - RNA, 13 nt, Human
cugagauggcucc

SEQ ID NO: 3775785 - RNA, 13 nt, Human
cugagauucuuca

SEQ ID NO: 3775786 - RNA, 18 nt, Human
cugagauuuauuaaagaa

SEQ ID NO: 3775787 - RNA, 15 nt, Human
cugagauuucaucug

SEQ ID NO: 3775788 - RNA, 22 nt, Human
cugagauuucaucugcucuccu

SEQ ID NO: 3775789 - RNA, 12 nt, Human
cugagcaaagca

SEQ ID NO: 3775790 - RNA, 15 nt, Human
cugagcaaauguggc

SEQ ID NO: 3775791 - RNA, 17 nt, Human
cugagcaaauguggcuc

SEQ ID NO: 3775792 - RNA, 23 nt, Human
cugagcaacagagugagacccug

SEQ ID NO: 3775793 - RNA, 14 nt, Human
cugagcaagagcug

SEQ ID NO: 3775794 - RNA, 19 nt, Human
cugagcaaugucugugcua

SEQ ID NO: 3775795 - RNA, 13 nt, Human
cugagcacagaug

SEQ ID NO: 3775796 - RNA, 13 nt, Human
cugagcaccaggg

SEQ ID NO: 3775797 - RNA, 13 nt, Human
cugagcaccuccc

SEQ ID NO: 3775798 - RNA, 23 nt, Human
cugagcaccugcuucaugcucag

SEQ ID NO: 3775799 - RNA, 14 nt, Human
cugagcacugccag

SEQ ID NO: 3775800 - RNA, 19 nt, Human
cugagcacugccaggaggg

SEQ ID NO: 3775801 - RNA, 22 nt, Human
cugagcacugccaggagggaca

SEQ ID NO: 3775802 - RNA, 16 nt, Human
cugagcacuggagugg

SEQ ID NO: 3775803 - RNA, 12 nt, Human
cugagcacuguu

SEQ ID NO: 3775804 - RNA, 15 nt, Human
cugagcacuguuuuc

SEQ ID NO: 3775805 - RNA, 16 nt, Human
cugagcagacugguga

SEQ ID NO: 3775806 - RNA, 17 nt, Human
cugagcagacuggugag

SEQ ID NO: 3775807 - RNA, 22 nt, Human
cugagcagacuggugagcagac

SEQ ID NO: 3775808 - RNA, 22 nt, Human
cugagcagagucuugcuaccuc

SEQ ID NO: 3775809 - RNA, 23 nt, Human
cugagcagagucuugcuaccuca

SEQ ID NO: 3775810 - RNA, 18 nt, Human
cugagcagcgagccugcu

SEQ ID NO: 3775811 - RNA, 13 nt, Human
cugagcagggaga

SEQ ID NO: 3775812 - RNA, 13 nt, Human
cugagcagggccg

SEQ ID NO: 3775813 - RNA, 17 nt, Human
cugagcaguccuuggcc

SEQ ID NO: 3775814 - RNA, 14 nt, Human
cugcuagcuagcuc

SEQ ID NO: 3775815 - RNA, 20 nt, Human
cugcuagcuagcucaacuag

SEQ ID NO: 3775816 - RNA, 12 nt, Human
cugcuaggccag

SEQ ID NO: 3775817 - RNA, 16 nt, Human
cugcuaggccagagcc

SEQ ID NO: 3775818 - RNA, 19 nt, Human
cugcuaggccagagcccac

SEQ ID NO: 3775819 - RNA, 23 nt, Human
cugcuaggugggccagccccucc

SEQ ID NO: 3775820 - RNA, 20 nt, Human
cugcuauccccaucucccug

SEQ ID NO: 3775821 - RNA, 23 nt, Human
cugcuauccccaucucccugccu

SEQ ID NO: 3775822 - RNA, 15 nt, Human
cugcuaugcuugaau

SEQ ID NO: 3775823 - RNA, 21 nt, Human
cugcuauuaggccagcaagcg

SEQ ID NO: 3775824 - RNA, 17 nt, Human
cugcuauuuauuuuccu

SEQ ID NO: 3775825 - RNA, 20 nt, Human
cugcuauuuuacugucuuaa

SEQ ID NO: 3775826 - RNA, 21 nt, Human
cugcuauuuuacugucuuaau

SEQ ID NO: 3775827 - RNA, 20 nt, Human
cugcucaagaagacauggag

SEQ ID NO: 3775828 - RNA, 23 nt, Human
cugcucaagaagacauggagacu

SEQ ID NO: 3775829 - RNA, 15 nt, Human
cugcucaauacaucu

SEQ ID NO: 3775830 - RNA, 20 nt, Human
cugcucaccgcccaucaggg

SEQ ID NO: 3775831 - RNA, 23 nt, Human
cugcucaccgcccaucaggguuc

SEQ ID NO: 3775832 - RNA, 12 nt, Human
cugcucacugca

SEQ ID NO: 3775833 - RNA, 13 nt, Human
cugcucagacaga

SEQ ID NO: 3775834 - RNA, 23 nt, Human
cugcucagaucccacuuuugcca

SEQ ID NO: 3775835 - RNA, 18 nt, Human
cugcucagcaaccuuuca

SEQ ID NO: 3775836 - RNA, 15 nt, Human
cugcucagccaagcu

SEQ ID NO: 3775837 - RNA, 12 nt, Human
cugcucagcccu

SEQ ID NO: 3775838 - RNA, 16 nt, Human
cugcucagcccuggag

SEQ ID NO: 3775839 - RNA, 14 nt, Human
cugcucagcucugg

SEQ ID NO: 3775840 - RNA, 15 nt, Human
cugcucagcuucucc

SEQ ID NO: 3775841 - RNA, 16 nt, Human
cugcucagcuucuccu

SEQ ID NO: 3775842 - RNA, 22 nt, Human
cugcucagggaaaagcagcucu

SEQ ID NO: 3775843 - RNA, 23 nt, Human
cugcucagggaaaagcagcucuc

SEQ ID NO: 3775844 - RNA, 16 nt, Human
cugcucaucauucucu

SEQ ID NO: 3775845 - RNA, 18 nt, Human
cugcucaucauucucugu

SEQ ID NO: 3775846 - RNA, 13 nt, Human
cugcucauccacu

SEQ ID NO: 3775847 - RNA, 23 nt, Human
cugcuccaaccgggaugggagcc

SEQ ID NO: 3775848 - RNA, 13 nt, Human
cugcuccaccaca

SEQ ID NO: 3775849 - RNA, 13 nt, Human
cugcuccacccuu

SEQ ID NO: 3775850 - RNA, 15 nt, Human
cugcuccacccuugg

SEQ ID NO: 3775851 - RNA, 16 nt, Human
cugcuccacccuuggc

SEQ ID NO: 3775852 - RNA, 21 nt, Human
cugcuccaccuuucagcccac

SEQ ID NO: 3775853 - RNA, 24 nt, Human
cugcuccaccuuucagcccacguc

SEQ ID NO: 3775854 - RNA, 21 nt, Human
cugcuccagaauuuggaaauc

SEQ ID NO: 3775855 - RNA, 22 nt, Human
cugcuccagaauuuggaaaucc

SEQ ID NO: 3775856 - RNA, 14 nt, Human
cugcuccagaccug

SEQ ID NO: 3775857 - RNA, 15 nt, Human
cugcuccagcuguuc

SEQ ID NO: 3775858 - RNA, 13 nt, Human
cugcuccaggccu

SEQ ID NO: 3775859 - RNA, 12 nt, Human
cugcucccaagg

SEQ ID NO: 3775860 - RNA, 17 nt, Human
cugcucccaaggggccu

SEQ ID NO: 3775861 - RNA, 18 nt, Human
cugcucccaaggggccug

SEQ ID NO: 3775862 - RNA, 23 nt, Human
cugcucccaaggggccugagcag

SEQ ID NO: 3775863 - RNA, 17 nt, Human
cugcucccaccuccuga

SEQ ID NO: 3775864 - RNA, 17 nt, Human
cugcucccaccuggcuc

SEQ ID NO: 3775865 - RNA, 21 nt, Human
cugcucccagcagcccuaagg

SEQ ID NO: 3775866 - RNA, 19 nt, Human
cugcuccccagcccuggcu

SEQ ID NO: 3775867 - RNA, 14 nt, Human
cugcucccccaccc

SEQ ID NO: 3775868 - RNA, 21 nt, Human
cugcucccccacccccucccc

SEQ ID NO: 3775869 - RNA, 17 nt, Human
cugcucccccuuuuccc

SEQ ID NO: 3775870 - RNA, 13 nt, Human
cugcucccuaagc

SEQ ID NO: 3775871 - RNA, 20 nt, Human
cugcucccuaagccagccug

SEQ ID NO: 3775872 - RNA, 21 nt, Human
cugcucccuaagccagccugg

SEQ ID NO: 3775873 - RNA, 14 nt, Human
cugcucccucagac

SEQ ID NO: 3775874 - RNA, 22 nt, Human
cugcucccuccgggucuuccua

SEQ ID NO: 3775875 - RNA, 20 nt, Human
cugcucccucucccccuuac

SEQ ID NO: 3775876 - RNA, 14 nt, Human
cugcucccugaagc

SEQ ID NO: 3775877 - RNA, 19 nt, Human
cugcucccugaagccagcc

SEQ ID NO: 3775878 - RNA, 15 nt, Human
cugcuccgcugcucc

SEQ ID NO: 3775879 - RNA, 17 nt, Human
cugcuccgcugcuccuu

SEQ ID NO: 3775880 - RNA, 18 nt, Human
cugcuccgcugcuccuug

SEQ ID NO: 3775881 - RNA, 15 nt, Human
cugcuccguggagga

SEQ ID NO: 3775882 - RNA, 23 nt, Human
cugcuccguggaggagguuggga

SEQ ID NO: 3775883 - RNA, 14 nt, Human
cugcuccuagaggg

SEQ ID NO: 3775884 - RNA, 17 nt, Human
cugcuccuagagggagg

SEQ ID NO: 3775885 - RNA, 11 nt, Human
cugcuccucca

SEQ ID NO: 3775886 - RNA, 12 nt, Human
cugcuccucccu

SEQ ID NO: 3775887 - RNA, 16 nt, Human
cugcuccucccuggcu

SEQ ID NO: 3775888 - RNA, 22 nt, Human
cugcuccucccuggcugcccug

SEQ ID NO: 3775889 - RNA, 23 nt, Human
cugcuccucccuggcugcccugg

SEQ ID NO: 3775890 - RNA, 14 nt, Human
cugcuccucuccag

SEQ ID NO: 3775891 - RNA, 16 nt, Human
cugcuccucuccaggc

SEQ ID NO: 3775892 - RNA, 16 nt, Human
cugcuccucuccccag

SEQ ID NO: 3775893 - RNA, 18 nt, Human
cugcuccucuccccagca

SEQ ID NO: 3775894 - RNA, 14 nt, Human
cugcuccugagccc

SEQ ID NO: 3775895 - RNA, 18 nt, Human
cugcuccugagcccccag

SEQ ID NO: 3775896 - RNA, 13 nt, Human
cugcuccugcagc

SEQ ID NO: 3775897 - RNA, 15 nt, Human
cugcuccuggagccu

SEQ ID NO: 3775898 - RNA, 19 nt, Human
cugcuccuggagccuuuga

SEQ ID NO: 3775899 - RNA, 20 nt, Human
cugcuccuuagcugccaagc

SEQ ID NO: 3775900 - RNA, 12 nt, Human
cugcuccuuccc

SEQ ID NO: 3775901 - RNA, 14 nt, Human
cugcuccuucccca

SEQ ID NO: 3775902 - RNA, 15 nt, Human
cugcucgcccuccuu

SEQ ID NO: 3775903 - RNA, 18 nt, Human
cugcucgcccuccuuucu

SEQ ID NO: 3775904 - RNA, 22 nt, Human
cugcucgcccuccuuucugugc

SEQ ID NO: 3775905 - RNA, 15 nt, Human
cugcucgccuuagca

SEQ ID NO: 3775906 - RNA, 15 nt, Human
cugcucgggcccagg

SEQ ID NO: 3775907 - RNA, 22 nt, Human
cugcucggggugcacaggaggg

SEQ ID NO: 3775908 - RNA, 18 nt, Human
cugcucguccccaaguga

SEQ ID NO: 3775909 - RNA, 21 nt, Human
cugcucguccccaagugaccu

SEQ ID NO: 3775910 - RNA, 20 nt, Human
cugcucuagaugagcugggc

SEQ ID NO: 3775911 - RNA, 22 nt, Human
cugcucuagaugagcugggccg

SEQ ID NO: 3775912 - RNA, 16 nt, Human
cugcucuagugggaca

SEQ ID NO: 3775913 - RNA, 21 nt, Human
cugcucuauuccaaaaagguu

SEQ ID NO: 3775914 - RNA, 15 nt, Human
cugcucuauuguagc

SEQ ID NO: 3775915 - RNA, 23 nt, Human
cugcucuauuguagcauuucuug

SEQ ID NO: 3775916 - RNA, 15 nt, Human
cugcucuccgaccag

SEQ ID NO: 3775917 - RNA, 14 nt, Human
cugcucuccucuuc

SEQ ID NO: 3775918 - RNA, 15 nt, Human
cugcucuccuuccug

SEQ ID NO: 3775919 - RNA, 17 nt, Human
cugcucuccuuccugga

SEQ ID NO: 3775920 - RNA, 22 nt, Human
cugcucucuacccagcccaucu

SEQ ID NO: 3775921 - RNA, 20 nt, Human
cugcucucuuuuucuccagg

SEQ ID NO: 3775922 - RNA, 12 nt, Human
cugcucugagaa

SEQ ID NO: 3775923 - RNA, 13 nt, Human
cugcucugaggcu

SEQ ID NO: 3775924 - RNA, 23 nt, Human
cugcucugaguuauguuaaaauc

SEQ ID NO: 3775925 - RNA, 12 nt, Human
cugcucugauga

SEQ ID NO: 3775926 - RNA, 20 nt, Human
cugcucugaugaagaggagu

SEQ ID NO: 3775927 - RNA, 12 nt, Human
cugcucugaugc

SEQ ID NO: 3775928 - RNA, 12 nt, Human
cugcucugccca

SEQ ID NO: 3775929 - RNA, 14 nt, Human
cugcucugcccaga

SEQ ID NO: 3775930 - RNA, 23 nt, Human
cugcucugcccagagcuggguga

SEQ ID NO: 3775931 - RNA, 13 nt, Human
cugcucugcccca

SEQ ID NO: 3775932 - RNA, 20 nt, Human
cugcucugcgugucaccugu

SEQ ID NO: 3775933 - RNA, 15 nt, Human
cugcucugcucgccu

SEQ ID NO: 3775934 - RNA, 12 nt, Human
cugcucugguua

SEQ ID NO: 3775935 - RNA, 22 nt, Human
cugcucugguuguuucuguucc

SEQ ID NO: 3775936 - RNA, 15 nt, Human
cugcucugugcccac

SEQ ID NO: 3775937 - RNA, 16 nt, Human
cugcucuuggcuggac

SEQ ID NO: 3775938 - RNA, 21 nt, Human
cugcucuuggcuggacccagc

SEQ ID NO: 3775939 - RNA, 22 nt, Human
cugcucuuggcuggacccagcc

SEQ ID NO: 3775940 - RNA, 17 nt, Human
cugcucuuucucugcca

SEQ ID NO: 3775941 - RNA, 17 nt, Human
cugcucuuucuucuucc

SEQ ID NO: 3775942 - RNA, 19 nt, Human
cugcucuuuuauacuguac

SEQ ID NO: 3775943 - RNA, 22 nt, Human
cugcugaaaaccaucuggccug

SEQ ID NO: 3775944 - RNA, 21 nt, Human
cugcugaagaugaaucaaugg

SEQ ID NO: 3775945 - RNA, 19 nt, Human
cugcugaagcugccugcuu

SEQ ID NO: 3775946 - RNA, 13 nt, Human
cugcugaaggcuc

SEQ ID NO: 3775947 - RNA, 22 nt, Human
cugcugaaugauuuccaaagag

SEQ ID NO: 3775948 - RNA, 23 nt, Human
cugcugaaugauuuccaaagaga

SEQ ID NO: 3775949 - RNA, 15 nt, Human
cugcugaauuuucac

SEQ ID NO: 3775950 - RNA, 11 nt, Human
cugcugacagu

SEQ ID NO: 3775951 - RNA, 15 nt, Human
cugcugacaguguug

SEQ ID NO: 3775952 - RNA, 18 nt, Human
cugcugaccuccacagcu

SEQ ID NO: 3775953 - RNA, 14 nt, Human
cugcugaccugcug

SEQ ID NO: 3775954 - RNA, 13 nt, Human
cugcugagaaccu

SEQ ID NO: 3775955 - RNA, 19 nt, Human
cugcugagaaccuggccuu

SEQ ID NO: 3775956 - RNA, 20 nt, Human
cugcugagaaccuggccuuc

SEQ ID NO: 3775957 - RNA, 19 nt, Human
cugcugagauacauacaga

SEQ ID NO: 3775958 - RNA, 19 nt, Human
cugcuucccaccucccugc

SEQ ID NO: 3775959 - RNA, 20 nt, Human
cugcuucccaccucccugcc

SEQ ID NO: 3775960 - RNA, 21 nt, Human
cugcuucccaccucccugccc

SEQ ID NO: 3775961 - RNA, 12 nt, Human
cugcuucccauc

SEQ ID NO: 3775962 - RNA, 18 nt, Human
cugcuucccauccuaccc

SEQ ID NO: 3775963 - RNA, 19 nt, Human
cugcuucccauccuacccu

SEQ ID NO: 3775964 - RNA, 16 nt, Human
cugcuucccugaagcu

SEQ ID NO: 3775965 - RNA, 15 nt, Human
cugcuucccuuacuu

SEQ ID NO: 3775966 - RNA, 20 nt, Human
cugcuucccuuacuuugcug

SEQ ID NO: 3775967 - RNA, 21 nt, Human
cugcuucccuuacuuugcuga

SEQ ID NO: 3775968 - RNA, 22 nt, Human
cugcuuccgguagggaggcagc

SEQ ID NO: 3775969 - RNA, 12 nt, Human
cugcuuccuccu

SEQ ID NO: 3775970 - RNA, 13 nt, Human
cugcuuccugcuu

SEQ ID NO: 3775971 - RNA, 14 nt, Human
cugcuucuccagcc

SEQ ID NO: 3775972 - RNA, 15 nt, Human
cugcuucuccagccu

SEQ ID NO: 3775973 - RNA, 20 nt, Human
cugcuucucugacuucugcc

SEQ ID NO: 3775974 - RNA, 20 nt, Human
cugcuucugcaccuuaucuu

SEQ ID NO: 3775975 - RNA, 13 nt, Human
cugcuugaggaaa

SEQ ID NO: 3775976 - RNA, 21 nt, Human
cugcuugaggcaacucaucuu

SEQ ID NO: 3775977 - RNA, 21 nt, Human
cugcuugauaggaauucaucu

SEQ ID NO: 3775978 - RNA, 16 nt, Human
cugcuugaugaagcaa

SEQ ID NO: 3775979 - RNA, 17 nt, Human
cugcuugaugaagcaag

SEQ ID NO: 3775980 - RNA, 20 nt, Human
cugcuugaugaagcaaggaa

SEQ ID NO: 3775981 - RNA, 21 nt, Human
cugcuugccaaggcagaggcc

SEQ ID NO: 3775982 - RNA, 23 nt, Human
cugcuugccaaggcagaggccug

SEQ ID NO: 3775983 - RNA, 15 nt, Human
cugcuugccaucccu

SEQ ID NO: 3775984 - RNA, 18 nt, Human
cugcuugccaucccuccc

SEQ ID NO: 3775985 - RNA, 20 nt, Human
cugcuugccaucccucccuc

SEQ ID NO: 3775986 - RNA, 16 nt, Human
cugcuugcccuaagca

SEQ ID NO: 3775987 - RNA, 20 nt, Human
cugcuugcuugcuuuuuaau

SEQ ID NO: 3775988 - RNA, 16 nt, Human
cugcuuggagcugagc

SEQ ID NO: 3775989 - RNA, 18 nt, Human
cugcuuggcccagggggc

SEQ ID NO: 3775990 - RNA, 23 nt, Human
cugcuuggcccagggggcuuccu

SEQ ID NO: 3775991 - RNA, 17 nt, Human
cugcuugggcuucaucc

SEQ ID NO: 3775992 - RNA, 18 nt, Human
cugcuuggguggagaagc

SEQ ID NO: 3775993 - RNA, 21 nt, Human
cugcuuggguggagaagccau

SEQ ID NO: 3775994 - RNA, 18 nt, Human
cugcuugguccuugauuu

SEQ ID NO: 3775995 - RNA, 13 nt, Human
cugcuuguuuccu

SEQ ID NO: 3775996 - RNA, 14 nt, Human
cugcuuguuuccua

SEQ ID NO: 3775997 - RNA, 19 nt, Human
cugcuuuaaagggccugcc

SEQ ID NO: 3775998 - RNA, 13 nt, Human
cugcuuuaaucag

SEQ ID NO: 3775999 - RNA, 23 nt, Human
cugcuuuagaauguuuuccuucu

SEQ ID NO: 3776000 - RNA, 14 nt, Human
cugcuuuagacuug

SEQ ID NO: 3776001 - RNA, 14 nt, Human
cugcuuuccccugu

SEQ ID NO: 3776002 - RNA, 16 nt, Human
cugcuuuccccugugg

SEQ ID NO: 3776003 - RNA, 17 nt, Human
cugcuuuccccuguggg

SEQ ID NO: 3776004 - RNA, 14 nt, Human
cugcuuucucccca

SEQ ID NO: 3776005 - RNA, 19 nt, Human
cugcuuucugauguugccu

SEQ ID NO: 3776006 - RNA, 14 nt, Human
cugcuuucuuugau

SEQ ID NO: 3776007 - RNA, 19 nt, Human
cugcuuugaauaaaugugu

SEQ ID NO: 3776008 - RNA, 22 nt, Human
cugcuuugacugagcagacugg

SEQ ID NO: 3776009 - RNA, 18 nt, Human
cugcuuugcgugcccggg

SEQ ID NO: 3776010 - RNA, 23 nt, Human
cugcuuugggauuuaauuuccag

SEQ ID NO: 3776011 - RNA, 12 nt, Human
cugcuuugggcu

SEQ ID NO: 3776012 - RNA, 17 nt, Human
cugcuuugggcugcccu

SEQ ID NO: 3776013 - RNA, 23 nt, Human
cugcuuugggcugcccuggugcu

SEQ ID NO: 3776014 - RNA, 21 nt, Human
cugcuuuguugugugccucua

SEQ ID NO: 3776015 - RNA, 19 nt, Human
cugcuuuuaacucuagaau

SEQ ID NO: 3776016 - RNA, 17 nt, Human
cugcuuuuaucucagau

SEQ ID NO: 3776017 - RNA, 12 nt, Human
cugcuuuucaau

SEQ ID NO: 3776018 - RNA, 15 nt, Human
cugcuuuucacugcu

SEQ ID NO: 3776019 - RNA, 17 nt, Human
cugcuuuucugcccugg

SEQ ID NO: 3776020 - RNA, 18 nt, Human
cugcuuuucugcccuggc

SEQ ID NO: 3776021 - RNA, 20 nt, Human
cugcuuuucugcccuggcug

SEQ ID NO: 3776022 - RNA, 18 nt, Human
cugcuuuucuuuucuaac

SEQ ID NO: 3776023 - RNA, 13 nt, Human
cugcuuuuggccu

SEQ ID NO: 3776024 - RNA, 15 nt, Human
cugcuuuuggucugu

SEQ ID NO: 3776025 - RNA, 17 nt, Human
cugcuuuuggucugugu

SEQ ID NO: 3776026 - RNA, 20 nt, Human
cugcuuuugucuaugggacu

SEQ ID NO: 3776027 - RNA, 18 nt, Human
cugcuuuuuauggccugu

SEQ ID NO: 3776028 - RNA, 22 nt, Human
cugcuuuuuccaacucagaaau

SEQ ID NO: 3776029 - RNA, 14 nt, Human
cugcuuuuuggaaa

SEQ ID NO: 3776030 - RNA, 19 nt, Human
cuggaaaacagaacacuua

SEQ ID NO: 3776031 - RNA, 14 nt, Human
cuggaaaagaggag

SEQ ID NO: 3776032 - RNA, 15 nt, Human
cuggaaaagaggagu

SEQ ID NO: 3776033 - RNA, 19 nt, Human
cuggaaaagggucuuggga

SEQ ID NO: 3776034 - RNA, 17 nt, Human
cuggaaaauaauacugc

SEQ ID NO: 3776035 - RNA, 20 nt, Human
cuggaaaauaauacugcuga

SEQ ID NO: 3776036 - RNA, 18 nt, Human
cuggaaaaugugacccag

SEQ ID NO: 3776037 - RNA, 19 nt, Human
cuggaaacauucaggagcu

SEQ ID NO: 3776038 - RNA, 14 nt, Human
cuggaaaggcucag

SEQ ID NO: 3776039 - RNA, 15 nt, Human
cuggaaaggcucagu

SEQ ID NO: 3776040 - RNA, 17 nt, Human
cuggaaaggcucagucu

SEQ ID NO: 3776041 - RNA, 23 nt, Human
cuggaaaggcucagucucaggag

SEQ ID NO: 3776042 - RNA, 13 nt, Human
cuggaaaggggag

SEQ ID NO: 3776043 - RNA, 16 nt, Human
cuggaaaggggagagc

SEQ ID NO: 3776044 - RNA, 18 nt, Human
cuggaaaggggagagccu

SEQ ID NO: 3776045 - RNA, 19 nt, Human
cuggaaaggggagagccug

SEQ ID NO: 3776046 - RNA, 19 nt, Human
cuggaacaaauuauuuuug

SEQ ID NO: 3776047 - RNA, 22 nt, Human
cuggaacacuagacaagccaga

SEQ ID NO: 3776048 - RNA, 23 nt, Human
cuggaacacuagacaagccagaa

SEQ ID NO: 3776049 - RNA, 14 nt, Human
cuggaacagauuca

SEQ ID NO: 3776050 - RNA, 20 nt, Human
cuggaacaucaucaaggcac

SEQ ID NO: 3776051 - RNA, 22 nt, Human
cuggaacauccuuugcagggca

SEQ ID NO: 3776052 - RNA, 24 nt, Human
cuggaacauccuuugcagggcagc

SEQ ID NO: 3776053 - RNA, 13 nt, Human
cuggaacccagac

SEQ ID NO: 3776054 - RNA, 22 nt, Human
cuggaacccagacucagacauu

SEQ ID NO: 3776055 - RNA, 17 nt, Human
cuggaaccucagccugg

SEQ ID NO: 3776056 - RNA, 22 nt, Human
cuggaaccucagccuggccaga

SEQ ID NO: 3776057 - RNA, 15 nt, Human
cuggaaccugcaaaa

SEQ ID NO: 3776058 - RNA, 16 nt, Human
cuggaaccugcaaaaa

SEQ ID NO: 3776059 - RNA, 18 nt, Human
cuggaaccugcaaaaaau

SEQ ID NO: 3776060 - RNA, 16 nt, Human
cuggaaccuugcuguc

SEQ ID NO: 3776061 - RNA, 17 nt, Human
cuggaaccuugcugucc

SEQ ID NO: 3776062 - RNA, 18 nt, Human
cuggaaccuugcuguccu

SEQ ID NO: 3776063 - RNA, 16 nt, Human
cuggaacggugaaggu

SEQ ID NO: 3776064 - RNA, 19 nt, Human
cuggaacucuaucugggcc

SEQ ID NO: 3776065 - RNA, 20 nt, Human
cuggaacucuaucugggccu

SEQ ID NO: 3776066 - RNA, 12 nt, Human
cuggaagaaaaa

SEQ ID NO: 3776067 - RNA, 14 nt, Human
cuggaagaaaaaaa

SEQ ID NO: 3776068 - RNA, 16 nt, Human
cuggaagaacaggccu

SEQ ID NO: 3776069 - RNA, 17 nt, Human
cuggaagaacaggccuc

SEQ ID NO: 3776070 - RNA, 12 nt, Human
cuggaagagagg

SEQ ID NO: 3776071 - RNA, 16 nt, Human
cuggaagagcagcccu

SEQ ID NO: 3776072 - RNA, 11 nt, Human
cuggaagagcc

SEQ ID NO: 3776073 - RNA, 14 nt, Human
cuggaagagcccag

SEQ ID NO: 3776074 - RNA, 15 nt, Human
cuggaagagcccagu

SEQ ID NO: 3776075 - RNA, 15 nt, Human
cuggaagauagcugu

SEQ ID NO: 3776076 - RNA, 16 nt, Human
cuggaagauagcugug

SEQ ID NO: 3776077 - RNA, 14 nt, Human
cuggaagauccugc

SEQ ID NO: 3776078 - RNA, 18 nt, Human
cuggaagauccugcgggu

SEQ ID NO: 3776079 - RNA, 15 nt, Human
cuggaagcacagaaa

SEQ ID NO: 3776080 - RNA, 15 nt, Human
cuggaagcacagcuu

SEQ ID NO: 3776081 - RNA, 12 nt, Human
cuggaagcacau

SEQ ID NO: 3776082 - RNA, 15 nt, Human
cuggaagcagugccc

SEQ ID NO: 3776083 - RNA, 16 nt, Human
cuggaagcagugccca

SEQ ID NO: 3776084 - RNA, 19 nt, Human
cuggaagcagugcccaggu

SEQ ID NO: 3776085 - RNA, 15 nt, Human
cuggaagccagcuuu

SEQ ID NO: 3776086 - RNA, 12 nt, Human
cuggaagcccag

SEQ ID NO: 3776087 - RNA, 22 nt, Human
cuggaagcccagccccuacugc

SEQ ID NO: 3776088 - RNA, 21 nt, Human
cuggaagccccugggcccagu

SEQ ID NO: 3776089 - RNA, 16 nt, Human
cuggaagcccucucug

SEQ ID NO: 3776090 - RNA, 14 nt, Human
cuggaagcccugga

SEQ ID NO: 3776091 - RNA, 17 nt, Human
cuggaagcccuggagac

SEQ ID NO: 3776092 - RNA, 12 nt, Human
cuggaagcugug

SEQ ID NO: 3776093 - RNA, 14 nt, Human
cuggaagcuuuguc

SEQ ID NO: 3776094 - RNA, 15 nt, Human
cuggaagcuuugucc

SEQ ID NO: 3776095 - RNA, 22 nt, Human
cuggaagcuuuguccccugcuu

SEQ ID NO: 3776096 - RNA, 22 nt, Human
cuggaaggaggaagaauagggc

SEQ ID NO: 3776097 - RNA, 16 nt, Human
cuggaagggcagagua

SEQ ID NO: 3776098 - RNA, 13 nt, Human
cuggaagggccaa

SEQ ID NO: 3776099 - RNA, 19 nt, Human
cuggaaggggaagggacac

SEQ ID NO: 3776100 - RNA, 20 nt, Human
cuggaagguggggacaggga

SEQ ID NO: 3776101 - RNA, 19 nt, Human
cuggaaguccaauguggca

SEQ ID NO: 3776102 - RNA, 15 nt, Human
cuggaagugacuuug

SEQ ID NO: 3776103 - RNA, 22 nt, Human
cuggaggacuagaaccuggagg

SEQ ID NO: 3776104 - RNA, 24 nt, Human
cuggaggcaccugguggccaugcu

SEQ ID NO: 3776105 - RNA, 12 nt, Human
cuggaggcaggg

SEQ ID NO: 3776106 - RNA, 16 nt, Human
cuggaggcagggccuu

SEQ ID NO: 3776107 - RNA, 19 nt, Human
cuggaggcaggggcuuccu

SEQ ID NO: 3776108 - RNA, 17 nt, Human
cuggaggcccaggcugg

SEQ ID NO: 3776109 - RNA, 13 nt, Human
cuggaggcccagu

SEQ ID NO: 3776110 - RNA, 15 nt, Human
cuggaggcccaguuc

SEQ ID NO: 3776111 - RNA, 14 nt, Human
cuggaggccccugg

SEQ ID NO: 3776112 - RNA, 21 nt, Human
cuggaggccucugggccuccu

SEQ ID NO: 3776113 - RNA, 21 nt, Human
cuggaggcucaaauuuugagu

SEQ ID NO: 3776114 - RNA, 21 nt, Human
cuggagggaagaguggaggug

SEQ ID NO: 3776115 - RNA, 19 nt, Human
cuggagggaaugaaccugg

SEQ ID NO: 3776116 - RNA, 20 nt, Human
cuggagggcuagaaccugga

SEQ ID NO: 3776117 - RNA, 21 nt, Human
cuggagggcuagaaccuggag

SEQ ID NO: 3776118 - RNA, 22 nt, Human
cuggagggcuagaaccuggcag

SEQ ID NO: 3776119 - RNA, 21 nt, Human
cuggagggcuagaacuggaga

SEQ ID NO: 3776120 - RNA, 19 nt, Human
cuggagggcuggaaucugg

SEQ ID NO: 3776121 - RNA, 22 nt, Human
cuggagggcuggaaucuggaga

SEQ ID NO: 3776122 - RNA, 15 nt, Human
cuggaggggacgcug

SEQ ID NO: 3776123 - RNA, 15 nt, Human
cuggaggggccccug

SEQ ID NO: 3776124 - RNA, 19 nt, Human
cuggagggggaauggcagc

SEQ ID NO: 3776125 - RNA, 21 nt, Human
cuggagggggaauggcagcag

SEQ ID NO: 3776126 - RNA, 22 nt, Human
cuggaggucacauucaggaaga

SEQ ID NO: 3776127 - RNA, 14 nt, Human
cuggaggucagcau

SEQ ID NO: 3776128 - RNA, 22 nt, Human
cuggagguggggccuggagcag

SEQ ID NO: 3776129 - RNA, 23 nt, Human
cuggagguggggcgaggcaggcc

SEQ ID NO: 3776130 - RNA, 20 nt, Human
cuggaggugggguugggauu

SEQ ID NO: 3776131 - RNA, 22 nt, Human
cuggaggugggguugggauugg

SEQ ID NO: 3776132 - RNA, 19 nt, Human
cuggagguugaagccaagu

SEQ ID NO: 3776133 - RNA, 17 nt, Human
cuggagguuuguuuaga

SEQ ID NO: 3776134 - RNA, 15 nt, Human
cuggagucuccugag

SEQ ID NO: 3776135 - RNA, 16 nt, Human
cuggagugagcacuca

SEQ ID NO: 3776136 - RNA, 15 nt, Human
cuggagugaggaaaa

SEQ ID NO: 3776137 - RNA, 15 nt, Human
cuggagugcagugag

SEQ ID NO: 3776138 - RNA, 16 nt, Human
cuggagugcagugagc

SEQ ID NO: 3776139 - RNA, 19 nt, Human
cuggagugcccacccuggg

SEQ ID NO: 3776140 - RNA, 20 nt, Human
cuggaguggcucgccaggcc

SEQ ID NO: 3776141 - RNA, 21 nt, Human
cuggaguggcucgccaggcca

SEQ ID NO: 3776142 - RNA, 17 nt, Human
cuggaguuagggacuga

SEQ ID NO: 3776143 - RNA, 21 nt, Human
cuggaguuauugaagcagagu

SEQ ID NO: 3776144 - RNA, 22 nt, Human
cuggaguuauugaagcagagug

SEQ ID NO: 3776145 - RNA, 16 nt, Human
cuggaguucugguucc

SEQ ID NO: 3776146 - RNA, 18 nt, Human
cuggaguugaucuggaac

SEQ ID NO: 3776147 - RNA, 22 nt, Human
cuggaguuucauguacaagaug

SEQ ID NO: 3776148 - RNA, 20 nt, Human
cuggaguuugggaucccugu

SEQ ID NO: 3776149 - RNA, 22 nt, Human
cuggaguuuuuguuuggagagc

SEQ ID NO: 3776150 - RNA, 16 nt, Human
cuggauaaagccacug

SEQ ID NO: 3776151 - RNA, 21 nt, Human
cuggauaauuuugcauaaaau

SEQ ID NO: 3776152 - RNA, 19 nt, Human
cuggauaggagccugcugg

SEQ ID NO: 3776153 - RNA, 20 nt, Human
cuggauaggagccugcuggu

SEQ ID NO: 3776154 - RNA, 18 nt, Human
cuggauaguccgucucug

SEQ ID NO: 3776155 - RNA, 19 nt, Human
cuggauaguccgucucugc

SEQ ID NO: 3776156 - RNA, 18 nt, Human
cuggauauagcuagguga

SEQ ID NO: 3776157 - RNA, 13 nt, Human
cuggauauuuuca

SEQ ID NO: 3776158 - RNA, 15 nt, Human
cuggauauuuucaaa

SEQ ID NO: 3776159 - RNA, 16 nt, Human
cuggauauuuucaaau

SEQ ID NO: 3776160 - RNA, 16 nt, Human
cuggaucacagcugcu

SEQ ID NO: 3776161 - RNA, 21 nt, Human
cuggaucacgacgcugcagag

SEQ ID NO: 3776162 - RNA, 13 nt, Human
cuggaucaguaaa

SEQ ID NO: 3776163 - RNA, 13 nt, Human
cuggaucaguccu

SEQ ID NO: 3776164 - RNA, 18 nt, Human
cuggauccccucugucua

SEQ ID NO: 3776165 - RNA, 15 nt, Human
cuggauccugaaaua

SEQ ID NO: 3776166 - RNA, 20 nt, Human
cuggaucuccauucucucag

SEQ ID NO: 3776167 - RNA, 18 nt, Human
cuggaucucccagggcua

SEQ ID NO: 3776168 - RNA, 19 nt, Human
cuggaucucccagggcuac

SEQ ID NO: 3776169 - RNA, 13 nt, Human
cuggaucucccug

SEQ ID NO: 3776170 - RNA, 23 nt, Human
cuggaucuccucaaguccccaag

SEQ ID NO: 3776171 - RNA, 20 nt, Human
cuggaucugggacccuuucc

SEQ ID NO: 3776172 - RNA, 21 nt, Human
cuggaucugggacccuuuccu

SEQ ID NO: 3776173 - RNA, 13 nt, Human
cuggaugaaauuu

SEQ ID NO: 3776174 - RNA, 23 nt, Human
cuggaugaaguuaucuggcuuca

SEQ ID NO: 3776175 - RNA, 22 nt, Human
cuggaugauacuaauaaacuaa

SEQ ID NO: 3776176 - RNA, 14 nt, Human
cuggaugauauuuu

SEQ ID NO: 3776177 - RNA, 21 nt, Human
cuggaugccaccucugcaggg

SEQ ID NO: 3776178 - RNA, 13 nt, Human
cuggaugcccagg

SEQ ID NO: 3776179 - RNA, 22 nt, Human
cuggaugcccccuguggaugcu

SEQ ID NO: 3776180 - RNA, 22 nt, Human
cuggaugccucauuaugucaac

SEQ ID NO: 3776181 - RNA, 16 nt, Human
cuggauggagcccagg

SEQ ID NO: 3776182 - RNA, 21 nt, Human
cuggauggaggaaaaccaagc

SEQ ID NO: 3776183 - RNA, 15 nt, Human
cuggauggggcaggc

SEQ ID NO: 3776184 - RNA, 24 nt, Human
cuggauggggcaggccaccuggcu

SEQ ID NO: 3776185 - RNA, 15 nt, Human
cuggauguaccacca

SEQ ID NO: 3776186 - RNA, 19 nt, Human
cuggaugucugccaauuuu

SEQ ID NO: 3776187 - RNA, 15 nt, Human
cuggauguuuggaaa

SEQ ID NO: 3776188 - RNA, 17 nt, Human
cuggauuauauuaugaa

SEQ ID NO: 3776189 - RNA, 16 nt, Human
cuggauucauugucuc

SEQ ID NO: 3776190 - RNA, 20 nt, Human
cuggauuccccaucucaggc

SEQ ID NO: 3776191 - RNA, 21 nt, Human
cuggauuccccaucucaggcc

SEQ ID NO: 3776192 - RNA, 12 nt, Human
cuggauuuaacu

SEQ ID NO: 3776193 - RNA, 14 nt, Human
cuggauuuuuacca

SEQ ID NO: 3776194 - RNA, 23 nt, Human
cuggcaaaaggaucuuuguggcc

SEQ ID NO: 3776195 - RNA, 22 nt, Human
cuggcaaaauaguucugcaggu

SEQ ID NO: 3776196 - RNA, 23 nt, Human
cuggcaaaauaguucugcagguu

SEQ ID NO: 3776197 - RNA, 18 nt, Human
cuggcaaagacagaagcc

SEQ ID NO: 3776198 - RNA, 18 nt, Human
cuggcaaagggagcagaa

SEQ ID NO: 3776199 - RNA, 14 nt, Human
cuggcaacaucuuu

SEQ ID NO: 3776200 - RNA, 17 nt, Human
cuggcaacaucuuuauc

SEQ ID NO: 3776201 - RNA, 23 nt, Human
cuggcaagaaaagaguuaaggca

SEQ ID NO: 3776202 - RNA, 22 nt, Human
cuggcaagcuagaaccuggagg

SEQ ID NO: 3776203 - RNA, 19 nt, Human
cuggcaaggacuuuguaca

SEQ ID NO: 3776204 - RNA, 19 nt, Human
cuggcaauaguguguucug

SEQ ID NO: 3776205 - RNA, 20 nt, Human
cuggcaauaguguguucuga

SEQ ID NO: 3776206 - RNA, 15 nt, Human
cuggcaaugccacag

SEQ ID NO: 3776207 - RNA, 20 nt, Human
cuggcaaugccacagcccug

SEQ ID NO: 3776208 - RNA, 19 nt, Human
cuggcaauguuuauuucau

SEQ ID NO: 3776209 - RNA, 19 nt, Human
cuggcaauugucuauuuau

SEQ ID NO: 3776210 - RNA, 12 nt, Human
cuggcacacauc

SEQ ID NO: 3776211 - RNA, 14 nt, Human
cuggcacagccugg

SEQ ID NO: 3776212 - RNA, 16 nt, Human
cuggcacagccuggcu

SEQ ID NO: 3776213 - RNA, 14 nt, Human
cuggcacaggacug

SEQ ID NO: 3776214 - RNA, 15 nt, Human
cuggcacagggcagu

SEQ ID NO: 3776215 - RNA, 12 nt, Human
cuggcacagugu

SEQ ID NO: 3776216 - RNA, 19 nt, Human
cuggcacaguuuucugaga

SEQ ID NO: 3776217 - RNA, 22 nt, Human
cuggcacaguuuucugagaaag

SEQ ID NO: 3776218 - RNA, 16 nt, Human
cuggcacccggccccu

SEQ ID NO: 3776219 - RNA, 19 nt, Human
cuggcacugaauuaaucau

SEQ ID NO: 3776220 - RNA, 20 nt, Human
cuggcacugacugggcauag

SEQ ID NO: 3776221 - RNA, 16 nt, Human
cuggcacugcuuccag

SEQ ID NO: 3776222 - RNA, 17 nt, Human
cuggcacugcuuccagu

SEQ ID NO: 3776223 - RNA, 19 nt, Human
cuggcacugcuuccaguga

SEQ ID NO: 3776224 - RNA, 18 nt, Human
cuggcacuggaccccagc

SEQ ID NO: 3776225 - RNA, 21 nt, Human
cuggcacuuggagacuuguau

SEQ ID NO: 3776226 - RNA, 16 nt, Human
cuggcagaacugagcu

SEQ ID NO: 3776227 - RNA, 18 nt, Human
cuggcagaacugagcucc

SEQ ID NO: 3776228 - RNA, 13 nt, Human
cuggcagaaggga

SEQ ID NO: 3776229 - RNA, 17 nt, Human
cuggcagaagggagcag

SEQ ID NO: 3776230 - RNA, 21 nt, Human
cuggcagcaccgccucuuccc

SEQ ID NO: 3776231 - RNA, 22 nt, Human
cuggcagccacacuucucagga

SEQ ID NO: 3776232 - RNA, 12 nt, Human
cuggcagcccag

SEQ ID NO: 3776233 - RNA, 13 nt, Human
cuggcagccccug

SEQ ID NO: 3776234 - RNA, 17 nt, Human
cuggcagccgugccuuc

SEQ ID NO: 3776235 - RNA, 12 nt, Human
cuggcagccucc

SEQ ID NO: 3776236 - RNA, 22 nt, Human
cuggcagccucccauccagggc

SEQ ID NO: 3776237 - RNA, 12 nt, Human
cuggcagcucag

SEQ ID NO: 3776238 - RNA, 17 nt, Human
cuggcagcucagagagg

SEQ ID NO: 3776239 - RNA, 19 nt, Human
cuggcagcucagagagggu

SEQ ID NO: 3776240 - RNA, 17 nt, Human
cuggcagcucagcuucc

SEQ ID NO: 3776241 - RNA, 12 nt, Human
cuggcagcucuc

SEQ ID NO: 3776242 - RNA, 16 nt, Human
cuggcagcucuccagu

SEQ ID NO: 3776243 - RNA, 17 nt, Human
cuggcagcucuccaguc

SEQ ID NO: 3776244 - RNA, 21 nt, Human
cuggcagcucuggacagcccc

SEQ ID NO: 3776245 - RNA, 11 nt, Human
cuggcaggcag

SEQ ID NO: 3776246 - RNA, 16 nt, Human
cuggccucgccuggcc

SEQ ID NO: 3776247 - RNA, 17 nt, Human
cuggccucgccuggccu

SEQ ID NO: 3776248 - RNA, 20 nt, Human
cuggccucuaccacaagggc

SEQ ID NO: 3776249 - RNA, 16 nt, Human
cuggccucugcacucc

SEQ ID NO: 3776250 - RNA, 20 nt, Human
cuggccucugcacuccccug

SEQ ID NO: 3776251 - RNA, 11 nt, Human
cuggccucugu

SEQ ID NO: 3776252 - RNA, 12 nt, Human
cuggccugacuu

SEQ ID NO: 3776253 - RNA, 19 nt, Human
cuggccugagaggggaagc

SEQ ID NO: 3776254 - RNA, 15 nt, Human
cuggccugagcuggg

SEQ ID NO: 3776255 - RNA, 21 nt, Human
cuggccugaggagcagcaguu

SEQ ID NO: 3776256 - RNA, 16 nt, Human
cuggccuggcacacau

SEQ ID NO: 3776257 - RNA, 17 nt, Human
cuggccuggcacacauc

SEQ ID NO: 3776258 - RNA, 14 nt, Human
cuggccuggccagu

SEQ ID NO: 3776259 - RNA, 15 nt, Human
cuggccuggccagug

SEQ ID NO: 3776260 - RNA, 19 nt, Human
cuggccuggccagugcccu

SEQ ID NO: 3776261 - RNA, 24 nt, Human
cuggccuggccccucagggucccu

SEQ ID NO: 3776262 - RNA, 15 nt, Human
cuggccuggccggca

SEQ ID NO: 3776263 - RNA, 16 nt, Human
cuggccuuccugcccu

SEQ ID NO: 3776264 - RNA, 15 nt, Human
cuggccuucggccuc

SEQ ID NO: 3776265 - RNA, 16 nt, Human
cuggccuugggcccuc

SEQ ID NO: 3776266 - RNA, 15 nt, Human
cuggccuuguggucc

SEQ ID NO: 3776267 - RNA, 20 nt, Human
cuggccuugugguccaaaua

SEQ ID NO: 3776268 - RNA, 15 nt, Human
cuggccuuuccucuc

SEQ ID NO: 3776269 - RNA, 17 nt, Human
cuggccuuuuucauuua

SEQ ID NO: 3776270 - RNA, 20 nt, Human
cuggccuuuuucauuuaucu

SEQ ID NO: 3776271 - RNA, 20 nt, Human
cuggcgacaguuuuccuucu

SEQ ID NO: 3776272 - RNA, 15 nt, Human
cuggcgcagccaagg

SEQ ID NO: 3776273 - RNA, 19 nt, Human
cuggcgcagccaaggccga

SEQ ID NO: 3776274 - RNA, 14 nt, Human
cuggcgccucugca

SEQ ID NO: 3776275 - RNA, 15 nt, Human
cuggcgccucugcaa

SEQ ID NO: 3776276 - RNA, 15 nt, Human
cuggcggccccaacu

SEQ ID NO: 3776277 - RNA, 22 nt, Human
cuggcggccccaacucgggcuc

SEQ ID NO: 3776278 - RNA, 17 nt, Human
cuggcggcuacucagca

SEQ ID NO: 3776279 - RNA, 22 nt, Human
cuggcggcuacucagcagcccu

SEQ ID NO: 3776280 - RNA, 20 nt, Human
cuggcggcuggggucccagc

SEQ ID NO: 3776281 - RNA, 22 nt, Human
cuggcggcuggggucccagcag

SEQ ID NO: 3776282 - RNA, 18 nt, Human
cuggcgucaugcaaaguc

SEQ ID NO: 3776283 - RNA, 15 nt, Human
cuggcgucugucuuc

SEQ ID NO: 3776284 - RNA, 22 nt, Human
cuggcgucugucuucaagggcu

SEQ ID NO: 3776285 - RNA, 14 nt, Human
cuggcgugcagugg

SEQ ID NO: 3776286 - RNA, 18 nt, Human
cuggcguggauuaaacuu

SEQ ID NO: 3776287 - RNA, 19 nt, Human
cuggcguggauuaaacuua

SEQ ID NO: 3776288 - RNA, 16 nt, Human
cuggcuaacacgguga

SEQ ID NO: 3776289 - RNA, 21 nt, Human
cuggcuagaggccagccccac

SEQ ID NO: 3776290 - RNA, 16 nt, Human
cuggcuagaguccuca

SEQ ID NO: 3776291 - RNA, 21 nt, Human
cuggcuagaguccucacuccc

SEQ ID NO: 3776292 - RNA, 23 nt, Human
cuggcuauagaugucuuuuccca

SEQ ID NO: 3776293 - RNA, 22 nt, Human
cuggcucacaguacagcaugug

SEQ ID NO: 3776294 - RNA, 13 nt, Human
cuggcucacccag

SEQ ID NO: 3776295 - RNA, 21 nt, Human
cuggcucagccucaaaugcag

SEQ ID NO: 3776296 - RNA, 19 nt, Human
cuggcucauauuccugcag

SEQ ID NO: 3776297 - RNA, 11 nt, Human
cuggcuccagc

SEQ ID NO: 3776298 - RNA, 13 nt, Human
cuggcuccagcug

SEQ ID NO: 3776299 - RNA, 20 nt, Human
cuggcuccagcuggccggga

SEQ ID NO: 3776300 - RNA, 19 nt, Human
cuggcucccacaggcagcu

SEQ ID NO: 3776301 - RNA, 16 nt, Human
cuggcucccaggacac

SEQ ID NO: 3776302 - RNA, 15 nt, Human
cuggcucccagggcc

SEQ ID NO: 3776303 - RNA, 16 nt, Human
cuggcucccagggcca

SEQ ID NO: 3776304 - RNA, 18 nt, Human
cuggcucccagggccaug

SEQ ID NO: 3776305 - RNA, 14 nt, Human
cuggcuccccaaag

SEQ ID NO: 3776306 - RNA, 17 nt, Human
cuggcuccccugcagcc

SEQ ID NO: 3776307 - RNA, 21 nt, Human
cuggcucccucacucucagga

SEQ ID NO: 3776308 - RNA, 18 nt, Human
cuggcucccuccuccagg

SEQ ID NO: 3776309 - RNA, 12 nt, Human
cuggcucccucu

SEQ ID NO: 3776310 - RNA, 22 nt, Human
cuggcucccucuuggucuuccc

SEQ ID NO: 3776311 - RNA, 23 nt, Human
cuggcucccucuuggucuuccca

SEQ ID NO: 3776312 - RNA, 24 nt, Human
cuggcucccucuuggucuucccag

SEQ ID NO: 3776313 - RNA, 16 nt, Human
cuggcuccgcugugug

SEQ ID NO: 3776314 - RNA, 17 nt, Human
cuggcuccgcugugugg

SEQ ID NO: 3776315 - RNA, 16 nt, Human
cuggcuccucuguggu

SEQ ID NO: 3776316 - RNA, 14 nt, Human
cuggcuccugaggg

SEQ ID NO: 3776317 - RNA, 15 nt, Human
cuggcuccugagggg

SEQ ID NO: 3776318 - RNA, 16 nt, Human
cuggcuccugaggggc

SEQ ID NO: 3776319 - RNA, 17 nt, Human
cuggcuccuuuacaaaa

SEQ ID NO: 3776320 - RNA, 23 nt, Human
cuggcucuccaagugccagaggu

SEQ ID NO: 3776321 - RNA, 13 nt, Human
cuggcucuccugg

SEQ ID NO: 3776322 - RNA, 16 nt, Human
cuggcucucuccagga

SEQ ID NO: 3776323 - RNA, 13 nt, Human
cuggcucugagcg

SEQ ID NO: 3776324 - RNA, 24 nt, Human
cuggcucugagcgccuccauccaa

SEQ ID NO: 3776325 - RNA, 24 nt, Human
cuggcucugcaaugggcacuggga

SEQ ID NO: 3776326 - RNA, 13 nt, Human
cuggcucuguggc

SEQ ID NO: 3776327 - RNA, 23 nt, Human
cuggcucuguggcgagccauuug

SEQ ID NO: 3776328 - RNA, 21 nt, Human
cuggcucuuccaggcugggag

SEQ ID NO: 3776329 - RNA, 17 nt, Human
cuggcucuucugcccaa

SEQ ID NO: 3776330 - RNA, 23 nt, Human
cuggcucuugauaccccccucug

SEQ ID NO: 3776331 - RNA, 23 nt, Human
cuggcucuuucgucacccuugga

SEQ ID NO: 3776332 - RNA, 16 nt, Human
cuggcugaacccugug

SEQ ID NO: 3776333 - RNA, 20 nt, Human
cuggcugaacccugugcugg

SEQ ID NO: 3776334 - RNA, 14 nt, Human
cuggcugaaggacu

SEQ ID NO: 3776335 - RNA, 17 nt, Human
cuggcugaaggacugug

SEQ ID NO: 3776336 - RNA, 19 nt, Human
cuggcugaccccaaagagc

SEQ ID NO: 3776337 - RNA, 23 nt, Human
cuggcugaccccaaagagccugg

SEQ ID NO: 3776338 - RNA, 12 nt, Human
cuggcugagccc

SEQ ID NO: 3776339 - RNA, 14 nt, Human
cuggcugagcccug

SEQ ID NO: 3776340 - RNA, 17 nt, Human
cuggcugagccuggcug

SEQ ID NO: 3776341 - RNA, 18 nt, Human
cuggcugagccuggcugg

SEQ ID NO: 3776342 - RNA, 21 nt, Human
cuggcugaggauuucaagccu

SEQ ID NO: 3776343 - RNA, 23 nt, Human
cuggcugagggcaguucgcagcc

SEQ ID NO: 3776344 - RNA, 17 nt, Human
cuggcugagguuccucu

SEQ ID NO: 3776345 - RNA, 13 nt, Human
cuggcugcaguga

SEQ ID NO: 3776346 - RNA, 12 nt, Human
cuggcugcccag

SEQ ID NO: 3776347 - RNA, 18 nt, Human
cuggcugccccaaccugc

SEQ ID NO: 3776348 - RNA, 21 nt, Human
cuggcugccccaaccugcuga

SEQ ID NO: 3776349 - RNA, 13 nt, Human
cuggcugcccugg

SEQ ID NO: 3776350 - RNA, 17 nt, Human
cuggcugcccuggcccu

SEQ ID NO: 3776351 - RNA, 20 nt, Human
cuggcugcccuggcccugag

SEQ ID NO: 3776352 - RNA, 18 nt, Human
cuggcugccuccacuccc

SEQ ID NO: 3776353 - RNA, 21 nt, Human
cuggcugccuccacucccacu

SEQ ID NO: 3776354 - RNA, 22 nt, Human
cuggcugccuccacucccacuu

SEQ ID NO: 3776355 - RNA, 19 nt, Human
cuggcugccuuagaaccuu

SEQ ID NO: 3776356 - RNA, 18 nt, Human
cuggcugcggggcgggca

SEQ ID NO: 3776357 - RNA, 21 nt, Human
cuggcugcugaucgccuuccc

SEQ ID NO: 3776358 - RNA, 15 nt, Human
cuggcugcugccccc

SEQ ID NO: 3776359 - RNA, 17 nt, Human
cuggcugcugcccccac

SEQ ID NO: 3776360 - RNA, 14 nt, Human
cuggcugcuugccc

SEQ ID NO: 3776361 - RNA, 15 nt, Human
cuggcuggcugaggg

SEQ ID NO: 3776362 - RNA, 23 nt, Human
cuggcugggacguggcucagcca

SEQ ID NO: 3776363 - RNA, 14 nt, Human
cuggcugggcaugg

SEQ ID NO: 3776364 - RNA, 22 nt, Human
cuggcuggggccuaucagugug

SEQ ID NO: 3776365 - RNA, 23 nt, Human
cuggcuggggccuaucagugugc

SEQ ID NO: 3776366 - RNA, 24 nt, Human
cuggcuggggccuaucagugugcc

SEQ ID NO: 3776367 - RNA, 16 nt, Human
cuggcugggggccuca

SEQ ID NO: 3776368 - RNA, 19 nt, Human
cuggcugggggccucacuc

SEQ ID NO: 3776369 - RNA, 19 nt, Human
cuggcugggguggccugug

SEQ ID NO: 3776370 - RNA, 22 nt, Human
cuggcuggguggcaccagcagc

SEQ ID NO: 3776371 - RNA, 18 nt, Human
cuggcugguagagcaggu

SEQ ID NO: 3776372 - RNA, 16 nt, Human
cuggcugguguuaaca

SEQ ID NO: 3776373 - RNA, 18 nt, Human
cuggcuguacugcucagg

SEQ ID NO: 3776374 - RNA, 13 nt, Human
cuggcugugggcu

SEQ ID NO: 3776375 - RNA, 19 nt, Human
cuggcugugggcucccuuc

SEQ ID NO: 3776376 - RNA, 20 nt, Human
cuggcuguguucuggugagg

SEQ ID NO: 3776377 - RNA, 23 nt, Human
cuggcuguucugugguuccucug

SEQ ID NO: 3776378 - RNA, 16 nt, Human
cuggcuguuggcuggg

SEQ ID NO: 3776379 - RNA, 18 nt, Human
cuggcuguuggcuggggg

SEQ ID NO: 3776380 - RNA, 19 nt, Human
cuggcuguuggcugggggc

SEQ ID NO: 3776381 - RNA, 12 nt, Human
cuggcuuauuua

SEQ ID NO: 3776382 - RNA, 15 nt, Human
cuggcuuauuuuaau

SEQ ID NO: 3776383 - RNA, 16 nt, Human
cuggcuuauuuuaaug

SEQ ID NO: 3776384 - RNA, 21 nt, Human
cuggcuucaccaucaauccug

SEQ ID NO: 3776385 - RNA, 16 nt, Human
cuggcuuccagguauc

SEQ ID NO: 3776386 - RNA, 22 nt, Human
cuggcuuccagguaucuccagg

SEQ ID NO: 3776387 - RNA, 23 nt, Human
cuggcuuccagguaucuccagga

SEQ ID NO: 3776388 - RNA, 12 nt, Human
cuggcuucuccu

SEQ ID NO: 3776389 - RNA, 15 nt, Human
acugagugggaagcc

SEQ ID NO: 3776390 - RNA, 16 nt, Human
acugagugggaagccc

SEQ ID NO: 3776391 - RNA, 18 nt, Human
acugaguuuuccauggca

SEQ ID NO: 3776392 - RNA, 16 nt, Human
acugccuacugcaucg

SEQ ID NO: 3776393 - RNA, 15 nt, Human
acugccuagaaacaa

SEQ ID NO: 3776394 - RNA, 19 nt, Human
agcagccagcucucagcca

SEQ ID NO: 3776395 - RNA, 23 nt, Human
agcagccagcucucagccaacga

SEQ ID NO: 3776396 - RNA, 14 nt, Human
agcagccaggagag

SEQ ID NO: 3776397 - RNA, 19 nt, Human
agcagccaucauaggaagg

SEQ ID NO: 3776398 - RNA, 20 nt, Human
agcagccaucauaggaaggg

SEQ ID NO: 3776399 - RNA, 19 nt, Human
agcagcccaagcuucccuc

SEQ ID NO: 3776400 - RNA, 13 nt, Human
agcagcccacccu

SEQ ID NO: 3776401 - RNA, 14 nt, Human
agcagcccacccug

SEQ ID NO: 3776402 - RNA, 16 nt, Human
agcagcccacccugcu

SEQ ID NO: 3776403 - RNA, 17 nt, Human
agcagcccccagcuccc

SEQ ID NO: 3776404 - RNA, 19 nt, Human
agcagcccccagcucccac

SEQ ID NO: 3776405 - RNA, 20 nt, Human
agcagcccccagcucccacc

SEQ ID NO: 3776406 - RNA, 14 nt, Human
agcagcccuaagga

SEQ ID NO: 3776407 - RNA, 20 nt, Human
agcagcccucaauugugaaa

SEQ ID NO: 3776408 - RNA, 15 nt, Human
agcagcccuggaguc

SEQ ID NO: 3776409 - RNA, 17 nt, Human
agcagcccuggagucau

SEQ ID NO: 3776410 - RNA, 22 nt, Human
agcagcccuuggccagaaguca

SEQ ID NO: 3776411 - RNA, 23 nt, Human
agcagccucgccccuggcagaga

SEQ ID NO: 3776412 - RNA, 14 nt, Human
agcagccuggagcc

SEQ ID NO: 3776413 - RNA, 23 nt, Human
agcagccuggcucucccagccag

SEQ ID NO: 3776414 - RNA, 16 nt, Human
agcagccuuuaaugca

SEQ ID NO: 3776415 - RNA, 18 nt, Human
agcagccuuuaaugcauc

SEQ ID NO: 3776416 - RNA, 20 nt, Human
agcagcgaccaccccugccu

SEQ ID NO: 3776417 - RNA, 21 nt, Human
agcagcgaccaccccugccuc

SEQ ID NO: 3776418 - RNA, 22 nt, Human
agcagcgaccaccccugccucc

SEQ ID NO: 3776419 - RNA, 18 nt, Human
agcagcgaccgcccccuc

SEQ ID NO: 3776420 - RNA, 23 nt, Human
agcagcgaccgcccccuccucua

SEQ ID NO: 3776421 - RNA, 13 nt, Human
agcagcgagccug

SEQ ID NO: 3776422 - RNA, 14 nt, Human
agcagcgccuuucc

SEQ ID NO: 3776423 - RNA, 15 nt, Human
agcagcggacuucaa

SEQ ID NO: 3776424 - RNA, 15 nt, Human
agcagcgguggccuc

SEQ ID NO: 3776425 - RNA, 17 nt, Human
agcagcgguuuggggag

SEQ ID NO: 3776426 - RNA, 18 nt, Human
agcagcguuucuaugaca

SEQ ID NO: 3776427 - RNA, 20 nt, Human
agcagcuaaaccaaggacug

SEQ ID NO: 3776428 - RNA, 11 nt, Human
agcagcuacca

SEQ ID NO: 3776429 - RNA, 16 nt, Human
agcagcucaaaggcac

SEQ ID NO: 3776430 - RNA, 13 nt, Human
agcagcucaggca

SEQ ID NO: 3776431 - RNA, 21 nt, Human
agcagcuccuuccuagccuug

SEQ ID NO: 3776432 - RNA, 14 nt, Human
agcagcucuccccu

SEQ ID NO: 3776433 - RNA, 17 nt, Human
agcagcucuugcuaauc

SEQ ID NO: 3776434 - RNA, 14 nt, Human
agcagcugagcagg

SEQ ID NO: 3776435 - RNA, 18 nt, Human
agcagcuggacuacccac

SEQ ID NO: 3776436 - RNA, 16 nt, Human
agcagcuucaguuguu

SEQ ID NO: 3776437 - RNA, 17 nt, Human
agcagcuucaguuguuu

SEQ ID NO: 3776438 - RNA, 15 nt, Human
agcagcuucugccac

SEQ ID NO: 3776439 - RNA, 20 nt, Human
agcagcuucugccacuuccc

SEQ ID NO: 3776440 - RNA, 15 nt, Human
agcagcuugcugcac

SEQ ID NO: 3776441 - RNA, 17 nt, Human
agcagcuuuaaacaaau

SEQ ID NO: 3776442 - RNA, 21 nt, Human
agcagcuuuagaaucccagcc

SEQ ID NO: 3776443 - RNA, 17 nt, Human
agcagcuuuagcaaaga

SEQ ID NO: 3776444 - RNA, 22 nt, Human
agcaggaagcauucagagagca

SEQ ID NO: 3776445 - RNA, 14 nt, Human
agcaggaaggccug

SEQ ID NO: 3776446 - RNA, 16 nt, Human
agcaggaaggccuggg

SEQ ID NO: 3776447 - RNA, 20 nt, Human
agcaggacauggacaaggau

SEQ ID NO: 3776448 - RNA, 22 nt, Human
agcaggaccucccuuccgaccc

SEQ ID NO: 3776449 - RNA, 16 nt, Human
agcacugccugcuccc

SEQ ID NO: 3776450 - RNA, 21 nt, Human
agcacugccugcucccauccu

SEQ ID NO: 3776451 - RNA, 17 nt, Human
agcacugcuugaggaaa

SEQ ID NO: 3776452 - RNA, 17 nt, Human
agcacuggagugcaggg

SEQ ID NO: 3776453 - RNA, 20 nt, Human
agcacuggagugcagggagg

SEQ ID NO: 3776454 - RNA, 16 nt, Human
agcacugggcucccgg

SEQ ID NO: 3776455 - RNA, 19 nt, Human
agcacuggguugcagggga

SEQ ID NO: 3776456 - RNA, 12 nt, Human
agcacuguauac

SEQ ID NO: 3776457 - RNA, 12 nt, Human
agcacugucccu

SEQ ID NO: 3776458 - RNA, 23 nt, Human
agcacugugcuaauaacagugca

SEQ ID NO: 3776459 - RNA, 15 nt, Human
agcacuguugagaag

SEQ ID NO: 3776460 - RNA, 17 nt, Human
agcacuguugauguauc

SEQ ID NO: 3776461 - RNA, 18 nt, Human
agcacuguuuucuagugu

SEQ ID NO: 3776462 - RNA, 14 nt, Human
agcacuguuuuucc

SEQ ID NO: 3776463 - RNA, 16 nt, Human
agcacuguuuuuccau

SEQ ID NO: 3776464 - RNA, 23 nt, Human
agcacuguuuuuccauaguuuug

SEQ ID NO: 3776465 - RNA, 18 nt, Human
agcacuuaaauuccucaa

SEQ ID NO: 3776466 - RNA, 12 nt, Human
agcacuuaagag

SEQ ID NO: 3776467 - RNA, 15 nt, Human
agcacuuauuuaaug

SEQ ID NO: 3776468 - RNA, 15 nt, Human
agcacuucaggaggc

SEQ ID NO: 3776469 - RNA, 19 nt, Human
agcacuucagggcagauuu

SEQ ID NO: 3776470 - RNA, 23 nt, Human
agcacuucaucuggcugccuuug

SEQ ID NO: 3776471 - RNA, 12 nt, Human
agcacuuccaaa

SEQ ID NO: 3776472 - RNA, 18 nt, Human
agcacuuccuugccaguc

SEQ ID NO: 3776473 - RNA, 17 nt, Human
agcacuucuaaguugag

SEQ ID NO: 3776474 - RNA, 20 nt, Human
agcacuucuaaguugaguau

SEQ ID NO: 3776475 - RNA, 22 nt, Human
agcacuugcaaccgucuguuau

SEQ ID NO: 3776476 - RNA, 13 nt, Human
agcacuuggacuc

SEQ ID NO: 3776477 - RNA, 14 nt, Human
agcacuuggagcca

SEQ ID NO: 3776478 - RNA, 17 nt, Human
agcacuuggagccaagg

SEQ ID NO: 3776479 - RNA, 23 nt, Human
agcacuuggagccaaggguucag

SEQ ID NO: 3776480 - RNA, 22 nt, Human
agcacuuggggguucaggcccg

SEQ ID NO: 3776481 - RNA, 12 nt, Human
agcacuuguaua

SEQ ID NO: 3776482 - RNA, 13 nt, Human
agcacuuguauau

SEQ ID NO: 3776483 - RNA, 21 nt, Human
agcacuuguggguuuuuguuu

SEQ ID NO: 3776484 - RNA, 19 nt, Human
agccuguguaacagcuccu

SEQ ID NO: 3776485 - RNA, 21 nt, Human
agccuguguaacagcuccuug

SEQ ID NO: 3776486 - RNA, 17 nt, Human
agccuguuccccucacu

SEQ ID NO: 3776487 - RNA, 22 nt, Human
agccuguuggacccgcucugga

SEQ ID NO: 3776488 - RNA, 16 nt, Human
agccuguuguuuaagu

SEQ ID NO: 3776489 - RNA, 14 nt, Human
agccuuaccacgca

SEQ ID NO: 3776490 - RNA, 15 nt, Human
agccuuaucaagugu

SEQ ID NO: 3776491 - RNA, 20 nt, Human
agccuucaaaacuauagcuu

SEQ ID NO: 3776492 - RNA, 21 nt, Human
agccuucaaaacuauagcuug

SEQ ID NO: 3776493 - RNA, 22 nt, Human
agccuucaaaacuauagcuugc

SEQ ID NO: 3776494 - RNA, 13 nt, Human
agccuucaagcuc

SEQ ID NO: 3776495 - RNA, 17 nt, Human
agccuucaagcucugag

SEQ ID NO: 3776496 - RNA, 18 nt, Human
agccuucaagcucugagg

SEQ ID NO: 3776497 - RNA, 19 nt, Human
agccuucaagcucugaggg

SEQ ID NO: 3776498 - RNA, 23 nt, Human
agccuucaagcucugagggaaag

SEQ ID NO: 3776499 - RNA, 14 nt, Human
agccuucagcucca

SEQ ID NO: 3776500 - RNA, 13 nt, Human
agccuuccaccca

SEQ ID NO: 3776501 - RNA, 20 nt, Human
agccuuccccuaccccuugu

SEQ ID NO: 3776502 - RNA, 12 nt, Human
agccuuccucca

SEQ ID NO: 3776503 - RNA, 21 nt, Human
agccuuccucugcagcugacc

SEQ ID NO: 3776504 - RNA, 23 nt, Human
agccuuccucugcagcugaccuc

SEQ ID NO: 3776505 - RNA, 12 nt, Human
agccuucucccu

SEQ ID NO: 3776506 - RNA, 16 nt, Human
agccuucucccuagcu

SEQ ID NO: 3776507 - RNA, 15 nt, Human
agccuucuguaggaa

SEQ ID NO: 3776508 - RNA, 19 nt, Human
agccuucuuugcuugccuc

SEQ ID NO: 3776509 - RNA, 13 nt, Human
agcuaagaaccug

SEQ ID NO: 3776510 - RNA, 19 nt, Human
agcuaaggacauuucccag

SEQ ID NO: 3776511 - RNA, 18 nt, Human
agcuaaggcucuaugagu

SEQ ID NO: 3776512 - RNA, 20 nt, Human
agcuaaggcucuaugagucu

SEQ ID NO: 3776513 - RNA, 19 nt, Human
agcuaagggaagacauuuc

SEQ ID NO: 3776514 - RNA, 18 nt, Human
agcuaagggguggggcug

SEQ ID NO: 3776515 - RNA, 19 nt, Human
agcuaagggguggggcugc

SEQ ID NO: 3776516 - RNA, 20 nt, Human
agcuaagggugggugcucag

SEQ ID NO: 3776517 - RNA, 23 nt, Human
agcuaagggugggugcucagaau

SEQ ID NO: 3776518 - RNA, 19 nt, Human
agcuaauaaaaagcuuuug

SEQ ID NO: 3776519 - RNA, 14 nt, Human
agcuaauaaaauau

SEQ ID NO: 3776520 - RNA, 15 nt, Human
agcuaauaaaauauc

SEQ ID NO: 3776521 - RNA, 16 nt, Human
agcuaaucagcauucu

SEQ ID NO: 3776522 - RNA, 20 nt, Human
agcuaaucuguagggcugga

SEQ ID NO: 3776523 - RNA, 12 nt, Human
agcuacaaaugc

SEQ ID NO: 3776524 - RNA, 15 nt, Human
agcuacaacagccuc

SEQ ID NO: 3776525 - RNA, 17 nt, Human
agcuacaacuaauaaca

SEQ ID NO: 3776526 - RNA, 21 nt, Human
agcuacaccuuucuccuuugu

SEQ ID NO: 3776527 - RNA, 14 nt, Human
agcuacagagaaac

SEQ ID NO: 3776528 - RNA, 18 nt, Human
agcuacagagaaaccagc

SEQ ID NO: 3776529 - RNA, 22 nt, Human
agcuacagagaaaccagcuucc

SEQ ID NO: 3776530 - RNA, 20 nt, Human
agcuacagcuuucuugcucc

SEQ ID NO: 3776531 - RNA, 22 nt, Human
agcuacaggaagcaccccaugc

SEQ ID NO: 3776532 - RNA, 19 nt, Human
agcuacagguuacaacaga

SEQ ID NO: 3776533 - RNA, 21 nt, Human
agcuacagguuacaacagauu

SEQ ID NO: 3776534 - RNA, 16 nt, Human
agcuacccaaaagaga

SEQ ID NO: 3776535 - RNA, 19 nt, Human
agcuacccaaaagagaaaa

SEQ ID NO: 3776536 - RNA, 20 nt, Human
agcuacccaaaagagaaaaa

SEQ ID NO: 3776537 - RNA, 15 nt, Human
agcuacccuguguau

SEQ ID NO: 3776538 - RNA, 21 nt, Human
agcuacccuuuuucuccagcu

SEQ ID NO: 3776539 - RNA, 23 nt, Human
agcuaccucaaccaaugccaaaa

SEQ ID NO: 3776540 - RNA, 22 nt, Human
agcuaccugcucagcccugcac

SEQ ID NO: 3776541 - RNA, 18 nt, Human
agcuaccuguguggacag

SEQ ID NO: 3776542 - RNA, 22 nt, Human
agcuacguggcacuauauucug

SEQ ID NO: 3776543 - RNA, 13 nt, Human
agcuacuaaugau

SEQ ID NO: 3776544 - RNA, 18 nt, Human
agcuacuaaugauguuuu

SEQ ID NO: 3776545 - RNA, 17 nt, Human
agcuacuagcaaaauaa

SEQ ID NO: 3776546 - RNA, 22 nt, Human
agcuacucaagaggcugaggca

SEQ ID NO: 3776547 - RNA, 18 nt, Human
agcuacucagaagccuga

SEQ ID NO: 3776548 - RNA, 13 nt, Human
agcuacucaggag

SEQ ID NO: 3776549 - RNA, 17 nt, Human
agcuacucaggaggcug

SEQ ID NO: 3776550 - RNA, 19 nt, Human
agcuacucgggaggcugag

SEQ ID NO: 3776551 - RNA, 22 nt, Human
agcuacucgggaggcugaggca

SEQ ID NO: 3776552 - RNA, 16 nt, Human
agcuacugauuuuugu

SEQ ID NO: 3776553 - RNA, 12 nt, Human
agcuacugccau

SEQ ID NO: 3776554 - RNA, 18 nt, Human
agcuacugcggaaaagga

SEQ ID NO: 3776555 - RNA, 15 nt, Human
agcuacuuaagagaa

SEQ ID NO: 3776556 - RNA, 19 nt, Human
agcuacuuaagagaaaugg

SEQ ID NO: 3776557 - RNA, 15 nt, Human
agcuacuuccuccuc

SEQ ID NO: 3776558 - RNA, 16 nt, Human
agcuacuugggaggcu

SEQ ID NO: 3776559 - RNA, 14 nt, Human
agcuacuugggcca

SEQ ID NO: 3776560 - RNA, 15 nt, Human
agcuacuugggccau

SEQ ID NO: 3776561 - RNA, 22 nt, Human
agcuacuugggccauagcuccu

SEQ ID NO: 3776562 - RNA, 17 nt, Human
agcuacuugguuugugu

SEQ ID NO: 3776563 - RNA, 21 nt, Human
agcuacuugguuuguguucuu

SEQ ID NO: 3776564 - RNA, 16 nt, Human
agcuagaacccucugu

SEQ ID NO: 3776565 - RNA, 17 nt, Human
agcuagaacccucuguu

SEQ ID NO: 3776566 - RNA, 14 nt, Human
agcuagaaggccac

SEQ ID NO: 3776567 - RNA, 24 nt, Human
agcuagaagugggccaggacaggc

SEQ ID NO: 3776568 - RNA, 14 nt, Human
agcuagaauugagu

SEQ ID NO: 3776569 - RNA, 16 nt, Human
agcuagacacaugaag

SEQ ID NO: 3776570 - RNA, 17 nt, Human
agcuagacacaugaagg

SEQ ID NO: 3776571 - RNA, 14 nt, Human
agcuagacugguga

SEQ ID NO: 3776572 - RNA, 21 nt, Human
agcuagacuggugacugauuc

SEQ ID NO: 3776573 - RNA, 14 nt, Human
agcuagagcuucaa

SEQ ID NO: 3776574 - RNA, 12 nt, Human
agcuagaggaac

SEQ ID NO: 3776575 - RNA, 19 nt, Human
agcuagcaaaagaaguaac

SEQ ID NO: 3776576 - RNA, 17 nt, Human
agcuagcuccccuccuc

SEQ ID NO: 3776577 - RNA, 15 nt, Human
agcuaggaacaaauc

SEQ ID NO: 3776578 - RNA, 23 nt, Human
agcuaggaacaaaucuuccuggu

SEQ ID NO: 3776579 - RNA, 18 nt, Human
agcuaggaauuguguuua

SEQ ID NO: 3776580 - RNA, 12 nt, Human
agcuaggccugg

SEQ ID NO: 3776581 - RNA, 21 nt, Human
agcuaggccuggccagaugca

SEQ ID NO: 3776582 - RNA, 19 nt, Human
agcuaguaauauauucuga

SEQ ID NO: 3776583 - RNA, 14 nt, Human
agcuagucaacagu

SEQ ID NO: 3776584 - RNA, 17 nt, Human
agcuagugacccacaug

SEQ ID NO: 3776585 - RNA, 20 nt, Human
agucccagcuacuugggagg

SEQ ID NO: 3776586 - RNA, 20 nt, Human
agucccaggagcugcccaga

SEQ ID NO: 3776587 - RNA, 15 nt, Human
aguccccaccccugc

SEQ ID NO: 3776588 - RNA, 17 nt, Human
aguccccaccccugccc

SEQ ID NO: 3776589 - RNA, 21 nt, Human
aguccccaggccccaggaagc

SEQ ID NO: 3776590 - RNA, 15 nt, Human
agucccccaacccca

SEQ ID NO: 3776591 - RNA, 22 nt, Human
agucccccuauccuuggcacca

SEQ ID NO: 3776592 - RNA, 16 nt, Human
agucccccugccccag

SEQ ID NO: 3776593 - RNA, 19 nt, Human
aguccccgggcaucuuugg

SEQ ID NO: 3776594 - RNA, 16 nt, Human
aguccccgucugccug

SEQ ID NO: 3776595 - RNA, 15 nt, Human
aguccccgugccccg

SEQ ID NO: 3776596 - RNA, 23 nt, Human
aguccccgugccccgccuccccg

SEQ ID NO: 3776597 - RNA, 22 nt, Human
aguccccguggccaucccugug

SEQ ID NO: 3776598 - RNA, 16 nt, Human
aguccccucccaucug

SEQ ID NO: 3776599 - RNA, 18 nt, Human
aguccccucccaucuggg

SEQ ID NO: 3776600 - RNA, 19 nt, Human
aguccccuccccggcccua

SEQ ID NO: 3776601 - RNA, 19 nt, Human
aguccccuguuuguuucug

SEQ ID NO: 3776602 - RNA, 23 nt, Human
aguccccuguuuguuucugaaag

SEQ ID NO: 3776603 - RNA, 13 nt, Human
agucccgucagga

SEQ ID NO: 3776604 - RNA, 15 nt, Human
agucccgucaggacg

SEQ ID NO: 3776605 - RNA, 15 nt, Human
agucccuauguauuu

SEQ ID NO: 3776606 - RNA, 20 nt, Human
agucccuauguauuugcagu

SEQ ID NO: 3776607 - RNA, 21 nt, Human
agucccucaagccaccagaug

SEQ ID NO: 3776608 - RNA, 23 nt, Human
agucccugaggcagguccccaga

SEQ ID NO: 3776609 - RNA, 13 nt, Human
agucccugccaau

SEQ ID NO: 3776610 - RNA, 21 nt, Human
agucccugccacgaauuucug

SEQ ID NO: 3776611 - RNA, 13 nt, Human
agucccugccugg

SEQ ID NO: 3776612 - RNA, 15 nt, Human
agucccugccuggac

SEQ ID NO: 3776613 - RNA, 23 nt, Human
agucccugccuggaccagccucu

SEQ ID NO: 3776614 - RNA, 16 nt, Human
agucccuguaauuguu

SEQ ID NO: 3776615 - RNA, 20 nt, Human
agucccuguaauuguuguuu

SEQ ID NO: 3776616 - RNA, 16 nt, Human
agucccugucaccucu

SEQ ID NO: 3776617 - RNA, 20 nt, Human
agucccuguuuucugagccc

SEQ ID NO: 3776618 - RNA, 21 nt, Human
agucccuguuuucugagcccg

SEQ ID NO: 3776619 - RNA, 22 nt, Human
agucccuuccccucccuggcuc

SEQ ID NO: 3776620 - RNA, 23 nt, Human
agucccuuccccucccuggcucc

SEQ ID NO: 3776621 - RNA, 23 nt, Human
aguccgaaagggacuuggaagcu

SEQ ID NO: 3776622 - RNA, 21 nt, Human
aguccggccccaguacacagg

SEQ ID NO: 3776623 - RNA, 15 nt, Human
aguccgucaaaacag

SEQ ID NO: 3776624 - RNA, 21 nt, Human
aguccgugcugacagcugcuc

SEQ ID NO: 3776625 - RNA, 23 nt, Human
aguccgugcugacagcugcuccu

SEQ ID NO: 3776626 - RNA, 22 nt, Human
aguccguguggauccaauguua

SEQ ID NO: 3776627 - RNA, 20 nt, Human
aguccuacaagcuaaaauua

SEQ ID NO: 3776628 - RNA, 19 nt, Human
aguccuagaauguuucauu

SEQ ID NO: 3776629 - RNA, 21 nt, Human
aguccuagcugcacagggcag

SEQ ID NO: 3776630 - RNA, 16 nt, Human
aguccuaucugggcuu

SEQ ID NO: 3776631 - RNA, 20 nt, Human
aguccuaucugggcuuccug

SEQ ID NO: 3776632 - RNA, 17 nt, Human
aguccucaaagcuuuuu

SEQ ID NO: 3776633 - RNA, 20 nt, Human
aguccucaaagcuuuuugaa

SEQ ID NO: 3776634 - RNA, 16 nt, Human
aguccucacucccagu

SEQ ID NO: 3776635 - RNA, 14 nt, Human
aguccuccagaacu

SEQ ID NO: 3776636 - RNA, 19 nt, Human
aguccuccagaacucuucc

SEQ ID NO: 3776637 - RNA, 13 nt, Human
aguccuccccuca

SEQ ID NO: 3776638 - RNA, 15 nt, Human
aguccuccccucaca

SEQ ID NO: 3776639 - RNA, 16 nt, Human
aguccuccccucacag

SEQ ID NO: 3776640 - RNA, 22 nt, Human
aguccuccccucacagccucug

SEQ ID NO: 3776641 - RNA, 13 nt, Human
aguccucuccacc

SEQ ID NO: 3776642 - RNA, 14 nt, Human
aguccucugaauga

SEQ ID NO: 3776643 - RNA, 19 nt, Human
aguccucuuuucugagagg

SEQ ID NO: 3776644 - RNA, 22 nt, Human
aguccucuuuucugagaggacu

SEQ ID NO: 3776645 - RNA, 20 nt, Human
aguccugcacaguuuucugg

SEQ ID NO: 3776646 - RNA, 16 nt, Human
aguccugccuggccag

SEQ ID NO: 3776647 - RNA, 20 nt, Human
aguccugccuggccaggcag

SEQ ID NO: 3776648 - RNA, 21 nt, Human
aguccugccuggccaggcaga

SEQ ID NO: 3776649 - RNA, 22 nt, Human
aguccugcgaaaacccccaaac

SEQ ID NO: 3776650 - RNA, 24 nt, Human
aguccugcuaccucccuugccuuu

SEQ ID NO: 3776651 - RNA, 15 nt, Human
aguccugcuccagaa

SEQ ID NO: 3776652 - RNA, 18 nt, Human
aguccugcuccagaauuu

SEQ ID NO: 3776653 - RNA, 20 nt, Human
aguccugcucucuacccagc

SEQ ID NO: 3776654 - RNA, 20 nt, Human
aguccuggaagccagcuuuc

SEQ ID NO: 3776655 - RNA, 19 nt, Human
aguccuggaugauacuaau

SEQ ID NO: 3776656 - RNA, 18 nt, Human
aguccuggauguugugug

SEQ ID NO: 3776657 - RNA, 14 nt, Human
aguccuggccuggc

SEQ ID NO: 3776658 - RNA, 20 nt, Human
aguccuggccuggcuucucc

SEQ ID NO: 3776659 - RNA, 22 nt, Human
aguccugggagaaccucaggcu

SEQ ID NO: 3776660 - RNA, 15 nt, Human
aguccugggaugugg

SEQ ID NO: 3776661 - RNA, 13 nt, Human
aguccugugaaug

SEQ ID NO: 3776662 - RNA, 22 nt, Human
aguccugugaaugccacugccu

SEQ ID NO: 3776663 - RNA, 14 nt, Human
aguccugugaauuu

SEQ ID NO: 3776664 - RNA, 23 nt, Human
aguccugugaauuucuucacugu

SEQ ID NO: 3776665 - RNA, 21 nt, Human
aguccuuaaaaaucacacugu

SEQ ID NO: 3776666 - RNA, 23 nt, Human
aguccuuauguuaagcccuggca

SEQ ID NO: 3776667 - RNA, 16 nt, Human
aguccuucaccucacu

SEQ ID NO: 3776668 - RNA, 17 nt, Human
aguccuucaccucacug

SEQ ID NO: 3776669 - RNA, 23 nt, Human
aguccuugauuucaaaguuuugu

SEQ ID NO: 3776670 - RNA, 12 nt, Human
aguccuuuugua

SEQ ID NO: 3776671 - RNA, 14 nt, Human
aguccuuuuguaaa

SEQ ID NO: 3776672 - RNA, 16 nt, Human
aguccuuuuuuuccau

SEQ ID NO: 3776673 - RNA, 17 nt, Human
agucgcgcugccugugu

SEQ ID NO: 3776674 - RNA, 13 nt, Human
agucgcugaggaa

SEQ ID NO: 3776675 - RNA, 17 nt, Human
agucgggggcuggccua

SEQ ID NO: 3776676 - RNA, 21 nt, Human
agucgggggcuggccuaggag

SEQ ID NO: 3776677 - RNA, 14 nt, Human
agucgguccucuuu

SEQ ID NO: 3776678 - RNA, 19 nt, Human
agucguccuuacuccugug

SEQ ID NO: 3776679 - RNA, 14 nt, Human
agucgugccugugu

SEQ ID NO: 3776680 - RNA, 17 nt, Human
agucguggggugugcug

SEQ ID NO: 3776681 - RNA, 20 nt, Human
agucguggggugugcuggga

SEQ ID NO: 3776682 - RNA, 20 nt, Human
agucuaaagcugguuuaaug

SEQ ID NO: 3776683 - RNA, 17 nt, Human
agucuaaaguuuacagu

SEQ ID NO: 3776684 - RNA, 18 nt, Human
agucuaaggccauggcau

SEQ ID NO: 3776685 - RNA, 13 nt, Human
agucuaauuuuua

SEQ ID NO: 3776686 - RNA, 17 nt, Human
agucuaauuuuuauuca

SEQ ID NO: 3776687 - RNA, 14 nt, Human
agucuacagaguga

SEQ ID NO: 3776688 - RNA, 21 nt, Human
agucuaccaaccuguucaagu

SEQ ID NO: 3776689 - RNA, 14 nt, Human
agucuacccagaga

SEQ ID NO: 3776690 - RNA, 17 nt, Human
agucuacccgacauaag

SEQ ID NO: 3776691 - RNA, 15 nt, Human
agucuacgcucuccu

SEQ ID NO: 3776692 - RNA, 19 nt, Human
agucuacucuuaagccauc

SEQ ID NO: 3776693 - RNA, 18 nt, Human
agucuagauggcuccucu

SEQ ID NO: 3776694 - RNA, 19 nt, Human
agucuagauggcuccucuc

SEQ ID NO: 3776695 - RNA, 14 nt, Human
agucuagauucaaa

SEQ ID NO: 3776696 - RNA, 21 nt, Human
agucuagcguagugcagcagg

SEQ ID NO: 3776697 - RNA, 16 nt, Human
agucuaggagcuggga

SEQ ID NO: 3776698 - RNA, 22 nt, Human
agucuaggagcugggaggaaaa

SEQ ID NO: 3776699 - RNA, 20 nt, Human
agucuagguugguagaguuu

SEQ ID NO: 3776700 - RNA, 15 nt, Human
agucuaguguaguau

SEQ ID NO: 3776701 - RNA, 23 nt, Human
agucuauaugacuucagaaaugu

SEQ ID NO: 3776702 - RNA, 22 nt, Human
agucuaucaaccccagacacug

SEQ ID NO: 3776703 - RNA, 15 nt, Human
agucuauccacagag

SEQ ID NO: 3776704 - RNA, 18 nt, Human
agucuaucuaaugacaug

SEQ ID NO: 3776705 - RNA, 11 nt, Human
agucuauggcc

SEQ ID NO: 3776706 - RNA, 17 nt, Human
agucucaaaaauacaaa

SEQ ID NO: 3776707 - RNA, 19 nt, Human
agucucaaaaauacaaaau

SEQ ID NO: 3776708 - RNA, 20 nt, Human
agucucaaaaauacaaaaua

SEQ ID NO: 3776709 - RNA, 21 nt, Human
agucucaaaaauacaaaauaa

SEQ ID NO: 3776710 - RNA, 16 nt, Human
agucucaaugaaauag

SEQ ID NO: 3776711 - RNA, 21 nt, Human
agucucacaugauuccagcca

SEQ ID NO: 3776712 - RNA, 23 nt, Human
agucucacaugauuccagccauc

SEQ ID NO: 3776713 - RNA, 13 nt, Human
agucucaggaaau

SEQ ID NO: 3776714 - RNA, 21 nt, Human
agucucagugcuagcuuauuu

SEQ ID NO: 3776715 - RNA, 21 nt, Human
agucucaugccuugagaucug

SEQ ID NO: 3776716 - RNA, 19 nt, Human
agucuccaaagucucugga

SEQ ID NO: 3776717 - RNA, 18 nt, Human
agucuccagcccacguuc

SEQ ID NO: 3776718 - RNA, 13 nt, Human
agucucccaaggc

SEQ ID NO: 3776719 - RNA, 14 nt, Human
agucucccagggag

SEQ ID NO: 3776720 - RNA, 15 nt, Human
agucucccagggagc

SEQ ID NO: 3776721 - RNA, 23 nt, Human
agucucccccacccuuguuccag

SEQ ID NO: 3776722 - RNA, 14 nt, Human
agucucccucccuu

SEQ ID NO: 3776723 - RNA, 12 nt, Human
agucucccuucu

SEQ ID NO: 3776724 - RNA, 14 nt, Human
agucucccuucucc

SEQ ID NO: 3776725 - RNA, 17 nt, Human
agucucccuucucccau

SEQ ID NO: 3776726 - RNA, 22 nt, Human
agucuccggccucuccagccuc

SEQ ID NO: 3776727 - RNA, 14 nt, Human
agucuccucuuuaa

SEQ ID NO: 3776728 - RNA, 20 nt, Human
agugaagacagaaccacagg

SEQ ID NO: 3776729 - RNA, 20 nt, Human
agugaagaggggcagcccuu

SEQ ID NO: 3776730 - RNA, 15 nt, Human
agugaagguuuacaa

SEQ ID NO: 3776731 - RNA, 21 nt, Human
agugaagucaugaccuccagg

SEQ ID NO: 3776732 - RNA, 15 nt, Human
agugaauaaacuuca

SEQ ID NO: 3776733 - RNA, 18 nt, Human
agugaauaaacuucagca

SEQ ID NO: 3776734 - RNA, 19 nt, Human
agugaauaaacuucagcac

SEQ ID NO: 3776735 - RNA, 20 nt, Human
agugaauaaacuucagcacc

SEQ ID NO: 3776736 - RNA, 21 nt, Human
agugaauaaacuucagcacca

SEQ ID NO: 3776737 - RNA, 18 nt, Human
agugaauaacugcaaagu

SEQ ID NO: 3776738 - RNA, 12 nt, Human
agugaauauuca

SEQ ID NO: 3776739 - RNA, 23 nt, Human
agugaaucuaaaagcuuuugcuu

SEQ ID NO: 3776740 - RNA, 13 nt, Human
agugaaugaaaga

SEQ ID NO: 3776741 - RNA, 16 nt, Human
agugaaugauucagug

SEQ ID NO: 3776742 - RNA, 14 nt, Human
agugaauucccuca

SEQ ID NO: 3776743 - RNA, 12 nt, Human
agugaauugaag

SEQ ID NO: 3776744 - RNA, 13 nt, Human
agugaauuugaau

SEQ ID NO: 3776745 - RNA, 20 nt, Human
agugaauuugaaugaaaaau

SEQ ID NO: 3776746 - RNA, 16 nt, Human
agugaauuugcacugu

SEQ ID NO: 3776747 - RNA, 15 nt, Human
agugaauuuuucucu

SEQ ID NO: 3776748 - RNA, 20 nt, Human
agugaauuuuucucuaacuc

SEQ ID NO: 3776749 - RNA, 18 nt, Human
agugaauuuuugcaauaa

SEQ ID NO: 3776750 - RNA, 23 nt, Human
agugaauuuuugcaauaaugcag

SEQ ID NO: 3776751 - RNA, 24 nt, Human
agugaauuuuugcaauaaugcagu

SEQ ID NO: 3776752 - RNA, 14 nt, Human
agugacaaaauaga

SEQ ID NO: 3776753 - RNA, 14 nt, Human
agugacaaggcccc

SEQ ID NO: 3776754 - RNA, 16 nt, Human
agugacaaggccccag

SEQ ID NO: 3776755 - RNA, 18 nt, Human
agugacaaggccccagag

SEQ ID NO: 3776756 - RNA, 13 nt, Human
agugacagaguaa

SEQ ID NO: 3776757 - RNA, 19 nt, Human
agugacagaguucacuaua

SEQ ID NO: 3776758 - RNA, 13 nt, Human
agugacagggaag

SEQ ID NO: 3776759 - RNA, 20 nt, Human
agugacagggaagcuacagg

SEQ ID NO: 3776760 - RNA, 15 nt, Human
agugacaguauuuug

SEQ ID NO: 3776761 - RNA, 19 nt, Human
agugacaguggauugcauu

SEQ ID NO: 3776762 - RNA, 17 nt, Human
agugacccacaugccau

SEQ ID NO: 3776763 - RNA, 15 nt, Human
agugacccggaggcc

SEQ ID NO: 3776764 - RNA, 16 nt, Human
agugacccggaggcca

SEQ ID NO: 3776765 - RNA, 17 nt, Human
agugacccggaggccac

SEQ ID NO: 3776766 - RNA, 23 nt, Human
agugacccggaggccacaugagu

SEQ ID NO: 3776767 - RNA, 17 nt, Human
agugacccugcucucac

SEQ ID NO: 3776768 - RNA, 18 nt, Human
agugaccugaggaagcgu

SEQ ID NO: 3776769 - RNA, 17 nt, Human
agugacuaaaccauugu

SEQ ID NO: 3776770 - RNA, 18 nt, Human
agugacuaguacaaauua

SEQ ID NO: 3776771 - RNA, 23 nt, Human
agugacucauccucuugaagaug

SEQ ID NO: 3776772 - RNA, 16 nt, Human
agugacuccaagaaca

SEQ ID NO: 3776773 - RNA, 13 nt, Human
agugacuccagga

SEQ ID NO: 3776774 - RNA, 17 nt, Human
agugacuccaggagagg

SEQ ID NO: 3776775 - RNA, 20 nt, Human
agugacucgggcuccugugc

SEQ ID NO: 3776776 - RNA, 22 nt, Human
agugacucgggcuccugugccc

SEQ ID NO: 3776777 - RNA, 17 nt, Human
agugacuguaucugugu

SEQ ID NO: 3776778 - RNA, 17 nt, Human
agugacuguucaagagc

SEQ ID NO: 3776779 - RNA, 14 nt, Human
agugacuugcccag

SEQ ID NO: 3776780 - RNA, 16 nt, Human
agugacuuguguccca

SEQ ID NO: 3776781 - RNA, 18 nt, Human
agugacuuuggcugcaug

SEQ ID NO: 3776782 - RNA, 18 nt, Human
agugagaaaaagcuccug

SEQ ID NO: 3776783 - RNA, 20 nt, Human
agugagaaaaagcuccuguc

SEQ ID NO: 3776784 - RNA, 22 nt, Human
agugagaaaaagcuccuguccu

SEQ ID NO: 3776785 - RNA, 23 nt, Human
agugagaagaauauuguuccuaa

SEQ ID NO: 3776786 - RNA, 12 nt, Human
agugagacagaa

SEQ ID NO: 3776787 - RNA, 21 nt, Human
agugagacaguccagccugga

SEQ ID NO: 3776788 - RNA, 16 nt, Human
agugagacccugucuc

SEQ ID NO: 3776789 - RNA, 17 nt, Human
agugagacccugucuca

SEQ ID NO: 3776790 - RNA, 14 nt, Human
agugagagggcaug

SEQ ID NO: 3776791 - RNA, 22 nt, Human
agugagagggcaugcgcacaag

SEQ ID NO: 3776792 - RNA, 12 nt, Human
agugagcaugcu

SEQ ID NO: 3776793 - RNA, 22 nt, Human
agugagcauggaacacuucgag

SEQ ID NO: 3776794 - RNA, 15 nt, Human
agugagccacuccgg

SEQ ID NO: 3776795 - RNA, 11 nt, Human
agugagccuga

SEQ ID NO: 3776796 - RNA, 14 nt, Human
agugagccuggcuc

SEQ ID NO: 3776797 - RNA, 12 nt, Human
agugagcugguu

SEQ ID NO: 3776798 - RNA, 23 nt, Human
agugagcugguuuuuagcggaga

SEQ ID NO: 3776799 - RNA, 21 nt, Human
agugagcuuggaaaggaccag

SEQ ID NO: 3776800 - RNA, 14 nt, Human
agugaggaaggcag

SEQ ID NO: 3776801 - RNA, 14 nt, Human
agugaggagaauga

SEQ ID NO: 3776802 - RNA, 16 nt, Human
agugaggaugaaaaaa

SEQ ID NO: 3776803 - RNA, 16 nt, Human
agugaggccacugaag

SEQ ID NO: 3776804 - RNA, 12 nt, Human
agugaggcucug

SEQ ID NO: 3776805 - RNA, 15 nt, Human
agugaggcucugccc

SEQ ID NO: 3776806 - RNA, 16 nt, Human
agugaggcucugcccu

SEQ ID NO: 3776807 - RNA, 12 nt, Human
agugagggccug

SEQ ID NO: 3776808 - RNA, 20 nt, Human
agugagggcuugucauuacc

SEQ ID NO: 3776809 - RNA, 22 nt, Human
agugagggucagagaggaguca

SEQ ID NO: 3776810 - RNA, 16 nt, Human
agugagucgaggacag

SEQ ID NO: 3776811 - RNA, 14 nt, Human
agugagucucucug

SEQ ID NO: 3776812 - RNA, 15 nt, Human
agugagucucucugg

SEQ ID NO: 3776813 - RNA, 14 nt, Human
agugagucugucag

SEQ ID NO: 3776814 - RNA, 15 nt, Human
agugagucugucagc

SEQ ID NO: 3776815 - RNA, 23 nt, Human
agugagugcaaaaagcugaguau

SEQ ID NO: 3776816 - RNA, 15 nt, Human
agugagugugcugcu

SEQ ID NO: 3776817 - RNA, 18 nt, Human
agugaguguggcuccccu

SEQ ID NO: 3776818 - RNA, 19 nt, Human
agugaguguggcuccccuc

SEQ ID NO: 3776819 - RNA, 14 nt, Human
agugaguguuucua

SEQ ID NO: 3776820 - RNA, 16 nt, Human
agugaguguuucuaug

SEQ ID NO: 3776821 - RNA, 23 nt, Human
agugaguugauagcacagacccu

SEQ ID NO: 3776822 - RNA, 17 nt, Human
agugauaacuccuaaga

SEQ ID NO: 3776823 - RNA, 19 nt, Human
agugauaauuucuggaauu

SEQ ID NO: 3776824 - RNA, 17 nt, Human
agugauacaacuucaag

SEQ ID NO: 3776825 - RNA, 20 nt, Human
agugauacuauccaguuacu

SEQ ID NO: 3776826 - RNA, 15 nt, Human
agugauauucuuugu

SEQ ID NO: 3776827 - RNA, 19 nt, Human
agugauauucuuuguuaau

SEQ ID NO: 3776828 - RNA, 15 nt, Human
agugauauuggaacu

SEQ ID NO: 3776829 - RNA, 15 nt, Human
agugauauuucucua

SEQ ID NO: 3776830 - RNA, 14 nt, Human
agugaucaaacuac

SEQ ID NO: 3776831 - RNA, 16 nt, Human
agugaucaagaagacu

SEQ ID NO: 3776832 - RNA, 19 nt, Human
agugaucaauaaaauguga

SEQ ID NO: 3776833 - RNA, 20 nt, Human
agugaucaauaaaaugugau

SEQ ID NO: 3776834 - RNA, 20 nt, Human
agugauccucccaccucagc

SEQ ID NO: 3776835 - RNA, 24 nt, Human
agugauccucccaccucagccucc

SEQ ID NO: 3776836 - RNA, 19 nt, Human
agugaugggcuuucucuuu

SEQ ID NO: 3776837 - RNA, 20 nt, Human
agugauggguuaguggaugg

SEQ ID NO: 3776838 - RNA, 17 nt, Human
agugauguuuuuaugau

SEQ ID NO: 3776839 - RNA, 23 nt, Human
agugauuaaggucucucuuugga

SEQ ID NO: 3776840 - RNA, 19 nt, Human
agugauucucaugccucag

SEQ ID NO: 3776841 - RNA, 14 nt, Human
agugauugcagcuu

SEQ ID NO: 3776842 - RNA, 16 nt, Human
agugauuguaugaauu

SEQ ID NO: 3776843 - RNA, 15 nt, Human
agugauugucuuaau

SEQ ID NO: 3776844 - RNA, 17 nt, Human
agugauugucuuaauau

SEQ ID NO: 3776845 - RNA, 13 nt, Human
agugauuucuaga

SEQ ID NO: 3776846 - RNA, 21 nt, Human
agugauuucuggggccccacc

SEQ ID NO: 3776847 - RNA, 23 nt, Human
agugauuuuuauccaaucuuguu

SEQ ID NO: 3776848 - RNA, 21 nt, Human
agugauuuuuaugccaccuga

SEQ ID NO: 3776849 - RNA, 17 nt, Human
agugcaaaucauagcug

SEQ ID NO: 3776850 - RNA, 18 nt, Human
agugcaaauuugauacau

SEQ ID NO: 3776851 - RNA, 15 nt, Human
agugcaacaguagca

SEQ ID NO: 3776852 - RNA, 24 nt, Human
agugcaaccacacaccucaccaga

SEQ ID NO: 3776853 - RNA, 18 nt, Human
agugcaagccccugcucc

SEQ ID NO: 3776854 - RNA, 14 nt, Human
agugcaaggaccua

SEQ ID NO: 3776855 - RNA, 23 nt, Human
agugcaauaaaucugacccagug

SEQ ID NO: 3776856 - RNA, 15 nt, Human
agugcaauauauuuu

SEQ ID NO: 3776857 - RNA, 16 nt, Human
agugcaaugacacagu

SEQ ID NO: 3776858 - RNA, 11 nt, Human
agugcacaccu

SEQ ID NO: 3776859 - RNA, 13 nt, Human
agugcacagcugu

SEQ ID NO: 3776860 - RNA, 18 nt, Human
agugcacggggcacagcg

SEQ ID NO: 3776861 - RNA, 21 nt, Human
agugcacuaauguguaagaca

SEQ ID NO: 3776862 - RNA, 21 nt, Human
agugcacugaaagucacggcu

SEQ ID NO: 3776863 - RNA, 18 nt, Human
agugcacuuucuaauguu

SEQ ID NO: 3776864 - RNA, 21 nt, Human
agugcacuuucuaauguuucu

SEQ ID NO: 3776865 - RNA, 18 nt, Human
agugcagcaaccagagca

SEQ ID NO: 3776866 - RNA, 21 nt, Human
agugcagcaaccagagcacug

SEQ ID NO: 3776867 - RNA, 15 nt, Human
agugcagcagggcag

SEQ ID NO: 3776868 - RNA, 21 nt, Human
agugcagcagguuaagaauuu

SEQ ID NO: 3776869 - RNA, 21 nt, Human
agugcagcccguguggccccu

SEQ ID NO: 3776870 - RNA, 15 nt, Human
agugcagcugauuuu

SEQ ID NO: 3776871 - RNA, 16 nt, Human
agugcagcugauuuua

SEQ ID NO: 3776872 - RNA, 22 nt, Human
aguggaauccuauauagaaugc

SEQ ID NO: 3776873 - RNA, 22 nt, Human
aguggaaugcuuccuagaaguu

SEQ ID NO: 3776874 - RNA, 15 nt, Human
aguggacagucugcu

SEQ ID NO: 3776875 - RNA, 15 nt, Human
aguggaccaggacag

SEQ ID NO: 3776876 - RNA, 19 nt, Human
aguggaccaggacaggacc

SEQ ID NO: 3776877 - RNA, 20 nt, Human
aguggaccaggacaggacca

SEQ ID NO: 3776878 - RNA, 16 nt, Human
aguggacccugaaaug

SEQ ID NO: 3776879 - RNA, 16 nt, Human
aguggaccgcccuuuu

SEQ ID NO: 3776880 - RNA, 13 nt, Human
aguggacucaggg

SEQ ID NO: 3776881 - RNA, 16 nt, Human
aguggacucagugggu

SEQ ID NO: 3776882 - RNA, 19 nt, Human
aguggagccugacagccag

SEQ ID NO: 3776883 - RNA, 12 nt, Human
aguggaggugga

SEQ ID NO: 3776884 - RNA, 19 nt, Human
aguggaggugggcugggcc

SEQ ID NO: 3776885 - RNA, 14 nt, Human
aguggagguuuguc

SEQ ID NO: 3776886 - RNA, 17 nt, Human
aguggagucugccaccc

SEQ ID NO: 3776887 - RNA, 18 nt, Human
aguggaucacucaccauu

SEQ ID NO: 3776888 - RNA, 23 nt, Human
aguggaucuccaaggaccagguu

SEQ ID NO: 3776889 - RNA, 15 nt, Human
aguggaugauguuuc

SEQ ID NO: 3776890 - RNA, 12 nt, Human
aguggauguaua

SEQ ID NO: 3776891 - RNA, 22 nt, Human
aguggcaaagcuguucuuccug

SEQ ID NO: 3776892 - RNA, 21 nt, Human
aguggcaccugucugcuccag

SEQ ID NO: 3776893 - RNA, 21 nt, Human
aguggcagcccagccagcguc

SEQ ID NO: 3776894 - RNA, 12 nt, Human
aguggcagcugc

SEQ ID NO: 3776895 - RNA, 20 nt, Human
aguggcagcugcuuuugucu

SEQ ID NO: 3776896 - RNA, 15 nt, Human
aguggcagggcacag

SEQ ID NO: 3776897 - RNA, 17 nt, Human
aguggcagggcacaggg

SEQ ID NO: 3776898 - RNA, 20 nt, Human
aguggcagggcacagggccu

SEQ ID NO: 3776899 - RNA, 22 nt, Human
aguggcagggcacagggccugg

SEQ ID NO: 3776900 - RNA, 23 nt, Human
aguggcagucuucaguuugcaga

SEQ ID NO: 3776901 - RNA, 19 nt, Human
aguggcaucaucucagcuc

SEQ ID NO: 3776902 - RNA, 22 nt, Human
aguggcauguuuugugcauuug

SEQ ID NO: 3776903 - RNA, 16 nt, Human
aguggcauuggcagca

SEQ ID NO: 3776904 - RNA, 20 nt, Human
aguggccacuaagcagagga

SEQ ID NO: 3776905 - RNA, 21 nt, Human
aguggccagaccagagcucug

SEQ ID NO: 3776906 - RNA, 23 nt, Human
aguggccagaccagagcucugga

SEQ ID NO: 3776907 - RNA, 17 nt, Human
aguggccaucauuucug

SEQ ID NO: 3776908 - RNA, 19 nt, Human
aguggccccaccuggcccu

SEQ ID NO: 3776909 - RNA, 22 nt, Human
aguggccuacaaaucaguaauu

SEQ ID NO: 3776910 - RNA, 15 nt, Human
aguggccucaacccu

SEQ ID NO: 3776911 - RNA, 21 nt, Human
aguggccuccgucacuaccug

SEQ ID NO: 3776912 - RNA, 21 nt, Human
aguggccucuuugucuaaaac

SEQ ID NO: 3776913 - RNA, 23 nt, Human
aguggccuggcuccgcugugugg

SEQ ID NO: 3776914 - RNA, 20 nt, Human
aguggccuuaccccugccuu

SEQ ID NO: 3776915 - RNA, 17 nt, Human
aguggccuuccccagca

SEQ ID NO: 3776916 - RNA, 21 nt, Human
aguggcgaaaucccugcucac

SEQ ID NO: 3776917 - RNA, 19 nt, Human
aguggcgcgaucucagcuc

SEQ ID NO: 3776918 - RNA, 23 nt, Human
aguggcguugggagggggagaaa

SEQ ID NO: 3776919 - RNA, 15 nt, Human
aguggcguuguugca

SEQ ID NO: 3776920 - RNA, 13 nt, Human
aguggcuccuccc

SEQ ID NO: 3776921 - RNA, 14 nt, Human
aguggcugcugacu

SEQ ID NO: 3776922 - RNA, 16 nt, Human
aguggcugcugcccag

SEQ ID NO: 3776923 - RNA, 16 nt, Human
aguggcuggaucugug

SEQ ID NO: 3776924 - RNA, 22 nt, Human
aguggcuggggcauggaaggca

SEQ ID NO: 3776925 - RNA, 18 nt, Human
aguggcugguccagggcu

SEQ ID NO: 3776926 - RNA, 17 nt, Human
aguggcugucaucagcc

SEQ ID NO: 3776927 - RNA, 17 nt, Human
aguggcuguccagugcc

SEQ ID NO: 3776928 - RNA, 23 nt, Human
aguggcuuaaaacaacacucaca

SEQ ID NO: 3776929 - RNA, 21 nt, Human
aguggcuucacuccugcugua

SEQ ID NO: 3776930 - RNA, 19 nt, Human
aguggcuuuuuuccuccug

SEQ ID NO: 3776931 - RNA, 20 nt, Human
agugggaaggacuuggcgcg

SEQ ID NO: 3776932 - RNA, 15 nt, Human
agugggacagagucu

SEQ ID NO: 3776933 - RNA, 17 nt, Human
agugggacagagucugg

SEQ ID NO: 3776934 - RNA, 21 nt, Human
agugggacagggcauggccag

SEQ ID NO: 3776935 - RNA, 18 nt, Human
agugggacccauagaucu

SEQ ID NO: 3776936 - RNA, 14 nt, Human
agugggagaaaaca

SEQ ID NO: 3776937 - RNA, 14 nt, Human
agugggagcugccu

SEQ ID NO: 3776938 - RNA, 11 nt, Human
agugggagggg

SEQ ID NO: 3776939 - RNA, 13 nt, Human
agugggaggggca

SEQ ID NO: 3776940 - RNA, 14 nt, Human
agugggaggggcag

SEQ ID NO: 3776941 - RNA, 17 nt, Human
agugggaggggcaggcu

SEQ ID NO: 3776942 - RNA, 20 nt, Human
agugggaucugucacaccag

SEQ ID NO: 3776943 - RNA, 15 nt, Human
agugggaugaaccag

SEQ ID NO: 3776944 - RNA, 13 nt, Human
agugggccaggac

SEQ ID NO: 3776945 - RNA, 16 nt, Human
agugggccaggacagg

SEQ ID NO: 3776946 - RNA, 20 nt, Human
agugggccaggacaggcccg

SEQ ID NO: 3776947 - RNA, 21 nt, Human
agugggccaggacaggcccgg

SEQ ID NO: 3776948 - RNA, 14 nt, Human
agugggccagugug

SEQ ID NO: 3776949 - RNA, 22 nt, Human
agugggcuugauucugcaguaa

SEQ ID NO: 3776950 - RNA, 18 nt, Human
aguggggagacaccucag

SEQ ID NO: 3776951 - RNA, 19 nt, Human
aguggggagacaccucaga

SEQ ID NO: 3776952 - RNA, 13 nt, Human
aguggggccugug

SEQ ID NO: 3776953 - RNA, 13 nt, Human
aguggggcucucu

SEQ ID NO: 3776954 - RNA, 12 nt, Human
aguggggcuggg

SEQ ID NO: 3776955 - RNA, 20 nt, Human
agugggggaguggccacaga

SEQ ID NO: 3776956 - RNA, 19 nt, Human
aguggggguggggguaggg

SEQ ID NO: 3776957 - RNA, 22 nt, Human
aguggggucucccucuccugcc

SEQ ID NO: 3776958 - RNA, 20 nt, Human
agugggguggugucagaccc

SEQ ID NO: 3776959 - RNA, 18 nt, Human
agugggguuaucucugug

SEQ ID NO: 3776960 - RNA, 21 nt, Human
agugggguuucgcagccugag

SEQ ID NO: 3776961 - RNA, 15 nt, Human
aguggguaaaauuag

SEQ ID NO: 3776962 - RNA, 17 nt, Human
aguggguacccccagga

SEQ ID NO: 3776963 - RNA, 16 nt, Human
agugggucccacuucc

SEQ ID NO: 3776964 - RNA, 18 nt, Human
agugggugaauaauacag

SEQ ID NO: 3776965 - RNA, 22 nt, Human
agugggugagaugcuggagaag

SEQ ID NO: 3776966 - RNA, 15 nt, Human
aguggguuauucugg

SEQ ID NO: 3776967 - RNA, 18 nt, Human
aguggguuauucuggagu

SEQ ID NO: 3776968 - RNA, 19 nt, Human
aguggguuauucuggaguu

SEQ ID NO: 3776969 - RNA, 21 nt, Human
aguggguuucacaagugaaaa

SEQ ID NO: 3776970 - RNA, 22 nt, Human
aguggguuuuuuaguugaauuu

SEQ ID NO: 3776971 - RNA, 23 nt, Human
aguggguuuuuuaguugaauuuu

SEQ ID NO: 3776972 - RNA, 23 nt, Human
aguggucaaaccgcacucaccca

SEQ ID NO: 3776973 - RNA, 17 nt, Human
agugguccacaucccgg

SEQ ID NO: 3776974 - RNA, 17 nt, Human
agugguccuagaggccc

SEQ ID NO: 3776975 - RNA, 22 nt, Human
aguggucgcuuacuuugaguga

SEQ ID NO: 3776976 - RNA, 13 nt, Human
aguggucuuucug

SEQ ID NO: 3776977 - RNA, 16 nt, Human
aguggucuuucuggag

SEQ ID NO: 3776978 - RNA, 14 nt, Human
aguggucuuuguaa

SEQ ID NO: 3776979 - RNA, 15 nt, Human
aguggucuuuguaag

SEQ ID NO: 3776980 - RNA, 18 nt, Human
aguggucuuuguaagagu

SEQ ID NO: 3776981 - RNA, 22 nt, Human
aguggucuuuguaagaguguag

SEQ ID NO: 3776982 - RNA, 24 nt, Human
aguggucuuuguaagaguguagaa

SEQ ID NO: 3776983 - RNA, 22 nt, Human
aguggugauuugaaaaauauaa

SEQ ID NO: 3776984 - RNA, 14 nt, Human
aguggugcagacag

SEQ ID NO: 3776985 - RNA, 21 nt, Human
aguggugcgaucucggcucag

SEQ ID NO: 3776986 - RNA, 17 nt, Human
aguggugcgaucugggu

SEQ ID NO: 3776987 - RNA, 20 nt, Human
aguggugcucaguuguagaa

SEQ ID NO: 3776988 - RNA, 13 nt, Human
agugguggcaggg

SEQ ID NO: 3776989 - RNA, 15 nt, Human
agugguggcagggcc

SEQ ID NO: 3776990 - RNA, 21 nt, Human
agugguggugaacagaacaaa

SEQ ID NO: 3776991 - RNA, 18 nt, Human
aguggugguuuucuguuc

SEQ ID NO: 3776992 - RNA, 20 nt, Human
aguggugguuuucuguucuu

SEQ ID NO: 3776993 - RNA, 21 nt, Human
aguggugguuuucuguucuuu

SEQ ID NO: 3776994 - RNA, 15 nt, Human
aguggugugaucuca

SEQ ID NO: 3776995 - RNA, 22 nt, Human
agugguuucauaggagacacau

SEQ ID NO: 3776996 - RNA, 18 nt, Human
agugguuuuauacugaag

SEQ ID NO: 3776997 - RNA, 20 nt, Human
agugguuuuauacugaagga

SEQ ID NO: 3776998 - RNA, 14 nt, Human
aguguaaaaaugag

SEQ ID NO: 3776999 - RNA, 17 nt, Human
aguguaaaaaugagaac

SEQ ID NO: 3777000 - RNA, 22 nt, Human
aguguaaaauauuuuaaaauaa

SEQ ID NO: 3777001 - RNA, 13 nt, Human
aguguaaagcauu

SEQ ID NO: 3777002 - RNA, 16 nt, Human
aguguaaagcauucca

SEQ ID NO: 3777003 - RNA, 21 nt, Human
aguguaaauccuuuuucuuua

SEQ ID NO: 3777004 - RNA, 13 nt, Human
aguguaacaagaa

SEQ ID NO: 3777005 - RNA, 17 nt, Human
aguguaacaagaaagga

SEQ ID NO: 3777006 - RNA, 23 nt, Human
aguguaacaauuguguagccuuu

SEQ ID NO: 3777007 - RNA, 17 nt, Human
aguguaacagcugaggu

SEQ ID NO: 3777008 - RNA, 18 nt, Human
aguguaacuugcuuaaau

SEQ ID NO: 3777009 - RNA, 17 nt, Human
aguguaagcuagaagaa

SEQ ID NO: 3777010 - RNA, 16 nt, Human
aguguaaugaauaccu

SEQ ID NO: 3777011 - RNA, 14 nt, Human
aguguaauugagaa

SEQ ID NO: 3777012 - RNA, 20 nt, Human
aguguaauuucuuugccugu

SEQ ID NO: 3777013 - RNA, 21 nt, Human
aguguaauuucuuugccuguu

SEQ ID NO: 3777014 - RNA, 18 nt, Human
aguguacagccagaccag

SEQ ID NO: 3777015 - RNA, 19 nt, Human
aguuaugccgcuagauaca

SEQ ID NO: 3777016 - RNA, 13 nt, Human
aguuaugugaaug

SEQ ID NO: 3777017 - RNA, 22 nt, Human
aguuauguguaugugaguauuc

SEQ ID NO: 3777018 - RNA, 17 nt, Human
aguuauuaaaauuguug

SEQ ID NO: 3777019 - RNA, 17 nt, Human
aguuauuaauuucuuca

SEQ ID NO: 3777020 - RNA, 20 nt, Human
aguuauuauauuuacaaaug

SEQ ID NO: 3777021 - RNA, 17 nt, Human
aguuauugaagcagagu

SEQ ID NO: 3777022 - RNA, 22 nt, Human
aguuauugauaaguucauacau

SEQ ID NO: 3777023 - RNA, 23 nt, Human
aguuauugauaaguucauacauu

SEQ ID NO: 3777024 - RNA, 16 nt, Human
aguuauugcaguuuau

SEQ ID NO: 3777025 - RNA, 18 nt, Human
aguuauugcaguuuauca

SEQ ID NO: 3777026 - RNA, 12 nt, Human
aguuauuguaca

SEQ ID NO: 3777027 - RNA, 18 nt, Human
aguuauuguacagcuguu

SEQ ID NO: 3777028 - RNA, 22 nt, Human
aguuauugucccuggcuuccuu

SEQ ID NO: 3777029 - RNA, 23 nt, Human
aguuauugucccuggcuuccuua

SEQ ID NO: 3777030 - RNA, 12 nt, Human
aguuauuuaaau

SEQ ID NO: 3777031 - RNA, 22 nt, Human
aguuauuuaugccucuguauuu

SEQ ID NO: 3777032 - RNA, 19 nt, Human
aguuauuucccuuuagcug

SEQ ID NO: 3777033 - RNA, 14 nt, Human
aguuauuuuccagg

SEQ ID NO: 3777034 - RNA, 14 nt, Human
aguuauuuucuaca

SEQ ID NO: 3777035 - RNA, 23 nt, Human
aguuauuuugcacccacugaaag

SEQ ID NO: 3777036 - RNA, 21 nt, Human
aguuauuuuuauuuauuuaaa

SEQ ID NO: 3777037 - RNA, 16 nt, Human
aguuauuuuuguacau

SEQ ID NO: 3777038 - RNA, 18 nt, Human
aguuauuuuuguacaugu

SEQ ID NO: 3777039 - RNA, 13 nt, Human
aguucaaaauucu

SEQ ID NO: 3777040 - RNA, 18 nt, Human
aguucaaacauaaggaaa

SEQ ID NO: 3777041 - RNA, 14 nt, Human
aguucaaacucaca

SEQ ID NO: 3777042 - RNA, 13 nt, Human
aguucaagaaaua

SEQ ID NO: 3777043 - RNA, 17 nt, Human
aguucaagaaaugaaga

SEQ ID NO: 3777044 - RNA, 18 nt, Human
aguucaagaaaugaagag

SEQ ID NO: 3777045 - RNA, 18 nt, Human
aguucaagaccagccugg

SEQ ID NO: 3777046 - RNA, 22 nt, Human
aguucaaggaacuugaaaaaua

SEQ ID NO: 3777047 - RNA, 15 nt, Human
aguucaaggaccaac

SEQ ID NO: 3777048 - RNA, 15 nt, Human
aguucaaucucccgc

SEQ ID NO: 3777049 - RNA, 22 nt, Human
aguucaaucucccgcugcugcu

SEQ ID NO: 3777050 - RNA, 14 nt, Human
aguucaaugaucua

SEQ ID NO: 3777051 - RNA, 22 nt, Human
aguucaaugaucuagguuuaac

SEQ ID NO: 3777052 - RNA, 18 nt, Human
aguucaauggcugcugaa

SEQ ID NO: 3777053 - RNA, 15 nt, Human
aguucacacccugca

SEQ ID NO: 3777054 - RNA, 16 nt, Human
aguucacacccugcaa

SEQ ID NO: 3777055 - RNA, 17 nt, Human
aguucaccuauuucaaa

SEQ ID NO: 3777056 - RNA, 15 nt, Human
aguucacuucaucuu

SEQ ID NO: 3777057 - RNA, 18 nt, Human
aguucagagcugcccucu

SEQ ID NO: 3777058 - RNA, 21 nt, Human
aguucagagcugcccucuccu

SEQ ID NO: 3777059 - RNA, 22 nt, Human
aguucagagcugcccucuccug

SEQ ID NO: 3777060 - RNA, 16 nt, Human
aguucagaucuuaaua

SEQ ID NO: 3777061 - RNA, 14 nt, Human
aguucagcacuugu

SEQ ID NO: 3777062 - RNA, 21 nt, Human
aguucagcauccgcaggugcu

SEQ ID NO: 3777063 - RNA, 16 nt, Human
aguucagccacccuga

SEQ ID NO: 3777064 - RNA, 15 nt, Human
aguucagcugcuucu

SEQ ID NO: 3777065 - RNA, 21 nt, Human
aguucaggagucccaaggaaa

SEQ ID NO: 3777066 - RNA, 19 nt, Human
aguucagggaagauaaguu

SEQ ID NO: 3777067 - RNA, 19 nt, Human
aguucagguaacaggcaga

SEQ ID NO: 3777068 - RNA, 20 nt, Human
aguucagguaacaggcagau

SEQ ID NO: 3777069 - RNA, 19 nt, Human
aguucagguagcugccccu

SEQ ID NO: 3777070 - RNA, 21 nt, Human
aguucagguagcugccccugg

SEQ ID NO: 3777071 - RNA, 20 nt, Human
aguucaguaagaccggaagc

SEQ ID NO: 3777072 - RNA, 14 nt, Human
aguucaguaccugg

SEQ ID NO: 3777073 - RNA, 19 nt, Human
aguucaguaccuggaggag

SEQ ID NO: 3777074 - RNA, 20 nt, Human
aguucaguaccuggaggagg

SEQ ID NO: 3777075 - RNA, 19 nt, Human
aguucaguggcacucaaca

SEQ ID NO: 3777076 - RNA, 13 nt, Human
aguucaguggcag

SEQ ID NO: 3777077 - RNA, 21 nt, Human
aguucaguggcagggcucagg

SEQ ID NO: 3777078 - RNA, 22 nt, Human
aguucaguggcagggcucagga

SEQ ID NO: 3777079 - RNA, 18 nt, Human
aguucauaaauuuauggu

SEQ ID NO: 3777080 - RNA, 19 nt, Human
aguucauaacagugccauu

SEQ ID NO: 3777081 - RNA, 10 nt, Human
aguucauaca

SEQ ID NO: 3777082 - RNA, 20 nt, Human
aguucauagggucucuucag

SEQ ID NO: 3777083 - RNA, 20 nt, Human
aguucaucagaguuauggug

SEQ ID NO: 3777084 - RNA, 22 nt, Human
aguucauccaauccucacuggg

SEQ ID NO: 3777085 - RNA, 19 nt, Human
aguucaucccagccccaau

SEQ ID NO: 3777086 - RNA, 16 nt, Human
aguucaucccuucucu

SEQ ID NO: 3777087 - RNA, 20 nt, Human
aguucaucccuucucuucca

SEQ ID NO: 3777088 - RNA, 22 nt, Human
aguucaucccuucucuuccagg

SEQ ID NO: 3777089 - RNA, 22 nt, Human
aguucaucuugaauuguaagga

SEQ ID NO: 3777090 - RNA, 13 nt, Human
aguucaugcagcu

SEQ ID NO: 3777091 - RNA, 17 nt, Human
aguucaugucugcuauc

SEQ ID NO: 3777092 - RNA, 16 nt, Human
aguucauuagaaauau

SEQ ID NO: 3777093 - RNA, 14 nt, Human
aguuccaagagucu

SEQ ID NO: 3777094 - RNA, 21 nt, Human
aguuccacugagcuccaugug

SEQ ID NO: 3777095 - RNA, 22 nt, Human
aguuccaugaagaccacaucca

SEQ ID NO: 3777096 - RNA, 18 nt, Human
aguucccacauuaaagaa

SEQ ID NO: 3777097 - RNA, 22 nt, Human
aguucccacauuaaagaagacc

SEQ ID NO: 3777098 - RNA, 17 nt, Human
aguucccaguuggagcu

SEQ ID NO: 3777099 - RNA, 19 nt, Human
aguucccaguuggagcucc

SEQ ID NO: 3777100 - RNA, 20 nt, Human
aguucccaguuggagcucca

SEQ ID NO: 3777101 - RNA, 21 nt, Human
aguucccaguuggagcuccag

SEQ ID NO: 3777102 - RNA, 16 nt, Human
aguucccauucuuuca

SEQ ID NO: 3777103 - RNA, 16 nt, Human
aguuccccaugcagac

SEQ ID NO: 3777104 - RNA, 15 nt, Human
aguucccccaaccuc

SEQ ID NO: 3777105 - RNA, 24 nt, Human
aguuccccuggaagcagugcccag

SEQ ID NO: 3777106 - RNA, 19 nt, Human
aguucccucugcucagcca

SEQ ID NO: 3777107 - RNA, 15 nt, Human
aguucccugaaacac

SEQ ID NO: 3777108 - RNA, 17 nt, Human
aguucccugaaacacga

SEQ ID NO: 3777109 - RNA, 20 nt, Human
aguucccugucucuugaaaa

SEQ ID NO: 3777110 - RNA, 17 nt, Human
aguucccuugaaacuuu

SEQ ID NO: 3777111 - RNA, 17 nt, Human
aguucccuuggccucag

SEQ ID NO: 3777112 - RNA, 22 nt, Human
aguuccuaagaagcuucuaaua

SEQ ID NO: 3777113 - RNA, 20 nt, Human
aguuccuauaacacugugaa

SEQ ID NO: 3777114 - RNA, 18 nt, Human
aguuccucuagugcccuc

SEQ ID NO: 3777115 - RNA, 22 nt, Human
aguuccucuuuugugcugcuuc

SEQ ID NO: 3777116 - RNA, 18 nt, Human
aguuccugaaccugaugc

SEQ ID NO: 3777117 - RNA, 19 nt, Human
aguuccugaaccugaugcu

SEQ ID NO: 3777118 - RNA, 20 nt, Human
aguuccugcggagugaagag

SEQ ID NO: 3777119 - RNA, 14 nt, Human
aguuccugugcaca

SEQ ID NO: 3777120 - RNA, 14 nt, Human
aguuccuuauguau

SEQ ID NO: 3777121 - RNA, 20 nt, Human
aguuccuucagcuuccauuu

SEQ ID NO: 3777122 - RNA, 19 nt, Human
aguuccuuuccuuuucuuu

SEQ ID NO: 3777123 - RNA, 18 nt, Human
aguucgagaccagccugg

SEQ ID NO: 3777124 - RNA, 21 nt, Human
aguucgagaccagccuggcca

SEQ ID NO: 3777125 - RNA, 21 nt, Human
aguucgaugggcccaauucuu

SEQ ID NO: 3777126 - RNA, 13 nt, Human
aguucgcagccac

SEQ ID NO: 3777127 - RNA, 21 nt, Human
aguucgcagccacccugagga

SEQ ID NO: 3777128 - RNA, 17 nt, Human
aguucgccuggagcccu

SEQ ID NO: 3777129 - RNA, 17 nt, Human
aguucggcucugggugg

SEQ ID NO: 3777130 - RNA, 19 nt, Human
aguucggugagcuacaaau

SEQ ID NO: 3777131 - RNA, 16 nt, Human
aguucuaagauucuaa

SEQ ID NO: 3777132 - RNA, 17 nt, Human
aguucuaagauucuaau

SEQ ID NO: 3777133 - RNA, 16 nt, Human
aguucuaauaauuucu

SEQ ID NO: 3777134 - RNA, 19 nt, Human
aguucuaauaauuucuaau

SEQ ID NO: 3777135 - RNA, 21 nt, Human
aguucuaauaauuucuaaugu

SEQ ID NO: 3777136 - RNA, 16 nt, Human
aguucuacucaggcug

SEQ ID NO: 3777137 - RNA, 17 nt, Human
aguucuacucaggcugg

SEQ ID NO: 3777138 - RNA, 23 nt, Human
aguucuacuucauguaauccaaa

SEQ ID NO: 3777139 - RNA, 14 nt, Human
aguucuagaaaaac

SEQ ID NO: 3777140 - RNA, 22 nt, Human
aguucuagacauggagguucua

SEQ ID NO: 3777141 - RNA, 23 nt, Human
aguucuagacauggagguucuaa

SEQ ID NO: 3777142 - RNA, 16 nt, Human
aguucuagagaagagg

SEQ ID NO: 3777143 - RNA, 13 nt, Human
aguucuaggaaaa

SEQ ID NO: 3777144 - RNA, 14 nt, Human
aguucuaggaaaau

SEQ ID NO: 3777145 - RNA, 14 nt, Human
aguucuaggcacug

SEQ ID NO: 3777146 - RNA, 18 nt, Human
aguucuauacuguaaagc

SEQ ID NO: 3777147 - RNA, 12 nt, Human
aguucucagggc

SEQ ID NO: 3777148 - RNA, 14 nt, Human
aguucucagggcuc

SEQ ID NO: 3777149 - RNA, 19 nt, Human
aguucucagggcuccugcc

SEQ ID NO: 3777150 - RNA, 12 nt, Human
aguucucuccuu

SEQ ID NO: 3777151 - RNA, 16 nt, Human
aguucucuccuucuuc

SEQ ID NO: 3777152 - RNA, 20 nt, Human
aguucucuucacucaaggau

SEQ ID NO: 3777153 - RNA, 20 nt, Human
aguucucuugguguuaaaac

SEQ ID NO: 3777154 - RNA, 13 nt, Human
aguucugaagaag

SEQ ID NO: 3777155 - RNA, 18 nt, Human
aguucugcaaauagaaaa

SEQ ID NO: 3777156 - RNA, 20 nt, Human
aguucugcaaauagaaaaca

SEQ ID NO: 3777157 - RNA, 20 nt, Human
aguucugccaggagacaggu

SEQ ID NO: 3777158 - RNA, 14 nt, Human
auagaauuuccaau

SEQ ID NO: 3777159 - RNA, 13 nt, Human
auagaauuuuuaa

SEQ ID NO: 3777160 - RNA, 16 nt, Human
auagacaaauagaaaa

SEQ ID NO: 3777161 - RNA, 22 nt, Human
auagacaauuuauuauggcaca

SEQ ID NO: 3777162 - RNA, 18 nt, Human
auagacagaagaaacaag

SEQ ID NO: 3777163 - RNA, 15 nt, Human
auagacagcaugaga

SEQ ID NO: 3777164 - RNA, 13 nt, Human
auagacaguuugu

SEQ ID NO: 3777165 - RNA, 16 nt, Human
auagacauuuguaaau

SEQ ID NO: 3777166 - RNA, 18 nt, Human
auagacccacaagaggca

SEQ ID NO: 3777167 - RNA, 15 nt, Human
auagacuagagaaac

SEQ ID NO: 3777168 - RNA, 17 nt, Human
auagacuggaaaaaaug

SEQ ID NO: 3777169 - RNA, 15 nt, Human
auagacuuaaaucuc

SEQ ID NO: 3777170 - RNA, 12 nt, Human
auagagaauguu

SEQ ID NO: 3777171 - RNA, 23 nt, Human
auagagacuguagauugcuucug

SEQ ID NO: 3777172 - RNA, 21 nt, Human
auagagagggagaagaaguca

SEQ ID NO: 3777173 - RNA, 17 nt, Human
auagagaguuguugugu

SEQ ID NO: 3777174 - RNA, 17 nt, Human
auagagaugagcuuucu

SEQ ID NO: 3777175 - RNA, 24 nt, Human
auagagauuuuuuaaccauggcag

SEQ ID NO: 3777176 - RNA, 21 nt, Human
auagagcaccuaguccaguga

SEQ ID NO: 3777177 - RNA, 14 nt, Human
auagagcagaaauu

SEQ ID NO: 3777178 - RNA, 19 nt, Human
auagagccgggugucccca

SEQ ID NO: 3777179 - RNA, 15 nt, Human
auagagccugaggga

SEQ ID NO: 3777180 - RNA, 14 nt, Human
auagagcuguauua

SEQ ID NO: 3777181 - RNA, 23 nt, Human
auagagcuguucaacaucacuga

SEQ ID NO: 3777182 - RNA, 12 nt, Human
auagagcuuuua

SEQ ID NO: 3777183 - RNA, 21 nt, Human
auagaggaagccugauuaaag

SEQ ID NO: 3777184 - RNA, 22 nt, Human
auagaggaagccugauuaaaga

SEQ ID NO: 3777185 - RNA, 12 nt, Human
auagaggcuagc

SEQ ID NO: 3777186 - RNA, 21 nt, Human
auagaggcuucuccgccagcc

SEQ ID NO: 3777187 - RNA, 14 nt, Human
auagagggccaaga

SEQ ID NO: 3777188 - RNA, 16 nt, Human
auagagguaccagcaa

SEQ ID NO: 3777189 - RNA, 15 nt, Human
auagaggugagggaa

SEQ ID NO: 3777190 - RNA, 15 nt, Human
auagaguauaugcac

SEQ ID NO: 3777191 - RNA, 21 nt, Human
auagaguguacuuaacuauuc

SEQ ID NO: 3777192 - RNA, 16 nt, Human
auagagugugauguau

SEQ ID NO: 3777193 - RNA, 16 nt, Human
auagaguuuaacacaa

SEQ ID NO: 3777194 - RNA, 15 nt, Human
auagaguuugcuauu

SEQ ID NO: 3777195 - RNA, 20 nt, Human
auagauaaaacaucuuugaa

SEQ ID NO: 3777196 - RNA, 15 nt, Human
auagauaauauuguu

SEQ ID NO: 3777197 - RNA, 21 nt, Human
auagauacccuacgcugucca

SEQ ID NO: 3777198 - RNA, 18 nt, Human
auagauaggucagugcaa

SEQ ID NO: 3777199 - RNA, 17 nt, Human
auagaucacauaacaga

SEQ ID NO: 3777200 - RNA, 21 nt, Human
auagaugcaagauauuuauau

SEQ ID NO: 3777201 - RNA, 17 nt, Human
auagaugcuggcccagg

SEQ ID NO: 3777202 - RNA, 12 nt, Human
auagaugggaau

SEQ ID NO: 3777203 - RNA, 19 nt, Human
auagaugggaaugaagcuu

SEQ ID NO: 3777204 - RNA, 13 nt, Human
auagaugggucug

SEQ ID NO: 3777205 - RNA, 19 nt, Human
auagaugucccuuucuugg

SEQ ID NO: 3777206 - RNA, 22 nt, Human
auagaugucccuuucuuggcca

SEQ ID NO: 3777207 - RNA, 15 nt, Human
auagaugucuuuuau

SEQ ID NO: 3777208 - RNA, 17 nt, Human
auagaugucuuuuauag

SEQ ID NO: 3777209 - RNA, 14 nt, Human
auagaugucuuuuc

SEQ ID NO: 3777210 - RNA, 12 nt, Human
auagaugugugg

SEQ ID NO: 3777211 - RNA, 22 nt, Human
auagauguuuugguagauuaaa

SEQ ID NO: 3777212 - RNA, 20 nt, Human
auagauuaaaucauacuccu

SEQ ID NO: 3777213 - RNA, 13 nt, Human
auagauuagaauu

SEQ ID NO: 3777214 - RNA, 15 nt, Human
auagauuagaauucu

SEQ ID NO: 3777215 - RNA, 16 nt, Human
auagauuagaauucug

SEQ ID NO: 3777216 - RNA, 21 nt, Human
auagauuagagaguguugaaa

SEQ ID NO: 3777217 - RNA, 23 nt, Human
auagauuagauuauauugagaca

SEQ ID NO: 3777218 - RNA, 15 nt, Human
auagauuauaacuug

SEQ ID NO: 3777219 - RNA, 15 nt, Human
auagauucuaaagau

SEQ ID NO: 3777220 - RNA, 18 nt, Human
auagauugugaauaauga

SEQ ID NO: 3777221 - RNA, 14 nt, Human
auagauuucugauu

SEQ ID NO: 3777222 - RNA, 15 nt, Human
auagauuucugauuu

SEQ ID NO: 3777223 - RNA, 16 nt, Human
auagauuucugauuuu

SEQ ID NO: 3777224 - RNA, 21 nt, Human
auagauuucugauuuuaugua

SEQ ID NO: 3777225 - RNA, 14 nt, Human
auagauuugaccuc

SEQ ID NO: 3777226 - RNA, 15 nt, Human
auagcaaaagaagaa

SEQ ID NO: 3777227 - RNA, 17 nt, Human
auagcaaaagaagaagu

SEQ ID NO: 3777228 - RNA, 18 nt, Human
auagcaaaagaagaaguu

SEQ ID NO: 3777229 - RNA, 19 nt, Human
auagcaaaagaagaaguuu

SEQ ID NO: 3777230 - RNA, 15 nt, Human
auagcaaaaucaaga

SEQ ID NO: 3777231 - RNA, 15 nt, Human
auagcaaagaauuga

SEQ ID NO: 3777232 - RNA, 19 nt, Human
auagcaaauguuuugacau

SEQ ID NO: 3777233 - RNA, 23 nt, Human
auagcaaauguuuugacaugaaa

SEQ ID NO: 3777234 - RNA, 16 nt, Human
auagcaacaacaauug

SEQ ID NO: 3777235 - RNA, 17 nt, Human
auagcaacaacaauugg

SEQ ID NO: 3777236 - RNA, 18 nt, Human
auagcaacaacaauuggu

SEQ ID NO: 3777237 - RNA, 19 nt, Human
auagcaacaacaauuggua

SEQ ID NO: 3777238 - RNA, 16 nt, Human
auagcaacacucuaua

SEQ ID NO: 3777239 - RNA, 22 nt, Human
auagcaacuuuuguguaaugaa

SEQ ID NO: 3777240 - RNA, 16 nt, Human
auagcaagacauuaua

SEQ ID NO: 3777241 - RNA, 22 nt, Human
auagcaagugaauuuuucucua

SEQ ID NO: 3777242 - RNA, 17 nt, Human
auagcaauagcauggau

SEQ ID NO: 3777243 - RNA, 15 nt, Human
auagcacagacccug

SEQ ID NO: 3777244 - RNA, 14 nt, Human
auagcaccagggcu

SEQ ID NO: 3777245 - RNA, 13 nt, Human
auagcacuuugaa

SEQ ID NO: 3777246 - RNA, 14 nt, Human
auagcacuuugaaa

SEQ ID NO: 3777247 - RNA, 19 nt, Human
auagcacuuugaaauaccu

SEQ ID NO: 3777248 - RNA, 20 nt, Human
auagcacuuugaaauaccuc

SEQ ID NO: 3777249 - RNA, 20 nt, Human
auagcagcaaaaauauaaaa

SEQ ID NO: 3777250 - RNA, 15 nt, Human
auagcaguaaaaaau

SEQ ID NO: 3777251 - RNA, 16 nt, Human
auagcaguagucuuuu

SEQ ID NO: 3777252 - RNA, 22 nt, Human
auagcauaugacaaauguuucu

SEQ ID NO: 3777253 - RNA, 23 nt, Human
auagcauaugacaaauguuucua

SEQ ID NO: 3777254 - RNA, 15 nt, Human
auagcaucacuuaaa

SEQ ID NO: 3777255 - RNA, 18 nt, Human
auagcaucacuuaaaaca

SEQ ID NO: 3777256 - RNA, 23 nt, Human
auagcaucucaggagauuucaug

SEQ ID NO: 3777257 - RNA, 21 nt, Human
auagcaucuggaagaucauuu

SEQ ID NO: 3777258 - RNA, 23 nt, Human
auagcaucuuugaauacaaagaa

SEQ ID NO: 3777259 - RNA, 18 nt, Human
auagcauggauagaguau

SEQ ID NO: 3777260 - RNA, 10 nt, Human
auagcaugua

SEQ ID NO: 3777261 - RNA, 22 nt, Human
auagcauguauugugucuuuug

SEQ ID NO: 3777262 - RNA, 15 nt, Human
auagcauuaacuaau

SEQ ID NO: 3777263 - RNA, 12 nt, Human
auagcauugcuu

SEQ ID NO: 3777264 - RNA, 15 nt, Human
auagcauuguaaaag

SEQ ID NO: 3777265 - RNA, 16 nt, Human
auagcauuuaugguaa

SEQ ID NO: 3777266 - RNA, 14 nt, Human
auagccaaaaauag

SEQ ID NO: 3777267 - RNA, 15 nt, Human
auagccaaaaauagc

SEQ ID NO: 3777268 - RNA, 15 nt, Human
auagccaaggccaaa

SEQ ID NO: 3777269 - RNA, 21 nt, Human
auagccacauuuggaauacuu

SEQ ID NO: 3777270 - RNA, 22 nt, Human
auagccacuaaccuugccuggu

SEQ ID NO: 3777271 - RNA, 23 nt, Human
auagccacuaaccuugccuggua

SEQ ID NO: 3777272 - RNA, 19 nt, Human
auagccacuuaccuucaau

SEQ ID NO: 3777273 - RNA, 21 nt, Human
auagccacuuaccuucaauaa

SEQ ID NO: 3777274 - RNA, 23 nt, Human
auagccacuuaccuucaauaaag

SEQ ID NO: 3777275 - RNA, 18 nt, Human
auagcccaggauauauuu

SEQ ID NO: 3777276 - RNA, 14 nt, Human
auagcccagguccu

SEQ ID NO: 3777277 - RNA, 16 nt, Human
auagcccuguccuggu

SEQ ID NO: 3777278 - RNA, 18 nt, Human
auagccgggcaugguggc

SEQ ID NO: 3777279 - RNA, 17 nt, Human
auagccuaggugacaga

SEQ ID NO: 3777280 - RNA, 19 nt, Human
auagccuauauuuacagug

SEQ ID NO: 3777281 - RNA, 13 nt, Human
auagccuguggcc

SEQ ID NO: 3777282 - RNA, 20 nt, Human
auagcgucauaacuagaacu

SEQ ID NO: 3777283 - RNA, 15 nt, Human
auagcguguguagau

SEQ ID NO: 3777284 - RNA, 13 nt, Human
auagcguucuugu

SEQ ID NO: 3777285 - RNA, 22 nt, Human
auagcguuggaauuaaaacaau

SEQ ID NO: 3777286 - RNA, 15 nt, Human
auagcuaacauuuua

SEQ ID NO: 3777287 - RNA, 22 nt, Human
auagcuaacauuuuaaauaaaa

SEQ ID NO: 3777288 - RNA, 15 nt, Human
auagcuaacuguaaa

SEQ ID NO: 3777289 - RNA, 17 nt, Human
auagcuaacuguaaauc

SEQ ID NO: 3777290 - RNA, 21 nt, Human
auagcuaagaaauaaaacugu

SEQ ID NO: 3777291 - RNA, 13 nt, Human
auagcuaaguaca

SEQ ID NO: 3777292 - RNA, 17 nt, Human
auagcuaauaauguuaa

SEQ ID NO: 3777293 - RNA, 15 nt, Human
auagcuacaggaagc

SEQ ID NO: 3777294 - RNA, 15 nt, Human
auagcuagacuggug

SEQ ID NO: 3777295 - RNA, 19 nt, Human
auagcuagacuggugacug

SEQ ID NO: 3777296 - RNA, 17 nt, Human
auagcuauauccaugua

SEQ ID NO: 3777297 - RNA, 23 nt, Human
auagcuauauccauguacuguag

SEQ ID NO: 3777298 - RNA, 18 nt, Human
auagcuauuacugucugg

SEQ ID NO: 3777299 - RNA, 20 nt, Human
auagcuauuuuuauggaauu

SEQ ID NO: 3777300 - RNA, 20 nt, Human
auagcucaggugucccugca

SEQ ID NO: 3777301 - RNA, 20 nt, Human
auagcuccugcuccacagcc

SEQ ID NO: 3777302 - RNA, 14 nt, Human
auagcuccuuuuga

SEQ ID NO: 3777303 - RNA, 10 nt, Human
auauauauau

SEQ ID NO: 3777304 - RNA, 14 nt, Human
auauauauauaaag

SEQ ID NO: 3777305 - RNA, 15 nt, Human
auauauauauaaagu

SEQ ID NO: 3777306 - RNA, 14 nt, Human
auauauauauauaa

SEQ ID NO: 3777307 - RNA, 14 nt, Human
auauauauauauau

SEQ ID NO: 3777308 - RNA, 16 nt, Human
auauauauauauauaa

SEQ ID NO: 3777309 - RNA, 16 nt, Human
auauauauauauaugu

SEQ ID NO: 3777310 - RNA, 14 nt, Human
auauauauauauca

SEQ ID NO: 3777311 - RNA, 15 nt, Human
auauauauauaugca

SEQ ID NO: 3777312 - RNA, 14 nt, Human
auauauauauaugu

SEQ ID NO: 3777313 - RNA, 14 nt, Human
auauauauaucagu

SEQ ID NO: 3777314 - RNA, 14 nt, Human
auauauaucaguuu

SEQ ID NO: 3777315 - RNA, 22 nt, Human
auauauaugcauauauauaugu

SEQ ID NO: 3777316 - RNA, 20 nt, Human
auauauaugccuuuuuccua

SEQ ID NO: 3777317 - RNA, 16 nt, Human
auauauauuaucuuuu

SEQ ID NO: 3777318 - RNA, 13 nt, Human
auauauauuuuaa

SEQ ID NO: 3777319 - RNA, 17 nt, Human
auauaucacccagacau

SEQ ID NO: 3777320 - RNA, 16 nt, Human
auauaucccugauaaa

SEQ ID NO: 3777321 - RNA, 17 nt, Human
auauaucuaaauuuaga

SEQ ID NO: 3777322 - RNA, 15 nt, Human
auauaucuaucuauu

SEQ ID NO: 3777323 - RNA, 12 nt, Human
auauaucugaaa

SEQ ID NO: 3777324 - RNA, 18 nt, Human
auauaucugaaaacugga

SEQ ID NO: 3777325 - RNA, 20 nt, Human
auauaucugcuguccagaca

SEQ ID NO: 3777326 - RNA, 15 nt, Human
auauaugaaaacuau

SEQ ID NO: 3777327 - RNA, 14 nt, Human
auauauggacaugg

SEQ ID NO: 3777328 - RNA, 15 nt, Human
auauauggacauggc

SEQ ID NO: 3777329 - RNA, 14 nt, Human
auauauggauaaug

SEQ ID NO: 3777330 - RNA, 13 nt, Human
auauauggcagag

SEQ ID NO: 3777331 - RNA, 14 nt, Human
auauauggcagagu

SEQ ID NO: 3777332 - RNA, 21 nt, Human
auauauggcagaguuguaaau

SEQ ID NO: 3777333 - RNA, 15 nt, Human
auauauggcauuugc

SEQ ID NO: 3777334 - RNA, 15 nt, Human
auauauguauguaaa

SEQ ID NO: 3777335 - RNA, 16 nt, Human
auauauguauguaaaa

SEQ ID NO: 3777336 - RNA, 13 nt, Human
auauaugugaaag

SEQ ID NO: 3777337 - RNA, 12 nt, Human
auauaugugaac

SEQ ID NO: 3777338 - RNA, 18 nt, Human
auauaugugaacauuuau

SEQ ID NO: 3777339 - RNA, 14 nt, Human
auauaugugaugau

SEQ ID NO: 3777340 - RNA, 15 nt, Human
auauaugugugugug

SEQ ID NO: 3777341 - RNA, 23 nt, Human
auauauguguguuuaaauaaagu

SEQ ID NO: 3777342 - RNA, 14 nt, Human
auauauguuuaccu

SEQ ID NO: 3777343 - RNA, 17 nt, Human
auauauguuuaccuuuu

SEQ ID NO: 3777344 - RNA, 22 nt, Human
auauauguuuuaagaggcaggg

SEQ ID NO: 3777345 - RNA, 18 nt, Human
auauauguuuuugaaggc

SEQ ID NO: 3777346 - RNA, 18 nt, Human
auauauuaaaaauauaaa

SEQ ID NO: 3777347 - RNA, 22 nt, Human
auauauuauacuuguaauuaug

SEQ ID NO: 3777348 - RNA, 14 nt, Human
auauauuaucuuuu

SEQ ID NO: 3777349 - RNA, 14 nt, Human
auauauuauuacuu

SEQ ID NO: 3777350 - RNA, 14 nt, Human
auauauuauuauaa

SEQ ID NO: 3777351 - RNA, 16 nt, Human
auauauuauuauaauc

SEQ ID NO: 3777352 - RNA, 14 nt, Human
auauauuauuugca

SEQ ID NO: 3777353 - RNA, 15 nt, Human
auauauucccaauag

SEQ ID NO: 3777354 - RNA, 16 nt, Human
auauauucucuuuggu

SEQ ID NO: 3777355 - RNA, 23 nt, Human
auauauucucuuugguguacaaa

SEQ ID NO: 3777356 - RNA, 18 nt, Human
auauauugaacuuuugua

SEQ ID NO: 3777357 - RNA, 15 nt, Human
auauauugaauauuu

SEQ ID NO: 3777358 - RNA, 14 nt, Human
auauauugaauuaa

SEQ ID NO: 3777359 - RNA, 19 nt, Human
auauauugguaacauccuu

SEQ ID NO: 3777360 - RNA, 12 nt, Human
auauauuuaaaa

SEQ ID NO: 3777361 - RNA, 18 nt, Human
auauauuuaaaaguguca

SEQ ID NO: 3777362 - RNA, 20 nt, Human
auauauuuaaagggaaauug

SEQ ID NO: 3777363 - RNA, 13 nt, Human
auauauuuaauga

SEQ ID NO: 3777364 - RNA, 15 nt, Human
auauauuuaaugaua

SEQ ID NO: 3777365 - RNA, 10 nt, Human
auauauuuau

SEQ ID NO: 3777366 - RNA, 15 nt, Human
auauauuuauuuaaa

SEQ ID NO: 3777367 - RNA, 9 nt, Human
auauauuuc

SEQ ID NO: 3777368 - RNA, 22 nt, Human
auauauuucacguguucccucu

SEQ ID NO: 3777369 - RNA, 21 nt, Human
auauauuuguguauuuaacag

SEQ ID NO: 3777370 - RNA, 16 nt, Human
auauauuuuacaauuu

SEQ ID NO: 3777371 - RNA, 14 nt, Human
auauauuuuguaug

SEQ ID NO: 3777372 - RNA, 17 nt, Human
auauauuuuguaugcaa

SEQ ID NO: 3777373 - RNA, 19 nt, Human
auauauuuuguaugcaagc

SEQ ID NO: 3777374 - RNA, 20 nt, Human
auauauuuuguaugcaagca

SEQ ID NO: 3777375 - RNA, 16 nt, Human
auauauuuugugugaa

SEQ ID NO: 3777376 - RNA, 16 nt, Human
auauauuuuguuuaca

SEQ ID NO: 3777377 - RNA, 23 nt, Human
auauauuuuuaagauaauaauau

SEQ ID NO: 3777378 - RNA, 21 nt, Human
auauauuuuuauauuuaguua

SEQ ID NO: 3777379 - RNA, 14 nt, Human
auauauuuuucaca

SEQ ID NO: 3777380 - RNA, 15 nt, Human
auauauuuuugguug

SEQ ID NO: 3777381 - RNA, 20 nt, Human
auauauuuuugguugucaau

SEQ ID NO: 3777382 - RNA, 20 nt, Human
auauauuuuuuaauuugaug

SEQ ID NO: 3777383 - RNA, 14 nt, Human
auaucaaaagacac

SEQ ID NO: 3777384 - RNA, 16 nt, Human
auaucaaaagacacag

SEQ ID NO: 3777385 - RNA, 18 nt, Human
auaucaaauuaauugugu

SEQ ID NO: 3777386 - RNA, 20 nt, Human
auaucaaauuaauuguguga

SEQ ID NO: 3777387 - RNA, 21 nt, Human
auaucaaauuaauugugugaa

SEQ ID NO: 3777388 - RNA, 16 nt, Human
auaucaagaugauucu

SEQ ID NO: 3777389 - RNA, 15 nt, Human
auaucaauuuaaaaa

SEQ ID NO: 3777390 - RNA, 19 nt, Human
auaucaccaggacuguuac

SEQ ID NO: 3777391 - RNA, 22 nt, Human
auaucacccagacauaaaggaa

SEQ ID NO: 3777392 - RNA, 15 nt, Human
auaucacucauuaau

SEQ ID NO: 3777393 - RNA, 18 nt, Human
auaucacuugucaauaaa

SEQ ID NO: 3777394 - RNA, 14 nt, Human
auaucagaaaaggg

SEQ ID NO: 3777395 - RNA, 17 nt, Human
auaucagaaaagggaag

SEQ ID NO: 3777396 - RNA, 14 nt, Human
auaucagccugagu

SEQ ID NO: 3777397 - RNA, 19 nt, Human
auaucauacuguucaaugg

SEQ ID NO: 3777398 - RNA, 18 nt, Human
auaucaucagcauaccuu

SEQ ID NO: 3777399 - RNA, 17 nt, Human
auaucaucaguauugaa

SEQ ID NO: 3777400 - RNA, 16 nt, Human
auaucauccacacaug

SEQ ID NO: 3777401 - RNA, 24 nt, Human
auaucauccacacaugaaucugca

SEQ ID NO: 3777402 - RNA, 13 nt, Human
auaucaugcaaaa

SEQ ID NO: 3777403 - RNA, 15 nt, Human
auaucauucagcaac

SEQ ID NO: 3777404 - RNA, 17 nt, Human
auaucauucuaaagaua

SEQ ID NO: 3777405 - RNA, 19 nt, Human
auauccaaaagcuuuuuau

SEQ ID NO: 3777406 - RNA, 14 nt, Human
auauccacacauuu

SEQ ID NO: 3777407 - RNA, 18 nt, Human
auauccaggucaacagaa

SEQ ID NO: 3777408 - RNA, 22 nt, Human
auauccaggucaacagaaugaa

SEQ ID NO: 3777409 - RNA, 14 nt, Human
auauccauguacug

SEQ ID NO: 3777410 - RNA, 17 nt, Human
auauccauguacuguag

SEQ ID NO: 3777411 - RNA, 17 nt, Human
auauccauucuuucuga

SEQ ID NO: 3777412 - RNA, 16 nt, Human
auaucccaaacuguga

SEQ ID NO: 3777413 - RNA, 18 nt, Human
auauccccuauuuaacag

SEQ ID NO: 3777414 - RNA, 15 nt, Human
auauccccucccagu

SEQ ID NO: 3777415 - RNA, 20 nt, Human
auaucccuuggacauuuuau

SEQ ID NO: 3777416 - RNA, 22 nt, Human
auaucccuuggacauuuuaugu

SEQ ID NO: 3777417 - RNA, 22 nt, Human
auauccuaaacaucauucauuu

SEQ ID NO: 3777418 - RNA, 13 nt, Human
auauccuaauaaa

SEQ ID NO: 3777419 - RNA, 20 nt, Human
auauccuaauaaaaagguga

SEQ ID NO: 3777420 - RNA, 23 nt, Human
auauccuaauaaaaaggugacca

SEQ ID NO: 3777421 - RNA, 14 nt, Human
auauccugccucag

SEQ ID NO: 3777422 - RNA, 13 nt, Human
auauccugugacu

SEQ ID NO: 3777423 - RNA, 15 nt, Human
auaucgcugacuuca

SEQ ID NO: 3777424 - RNA, 14 nt, Human
auaucuaaaauauu

SEQ ID NO: 3777425 - RNA, 19 nt, Human
auaucuaaaguuauauuuc

SEQ ID NO: 3777426 - RNA, 19 nt, Human
auaucuaauauauaugaau

SEQ ID NO: 3777427 - RNA, 14 nt, Human
auaucuacagauag

SEQ ID NO: 3777428 - RNA, 16 nt, Human
auaucuagguuuauga

SEQ ID NO: 3777429 - RNA, 17 nt, Human
auaucuagguuuaugac

SEQ ID NO: 3777430 - RNA, 22 nt, Human
auaucuauaguagacacacuau

SEQ ID NO: 3777431 - RNA, 14 nt, Human
auaucuauauauaa

SEQ ID NO: 3777432 - RNA, 17 nt, Human
auaucuauauauaauuc

SEQ ID NO: 3777433 - RNA, 20 nt, Human
auaucuauauauaauucugu

SEQ ID NO: 3777434 - RNA, 17 nt, Human
auaucuauauuuuacau

SEQ ID NO: 3777435 - RNA, 22 nt, Human
auaucuauauuuuacauaaauu

SEQ ID NO: 3777436 - RNA, 14 nt, Human
auaucuaucuauuu

SEQ ID NO: 3777437 - RNA, 18 nt, Human
auaucuaucuauuugagg

SEQ ID NO: 3777438 - RNA, 14 nt, Human
auaucuaucuuaua

SEQ ID NO: 3777439 - RNA, 20 nt, Human
auaucuaucuuauauaguuu

SEQ ID NO: 3777440 - RNA, 21 nt, Human
auaucuaucuuauauaguuua

SEQ ID NO: 3777441 - RNA, 15 nt, Human
auaucuauguuuuac

SEQ ID NO: 3777442 - RNA, 12 nt, Human
auaucuauuaau

SEQ ID NO: 3777443 - RNA, 13 nt, Human
auaucuauuaaua

SEQ ID NO: 3777444 - RNA, 18 nt, Human
auaucuauuaauauaugu

SEQ ID NO: 3777445 - RNA, 20 nt, Human
auaucuccgucaacucauau

SEQ ID NO: 3777446 - RNA, 21 nt, Human
auaucuccgucaacucauauu

SEQ ID NO: 3777447 - RNA, 22 nt, Human
auaucuccugaaaagguuuaug

SEQ ID NO: 3777448 - RNA, 23 nt, Human
auaucuccugaaaagguuuauga

SEQ ID NO: 3777449 - RNA, 16 nt, Human
aucuugaucugcucag

SEQ ID NO: 3777450 - RNA, 20 nt, Human
aucuugaucugcucagcccu

SEQ ID NO: 3777451 - RNA, 24 nt, Human
aucuugcaccccaaagcuuuccug

SEQ ID NO: 3777452 - RNA, 22 nt, Human
aucuugcagaaguucuuagugu

SEQ ID NO: 3777453 - RNA, 14 nt, Human
aucuugcauguaac

SEQ ID NO: 3777454 - RNA, 15 nt, Human
aucuugccuccaggu

SEQ ID NO: 3777455 - RNA, 16 nt, Human
aucuugcucuaucuca

SEQ ID NO: 3777456 - RNA, 14 nt, Human
aucuugcucugcug

SEQ ID NO: 3777457 - RNA, 15 nt, Human
aucuugcucuguaau

SEQ ID NO: 3777458 - RNA, 23 nt, Human
aucuugcuucccuaaucuauggu

SEQ ID NO: 3777459 - RNA, 14 nt, Human
aucuuggacugaca

SEQ ID NO: 3777460 - RNA, 16 nt, Human
aucuuggacugacauu

SEQ ID NO: 3777461 - RNA, 19 nt, Human
aucuuggacugacauuuag

SEQ ID NO: 3777462 - RNA, 19 nt, Human
aucuuggcagguaggaaua

SEQ ID NO: 3777463 - RNA, 19 nt, Human
aucuuggcccuguuaaggc

SEQ ID NO: 3777464 - RNA, 20 nt, Human
aucuuggccuaaaccucagu

SEQ ID NO: 3777465 - RNA, 21 nt, Human
aucuuggccuaaaccucaguu

SEQ ID NO: 3777466 - RNA, 16 nt, Human
aucuuggccuuacugu

SEQ ID NO: 3777467 - RNA, 18 nt, Human
aucuugggacuggguuug

SEQ ID NO: 3777468 - RNA, 22 nt, Human
aucuuggggacaucucuuugaa

SEQ ID NO: 3777469 - RNA, 16 nt, Human
aucuuggggggguggc

SEQ ID NO: 3777470 - RNA, 20 nt, Human
aucuuggggggguggccgcu

SEQ ID NO: 3777471 - RNA, 23 nt, Human
aucuugguaaauuuccccaacag

SEQ ID NO: 3777472 - RNA, 22 nt, Human
aucuugguacuacuagaugucu

SEQ ID NO: 3777473 - RNA, 19 nt, Human
aucuugguguguuaagagu

SEQ ID NO: 3777474 - RNA, 21 nt, Human
aucuugguugaugccaaaaaa

SEQ ID NO: 3777475 - RNA, 20 nt, Human
aucuugguuugccuuccaga

SEQ ID NO: 3777476 - RNA, 20 nt, Human
aucuuguagcuuuaucaaag

SEQ ID NO: 3777477 - RNA, 14 nt, Human
aucuuguccccaac

SEQ ID NO: 3777478 - RNA, 15 nt, Human
aucuugucucugggc

SEQ ID NO: 3777479 - RNA, 18 nt, Human
aucuugugaaaauaauug

SEQ ID NO: 3777480 - RNA, 15 nt, Human
aucuugugaaauggc

SEQ ID NO: 3777481 - RNA, 19 nt, Human
aucuugugcuagaauacuu

SEQ ID NO: 3777482 - RNA, 22 nt, Human
aucuugugcuagaauacuuuuu

SEQ ID NO: 3777483 - RNA, 18 nt, Human
aucuugugugauuaacuu

SEQ ID NO: 3777484 - RNA, 16 nt, Human
aucuuguguuguccuu

SEQ ID NO: 3777485 - RNA, 15 nt, Human
aucuuguucaggaaa

SEQ ID NO: 3777486 - RNA, 19 nt, Human
aucuuguucaggaaaaggu

SEQ ID NO: 3777487 - RNA, 19 nt, Human
aucuuguuccaaggccagg

SEQ ID NO: 3777488 - RNA, 15 nt, Human
aucuuguuucugaaa

SEQ ID NO: 3777489 - RNA, 14 nt, Human
aucuuuaaaccaau

SEQ ID NO: 3777490 - RNA, 13 nt, Human
aucuuuaagcaga

SEQ ID NO: 3777491 - RNA, 17 nt, Human
aucuuuaagcagagaag

SEQ ID NO: 3777492 - RNA, 16 nt, Human
aucuuuaauuuuacau

SEQ ID NO: 3777493 - RNA, 21 nt, Human
aucuuuaauuuuacauuuccu

SEQ ID NO: 3777494 - RNA, 22 nt, Human
aucuuuaauuuuacauuuccua

SEQ ID NO: 3777495 - RNA, 17 nt, Human
aucuuuacaaaacuaca

SEQ ID NO: 3777496 - RNA, 21 nt, Human
aucuuuacaaaacuacaugag

SEQ ID NO: 3777497 - RNA, 13 nt, Human
aucuuuauuaauc

SEQ ID NO: 3777498 - RNA, 16 nt, Human
aucuuuauugaaauuc

SEQ ID NO: 3777499 - RNA, 16 nt, Human
aucuuuauugagaaag

SEQ ID NO: 3777500 - RNA, 18 nt, Human
aucuuuauugagaaagag

SEQ ID NO: 3777501 - RNA, 18 nt, Human
aucuuucaaaccagcuuc

SEQ ID NO: 3777502 - RNA, 17 nt, Human
aucuuucacacuuccac

SEQ ID NO: 3777503 - RNA, 22 nt, Human
aucuuucagaaauauaacacau

SEQ ID NO: 3777504 - RNA, 14 nt, Human
aucuuucccuccuu

SEQ ID NO: 3777505 - RNA, 17 nt, Human
aucuuucccuccuuggu

SEQ ID NO: 3777506 - RNA, 11 nt, Human
aucuuuccugu

SEQ ID NO: 3777507 - RNA, 15 nt, Human
aucuuuccuuccucu

SEQ ID NO: 3777508 - RNA, 21 nt, Human
aucuuucuaugcugcuuuuau

SEQ ID NO: 3777509 - RNA, 16 nt, Human
aucuuucuauuccaaa

SEQ ID NO: 3777510 - RNA, 22 nt, Human
aucuuucuccuugaauaucuuu

SEQ ID NO: 3777511 - RNA, 13 nt, Human
aucuuucugcaga

SEQ ID NO: 3777512 - RNA, 17 nt, Human
aucuuucuuuaccugag

SEQ ID NO: 3777513 - RNA, 21 nt, Human
aucuuugaaagguuagagaau

SEQ ID NO: 3777514 - RNA, 15 nt, Human
aucuuugauguguug

SEQ ID NO: 3777515 - RNA, 16 nt, Human
aucuuugauguguugu

SEQ ID NO: 3777516 - RNA, 14 nt, Human
aucuuugauucucc

SEQ ID NO: 3777517 - RNA, 14 nt, Human
aucuuugcacucca

SEQ ID NO: 3777518 - RNA, 19 nt, Human
aucuuugcagguugcuuug

SEQ ID NO: 3777519 - RNA, 15 nt, Human
aucuuugccacccuc

SEQ ID NO: 3777520 - RNA, 13 nt, Human
aucuuugccuugg

SEQ ID NO: 3777521 - RNA, 20 nt, Human
aucuuugccuugggcugcuc

SEQ ID NO: 3777522 - RNA, 20 nt, Human
aucuuuguaccaaaauuuua

SEQ ID NO: 3777523 - RNA, 14 nt, Human
aucuuugugauaau

SEQ ID NO: 3777524 - RNA, 17 nt, Human
aucuuugugauaauuua

SEQ ID NO: 3777525 - RNA, 15 nt, Human
aucuuuguggccaag

SEQ ID NO: 3777526 - RNA, 16 nt, Human
aucuuuguggccaagg

SEQ ID NO: 3777527 - RNA, 13 nt, Human
aucuuuuaugauu

SEQ ID NO: 3777528 - RNA, 15 nt, Human
aucuuuuauguuuga

SEQ ID NO: 3777529 - RNA, 21 nt, Human
aucuuuuauguuugaauaugg

SEQ ID NO: 3777530 - RNA, 16 nt, Human
aucuuuucacaaauaa

SEQ ID NO: 3777531 - RNA, 22 nt, Human
aucuuuucauugaacagcaaag

SEQ ID NO: 3777532 - RNA, 22 nt, Human
aucuuuucauuuaggugaggaa

SEQ ID NO: 3777533 - RNA, 13 nt, Human
aucuuuucuacag

SEQ ID NO: 3777534 - RNA, 14 nt, Human
aucuuuucuacagc

SEQ ID NO: 3777535 - RNA, 17 nt, Human
aucuuuucuacagcaaa

SEQ ID NO: 3777536 - RNA, 13 nt, Human
aucuuuucuuauu

SEQ ID NO: 3777537 - RNA, 12 nt, Human
aucuuuucuuua

SEQ ID NO: 3777538 - RNA, 13 nt, Human
aucuuuucuuuag

SEQ ID NO: 3777539 - RNA, 19 nt, Human
aucuuuucuuuagagaacu

SEQ ID NO: 3777540 - RNA, 11 nt, Human
aucuuuugaac

SEQ ID NO: 3777541 - RNA, 17 nt, Human
aucuuuugaagcauaga

SEQ ID NO: 3777542 - RNA, 23 nt, Human
aucuuuugauaugcauauuuguu

SEQ ID NO: 3777543 - RNA, 15 nt, Human
aucuuuuguauaguu

SEQ ID NO: 3777544 - RNA, 16 nt, Human
aucuuuuguauuaaga

SEQ ID NO: 3777545 - RNA, 23 nt, Human
aucuuuuguuuccuuuuuuccca

SEQ ID NO: 3777546 - RNA, 15 nt, Human
aucuuuuuaaagcuu

SEQ ID NO: 3777547 - RNA, 18 nt, Human
aucuuuuuaccuuucaua

SEQ ID NO: 3777548 - RNA, 19 nt, Human
aucuuuuuauugaugugca

SEQ ID NO: 3777549 - RNA, 13 nt, Human
aucuuuuucacug

SEQ ID NO: 3777550 - RNA, 13 nt, Human
aucuuuuucuaac

SEQ ID NO: 3777551 - RNA, 23 nt, Human
aucuuuuuuagcauaaaauuuuc

SEQ ID NO: 3777552 - RNA, 21 nt, Human
aucuuuuuuguuaacugauuu

SEQ ID NO: 3777553 - RNA, 20 nt, Human
aucuuuuuuguucaaagauu

SEQ ID NO: 3777554 - RNA, 14 nt, Human
augaaaaaauauau

SEQ ID NO: 3777555 - RNA, 17 nt, Human
augaaaaaauauauauc

SEQ ID NO: 3777556 - RNA, 16 nt, Human
augaaaaaauguauau

SEQ ID NO: 3777557 - RNA, 14 nt, Human
augaaaaagaagaa

SEQ ID NO: 3777558 - RNA, 16 nt, Human
augaaaaagaagaauc

SEQ ID NO: 3777559 - RNA, 15 nt, Human
augaaaaagcaugua

SEQ ID NO: 3777560 - RNA, 21 nt, Human
augaaaaagcauguacagugu

SEQ ID NO: 3777561 - RNA, 13 nt, Human
augaaaaauagca

SEQ ID NO: 3777562 - RNA, 13 nt, Human
augaaaaauauga

SEQ ID NO: 3777563 - RNA, 16 nt, Human
augaaaaaugaaagau

SEQ ID NO: 3777564 - RNA, 18 nt, Human
augaaaaauuggggagga

SEQ ID NO: 3777565 - RNA, 16 nt, Human
augaaaaauuuaagca

SEQ ID NO: 3777566 - RNA, 17 nt, Human
augaaaaauuuaagcau

SEQ ID NO: 3777567 - RNA, 16 nt, Human
augaaaacacauuuuu

SEQ ID NO: 3777568 - RNA, 18 nt, Human
augaaaacaguguguaaa

SEQ ID NO: 3777569 - RNA, 20 nt, Human
augaaaacauggaacagugu

SEQ ID NO: 3777570 - RNA, 19 nt, Human
augaaaacguuuuauugug

SEQ ID NO: 3777571 - RNA, 15 nt, Human
augaaaacuauacaa

SEQ ID NO: 3777572 - RNA, 13 nt, Human
augaaaagacaag

SEQ ID NO: 3777573 - RNA, 22 nt, Human
augaaaagacaagaaaaucagg

SEQ ID NO: 3777574 - RNA, 23 nt, Human
augaaaagcuuuguuuguucuug

SEQ ID NO: 3777575 - RNA, 12 nt, Human
augaaaaggaau

SEQ ID NO: 3777576 - RNA, 17 nt, Human
augaaaauaaagaaugg

SEQ ID NO: 3777577 - RNA, 13 nt, Human
augaaaauauuua

SEQ ID NO: 3777578 - RNA, 19 nt, Human
augaaaaugaguugugaaa

SEQ ID NO: 3777579 - RNA, 21 nt, Human
augaaaaugaguugugaaagu

SEQ ID NO: 3777580 - RNA, 13 nt, Human
augaaaaugucuu

SEQ ID NO: 3777581 - RNA, 15 nt, Human
augaaaauuguguua

SEQ ID NO: 3777582 - RNA, 17 nt, Human
augaaaauuuuaaaaau

SEQ ID NO: 3777583 - RNA, 21 nt, Human
augaaaauuuuaccagcagaa

SEQ ID NO: 3777584 - RNA, 16 nt, Human
augaaacaccuucucu

SEQ ID NO: 3777585 - RNA, 13 nt, Human
augaaacagaaac

SEQ ID NO: 3777586 - RNA, 15 nt, Human
augaaacccccacac

SEQ ID NO: 3777587 - RNA, 18 nt, Human
augaaacccccacacaca

SEQ ID NO: 3777588 - RNA, 22 nt, Human
augaaaccuuauuuuuucccaa

SEQ ID NO: 3777589 - RNA, 19 nt, Human
augaaacuaaagcaauaga

SEQ ID NO: 3777590 - RNA, 22 nt, Human
augaaacuaaagcaauagaaac

SEQ ID NO: 3777591 - RNA, 17 nt, Human
augaaacuagaaagcag

SEQ ID NO: 3777592 - RNA, 13 nt, Human
augaaacuuggau

SEQ ID NO: 3777593 - RNA, 18 nt, Human
augaaacuuguguaaaua

SEQ ID NO: 3777594 - RNA, 16 nt, Human
augagauauuaaacca

SEQ ID NO: 3777595 - RNA, 19 nt, Human
augagaucccgccucuucu

SEQ ID NO: 3777596 - RNA, 12 nt, Human
augagaugugug

SEQ ID NO: 3777597 - RNA, 22 nt, Human
augagauuguuuuaucaugaca

SEQ ID NO: 3777598 - RNA, 14 nt, Human
augagcaccuccau

SEQ ID NO: 3777599 - RNA, 14 nt, Human
augagcacuucuaa

SEQ ID NO: 3777600 - RNA, 21 nt, Human
augagcaucaggccaggcccu

SEQ ID NO: 3777601 - RNA, 14 nt, Human
augagcaucccagg

SEQ ID NO: 3777602 - RNA, 17 nt, Human
augagcauccugagccc

SEQ ID NO: 3777603 - RNA, 18 nt, Human
augagcauccugagcccc

SEQ ID NO: 3777604 - RNA, 15 nt, Human
augagcauggagcug

SEQ ID NO: 3777605 - RNA, 18 nt, Human
augagcauggagcuggcc

SEQ ID NO: 3777606 - RNA, 21 nt, Human
augagcauguuuagacuuuaa

SEQ ID NO: 3777607 - RNA, 16 nt, Human
augagccgcccaaggc

SEQ ID NO: 3777608 - RNA, 21 nt, Human
augagccgcccaaggccuucc

SEQ ID NO: 3777609 - RNA, 22 nt, Human
augagccgcccaaggccuuccc

SEQ ID NO: 3777610 - RNA, 20 nt, Human
augagccgcugugagccccu

SEQ ID NO: 3777611 - RNA, 11 nt, Human
augagccuggc

SEQ ID NO: 3777612 - RNA, 12 nt, Human
augagccuggca

SEQ ID NO: 3777613 - RNA, 15 nt, Human
augagcuauguauua

SEQ ID NO: 3777614 - RNA, 13 nt, Human
augagcuccagac

SEQ ID NO: 3777615 - RNA, 22 nt, Human
augagcuccagacccccagcaa

SEQ ID NO: 3777616 - RNA, 10 nt, Human
augagcuccc

SEQ ID NO: 3777617 - RNA, 21 nt, Human
augagcucccacaagccugag

SEQ ID NO: 3777618 - RNA, 22 nt, Human
augagcuccucuuccuggcuuc

SEQ ID NO: 3777619 - RNA, 19 nt, Human
augagcuccuuaaggcucu

SEQ ID NO: 3777620 - RNA, 22 nt, Human
augagcucuacccagggccugc

SEQ ID NO: 3777621 - RNA, 13 nt, Human
augagcugagggg

SEQ ID NO: 3777622 - RNA, 13 nt, Human
augagcuggaagg

SEQ ID NO: 3777623 - RNA, 18 nt, Human
augagcugugcacaaagu

SEQ ID NO: 3777624 - RNA, 20 nt, Human
augagcuuuauguaauaaug

SEQ ID NO: 3777625 - RNA, 13 nt, Human
augagcuuucuga

SEQ ID NO: 3777626 - RNA, 19 nt, Human
augagcuuucugaacagcu

SEQ ID NO: 3777627 - RNA, 21 nt, Human
augagcuuugucuacuucaaa

SEQ ID NO: 3777628 - RNA, 21 nt, Human
augaggaaaauaauguaauug

SEQ ID NO: 3777629 - RNA, 23 nt, Human
augaggaauaauuauuuauuuaa

SEQ ID NO: 3777630 - RNA, 17 nt, Human
augaggagagaaaauau

SEQ ID NO: 3777631 - RNA, 17 nt, Human
augaggaggggagggua

SEQ ID NO: 3777632 - RNA, 12 nt, Human
augaggagggug

SEQ ID NO: 3777633 - RNA, 18 nt, Human
augaggcaaugucaggaa

SEQ ID NO: 3777634 - RNA, 13 nt, Human
augaggcagagga

SEQ ID NO: 3777635 - RNA, 22 nt, Human
augaggcauuuguuugaacuga

SEQ ID NO: 3777636 - RNA, 15 nt, Human
augaggccacuggag

SEQ ID NO: 3777637 - RNA, 17 nt, Human
augaggccagaccaugg

SEQ ID NO: 3777638 - RNA, 15 nt, Human
augaggcccuccaca

SEQ ID NO: 3777639 - RNA, 15 nt, Human
augaggccgcuagag

SEQ ID NO: 3777640 - RNA, 22 nt, Human
augaggcugcuuuccaaagcca

SEQ ID NO: 3777641 - RNA, 15 nt, Human
augaggcuugcugag

SEQ ID NO: 3777642 - RNA, 18 nt, Human
augaggcuugcugagagg

SEQ ID NO: 3777643 - RNA, 14 nt, Human
augagggaaaagaa

SEQ ID NO: 3777644 - RNA, 15 nt, Human
augagggaaaagaaa

SEQ ID NO: 3777645 - RNA, 14 nt, Human
augagggacuggaa

SEQ ID NO: 3777646 - RNA, 17 nt, Human
augagggagaugccaug

SEQ ID NO: 3777647 - RNA, 16 nt, Human
augagggaugggccug

SEQ ID NO: 3777648 - RNA, 18 nt, Human
augagggaugggccuggc

SEQ ID NO: 3777649 - RNA, 14 nt, Human
augagggcagcagc

SEQ ID NO: 3777650 - RNA, 15 nt, Human
augagggcagcagcc

SEQ ID NO: 3777651 - RNA, 20 nt, Human
augagggcagcagccagccc

SEQ ID NO: 3777652 - RNA, 11 nt, Human
augagggccac

SEQ ID NO: 3777653 - RNA, 19 nt, Human
augaggggacauuuuggug

SEQ ID NO: 3777654 - RNA, 12 nt, Human
augaggggagag

SEQ ID NO: 3777655 - RNA, 20 nt, Human
augagggucuugguuccagc

SEQ ID NO: 3777656 - RNA, 18 nt, Human
augagguacugagaguga

SEQ ID NO: 3777657 - RNA, 16 nt, Human
augagguaucuucuuu

SEQ ID NO: 3777658 - RNA, 18 nt, Human
augaggucagagccugca

SEQ ID NO: 3777659 - RNA, 20 nt, Human
augaggucagagccugcagu

SEQ ID NO: 3777660 - RNA, 19 nt, Human
augaggucccaggcagaga

SEQ ID NO: 3777661 - RNA, 14 nt, Human
augaggucugaaau

SEQ ID NO: 3777662 - RNA, 17 nt, Human
augaggucugaaaugga

SEQ ID NO: 3777663 - RNA, 16 nt, Human
augaggucugggcuag

SEQ ID NO: 3777664 - RNA, 14 nt, Human
augaggucuguuua

SEQ ID NO: 3777665 - RNA, 15 nt, Human
augaggucuguuuaa

SEQ ID NO: 3777666 - RNA, 14 nt, Human
augaggugggaggu

SEQ ID NO: 3777667 - RNA, 22 nt, Human
augaggugggagguggaagaag

SEQ ID NO: 3777668 - RNA, 21 nt, Human
augaguaaaaaaaaaaacaau

SEQ ID NO: 3777669 - RNA, 15 nt, Human
augaguaaaggagua

SEQ ID NO: 3777670 - RNA, 16 nt, Human
augaguaacauuugcu

SEQ ID NO: 3777671 - RNA, 17 nt, Human
augaguacaaaugccuu

SEQ ID NO: 3777672 - RNA, 13 nt, Human
augaguagccagg

SEQ ID NO: 3777673 - RNA, 17 nt, Human
augaguauacaauauau

SEQ ID NO: 3777674 - RNA, 18 nt, Human
augaguauacaauauaua

SEQ ID NO: 3777675 - RNA, 21 nt, Human
augaguauacaauauauaaaa

SEQ ID NO: 3777676 - RNA, 16 nt, Human
augagucccaguggga

SEQ ID NO: 3777677 - RNA, 16 nt, Human
augaguccuugaaaau

SEQ ID NO: 3777678 - RNA, 12 nt, Human
augagucuagau

SEQ ID NO: 3777679 - RNA, 17 nt, Human
augagucuagauguuua

SEQ ID NO: 3777680 - RNA, 19 nt, Human
augagucuguuguguguca

SEQ ID NO: 3777681 - RNA, 13 nt, Human
augagugauucuu

SEQ ID NO: 3777682 - RNA, 17 nt, Human
augaguggcuuuaauga

SEQ ID NO: 3777683 - RNA, 21 nt, Human
augaguguaacaagaaaggag

SEQ ID NO: 3777684 - RNA, 23 nt, Human
augagugugauccaguuuuucau

SEQ ID NO: 3777685 - RNA, 13 nt, Human
augagugugcaug

SEQ ID NO: 3777686 - RNA, 17 nt, Human
augaguuacugugcauu

SEQ ID NO: 3777687 - RNA, 19 nt, Human
augaguuagaauaauaaau

SEQ ID NO: 3777688 - RNA, 16 nt, Human
augaguuaucuaagaa

SEQ ID NO: 3777689 - RNA, 18 nt, Human
augaguuggcugggaaua

SEQ ID NO: 3777690 - RNA, 15 nt, Human
augaguugugaaagu

SEQ ID NO: 3777691 - RNA, 20 nt, Human
augaguugugaaaguuuuga

SEQ ID NO: 3777692 - RNA, 15 nt, Human
augaguuuaaaaauc

SEQ ID NO: 3777693 - RNA, 22 nt, Human
augaguuuaaaaaucaacuuuu

SEQ ID NO: 3777694 - RNA, 15 nt, Human
augaguuucauagcu

SEQ ID NO: 3777695 - RNA, 15 nt, Human
augaguuugcccugg

SEQ ID NO: 3777696 - RNA, 14 nt, Human
augaguuugcuuau

SEQ ID NO: 3777697 - RNA, 18 nt, Human
augaguuuugggaaguua

SEQ ID NO: 3777698 - RNA, 20 nt, Human
augaguuuuugauagcuuua

SEQ ID NO: 3777699 - RNA, 17 nt, Human
augauaaagagacagug

SEQ ID NO: 3777700 - RNA, 17 nt, Human
augauaaguaaaugcua

SEQ ID NO: 3777701 - RNA, 12 nt, Human
augauaaugaac

SEQ ID NO: 3777702 - RNA, 17 nt, Human
augauacagcagagcua

SEQ ID NO: 3777703 - RNA, 18 nt, Human
augauacuucgacacugu

SEQ ID NO: 3777704 - RNA, 20 nt, Human
augauagauuugaccuccuc

SEQ ID NO: 3777705 - RNA, 17 nt, Human
augauaugcuuguaacu

SEQ ID NO: 3777706 - RNA, 21 nt, Human
augauauguaaacauaauucu

SEQ ID NO: 3777707 - RNA, 18 nt, Human
augauauuaaaaauuggc

SEQ ID NO: 3777708 - RNA, 13 nt, Human
augauauugcaua

SEQ ID NO: 3777709 - RNA, 13 nt, Human
augaucaaaaaua

SEQ ID NO: 3777710 - RNA, 12 nt, Human
augaucaaaugu

SEQ ID NO: 3777711 - RNA, 13 nt, Human
augaucaaauguu

SEQ ID NO: 3777712 - RNA, 15 nt, Human
augaucaaauguuua

SEQ ID NO: 3777713 - RNA, 17 nt, Human
augaucaaauguuuaau

SEQ ID NO: 3777714 - RNA, 18 nt, Human
augaucaauccuuuauua

SEQ ID NO: 3777715 - RNA, 19 nt, Human
augaucacggcucacugca

SEQ ID NO: 3777716 - RNA, 23 nt, Human
augaucacggcucacugcagccu

SEQ ID NO: 3777717 - RNA, 19 nt, Human
augaucagcuguuugucau

SEQ ID NO: 3777718 - RNA, 13 nt, Human
augaucaguuuuu

SEQ ID NO: 3777719 - RNA, 15 nt, Human
augaucaguuuuuuu

SEQ ID NO: 3777720 - RNA, 22 nt, Human
augaucauuugcccuuaaggac

SEQ ID NO: 3777721 - RNA, 10 nt, Human
augauccagc

SEQ ID NO: 3777722 - RNA, 22 nt, Human
augauccagcagauuauucacu

SEQ ID NO: 3777723 - RNA, 21 nt, Human
augauccaugaguuugcccug

SEQ ID NO: 3777724 - RNA, 22 nt, Human
augauccaugaguuugcccugg

SEQ ID NO: 3777725 - RNA, 18 nt, Human
augauccccacgccacag

SEQ ID NO: 3777726 - RNA, 19 nt, Human
augauccccacgccacagc

SEQ ID NO: 3777727 - RNA, 23 nt, Human
augauccccacgccacagcccuu

SEQ ID NO: 3777728 - RNA, 16 nt, Human
augauccuaggcauuu

SEQ ID NO: 3777729 - RNA, 20 nt, Human
augauccuguauucagacag

SEQ ID NO: 3777730 - RNA, 22 nt, Human
augaucgaaaaaauaauuauuu

SEQ ID NO: 3777731 - RNA, 15 nt, Human
augaucuacucagaa

SEQ ID NO: 3777732 - RNA, 16 nt, Human
augaucuacucagaaa

SEQ ID NO: 3777733 - RNA, 15 nt, Human
augaucuaggaagac

SEQ ID NO: 3777734 - RNA, 20 nt, Human
augaucuaggaagacuuugg

SEQ ID NO: 3777735 - RNA, 22 nt, Human
augaucuagguuuaacucagau

SEQ ID NO: 3777736 - RNA, 21 nt, Human
augaucugagucccaggagcu

SEQ ID NO: 3777737 - RNA, 15 nt, Human
augaucugugccuuu

SEQ ID NO: 3777738 - RNA, 14 nt, Human
augaucuucuuuau

SEQ ID NO: 3777739 - RNA, 12 nt, Human
auguguuugcuu

SEQ ID NO: 3777740 - RNA, 14 nt, Human
auguguuuucugaa

SEQ ID NO: 3777741 - RNA, 15 nt, Human
auguguuuucugaau

SEQ ID NO: 3777742 - RNA, 18 nt, Human
auguguuuuguuuauuaa

SEQ ID NO: 3777743 - RNA, 15 nt, Human
auguguuuuucucca

SEQ ID NO: 3777744 - RNA, 19 nt, Human
auguuaaaaaaauaagaag

SEQ ID NO: 3777745 - RNA, 18 nt, Human
auguuaaaauaaaugguu

SEQ ID NO: 3777746 - RNA, 23 nt, Human
auguuaaacuagcauaucugccu

SEQ ID NO: 3777747 - RNA, 24 nt, Human
auguuaaacuagcauaucugccuu

SEQ ID NO: 3777748 - RNA, 23 nt, Human
auguuaaacuuauaacccacuuu

SEQ ID NO: 3777749 - RNA, 16 nt, Human
auguuaaagagaauga

SEQ ID NO: 3777750 - RNA, 13 nt, Human
auguuaaagaugu

SEQ ID NO: 3777751 - RNA, 22 nt, Human
auguuaaauaaauuguauauuc

SEQ ID NO: 3777752 - RNA, 18 nt, Human
auguuaaaucccauucau

SEQ ID NO: 3777753 - RNA, 14 nt, Human
auguuaaauuugua

SEQ ID NO: 3777754 - RNA, 22 nt, Human
auguuaaauuuguaaguuucag

SEQ ID NO: 3777755 - RNA, 23 nt, Human
auguuaacaaugccuauuguaau

SEQ ID NO: 3777756 - RNA, 13 nt, Human
auguuaacacauu

SEQ ID NO: 3777757 - RNA, 18 nt, Human
auguuaacacauuuugua

SEQ ID NO: 3777758 - RNA, 22 nt, Human
auguuaacacauuuuguauaau

SEQ ID NO: 3777759 - RNA, 18 nt, Human
auguuaaccaaggaaaua

SEQ ID NO: 3777760 - RNA, 21 nt, Human
auguuaaccucagugucauuu

SEQ ID NO: 3777761 - RNA, 19 nt, Human
auguuaaccucugcuuuua

SEQ ID NO: 3777762 - RNA, 16 nt, Human
auguuaagacuugaca

SEQ ID NO: 3777763 - RNA, 18 nt, Human
auguuaagacuugacagu

SEQ ID NO: 3777764 - RNA, 21 nt, Human
auguuaagcagcuaaauuuuc

SEQ ID NO: 3777765 - RNA, 21 nt, Human
auguuaagcccuggcaggcag

SEQ ID NO: 3777766 - RNA, 13 nt, Human
auguuaaggaaac

SEQ ID NO: 3777767 - RNA, 22 nt, Human
auguuaauauuuuagguguaaa

SEQ ID NO: 3777768 - RNA, 22 nt, Human
auguuaauucagcacugauuuc

SEQ ID NO: 3777769 - RNA, 19 nt, Human
auguuaauugauagaauaa

SEQ ID NO: 3777770 - RNA, 20 nt, Human
auguuaauuuguguguuuuu

SEQ ID NO: 3777771 - RNA, 20 nt, Human
auguuacaucuguuuuaaau

SEQ ID NO: 3777772 - RNA, 16 nt, Human
auguuaccaucuuacu

SEQ ID NO: 3777773 - RNA, 21 nt, Human
auguuaccaucuuacuugagc

SEQ ID NO: 3777774 - RNA, 14 nt, Human
auguuacugaccag

SEQ ID NO: 3777775 - RNA, 16 nt, Human
auguuacugaucaugc

SEQ ID NO: 3777776 - RNA, 19 nt, Human
auguuacugaucaugcauu

SEQ ID NO: 3777777 - RNA, 21 nt, Human
auguuacugaucaugcauugu

SEQ ID NO: 3777778 - RNA, 22 nt, Human
auguuacugaucaugcauuguu

SEQ ID NO: 3777779 - RNA, 22 nt, Human
auguuagacucaugguguguua

SEQ ID NO: 3777780 - RNA, 22 nt, Human
auguuagagguuuuaaagugau

SEQ ID NO: 3777781 - RNA, 20 nt, Human
auguuaggcugggcccagag

SEQ ID NO: 3777782 - RNA, 16 nt, Human
auguuaguaauaccuc

SEQ ID NO: 3777783 - RNA, 22 nt, Human
auguuagucauuguuauuuaua

SEQ ID NO: 3777784 - RNA, 23 nt, Human
auguuaguuaccuuauaguuacu

SEQ ID NO: 3777785 - RNA, 15 nt, Human
auguuaguuuuccuu

SEQ ID NO: 3777786 - RNA, 14 nt, Human
auguuauauauaaa

SEQ ID NO: 3777787 - RNA, 19 nt, Human
auguuauauauaaauauau

SEQ ID NO: 3777788 - RNA, 22 nt, Human
auguuauauauaaauauauuau

SEQ ID NO: 3777789 - RNA, 13 nt, Human
auguuauauauuu

SEQ ID NO: 3777790 - RNA, 17 nt, Human
auguuauauauuuuuug

SEQ ID NO: 3777791 - RNA, 18 nt, Human
auguuauaucauauguau

SEQ ID NO: 3777792 - RNA, 23 nt, Human
auguuauauuuuucuuaaaaagu

SEQ ID NO: 3777793 - RNA, 20 nt, Human
auguuaucuucucaaguucu

SEQ ID NO: 3777794 - RNA, 13 nt, Human
auguuaugauaaa

SEQ ID NO: 3777795 - RNA, 16 nt, Human
auguuaugauaaaaaa

SEQ ID NO: 3777796 - RNA, 20 nt, Human
auguuaugauaaaaaauuuu

SEQ ID NO: 3777797 - RNA, 22 nt, Human
auguuaugauaaaaaauuuugu

SEQ ID NO: 3777798 - RNA, 17 nt, Human
auguuaugcauaaaguc

SEQ ID NO: 3777799 - RNA, 18 nt, Human
auguuaugcauaaaguca

SEQ ID NO: 3777800 - RNA, 21 nt, Human
auguuauguaaaaggccaaac

SEQ ID NO: 3777801 - RNA, 14 nt, Human
auguuauugaaaaa

SEQ ID NO: 3777802 - RNA, 23 nt, Human
auguuauuuaacagcugaauuau

SEQ ID NO: 3777803 - RNA, 15 nt, Human
auguuauuucugcaa

SEQ ID NO: 3777804 - RNA, 19 nt, Human
auguuauuuguaauagaug

SEQ ID NO: 3777805 - RNA, 18 nt, Human
auguucaaagccacauua

SEQ ID NO: 3777806 - RNA, 22 nt, Human
auguucacuuuugacaaaggca

SEQ ID NO: 3777807 - RNA, 16 nt, Human
auguucagaagaaauu

SEQ ID NO: 3777808 - RNA, 23 nt, Human
auguucagaagguugcucuagau

SEQ ID NO: 3777809 - RNA, 22 nt, Human
auguucaguguaauuucuuugc

SEQ ID NO: 3777810 - RNA, 16 nt, Human
auguucaucaauuccc

SEQ ID NO: 3777811 - RNA, 14 nt, Human
auguucauuguaau

SEQ ID NO: 3777812 - RNA, 22 nt, Human
auguucauuguaauguuacuga

SEQ ID NO: 3777813 - RNA, 23 nt, Human
auguucauuguaauguuacugau

SEQ ID NO: 3777814 - RNA, 15 nt, Human
auguuccaauaaaca

SEQ ID NO: 3777815 - RNA, 16 nt, Human
auguuccaauaaacag

SEQ ID NO: 3777816 - RNA, 20 nt, Human
auguuccgaauugagcacaa

SEQ ID NO: 3777817 - RNA, 19 nt, Human
auguuccugaauucuauuu

SEQ ID NO: 3777818 - RNA, 22 nt, Human
auguuccuuuggaagaaaaaau

SEQ ID NO: 3777819 - RNA, 23 nt, Human
auguucgguuuuuuuccuguuuc

SEQ ID NO: 3777820 - RNA, 17 nt, Human
auguucuaaccuuuaca

SEQ ID NO: 3777821 - RNA, 12 nt, Human
auguucuaaggc

SEQ ID NO: 3777822 - RNA, 13 nt, Human
auguucuaaggcu

SEQ ID NO: 3777823 - RNA, 14 nt, Human
auguucuaaggcuc

SEQ ID NO: 3777824 - RNA, 16 nt, Human
auguucuaaggcucug

SEQ ID NO: 3777825 - RNA, 20 nt, Human
auguucuaaggcucugagag

SEQ ID NO: 3777826 - RNA, 22 nt, Human
auguucuaaggcucugagaguc

SEQ ID NO: 3777827 - RNA, 18 nt, Human
auguucuaagucuuucca

SEQ ID NO: 3777828 - RNA, 19 nt, Human
auguucuaagucuuuccau

SEQ ID NO: 3777829 - RNA, 19 nt, Human
auguucuaaguuucuaaga

SEQ ID NO: 3777830 - RNA, 23 nt, Human
auguucuaaguuucuaagauucu

SEQ ID NO: 3777831 - RNA, 20 nt, Human
auguucuaugguuaugaaag

SEQ ID NO: 3777832 - RNA, 21 nt, Human
auguucuaugguuaugaaaga

SEQ ID NO: 3777833 - RNA, 20 nt, Human
auguucuauuuuuuguuuug

SEQ ID NO: 3777834 - RNA, 14 nt, Human
auguucucuaucau

SEQ ID NO: 3777835 - RNA, 15 nt, Human
auguucucuaucauu

SEQ ID NO: 3777836 - RNA, 16 nt, Human
auguucucuaucauuu

SEQ ID NO: 3777837 - RNA, 19 nt, Human
auguucucuaucauuuaau

SEQ ID NO: 3777838 - RNA, 17 nt, Human
auguucucucuucucca

SEQ ID NO: 3777839 - RNA, 18 nt, Human
auguucucugaggacacu

SEQ ID NO: 3777840 - RNA, 14 nt, Human
auguucugacauua

SEQ ID NO: 3777841 - RNA, 13 nt, Human
auguucuggcccu

SEQ ID NO: 3777842 - RNA, 15 nt, Human
auguucugggacaca

SEQ ID NO: 3777843 - RNA, 21 nt, Human
auguucuuaugcaaaauggaa

SEQ ID NO: 3777844 - RNA, 11 nt, Human
auguucuucca

SEQ ID NO: 3777845 - RNA, 20 nt, Human
auguucuuuauauacaauaa

SEQ ID NO: 3777846 - RNA, 16 nt, Human
auguucuuuggaaagu

SEQ ID NO: 3777847 - RNA, 21 nt, Human
auguugaaaaaauuuaaaagu

SEQ ID NO: 3777848 - RNA, 18 nt, Human
auguugaagaauacaguu

SEQ ID NO: 3777849 - RNA, 15 nt, Human
auguugaauacuuuu

SEQ ID NO: 3777850 - RNA, 12 nt, Human
auguugaauauu

SEQ ID NO: 3777851 - RNA, 21 nt, Human
auguugacaucacuggcaugg

SEQ ID NO: 3777852 - RNA, 18 nt, Human
auguugaucauguacuuu

SEQ ID NO: 3777853 - RNA, 20 nt, Human
auguugauccauccagcuug

SEQ ID NO: 3777854 - RNA, 24 nt, Human
auguugauccauccagcuugccag

SEQ ID NO: 3777855 - RNA, 21 nt, Human
auguugauuuuuacuguguuu

SEQ ID NO: 3777856 - RNA, 15 nt, Human
auguugcaaugugaa

SEQ ID NO: 3777857 - RNA, 21 nt, Human
auguugcacacccacucagcu

SEQ ID NO: 3777858 - RNA, 16 nt, Human
auguugccauguguuu

SEQ ID NO: 3777859 - RNA, 13 nt, Human
auguugcccaggc

SEQ ID NO: 3777860 - RNA, 14 nt, Human
auguugcuaacagc

SEQ ID NO: 3777861 - RNA, 19 nt, Human
auguugcuaugugccuuau

SEQ ID NO: 3777862 - RNA, 22 nt, Human
auguugcuaugugccuuauguu

SEQ ID NO: 3777863 - RNA, 20 nt, Human
auguugcugaggagugagga

SEQ ID NO: 3777864 - RNA, 11 nt, Human
auguugcugcc

SEQ ID NO: 3777865 - RNA, 19 nt, Human
auguugcuggacugucaua

SEQ ID NO: 3777866 - RNA, 17 nt, Human
auguugcuuaggaugug

SEQ ID NO: 3777867 - RNA, 23 nt, Human
auguuggacaccuuuagguucuu

SEQ ID NO: 3777868 - RNA, 18 nt, Human
auguuggauuuauaaaug

SEQ ID NO: 3777869 - RNA, 19 nt, Human
auguuggcagaugcagcuc

SEQ ID NO: 3777870 - RNA, 12 nt, Human
auguuggcuggg

SEQ ID NO: 3777871 - RNA, 19 nt, Human
auguugggaaacuuggcuc

SEQ ID NO: 3777872 - RNA, 20 nt, Human
auguugggaaacuuggcucg

SEQ ID NO: 3777873 - RNA, 17 nt, Human
auguuggucaggcuggu

SEQ ID NO: 3777874 - RNA, 14 nt, Human
auguugguguucca

SEQ ID NO: 3777875 - RNA, 18 nt, Human
auguugguugcacuuugu

SEQ ID NO: 3777876 - RNA, 17 nt, Human
auguugguuuacuuuca

SEQ ID NO: 3777877 - RNA, 19 nt, Human
auguugguuuacuuucaaa

SEQ ID NO: 3777878 - RNA, 17 nt, Human
auguuguaauauuucuu

SEQ ID NO: 3777879 - RNA, 15 nt, Human
auguuguaaugcugc

SEQ ID NO: 3777880 - RNA, 12 nt, Human
auguuguagugu

SEQ ID NO: 3777881 - RNA, 19 nt, Human
auguuguagugucccccac

SEQ ID NO: 3777882 - RNA, 22 nt, Human
auuaaucacuguguauauuuga

SEQ ID NO: 3777883 - RNA, 23 nt, Human
auuaaucacuguguauauuugau

SEQ ID NO: 3777884 - RNA, 17 nt, Human
auuaauccacauguuuc

SEQ ID NO: 3777885 - RNA, 20 nt, Human
auuaaucuuaguguaugauu

SEQ ID NO: 3777886 - RNA, 22 nt, Human
auuaaucuuaguguaugauuac

SEQ ID NO: 3777887 - RNA, 18 nt, Human
auuaaucuuucuuuaccu

SEQ ID NO: 3777888 - RNA, 19 nt, Human
auuaaugaaaauaagaauu

SEQ ID NO: 3777889 - RNA, 13 nt, Human
auuaaugaaauau

SEQ ID NO: 3777890 - RNA, 17 nt, Human
auuaaugaaauaucugu

SEQ ID NO: 3777891 - RNA, 11 nt, Human
auuaaugcacu

SEQ ID NO: 3777892 - RNA, 15 nt, Human
auuaaugcacuuucu

SEQ ID NO: 3777893 - RNA, 13 nt, Human
auuaaugcccaga

SEQ ID NO: 3777894 - RNA, 15 nt, Human
auuaaugccuuuaaa

SEQ ID NO: 3777895 - RNA, 16 nt, Human
auuaaugccuuuaaag

SEQ ID NO: 3777896 - RNA, 21 nt, Human
auuaaugccuuuaaaguauga

SEQ ID NO: 3777897 - RNA, 17 nt, Human
auuaauggucuaaaaau

SEQ ID NO: 3777898 - RNA, 12 nt, Human
auuaauguugau

SEQ ID NO: 3777899 - RNA, 13 nt, Human
auuaauuaaacau

SEQ ID NO: 3777900 - RNA, 16 nt, Human
auuaauuggcagcaga

SEQ ID NO: 3777901 - RNA, 18 nt, Human
auuaauugugugaacuug

SEQ ID NO: 3777902 - RNA, 18 nt, Human
auuaauuguuuugcacuu

SEQ ID NO: 3777903 - RNA, 16 nt, Human
auuaauuuaucagauu

SEQ ID NO: 3777904 - RNA, 17 nt, Human
auuaauuuaugcagaau

SEQ ID NO: 3777905 - RNA, 17 nt, Human
auuaauuugauuaacaa

SEQ ID NO: 3777906 - RNA, 22 nt, Human
auuaauuugauuaacaaauaug

SEQ ID NO: 3777907 - RNA, 21 nt, Human
auuaauuugcaucugaaauag

SEQ ID NO: 3777908 - RNA, 16 nt, Human
auuaauuuuuuuauug

SEQ ID NO: 3777909 - RNA, 22 nt, Human
auuacaaaaugacauuuugcca

SEQ ID NO: 3777910 - RNA, 23 nt, Human
auuacaaaguuaaaauuguuauc

SEQ ID NO: 3777911 - RNA, 21 nt, Human
auuacaaaucagaagucaucu

SEQ ID NO: 3777912 - RNA, 22 nt, Human
auuacaaaucagaagucaucuu

SEQ ID NO: 3777913 - RNA, 13 nt, Human
auuacaaauugcu

SEQ ID NO: 3777914 - RNA, 22 nt, Human
auuacaaauugcuuacuuugga

SEQ ID NO: 3777915 - RNA, 15 nt, Human
auuacaacagugaga

SEQ ID NO: 3777916 - RNA, 17 nt, Human
auuacaacggagucaaa

SEQ ID NO: 3777917 - RNA, 14 nt, Human
auuacaaguauuuu

SEQ ID NO: 3777918 - RNA, 15 nt, Human
auuacaauuuuaucu

SEQ ID NO: 3777919 - RNA, 14 nt, Human
auuacacuugguaa

SEQ ID NO: 3777920 - RNA, 15 nt, Human
auuacagauaaaaug

SEQ ID NO: 3777921 - RNA, 20 nt, Human
auuacaggcaccugccacca

SEQ ID NO: 3777922 - RNA, 16 nt, Human
auuacaggcaugugcc

SEQ ID NO: 3777923 - RNA, 17 nt, Human
auuacaggcgugagcca

SEQ ID NO: 3777924 - RNA, 22 nt, Human
auuacaggcgugagccaccucg

SEQ ID NO: 3777925 - RNA, 19 nt, Human
auuacaggcuccugccacc

SEQ ID NO: 3777926 - RNA, 15 nt, Human
auuacagggcacagg

SEQ ID NO: 3777927 - RNA, 16 nt, Human
auuacagggcacaggc

SEQ ID NO: 3777928 - RNA, 13 nt, Human
auuacagguguga

SEQ ID NO: 3777929 - RNA, 12 nt, Human
auuacaguauaa

SEQ ID NO: 3777930 - RNA, 14 nt, Human
auuacaguauaauu

SEQ ID NO: 3777931 - RNA, 18 nt, Human
auuacaguccaaaauacu

SEQ ID NO: 3777932 - RNA, 14 nt, Human
auuacaguguuuau

SEQ ID NO: 3777933 - RNA, 22 nt, Human
auuacauaaauaaauuaaauaa

SEQ ID NO: 3777934 - RNA, 21 nt, Human
auuacauaaucuguacaauga

SEQ ID NO: 3777935 - RNA, 23 nt, Human
auuacauaauuuaguuguuucua

SEQ ID NO: 3777936 - RNA, 14 nt, Human
auuacauccuugug

SEQ ID NO: 3777937 - RNA, 16 nt, Human
auuacauguaaaacau

SEQ ID NO: 3777938 - RNA, 16 nt, Human
auuacauguaauuuga

SEQ ID NO: 3777939 - RNA, 21 nt, Human
auuacauuacugaaaacuuca

SEQ ID NO: 3777940 - RNA, 19 nt, Human
auuacauugcuuuuucuug

SEQ ID NO: 3777941 - RNA, 15 nt, Human
auuacauuuguauaa

SEQ ID NO: 3777942 - RNA, 18 nt, Human
auuacauuuguauaaaau

SEQ ID NO: 3777943 - RNA, 15 nt, Human
auuacauuuucagug

SEQ ID NO: 3777944 - RNA, 20 nt, Human
auuaccaauaggcaaauuaa

SEQ ID NO: 3777945 - RNA, 12 nt, Human
auuaccacugaa

SEQ ID NO: 3777946 - RNA, 12 nt, Human
auuaccagggac

SEQ ID NO: 3777947 - RNA, 13 nt, Human
auuacccaagcaa

SEQ ID NO: 3777948 - RNA, 15 nt, Human
auuacccaagcaaaa

SEQ ID NO: 3777949 - RNA, 19 nt, Human
auuacccagcuaaauaauc

SEQ ID NO: 3777950 - RNA, 19 nt, Human
auuacccccuccuucagac

SEQ ID NO: 3777951 - RNA, 17 nt, Human
auuaccgcguuguaaaa

SEQ ID NO: 3777952 - RNA, 18 nt, Human
auuaccgcguuguaaaau

SEQ ID NO: 3777953 - RNA, 21 nt, Human
auuaccgcguuguaaaauaua

SEQ ID NO: 3777954 - RNA, 17 nt, Human
auuaccuccugagaaaa

SEQ ID NO: 3777955 - RNA, 19 nt, Human
auuaccuucuauuggucuc

SEQ ID NO: 3777956 - RNA, 23 nt, Human
auuaccuuuuaccagcuuuuaac

SEQ ID NO: 3777957 - RNA, 20 nt, Human
auuaccuuuuuugauaaagu

SEQ ID NO: 3777958 - RNA, 21 nt, Human
auuacguaugucugguucuca

SEQ ID NO: 3777959 - RNA, 14 nt, Human
auuacgugagccag

SEQ ID NO: 3777960 - RNA, 20 nt, Human
auuacgugagccagguaaug

SEQ ID NO: 3777961 - RNA, 13 nt, Human
auuacgugcucug

SEQ ID NO: 3777962 - RNA, 21 nt, Human
auuacuaacuucuaaaacugu

SEQ ID NO: 3777963 - RNA, 20 nt, Human
auuacuaaggaguaaucugu

SEQ ID NO: 3777964 - RNA, 19 nt, Human
auuacuaauuuuacacauu

SEQ ID NO: 3777965 - RNA, 20 nt, Human
auuacuaauuuuacacauua

SEQ ID NO: 3777966 - RNA, 19 nt, Human
auuacuccuauuuuuguaa

SEQ ID NO: 3777967 - RNA, 20 nt, Human
auuacuccuauuuuuguaaa

SEQ ID NO: 3777968 - RNA, 15 nt, Human
auuacucuuaaggaa

SEQ ID NO: 3777969 - RNA, 17 nt, Human
auuacucuuguaagauu

SEQ ID NO: 3777970 - RNA, 20 nt, Human
auuacugccauucacuucau

SEQ ID NO: 3777971 - RNA, 21 nt, Human
auuacuggccuuuuucauuua

SEQ ID NO: 3777972 - RNA, 15 nt, Human
auuacugggccuuag

SEQ ID NO: 3777973 - RNA, 15 nt, Human
auuacugguccaaaa

SEQ ID NO: 3777974 - RNA, 13 nt, Human
auuacuguaagaa

SEQ ID NO: 3777975 - RNA, 15 nt, Human
auuacugucaauaaa

SEQ ID NO: 3777976 - RNA, 17 nt, Human
auuacugucaauaaaca

SEQ ID NO: 3777977 - RNA, 17 nt, Human
auuacuguuuaagacac

SEQ ID NO: 3777978 - RNA, 16 nt, Human
auuacuguuuauuucu

SEQ ID NO: 3777979 - RNA, 13 nt, Human
auuacuguuuguc

SEQ ID NO: 3777980 - RNA, 15 nt, Human
auuacuuaucaucca

SEQ ID NO: 3777981 - RNA, 19 nt, Human
auuacuuaucccugcccau

SEQ ID NO: 3777982 - RNA, 15 nt, Human
auuacuuauuuuuga

SEQ ID NO: 3777983 - RNA, 16 nt, Human
auuacuuauuuuugac

SEQ ID NO: 3777984 - RNA, 17 nt, Human
auuacuuauuuuugaca

SEQ ID NO: 3777985 - RNA, 22 nt, Human
auuacuucucuauaaaaaauau

SEQ ID NO: 3777986 - RNA, 13 nt, Human
auuacuuguaaau

SEQ ID NO: 3777987 - RNA, 20 nt, Human
auuacuuguaaauauaaaga

SEQ ID NO: 3777988 - RNA, 14 nt, Human
auuacuuuaucacu

SEQ ID NO: 3777989 - RNA, 14 nt, Human
auuacuuuuuucca

SEQ ID NO: 3777990 - RNA, 16 nt, Human
auuagaaaaaaauuac

SEQ ID NO: 3777991 - RNA, 12 nt, Human
auuagaaaacuu

SEQ ID NO: 3777992 - RNA, 16 nt, Human
auuagaaaacuuuguu

SEQ ID NO: 3777993 - RNA, 17 nt, Human
auuagaaaacuuuguua

SEQ ID NO: 3777994 - RNA, 18 nt, Human
auuagaaaacuuuguuag

SEQ ID NO: 3777995 - RNA, 13 nt, Human
auuagaaaauguu

SEQ ID NO: 3777996 - RNA, 22 nt, Human
auuagaaaauguuauuuaacag

SEQ ID NO: 3777997 - RNA, 11 nt, Human
auuagaaauga

SEQ ID NO: 3777998 - RNA, 23 nt, Human
auuagaaauuagcugugugaaau

SEQ ID NO: 3777999 - RNA, 23 nt, Human
auuagaacaggcaagugaagaaa

SEQ ID NO: 3778000 - RNA, 10 nt, Human
auuagaacuu

SEQ ID NO: 3778001 - RNA, 15 nt, Human
auuagaagacaacag

SEQ ID NO: 3778002 - RNA, 13 nt, Human
auuagaagacauu

SEQ ID NO: 3778003 - RNA, 14 nt, Human
auuagaaguguuaa

SEQ ID NO: 3778004 - RNA, 13 nt, Human
auuagaauagugu

SEQ ID NO: 3778005 - RNA, 22 nt, Human
auuagaauaguguucugcaaaa

SEQ ID NO: 3778006 - RNA, 15 nt, Human
auuagaauuaccauu

SEQ ID NO: 3778007 - RNA, 12 nt, Human
auuagaauucug

SEQ ID NO: 3778008 - RNA, 15 nt, Human
auuagaauucuguau

SEQ ID NO: 3778009 - RNA, 18 nt, Human
auuagaauucuguauaga

SEQ ID NO: 3778010 - RNA, 21 nt, Human
auuagaauucuguauagauua

SEQ ID NO: 3778011 - RNA, 13 nt, Human
auuagacagaaca

SEQ ID NO: 3778012 - RNA, 14 nt, Human
auuagacagaacac

SEQ ID NO: 3778013 - RNA, 17 nt, Human
auuagacagaacaccua

SEQ ID NO: 3778014 - RNA, 22 nt, Human
auuagacuggaacuugaacuga

SEQ ID NO: 3778015 - RNA, 14 nt, Human
auuagacuggacag

SEQ ID NO: 3778016 - RNA, 22 nt, Human
auuagacuguaggaagaguagc

SEQ ID NO: 3778017 - RNA, 18 nt, Human
auuagacugugauucaga

SEQ ID NO: 3778018 - RNA, 14 nt, Human
auuagacuucuguu

SEQ ID NO: 3778019 - RNA, 16 nt, Human
auuagacuucuguuuu

SEQ ID NO: 3778020 - RNA, 19 nt, Human
auuagacuucuguuuucaa

SEQ ID NO: 3778021 - RNA, 15 nt, Human
auuagagaguguuga

SEQ ID NO: 3778022 - RNA, 13 nt, Human
auuagagcaggcg

SEQ ID NO: 3778023 - RNA, 14 nt, Human
auuagagcauugaa

SEQ ID NO: 3778024 - RNA, 16 nt, Human
auuagagccuguaaac

SEQ ID NO: 3778025 - RNA, 19 nt, Human
auuagagggaggagaauga

SEQ ID NO: 3778026 - RNA, 22 nt, Human
auuagagggagguguuuaaaga

SEQ ID NO: 3778027 - RNA, 18 nt, Human
auuagauaaauguccauu

SEQ ID NO: 3778028 - RNA, 18 nt, Human
auuuagaaacuaauugac

SEQ ID NO: 3778029 - RNA, 15 nt, Human
auuuagaaauauaau

SEQ ID NO: 3778030 - RNA, 18 nt, Human
auuuagaagaaagauguu

SEQ ID NO: 3778031 - RNA, 23 nt, Human
auuuagaagccaacuaugauuau

SEQ ID NO: 3778032 - RNA, 11 nt, Human
auuuagaaugg

SEQ ID NO: 3778033 - RNA, 14 nt, Human
auuuagacaagaga

SEQ ID NO: 3778034 - RNA, 20 nt, Human
auuuagacaagagaugggaa

SEQ ID NO: 3778035 - RNA, 19 nt, Human
auuuagagcuagucuuuca

SEQ ID NO: 3778036 - RNA, 13 nt, Human
auuuagauguaua

SEQ ID NO: 3778037 - RNA, 18 nt, Human
auuuagcaaauaauuucc

SEQ ID NO: 3778038 - RNA, 18 nt, Human
auuuagccaccaucuuug

SEQ ID NO: 3778039 - RNA, 16 nt, Human
auuuagcccucacauu

SEQ ID NO: 3778040 - RNA, 16 nt, Human
auuuagccgggcgcgg

SEQ ID NO: 3778041 - RNA, 15 nt, Human
auuuagccuguccug

SEQ ID NO: 3778042 - RNA, 21 nt, Human
auuuagcuccaaaccuucaca

SEQ ID NO: 3778043 - RNA, 12 nt, Human
auuuaggaacuu

SEQ ID NO: 3778044 - RNA, 22 nt, Human
auuuaggcagauugaaaaggac

SEQ ID NO: 3778045 - RNA, 20 nt, Human
auuuagggagaaauguuguu

SEQ ID NO: 3778046 - RNA, 22 nt, Human
auuuagggagaaauguuguuca

SEQ ID NO: 3778047 - RNA, 19 nt, Human
auuuagggaguauucuaau

SEQ ID NO: 3778048 - RNA, 17 nt, Human
auuuaggguacuaaauu

SEQ ID NO: 3778049 - RNA, 19 nt, Human
auuuagguuuuuauuagua

SEQ ID NO: 3778050 - RNA, 23 nt, Human
auuuagguuuuuguuuguuuccu

SEQ ID NO: 3778051 - RNA, 14 nt, Human
auuuaguaaaccaa

SEQ ID NO: 3778052 - RNA, 15 nt, Human
auuuaguaagaauac

SEQ ID NO: 3778053 - RNA, 18 nt, Human
auuuaguauuuuguuuca

SEQ ID NO: 3778054 - RNA, 22 nt, Human
auuuagucucuuuauuccuagu

SEQ ID NO: 3778055 - RNA, 13 nt, Human
auuuaguguucau

SEQ ID NO: 3778056 - RNA, 23 nt, Human
auuuaguguuuuuuuauuucuac

SEQ ID NO: 3778057 - RNA, 16 nt, Human
auuuaguuauaguuuc

SEQ ID NO: 3778058 - RNA, 13 nt, Human
auuuaguuauuga

SEQ ID NO: 3778059 - RNA, 15 nt, Human
auuuaguuugauuau

SEQ ID NO: 3778060 - RNA, 19 nt, Human
auuuaguuuuuguucuuaa

SEQ ID NO: 3778061 - RNA, 23 nt, Human
auuuauaaaaauaaaaaacacug

SEQ ID NO: 3778062 - RNA, 15 nt, Human
auuuauaaaacuucu

SEQ ID NO: 3778063 - RNA, 15 nt, Human
auuuauaaacagaca

SEQ ID NO: 3778064 - RNA, 21 nt, Human
auuuauaaacagacaauaugu

SEQ ID NO: 3778065 - RNA, 14 nt, Human
auuuauaaaugcua

SEQ ID NO: 3778066 - RNA, 13 nt, Human
auuuauaacucau

SEQ ID NO: 3778067 - RNA, 15 nt, Human
auuuauaacucauca

SEQ ID NO: 3778068 - RNA, 19 nt, Human
auuuauaacucaucauaaa

SEQ ID NO: 3778069 - RNA, 17 nt, Human
auuuauaagcagauuua

SEQ ID NO: 3778070 - RNA, 15 nt, Human
auuuauaauacagaa

SEQ ID NO: 3778071 - RNA, 17 nt, Human
auuuauaauacagaauc

SEQ ID NO: 3778072 - RNA, 13 nt, Human
auuuauaaucacu

SEQ ID NO: 3778073 - RNA, 14 nt, Human
auuuauaauguuag

SEQ ID NO: 3778074 - RNA, 11 nt, Human
auuuauaauug

SEQ ID NO: 3778075 - RNA, 12 nt, Human
auuuauaauuuu

SEQ ID NO: 3778076 - RNA, 14 nt, Human
auuuauacaaauua

SEQ ID NO: 3778077 - RNA, 22 nt, Human
auuuauaccucaaacuaucugg

SEQ ID NO: 3778078 - RNA, 23 nt, Human
auuuauaccucaauuuucacugu

SEQ ID NO: 3778079 - RNA, 15 nt, Human
auuuauacuggcaug

SEQ ID NO: 3778080 - RNA, 17 nt, Human
auuuauacuguauauau

SEQ ID NO: 3778081 - RNA, 13 nt, Human
auuuauaguaaug

SEQ ID NO: 3778082 - RNA, 12 nt, Human
auuuauaguuug

SEQ ID NO: 3778083 - RNA, 14 nt, Human
auuuauaguuugua

SEQ ID NO: 3778084 - RNA, 15 nt, Human
auuuauauaaaugua

SEQ ID NO: 3778085 - RNA, 15 nt, Human
auuuauauaaauuuu

SEQ ID NO: 3778086 - RNA, 15 nt, Human
auuuauauaauuaug

SEQ ID NO: 3778087 - RNA, 16 nt, Human
auuuauauaauuaugu

SEQ ID NO: 3778088 - RNA, 20 nt, Human
auuuauauaauuauguuauu

SEQ ID NO: 3778089 - RNA, 22 nt, Human
auuuauauaauuauguuauuga

SEQ ID NO: 3778090 - RNA, 15 nt, Human
auuuauauagauuau

SEQ ID NO: 3778091 - RNA, 14 nt, Human
auuuauauauguau

SEQ ID NO: 3778092 - RNA, 14 nt, Human
auuuauauauuuau

SEQ ID NO: 3778093 - RNA, 15 nt, Human
auuuauauauuuaua

SEQ ID NO: 3778094 - RNA, 16 nt, Human
auuuauauauuuauaa

SEQ ID NO: 3778095 - RNA, 15 nt, Human
auuuauaucacaugu

SEQ ID NO: 3778096 - RNA, 11 nt, Human
auuuauaugua

SEQ ID NO: 3778097 - RNA, 16 nt, Human
auuuauauguacauga

SEQ ID NO: 3778098 - RNA, 15 nt, Human
auuuauauguacugu

SEQ ID NO: 3778099 - RNA, 21 nt, Human
auuuauauguauguguuuaga

SEQ ID NO: 3778100 - RNA, 20 nt, Human
auuuauauugauaagaucuu

SEQ ID NO: 3778101 - RNA, 21 nt, Human
auuuauauuguaaauauugug

SEQ ID NO: 3778102 - RNA, 16 nt, Human
auuuauauuuauugac

SEQ ID NO: 3778103 - RNA, 18 nt, Human
auuuauauuuuuauuuua

SEQ ID NO: 3778104 - RNA, 20 nt, Human
auuuaucaaagcauagaugu

SEQ ID NO: 3778105 - RNA, 13 nt, Human
auuuaucaaauca

SEQ ID NO: 3778106 - RNA, 14 nt, Human
auuuaucaaaucag

SEQ ID NO: 3778107 - RNA, 14 nt, Human
auuuaucacacaaa

SEQ ID NO: 3778108 - RNA, 16 nt, Human
auuuaucacacuucug

SEQ ID NO: 3778109 - RNA, 14 nt, Human
auuuaucagugaca

SEQ ID NO: 3778110 - RNA, 20 nt, Human
auuuauccacaggaaagugu

SEQ ID NO: 3778111 - RNA, 20 nt, Human
auuuauccugaaauuucaga

SEQ ID NO: 3778112 - RNA, 21 nt, Human
auuuauccugaaauuucagau

SEQ ID NO: 3778113 - RNA, 15 nt, Human
auuuaucuaaauuaa

SEQ ID NO: 3778114 - RNA, 11 nt, Human
auuuaucuaua

SEQ ID NO: 3778115 - RNA, 15 nt, Human
auuuaucuauaauuu

SEQ ID NO: 3778116 - RNA, 20 nt, Human
auuuaucuauuguaagauaa

SEQ ID NO: 3778117 - RNA, 19 nt, Human
auuuaucugagucaacucc

SEQ ID NO: 3778118 - RNA, 16 nt, Human
auuuaucuugaaggaa

SEQ ID NO: 3778119 - RNA, 20 nt, Human
auuuaucuugaaggaaaaau

SEQ ID NO: 3778120 - RNA, 16 nt, Human
auuuaucuuucaaaga

SEQ ID NO: 3778121 - RNA, 13 nt, Human
auuuaucuuugau

SEQ ID NO: 3778122 - RNA, 22 nt, Human
auuuaugaaguuuaaaacagua

SEQ ID NO: 3778123 - RNA, 18 nt, Human
auuuaugaguuuuugaua

SEQ ID NO: 3778124 - RNA, 17 nt, Human
auuuaugauuuaauaaa

SEQ ID NO: 3778125 - RNA, 13 nt, Human
auuuaugcacauu

SEQ ID NO: 3778126 - RNA, 22 nt, Human
auuuaugcauauuauuuuaugu

SEQ ID NO: 3778127 - RNA, 12 nt, Human
auuuauguagau

SEQ ID NO: 3778128 - RNA, 14 nt, Human
auuuauguauggug

SEQ ID NO: 3778129 - RNA, 12 nt, Human
auuuauguauug

SEQ ID NO: 3778130 - RNA, 15 nt, Human
auuuauguccaggug

SEQ ID NO: 3778131 - RNA, 18 nt, Human
auuuaugugugaggagcu

SEQ ID NO: 3778132 - RNA, 23 nt, Human
auuuauuaaacagauuuuuacaa

SEQ ID NO: 3778133 - RNA, 16 nt, Human
auuuauuaaagaaaaa

SEQ ID NO: 3778134 - RNA, 23 nt, Human
auuuauuaaagaaaaaaauguau

SEQ ID NO: 3778135 - RNA, 17 nt, Human
auuuauuaaauaaaauc

SEQ ID NO: 3778136 - RNA, 16 nt, Human
auuuauuaacuuaaua

SEQ ID NO: 3778137 - RNA, 22 nt, Human
auuuauuaagauggauucucag

SEQ ID NO: 3778138 - RNA, 20 nt, Human
auuuauuaauauauauuauc

SEQ ID NO: 3778139 - RNA, 15 nt, Human
auuuauuaauugcuu

SEQ ID NO: 3778140 - RNA, 18 nt, Human
auuuauuaauugcuuuga

SEQ ID NO: 3778141 - RNA, 12 nt, Human
auuuauuacaac

SEQ ID NO: 3778142 - RNA, 12 nt, Human
auuuauuacaua

SEQ ID NO: 3778143 - RNA, 22 nt, Human
auuuauuagcccugcauuuuca

SEQ ID NO: 3778144 - RNA, 17 nt, Human
auuuauuauugaaauug

SEQ ID NO: 3778145 - RNA, 13 nt, Human
auuuauuauuuau

SEQ ID NO: 3778146 - RNA, 14 nt, Human
auuuauuauuuuca

SEQ ID NO: 3778147 - RNA, 11 nt, Human
auuuauucaau

SEQ ID NO: 3778148 - RNA, 17 nt, Human
auuuauucaauaaagua

SEQ ID NO: 3778149 - RNA, 19 nt, Human
auuuauucugggaauguau

SEQ ID NO: 3778150 - RNA, 11 nt, Human
auuuauucuuu

SEQ ID NO: 3778151 - RNA, 13 nt, Human
auuuauugaaaug

SEQ ID NO: 3778152 - RNA, 22 nt, Human
auuuauugaaaugauuucacag

SEQ ID NO: 3778153 - RNA, 18 nt, Human
auuuauugaagaaacaga

SEQ ID NO: 3778154 - RNA, 14 nt, Human
auuuauugacucuu

SEQ ID NO: 3778155 - RNA, 20 nt, Human
auuuauugacucuugaguug

SEQ ID NO: 3778156 - RNA, 15 nt, Human
auuuauugaggaaaa

SEQ ID NO: 3778157 - RNA, 18 nt, Human
auuuauugaggaaaaaua

SEQ ID NO: 3778158 - RNA, 22 nt, Human
auuuauugcagaggauguucau

SEQ ID NO: 3778159 - RNA, 19 nt, Human
auuuauugcuugauacuuu

SEQ ID NO: 3778160 - RNA, 16 nt, Human
auuuauuguuuaugua

SEQ ID NO: 3778161 - RNA, 16 nt, Human
auuuauuuaaaagauu

SEQ ID NO: 3778162 - RNA, 14 nt, Human
auuuauuuaaaugu

SEQ ID NO: 3778163 - RNA, 12 nt, Human
auuuauuuaaua

SEQ ID NO: 3778164 - RNA, 17 nt, Human
auuuauuuaaugugagu

SEQ ID NO: 3778165 - RNA, 21 nt, Human
auuuauuuaaugugaguuugg

SEQ ID NO: 3778166 - RNA, 15 nt, Human
auuuauuuaauguua

SEQ ID NO: 3778167 - RNA, 13 nt, Human
auuuauuuacaaa

SEQ ID NO: 3778168 - RNA, 24 nt, Human
auuuauuuacugagcuucucugug

SEQ ID NO: 3778169 - RNA, 15 nt, Human
auuuauuuauguacu

SEQ ID NO: 3778170 - RNA, 16 nt, Human
auuuauuuauuaagau

SEQ ID NO: 3778171 - RNA, 14 nt, Human
auuuauuucaaaaa

SEQ ID NO: 3778172 - RNA, 19 nt, Human
auuuauuuccaauguuuca

SEQ ID NO: 3778173 - RNA, 23 nt, Human
auuuauuuccuaguucuguagaa

SEQ ID NO: 3778174 - RNA, 23 nt, Human
auuuccuugaauguggcuugaga

SEQ ID NO: 3778175 - RNA, 14 nt, Human
auuuccuuuaugug

SEQ ID NO: 3778176 - RNA, 15 nt, Human
auuuccuuuauguga

SEQ ID NO: 3778177 - RNA, 18 nt, Human
auuuccuuuaugugaauu

SEQ ID NO: 3778178 - RNA, 18 nt, Human
auuuccuuuggagcuuuu

SEQ ID NO: 3778179 - RNA, 15 nt, Human
auuuccuuuuugaca

SEQ ID NO: 3778180 - RNA, 17 nt, Human
auuuccuuuuugacacu

SEQ ID NO: 3778181 - RNA, 20 nt, Human
auuuccuuuuugacacugaa

SEQ ID NO: 3778182 - RNA, 15 nt, Human
auuucgcuucuuaga

SEQ ID NO: 3778183 - RNA, 21 nt, Human
auuucgucuguuuauaaacau

SEQ ID NO: 3778184 - RNA, 14 nt, Human
auuucgugagcccc

SEQ ID NO: 3778185 - RNA, 20 nt, Human
auuucgugggucuguuuucc

SEQ ID NO: 3778186 - RNA, 20 nt, Human
auuucuaaaaaacagaggcc

SEQ ID NO: 3778187 - RNA, 12 nt, Human
auuucuaaaaga

SEQ ID NO: 3778188 - RNA, 14 nt, Human
auuucuaaaaucuu

SEQ ID NO: 3778189 - RNA, 13 nt, Human
auuucuaaaucuc

SEQ ID NO: 3778190 - RNA, 23 nt, Human
auuucuaacucugauguaaauga

SEQ ID NO: 3778191 - RNA, 19 nt, Human
auuucuaauuauguagcuc

SEQ ID NO: 3778192 - RNA, 15 nt, Human
auuucuacugucaaa

SEQ ID NO: 3778193 - RNA, 21 nt, Human
auuucuacugucaaaugaugu

SEQ ID NO: 3778194 - RNA, 15 nt, Human
auuucuacugugacu

SEQ ID NO: 3778195 - RNA, 18 nt, Human
auuucuacugugacugau

SEQ ID NO: 3778196 - RNA, 14 nt, Human
auuucuagaaacaa

SEQ ID NO: 3778197 - RNA, 16 nt, Human
auuucuagccugcacu

SEQ ID NO: 3778198 - RNA, 16 nt, Human
auuucuagcuuaucua

SEQ ID NO: 3778199 - RNA, 15 nt, Human
auuucuaggaagaau

SEQ ID NO: 3778200 - RNA, 16 nt, Human
auuucuaggaagaauu

SEQ ID NO: 3778201 - RNA, 17 nt, Human
auuucuaggaagaauuu

SEQ ID NO: 3778202 - RNA, 20 nt, Human
auuucuagguaggaaaugug

SEQ ID NO: 3778203 - RNA, 21 nt, Human
auuucuaguccaaaauuacaa

SEQ ID NO: 3778204 - RNA, 17 nt, Human
auuucuaguuauuuauu

SEQ ID NO: 3778205 - RNA, 17 nt, Human
auuucuauagccaaaaa

SEQ ID NO: 3778206 - RNA, 13 nt, Human
auuucuaucccaa

SEQ ID NO: 3778207 - RNA, 14 nt, Human
auuucuaugaaaua

SEQ ID NO: 3778208 - RNA, 14 nt, Human
auuucuaugagaaa

SEQ ID NO: 3778209 - RNA, 19 nt, Human
auuucuaugcugaguuugu

SEQ ID NO: 3778210 - RNA, 21 nt, Human
auuucuaugcugaguuugugc

SEQ ID NO: 3778211 - RNA, 13 nt, Human
auuucuauuuauu

SEQ ID NO: 3778212 - RNA, 15 nt, Human
auuucuauuucuccu

SEQ ID NO: 3778213 - RNA, 18 nt, Human
auuucuauuuuuguagaa

SEQ ID NO: 3778214 - RNA, 19 nt, Human
auuucucaacaaagcacag

SEQ ID NO: 3778215 - RNA, 23 nt, Human
auuucucacacucuaacuguaua

SEQ ID NO: 3778216 - RNA, 14 nt, Human
auuucucauguuuu

SEQ ID NO: 3778217 - RNA, 17 nt, Human
auuucuccagaacccau

SEQ ID NO: 3778218 - RNA, 15 nt, Human
auuucuccauacgca

SEQ ID NO: 3778219 - RNA, 19 nt, Human
auuucuccucccuuccuuu

SEQ ID NO: 3778220 - RNA, 10 nt, Human
auuucuccuu

SEQ ID NO: 3778221 - RNA, 15 nt, Human
auuucuccuuugaua

SEQ ID NO: 3778222 - RNA, 20 nt, Human
auuucuccuuugauaaaaua

SEQ ID NO: 3778223 - RNA, 15 nt, Human
auuucucuuaaguac

SEQ ID NO: 3778224 - RNA, 20 nt, Human
auuucugaagguagcauucu

SEQ ID NO: 3778225 - RNA, 11 nt, Human
auuucugagaa

SEQ ID NO: 3778226 - RNA, 23 nt, Human
auuucugagaagguccuuaauga

SEQ ID NO: 3778227 - RNA, 15 nt, Human
auuucugauauagaa

SEQ ID NO: 3778228 - RNA, 11 nt, Human
auuucugauuu

SEQ ID NO: 3778229 - RNA, 19 nt, Human
auuucugauuuuauguaaa

SEQ ID NO: 3778230 - RNA, 13 nt, Human
auuucugcaaaca

SEQ ID NO: 3778231 - RNA, 13 nt, Human
auuucugcauaug

SEQ ID NO: 3778232 - RNA, 22 nt, Human
auuucugcauauguugaauacu

SEQ ID NO: 3778233 - RNA, 23 nt, Human
auuucugcauauguugaauacuu

SEQ ID NO: 3778234 - RNA, 14 nt, Human
auuucugcugaauu

SEQ ID NO: 3778235 - RNA, 20 nt, Human
auuucugcugaauuuucaca

SEQ ID NO: 3778236 - RNA, 18 nt, Human
auuucugggucuuuugcu

SEQ ID NO: 3778237 - RNA, 23 nt, Human
auuucuguaaauaccauugacac

SEQ ID NO: 3778238 - RNA, 13 nt, Human
auuucuguauaua

SEQ ID NO: 3778239 - RNA, 20 nt, Human
auuucugucacaguaaaaau

SEQ ID NO: 3778240 - RNA, 23 nt, Human
auuucugucacaguaaaaauaaa

SEQ ID NO: 3778241 - RNA, 16 nt, Human
auuucugugcccuccu

SEQ ID NO: 3778242 - RNA, 11 nt, Human
auuucuguguu

SEQ ID NO: 3778243 - RNA, 16 nt, Human
auuucuguuuagauaa

SEQ ID NO: 3778244 - RNA, 22 nt, Human
auuucuuauacgcuuuucuuug

SEQ ID NO: 3778245 - RNA, 14 nt, Human
auuucuuauauaug

SEQ ID NO: 3778246 - RNA, 14 nt, Human
auuucuuaugugac

SEQ ID NO: 3778247 - RNA, 19 nt, Human
auuucuuaugugacauuaa

SEQ ID NO: 3778248 - RNA, 21 nt, Human
auuucuuaugugacauuaaca

SEQ ID NO: 3778249 - RNA, 15 nt, Human
auuucuucaaaaugu

SEQ ID NO: 3778250 - RNA, 19 nt, Human
auuucuucaaaauguauau

SEQ ID NO: 3778251 - RNA, 13 nt, Human
auuucuucaccag

SEQ ID NO: 3778252 - RNA, 18 nt, Human
auuucuucagucagaaaa

SEQ ID NO: 3778253 - RNA, 16 nt, Human
auuucuuccacaagag

SEQ ID NO: 3778254 - RNA, 20 nt, Human
auuucuuccacaagagccca

SEQ ID NO: 3778255 - RNA, 20 nt, Human
auuucuuccuaccaagucaa

SEQ ID NO: 3778256 - RNA, 17 nt, Human
auuucuucguucuuuuu

SEQ ID NO: 3778257 - RNA, 19 nt, Human
auuucuucguucuuuuuaa

SEQ ID NO: 3778258 - RNA, 18 nt, Human
auuucuugggcccuccug

SEQ ID NO: 3778259 - RNA, 20 nt, Human
auuucuugggcccuccugaa

SEQ ID NO: 3778260 - RNA, 19 nt, Human
auuucuugguaagaagccg

SEQ ID NO: 3778261 - RNA, 13 nt, Human
auuucuuguuugu

SEQ ID NO: 3778262 - RNA, 18 nt, Human
auuucuuuaaaagaauga

SEQ ID NO: 3778263 - RNA, 20 nt, Human
auuucuuuaaaagaaugacu

SEQ ID NO: 3778264 - RNA, 21 nt, Human
auuucuuuaaaagaaugacua

SEQ ID NO: 3778265 - RNA, 22 nt, Human
auuucuuuauaaaauuuacugu

SEQ ID NO: 3778266 - RNA, 22 nt, Human
auuucuuuauauuuauccacua

SEQ ID NO: 3778267 - RNA, 13 nt, Human
auuucuuuccaga

SEQ ID NO: 3778268 - RNA, 22 nt, Human
auuucuuugaaaaaaaauaaau

SEQ ID NO: 3778269 - RNA, 21 nt, Human
auuucuuugccuguucaguua

SEQ ID NO: 3778270 - RNA, 17 nt, Human
auuucuuugcuguaaga

SEQ ID NO: 3778271 - RNA, 22 nt, Human
auuucuuugcuguaagaugucu

SEQ ID NO: 3778272 - RNA, 21 nt, Human
auuucuuuguuaucaaacuuc

SEQ ID NO: 3778273 - RNA, 22 nt, Human
auuucuuuguuaucaaacuuca

SEQ ID NO: 3778274 - RNA, 18 nt, Human
auuucuuuucuuccuggc

SEQ ID NO: 3778275 - RNA, 19 nt, Human
auuucuuuucuuuuuacau

SEQ ID NO: 3778276 - RNA, 23 nt, Human
auuucuuuugccguuauuaaaaa

SEQ ID NO: 3778277 - RNA, 21 nt, Human
auuucuuuuguaauaaacuau

SEQ ID NO: 3778278 - RNA, 18 nt, Human
auuucuuuuuuaaaugaa

SEQ ID NO: 3778279 - RNA, 22 nt, Human
auuucuuuuuuaaaugaagaaa

SEQ ID NO: 3778280 - RNA, 14 nt, Human
auuugaaaaaaacu

SEQ ID NO: 3778281 - RNA, 20 nt, Human
auuugaaaaauauaaaauua

SEQ ID NO: 3778282 - RNA, 17 nt, Human
auuugaaaacagaaauu

SEQ ID NO: 3778283 - RNA, 18 nt, Human
auuugaaaaugauaaaag

SEQ ID NO: 3778284 - RNA, 11 nt, Human
auuugaaagaa

SEQ ID NO: 3778285 - RNA, 14 nt, Human
auuugaaagaaagg

SEQ ID NO: 3778286 - RNA, 16 nt, Human
auuugaaagugccuuu

SEQ ID NO: 3778287 - RNA, 15 nt, Human
auuugaaauaagaau

SEQ ID NO: 3778288 - RNA, 11 nt, Human
auuugaaauuu

SEQ ID NO: 3778289 - RNA, 20 nt, Human
auuugaacaaugaaguugaa

SEQ ID NO: 3778290 - RNA, 13 nt, Human
auuugaacacugg

SEQ ID NO: 3778291 - RNA, 18 nt, Human
auuugaacacuuggugcu

SEQ ID NO: 3778292 - RNA, 19 nt, Human
auuugaagaaugaacaaau

SEQ ID NO: 3778293 - RNA, 20 nt, Human
auuugaagacaaaaauacuc

SEQ ID NO: 3778294 - RNA, 18 nt, Human
auuugaagguagaauguu

SEQ ID NO: 3778295 - RNA, 14 nt, Human
auuugaaggucugc

SEQ ID NO: 3778296 - RNA, 17 nt, Human
auuugaaguguaccugu

SEQ ID NO: 3778297 - RNA, 22 nt, Human
auuugaaguguaccuguguaca

SEQ ID NO: 3778298 - RNA, 23 nt, Human
auuugaaucagccuacaggccuc

SEQ ID NO: 3778299 - RNA, 14 nt, Human
auuugaaugaaaaa

SEQ ID NO: 3778300 - RNA, 16 nt, Human
auuugaaugaaaaauu

SEQ ID NO: 3778301 - RNA, 19 nt, Human
auuugaaugaaaaauuuaa

SEQ ID NO: 3778302 - RNA, 17 nt, Human
auuugaauggguccauu

SEQ ID NO: 3778303 - RNA, 22 nt, Human
auuugaauguaugcuucauaca

SEQ ID NO: 3778304 - RNA, 23 nt, Human
auuugaauguaugcuucauacag

SEQ ID NO: 3778305 - RNA, 18 nt, Human
auuugaauguuaagcaga

SEQ ID NO: 3778306 - RNA, 19 nt, Human
auuugaauguuaagcagau

SEQ ID NO: 3778307 - RNA, 19 nt, Human
auuugaauuaaaacuucuu

SEQ ID NO: 3778308 - RNA, 21 nt, Human
auuugaauuaaaacuucuuaa

SEQ ID NO: 3778309 - RNA, 23 nt, Human
auuugacaaaauuuguugaaauu

SEQ ID NO: 3778310 - RNA, 17 nt, Human
auuugacuauucuguau

SEQ ID NO: 3778311 - RNA, 13 nt, Human
auuugacuguuuu

SEQ ID NO: 3778312 - RNA, 17 nt, Human
auuugacuguuuuuacc

SEQ ID NO: 3778313 - RNA, 19 nt, Human
auuugacuugcaugaagag

SEQ ID NO: 3778314 - RNA, 18 nt, Human
auuugacuuuaauuuaug

SEQ ID NO: 3778315 - RNA, 17 nt, Human
auuugagaaaugcauau

SEQ ID NO: 3778316 - RNA, 23 nt, Human
auuugagaauagacccuuacuag

SEQ ID NO: 3778317 - RNA, 17 nt, Human
auuugagagaaauauga

SEQ ID NO: 3778318 - RNA, 17 nt, Human
caacagcaaaucacgac

SEQ ID NO: 3778319 - RNA, 17 nt, Human
caacagccacucagaaa

SEQ ID NO: 3778320 - RNA, 15 nt, Human
caacagccucacuug

SEQ ID NO: 3778321 - RNA, 12 nt, Human
caacagcgccca

SEQ ID NO: 3778322 - RNA, 15 nt, Human
caacagcgcccaaag

SEQ ID NO: 3778323 - RNA, 23 nt, Human
caacagcguuccuagagaagaca

SEQ ID NO: 3778324 - RNA, 15 nt, Human
caacagcuacaacag

SEQ ID NO: 3778325 - RNA, 22 nt, Human
caacagcucaagucuucccuga

SEQ ID NO: 3778326 - RNA, 19 nt, Human
caacagcuggacccugacc

SEQ ID NO: 3778327 - RNA, 15 nt, Human
caacaggagaauuuu

SEQ ID NO: 3778328 - RNA, 15 nt, Human
caacaggaggacaau

SEQ ID NO: 3778329 - RNA, 16 nt, Human
caacaggaggacaauu

SEQ ID NO: 3778330 - RNA, 20 nt, Human
caacaggccucagggcuccu

SEQ ID NO: 3778331 - RNA, 13 nt, Human
caacaggcugggc

SEQ ID NO: 3778332 - RNA, 22 nt, Human
caacaggcuguucugcacugaa

SEQ ID NO: 3778333 - RNA, 18 nt, Human
caacaggguuuuuuucca

SEQ ID NO: 3778334 - RNA, 17 nt, Human
caacagguaaaacaggg

SEQ ID NO: 3778335 - RNA, 22 nt, Human
caacagguggcaggaccaggac

SEQ ID NO: 3778336 - RNA, 23 nt, Human
caacagguggcaggaccaggacu

SEQ ID NO: 3778337 - RNA, 20 nt, Human
caacaguagcauaggacccu

SEQ ID NO: 3778338 - RNA, 18 nt, Human
caacagucaaaacagaga

SEQ ID NO: 3778339 - RNA, 12 nt, Human
caacagugaguc

SEQ ID NO: 3778340 - RNA, 14 nt, Human
caacagugcuaaaa

SEQ ID NO: 3778341 - RNA, 18 nt, Human
caacagugcuaaaaaugg

SEQ ID NO: 3778342 - RNA, 17 nt, Human
caacaguggggaagagu

SEQ ID NO: 3778343 - RNA, 12 nt, Human
caacagugugaa

SEQ ID NO: 3778344 - RNA, 13 nt, Human
caacagugugaag

SEQ ID NO: 3778345 - RNA, 17 nt, Human
caacagugugaaguuag

SEQ ID NO: 3778346 - RNA, 18 nt, Human
caacagugugaaguuaga

SEQ ID NO: 3778347 - RNA, 23 nt, Human
caacagugugaaguuagaauucc

SEQ ID NO: 3778348 - RNA, 16 nt, Human
caacaguuacauaauu

SEQ ID NO: 3778349 - RNA, 15 nt, Human
caacaguuccuucag

SEQ ID NO: 3778350 - RNA, 12 nt, Human
caacaguuuaau

SEQ ID NO: 3778351 - RNA, 20 nt, Human
caacaguuuaaugaagaucu

SEQ ID NO: 3778352 - RNA, 22 nt, Human
caacaguuuuccuaugcuuuga

SEQ ID NO: 3778353 - RNA, 15 nt, Human
caacauacucccauc

SEQ ID NO: 3778354 - RNA, 17 nt, Human
caacauacucccaucug

SEQ ID NO: 3778355 - RNA, 14 nt, Human
caacauauaaaaua

SEQ ID NO: 3778356 - RNA, 12 nt, Human
caacauauacaa

SEQ ID NO: 3778357 - RNA, 22 nt, Human
caacaucaauguucauuguaau

SEQ ID NO: 3778358 - RNA, 14 nt, Human
caacaucacagccc

SEQ ID NO: 3778359 - RNA, 13 nt, Human
caacaucagcuug

SEQ ID NO: 3778360 - RNA, 13 nt, Human
caacauccacucu

SEQ ID NO: 3778361 - RNA, 15 nt, Human
caacaugagucaaga

SEQ ID NO: 3778362 - RNA, 22 nt, Human
caacaugaugagguaguaccuu

SEQ ID NO: 3778363 - RNA, 23 nt, Human
caacauggagaaacccugucucu

SEQ ID NO: 3778364 - RNA, 12 nt, Human
caacauggcuuu

SEQ ID NO: 3778365 - RNA, 21 nt, Human
caacauggugaaaccccaucu

SEQ ID NO: 3778366 - RNA, 13 nt, Human
caacauguauaau

SEQ ID NO: 3778367 - RNA, 19 nt, Human
caacauguauaauauuuuu

SEQ ID NO: 3778368 - RNA, 22 nt, Human
caacauguugggaaacuuggcu

SEQ ID NO: 3778369 - RNA, 23 nt, Human
caacauguugggaaacuuggcuc

SEQ ID NO: 3778370 - RNA, 20 nt, Human
caacauuaaaacaauauugu

SEQ ID NO: 3778371 - RNA, 21 nt, Human
caacauuacagggaaugccug

SEQ ID NO: 3778372 - RNA, 17 nt, Human
caacauugcuugugcca

SEQ ID NO: 3778373 - RNA, 18 nt, Human
caacauuuacaacucauu

SEQ ID NO: 3778374 - RNA, 22 nt, Human
caacauuuuagcucuauugaua

SEQ ID NO: 3778375 - RNA, 19 nt, Human
caacauuuugagaacaaag

SEQ ID NO: 3778376 - RNA, 13 nt, Human
caaccaagucaca

SEQ ID NO: 3778377 - RNA, 18 nt, Human
caaccaagucaugugcau

SEQ ID NO: 3778378 - RNA, 14 nt, Human
caaccaauggaaug

SEQ ID NO: 3778379 - RNA, 14 nt, Human
caaccacacccaca

SEQ ID NO: 3778380 - RNA, 20 nt, Human
caaccacacuugucggcucc

SEQ ID NO: 3778381 - RNA, 21 nt, Human
caaccacacuugucggcucca

SEQ ID NO: 3778382 - RNA, 17 nt, Human
caaccaccgcuccccag

SEQ ID NO: 3778383 - RNA, 22 nt, Human
caaccaccgcuccccagcccag

SEQ ID NO: 3778384 - RNA, 18 nt, Human
caaccacugcgaccacaa

SEQ ID NO: 3778385 - RNA, 14 nt, Human
caaccacuggucug

SEQ ID NO: 3778386 - RNA, 22 nt, Human
caaccacuggucuguagggauu

SEQ ID NO: 3778387 - RNA, 12 nt, Human
caaccagacaga

SEQ ID NO: 3778388 - RNA, 15 nt, Human
caaccagacagaggg

SEQ ID NO: 3778389 - RNA, 15 nt, Human
caaccagagcacugu

SEQ ID NO: 3778390 - RNA, 16 nt, Human
caaccagagcacugua

SEQ ID NO: 3778391 - RNA, 17 nt, Human
caaccagcuaagaaaag

SEQ ID NO: 3778392 - RNA, 22 nt, Human
caaccagcuaagaaaagauuuu

SEQ ID NO: 3778393 - RNA, 22 nt, Human
caaccagggauuguuucuguuu

SEQ ID NO: 3778394 - RNA, 12 nt, Human
caaccagugcca

SEQ ID NO: 3778395 - RNA, 15 nt, Human
caaccagugccaagg

SEQ ID NO: 3778396 - RNA, 18 nt, Human
caaccaucaaaguggcaa

SEQ ID NO: 3778397 - RNA, 13 nt, Human
caaccaucgcuuu

SEQ ID NO: 3778398 - RNA, 23 nt, Human
caaccaugaguggcauggccacc

SEQ ID NO: 3778399 - RNA, 18 nt, Human
caaccauggacuuuauaa

SEQ ID NO: 3778400 - RNA, 14 nt, Human
caaccaugucauuu

SEQ ID NO: 3778401 - RNA, 16 nt, Human
caaccaugucauuuca

SEQ ID NO: 3778402 - RNA, 17 nt, Human
caaccauuaaagucaga

SEQ ID NO: 3778403 - RNA, 16 nt, Human
caaccauuuccucaga

SEQ ID NO: 3778404 - RNA, 14 nt, Human
caaccauuugaaac

SEQ ID NO: 3778405 - RNA, 19 nt, Human
caacccaaggacugaggga

SEQ ID NO: 3778406 - RNA, 22 nt, Human
caacccaaggacugagggacuc

SEQ ID NO: 3778407 - RNA, 17 nt, Human
caacccaccugcgucuc

SEQ ID NO: 3778408 - RNA, 20 nt, Human
caacccaucuaccccuggau

SEQ ID NO: 3778409 - RNA, 22 nt, Human
caacccaugaugagcuccucuu

SEQ ID NO: 3778410 - RNA, 15 nt, Human
caaccccaacuccag

SEQ ID NO: 3778411 - RNA, 23 nt, Human
caaccccacacgcuccucccucu

SEQ ID NO: 3778412 - RNA, 12 nt, Human
caaccccagccg

SEQ ID NO: 3778413 - RNA, 23 nt, Human
caaccccagccgcucggaggccc

SEQ ID NO: 3778414 - RNA, 19 nt, Human
caaccccaguucugcuccu

SEQ ID NO: 3778415 - RNA, 22 nt, Human
caaccccaguucugcuccucuc

SEQ ID NO: 3778416 - RNA, 11 nt, Human
caacccccacc

SEQ ID NO: 3778417 - RNA, 18 nt, Human
caacccccaccccacacu

SEQ ID NO: 3778418 - RNA, 20 nt, Human
caacccccagcacccgggcu

SEQ ID NO: 3778419 - RNA, 14 nt, Human
caacccccagccug

SEQ ID NO: 3778420 - RNA, 15 nt, Human
caacccccagccugc

SEQ ID NO: 3778421 - RNA, 16 nt, Human
caacccccagccugcu

SEQ ID NO: 3778422 - RNA, 15 nt, Human
caacccccagcuccc

SEQ ID NO: 3778423 - RNA, 18 nt, Human
caacccccagcucccgcu

SEQ ID NO: 3778424 - RNA, 16 nt, Human
caacccccauuucuau

SEQ ID NO: 3778425 - RNA, 16 nt, Human
caaccccccaccugcc

SEQ ID NO: 3778426 - RNA, 14 nt, Human
caaccccccagcac

SEQ ID NO: 3778427 - RNA, 22 nt, Human
caaccccccaucacaaacuuaa

SEQ ID NO: 3778428 - RNA, 23 nt, Human
caaccccucgcccagucccagca

SEQ ID NO: 3778429 - RNA, 12 nt, Human
caaccccugagg

SEQ ID NO: 3778430 - RNA, 13 nt, Human
caaccccugagga

SEQ ID NO: 3778431 - RNA, 17 nt, Human
caaccccuggaccccag

SEQ ID NO: 3778432 - RNA, 22 nt, Human
caaccccuggaccccagccuca

SEQ ID NO: 3778433 - RNA, 21 nt, Human
caaccccuguggagcccgcac

SEQ ID NO: 3778434 - RNA, 19 nt, Human
caaccccuuaagcccuggc

SEQ ID NO: 3778435 - RNA, 18 nt, Human
caaccccuucgcuccugu

SEQ ID NO: 3778436 - RNA, 20 nt, Human
caacccgucuggcccaccag

SEQ ID NO: 3778437 - RNA, 21 nt, Human
caacccguggaggcugcucgg

SEQ ID NO: 3778438 - RNA, 21 nt, Human
caacccuagguucccuguucu

SEQ ID NO: 3778439 - RNA, 18 nt, Human
caacccucagagccaccc

SEQ ID NO: 3778440 - RNA, 12 nt, Human
caacccucaggg

SEQ ID NO: 3778441 - RNA, 15 nt, Human
caacccucaucacca

SEQ ID NO: 3778442 - RNA, 17 nt, Human
caacccucccucagccc

SEQ ID NO: 3778443 - RNA, 11 nt, Human
caacccugcaa

SEQ ID NO: 3778444 - RNA, 12 nt, Human
caacccugcaaa

SEQ ID NO: 3778445 - RNA, 11 nt, Human
caacccugccc

SEQ ID NO: 3778446 - RNA, 16 nt, Human
caacccugccccugcc

SEQ ID NO: 3778447 - RNA, 22 nt, Human
caacccugccccugccccguca

SEQ ID NO: 3778448 - RNA, 15 nt, Human
caacccugccgucac

SEQ ID NO: 3778449 - RNA, 19 nt, Human
caacccuggcauuaugucc

SEQ ID NO: 3778450 - RNA, 16 nt, Human
caacccuguuuccuga

SEQ ID NO: 3778451 - RNA, 12 nt, Human
caacccuucccc

SEQ ID NO: 3778452 - RNA, 17 nt, Human
caacccuucccucaccu

SEQ ID NO: 3778453 - RNA, 10 nt, Human
caacccuucu

SEQ ID NO: 3778454 - RNA, 21 nt, Human
caacccuucuccucuuguaaa

SEQ ID NO: 3778455 - RNA, 22 nt, Human
caaccgagagaaugcugaccug

SEQ ID NO: 3778456 - RNA, 18 nt, Human
caaccgaugcuccagcca

SEQ ID NO: 3778457 - RNA, 21 nt, Human
caaccgaugcuccagccaacc

SEQ ID NO: 3778458 - RNA, 17 nt, Human
caaccgccucaaaaugu

SEQ ID NO: 3778459 - RNA, 13 nt, Human
caaccggcuuugu

SEQ ID NO: 3778460 - RNA, 22 nt, Human
caaccggcuuuguggcacuggg

SEQ ID NO: 3778461 - RNA, 21 nt, Human
caaccgguggauccucaaaca

SEQ ID NO: 3778462 - RNA, 20 nt, Human
caaccguggcccuuccugga

SEQ ID NO: 3778463 - RNA, 19 nt, Human
caagagucgcugugccaca

SEQ ID NO: 3778464 - RNA, 22 nt, Human
caagagucgcugugccacaggc

SEQ ID NO: 3778465 - RNA, 14 nt, Human
caagagucuaaaga

SEQ ID NO: 3778466 - RNA, 20 nt, Human
caagagucuaauagucuuug

SEQ ID NO: 3778467 - RNA, 20 nt, Human
caagagugaauucccucacu

SEQ ID NO: 3778468 - RNA, 14 nt, Human
caagagugauucuu

SEQ ID NO: 3778469 - RNA, 15 nt, Human
caagagugauucuug

SEQ ID NO: 3778470 - RNA, 19 nt, Human
caagagugauucuugcugc

SEQ ID NO: 3778471 - RNA, 18 nt, Human
caagagugauugcagcuu

SEQ ID NO: 3778472 - RNA, 22 nt, Human
caagaguuuauuuccaaauaaa

SEQ ID NO: 3778473 - RNA, 16 nt, Human
caagauaaaggacagu

SEQ ID NO: 3778474 - RNA, 18 nt, Human
caagauaaaggacaguga

SEQ ID NO: 3778475 - RNA, 15 nt, Human
caagauaccuuuuuu

SEQ ID NO: 3778476 - RNA, 21 nt, Human
caagauauuguacauaaaaga

SEQ ID NO: 3778477 - RNA, 18 nt, Human
caagaucauguaccccaa

SEQ ID NO: 3778478 - RNA, 15 nt, Human
caagaucugugcagc

SEQ ID NO: 3778479 - RNA, 18 nt, Human
caagaugaaauuccauuu

SEQ ID NO: 3778480 - RNA, 17 nt, Human
caagaugacuggggugg

SEQ ID NO: 3778481 - RNA, 19 nt, Human
caagaugagagaacuggag

SEQ ID NO: 3778482 - RNA, 23 nt, Human
caagaugagauuggcauggcuuu

SEQ ID NO: 3778483 - RNA, 19 nt, Human
caagauggaauuuaucaaa

SEQ ID NO: 3778484 - RNA, 13 nt, Human
caagauggcacag

SEQ ID NO: 3778485 - RNA, 20 nt, Human
caagauggcacagggcauga

SEQ ID NO: 3778486 - RNA, 18 nt, Human
caagaugggcaucuuuug

SEQ ID NO: 3778487 - RNA, 22 nt, Human
caagauggggagugagaggcug

SEQ ID NO: 3778488 - RNA, 19 nt, Human
caagaugggggcagggcug

SEQ ID NO: 3778489 - RNA, 13 nt, Human
caagaugguucua

SEQ ID NO: 3778490 - RNA, 15 nt, Human
caagaugucagacug

SEQ ID NO: 3778491 - RNA, 17 nt, Human
caagaugucagacuggc

SEQ ID NO: 3778492 - RNA, 19 nt, Human
caagauguugauuuuuacu

SEQ ID NO: 3778493 - RNA, 13 nt, Human
caagauucagcua

SEQ ID NO: 3778494 - RNA, 14 nt, Human
caagauucccagag

SEQ ID NO: 3778495 - RNA, 15 nt, Human
caagauucccagaga

SEQ ID NO: 3778496 - RNA, 18 nt, Human
caagauucccagagacag

SEQ ID NO: 3778497 - RNA, 19 nt, Human
caagauucccagagacagg

SEQ ID NO: 3778498 - RNA, 15 nt, Human
caagauucccaggag

SEQ ID NO: 3778499 - RNA, 21 nt, Human
caagauucccaggaguucugc

SEQ ID NO: 3778500 - RNA, 12 nt, Human
caagauucuaga

SEQ ID NO: 3778501 - RNA, 14 nt, Human
caagauucuagaug

SEQ ID NO: 3778502 - RNA, 22 nt, Human
caagauugguguuuuuuucuau

SEQ ID NO: 3778503 - RNA, 22 nt, Human
caagauuguuccugcuuuuccc

SEQ ID NO: 3778504 - RNA, 16 nt, Human
caagauuuaaaugcca

SEQ ID NO: 3778505 - RNA, 14 nt, Human
caagauuuagaaaa

SEQ ID NO: 3778506 - RNA, 22 nt, Human
caagauuuaugagaaauauuug

SEQ ID NO: 3778507 - RNA, 12 nt, Human
caagauuucaga

SEQ ID NO: 3778508 - RNA, 13 nt, Human
caagauuuccuug

SEQ ID NO: 3778509 - RNA, 15 nt, Human
caagauuuuccuuuu

SEQ ID NO: 3778510 - RNA, 18 nt, Human
caagauuuuuuaauuguu

SEQ ID NO: 3778511 - RNA, 22 nt, Human
caagcaaaaucauggaaugguu

SEQ ID NO: 3778512 - RNA, 14 nt, Human
caagcaaacccaga

SEQ ID NO: 3778513 - RNA, 19 nt, Human
caagcaaaggugaagagac

SEQ ID NO: 3778514 - RNA, 15 nt, Human
caagcaaaugugaau

SEQ ID NO: 3778515 - RNA, 17 nt, Human
caagcaaaugugaauca

SEQ ID NO: 3778516 - RNA, 19 nt, Human
caagcaaaugugaaucauu

SEQ ID NO: 3778517 - RNA, 16 nt, Human
caagcaaccugggucc

SEQ ID NO: 3778518 - RNA, 15 nt, Human
caagcaagcucucuu

SEQ ID NO: 3778519 - RNA, 22 nt, Human
caagcaagcucucuugccgagg

SEQ ID NO: 3778520 - RNA, 15 nt, Human
caagcaaguucugag

SEQ ID NO: 3778521 - RNA, 14 nt, Human
caagcaauccuccu

SEQ ID NO: 3778522 - RNA, 14 nt, Human
caagcacagcagcc

SEQ ID NO: 3778523 - RNA, 15 nt, Human
caagcacaguggugg

SEQ ID NO: 3778524 - RNA, 17 nt, Human
caagcacaucugcauuu

SEQ ID NO: 3778525 - RNA, 14 nt, Human
caagcaccuccugc

SEQ ID NO: 3778526 - RNA, 11 nt, Human
caagcacugau

SEQ ID NO: 3778527 - RNA, 12 nt, Human
caagcacugaua

SEQ ID NO: 3778528 - RNA, 18 nt, Human
caagcacugcuaggcgag

SEQ ID NO: 3778529 - RNA, 23 nt, Human
caagcacugcuaggcgagugcca

SEQ ID NO: 3778530 - RNA, 17 nt, Human
caagcacugugcucagg

SEQ ID NO: 3778531 - RNA, 19 nt, Human
caagcagaggaccagggcc

SEQ ID NO: 3778532 - RNA, 20 nt, Human
caagcagaggaccagggccu

SEQ ID NO: 3778533 - RNA, 18 nt, Human
caagcagagguggccaga

SEQ ID NO: 3778534 - RNA, 20 nt, Human
caagcagagguggccagagc

SEQ ID NO: 3778535 - RNA, 21 nt, Human
caagcagagugcacagcuguc

SEQ ID NO: 3778536 - RNA, 17 nt, Human
caagcagauacugcugu

SEQ ID NO: 3778537 - RNA, 22 nt, Human
caagcagccaagcuccuuggga

SEQ ID NO: 3778538 - RNA, 13 nt, Human
caagcagcuuaga

SEQ ID NO: 3778539 - RNA, 17 nt, Human
caagcaggaaaugaaaa

SEQ ID NO: 3778540 - RNA, 23 nt, Human
caagcaggaaaugaaaaugucuu

SEQ ID NO: 3778541 - RNA, 18 nt, Human
caagcaggacagugcuug

SEQ ID NO: 3778542 - RNA, 18 nt, Human
caagcaggacauggacaa

SEQ ID NO: 3778543 - RNA, 13 nt, Human
caagcaggagacg

SEQ ID NO: 3778544 - RNA, 19 nt, Human
caagcaggcgcugugcuau

SEQ ID NO: 3778545 - RNA, 23 nt, Human
caagcaguggauacgugucaaug

SEQ ID NO: 3778546 - RNA, 14 nt, Human
caagcaguuucaau

SEQ ID NO: 3778547 - RNA, 15 nt, Human
caagcaguuucaaua

SEQ ID NO: 3778548 - RNA, 16 nt, Human
caagcaguuucaauaa

SEQ ID NO: 3778549 - RNA, 21 nt, Human
caagcaguuucaauaaaguuu

SEQ ID NO: 3778550 - RNA, 22 nt, Human
caagcaguuucaauaaaguuug

SEQ ID NO: 3778551 - RNA, 16 nt, Human
caagcauaccaacacg

SEQ ID NO: 3778552 - RNA, 21 nt, Human
caagcauaccaacacgagcag

SEQ ID NO: 3778553 - RNA, 13 nt, Human
caagcaucuccug

SEQ ID NO: 3778554 - RNA, 14 nt, Human
caagcaucuccuga

SEQ ID NO: 3778555 - RNA, 21 nt, Human
caagcaucuuggggggguggc

SEQ ID NO: 3778556 - RNA, 21 nt, Human
caagcaugaagauaaacacag

SEQ ID NO: 3778557 - RNA, 13 nt, Human
caagcauguaacu

SEQ ID NO: 3778558 - RNA, 21 nt, Human
caagcauguauuuuugucaau

SEQ ID NO: 3778559 - RNA, 13 nt, Human
caagcauguggau

SEQ ID NO: 3778560 - RNA, 22 nt, Human
caagcauucagaagaaaaagaa

SEQ ID NO: 3778561 - RNA, 23 nt, Human
caagcauugcuucagaaugaauu

SEQ ID NO: 3778562 - RNA, 17 nt, Human
caagccaagaaagaugu

SEQ ID NO: 3778563 - RNA, 16 nt, Human
caagccaagcagccaa

SEQ ID NO: 3778564 - RNA, 18 nt, Human
caagccaagcagccaagc

SEQ ID NO: 3778565 - RNA, 21 nt, Human
caagccaagcagccaagcucc

SEQ ID NO: 3778566 - RNA, 21 nt, Human
caagccaagggaaccuguguc

SEQ ID NO: 3778567 - RNA, 23 nt, Human
caagccaagggaaccuguguccg

SEQ ID NO: 3778568 - RNA, 14 nt, Human
caagccacagaagc

SEQ ID NO: 3778569 - RNA, 19 nt, Human
caagccacagaagccagga

SEQ ID NO: 3778570 - RNA, 21 nt, Human
caagccaccaacauacuccca

SEQ ID NO: 3778571 - RNA, 21 nt, Human
caagccagauuuuccugaaaa

SEQ ID NO: 3778572 - RNA, 15 nt, Human
caagccagauuuuuu

SEQ ID NO: 3778573 - RNA, 13 nt, Human
caagccagccaac

SEQ ID NO: 3778574 - RNA, 13 nt, Human
caagccaggcuca

SEQ ID NO: 3778575 - RNA, 19 nt, Human
caagccagggauggggcca

SEQ ID NO: 3778576 - RNA, 24 nt, Human
caagccagggauggggccacagcc

SEQ ID NO: 3778577 - RNA, 14 nt, Human
caagccagggugug

SEQ ID NO: 3778578 - RNA, 21 nt, Human
caagccauggguagccugggu

SEQ ID NO: 3778579 - RNA, 19 nt, Human
caagccauguauaaaugug

SEQ ID NO: 3778580 - RNA, 21 nt, Human
caagccauguauaaaugugau

SEQ ID NO: 3778581 - RNA, 19 nt, Human
caagcccagcccauggaga

SEQ ID NO: 3778582 - RNA, 15 nt, Human
caagcccaggccacc

SEQ ID NO: 3778583 - RNA, 21 nt, Human
caagcccaggugccagccuga

SEQ ID NO: 3778584 - RNA, 17 nt, Human
caagccccucuuucugu

SEQ ID NO: 3778585 - RNA, 17 nt, Human
caagccccugcccaucu

SEQ ID NO: 3778586 - RNA, 21 nt, Human
caagcccgacuugcuguuuug

SEQ ID NO: 3778587 - RNA, 18 nt, Human
caagcccuacagagcugu

SEQ ID NO: 3778588 - RNA, 14 nt, Human
caagcccugagagu

SEQ ID NO: 3778589 - RNA, 17 nt, Human
caagccguggcuucccg

SEQ ID NO: 3778590 - RNA, 18 nt, Human
caagccguggcuucccgc

SEQ ID NO: 3778591 - RNA, 18 nt, Human
caagccugagggaaaggc

SEQ ID NO: 3778592 - RNA, 22 nt, Human
caagccugagggaaaggccagc

SEQ ID NO: 3778593 - RNA, 23 nt, Human
caagccugcacaauaaaaauguu

SEQ ID NO: 3778594 - RNA, 14 nt, Human
caagccugccuagg

SEQ ID NO: 3778595 - RNA, 12 nt, Human
caagccugguca

SEQ ID NO: 3778596 - RNA, 16 nt, Human
caagccuggucagccc

SEQ ID NO: 3778597 - RNA, 18 nt, Human
caagccuggucagcccaa

SEQ ID NO: 3778598 - RNA, 14 nt, Human
caagccugucugag

SEQ ID NO: 3778599 - RNA, 16 nt, Human
caagcgauucuccugc

SEQ ID NO: 3778600 - RNA, 18 nt, Human
caagcgauucuccugccu

SEQ ID NO: 3778601 - RNA, 20 nt, Human
caagcgauucuccugccuca

SEQ ID NO: 3778602 - RNA, 17 nt, Human
caagcgauucucuugcc

SEQ ID NO: 3778603 - RNA, 21 nt, Human
caagcgauucucuugccucaa

SEQ ID NO: 3778604 - RNA, 16 nt, Human
caagcgcccuggcccc

SEQ ID NO: 3778605 - RNA, 17 nt, Human
caagcgcccuggccccc

SEQ ID NO: 3778606 - RNA, 18 nt, Human
caagcgcccuggccccca

SEQ ID NO: 3778607 - RNA, 19 nt, Human
caauacacuaguuguuucu

SEQ ID NO: 3778608 - RNA, 15 nt, Human
caauacagauauauu

SEQ ID NO: 3778609 - RNA, 14 nt, Human
caauacagcaaacc

SEQ ID NO: 3778610 - RNA, 19 nt, Human
caauacaguacaggcagca

SEQ ID NO: 3778611 - RNA, 13 nt, Human
caauacagugcuc

SEQ ID NO: 3778612 - RNA, 15 nt, Human
caauacaugcugcua

SEQ ID NO: 3778613 - RNA, 19 nt, Human
caauacccaaauccucucc

SEQ ID NO: 3778614 - RNA, 23 nt, Human
caauacccuuugaauuggacaau

SEQ ID NO: 3778615 - RNA, 17 nt, Human
caauacucauaauguga

SEQ ID NO: 3778616 - RNA, 23 nt, Human
caauagaaacucaccauguaaaa

SEQ ID NO: 3778617 - RNA, 12 nt, Human
caauagagacug

SEQ ID NO: 3778618 - RNA, 14 nt, Human
caauagcaccccua

SEQ ID NO: 3778619 - RNA, 17 nt, Human
caauagcacuuucauug

SEQ ID NO: 3778620 - RNA, 18 nt, Human
caauagcauuagaaauaa

SEQ ID NO: 3778621 - RNA, 18 nt, Human
caauagcuuuacccucag

SEQ ID NO: 3778622 - RNA, 18 nt, Human
caauaggaaaaacugauu

SEQ ID NO: 3778623 - RNA, 22 nt, Human
caauaggaguggugauuugaaa

SEQ ID NO: 3778624 - RNA, 21 nt, Human
caauaggaugggcuucugugc

SEQ ID NO: 3778625 - RNA, 23 nt, Human
caauaggcaaaggggggaaggga

SEQ ID NO: 3778626 - RNA, 15 nt, Human
caauaggcaaauuaa

SEQ ID NO: 3778627 - RNA, 17 nt, Human
caauaggcaaauuaauc

SEQ ID NO: 3778628 - RNA, 22 nt, Human
caauaggugcugaguguacaga

SEQ ID NO: 3778629 - RNA, 16 nt, Human
caauagugggcccucc

SEQ ID NO: 3778630 - RNA, 20 nt, Human
caauaguguccuaugcaaua

SEQ ID NO: 3778631 - RNA, 21 nt, Human
caauaguguccuaugcaauaa

SEQ ID NO: 3778632 - RNA, 14 nt, Human
caauaguguguucu

SEQ ID NO: 3778633 - RNA, 16 nt, Human
caauaguuugcauaga

SEQ ID NO: 3778634 - RNA, 23 nt, Human
caauauaaaaggcaaauguguac

SEQ ID NO: 3778635 - RNA, 18 nt, Human
caauauaaccaauguuua

SEQ ID NO: 3778636 - RNA, 21 nt, Human
caauauaaccaauguuuaaaa

SEQ ID NO: 3778637 - RNA, 16 nt, Human
caauauaagcuuuucu

SEQ ID NO: 3778638 - RNA, 21 nt, Human
caauauaauguuuuuaauauu

SEQ ID NO: 3778639 - RNA, 13 nt, Human
caauauagcaaga

SEQ ID NO: 3778640 - RNA, 16 nt, Human
caauauauaaaaauau

SEQ ID NO: 3778641 - RNA, 18 nt, Human
caauauauaaaaauauau

SEQ ID NO: 3778642 - RNA, 22 nt, Human
caauauaucuaaauugaauaau

SEQ ID NO: 3778643 - RNA, 18 nt, Human
caauauauuaccagcaag

SEQ ID NO: 3778644 - RNA, 20 nt, Human
caauauauugaacuuuugua

SEQ ID NO: 3778645 - RNA, 13 nt, Human
caauauccuaaua

SEQ ID NO: 3778646 - RNA, 14 nt, Human
caauauccuaauaa

SEQ ID NO: 3778647 - RNA, 20 nt, Human
caauauccuaauaaaaaggu

SEQ ID NO: 3778648 - RNA, 12 nt, Human
caauauccuuug

SEQ ID NO: 3778649 - RNA, 15 nt, Human
caauauccuuugccu

SEQ ID NO: 3778650 - RNA, 16 nt, Human
caauaucuaauauaua

SEQ ID NO: 3778651 - RNA, 23 nt, Human
caauaugaaguuacuuucuuaau

SEQ ID NO: 3778652 - RNA, 11 nt, Human
caauaugcuua

SEQ ID NO: 3778653 - RNA, 12 nt, Human
caauaugcuuac

SEQ ID NO: 3778654 - RNA, 15 nt, Human
caauauguaaauagu

SEQ ID NO: 3778655 - RNA, 14 nt, Human
caauauguauugua

SEQ ID NO: 3778656 - RNA, 16 nt, Human
caauauguauuguaaa

SEQ ID NO: 3778657 - RNA, 12 nt, Human
caauaugugcca

SEQ ID NO: 3778658 - RNA, 19 nt, Human
caauaugugccaaucaaua

SEQ ID NO: 3778659 - RNA, 21 nt, Human
caauauuaaauacagacacua

SEQ ID NO: 3778660 - RNA, 23 nt, Human
caauauuaaauacagacacuaag

SEQ ID NO: 3778661 - RNA, 23 nt, Human
caauauuaaugccuuuaaaguau

SEQ ID NO: 3778662 - RNA, 13 nt, Human
caauauuauaauu

SEQ ID NO: 3778663 - RNA, 19 nt, Human
caauauuccagaucuuuca

SEQ ID NO: 3778664 - RNA, 13 nt, Human
caauauuccuuag

SEQ ID NO: 3778665 - RNA, 17 nt, Human
caauauucgcuguguca

SEQ ID NO: 3778666 - RNA, 12 nt, Human
caauauucucug

SEQ ID NO: 3778667 - RNA, 21 nt, Human
caauauugauugggaaaacau

SEQ ID NO: 3778668 - RNA, 18 nt, Human
caauauuguacaguuuuu

SEQ ID NO: 3778669 - RNA, 16 nt, Human
caauauugucucccuu

SEQ ID NO: 3778670 - RNA, 14 nt, Human
caauauuuauggau

SEQ ID NO: 3778671 - RNA, 22 nt, Human
caauauuuauuguauuuuagua

SEQ ID NO: 3778672 - RNA, 19 nt, Human
caauauuuccucaugugau

SEQ ID NO: 3778673 - RNA, 22 nt, Human
caauauuucugcuuucuuugau

SEQ ID NO: 3778674 - RNA, 22 nt, Human
caauauuugugugcuaaacgug

SEQ ID NO: 3778675 - RNA, 23 nt, Human
caauauuugugugcuaaacgugu

SEQ ID NO: 3778676 - RNA, 13 nt, Human
caauauuuuaagc

SEQ ID NO: 3778677 - RNA, 17 nt, Human
caauauuuuaagcauua

SEQ ID NO: 3778678 - RNA, 15 nt, Human
caauauuuuaugguu

SEQ ID NO: 3778679 - RNA, 23 nt, Human
caauauuuuaugguuauguuuuu

SEQ ID NO: 3778680 - RNA, 11 nt, Human
caauauuuucc

SEQ ID NO: 3778681 - RNA, 13 nt, Human
caauauuuuccau

SEQ ID NO: 3778682 - RNA, 16 nt, Human
caauauuuuccaugaa

SEQ ID NO: 3778683 - RNA, 19 nt, Human
caauauuuucuuuaaugcu

SEQ ID NO: 3778684 - RNA, 21 nt, Human
caauauuuuggaguauguuaa

SEQ ID NO: 3778685 - RNA, 12 nt, Human
caauauuuuucu

SEQ ID NO: 3778686 - RNA, 22 nt, Human
caaucaaauaaguauuuauaau

SEQ ID NO: 3778687 - RNA, 14 nt, Human
caaucaacacuacc

SEQ ID NO: 3778688 - RNA, 15 nt, Human
caaucaacucuaaua

SEQ ID NO: 3778689 - RNA, 16 nt, Human
caaucaagauaaagga

SEQ ID NO: 3778690 - RNA, 15 nt, Human
caaucaagucuguuu

SEQ ID NO: 3778691 - RNA, 15 nt, Human
caaucagaaugaaca

SEQ ID NO: 3778692 - RNA, 19 nt, Human
caaucagagaccaggcccu

SEQ ID NO: 3778693 - RNA, 16 nt, Human
caaucagauuuuccug

SEQ ID NO: 3778694 - RNA, 12 nt, Human
caaucagcacug

SEQ ID NO: 3778695 - RNA, 16 nt, Human
caaucagcacugaaaa

SEQ ID NO: 3778696 - RNA, 17 nt, Human
caaucagcugcuuuguu

SEQ ID NO: 3778697 - RNA, 18 nt, Human
caaucagcugcuuuguua

SEQ ID NO: 3778698 - RNA, 19 nt, Human
caaucaguauaauucugua

SEQ ID NO: 3778699 - RNA, 14 nt, Human
caaucaguccccuc

SEQ ID NO: 3778700 - RNA, 15 nt, Human
caaucaguccccucc

SEQ ID NO: 3778701 - RNA, 21 nt, Human
caaucaguccccucccaucug

SEQ ID NO: 3778702 - RNA, 20 nt, Human
caaucauauuaauacaauga

SEQ ID NO: 3778703 - RNA, 17 nt, Human
caaucaucugugugaaa

SEQ ID NO: 3778704 - RNA, 19 nt, Human
caaucaucugugugaaaau

SEQ ID NO: 3778705 - RNA, 20 nt, Human
caaucaucugugugaaaaug

SEQ ID NO: 3778706 - RNA, 21 nt, Human
caaucauugcugaaaauggua

SEQ ID NO: 3778707 - RNA, 13 nt, Human
caaucauuguaca

SEQ ID NO: 3778708 - RNA, 20 nt, Human
caaucauuguacaguuuguu

SEQ ID NO: 3778709 - RNA, 17 nt, Human
caaucauuguuuugaau

SEQ ID NO: 3778710 - RNA, 20 nt, Human
caaucauuguuuugaauauu

SEQ ID NO: 3778711 - RNA, 21 nt, Human
caauccagguacgcacagaca

SEQ ID NO: 3778712 - RNA, 16 nt, Human
caauccaucagugcca

SEQ ID NO: 3778713 - RNA, 22 nt, Human
caauccauguuaguuuuuacuu

SEQ ID NO: 3778714 - RNA, 22 nt, Human
caauccccucauucaggaaaac

SEQ ID NO: 3778715 - RNA, 20 nt, Human
caauccccuccuugggcacu

SEQ ID NO: 3778716 - RNA, 20 nt, Human
caaucccucaccuucugagu

SEQ ID NO: 3778717 - RNA, 22 nt, Human
caauccuaacacauuaucggga

SEQ ID NO: 3778718 - RNA, 21 nt, Human
caauccuaauuucuccucccu

SEQ ID NO: 3778719 - RNA, 12 nt, Human
caauccuaugca

SEQ ID NO: 3778720 - RNA, 16 nt, Human
caauccuaugcauggu

SEQ ID NO: 3778721 - RNA, 18 nt, Human
caauccuaugcaugguuu

SEQ ID NO: 3778722 - RNA, 20 nt, Human
caauccuaugcaugguuuca

SEQ ID NO: 3778723 - RNA, 22 nt, Human
caauccuaugcaugguuucagc

SEQ ID NO: 3778724 - RNA, 14 nt, Human
caauccuauguuuu

SEQ ID NO: 3778725 - RNA, 20 nt, Human
caauccuauguuuuuguuca

SEQ ID NO: 3778726 - RNA, 17 nt, Human
caauccucacugggugg

SEQ ID NO: 3778727 - RNA, 19 nt, Human
caauccucucaccucagcc

SEQ ID NO: 3778728 - RNA, 18 nt, Human
caauccugauuccucucu

SEQ ID NO: 3778729 - RNA, 21 nt, Human
caauccugauuccucucuaag

SEQ ID NO: 3778730 - RNA, 11 nt, Human
caauccugccc

SEQ ID NO: 3778731 - RNA, 13 nt, Human
caauccugccccc

SEQ ID NO: 3778732 - RNA, 11 nt, Human
caauccuggac

SEQ ID NO: 3778733 - RNA, 17 nt, Human
caauccugucuuucuga

SEQ ID NO: 3778734 - RNA, 15 nt, Human
caauccuuacaaaug

SEQ ID NO: 3778735 - RNA, 17 nt, Human
caauccuuacaaaugau

SEQ ID NO: 3778736 - RNA, 14 nt, Human
caauccuuguucag

SEQ ID NO: 3778737 - RNA, 19 nt, Human
caaucgacuggguuuaugu

SEQ ID NO: 3778738 - RNA, 13 nt, Human
caaucgcaaauca

SEQ ID NO: 3778739 - RNA, 15 nt, Human
caaucgcaaaucaaa

SEQ ID NO: 3778740 - RNA, 20 nt, Human
caaucuaaccacaucaauau

SEQ ID NO: 3778741 - RNA, 16 nt, Human
caaucuacucaaagca

SEQ ID NO: 3778742 - RNA, 17 nt, Human
caaucuacucaaagcau

SEQ ID NO: 3778743 - RNA, 23 nt, Human
caaucuauuauuucucuaauuau

SEQ ID NO: 3778744 - RNA, 19 nt, Human
caaucuauuuauuggacau

SEQ ID NO: 3778745 - RNA, 21 nt, Human
caaucucaaauucucaaccua

SEQ ID NO: 3778746 - RNA, 18 nt, Human
caaucucuuaaauugggu

SEQ ID NO: 3778747 - RNA, 21 nt, Human
caaucucuuaaauuggguuca

SEQ ID NO: 3778748 - RNA, 14 nt, Human
caaucucuuuuugu

SEQ ID NO: 3778749 - RNA, 19 nt, Human
caaucugacauucucagga

SEQ ID NO: 3778750 - RNA, 17 nt, Human
caaucuggaagaaaaaa

SEQ ID NO: 3778751 - RNA, 17 nt, Human
accgcuucugccuuuuc

SEQ ID NO: 3778752 - RNA, 22 nt, Human
accgcuuguggggacccaggcu

SEQ ID NO: 3778753 - RNA, 15 nt, Human
accggaagcuccugg

SEQ ID NO: 3778754 - RNA, 17 nt, Human
accggaagcuccuggua

SEQ ID NO: 3778755 - RNA, 15 nt, Human
accggaagguuuuua

SEQ ID NO: 3778756 - RNA, 23 nt, Human
accggagcuuucaaagaaggaau

SEQ ID NO: 3778757 - RNA, 13 nt, Human
accggauccuggg

SEQ ID NO: 3778758 - RNA, 18 nt, Human
accggcaauuuccggcca

SEQ ID NO: 3778759 - RNA, 15 nt, Human
accggccugccagga

SEQ ID NO: 3778760 - RNA, 14 nt, Human
accggcucucaccu

SEQ ID NO: 3778761 - RNA, 16 nt, Human
accggcucucaccugg

SEQ ID NO: 3778762 - RNA, 21 nt, Human
accggcucucaccuggcccug

SEQ ID NO: 3778763 - RNA, 18 nt, Human
accggcuggccuggcccc

SEQ ID NO: 3778764 - RNA, 18 nt, Human
accgggaauaaccuucca

SEQ ID NO: 3778765 - RNA, 20 nt, Human
accgggcacucagaagacac

SEQ ID NO: 3778766 - RNA, 15 nt, Human
accgggcagggccgc

SEQ ID NO: 3778767 - RNA, 19 nt, Human
accgggccacagagaaagu

SEQ ID NO: 3778768 - RNA, 20 nt, Human
accgggccacuccuuccugc

SEQ ID NO: 3778769 - RNA, 21 nt, Human
accgggccacuccuuccugcc

SEQ ID NO: 3778770 - RNA, 21 nt, Human
accgggcugggagcucugcag

SEQ ID NO: 3778771 - RNA, 18 nt, Human
accgguugcuucugggaa

SEQ ID NO: 3778772 - RNA, 22 nt, Human
accguaaagguuuauuuuucug

SEQ ID NO: 3778773 - RNA, 16 nt, Human
accguccccucccagg

SEQ ID NO: 3778774 - RNA, 18 nt, Human
accguccccucccaggga

SEQ ID NO: 3778775 - RNA, 17 nt, Human
accguccucaccccugu

SEQ ID NO: 3778776 - RNA, 22 nt, Human
accgugagcaggaaggccuggg

SEQ ID NO: 3778777 - RNA, 14 nt, Human
accgugaggccaga

SEQ ID NO: 3778778 - RNA, 17 nt, Human
accgugaggccagagac

SEQ ID NO: 3778779 - RNA, 22 nt, Human
accguggaggaggaaggcaaga

SEQ ID NO: 3778780 - RNA, 15 nt, Human
accguggcccugccc

SEQ ID NO: 3778781 - RNA, 20 nt, Human
accguggcccuuccuggaca

SEQ ID NO: 3778782 - RNA, 22 nt, Human
accguggcccuuccuggacagc

SEQ ID NO: 3778783 - RNA, 18 nt, Human
accgugggcagggagcgg

SEQ ID NO: 3778784 - RNA, 16 nt, Human
accgugguaugucugc

SEQ ID NO: 3778785 - RNA, 13 nt, Human
accgugucaagcu

SEQ ID NO: 3778786 - RNA, 17 nt, Human
accgugucaagcugcuc

SEQ ID NO: 3778787 - RNA, 16 nt, Human
accguguuggucugua

SEQ ID NO: 3778788 - RNA, 15 nt, Human
accguguuugucucu

SEQ ID NO: 3778789 - RNA, 18 nt, Human
accguguuugucucuucu

SEQ ID NO: 3778790 - RNA, 19 nt, Human
accguguuugucucuucug

SEQ ID NO: 3778791 - RNA, 19 nt, Human
accuaaaaaagauauauua

SEQ ID NO: 3778792 - RNA, 13 nt, Human
accuaaaacuuaa

SEQ ID NO: 3778793 - RNA, 21 nt, Human
accuaaaagagauuucaagag

SEQ ID NO: 3778794 - RNA, 19 nt, Human
accuaaaauuugcccuccc

SEQ ID NO: 3778795 - RNA, 19 nt, Human
accuaaacgguucaguuuc

SEQ ID NO: 3778796 - RNA, 16 nt, Human
accuaaagguguauuu

SEQ ID NO: 3778797 - RNA, 19 nt, Human
accuaacauucgaucucau

SEQ ID NO: 3778798 - RNA, 17 nt, Human
accuaaccagggccaga

SEQ ID NO: 3778799 - RNA, 13 nt, Human
accuaaccugugu

SEQ ID NO: 3778800 - RNA, 19 nt, Human
accuaacgcccuauuuuug

SEQ ID NO: 3778801 - RNA, 16 nt, Human
accuaagggacauguu

SEQ ID NO: 3778802 - RNA, 14 nt, Human
accuaaguacugua

SEQ ID NO: 3778803 - RNA, 17 nt, Human
accuaaguacuguaaua

SEQ ID NO: 3778804 - RNA, 14 nt, Human
accuaagucucugu

SEQ ID NO: 3778805 - RNA, 20 nt, Human
accuaaguuucaguugauuu

SEQ ID NO: 3778806 - RNA, 11 nt, Human
accuaauccaa

SEQ ID NO: 3778807 - RNA, 20 nt, Human
accuaauccaggcagaucca

SEQ ID NO: 3778808 - RNA, 17 nt, Human
accuaaucucuguaaag

SEQ ID NO: 3778809 - RNA, 13 nt, Human
accuaaugaaagu

SEQ ID NO: 3778810 - RNA, 12 nt, Human
accuaauguuua

SEQ ID NO: 3778811 - RNA, 19 nt, Human
accuaauguuuaugagcca

SEQ ID NO: 3778812 - RNA, 20 nt, Human
accuaauguuuaugagccag

SEQ ID NO: 3778813 - RNA, 22 nt, Human
accuacaccauuaucuuggaaa

SEQ ID NO: 3778814 - RNA, 15 nt, Human
accuacaguguacag

SEQ ID NO: 3778815 - RNA, 18 nt, Human
accuacaguguacagucu

SEQ ID NO: 3778816 - RNA, 20 nt, Human
accuacaguguacagucuug

SEQ ID NO: 3778817 - RNA, 18 nt, Human
accuacaguuuuaacugu

SEQ ID NO: 3778818 - RNA, 19 nt, Human
accuacaguuuuaacugug

SEQ ID NO: 3778819 - RNA, 17 nt, Human
accuaccacagugucug

SEQ ID NO: 3778820 - RNA, 12 nt, Human
accuaccacaug

SEQ ID NO: 3778821 - RNA, 19 nt, Human
accuaccaccccuuccugu

SEQ ID NO: 3778822 - RNA, 22 nt, Human
accuaccccucccuccuggagg

SEQ ID NO: 3778823 - RNA, 17 nt, Human
accuacccucagugagc

SEQ ID NO: 3778824 - RNA, 15 nt, Human
accuaccucagguug

SEQ ID NO: 3778825 - RNA, 15 nt, Human
accuaccuguugagc

SEQ ID NO: 3778826 - RNA, 17 nt, Human
accuaccuguugagcau

SEQ ID NO: 3778827 - RNA, 17 nt, Human
accuacuguucuaaagc

SEQ ID NO: 3778828 - RNA, 18 nt, Human
accuacuguucuaaagcu

SEQ ID NO: 3778829 - RNA, 21 nt, Human
accuacuguucuaaagcucug

SEQ ID NO: 3778830 - RNA, 15 nt, Human
accuagagccagacc

SEQ ID NO: 3778831 - RNA, 16 nt, Human
accuagagccagacca

SEQ ID NO: 3778832 - RNA, 13 nt, Human
accuagaucagaa

SEQ ID NO: 3778833 - RNA, 21 nt, Human
accuagauguauaacuaggag

SEQ ID NO: 3778834 - RNA, 13 nt, Human
accuagauuuaau

SEQ ID NO: 3778835 - RNA, 17 nt, Human
accuagauuuaauauaa

SEQ ID NO: 3778836 - RNA, 12 nt, Human
accuagauuuuu

SEQ ID NO: 3778837 - RNA, 13 nt, Human
accuagcaauucc

SEQ ID NO: 3778838 - RNA, 14 nt, Human
accuagcaauucca

SEQ ID NO: 3778839 - RNA, 14 nt, Human
accuagcagcaccg

SEQ ID NO: 3778840 - RNA, 23 nt, Human
accuagcagcaccguucugugca

SEQ ID NO: 3778841 - RNA, 13 nt, Human
accuagccuuaga

SEQ ID NO: 3778842 - RNA, 18 nt, Human
accuagcuggcucuguga

SEQ ID NO: 3778843 - RNA, 14 nt, Human
accuagcugugcaa

SEQ ID NO: 3778844 - RNA, 18 nt, Human
accuaggaagccucagau

SEQ ID NO: 3778845 - RNA, 17 nt, Human
accuaggauaucuucuc

SEQ ID NO: 3778846 - RNA, 17 nt, Human
accuaggccacuccucc

SEQ ID NO: 3778847 - RNA, 12 nt, Human
accuaggcuagg

SEQ ID NO: 3778848 - RNA, 15 nt, Human
accuagggaggaccu

SEQ ID NO: 3778849 - RNA, 16 nt, Human
accuagggugauauua

SEQ ID NO: 3778850 - RNA, 21 nt, Human
accuagggugauauuaaccag

SEQ ID NO: 3778851 - RNA, 14 nt, Human
accuaguacugccc

SEQ ID NO: 3778852 - RNA, 18 nt, Human
accuauaaaacaggucaa

SEQ ID NO: 3778853 - RNA, 16 nt, Human
accuauaaugugugua

SEQ ID NO: 3778854 - RNA, 17 nt, Human
accuauaauguguguau

SEQ ID NO: 3778855 - RNA, 15 nt, Human
accuauaccuguguu

SEQ ID NO: 3778856 - RNA, 16 nt, Human
accuauagucccagcu

SEQ ID NO: 3778857 - RNA, 17 nt, Human
accuauaugauuuauag

SEQ ID NO: 3778858 - RNA, 17 nt, Human
accuaugagugagaaua

SEQ ID NO: 3778859 - RNA, 19 nt, Human
accuaugauauuuucugug

SEQ ID NO: 3778860 - RNA, 22 nt, Human
accuaugguauaaugguugacu

SEQ ID NO: 3778861 - RNA, 15 nt, Human
accuaugucauuuca

SEQ ID NO: 3778862 - RNA, 18 nt, Human
accuaugucauuucauuu

SEQ ID NO: 3778863 - RNA, 17 nt, Human
accuauuucaaaaauuu

SEQ ID NO: 3778864 - RNA, 16 nt, Human
accuauuuccagaaau

SEQ ID NO: 3778865 - RNA, 17 nt, Human
accuauuuccagaaaua

SEQ ID NO: 3778866 - RNA, 19 nt, Human
accuauuuccagaaauaca

SEQ ID NO: 3778867 - RNA, 15 nt, Human
accucaaaauuuaac

SEQ ID NO: 3778868 - RNA, 20 nt, Human
accucaaacuaucuggccau

SEQ ID NO: 3778869 - RNA, 23 nt, Human
accucaaacuuccagucagguag

SEQ ID NO: 3778870 - RNA, 21 nt, Human
accucaaccauccuggcugcg

SEQ ID NO: 3778871 - RNA, 15 nt, Human
accucaaccuguaaa

SEQ ID NO: 3778872 - RNA, 18 nt, Human
accucaaccuguaaauua

SEQ ID NO: 3778873 - RNA, 19 nt, Human
accucaaccuguaaauuau

SEQ ID NO: 3778874 - RNA, 21 nt, Human
accucaaccuguaaauuauuu

SEQ ID NO: 3778875 - RNA, 21 nt, Human
accucaagggggacugucuuu

SEQ ID NO: 3778876 - RNA, 20 nt, Human
accucaagugauccucccac

SEQ ID NO: 3778877 - RNA, 23 nt, Human
accucaagugaucugcccaccuc

SEQ ID NO: 3778878 - RNA, 17 nt, Human
accucacaccucacucu

SEQ ID NO: 3778879 - RNA, 16 nt, Human
accucacacuccuuua

SEQ ID NO: 3778880 - RNA, 20 nt, Human
accucacagugacccuuccc

SEQ ID NO: 3778881 - RNA, 21 nt, Human
accucacagugacccuuccca

SEQ ID NO: 3778882 - RNA, 18 nt, Human
accucaccccgaggcccu

SEQ ID NO: 3778883 - RNA, 20 nt, Human
accucaccccguuacagcuc

SEQ ID NO: 3778884 - RNA, 22 nt, Human
accucaccccguuacagcuccc

SEQ ID NO: 3778885 - RNA, 19 nt, Human
accucacccgaggcugccc

SEQ ID NO: 3778886 - RNA, 17 nt, Human
accucacgcaccuccca

SEQ ID NO: 3778887 - RNA, 20 nt, Human
accucacuauucaaguauua

SEQ ID NO: 3778888 - RNA, 16 nt, Human
accucacucagcacca

SEQ ID NO: 3778889 - RNA, 20 nt, Human
accucacucagcaccacuca

SEQ ID NO: 3778890 - RNA, 14 nt, Human
accucacuccuguu

SEQ ID NO: 3778891 - RNA, 23 nt, Human
accucacucugcuaccuugcccc

SEQ ID NO: 3778892 - RNA, 15 nt, Human
accucacucuugcca

SEQ ID NO: 3778893 - RNA, 16 nt, Human
accucacucuugccaa

SEQ ID NO: 3778894 - RNA, 21 nt, Human
accucacugggguccuggggc

SEQ ID NO: 3778895 - RNA, 16 nt, Human
accucagagccccgca

SEQ ID NO: 3778896 - RNA, 21 nt, Human
accucagauggcagcuuuuaa

SEQ ID NO: 3778897 - RNA, 15 nt, Human
accucagcaaccugu

SEQ ID NO: 3778898 - RNA, 22 nt, Human
accucagccaugaggaguugcu

SEQ ID NO: 3778899 - RNA, 11 nt, Human
accucagccug

SEQ ID NO: 3778900 - RNA, 12 nt, Human
accucagccugc

SEQ ID NO: 3778901 - RNA, 19 nt, Human
accucagccuggccagaca

SEQ ID NO: 3778902 - RNA, 20 nt, Human
accucagccuggccagacac

SEQ ID NO: 3778903 - RNA, 13 nt, Human
accucagccuggg

SEQ ID NO: 3778904 - RNA, 14 nt, Human
accucagccugggc

SEQ ID NO: 3778905 - RNA, 15 nt, Human
accucagcugcuucu

SEQ ID NO: 3778906 - RNA, 18 nt, Human
accucaggcacuagccuu

SEQ ID NO: 3778907 - RNA, 19 nt, Human
accucaggcacuagccuuu

SEQ ID NO: 3778908 - RNA, 23 nt, Human
accucaggcacuagccuuuggcu

SEQ ID NO: 3778909 - RNA, 12 nt, Human
accucaggcagc

SEQ ID NO: 3778910 - RNA, 16 nt, Human
accucaggcagcucaa

SEQ ID NO: 3778911 - RNA, 17 nt, Human
accucaggcagcucaag

SEQ ID NO: 3778912 - RNA, 18 nt, Human
acucuuuguuauuugaaa

SEQ ID NO: 3778913 - RNA, 12 nt, Human
acucuuuugcuu

SEQ ID NO: 3778914 - RNA, 20 nt, Human
acucuuuugcuuuauuccag

SEQ ID NO: 3778915 - RNA, 19 nt, Human
acucuuuuuagggccaggc

SEQ ID NO: 3778916 - RNA, 20 nt, Human
acucuuuuuucauggacacu

SEQ ID NO: 3778917 - RNA, 15 nt, Human
acugaaaaaauauau

SEQ ID NO: 3778918 - RNA, 16 nt, Human
acugaaaaauuauacu

SEQ ID NO: 3778919 - RNA, 12 nt, Human
acugaaaacaua

SEQ ID NO: 3778920 - RNA, 17 nt, Human
acugaaaacauaaaaag

SEQ ID NO: 3778921 - RNA, 15 nt, Human
acugaaaacaucugg

SEQ ID NO: 3778922 - RNA, 16 nt, Human
acugaaaagaaggaaa

SEQ ID NO: 3778923 - RNA, 20 nt, Human
acugaaaaggaggggucugg

SEQ ID NO: 3778924 - RNA, 13 nt, Human
acugaaacuuccc

SEQ ID NO: 3778925 - RNA, 19 nt, Human
acugaaagguagacuuuua

SEQ ID NO: 3778926 - RNA, 14 nt, Human
acugaaaguguuuc

SEQ ID NO: 3778927 - RNA, 15 nt, Human
acugaaauauacaca

SEQ ID NO: 3778928 - RNA, 17 nt, Human
acugaaauauacacaca

SEQ ID NO: 3778929 - RNA, 17 nt, Human
acugaaaugccugcuuu

SEQ ID NO: 3778930 - RNA, 14 nt, Human
acugaacaaaaaaa

SEQ ID NO: 3778931 - RNA, 22 nt, Human
acugaacaaacuaucagaggaa

SEQ ID NO: 3778932 - RNA, 19 nt, Human
acugaacaccauugaaggc

SEQ ID NO: 3778933 - RNA, 21 nt, Human
acugaacaguaacauagcugu

SEQ ID NO: 3778934 - RNA, 16 nt, Human
acugaacauuccagag

SEQ ID NO: 3778935 - RNA, 16 nt, Human
acugaaccacuuguag

SEQ ID NO: 3778936 - RNA, 19 nt, Human
acugaacgauccuucaaag

SEQ ID NO: 3778937 - RNA, 21 nt, Human
acugaacuguguguaauuguu

SEQ ID NO: 3778938 - RNA, 13 nt, Human
acugaacuucagg

SEQ ID NO: 3778939 - RNA, 13 nt, Human
acugaacuuucuu

SEQ ID NO: 3778940 - RNA, 16 nt, Human
acugaacuuucuuauc

SEQ ID NO: 3778941 - RNA, 15 nt, Human
acugaacuuugaaga

SEQ ID NO: 3778942 - RNA, 16 nt, Human
acugaacuuugaagac

SEQ ID NO: 3778943 - RNA, 23 nt, Human
acugaagaggaggaggagggucu

SEQ ID NO: 3778944 - RNA, 12 nt, Human
acugaagaguaa

SEQ ID NO: 3778945 - RNA, 17 nt, Human
acugaagauagaagaaa

SEQ ID NO: 3778946 - RNA, 14 nt, Human
acugaagccugcag

SEQ ID NO: 3778947 - RNA, 19 nt, Human
acugaagccugcaggaguu

SEQ ID NO: 3778948 - RNA, 23 nt, Human
acugaaggaaaaacacaagcaaa

SEQ ID NO: 3778949 - RNA, 13 nt, Human
acugaaggagaag

SEQ ID NO: 3778950 - RNA, 14 nt, Human
acugaaggagaagg

SEQ ID NO: 3778951 - RNA, 21 nt, Human
acugaaggagaaggugcccca

SEQ ID NO: 3778952 - RNA, 19 nt, Human
acugaaggcuaaaaagcaa

SEQ ID NO: 3778953 - RNA, 20 nt, Human
acugaaggcuuucagggccu

SEQ ID NO: 3778954 - RNA, 17 nt, Human
acugaagguaaaauuga

SEQ ID NO: 3778955 - RNA, 13 nt, Human
acugaagucugaa

SEQ ID NO: 3778956 - RNA, 16 nt, Human
acugaagucugaaauu

SEQ ID NO: 3778957 - RNA, 21 nt, Human
acugaagucuuacuacagaaa

SEQ ID NO: 3778958 - RNA, 17 nt, Human
acugaaguuaacagaga

SEQ ID NO: 3778959 - RNA, 21 nt, Human
acugaaguuaacagagacaga

SEQ ID NO: 3778960 - RNA, 18 nt, Human
acugaaguuugauaaaua

SEQ ID NO: 3778961 - RNA, 21 nt, Human
acugaaguuugauaaauagug

SEQ ID NO: 3778962 - RNA, 22 nt, Human
acugaaguuugauaaauagugu

SEQ ID NO: 3778963 - RNA, 22 nt, Human
acugaauaaauuguacagccgg

SEQ ID NO: 3778964 - RNA, 13 nt, Human
acugaauaccacu

SEQ ID NO: 3778965 - RNA, 21 nt, Human
acugaauaccacucuguaauu

SEQ ID NO: 3778966 - RNA, 22 nt, Human
acugaauaccacucuguaauug

SEQ ID NO: 3778967 - RNA, 18 nt, Human
acugaauauuuauauuuc

SEQ ID NO: 3778968 - RNA, 22 nt, Human
acugaauauuuauauuucacua

SEQ ID NO: 3778969 - RNA, 22 nt, Human
acugaaugaaacccccacacac

SEQ ID NO: 3778970 - RNA, 20 nt, Human
acugaaugaagcaguauuuu

SEQ ID NO: 3778971 - RNA, 20 nt, Human
acugaaugaggucagcaugu

SEQ ID NO: 3778972 - RNA, 21 nt, Human
acugaaugccucaaugugacc

SEQ ID NO: 3778973 - RNA, 22 nt, Human
acugaauggacuuugcacacuu

SEQ ID NO: 3778974 - RNA, 20 nt, Human
acugaaugggaucaugaaag

SEQ ID NO: 3778975 - RNA, 21 nt, Human
acugaaugggaucaugaaagu

SEQ ID NO: 3778976 - RNA, 13 nt, Human
acugaauuaauca

SEQ ID NO: 3778977 - RNA, 14 nt, Human
acugaauuaugaaa

SEQ ID NO: 3778978 - RNA, 21 nt, Human
acugaauuccaaacaugguuu

SEQ ID NO: 3778979 - RNA, 15 nt, Human
acugaauuuuuaugu

SEQ ID NO: 3778980 - RNA, 15 nt, Human
acugaauuuuuuugu

SEQ ID NO: 3778981 - RNA, 17 nt, Human
acugacaaaucaaguuu

SEQ ID NO: 3778982 - RNA, 19 nt, Human
acugacaaaucaaguuucc

SEQ ID NO: 3778983 - RNA, 18 nt, Human
acugacaagccaucuuga

SEQ ID NO: 3778984 - RNA, 23 nt, Human
acugacacaaaaaguagauuaag

SEQ ID NO: 3778985 - RNA, 16 nt, Human
acugacacaaaggaag

SEQ ID NO: 3778986 - RNA, 17 nt, Human
acugacacaaaggaagu

SEQ ID NO: 3778987 - RNA, 20 nt, Human
acugacacaggaaaccaaca

SEQ ID NO: 3778988 - RNA, 13 nt, Human
acugacacaugcu

SEQ ID NO: 3778989 - RNA, 17 nt, Human
acugacaccuuugcagg

SEQ ID NO: 3778990 - RNA, 20 nt, Human
acugacaccuuugcaggcau

SEQ ID NO: 3778991 - RNA, 14 nt, Human
acugacagaggggg

SEQ ID NO: 3778992 - RNA, 20 nt, Human
acugacagcaugugcccucc

SEQ ID NO: 3778993 - RNA, 21 nt, Human
acugacaggcagccuggacau

SEQ ID NO: 3778994 - RNA, 15 nt, Human
acugacauauaucua

SEQ ID NO: 3778995 - RNA, 16 nt, Human
acugacaugcccuccc

SEQ ID NO: 3778996 - RNA, 13 nt, Human
acugaccagccuc

SEQ ID NO: 3778997 - RNA, 15 nt, Human
acugaccagccucca

SEQ ID NO: 3778998 - RNA, 23 nt, Human
acugaccauccacucuacccucc

SEQ ID NO: 3778999 - RNA, 18 nt, Human
acugacccucccuuccug

SEQ ID NO: 3779000 - RNA, 12 nt, Human
acugacccuucc

SEQ ID NO: 3779001 - RNA, 15 nt, Human
acugacccuuccaga

SEQ ID NO: 3779002 - RNA, 13 nt, Human
acugaccuugaug

SEQ ID NO: 3779003 - RNA, 22 nt, Human
acugaccuuggagagacacagc

SEQ ID NO: 3779004 - RNA, 14 nt, Human
acugacgccagggu

SEQ ID NO: 3779005 - RNA, 18 nt, Human
acugacuauucuugaugu

SEQ ID NO: 3779006 - RNA, 24 nt, Human
acugacuauucuugauguaaaauc

SEQ ID NO: 3779007 - RNA, 12 nt, Human
acugacucugga

SEQ ID NO: 3779008 - RNA, 13 nt, Human
acugacucuuaag

SEQ ID NO: 3779009 - RNA, 15 nt, Human
acugacucuuaagaa

SEQ ID NO: 3779010 - RNA, 16 nt, Human
acugacuucuaaguaa

SEQ ID NO: 3779011 - RNA, 13 nt, Human
acugacuugagac

SEQ ID NO: 3779012 - RNA, 20 nt, Human
acugacuuguuugucuucca

SEQ ID NO: 3779013 - RNA, 12 nt, Human
acugagaaauuu

SEQ ID NO: 3779014 - RNA, 17 nt, Human
acugagaaauuuauaaa

SEQ ID NO: 3779015 - RNA, 15 nt, Human
acugagacagcccgg

SEQ ID NO: 3779016 - RNA, 21 nt, Human
acugagacagcccgggcucug

SEQ ID NO: 3779017 - RNA, 23 nt, Human
acugagacagcccgggcucugcc

SEQ ID NO: 3779018 - RNA, 16 nt, Human
acugagagagcgcagc

SEQ ID NO: 3779019 - RNA, 17 nt, Human
acugagagaucugcugu

SEQ ID NO: 3779020 - RNA, 20 nt, Human
acugagagaugcagaaauau

SEQ ID NO: 3779021 - RNA, 18 nt, Human
acugagagugaacaaauu

SEQ ID NO: 3779022 - RNA, 19 nt, Human
acugagauaccagcgagga

SEQ ID NO: 3779023 - RNA, 17 nt, Human
acugagaugugaacaca

SEQ ID NO: 3779024 - RNA, 22 nt, Human
acugagaugugaacacaucagc

SEQ ID NO: 3779025 - RNA, 20 nt, Human
acugagcaacgcuauuccag

SEQ ID NO: 3779026 - RNA, 21 nt, Human
acugagcaagacccugucucu

SEQ ID NO: 3779027 - RNA, 14 nt, Human
acugagcacccucu

SEQ ID NO: 3779028 - RNA, 13 nt, Human
acugagcacuguu

SEQ ID NO: 3779029 - RNA, 12 nt, Human
acugagcagacu

SEQ ID NO: 3779030 - RNA, 21 nt, Human
acugagccccgcagaccuccc

SEQ ID NO: 3779031 - RNA, 23 nt, Human
acugagccccgcagaccucccca

SEQ ID NO: 3779032 - RNA, 23 nt, Human
acugagcuccaugugcccccucu

SEQ ID NO: 3779033 - RNA, 14 nt, Human
acugagcuccucug

SEQ ID NO: 3779034 - RNA, 17 nt, Human
acugagcuuggaagcuu

SEQ ID NO: 3779035 - RNA, 19 nt, Human
acugaggacaaaguggagg

SEQ ID NO: 3779036 - RNA, 15 nt, Human
acugaggcacgagca

SEQ ID NO: 3779037 - RNA, 13 nt, Human
acugaggcagaca

SEQ ID NO: 3779038 - RNA, 22 nt, Human
acugaggcagacagcagcucag

SEQ ID NO: 3779039 - RNA, 23 nt, Human
acugaggcagacagcagcucagg

SEQ ID NO: 3779040 - RNA, 18 nt, Human
acugaggcaguuugagga

SEQ ID NO: 3779041 - RNA, 21 nt, Human
acugaggccugagacccagga

SEQ ID NO: 3779042 - RNA, 22 nt, Human
acugagggaccaacugggccca

SEQ ID NO: 3779043 - RNA, 14 nt, Human
acugagggacucug

SEQ ID NO: 3779044 - RNA, 22 nt, Human
acugagggacucugaagccucu

SEQ ID NO: 3779045 - RNA, 17 nt, Human
acugaggggaggggagc

SEQ ID NO: 3779046 - RNA, 17 nt, Human
acugagggggccuggau

SEQ ID NO: 3779047 - RNA, 18 nt, Human
acugaggggucuccagga

SEQ ID NO: 3779048 - RNA, 19 nt, Human
acugaguacguugugcauu

SEQ ID NO: 3779049 - RNA, 23 nt, Human
acugagugacucuauauagcuga

SEQ ID NO: 3779050 - RNA, 22 nt, Human
acgaggcccucgggcccagccc

SEQ ID NO: 3779051 - RNA, 14 nt, Human
acgaggcugggcca

SEQ ID NO: 3779052 - RNA, 12 nt, Human
acgagggcuggc

SEQ ID NO: 3779053 - RNA, 14 nt, Human
acgagggcuggcug

SEQ ID NO: 3779054 - RNA, 16 nt, Human
acgagggcuggcuggc

SEQ ID NO: 3779055 - RNA, 20 nt, Human
acgaggucaagagaucgaga

SEQ ID NO: 3779056 - RNA, 20 nt, Human
acgaggucaggagaucgaga

SEQ ID NO: 3779057 - RNA, 14 nt, Human
acgaucacaaauga

SEQ ID NO: 3779058 - RNA, 15 nt, Human
acgaucacaaaugac

SEQ ID NO: 3779059 - RNA, 17 nt, Human
acgaucaggcacagguc

SEQ ID NO: 3779060 - RNA, 15 nt, Human
acgaugauguacaga

SEQ ID NO: 3779061 - RNA, 15 nt, Human
acgauggcacccagu

SEQ ID NO: 3779062 - RNA, 19 nt, Human
acgauguggcccuggccug

SEQ ID NO: 3779063 - RNA, 15 nt, Human
acgaugugucuguau

SEQ ID NO: 3779064 - RNA, 19 nt, Human
acgauucauuuuugaaacu

SEQ ID NO: 3779065 - RNA, 16 nt, Human
acgauuccuucucuga

SEQ ID NO: 3779066 - RNA, 14 nt, Human
acgauuuaauucuc

SEQ ID NO: 3779067 - RNA, 13 nt, Human
acgauuucuguuu

SEQ ID NO: 3779068 - RNA, 14 nt, Human
acgauuucuguuua

SEQ ID NO: 3779069 - RNA, 18 nt, Human
acgcaaaaccacuuuccu

SEQ ID NO: 3779070 - RNA, 23 nt, Human
acgcaaugaaaagucguuuucca

SEQ ID NO: 3779071 - RNA, 12 nt, Human
acgcacacagcu

SEQ ID NO: 3779072 - RNA, 13 nt, Human
acgcacacagcuu

SEQ ID NO: 3779073 - RNA, 15 nt, Human
acgcacagccaagga

SEQ ID NO: 3779074 - RNA, 17 nt, Human
acgcacagccaaggacu

SEQ ID NO: 3779075 - RNA, 19 nt, Human
acgcacauauacacacaca

SEQ ID NO: 3779076 - RNA, 22 nt, Human
acgcaccaccaugccaggcuaa

SEQ ID NO: 3779077 - RNA, 19 nt, Human
acgcaccucccauccuaau

SEQ ID NO: 3779078 - RNA, 14 nt, Human
acgcacgcacacac

SEQ ID NO: 3779079 - RNA, 23 nt, Human
acgcacugagcaacgcuauucca

SEQ ID NO: 3779080 - RNA, 13 nt, Human
acgcagccaggac

SEQ ID NO: 3779081 - RNA, 14 nt, Human
acgcagcccuagag

SEQ ID NO: 3779082 - RNA, 19 nt, Human
acgcagcccuagagccugc

SEQ ID NO: 3779083 - RNA, 12 nt, Human
acgcagcccugc

SEQ ID NO: 3779084 - RNA, 16 nt, Human
acgcaggaacucccag

SEQ ID NO: 3779085 - RNA, 16 nt, Human
acgcaggcaucugauu

SEQ ID NO: 3779086 - RNA, 22 nt, Human
acgcaucuaguuccccuguuua

SEQ ID NO: 3779087 - RNA, 15 nt, Human
acgccacagcccagc

SEQ ID NO: 3779088 - RNA, 12 nt, Human
acgccacauccc

SEQ ID NO: 3779089 - RNA, 13 nt, Human
acgccaccauucc

SEQ ID NO: 3779090 - RNA, 21 nt, Human
acgccacucauuucaucucau

SEQ ID NO: 3779091 - RNA, 18 nt, Human
acgccacugcacuauagc

SEQ ID NO: 3779092 - RNA, 14 nt, Human
acgccacugcacuc

SEQ ID NO: 3779093 - RNA, 21 nt, Human
acgccacugcacuccagccug

SEQ ID NO: 3779094 - RNA, 18 nt, Human
acgccagggaccccagaa

SEQ ID NO: 3779095 - RNA, 24 nt, Human
acgccaggggaaaaucagccugcu

SEQ ID NO: 3779096 - RNA, 15 nt, Human
acgccaucccagccc

SEQ ID NO: 3779097 - RNA, 18 nt, Human
acgcccacuucccugggu

SEQ ID NO: 3779098 - RNA, 15 nt, Human
acgcccaucucagga

SEQ ID NO: 3779099 - RNA, 16 nt, Human
acgcccaugugugagu

SEQ ID NO: 3779100 - RNA, 16 nt, Human
acgcccguccugccug

SEQ ID NO: 3779101 - RNA, 18 nt, Human
acgcccguccugccugug

SEQ ID NO: 3779102 - RNA, 14 nt, Human
acgcccuccccucc

SEQ ID NO: 3779103 - RNA, 21 nt, Human
acgcccuccccuccccugcug

SEQ ID NO: 3779104 - RNA, 23 nt, Human
acgcccuccccuccccugcugca

SEQ ID NO: 3779105 - RNA, 14 nt, Human
acgcccucucccca

SEQ ID NO: 3779106 - RNA, 17 nt, Human
acgcccuuggccauggg

SEQ ID NO: 3779107 - RNA, 23 nt, Human
acgccggggacagaggccugccc

SEQ ID NO: 3779108 - RNA, 17 nt, Human
acgccuaugaucccagc

SEQ ID NO: 3779109 - RNA, 18 nt, Human
acgccuaugaucccagca

SEQ ID NO: 3779110 - RNA, 18 nt, Human
acgccucacugaaacaug

SEQ ID NO: 3779111 - RNA, 14 nt, Human
acgccucccacugg

SEQ ID NO: 3779112 - RNA, 15 nt, Human
acgccugagcccagg

SEQ ID NO: 3779113 - RNA, 16 nt, Human
acgccugagcccaggg

SEQ ID NO: 3779114 - RNA, 17 nt, Human
acgccugagcccaggga

SEQ ID NO: 3779115 - RNA, 19 nt, Human
acgccugaggcaauuagac

SEQ ID NO: 3779116 - RNA, 18 nt, Human
acgccugcaaacgcugcc

SEQ ID NO: 3779117 - RNA, 21 nt, Human
acgccugcccuccccagagca

SEQ ID NO: 3779118 - RNA, 16 nt, Human
acgccuguaaucccag

SEQ ID NO: 3779119 - RNA, 18 nt, Human
acgccuguaaucccagca

SEQ ID NO: 3779120 - RNA, 20 nt, Human
acgccuguaaucccagcacu

SEQ ID NO: 3779121 - RNA, 19 nt, Human
acgccuguaaucccagcag

SEQ ID NO: 3779122 - RNA, 16 nt, Human
acgccuguaguccuag

SEQ ID NO: 3779123 - RNA, 18 nt, Human
acgccuuguucuuggcca

SEQ ID NO: 3779124 - RNA, 20 nt, Human
acgcgaaaccaauuccucau

SEQ ID NO: 3779125 - RNA, 22 nt, Human
acgcgaaaguaucaccagggug

SEQ ID NO: 3779126 - RNA, 19 nt, Human
acgcgcagaugugcagcag

SEQ ID NO: 3779127 - RNA, 23 nt, Human
acgcgccucgccggaucugaggg

SEQ ID NO: 3779128 - RNA, 14 nt, Human
acgcgcgcacacac

SEQ ID NO: 3779129 - RNA, 15 nt, Human
acgcgcgcacacaca

SEQ ID NO: 3779130 - RNA, 15 nt, Human
acgcgguuugguuug

SEQ ID NO: 3779131 - RNA, 15 nt, Human
acgcgucuccuguuu

SEQ ID NO: 3779132 - RNA, 13 nt, Human
acgcgucuuccug

SEQ ID NO: 3779133 - RNA, 15 nt, Human
acgcgucuuccugag

SEQ ID NO: 3779134 - RNA, 20 nt, Human
acgcgugcacacaccagagc

SEQ ID NO: 3779135 - RNA, 23 nt, Human
acgcgugcacacaccagagccca

SEQ ID NO: 3779136 - RNA, 16 nt, Human
acgcgugccguggcac

SEQ ID NO: 3779137 - RNA, 21 nt, Human
acgcguguguacacgggacug

SEQ ID NO: 3779138 - RNA, 16 nt, Human
acgcuaaagagcccuu

SEQ ID NO: 3779139 - RNA, 21 nt, Human
acgcuccaaagucauaauugc

SEQ ID NO: 3779140 - RNA, 11 nt, Human
acgcuccagcu

SEQ ID NO: 3779141 - RNA, 14 nt, Human
acgcuccagcugcc

SEQ ID NO: 3779142 - RNA, 19 nt, Human
acgcuccagcugccccggc

SEQ ID NO: 3779143 - RNA, 14 nt, Human
acgcuccccgccug

SEQ ID NO: 3779144 - RNA, 17 nt, Human
acgcuccccgccuguuc

SEQ ID NO: 3779145 - RNA, 19 nt, Human
acgcuccccgccuguuccc

SEQ ID NO: 3779146 - RNA, 20 nt, Human
acgcuccccgccuguucccc

SEQ ID NO: 3779147 - RNA, 16 nt, Human
acgcucccucccccug

SEQ ID NO: 3779148 - RNA, 19 nt, Human
acuccggccugaugacaga

SEQ ID NO: 3779149 - RNA, 14 nt, Human
acuccggcugugcu

SEQ ID NO: 3779150 - RNA, 16 nt, Human
acuccggcugugcugg

SEQ ID NO: 3779151 - RNA, 20 nt, Human
acuccgugcuuaaccaaaga

SEQ ID NO: 3779152 - RNA, 21 nt, Human
acuccguuggccacuccgaga

SEQ ID NO: 3779153 - RNA, 19 nt, Human
acuccuaaaccuuugcccc

SEQ ID NO: 3779154 - RNA, 21 nt, Human
acuccuacaugauguuaugua

SEQ ID NO: 3779155 - RNA, 20 nt, Human
acuccuagagaacgcagccc

SEQ ID NO: 3779156 - RNA, 21 nt, Human
acuccuagagaacgcagcccu

SEQ ID NO: 3779157 - RNA, 23 nt, Human
acuccuagcuguccuuuuuccuc

SEQ ID NO: 3779158 - RNA, 14 nt, Human
acuccuaugcuuua

SEQ ID NO: 3779159 - RNA, 16 nt, Human
acuccucaggguugag

SEQ ID NO: 3779160 - RNA, 19 nt, Human
acuccucaggguugagguc

SEQ ID NO: 3779161 - RNA, 22 nt, Human
acuccucaguucuugccacuuu

SEQ ID NO: 3779162 - RNA, 13 nt, Human
acuccucccaggg

SEQ ID NO: 3779163 - RNA, 19 nt, Human
acuccucccaggguuuuaa

SEQ ID NO: 3779164 - RNA, 22 nt, Human
acuccucccaggguuuuaacuu

SEQ ID NO: 3779165 - RNA, 23 nt, Human
acuccuccccacccuccuggccu

SEQ ID NO: 3779166 - RNA, 11 nt, Human
acuccucccuc

SEQ ID NO: 3779167 - RNA, 16 nt, Human
acuccucccugaugua

SEQ ID NO: 3779168 - RNA, 13 nt, Human
acuccuccucuuu

SEQ ID NO: 3779169 - RNA, 15 nt, Human
acuccuccuuucucc

SEQ ID NO: 3779170 - RNA, 16 nt, Human
acuccuccuuuuucca

SEQ ID NO: 3779171 - RNA, 23 nt, Human
acuccucggccuggcuccuaccc

SEQ ID NO: 3779172 - RNA, 20 nt, Human
acuccucugacucagggcuc

SEQ ID NO: 3779173 - RNA, 12 nt, Human
acuccucugcag

SEQ ID NO: 3779174 - RNA, 15 nt, Human
acuccucugcgucua

SEQ ID NO: 3779175 - RNA, 20 nt, Human
acuccucugcgucuauccug

SEQ ID NO: 3779176 - RNA, 14 nt, Human
acuccucuuauuug

SEQ ID NO: 3779177 - RNA, 16 nt, Human
acuccucuuauuugcu

SEQ ID NO: 3779178 - RNA, 16 nt, Human
acuccugaccucaggc

SEQ ID NO: 3779179 - RNA, 19 nt, Human
acuccugacgucugaagcu

SEQ ID NO: 3779180 - RNA, 16 nt, Human
acuccugaggacagcu

SEQ ID NO: 3779181 - RNA, 19 nt, Human
acuccugaggacagcuguc

SEQ ID NO: 3779182 - RNA, 15 nt, Human
acuccugcaaaauuu

SEQ ID NO: 3779183 - RNA, 18 nt, Human
acuccugcaaaauuuuau

SEQ ID NO: 3779184 - RNA, 18 nt, Human
acuccugcaggcagccag

SEQ ID NO: 3779185 - RNA, 19 nt, Human
acuccugcaggcagccagg

SEQ ID NO: 3779186 - RNA, 17 nt, Human
acuccugccaaggagga

SEQ ID NO: 3779187 - RNA, 12 nt, Human
acuccuggaaau

SEQ ID NO: 3779188 - RNA, 12 nt, Human
acuccuggccuc

SEQ ID NO: 3779189 - RNA, 16 nt, Human
acuccuggguugagcu

SEQ ID NO: 3779190 - RNA, 23 nt, Human
acuccuggguugagcuguugccu

SEQ ID NO: 3779191 - RNA, 22 nt, Human
acuccugguccuaggcuggaag

SEQ ID NO: 3779192 - RNA, 21 nt, Human
acuccuggucugaaaauguug

SEQ ID NO: 3779193 - RNA, 17 nt, Human
acuccuguacacugaau

SEQ ID NO: 3779194 - RNA, 18 nt, Human
acuccugucuucugcuuu

SEQ ID NO: 3779195 - RNA, 17 nt, Human
acuccugugggagccuc

SEQ ID NO: 3779196 - RNA, 18 nt, Human
acuccugugggagccucg

SEQ ID NO: 3779197 - RNA, 17 nt, Human
acuccuguuacuuaccu

SEQ ID NO: 3779198 - RNA, 12 nt, Human
acuccuuagaga

SEQ ID NO: 3779199 - RNA, 13 nt, Human
acuccuuccuggc

SEQ ID NO: 3779200 - RNA, 17 nt, Human
aauaaaaacuuacacuc

SEQ ID NO: 3779201 - RNA, 23 nt, Human
aauaaaaagaucacuuucucagu

SEQ ID NO: 3779202 - RNA, 13 nt, Human
aauaaaaagcuuu

SEQ ID NO: 3779203 - RNA, 12 nt, Human
aauaaaaaguua

SEQ ID NO: 3779204 - RNA, 12 nt, Human
aauaaaaauaau

SEQ ID NO: 3779205 - RNA, 22 nt, Human
aauaaaaauauuguguugugaa

SEQ ID NO: 3779206 - RNA, 13 nt, Human
aauaaaaauggau

SEQ ID NO: 3779207 - RNA, 14 nt, Human
aauaaaacaaaggg

SEQ ID NO: 3779208 - RNA, 23 nt, Human
aauaaaacauuuuaaauggacag

SEQ ID NO: 3779209 - RNA, 19 nt, Human
aauaaaacauuuucacaca

SEQ ID NO: 3779210 - RNA, 20 nt, Human
aauaaaacccguugauuacu

SEQ ID NO: 3779211 - RNA, 21 nt, Human
aauaaaaccgaaggugaaaaa

SEQ ID NO: 3779212 - RNA, 18 nt, Human
aauaaaacugaugugaaa

SEQ ID NO: 3779213 - RNA, 19 nt, Human
aauaaaacugaugugaaac

SEQ ID NO: 3779214 - RNA, 12 nt, Human
aauaaaacuguc

SEQ ID NO: 3779215 - RNA, 12 nt, Human
aauaaaacuuuu

SEQ ID NO: 3779216 - RNA, 14 nt, Human
aauaaaacuuuuua

SEQ ID NO: 3779217 - RNA, 15 nt, Human
aauaaaagcccagga

SEQ ID NO: 3779218 - RNA, 17 nt, Human
aauaaaagcccaggagc

SEQ ID NO: 3779219 - RNA, 13 nt, Human
aauaaaaggucua

SEQ ID NO: 3779220 - RNA, 20 nt, Human
aauaaaaguuuuacaaaggg

SEQ ID NO: 3779221 - RNA, 16 nt, Human
aauaaaauaauucuaa

SEQ ID NO: 3779222 - RNA, 12 nt, Human
aauaaaauauaa

SEQ ID NO: 3779223 - RNA, 14 nt, Human
aauaaaauauuuuc

SEQ ID NO: 3779224 - RNA, 16 nt, Human
aauaaaauauuuucug

SEQ ID NO: 3779225 - RNA, 17 nt, Human
aauaaaauauuuucugu

SEQ ID NO: 3779226 - RNA, 19 nt, Human
aauaaaauauuuucugugu

SEQ ID NO: 3779227 - RNA, 22 nt, Human
aauaaaauauuuucuguguguu

SEQ ID NO: 3779228 - RNA, 23 nt, Human
aauaaaauauuuucuguguguuc

SEQ ID NO: 3779229 - RNA, 16 nt, Human
aauaaaaucaauuuuu

SEQ ID NO: 3779230 - RNA, 22 nt, Human
aauaaaauccauacauuugugu

SEQ ID NO: 3779231 - RNA, 13 nt, Human
aauaaaauguuua

SEQ ID NO: 3779232 - RNA, 17 nt, Human
aauaaaauuaagaaugu

SEQ ID NO: 3779233 - RNA, 18 nt, Human
aauaaaauucaacaaaca

SEQ ID NO: 3779234 - RNA, 15 nt, Human
aauaaaauugcacuu

SEQ ID NO: 3779235 - RNA, 12 nt, Human
aauaaaauuuaa

SEQ ID NO: 3779236 - RNA, 12 nt, Human
aauaaaauuugu

SEQ ID NO: 3779237 - RNA, 13 nt, Human
aauaaaauuuguu

SEQ ID NO: 3779238 - RNA, 18 nt, Human
aauaaaauuuuuuuucau

SEQ ID NO: 3779239 - RNA, 22 nt, Human
aauaaaauuuuuuuucauguuu

SEQ ID NO: 3779240 - RNA, 13 nt, Human
aauaaacaaauaa

SEQ ID NO: 3779241 - RNA, 15 nt, Human
aauaaacacuacaga

SEQ ID NO: 3779242 - RNA, 11 nt, Human
aauaaacacuc

SEQ ID NO: 3779243 - RNA, 19 nt, Human
aauaaacacucuugaaaaa

SEQ ID NO: 3779244 - RNA, 19 nt, Human
aauaaaccaaugaacgaag

SEQ ID NO: 3779245 - RNA, 10 nt, Human
aauaaaccau

SEQ ID NO: 3779246 - RNA, 17 nt, Human
aauaaaccucaaaaugu

SEQ ID NO: 3779247 - RNA, 12 nt, Human
aauaaacgauuu

SEQ ID NO: 3779248 - RNA, 20 nt, Human
aauaaacuacucuuugauuu

SEQ ID NO: 3779249 - RNA, 17 nt, Human
aauaaacuuagaauaaa

SEQ ID NO: 3779250 - RNA, 22 nt, Human
aauaaacuuagaauaaaauugu

SEQ ID NO: 3779251 - RNA, 15 nt, Human
aauaaacuuuuuuuc

SEQ ID NO: 3779252 - RNA, 17 nt, Human
aauaaacuuuuuuucaa

SEQ ID NO: 3779253 - RNA, 17 nt, Human
aauaaacuuuuuuuuga

SEQ ID NO: 3779254 - RNA, 13 nt, Human
aauaaagaaaaga

SEQ ID NO: 3779255 - RNA, 15 nt, Human
aauaaagaaaagaug

SEQ ID NO: 3779256 - RNA, 13 nt, Human
aauaaagaaauug

SEQ ID NO: 3779257 - RNA, 17 nt, Human
aauaaagaauggaaagc

SEQ ID NO: 3779258 - RNA, 17 nt, Human
aauaaagacaaccauau

SEQ ID NO: 3779259 - RNA, 20 nt, Human
aauaaagacaaccauauuua

SEQ ID NO: 3779260 - RNA, 15 nt, Human
aauaaagcaauuuuc

SEQ ID NO: 3779261 - RNA, 23 nt, Human
aauaaagcaauuuuccuugaagc

SEQ ID NO: 3779262 - RNA, 15 nt, Human
aauaaagcacugagc

SEQ ID NO: 3779263 - RNA, 11 nt, Human
aauaaagcccu

SEQ ID NO: 3779264 - RNA, 15 nt, Human
aauaaagcccuggga

SEQ ID NO: 3779265 - RNA, 18 nt, Human
aauaaagccuucaaacuc

SEQ ID NO: 3779266 - RNA, 17 nt, Human
aauaaagcgaaaaacuc

SEQ ID NO: 3779267 - RNA, 22 nt, Human
aauaaaggacuguaaucuuauu

SEQ ID NO: 3779268 - RNA, 23 nt, Human
aauaaaggcagcuguugucucuu

SEQ ID NO: 3779269 - RNA, 16 nt, Human
aauaaaggcaguuuuc

SEQ ID NO: 3779270 - RNA, 16 nt, Human
aauaaaguaucaugca

SEQ ID NO: 3779271 - RNA, 17 nt, Human
aauaaaguaucaugcau

SEQ ID NO: 3779272 - RNA, 20 nt, Human
aauaaaguauuccaccuuaa

SEQ ID NO: 3779273 - RNA, 13 nt, Human
aauaaaguauuua

SEQ ID NO: 3779274 - RNA, 23 nt, Human
aauaaaguauuuaauuagugcua

SEQ ID NO: 3779275 - RNA, 15 nt, Human
aauaaaguguaacaa

SEQ ID NO: 3779276 - RNA, 16 nt, Human
aauaaaguguuuucag

SEQ ID NO: 3779277 - RNA, 19 nt, Human
aauaaaguucugaguguuu

SEQ ID NO: 3779278 - RNA, 18 nt, Human
aauaaauaaaaacuaauu

SEQ ID NO: 3779279 - RNA, 12 nt, Human
aauaaauaaaug

SEQ ID NO: 3779280 - RNA, 19 nt, Human
aauaaauaaggaaaagcuu

SEQ ID NO: 3779281 - RNA, 16 nt, Human
aauaaauacauucuug

SEQ ID NO: 3779282 - RNA, 21 nt, Human
aauaaauagcuauauccaugu

SEQ ID NO: 3779283 - RNA, 15 nt, Human
aauaaauaguucuuc

SEQ ID NO: 3779284 - RNA, 13 nt, Human
aauaaauauauau

SEQ ID NO: 3779285 - RNA, 14 nt, Human
aauaaauauauaua

SEQ ID NO: 3779286 - RNA, 15 nt, Human
aauaaauauauauaa

SEQ ID NO: 3779287 - RNA, 23 nt, Human
aauaaauauaucuaccccagacu

SEQ ID NO: 3779288 - RNA, 10 nt, Human
aauaaauaug

SEQ ID NO: 3779289 - RNA, 11 nt, Human
aauaaauaugc

SEQ ID NO: 3779290 - RNA, 19 nt, Human
aauaaauaugccucuccuu

SEQ ID NO: 3779291 - RNA, 21 nt, Human
aauaaaucauuaauacucuuc

SEQ ID NO: 3779292 - RNA, 21 nt, Human
aauaaaucauucuuacuaaaa

SEQ ID NO: 3779293 - RNA, 15 nt, Human
aauaaaucugaccca

SEQ ID NO: 3779294 - RNA, 23 nt, Human
aauaaaugaaugucacuucugga

SEQ ID NO: 3779295 - RNA, 14 nt, Human
aauaaaugucacuu

SEQ ID NO: 3779296 - RNA, 19 nt, Human
aauaaaugucacuuuuuga

SEQ ID NO: 3779297 - RNA, 21 nt, Human
aauaaaugugccuucauuuuu

SEQ ID NO: 3779298 - RNA, 20 nt, Human
aauaaauugcuaauguugcu

SEQ ID NO: 3779299 - RNA, 16 nt, Human
aauaaauuguauauuc

SEQ ID NO: 3779300 - RNA, 15 nt, Human
aauaaauuuauauga

SEQ ID NO: 3779301 - RNA, 20 nt, Human
aauaaauuuauuuucuugga

SEQ ID NO: 3779302 - RNA, 13 nt, Human
aauaaauuugacu

SEQ ID NO: 3779303 - RNA, 20 nt, Human
aauaaauuugacuuuucugu

SEQ ID NO: 3779304 - RNA, 14 nt, Human
aauaaauuuugaaa

SEQ ID NO: 3779305 - RNA, 16 nt, Human
aauaaauuuugaaaag

SEQ ID NO: 3779306 - RNA, 18 nt, Human
aauaaauuuugaaaagua

SEQ ID NO: 3779307 - RNA, 14 nt, Human
aauaacaaaaugga

SEQ ID NO: 3779308 - RNA, 15 nt, Human
aauaacuguguacug

SEQ ID NO: 3779309 - RNA, 23 nt, Human
aauaacuuagacucuaguauuua

SEQ ID NO: 3779310 - RNA, 13 nt, Human
aauaacuucaguc

SEQ ID NO: 3779311 - RNA, 21 nt, Human
aauaacuucaguccugcucca

SEQ ID NO: 3779312 - RNA, 12 nt, Human
aauaacuuuuuu

SEQ ID NO: 3779313 - RNA, 12 nt, Human
aauaagaaaaga

SEQ ID NO: 3779314 - RNA, 15 nt, Human
aauaagaauggaaaa

SEQ ID NO: 3779315 - RNA, 17 nt, Human
aauaagacauaacguuu

SEQ ID NO: 3779316 - RNA, 14 nt, Human
aauaagauucuaac

SEQ ID NO: 3779317 - RNA, 14 nt, Human
aauaagcaggaugu

SEQ ID NO: 3779318 - RNA, 17 nt, Human
aauaagcuaguugaaua

SEQ ID NO: 3779319 - RNA, 18 nt, Human
aauaagcuaguugaauac

SEQ ID NO: 3779320 - RNA, 20 nt, Human
aauaagcuauuugauguaau

SEQ ID NO: 3779321 - RNA, 14 nt, Human
aauaagcucuaguu

SEQ ID NO: 3779322 - RNA, 15 nt, Human
aauaagcucuaguuc

SEQ ID NO: 3779323 - RNA, 21 nt, Human
aauaaggcaggcauugaggaa

SEQ ID NO: 3779324 - RNA, 17 nt, Human
aauaaggccuuaauaug

SEQ ID NO: 3779325 - RNA, 13 nt, Human
aauaagguuuuaa

SEQ ID NO: 3779326 - RNA, 22 nt, Human
aauaaguaucacacuguauaua

SEQ ID NO: 3779327 - RNA, 16 nt, Human
aauaaguauuuauaau

SEQ ID NO: 3779328 - RNA, 14 nt, Human
aauaagucaacagu

SEQ ID NO: 3779329 - RNA, 16 nt, Human
aauaagucaacaguaa

SEQ ID NO: 3779330 - RNA, 17 nt, Human
aauaagugccaggaugg

SEQ ID NO: 3779331 - RNA, 21 nt, Human
aauaagugugugguagaaaca

SEQ ID NO: 3779332 - RNA, 23 nt, Human
aauaagugugugguagaaacaaa

SEQ ID NO: 3779333 - RNA, 11 nt, Human
aauaaguuauu

SEQ ID NO: 3779334 - RNA, 20 nt, Human
aauaaguuuuuguuucacag

SEQ ID NO: 3779335 - RNA, 12 nt, Human
aauaauaaauag

SEQ ID NO: 3779336 - RNA, 13 nt, Human
aauaauaaauagu

SEQ ID NO: 3779337 - RNA, 11 nt, Human
aauaauaaauc

SEQ ID NO: 3779338 - RNA, 14 nt, Human
aauaauaaauugca

SEQ ID NO: 3779339 - RNA, 20 nt, Human
aauaauaccucaauguuuga

SEQ ID NO: 3779340 - RNA, 16 nt, Human
aauaauaccuuagaag

SEQ ID NO: 3779341 - RNA, 14 nt, Human
aauaauagacugua

SEQ ID NO: 3779342 - RNA, 17 nt, Human
aauaauauauuuuaaau

SEQ ID NO: 3779343 - RNA, 17 nt, Human
aauaauauauuuucugu

SEQ ID NO: 3779344 - RNA, 19 nt, Human
aauaauauauuuucuguuu

SEQ ID NO: 3779345 - RNA, 15 nt, Human
aauaauaugcauugu

SEQ ID NO: 3779346 - RNA, 20 nt, Human
aauaauauguuuccuucccu

SEQ ID NO: 3779347 - RNA, 14 nt, Human
aauaauauuguugu

SEQ ID NO: 3779348 - RNA, 13 nt, Human
aauaauauuguuu

SEQ ID NO: 3779349 - RNA, 15 nt, Human
aauaaucaagagccu

SEQ ID NO: 3779350 - RNA, 20 nt, Human
aauaaucacgcuuuccugaa

SEQ ID NO: 3779351 - RNA, 21 nt, Human
aauaaucacgcuuuccugaau

SEQ ID NO: 3779352 - RNA, 14 nt, Human
aauaauccugcaaa

SEQ ID NO: 3779353 - RNA, 13 nt, Human
aauaaucggccca

SEQ ID NO: 3779354 - RNA, 14 nt, Human
aauaaucucauugg

SEQ ID NO: 3779355 - RNA, 19 nt, Human
aauaaucuuauuagggaga

SEQ ID NO: 3779356 - RNA, 23 nt, Human
aauaaucuuauuagggagaaaau

SEQ ID NO: 3779357 - RNA, 14 nt, Human
aauaaucuuguuuc

SEQ ID NO: 3779358 - RNA, 16 nt, Human
aauaaugagcuauuaa

SEQ ID NO: 3779359 - RNA, 10 nt, Human
aauaaugcag

SEQ ID NO: 3779360 - RNA, 12 nt, Human
aauaaugcagua

SEQ ID NO: 3779361 - RNA, 19 nt, Human
aauaaugcaguaugguaca

SEQ ID NO: 3779362 - RNA, 22 nt, Human
aauaaugccuuuguaaccacaa

SEQ ID NO: 3779363 - RNA, 12 nt, Human
aauaaugcugca

SEQ ID NO: 3779364 - RNA, 12 nt, Human
aauaaugcuuug

SEQ ID NO: 3779365 - RNA, 18 nt, Human
aauaauggguuucuuuca

SEQ ID NO: 3779366 - RNA, 16 nt, Human
aauaauguaauuguaa

SEQ ID NO: 3779367 - RNA, 11 nt, Human
aauaaugucuc

SEQ ID NO: 3779368 - RNA, 13 nt, Human
aauaaugucucug

SEQ ID NO: 3779369 - RNA, 23 nt, Human
aauaaugucuuguuaauauucuu

SEQ ID NO: 3779370 - RNA, 17 nt, Human
aauaaugugcacugaau

SEQ ID NO: 3779371 - RNA, 16 nt, Human
aauaaugugggaagaa

SEQ ID NO: 3779372 - RNA, 19 nt, Human
aauaauguguaguucaugu

SEQ ID NO: 3779373 - RNA, 12 nt, Human
aauaauguuuca

SEQ ID NO: 3779374 - RNA, 23 nt, Human
aauaauuauaugcuauuucuaua

SEQ ID NO: 3779375 - RNA, 17 nt, Human
aauaauucauauucuuc

SEQ ID NO: 3779376 - RNA, 14 nt, Human
aauaauucuaaauc

SEQ ID NO: 3779377 - RNA, 14 nt, Human
aauaauugguucuu

SEQ ID NO: 3779378 - RNA, 13 nt, Human
aauaauuuauagu

SEQ ID NO: 3779379 - RNA, 13 nt, Human
aauaauuuuaaaa

SEQ ID NO: 3779380 - RNA, 17 nt, Human
aauaauuuuaaaaaugg

SEQ ID NO: 3779381 - RNA, 21 nt, Human
aauaauuuuaagaaaucaaag

SEQ ID NO: 3779382 - RNA, 23 nt, Human
aauaauuuuaugaacugcaugua

SEQ ID NO: 3779383 - RNA, 20 nt, Human
aauaauuuuuauauuugaaa

SEQ ID NO: 3779384 - RNA, 21 nt, Human
aauacaaaaaauuagccgggc

SEQ ID NO: 3779385 - RNA, 18 nt, Human
aauacaaaaaucagccag

SEQ ID NO: 3779386 - RNA, 13 nt, Human
aauacaaaacuuc

SEQ ID NO: 3779387 - RNA, 20 nt, Human
aauacaaacauauuuguuaa

SEQ ID NO: 3779388 - RNA, 21 nt, Human
aauacaaagaaccaagaaaaa

SEQ ID NO: 3779389 - RNA, 17 nt, Human
aauacaaaguuagagaa

SEQ ID NO: 3779390 - RNA, 18 nt, Human
aauacaaauggauuuugg

SEQ ID NO: 3779391 - RNA, 15 nt, Human
aauacaaauugguug

SEQ ID NO: 3779392 - RNA, 22 nt, Human
aauacaagacugccauauuaaa

SEQ ID NO: 3779393 - RNA, 17 nt, Human
aauacaaguuucaucca

SEQ ID NO: 3779394 - RNA, 12 nt, Human
aauacaauaaac

SEQ ID NO: 3779395 - RNA, 12 nt, Human
aauacaauuuug

SEQ ID NO: 3779396 - RNA, 18 nt, Human
aauacaauuuuguuucug

SEQ ID NO: 3779397 - RNA, 20 nt, Human
aauacaauuuuguuucugua

SEQ ID NO: 3779398 - RNA, 15 nt, Human
aauacacaaguaaac

SEQ ID NO: 3779399 - RNA, 17 nt, Human
aauacacaaguaaacau

SEQ ID NO: 3779400 - RNA, 15 nt, Human
aauacacauuugcua

SEQ ID NO: 3779401 - RNA, 16 nt, Human
aauacaccacuacauu

SEQ ID NO: 3779402 - RNA, 18 nt, Human
aauacaccacuacauucu

SEQ ID NO: 3779403 - RNA, 20 nt, Human
aauacaccacuacauucugu

SEQ ID NO: 3779404 - RNA, 21 nt, Human
aauacaccacuacauucuguu

SEQ ID NO: 3779405 - RNA, 20 nt, Human
aauacacuaauuccuuucua

SEQ ID NO: 3779406 - RNA, 17 nt, Human
aauacacuugcccugcu

SEQ ID NO: 3779407 - RNA, 19 nt, Human
aauacagaaauuagccggg

SEQ ID NO: 3779408 - RNA, 13 nt, Human
aauacagaggcaa

SEQ ID NO: 3779409 - RNA, 18 nt, Human
aauacagauaaaugauuc

SEQ ID NO: 3779410 - RNA, 19 nt, Human
aauacagauauauuuucuu

SEQ ID NO: 3779411 - RNA, 15 nt, Human
aauacagcagcaaga

SEQ ID NO: 3779412 - RNA, 16 nt, Human
aauacagcagcaagaa

SEQ ID NO: 3779413 - RNA, 17 nt, Human
aauacagcagcaagaaa

SEQ ID NO: 3779414 - RNA, 13 nt, Human
aauacaggaaaca

SEQ ID NO: 3779415 - RNA, 16 nt, Human
aauacagggcauuuug

SEQ ID NO: 3779416 - RNA, 19 nt, Human
aauacaguaagcugcucua

SEQ ID NO: 3779417 - RNA, 16 nt, Human
aauacaguauucugua

SEQ ID NO: 3779418 - RNA, 17 nt, Human
aauacaguucugucaua

SEQ ID NO: 3779419 - RNA, 15 nt, Human
aauacauacggucag

SEQ ID NO: 3779420 - RNA, 19 nt, Human
aauacauagggauaugcgu

SEQ ID NO: 3779421 - RNA, 18 nt, Human
aauacauauggauguuac

SEQ ID NO: 3779422 - RNA, 17 nt, Human
aauacaugacauuuauu

SEQ ID NO: 3779423 - RNA, 17 nt, Human
aauacaugaugauuuca

SEQ ID NO: 3779424 - RNA, 21 nt, Human
aauacaugcuaagagaaguag

SEQ ID NO: 3779425 - RNA, 14 nt, Human
aauacauuaaagca

SEQ ID NO: 3779426 - RNA, 15 nt, Human
aauacauuaaagcag

SEQ ID NO: 3779427 - RNA, 15 nt, Human
aauacauucugcuuu

SEQ ID NO: 3779428 - RNA, 12 nt, Human
aauacauucuug

SEQ ID NO: 3779429 - RNA, 16 nt, Human
aauacauuuaaaacuu

SEQ ID NO: 3779430 - RNA, 12 nt, Human
aauacauuuuau

SEQ ID NO: 3779431 - RNA, 12 nt, Human
aauaccaaggaa

SEQ ID NO: 3779432 - RNA, 19 nt, Human
aauaccacaucaaauaaga

SEQ ID NO: 3779433 - RNA, 17 nt, Human
aauaccacucuguaauu

SEQ ID NO: 3779434 - RNA, 19 nt, Human
aauaccacucuguaauugc

SEQ ID NO: 3779435 - RNA, 20 nt, Human
aauaccacucuguaauugca

SEQ ID NO: 3779436 - RNA, 16 nt, Human
aauaccagacugcagg

SEQ ID NO: 3779437 - RNA, 20 nt, Human
aauaccagugaaccaaagag

SEQ ID NO: 3779438 - RNA, 18 nt, Human
aauaccaugccauuuaaa

SEQ ID NO: 3779439 - RNA, 20 nt, Human
aauaccauuaaaacugcuuu

SEQ ID NO: 3779440 - RNA, 22 nt, Human
aauaccauuuuuuaaggaaaca

SEQ ID NO: 3779441 - RNA, 23 nt, Human
aauaccauuuuuuaaggaaacaa

SEQ ID NO: 3779442 - RNA, 15 nt, Human
aauaccucaauguuu

SEQ ID NO: 3779443 - RNA, 15 nt, Human
aauaccucaugcuuc

SEQ ID NO: 3779444 - RNA, 15 nt, Human
aauaccucuaauagu

SEQ ID NO: 3779445 - RNA, 16 nt, Human
aauaccucuuagcuga

SEQ ID NO: 3779446 - RNA, 15 nt, Human
aauaccucuuugaaa

SEQ ID NO: 3779447 - RNA, 18 nt, Human
aauaccugaaugcucugu

SEQ ID NO: 3779448 - RNA, 18 nt, Human
aauaccugucccccugac

SEQ ID NO: 3779449 - RNA, 19 nt, Human
aauaccugucccccugaca

SEQ ID NO: 3779450 - RNA, 19 nt, Human
aauaccuuagugcaguuau

SEQ ID NO: 3779451 - RNA, 23 nt, Human
aauacgacacugaaauaugugaa

SEQ ID NO: 3779452 - RNA, 18 nt, Human
aauacgcacuacaugugg

SEQ ID NO: 3779453 - RNA, 20 nt, Human
aauacgugggcauucaaaug

SEQ ID NO: 3779454 - RNA, 13 nt, Human
aauacguuugaua

SEQ ID NO: 3779455 - RNA, 15 nt, Human
aauacuaaaauaugu

SEQ ID NO: 3779456 - RNA, 13 nt, Human
aauacuaaugaaa

SEQ ID NO: 3779457 - RNA, 14 nt, Human
aauacuaccuugaa

SEQ ID NO: 3779458 - RNA, 17 nt, Human
aauacuaguugugaccu

SEQ ID NO: 3779459 - RNA, 21 nt, Human
aauacuauauuuauacuguau

SEQ ID NO: 3779460 - RNA, 19 nt, Human
aauacuauuuaagauguga

SEQ ID NO: 3779461 - RNA, 20 nt, Human
aauacuauuuaagaugugaa

SEQ ID NO: 3779462 - RNA, 20 nt, Human
aauacucaaaugaguaacau

SEQ ID NO: 3779463 - RNA, 15 nt, Human
aauacucauguguau

SEQ ID NO: 3779464 - RNA, 17 nt, Human
aauacucuaauucuaac

SEQ ID NO: 3779465 - RNA, 20 nt, Human
aauacucuacccucuuagaa

SEQ ID NO: 3779466 - RNA, 22 nt, Human
aauacucuacccucuuagaaaa

SEQ ID NO: 3779467 - RNA, 17 nt, Human
aauacucuauuuuuaca

SEQ ID NO: 3779468 - RNA, 14 nt, Human
aauacucuguugua

SEQ ID NO: 3779469 - RNA, 20 nt, Human
aauacugaaccacuuguaga

SEQ ID NO: 3779470 - RNA, 23 nt, Human
aauacugacuccaaccauucaaa

SEQ ID NO: 3779471 - RNA, 11 nt, Human
aauacugcacu

SEQ ID NO: 3779472 - RNA, 16 nt, Human
aauacugccagaugcu

SEQ ID NO: 3779473 - RNA, 13 nt, Human
aauacugcuugaa

SEQ ID NO: 3779474 - RNA, 16 nt, Human
aauacuguguggaacu

SEQ ID NO: 3779475 - RNA, 17 nt, Human
aauacuguuauucuuug

SEQ ID NO: 3779476 - RNA, 19 nt, Human
aauacuguuauucuuugca

SEQ ID NO: 3779477 - RNA, 22 nt, Human
aauacuguuauucuuugcacuu

SEQ ID NO: 3779478 - RNA, 18 nt, Human
aauacuuaaauguuaugu

SEQ ID NO: 3779479 - RNA, 16 nt, Human
aauacuuacauucucu

SEQ ID NO: 3779480 - RNA, 23 nt, Human
aauacuuauucauugugguuauu

SEQ ID NO: 3779481 - RNA, 12 nt, Human
aauacuuccaga

SEQ ID NO: 3779482 - RNA, 17 nt, Human
aauacuucuugugugua

SEQ ID NO: 3779483 - RNA, 14 nt, Human
aauacuugaaccau

SEQ ID NO: 3779484 - RNA, 14 nt, Human
aauacuugaacuug

SEQ ID NO: 3779485 - RNA, 18 nt, Human
aauacuugaacuugccuc

SEQ ID NO: 3779486 - RNA, 19 nt, Human
aauacuugaacuugccucu

SEQ ID NO: 3779487 - RNA, 17 nt, Human
aauacuugucaauauuu

SEQ ID NO: 3779488 - RNA, 15 nt, Human
aauacuuuaaaggaa

SEQ ID NO: 3779489 - RNA, 15 nt, Human
aauacuuugaaugug

SEQ ID NO: 3779490 - RNA, 14 nt, Human
aauagaaaaguuau

SEQ ID NO: 3779491 - RNA, 19 nt, Human
aauagaaaaguuauuagug

SEQ ID NO: 3779492 - RNA, 14 nt, Human
aauagaaaaugguc

SEQ ID NO: 3779493 - RNA, 15 nt, Human
aauagaaaauggucc

SEQ ID NO: 3779494 - RNA, 21 nt, Human
aauagaaacucaccauguaaa

SEQ ID NO: 3779495 - RNA, 16 nt, Human
aauagaaauaaguggu

SEQ ID NO: 3779496 - RNA, 17 nt, Human
aauagaaauggggaacu

SEQ ID NO: 3779497 - RNA, 13 nt, Human
aauagaacacagu

SEQ ID NO: 3779498 - RNA, 22 nt, Human
aauagaacauugauugcugugu

SEQ ID NO: 3779499 - RNA, 22 nt, Human
aauagaagcuaagguuuagaua

SEQ ID NO: 3779500 - RNA, 19 nt, Human
aauagaaggaaacuagcuu

SEQ ID NO: 3779501 - RNA, 22 nt, Human
aauagaaggauguacauuucca

SEQ ID NO: 3779502 - RNA, 18 nt, Human
aauagaagugcuccccuc

SEQ ID NO: 3779503 - RNA, 16 nt, Human
aauagaauguaaaugu

SEQ ID NO: 3779504 - RNA, 15 nt, Human
aauagacaaaaagua

SEQ ID NO: 3779505 - RNA, 23 nt, Human
aauagacacuccccgaagucuuu

SEQ ID NO: 3779506 - RNA, 13 nt, Human
aauagacaucaaa

SEQ ID NO: 3779507 - RNA, 15 nt, Human
aauagagaugagcuu

SEQ ID NO: 3779508 - RNA, 14 nt, Human
aauagagccugagg

SEQ ID NO: 3779509 - RNA, 19 nt, Human
aauagagcuguucaacauc

SEQ ID NO: 3779510 - RNA, 18 nt, Human
aauagauaugaaagcuga

SEQ ID NO: 3779511 - RNA, 16 nt, Human
aauagaugcugacugu

SEQ ID NO: 3779512 - RNA, 12 nt, Human
aauagaugucuu

SEQ ID NO: 3779513 - RNA, 14 nt, Human
aauagaugucuuuu

SEQ ID NO: 3779514 - RNA, 11 nt, Human
aauagauucuc

SEQ ID NO: 3779515 - RNA, 21 nt, Human
aauagauuuuauaagaugacu

SEQ ID NO: 3779516 - RNA, 14 nt, Human
aauagcaaagaauu

SEQ ID NO: 3779517 - RNA, 21 nt, Human
aauagcaaguggcauaaagca

SEQ ID NO: 3779518 - RNA, 16 nt, Human
aauagcaauagcaugg

SEQ ID NO: 3779519 - RNA, 16 nt, Human
aauagcacuuaaauuc

SEQ ID NO: 3779520 - RNA, 19 nt, Human
aauagcacuuucauugcca

SEQ ID NO: 3779521 - RNA, 22 nt, Human
aauagcagcccucaauugugaa

SEQ ID NO: 3779522 - RNA, 12 nt, Human
aauagcaucugu

SEQ ID NO: 3779523 - RNA, 19 nt, Human
aauagcaucuguacaaagg

SEQ ID NO: 3779524 - RNA, 18 nt, Human
aauagcauguauuguguc

SEQ ID NO: 3779525 - RNA, 15 nt, Human
aauagcauguuguag

SEQ ID NO: 3779526 - RNA, 22 nt, Human
aauagccacauuuggaauacuu

SEQ ID NO: 3779527 - RNA, 21 nt, Human
aauagccacuaaccuugccug

SEQ ID NO: 3779528 - RNA, 22 nt, Human
aauagccacuuaccuucaauaa

SEQ ID NO: 3779529 - RNA, 18 nt, Human
aauagccauauuuguaaa

SEQ ID NO: 3779530 - RNA, 22 nt, Human
aauagcgcuguuuuuguugugu

SEQ ID NO: 3779531 - RNA, 18 nt, Human
aauagcgucauaacuaga

SEQ ID NO: 3779532 - RNA, 18 nt, Human
aauagcuaauaauguuaa

SEQ ID NO: 3779533 - RNA, 15 nt, Human
aauagcuauauccau

SEQ ID NO: 3779534 - RNA, 18 nt, Human
aauagcuauauccaugua

SEQ ID NO: 3779535 - RNA, 22 nt, Human
aauagcuauauccauguacugu

SEQ ID NO: 3779536 - RNA, 15 nt, Human
aauagcuuuaaugau

SEQ ID NO: 3779537 - RNA, 21 nt, Human
aauagcuuuacccucaggcau

SEQ ID NO: 3779538 - RNA, 15 nt, Human
aauagcuuuuguguc

SEQ ID NO: 3779539 - RNA, 17 nt, Human
aauaggaaaaacugauu

SEQ ID NO: 3779540 - RNA, 18 nt, Human
aauaggaaaaacugauuu

SEQ ID NO: 3779541 - RNA, 20 nt, Human
aauaggaaucauucagaaau

SEQ ID NO: 3779542 - RNA, 14 nt, Human
aauaggacuuguuu

SEQ ID NO: 3779543 - RNA, 20 nt, Human
aauaggaugggcuucugugc

SEQ ID NO: 3779544 - RNA, 16 nt, Human
aauaggauuuuuagaa

SEQ ID NO: 3779545 - RNA, 13 nt, Human
aauaggcaaaggg

SEQ ID NO: 3779546 - RNA, 18 nt, Human
aauaggcacuuuaaaaca

SEQ ID NO: 3779547 - RNA, 19 nt, Human
aauagggcccaugggaggg

SEQ ID NO: 3779548 - RNA, 20 nt, Human
aauagggcccaugggaggga

SEQ ID NO: 3779549 - RNA, 21 nt, Human
aauagggcugagcucucugug

SEQ ID NO: 3779550 - RNA, 22 nt, Human
aauaguaaaagauaacaagauc

SEQ ID NO: 3779551 - RNA, 13 nt, Human
aauaguagaugug

SEQ ID NO: 3779552 - RNA, 22 nt, Human
aauaguagauguggccuuugaa

SEQ ID NO: 3779553 - RNA, 13 nt, Human
aauaguaggcaag

SEQ ID NO: 3779554 - RNA, 18 nt, Human
aauaguauccuccagguu

SEQ ID NO: 3779555 - RNA, 20 nt, Human
aauaguauccuccagguuuu

SEQ ID NO: 3779556 - RNA, 23 nt, Human
aauaguauccuccagguuuuuca

SEQ ID NO: 3779557 - RNA, 23 nt, Human
aauaguaugaguaaugcuuaagg

SEQ ID NO: 3779558 - RNA, 15 nt, Human
aauaguauuugagag

SEQ ID NO: 3779559 - RNA, 19 nt, Human
acaccugcagauucuagga

SEQ ID NO: 3779560 - RNA, 22 nt, Human
acaccugcccugcccugccacc

SEQ ID NO: 3779561 - RNA, 11 nt, Human
acaccuggccc

SEQ ID NO: 3779562 - RNA, 14 nt, Human
acaccuggcccugg

SEQ ID NO: 3779563 - RNA, 15 nt, Human
acaccuggcccuggg

SEQ ID NO: 3779564 - RNA, 19 nt, Human
acaccuggcccuggggccu

SEQ ID NO: 3779565 - RNA, 20 nt, Human
acaccuggcccuggggccug

SEQ ID NO: 3779566 - RNA, 20 nt, Human
acaccuguagcacuuacugg

SEQ ID NO: 3779567 - RNA, 15 nt, Human
acaccuucauuuuga

SEQ ID NO: 3779568 - RNA, 14 nt, Human
acaccuuccagcuc

SEQ ID NO: 3779569 - RNA, 12 nt, Human
acaccuucuaua

SEQ ID NO: 3779570 - RNA, 18 nt, Human
acaccuucuuauuauaua

SEQ ID NO: 3779571 - RNA, 14 nt, Human
acaccuugacaggg

SEQ ID NO: 3779572 - RNA, 18 nt, Human
acaccuuguuucccucuc

SEQ ID NO: 3779573 - RNA, 18 nt, Human
acaccuuugcaggcaugc

SEQ ID NO: 3779574 - RNA, 15 nt, Human
acaccuuuuaacuca

SEQ ID NO: 3779575 - RNA, 23 nt, Human
acaccuuuuauugacacagaaaa

SEQ ID NO: 3779576 - RNA, 15 nt, Human
acacgaaagagagag

SEQ ID NO: 3779577 - RNA, 18 nt, Human
acacgaauagacaucaaa

SEQ ID NO: 3779578 - RNA, 12 nt, Human
acacgaauauug

SEQ ID NO: 3779579 - RNA, 13 nt, Human
acacgaaucucac

SEQ ID NO: 3779580 - RNA, 21 nt, Human
acacgagcaggcuacugucag

SEQ ID NO: 3779581 - RNA, 14 nt, Human
acacgcacacacac

SEQ ID NO: 3779582 - RNA, 17 nt, Human
acacgcaccugccucag

SEQ ID NO: 3779583 - RNA, 16 nt, Human
acacgcacgcacacac

SEQ ID NO: 3779584 - RNA, 18 nt, Human
acacgcacgcacacacac

SEQ ID NO: 3779585 - RNA, 21 nt, Human
acacgcacggcagccacagcu

SEQ ID NO: 3779586 - RNA, 14 nt, Human
acacgcaggagcac

SEQ ID NO: 3779587 - RNA, 22 nt, Human
acacgccugcaaacgcugccug

SEQ ID NO: 3779588 - RNA, 21 nt, Human
acacgcgggcgcgaucccaca

SEQ ID NO: 3779589 - RNA, 23 nt, Human
acacgcgggcgcgaucccacaca

SEQ ID NO: 3779590 - RNA, 17 nt, Human
acacgcuccuuccucug

SEQ ID NO: 3779591 - RNA, 19 nt, Human
acacgcuccuuccucugag

SEQ ID NO: 3779592 - RNA, 18 nt, Human
acacgcugcucugcccca

SEQ ID NO: 3779593 - RNA, 22 nt, Human
acacgcugcucugccccagcuu

SEQ ID NO: 3779594 - RNA, 12 nt, Human
acacgcuuuugu

SEQ ID NO: 3779595 - RNA, 22 nt, Human
acacggagcccagcccucccca

SEQ ID NO: 3779596 - RNA, 18 nt, Human
acacggaggcaucugcac

SEQ ID NO: 3779597 - RNA, 16 nt, Human
acacggaucugagaau

SEQ ID NO: 3779598 - RNA, 19 nt, Human
acacggaucugagaaucuu

SEQ ID NO: 3779599 - RNA, 20 nt, Human
acacgggagccgcuggcaga

SEQ ID NO: 3779600 - RNA, 19 nt, Human
acacgggcagccuggcucc

SEQ ID NO: 3779601 - RNA, 13 nt, Human
acacgggccuguc

SEQ ID NO: 3779602 - RNA, 20 nt, Human
acacguaaugaaacuuggau

SEQ ID NO: 3779603 - RNA, 22 nt, Human
acacguauuugaauggccuuca

SEQ ID NO: 3779604 - RNA, 17 nt, Human
acacgucugacccucuc

SEQ ID NO: 3779605 - RNA, 19 nt, Human
acacgucugacccucucca

SEQ ID NO: 3779606 - RNA, 13 nt, Human
acacgugagaauc

SEQ ID NO: 3779607 - RNA, 16 nt, Human
acacgugagaaucccu

SEQ ID NO: 3779608 - RNA, 21 nt, Human
acacgugagaaucccuggcaa

SEQ ID NO: 3779609 - RNA, 22 nt, Human
acacguggaggaaugcuccccc

SEQ ID NO: 3779610 - RNA, 23 nt, Human
acacguggccaagagaaacuucc

SEQ ID NO: 3779611 - RNA, 16 nt, Human
acacgugggcuccccu

SEQ ID NO: 3779612 - RNA, 19 nt, Human
acacgugggcuccccucuu

SEQ ID NO: 3779613 - RNA, 14 nt, Human
acacguuuuaagga

SEQ ID NO: 3779614 - RNA, 17 nt, Human
acacguuuuaaggacug

SEQ ID NO: 3779615 - RNA, 14 nt, Human
acacuaaaaauaaa

SEQ ID NO: 3779616 - RNA, 18 nt, Human
acacuaaaauuuuaggca

SEQ ID NO: 3779617 - RNA, 15 nt, Human
acacuaaauguuaaa

SEQ ID NO: 3779618 - RNA, 19 nt, Human
acacuaaauguuaaagaug

SEQ ID NO: 3779619 - RNA, 20 nt, Human
acacuaaauguuaaagaugu

SEQ ID NO: 3779620 - RNA, 21 nt, Human
acacuaaauguuaaagaugua

SEQ ID NO: 3779621 - RNA, 23 nt, Human
acacuaaccaagcugaguuuccu

SEQ ID NO: 3779622 - RNA, 16 nt, Human
acacuaacgaaauauc

SEQ ID NO: 3779623 - RNA, 21 nt, Human
acacuaacgaaauaucaaagu

SEQ ID NO: 3779624 - RNA, 19 nt, Human
acacuaacucaccagcccc

SEQ ID NO: 3779625 - RNA, 14 nt, Human
acacuaagggugua

SEQ ID NO: 3779626 - RNA, 17 nt, Human
acacuaauauauuuaaa

SEQ ID NO: 3779627 - RNA, 20 nt, Human
acacuaauauauuuaaaaau

SEQ ID NO: 3779628 - RNA, 15 nt, Human
acacuaaugaggaaa

SEQ ID NO: 3779629 - RNA, 23 nt, Human
acacuaauuccuuucuauccuac

SEQ ID NO: 3779630 - RNA, 17 nt, Human
acacuacacacugugua

SEQ ID NO: 3779631 - RNA, 15 nt, Human
acacuacaccacaca

SEQ ID NO: 3779632 - RNA, 17 nt, Human
acacuacaccacacaca

SEQ ID NO: 3779633 - RNA, 15 nt, Human
acacuacacccagca

SEQ ID NO: 3779634 - RNA, 16 nt, Human
acacuaccgaaugugu

SEQ ID NO: 3779635 - RNA, 18 nt, Human
acacuaccgaaugugucu

SEQ ID NO: 3779636 - RNA, 19 nt, Human
acacuaccgaaugugucuu

SEQ ID NO: 3779637 - RNA, 14 nt, Human
acacuacugagaau

SEQ ID NO: 3779638 - RNA, 19 nt, Human
acacuagccagacacucug

SEQ ID NO: 3779639 - RNA, 17 nt, Human
acacuagcccaaugaaa

SEQ ID NO: 3779640 - RNA, 19 nt, Human
acacuaguuuugugccagc

SEQ ID NO: 3779641 - RNA, 18 nt, Human
acacuauuaccaugagaa

SEQ ID NO: 3779642 - RNA, 14 nt, Human
acacuauuuuaugc

SEQ ID NO: 3779643 - RNA, 14 nt, Human
acacuauuuucaga

SEQ ID NO: 3779644 - RNA, 15 nt, Human
acacuauuuucagaa

SEQ ID NO: 3779645 - RNA, 16 nt, Human
acacucaaaagcuggg

SEQ ID NO: 3779646 - RNA, 13 nt, Human
acacucaaaucaa

SEQ ID NO: 3779647 - RNA, 16 nt, Human
acacucacuccugaga

SEQ ID NO: 3779648 - RNA, 15 nt, Human
acacucaugcugaaa

SEQ ID NO: 3779649 - RNA, 17 nt, Human
acacucauugaccugag

SEQ ID NO: 3779650 - RNA, 16 nt, Human
acacuccaauuaagga

SEQ ID NO: 3779651 - RNA, 21 nt, Human
acacuccaauuaaggauuuua

SEQ ID NO: 3779652 - RNA, 17 nt, Human
acacuccagccugagca

SEQ ID NO: 3779653 - RNA, 15 nt, Human
acacuccagccuggg

SEQ ID NO: 3779654 - RNA, 13 nt, Human
acacuccagugcc

SEQ ID NO: 3779655 - RNA, 14 nt, Human
acacuccaucagcu

SEQ ID NO: 3779656 - RNA, 13 nt, Human
acacuccuugcau

SEQ ID NO: 3779657 - RNA, 14 nt, Human
acacuccuugcauc

SEQ ID NO: 3779658 - RNA, 23 nt, Human
acacucgcccgcccacuguccug

SEQ ID NO: 3779659 - RNA, 24 nt, Human
acacucgcccgcccacuguccugg

SEQ ID NO: 3779660 - RNA, 17 nt, Human
acacucguaugauacuu

SEQ ID NO: 3779661 - RNA, 13 nt, Human
acacucuccuggg

SEQ ID NO: 3779662 - RNA, 15 nt, Human
acacucuccugggcc

SEQ ID NO: 3779663 - RNA, 16 nt, Human
acacucuccugggccc

SEQ ID NO: 3779664 - RNA, 19 nt, Human
acacucuccugggccccuc

SEQ ID NO: 3779665 - RNA, 14 nt, Human
acacucucuggaag

SEQ ID NO: 3779666 - RNA, 13 nt, Human
acacucuguaauu

SEQ ID NO: 3779667 - RNA, 16 nt, Human
acacugaaaaauuaua

SEQ ID NO: 3779668 - RNA, 13 nt, Human
acacugaaaguuu

SEQ ID NO: 3779669 - RNA, 17 nt, Human
acacugaaauauacaca

SEQ ID NO: 3779670 - RNA, 14 nt, Human
acacugaaaugccu

SEQ ID NO: 3779671 - RNA, 15 nt, Human
acacugaaaugccuu

SEQ ID NO: 3779672 - RNA, 19 nt, Human
acacugaaguuaacagaga

SEQ ID NO: 3779673 - RNA, 21 nt, Human
acacugaauuuuuauguguga

SEQ ID NO: 3779674 - RNA, 19 nt, Human
acacugguucucaaugaaa

SEQ ID NO: 3779675 - RNA, 20 nt, Human
acacuguauguuauagaacu

SEQ ID NO: 3779676 - RNA, 17 nt, Human
acacugucaugcuucau

SEQ ID NO: 3779677 - RNA, 21 nt, Human
acacugugacaucucuauucc

SEQ ID NO: 3779678 - RNA, 22 nt, Human
acacugugcccagcccggaccu

SEQ ID NO: 3779679 - RNA, 12 nt, Human
acacugugcccu

SEQ ID NO: 3779680 - RNA, 17 nt, Human
acacugugcccuggugg

SEQ ID NO: 3779681 - RNA, 18 nt, Human
acacugugcccuggugga

SEQ ID NO: 3779682 - RNA, 14 nt, Human
acacugugcuuucu

SEQ ID NO: 3779683 - RNA, 15 nt, Human
acacugugcuuucua

SEQ ID NO: 3779684 - RNA, 19 nt, Human
acacugugggugugugacu

SEQ ID NO: 3779685 - RNA, 18 nt, Human
acacugugguagguguuu

SEQ ID NO: 3779686 - RNA, 23 nt, Human
acacuguguaaauacccauaugu

SEQ ID NO: 3779687 - RNA, 19 nt, Human
acacuguuagaacacuauu

SEQ ID NO: 3779688 - RNA, 15 nt, Human
acacuguuauuuuca

SEQ ID NO: 3779689 - RNA, 16 nt, Human
acacuguucucugccc

SEQ ID NO: 3779690 - RNA, 17 nt, Human
acacuguucucugcccu

SEQ ID NO: 3779691 - RNA, 18 nt, Human
acacuguucuuagcucaa

SEQ ID NO: 3779692 - RNA, 16 nt, Human
acacuguuguuuaguu

SEQ ID NO: 3779693 - RNA, 21 nt, Human
acacuguuuacaagaaaaaau

SEQ ID NO: 3779694 - RNA, 23 nt, Human
acacuguuuacaagaaaaaauga

SEQ ID NO: 3779695 - RNA, 15 nt, Human
acacuguuucaaacu

SEQ ID NO: 3779696 - RNA, 20 nt, Human
acacuguuucaaacuuuacu

SEQ ID NO: 3779697 - RNA, 23 nt, Human
acacuguuucaaacuuuacuaug

SEQ ID NO: 3779698 - RNA, 18 nt, Human
acacuuacacuuuaugca

SEQ ID NO: 3779699 - RNA, 18 nt, Human
acacuuaccccauggcug

SEQ ID NO: 3779700 - RNA, 17 nt, Human
acacuuacuguaagaca

SEQ ID NO: 3779701 - RNA, 14 nt, Human
acacuuacuguugu

SEQ ID NO: 3779702 - RNA, 15 nt, Human
acacuuagcuggaga

SEQ ID NO: 3779703 - RNA, 14 nt, Human
acacuuauaaguga

SEQ ID NO: 3779704 - RNA, 14 nt, Human
acacuuauugcuuu

SEQ ID NO: 3779705 - RNA, 20 nt, Human
acacuuauugcuuugaaacu

SEQ ID NO: 3779706 - RNA, 17 nt, Human
acacuucagagagcugg

SEQ ID NO: 3779707 - RNA, 18 nt, Human
acacuucaggcucuucuc

SEQ ID NO: 3779708 - RNA, 17 nt, Human
acacuucaguuaucuug

SEQ ID NO: 3779709 - RNA, 21 nt, Human
acacuuccaccagccugcacu

SEQ ID NO: 3779710 - RNA, 11 nt, Human
acacuucccug

SEQ ID NO: 3779711 - RNA, 14 nt, Human
acacuuccugccua

SEQ ID NO: 3779712 - RNA, 13 nt, Human
acacuuccugucc

SEQ ID NO: 3779713 - RNA, 22 nt, Human
acacuucucaggacacaggccu

SEQ ID NO: 3779714 - RNA, 23 nt, Human
acacuucucaggacacaggccug

SEQ ID NO: 3779715 - RNA, 14 nt, Human
acacuucuguccug

SEQ ID NO: 3779716 - RNA, 20 nt, Human
acacuucugugagaccccca

SEQ ID NO: 3779717 - RNA, 22 nt, Human
acacuucuucuuggucuuauuu

SEQ ID NO: 3779718 - RNA, 13 nt, Human
acacuugcccugc

SEQ ID NO: 3779719 - RNA, 15 nt, Human
acacuugcccugcuc

SEQ ID NO: 3779720 - RNA, 22 nt, Human
acacuuggcccaaguggcagag

SEQ ID NO: 3779721 - RNA, 20 nt, Human
acacuuggggagauuugcca

SEQ ID NO: 3779722 - RNA, 18 nt, Human
acacuuggugcugggaac

SEQ ID NO: 3779723 - RNA, 19 nt, Human
acacuuggugcugggaacc

SEQ ID NO: 3779724 - RNA, 17 nt, Human
acacuugguuggguccu

SEQ ID NO: 3779725 - RNA, 21 nt, Human
acacuuguaauuuuguaucuu

SEQ ID NO: 3779726 - RNA, 12 nt, Human
acacuugugaau

SEQ ID NO: 3779727 - RNA, 14 nt, Human
acacuugugacuuu

SEQ ID NO: 3779728 - RNA, 20 nt, Human
acacuugugacuuuugcuuu

SEQ ID NO: 3779729 - RNA, 22 nt, Human
acacuugugauuauaaaauuaa

SEQ ID NO: 3779730 - RNA, 13 nt, Human
acacuugugugug

SEQ ID NO: 3779731 - RNA, 16 nt, Human
acacuugugugugggc

SEQ ID NO: 3779732 - RNA, 23 nt, Human
acacuugugugugggcugugagu

SEQ ID NO: 3779733 - RNA, 19 nt, Human
acacuuguuccagcucuuu

SEQ ID NO: 3779734 - RNA, 21 nt, Human
acacuuuaugccggaugugcu

SEQ ID NO: 3779735 - RNA, 22 nt, Human
acacuuuaugccggaugugcuu

SEQ ID NO: 3779736 - RNA, 21 nt, Human
acacuuugaaauguguuucug

SEQ ID NO: 3779737 - RNA, 17 nt, Human
acacuuuggcccagggu

SEQ ID NO: 3779738 - RNA, 18 nt, Human
acacuuuggcccagggug

SEQ ID NO: 3779739 - RNA, 19 nt, Human
acacuuuucaccuccuuca

SEQ ID NO: 3779740 - RNA, 13 nt, Human
acacuuuugguua

SEQ ID NO: 3779741 - RNA, 21 nt, Human
acacuuuuucuuuacaaacaa

SEQ ID NO: 3779742 - RNA, 14 nt, Human
acagaaaaaaaaca

SEQ ID NO: 3779743 - RNA, 11 nt, Human
acagaaaaacc

SEQ ID NO: 3779744 - RNA, 12 nt, Human
acagaaaacaac

SEQ ID NO: 3779745 - RNA, 21 nt, Human
acagaaaauauacuguaaaga

SEQ ID NO: 3779746 - RNA, 17 nt, Human
acagaaaauucuucucc

SEQ ID NO: 3779747 - RNA, 12 nt, Human
acagaaacacug

SEQ ID NO: 3779748 - RNA, 18 nt, Human
acagaaacacugccuuuu

SEQ ID NO: 3779749 - RNA, 14 nt, Human
acagaaacauuuuc

SEQ ID NO: 3779750 - RNA, 11 nt, Human
acagaaagaga

SEQ ID NO: 3779751 - RNA, 16 nt, Human
acagaaagagagcacu

SEQ ID NO: 3779752 - RNA, 18 nt, Human
acagaaagagagcacuga

SEQ ID NO: 3779753 - RNA, 16 nt, Human
acagaaagguuuucuu

SEQ ID NO: 3779754 - RNA, 22 nt, Human
acagaaagucauuccuucuuuu

SEQ ID NO: 3779755 - RNA, 13 nt, Human
acagaaauacuau

SEQ ID NO: 3779756 - RNA, 17 nt, Human
acagaaauauaauaaaa

SEQ ID NO: 3779757 - RNA, 14 nt, Human
acagaaauauauau

SEQ ID NO: 3779758 - RNA, 19 nt, Human
acagaaauauauauacaua

SEQ ID NO: 3779759 - RNA, 24 nt, Human
acagaaaugauuacuaaggaagau

SEQ ID NO: 3779760 - RNA, 15 nt, Human
acagaaaugcugcug

SEQ ID NO: 3779761 - RNA, 19 nt, Human
acagaaaugcugcuggcca

SEQ ID NO: 3779762 - RNA, 21 nt, Human
acagaaaugcugcuggccaaa

SEQ ID NO: 3779763 - RNA, 17 nt, Human
acagaaauggaaagcag

SEQ ID NO: 3779764 - RNA, 19 nt, Human
acagaaauggggaauucuc

SEQ ID NO: 3779765 - RNA, 22 nt, Human
acagaaauggggaauucucuaa

SEQ ID NO: 3779766 - RNA, 13 nt, Human
acagaaauguaca

SEQ ID NO: 3779767 - RNA, 17 nt, Human
acagaaauuagccgggc

SEQ ID NO: 3779768 - RNA, 21 nt, Human
acagaacacauaauucaggaa

SEQ ID NO: 3779769 - RNA, 13 nt, Human
acagaacacuaaa

SEQ ID NO: 3779770 - RNA, 12 nt, Human
acagaacacuua

SEQ ID NO: 3779771 - RNA, 14 nt, Human
acagaacagcuuca

SEQ ID NO: 3779772 - RNA, 13 nt, Human
acagaacaggguc

SEQ ID NO: 3779773 - RNA, 16 nt, Human
acagaacaugcuguua

SEQ ID NO: 3779774 - RNA, 16 nt, Human
acagaaccuuguuauu

SEQ ID NO: 3779775 - RNA, 19 nt, Human
acagaaccuuguuauuucu

SEQ ID NO: 3779776 - RNA, 15 nt, Human
acagaacuaaauguu

SEQ ID NO: 3779777 - RNA, 17 nt, Human
acagaacuugaaugugu

SEQ ID NO: 3779778 - RNA, 20 nt, Human
acagaacuugaaugugucag

SEQ ID NO: 3779779 - RNA, 12 nt, Human
acagaagaaaca

SEQ ID NO: 3779780 - RNA, 16 nt, Human
acagaagaaggcagca

SEQ ID NO: 3779781 - RNA, 18 nt, Human
acagaagcacaugcaccu

SEQ ID NO: 3779782 - RNA, 22 nt, Human
acagcaaacaggugcuaauuug

SEQ ID NO: 3779783 - RNA, 15 nt, Human
acagcaaaccaagag

SEQ ID NO: 3779784 - RNA, 16 nt, Human
acagcaaaccaagaga

SEQ ID NO: 3779785 - RNA, 18 nt, Human
acagcaaaccaagagauu

SEQ ID NO: 3779786 - RNA, 23 nt, Human
acagcaaaccaagagauugcuaa

SEQ ID NO: 3779787 - RNA, 16 nt, Human
acagcaaaugcaaaaa

SEQ ID NO: 3779788 - RNA, 17 nt, Human
acagcaaggaggcuggc

SEQ ID NO: 3779789 - RNA, 18 nt, Human
acagcaaggaggcuggcu

SEQ ID NO: 3779790 - RNA, 19 nt, Human
acagcaaggaggcuggcug

SEQ ID NO: 3779791 - RNA, 21 nt, Human
acagcaaguagauaaauauuu

SEQ ID NO: 3779792 - RNA, 16 nt, Human
acagcaagucaggguu

SEQ ID NO: 3779793 - RNA, 16 nt, Human
acagcaagugugaaua

SEQ ID NO: 3779794 - RNA, 15 nt, Human
acagcaauuccucag

SEQ ID NO: 3779795 - RNA, 15 nt, Human
acagcacagagaaga

SEQ ID NO: 3779796 - RNA, 13 nt, Human
acagcacuacucu

SEQ ID NO: 3779797 - RNA, 14 nt, Human
acagcacuacucug

SEQ ID NO: 3779798 - RNA, 17 nt, Human
acagcacuacucugugc

SEQ ID NO: 3779799 - RNA, 16 nt, Human
acagcacuacugggug

SEQ ID NO: 3779800 - RNA, 17 nt, Human
acagcacuacugggugu

SEQ ID NO: 3779801 - RNA, 20 nt, Human
acagcacuggcucucuccag

SEQ ID NO: 3779802 - RNA, 15 nt, Human
acagcagcaagaaaa

SEQ ID NO: 3779803 - RNA, 13 nt, Human
acagcagcaucuc

SEQ ID NO: 3779804 - RNA, 13 nt, Human
acagcagcauuuu

SEQ ID NO: 3779805 - RNA, 19 nt, Human
acagcagcauuuuuauuuc

SEQ ID NO: 3779806 - RNA, 17 nt, Human
acagcagccccugcaca

SEQ ID NO: 3779807 - RNA, 18 nt, Human
acagcagccugcuuccca

SEQ ID NO: 3779808 - RNA, 19 nt, Human
acagcagccugcuucccac

SEQ ID NO: 3779809 - RNA, 22 nt, Human
acagcagccuggggcuggccuc

SEQ ID NO: 3779810 - RNA, 19 nt, Human
acagcaggcccaccuaccu

SEQ ID NO: 3779811 - RNA, 18 nt, Human
acagcaggcugccagugc

SEQ ID NO: 3779812 - RNA, 22 nt, Human
acagcaggguagucugguuucu

SEQ ID NO: 3779813 - RNA, 18 nt, Human
acagcagguccuccaucc

SEQ ID NO: 3779814 - RNA, 13 nt, Human
acagcaguguucc

SEQ ID NO: 3779815 - RNA, 22 nt, Human
acagcauaacaagguccaagau

SEQ ID NO: 3779816 - RNA, 17 nt, Human
acagcaucauuuugcau

SEQ ID NO: 3779817 - RNA, 11 nt, Human
acagcaucucc

SEQ ID NO: 3779818 - RNA, 22 nt, Human
acagcaucuccaagcagcuuag

SEQ ID NO: 3779819 - RNA, 16 nt, Human
acagcauggcacuccc

SEQ ID NO: 3779820 - RNA, 12 nt, Human
acagcaugugcc

SEQ ID NO: 3779821 - RNA, 20 nt, Human
acagcaugugcccuccugag

SEQ ID NO: 3779822 - RNA, 16 nt, Human
acagcauguguuaauc

SEQ ID NO: 3779823 - RNA, 11 nt, Human
acagcauugcu

SEQ ID NO: 3779824 - RNA, 15 nt, Human
acagcauugcuuucu

SEQ ID NO: 3779825 - RNA, 18 nt, Human
acagcauugcuuucugaa

SEQ ID NO: 3779826 - RNA, 22 nt, Human
acagcauugcuuucugaaauua

SEQ ID NO: 3779827 - RNA, 15 nt, Human
acagcauuuuccucu

SEQ ID NO: 3779828 - RNA, 19 nt, Human
acagcauuuuccucugcuu

SEQ ID NO: 3779829 - RNA, 22 nt, Human
acagccaacacgcaccugccuc

SEQ ID NO: 3779830 - RNA, 16 nt, Human
acagccaacuagcccc

SEQ ID NO: 3779831 - RNA, 17 nt, Human
acagccaacuagccccu

SEQ ID NO: 3779832 - RNA, 19 nt, Human
acagccaacuagccccugg

SEQ ID NO: 3779833 - RNA, 20 nt, Human
acagccaacuagccccuggg

SEQ ID NO: 3779834 - RNA, 18 nt, Human
acagccaagugccaaaug

SEQ ID NO: 3779835 - RNA, 11 nt, Human
acagccacaca

SEQ ID NO: 3779836 - RNA, 13 nt, Human
acagccacacaca

SEQ ID NO: 3779837 - RNA, 21 nt, Human
acagccacacacacagaaaau

SEQ ID NO: 3779838 - RNA, 18 nt, Human
acagccacggccaggcca

SEQ ID NO: 3779839 - RNA, 14 nt, Human
acagccacucagaa

SEQ ID NO: 3779840 - RNA, 15 nt, Human
acagccaggugccuu

SEQ ID NO: 3779841 - RNA, 21 nt, Human
acagccagugggagauguuag

SEQ ID NO: 3779842 - RNA, 16 nt, Human
acagccaucccagccu

SEQ ID NO: 3779843 - RNA, 19 nt, Human
acagccaucccagccuugg

SEQ ID NO: 3779844 - RNA, 16 nt, Human
acagccaugcccgcau

SEQ ID NO: 3779845 - RNA, 17 nt, Human
acagcccaaagaaggaa

SEQ ID NO: 3779846 - RNA, 15 nt, Human
acagcccacguccug

SEQ ID NO: 3779847 - RNA, 17 nt, Human
acagcccacguccuguc

SEQ ID NO: 3779848 - RNA, 19 nt, Human
acagcccacguccugucag

SEQ ID NO: 3779849 - RNA, 20 nt, Human
acagcccacguccugucagu

SEQ ID NO: 3779850 - RNA, 18 nt, Human
acagcccagagccuggcu

SEQ ID NO: 3779851 - RNA, 17 nt, Human
acagcccagccacggac

SEQ ID NO: 3779852 - RNA, 20 nt, Human
acagcccaggccuccagcuc

SEQ ID NO: 3779853 - RNA, 21 nt, Human
acagcccaggccuccagcuca

SEQ ID NO: 3779854 - RNA, 12 nt, Human
acagccccaccc

SEQ ID NO: 3779855 - RNA, 13 nt, Human
acagccccagagc

SEQ ID NO: 3779856 - RNA, 14 nt, Human
acagccccagagca

SEQ ID NO: 3779857 - RNA, 15 nt, Human
acagccccagagcag

SEQ ID NO: 3779858 - RNA, 15 nt, Human
acagcccccucugcc

SEQ ID NO: 3779859 - RNA, 14 nt, Human
acagccccuccucc

SEQ ID NO: 3779860 - RNA, 16 nt, Human
acagccccuccuccau

SEQ ID NO: 3779861 - RNA, 22 nt, Human
acagcccgcaugcagcagcuug

SEQ ID NO: 3779862 - RNA, 18 nt, Human
acagcccgggcucugccu

SEQ ID NO: 3779863 - RNA, 23 nt, Human
acagcccgggcucugccucccau

SEQ ID NO: 3779864 - RNA, 15 nt, Human
acagcccuauuucuu

SEQ ID NO: 3779865 - RNA, 23 nt, Human
acagcccuccaucuaaacugccc

SEQ ID NO: 3779866 - RNA, 15 nt, Human
acagcccucccgccc

SEQ ID NO: 3779867 - RNA, 18 nt, Human
acagcccucccgccccuu

SEQ ID NO: 3779868 - RNA, 22 nt, Human
acagcccucccgccccuucccc

SEQ ID NO: 3779869 - RNA, 13 nt, Human
acagcccugucag

SEQ ID NO: 3779870 - RNA, 14 nt, Human
acagcccugucagc

SEQ ID NO: 3779871 - RNA, 17 nt, Human
acagcccugucagcaug

SEQ ID NO: 3779872 - RNA, 18 nt, Human
acagcccugucagcauga

SEQ ID NO: 3779873 - RNA, 19 nt, Human
acagcccugucagcaugaa

SEQ ID NO: 3779874 - RNA, 21 nt, Human
acagcccugucagcaugaauu

SEQ ID NO: 3779875 - RNA, 22 nt, Human
acagcccugucagcaugaauuu

SEQ ID NO: 3779876 - RNA, 22 nt, Human
acagcccuuaugcgguuaauuu

SEQ ID NO: 3779877 - RNA, 14 nt, Human
acagccgcuccaga

SEQ ID NO: 3779878 - RNA, 14 nt, Human
acagccgcuccugu

SEQ ID NO: 3779879 - RNA, 20 nt, Human
acagccgcuccugucugcca

SEQ ID NO: 3779880 - RNA, 19 nt, Human
acagccgucagccaaaugu

SEQ ID NO: 3779881 - RNA, 23 nt, Human
acagccucacuuggucugccagg

SEQ ID NO: 3779882 - RNA, 15 nt, Human
acagccuccccugcc

SEQ ID NO: 3779883 - RNA, 21 nt, Human
acagccuccccugccagggca

SEQ ID NO: 3779884 - RNA, 22 nt, Human
acagccuccccugccagggcag

SEQ ID NO: 3779885 - RNA, 23 nt, Human
acagccuccucugucugcccuuc

SEQ ID NO: 3779886 - RNA, 12 nt, Human
acagccucugac

SEQ ID NO: 3779887 - RNA, 23 nt, Human
acagccucugaccccuccucacu

SEQ ID NO: 3779888 - RNA, 13 nt, Human
acagccucugacu

SEQ ID NO: 3779889 - RNA, 21 nt, Human
acagccugacaacauuucuau

SEQ ID NO: 3779890 - RNA, 22 nt, Human
acagccugagucaccugcagaa

SEQ ID NO: 3779891 - RNA, 14 nt, Human
acagccuggcacag

SEQ ID NO: 3779892 - RNA, 21 nt, Human
acagccuggucgccuuccacc

SEQ ID NO: 3779893 - RNA, 18 nt, Human
acagccugugucuuuaaa

SEQ ID NO: 3779894 - RNA, 14 nt, Human
acagcgacauagcc

SEQ ID NO: 3779895 - RNA, 14 nt, Human
acagcgagaggcag

SEQ ID NO: 3779896 - RNA, 15 nt, Human
acagcgagaggcaga

SEQ ID NO: 3779897 - RNA, 15 nt, Human
acagcgccagccuca

SEQ ID NO: 3779898 - RNA, 13 nt, Human
acagcggccccug

SEQ ID NO: 3779899 - RNA, 19 nt, Human
acagcggccccugcauccc

SEQ ID NO: 3779900 - RNA, 19 nt, Human
acagcggcuggacuuggag

SEQ ID NO: 3779901 - RNA, 21 nt, Human
acagcggcuggacuuggaggu

SEQ ID NO: 3779902 - RNA, 19 nt, Human
acagcgucccuagcaguga

SEQ ID NO: 3779903 - RNA, 13 nt, Human
acagcguuccuag

SEQ ID NO: 3779904 - RNA, 15 nt, Human
acagcuaacauggaa

SEQ ID NO: 3779905 - RNA, 17 nt, Human
acagcuaacauggaagu

SEQ ID NO: 3779906 - RNA, 14 nt, Human
acagcuacaacagc

SEQ ID NO: 3779907 - RNA, 21 nt, Human
acagcuacuugguuuguguuc

SEQ ID NO: 3779908 - RNA, 19 nt, Human
acagcucaggaggcgcccu

SEQ ID NO: 3779909 - RNA, 21 nt, Human
acagcucaguucuagucucuc

SEQ ID NO: 3779910 - RNA, 17 nt, Human
acagcucauuaaacuuu

SEQ ID NO: 3779911 - RNA, 17 nt, Human
acagcuccacccuggcc

SEQ ID NO: 3779912 - RNA, 15 nt, Human
acagcucccacccca

SEQ ID NO: 3779913 - RNA, 14 nt, Human
acagcuccccaagu

SEQ ID NO: 3779914 - RNA, 16 nt, Human
acagcucccccagcuc

SEQ ID NO: 3779915 - RNA, 12 nt, Human
acagcuccuccc

SEQ ID NO: 3779916 - RNA, 16 nt, Human
acagcuccuucugucc

SEQ ID NO: 3779917 - RNA, 15 nt, Human
acagcuccuugggag

SEQ ID NO: 3779918 - RNA, 17 nt, Human
acagcuccuugggagga

SEQ ID NO: 3779919 - RNA, 19 nt, Human
acagcuccuugggaggaag

SEQ ID NO: 3779920 - RNA, 21 nt, Human
acagcuccuugggaggaagca

SEQ ID NO: 3779921 - RNA, 15 nt, Human
acagcuccuuuucca

SEQ ID NO: 3779922 - RNA, 13 nt, Human
acagcucuagaca

SEQ ID NO: 3779923 - RNA, 20 nt, Human
acagcucugcauacucauua

SEQ ID NO: 3779924 - RNA, 13 nt, Human
acagcucuguccu

SEQ ID NO: 3779925 - RNA, 16 nt, Human
acagcucuguccuggg

SEQ ID NO: 3779926 - RNA, 20 nt, Human
acagcucuguguugccaugu

SEQ ID NO: 3779927 - RNA, 17 nt, Human
acagcucuucuccaggc

SEQ ID NO: 3779928 - RNA, 15 nt, Human
acagcugagagacuu

SEQ ID NO: 3779929 - RNA, 16 nt, Human
acagcugagagacuuu

SEQ ID NO: 3779930 - RNA, 22 nt, Human
acagcugagagacuuuuaauca

SEQ ID NO: 3779931 - RNA, 23 nt, Human
acagcugagcacauucuggcuca

SEQ ID NO: 3779932 - RNA, 20 nt, Human
acauguccagcaccuugugc

SEQ ID NO: 3779933 - RNA, 21 nt, Human
acauguccuuguguguuuuga

SEQ ID NO: 3779934 - RNA, 18 nt, Human
acaugucuccuauccugg

SEQ ID NO: 3779935 - RNA, 17 nt, Human
acaugucuguucuacau

SEQ ID NO: 3779936 - RNA, 12 nt, Human
acaugucuuaau

SEQ ID NO: 3779937 - RNA, 22 nt, Human
acaugucuuaaugaaguuugaa

SEQ ID NO: 3779938 - RNA, 14 nt, Human
acaugugaaaagaa

SEQ ID NO: 3779939 - RNA, 17 nt, Human
acaugugaaaagaauag

SEQ ID NO: 3779940 - RNA, 17 nt, Human
acaugugaaaccuuuuu

SEQ ID NO: 3779941 - RNA, 20 nt, Human
acaugugaaaccuuuuuuaa

SEQ ID NO: 3779942 - RNA, 21 nt, Human
acaugugaaaccuuuuuuaag

SEQ ID NO: 3779943 - RNA, 23 nt, Human
acaugugaaaccuuuuuuaagau

SEQ ID NO: 3779944 - RNA, 12 nt, Human
acaugugacaca

SEQ ID NO: 3779945 - RNA, 15 nt, Human
acaugugacacauau

SEQ ID NO: 3779946 - RNA, 13 nt, Human
acaugugacauuu

SEQ ID NO: 3779947 - RNA, 17 nt, Human
acaugugauacauuuuu

SEQ ID NO: 3779948 - RNA, 22 nt, Human
acaugugccagggcaaugauga

SEQ ID NO: 3779949 - RNA, 17 nt, Human
acaugugccgaaugugc

SEQ ID NO: 3779950 - RNA, 23 nt, Human
acauguggugggacagggaccca

SEQ ID NO: 3779951 - RNA, 23 nt, Human
acaugugguuacacagugugaau

SEQ ID NO: 3779952 - RNA, 21 nt, Human
acauguguagccuauguugug

SEQ ID NO: 3779953 - RNA, 18 nt, Human
acauguguagccugugca

SEQ ID NO: 3779954 - RNA, 13 nt, Human
acauguguguaua

SEQ ID NO: 3779955 - RNA, 18 nt, Human
acauguguguauauaugu

SEQ ID NO: 3779956 - RNA, 23 nt, Human
acauguguguauauauguguaua

SEQ ID NO: 3779957 - RNA, 22 nt, Human
acauguguguauauguagaugu

SEQ ID NO: 3779958 - RNA, 14 nt, Human
acauguuaaaccau

SEQ ID NO: 3779959 - RNA, 17 nt, Human
acauguuaaacuuacuu

SEQ ID NO: 3779960 - RNA, 19 nt, Human
acauguuacuggauaaauu

SEQ ID NO: 3779961 - RNA, 15 nt, Human
acauguugguauuua

SEQ ID NO: 3779962 - RNA, 18 nt, Human
acauguuuagaguugcaa

SEQ ID NO: 3779963 - RNA, 14 nt, Human
acauguuuauguaa

SEQ ID NO: 3779964 - RNA, 23 nt, Human
acauguuuauguaaacaaaucuu

SEQ ID NO: 3779965 - RNA, 21 nt, Human
acauguuuauuuauucugcau

SEQ ID NO: 3779966 - RNA, 12 nt, Human
acauguuucaga

SEQ ID NO: 3779967 - RNA, 13 nt, Human
acauguuuccagc

SEQ ID NO: 3779968 - RNA, 22 nt, Human
acauguuucuuuguaaugaaaa

SEQ ID NO: 3779969 - RNA, 23 nt, Human
acauguuucuuuguaaugaaaac

SEQ ID NO: 3779970 - RNA, 22 nt, Human
acauguuugcaccuuucuaguu

SEQ ID NO: 3779971 - RNA, 22 nt, Human
acauguuuuagacaaauacuca

SEQ ID NO: 3779972 - RNA, 17 nt, Human
acauguuuucaaaugga

SEQ ID NO: 3779973 - RNA, 23 nt, Human
acauguuuugauaaaguaguaaa

SEQ ID NO: 3779974 - RNA, 17 nt, Human
acauguuuuuauacaaa

SEQ ID NO: 3779975 - RNA, 15 nt, Human
acauuaaaaaaugaa

SEQ ID NO: 3779976 - RNA, 15 nt, Human
acauuaaaugacucu

SEQ ID NO: 3779977 - RNA, 12 nt, Human
acauuaagaaaa

SEQ ID NO: 3779978 - RNA, 17 nt, Human
acauuaagaaaaucaua

SEQ ID NO: 3779979 - RNA, 21 nt, Human
acauuaagaaaaucauauugc

SEQ ID NO: 3779980 - RNA, 15 nt, Human
acauuaagaauguug

SEQ ID NO: 3779981 - RNA, 18 nt, Human
acauuaauauacuugaau

SEQ ID NO: 3779982 - RNA, 21 nt, Human
acauuaaucaaucaucugugu

SEQ ID NO: 3779983 - RNA, 17 nt, Human
acauuaauggucuaaaa

SEQ ID NO: 3779984 - RNA, 15 nt, Human
acauuaauguuaauu

SEQ ID NO: 3779985 - RNA, 15 nt, Human
acauuaauguugauu

SEQ ID NO: 3779986 - RNA, 22 nt, Human
acauuacaaaguuaaaauuguu

SEQ ID NO: 3779987 - RNA, 17 nt, Human
acauuacugaaaacuuc

SEQ ID NO: 3779988 - RNA, 18 nt, Human
acauuagaacacugcauu

SEQ ID NO: 3779989 - RNA, 12 nt, Human
acauuagaacuu

SEQ ID NO: 3779990 - RNA, 15 nt, Human
acauuagaagacaau

SEQ ID NO: 3779991 - RNA, 20 nt, Human
acauuagaauaaaagguagu

SEQ ID NO: 3779992 - RNA, 14 nt, Human
acauuagagaacau

SEQ ID NO: 3779993 - RNA, 19 nt, Human
acauuagauuuuauuuuac

SEQ ID NO: 3779994 - RNA, 15 nt, Human
uucaaacacaaaugc

SEQ ID NO: 3779995 - RNA, 18 nt, Human
uucaaacagucucaggaa

SEQ ID NO: 3779996 - RNA, 14 nt, Human
uucaaacauauaua

SEQ ID NO: 3779997 - RNA, 22 nt, Human
uucaaaccaguauacaagauaa

SEQ ID NO: 3779998 - RNA, 16 nt, Human
uucaaacuggggccuc

SEQ ID NO: 3779999 - RNA, 13 nt, Human
uucauuaccuuuu

SEQ ID NO: 3780000 - RNA, 21 nt, Human
uucauuaccuuuuuugauaaa

SEQ ID NO: 3780001 - RNA, 21 nt, Human
uucauuacuugauuaagauuu

SEQ ID NO: 3780002 - RNA, 14 nt, Human
uucauuagcuguga

SEQ ID NO: 3780003 - RNA, 15 nt, Human
uucauuagucauguu

SEQ ID NO: 3780004 - RNA, 16 nt, Human
uucauuagucauguuu

SEQ ID NO: 3780005 - RNA, 14 nt, Human
uucauuaucucaaa

SEQ ID NO: 3780006 - RNA, 22 nt, Human
uucauuauuaguacugcucuug

SEQ ID NO: 3780007 - RNA, 13 nt, Human
uucauuauuggaa

SEQ ID NO: 3780008 - RNA, 22 nt, Human
uucauuauuuuauuaugaaacu

SEQ ID NO: 3780009 - RNA, 17 nt, Human
uucauucaauauugaca

SEQ ID NO: 3780010 - RNA, 18 nt, Human
uucauucauauuacaaua

SEQ ID NO: 3780011 - RNA, 23 nt, Human
uucauucauauuacaauauuugu

SEQ ID NO: 3780012 - RNA, 12 nt, Human
uucauucauccc

SEQ ID NO: 3780013 - RNA, 18 nt, Human
uucauucauggaccacug

SEQ ID NO: 3780014 - RNA, 22 nt, Human
uucauucaugucauguguacaa

SEQ ID NO: 3780015 - RNA, 14 nt, Human
uucauucauucacu

SEQ ID NO: 3780016 - RNA, 16 nt, Human
uucauuccauucugga

SEQ ID NO: 3780017 - RNA, 21 nt, Human
uucauuccauugccuagcucu

SEQ ID NO: 3780018 - RNA, 13 nt, Human
uucauucuccugc

SEQ ID NO: 3780019 - RNA, 17 nt, Human
uucauucuccuuguugu

SEQ ID NO: 3780020 - RNA, 21 nt, Human
uucauucucgugagucauuua

SEQ ID NO: 3780021 - RNA, 18 nt, Human
uucauucugcaaguauac

SEQ ID NO: 3780022 - RNA, 14 nt, Human
uucauucuggucuc

SEQ ID NO: 3780023 - RNA, 13 nt, Human
uucauucuuagcu

SEQ ID NO: 3780024 - RNA, 18 nt, Human
uucauucuucucuagcug

SEQ ID NO: 3780025 - RNA, 13 nt, Human
uucauucuugaaa

SEQ ID NO: 3780026 - RNA, 22 nt, Human
uucauugagaguuuugucuuga

SEQ ID NO: 3780027 - RNA, 18 nt, Human
uucauugaguugguuacu

SEQ ID NO: 3780028 - RNA, 18 nt, Human
uucauugauaugaaaaau

SEQ ID NO: 3780029 - RNA, 20 nt, Human
uucauugauuuccuguguca

SEQ ID NO: 3780030 - RNA, 17 nt, Human
uucauugccagugucuu

SEQ ID NO: 3780031 - RNA, 20 nt, Human
uucauugcccccagggcacu

SEQ ID NO: 3780032 - RNA, 18 nt, Human
uucauugccuguguaugg

SEQ ID NO: 3780033 - RNA, 12 nt, Human
uucauuguaaaa

SEQ ID NO: 3780034 - RNA, 17 nt, Human
uucauuguaauguuacu

SEQ ID NO: 3780035 - RNA, 14 nt, Human
uucauuguaugaug

SEQ ID NO: 3780036 - RNA, 15 nt, Human
uucauugucccucuu

SEQ ID NO: 3780037 - RNA, 23 nt, Human
uucauugugguuauuuuuauaca

SEQ ID NO: 3780038 - RNA, 19 nt, Human
uucauuuacuguggcuucu

SEQ ID NO: 3780039 - RNA, 18 nt, Human
uucauuuaggugaggaag

SEQ ID NO: 3780040 - RNA, 19 nt, Human
uucauuuagucaugugacc

SEQ ID NO: 3780041 - RNA, 17 nt, Human
uucauuuaucuauaauu

SEQ ID NO: 3780042 - RNA, 15 nt, Human
uucauuucaacuguu

SEQ ID NO: 3780043 - RNA, 14 nt, Human
uucauuuccugccc

SEQ ID NO: 3780044 - RNA, 16 nt, Human
uucauuuccugugucu

SEQ ID NO: 3780045 - RNA, 16 nt, Human
uucauuugcacaagua

SEQ ID NO: 3780046 - RNA, 22 nt, Human
uucauuuguggugauauagaau

SEQ ID NO: 3780047 - RNA, 13 nt, Human
uucauuuguguca

SEQ ID NO: 3780048 - RNA, 15 nt, Human
uucauuuuaaaaagu

SEQ ID NO: 3780049 - RNA, 21 nt, Human
uucauuuuaacaucugagaaa

SEQ ID NO: 3780050 - RNA, 18 nt, Human
uucauuuuauauugaaaa

SEQ ID NO: 3780051 - RNA, 19 nt, Human
uucauuuuauauugaaaaa

SEQ ID NO: 3780052 - RNA, 13 nt, Human
uucauuuugagcu

SEQ ID NO: 3780053 - RNA, 17 nt, Human
uucauuuugagcugaaa

SEQ ID NO: 3780054 - RNA, 13 nt, Human
uucauuuugcuuu

SEQ ID NO: 3780055 - RNA, 14 nt, Human
uucauuuugcuuua

SEQ ID NO: 3780056 - RNA, 14 nt, Human
uucauuuuuaauca

SEQ ID NO: 3780057 - RNA, 21 nt, Human
uucauuuuuguuauccuuuuu

SEQ ID NO: 3780058 - RNA, 16 nt, Human
uuccaaaagccaaugg

SEQ ID NO: 3780059 - RNA, 18 nt, Human
uuccaaaaguggccucuu

SEQ ID NO: 3780060 - RNA, 21 nt, Human
uuccaaaauaauuuuaagaaa

SEQ ID NO: 3780061 - RNA, 14 nt, Human
uuccaaaauauuau

SEQ ID NO: 3780062 - RNA, 14 nt, Human
uuccaaaauucuua

SEQ ID NO: 3780063 - RNA, 20 nt, Human
uuccaaaauucuuauuuuuc

SEQ ID NO: 3780064 - RNA, 22 nt, Human
uuccaaacaugagguucucucu

SEQ ID NO: 3780065 - RNA, 16 nt, Human
uuccaaaccugacaga

SEQ ID NO: 3780066 - RNA, 21 nt, Human
uuccaaagaauguuagagcac

SEQ ID NO: 3780067 - RNA, 20 nt, Human
uuccaaagcagagagcauua

SEQ ID NO: 3780068 - RNA, 16 nt, Human
uuccaaagcuuuauua

SEQ ID NO: 3780069 - RNA, 23 nt, Human
uuccaaaggccauggagagcugg

SEQ ID NO: 3780070 - RNA, 16 nt, Human
uuccaaaguacacugu

SEQ ID NO: 3780071 - RNA, 14 nt, Human
uuccaaagucucua

SEQ ID NO: 3780072 - RNA, 16 nt, Human
uuccaaagucucuaau

SEQ ID NO: 3780073 - RNA, 17 nt, Human
uuccaaagucucuaauu

SEQ ID NO: 3780074 - RNA, 15 nt, Human
uuccaaauaaaaugu

SEQ ID NO: 3780075 - RNA, 17 nt, Human
uuccaaauaaaauguuc

SEQ ID NO: 3780076 - RNA, 23 nt, Human
uuccaaauaauauguuuccuucc

SEQ ID NO: 3780077 - RNA, 21 nt, Human
uuccaaaugaauguugucugu

SEQ ID NO: 3780078 - RNA, 21 nt, Human
uuccaaauguaauaaacuuua

SEQ ID NO: 3780079 - RNA, 23 nt, Human
uuccaaauuauuucuuaauuauu

SEQ ID NO: 3780080 - RNA, 18 nt, Human
uuccaaauucaguuucau

SEQ ID NO: 3780081 - RNA, 18 nt, Human
uuccaacaccacagacac

SEQ ID NO: 3780082 - RNA, 23 nt, Human
uuccaacaccacagacacacaca

SEQ ID NO: 3780083 - RNA, 22 nt, Human
uuccaacacugauuuccccuuu

SEQ ID NO: 3780084 - RNA, 21 nt, Human
uuccaaccauuuaucuugaag

SEQ ID NO: 3780085 - RNA, 15 nt, Human
uuccaaccccaacuc

SEQ ID NO: 3780086 - RNA, 19 nt, Human
uuccaacccucaucaccaa

SEQ ID NO: 3780087 - RNA, 22 nt, Human
uuccaacguuuggaagauccug

SEQ ID NO: 3780088 - RNA, 16 nt, Human
uuccaacugcugcccc

SEQ ID NO: 3780089 - RNA, 17 nt, Human
uuccaacuuggcugcag

SEQ ID NO: 3780090 - RNA, 22 nt, Human
uuccaacuuggcugcaggaauc

SEQ ID NO: 3780091 - RNA, 21 nt, Human
uuccaagaaagaugaauacau

SEQ ID NO: 3780092 - RNA, 23 nt, Human
uuccaagaauagcaucuguacaa

SEQ ID NO: 3780093 - RNA, 16 nt, Human
uuccaagacaugucug

SEQ ID NO: 3780094 - RNA, 16 nt, Human
uuccaagacucuagag

SEQ ID NO: 3780095 - RNA, 17 nt, Human
uuccaagacucuagagu

SEQ ID NO: 3780096 - RNA, 22 nt, Human
uuccaagacucuagaguccaag

SEQ ID NO: 3780097 - RNA, 20 nt, Human
uuccaagacuuauuuucaca

SEQ ID NO: 3780098 - RNA, 14 nt, Human
uuccaagagccuga

SEQ ID NO: 3780099 - RNA, 13 nt, Human
uuccaagagcuga

SEQ ID NO: 3780100 - RNA, 13 nt, Human
uuccaagagucua

SEQ ID NO: 3780101 - RNA, 16 nt, Human
uuccaagcaaauguua

SEQ ID NO: 3780102 - RNA, 23 nt, Human
uuccaagcuuccauagcugcugc

SEQ ID NO: 3780103 - RNA, 18 nt, Human
uuccaaggggcaaauuuu

SEQ ID NO: 3780104 - RNA, 19 nt, Human
uuccaaguaauauaaugga

SEQ ID NO: 3780105 - RNA, 15 nt, Human
uuccaagucuccacc

SEQ ID NO: 3780106 - RNA, 12 nt, Human
uuccaagugugc

SEQ ID NO: 3780107 - RNA, 22 nt, Human
uuccaagugugcauauuguaca

SEQ ID NO: 3780108 - RNA, 13 nt, Human
uuccaauaaacag

SEQ ID NO: 3780109 - RNA, 13 nt, Human
uuccaauauuucu

SEQ ID NO: 3780110 - RNA, 18 nt, Human
uuccaaugucuggagacc

SEQ ID NO: 3780111 - RNA, 19 nt, Human
uuccaauucuaucuuuugu

SEQ ID NO: 3780112 - RNA, 22 nt, Human
uuccaauuuacauacucugcuu

SEQ ID NO: 3780113 - RNA, 17 nt, Human
uuccaauuuaguuguug

SEQ ID NO: 3780114 - RNA, 18 nt, Human
uuccacaaaaucugucca

SEQ ID NO: 3780115 - RNA, 19 nt, Human
uuccacaagauucccagag

SEQ ID NO: 3780116 - RNA, 19 nt, Human
uuccacacagaaugcaacc

SEQ ID NO: 3780117 - RNA, 15 nt, Human
uuccacacccccacc

SEQ ID NO: 3780118 - RNA, 16 nt, Human
uuccacacccccaccc

SEQ ID NO: 3780119 - RNA, 19 nt, Human
uuccacaccuagcaucuca

SEQ ID NO: 3780120 - RNA, 19 nt, Human
uuccacaccuggcacugcu

SEQ ID NO: 3780121 - RNA, 15 nt, Human
uuccacaccuuuuau

SEQ ID NO: 3780122 - RNA, 18 nt, Human
uuccacaguugccaccac

SEQ ID NO: 3780123 - RNA, 16 nt, Human
uuccacauauaaagcu

SEQ ID NO: 3780124 - RNA, 20 nt, Human
uuccacauccggaggagaag

SEQ ID NO: 3780125 - RNA, 15 nt, Human
uuccacauguuacug

SEQ ID NO: 3780126 - RNA, 21 nt, Human
uuccaccacagccagcaccug

SEQ ID NO: 3780127 - RNA, 11 nt, Human
uuccaccagcc

SEQ ID NO: 3780128 - RNA, 19 nt, Human
uuccaccccaagagaacuc

SEQ ID NO: 3780129 - RNA, 20 nt, Human
uuccacccccucccuggccu

SEQ ID NO: 3780130 - RNA, 13 nt, Human
uuccacccuggaa

SEQ ID NO: 3780131 - RNA, 13 nt, Human
uuccaccucaccc

SEQ ID NO: 3780132 - RNA, 16 nt, Human
uuccaccugcucugcu

SEQ ID NO: 3780133 - RNA, 13 nt, Human
uuccaccuggaag

SEQ ID NO: 3780134 - RNA, 16 nt, Human
uuccaccuuaaauuaa

SEQ ID NO: 3780135 - RNA, 20 nt, Human
uuccaccuuaaauuaaacaa

SEQ ID NO: 3780136 - RNA, 15 nt, Human
uuccaccuucccaug

SEQ ID NO: 3780137 - RNA, 18 nt, Human
uuccacuacaccuggcug

SEQ ID NO: 3780138 - RNA, 22 nt, Human
uuccacuacaccuggcugaggu

SEQ ID NO: 3780139 - RNA, 16 nt, Human
uuccacuccauugucg

SEQ ID NO: 3780140 - RNA, 18 nt, Human
uuccacuccuccuagcca

SEQ ID NO: 3780141 - RNA, 21 nt, Human
uuccacuccuccuagccaccc

SEQ ID NO: 3780142 - RNA, 18 nt, Human
uuccacucugauagaauu

SEQ ID NO: 3780143 - RNA, 12 nt, Human
uuccacugagcu

SEQ ID NO: 3780144 - RNA, 23 nt, Human
uuccacugauggaaacaaagugg

SEQ ID NO: 3780145 - RNA, 14 nt, Human
uuccacugccucug

SEQ ID NO: 3780146 - RNA, 23 nt, Human
uuccacugccugggaugaugcag

SEQ ID NO: 3780147 - RNA, 17 nt, Human
uuccacugcguugucca

SEQ ID NO: 3780148 - RNA, 20 nt, Human
uuauuguggauaacaaagau

SEQ ID NO: 3780149 - RNA, 16 nt, Human
uuauuguguuugucau

SEQ ID NO: 3780150 - RNA, 20 nt, Human
uuauuguguuuuuaauuuau

SEQ ID NO: 3780151 - RNA, 13 nt, Human
uuauuguuccaag

SEQ ID NO: 3780152 - RNA, 12 nt, Human
uuauuguuuaaa

SEQ ID NO: 3780153 - RNA, 13 nt, Human
uuauuuaaaagau

SEQ ID NO: 3780154 - RNA, 16 nt, Human
uuauuuaaaagauuca

SEQ ID NO: 3780155 - RNA, 21 nt, Human
uuauuuaaaauguaaaaagga

SEQ ID NO: 3780156 - RNA, 14 nt, Human
uuauuuaaagcauu

SEQ ID NO: 3780157 - RNA, 13 nt, Human
uuauuuaaauaga

SEQ ID NO: 3780158 - RNA, 13 nt, Human
uuauuuaacagcu

SEQ ID NO: 3780159 - RNA, 23 nt, Human
uuauuuaacagcugaauuaucua

SEQ ID NO: 3780160 - RNA, 14 nt, Human
uuauuuaagacuaa

SEQ ID NO: 3780161 - RNA, 14 nt, Human
uuauuuaauaacaa

SEQ ID NO: 3780162 - RNA, 19 nt, Human
uuauuuaauaacauuaccu

SEQ ID NO: 3780163 - RNA, 18 nt, Human
uuauuuaaugaaagacug

SEQ ID NO: 3780164 - RNA, 14 nt, Human
uuauuuaauuaaaa

SEQ ID NO: 3780165 - RNA, 11 nt, Human
uuauuuacaag

SEQ ID NO: 3780166 - RNA, 17 nt, Human
uuauuuacuaauuuucu

SEQ ID NO: 3780167 - RNA, 15 nt, Human
uuauuuagacaagag

SEQ ID NO: 3780168 - RNA, 17 nt, Human
uuauuuagacucaucuu

SEQ ID NO: 3780169 - RNA, 23 nt, Human
uuauuuagacucaucuuacugua

SEQ ID NO: 3780170 - RNA, 15 nt, Human
uuauuuagauucacu

SEQ ID NO: 3780171 - RNA, 15 nt, Human
uuauuuauacacugu

SEQ ID NO: 3780172 - RNA, 13 nt, Human
uuauuuauaugua

SEQ ID NO: 3780173 - RNA, 15 nt, Human
uuauuuauauguacu

SEQ ID NO: 3780174 - RNA, 18 nt, Human
uuauuuauauguacuguu

SEQ ID NO: 3780175 - RNA, 21 nt, Human
uuauuuauauguacuguuuua

SEQ ID NO: 3780176 - RNA, 16 nt, Human
uuauuuauauguaugu

SEQ ID NO: 3780177 - RNA, 13 nt, Human
uuauuuauguacu

SEQ ID NO: 3780178 - RNA, 16 nt, Human
uuauuuauguacuuuu

SEQ ID NO: 3780179 - RNA, 12 nt, Human
uuauuuauguau

SEQ ID NO: 3780180 - RNA, 15 nt, Human
uuauuuauguauggu

SEQ ID NO: 3780181 - RNA, 21 nt, Human
uuauuuauguauggugcaaug

SEQ ID NO: 3780182 - RNA, 21 nt, Human
uuauuuauguauugugcaaug

SEQ ID NO: 3780183 - RNA, 15 nt, Human
uuauuuauuggagau

SEQ ID NO: 3780184 - RNA, 13 nt, Human
uuauuuauuuaau

SEQ ID NO: 3780185 - RNA, 14 nt, Human
uuauuuauuuaaua

SEQ ID NO: 3780186 - RNA, 15 nt, Human
uuauuuauuuaugga

SEQ ID NO: 3780187 - RNA, 15 nt, Human
uucacagcucugugu

SEQ ID NO: 3780188 - RNA, 23 nt, Human
uucacagcucuguguugccaugu

SEQ ID NO: 3780189 - RNA, 13 nt, Human
uucacagcuuuua

SEQ ID NO: 3780190 - RNA, 19 nt, Human
uucacaggcgaggccugga

SEQ ID NO: 3780191 - RNA, 23 nt, Human
uucacagggguucccuucucuca

SEQ ID NO: 3780192 - RNA, 18 nt, Human
uucacaguaccaucugaa

SEQ ID NO: 3780193 - RNA, 19 nt, Human
uucacaguacccaaacugc

SEQ ID NO: 3780194 - RNA, 23 nt, Human
uucacaguacccaaacugcuuuu

SEQ ID NO: 3780195 - RNA, 18 nt, Human
uucacaguagagccagcu

SEQ ID NO: 3780196 - RNA, 16 nt, Human
uucacagucacugaug

SEQ ID NO: 3780197 - RNA, 14 nt, Human
uucacauaaaugca

SEQ ID NO: 3780198 - RNA, 19 nt, Human
uucacauaaaugcagccca

SEQ ID NO: 3780199 - RNA, 23 nt, Human
uucacauagcccacuuacauuua

SEQ ID NO: 3780200 - RNA, 21 nt, Human
uucacauaucuaguaugaaau

SEQ ID NO: 3780201 - RNA, 21 nt, Human
uucacaucgcagauucucccu

SEQ ID NO: 3780202 - RNA, 20 nt, Human
uucacaucuaaccucaucuu

SEQ ID NO: 3780203 - RNA, 14 nt, Human
uucacaugaacaua

SEQ ID NO: 3780204 - RNA, 19 nt, Human
uucacaugagcuauuucca

SEQ ID NO: 3780205 - RNA, 15 nt, Human
uucacauguuuucaa

SEQ ID NO: 3780206 - RNA, 16 nt, Human
uucacauguuuucaaa

SEQ ID NO: 3780207 - RNA, 17 nt, Human
uucacauguuuucaaau

SEQ ID NO: 3780208 - RNA, 20 nt, Human
uucacauuaauggucuaaaa

SEQ ID NO: 3780209 - RNA, 15 nt, Human
uucacauuagaagac

SEQ ID NO: 3780210 - RNA, 23 nt, Human
uucacauuccccuggggacccac

SEQ ID NO: 3780211 - RNA, 12 nt, Human
uucacauucuua

SEQ ID NO: 3780212 - RNA, 19 nt, Human
uucacauuguauucagagu

SEQ ID NO: 3780213 - RNA, 20 nt, Human
uucacauuguuugcugcuau

SEQ ID NO: 3780214 - RNA, 13 nt, Human
uucaccaaaauua

SEQ ID NO: 3780215 - RNA, 19 nt, Human
uucaccagaauggaaagac

SEQ ID NO: 3780216 - RNA, 18 nt, Human
uucaccagauuugcuaau

SEQ ID NO: 3780217 - RNA, 23 nt, Human
uucaccaguacauucucaguuuu

SEQ ID NO: 3780218 - RNA, 19 nt, Human
uucaccaucaauccugauu

SEQ ID NO: 3780219 - RNA, 21 nt, Human
uucaccaugauggccaggcug

SEQ ID NO: 3780220 - RNA, 17 nt, Human
uucaccauguaaaacaa

SEQ ID NO: 3780221 - RNA, 21 nt, Human
uucaccauguaaaacaaaaaa

SEQ ID NO: 3780222 - RNA, 22 nt, Human
uucaccauguuggccaggcugg

SEQ ID NO: 3780223 - RNA, 13 nt, Human
uucaccauucgua

SEQ ID NO: 3780224 - RNA, 17 nt, Human
uucacccacagaaagag

SEQ ID NO: 3780225 - RNA, 19 nt, Human
uucacccacagaaagagag

SEQ ID NO: 3780226 - RNA, 15 nt, Human
uucacccagacagcu

SEQ ID NO: 3780227 - RNA, 18 nt, Human
uucacccagcuaaucugu

SEQ ID NO: 3780228 - RNA, 21 nt, Human
uucacccaggccuauguugau

SEQ ID NO: 3780229 - RNA, 22 nt, Human
uucaccccaguggccacucagc

SEQ ID NO: 3780230 - RNA, 23 nt, Human
uucaccccaucccuccuuaagag

SEQ ID NO: 3780231 - RNA, 16 nt, Human
uucacccccuuuccug

SEQ ID NO: 3780232 - RNA, 15 nt, Human
uucaccccucccuuu

SEQ ID NO: 3780233 - RNA, 16 nt, Human
uucaccccucccuuuc

SEQ ID NO: 3780234 - RNA, 18 nt, Human
uucaccccucccuuucuc

SEQ ID NO: 3780235 - RNA, 22 nt, Human
uucaccccucccuuucuccccu

SEQ ID NO: 3780236 - RNA, 16 nt, Human
uucaccuaagagauuc

SEQ ID NO: 3780237 - RNA, 17 nt, Human
uucaccuaagucucugu

SEQ ID NO: 3780238 - RNA, 19 nt, Human
uucaccuaagucucuguga

SEQ ID NO: 3780239 - RNA, 22 nt, Human
uucaccuacauuugagaauuau

SEQ ID NO: 3780240 - RNA, 18 nt, Human
uucaccuaccgaguucaa

SEQ ID NO: 3780241 - RNA, 13 nt, Human
uucaccuccuuca

SEQ ID NO: 3780242 - RNA, 16 nt, Human
uucaccugauucaacu

SEQ ID NO: 3780243 - RNA, 18 nt, Human
uucaccugccccaacucu

SEQ ID NO: 3780244 - RNA, 13 nt, Human
uucaccuguaaaa

SEQ ID NO: 3780245 - RNA, 16 nt, Human
uucaccuguaaaacuu

SEQ ID NO: 3780246 - RNA, 17 nt, Human
uucaccuguaaaccuga

SEQ ID NO: 3780247 - RNA, 20 nt, Human
uucaccuuuguccccaccgc

SEQ ID NO: 3780248 - RNA, 17 nt, Human
uucacgaaguguugcau

SEQ ID NO: 3780249 - RNA, 15 nt, Human
uucacgagagcccgg

SEQ ID NO: 3780250 - RNA, 14 nt, Human
uucacgcaacuuga

SEQ ID NO: 3780251 - RNA, 16 nt, Human
uucacgcaacuugaaa

SEQ ID NO: 3780252 - RNA, 13 nt, Human
uucacggaagagc

SEQ ID NO: 3780253 - RNA, 18 nt, Human
uucacggaagagccuugc

SEQ ID NO: 3780254 - RNA, 13 nt, Human
uucacggaaguuu

SEQ ID NO: 3780255 - RNA, 14 nt, Human
uucacguagaacau

SEQ ID NO: 3780256 - RNA, 14 nt, Human
uucacgugcagcuc

SEQ ID NO: 3780257 - RNA, 23 nt, Human
uucacuacccaucgguguccauu

SEQ ID NO: 3780258 - RNA, 13 nt, Human
uucacuauuuccu

SEQ ID NO: 3780259 - RNA, 19 nt, Human
uucacuauuuccuuuauaa

SEQ ID NO: 3780260 - RNA, 14 nt, Human
uucacucaagcacu

SEQ ID NO: 3780261 - RNA, 16 nt, Human
uucacucacucuaaag

SEQ ID NO: 3780262 - RNA, 17 nt, Human
uucacucccccuaaacc

SEQ ID NO: 3780263 - RNA, 21 nt, Human
uucacuccggugugccugcag

SEQ ID NO: 3780264 - RNA, 22 nt, Human
uucacuccggugugccugcagc

SEQ ID NO: 3780265 - RNA, 19 nt, Human
uucacucuaagucauguau

SEQ ID NO: 3780266 - RNA, 13 nt, Human
uucacucucugaa

SEQ ID NO: 3780267 - RNA, 16 nt, Human
uucacucuuccagaau

SEQ ID NO: 3780268 - RNA, 22 nt, Human
uucacugaagaaaccuucagau

SEQ ID NO: 3780269 - RNA, 19 nt, Human
uucacugaaguucuccuga

SEQ ID NO: 3780270 - RNA, 11 nt, Human
uucacugauuu

SEQ ID NO: 3780271 - RNA, 16 nt, Human
uucacugcuggcugcc

SEQ ID NO: 3780272 - RNA, 14 nt, Human
uucacuggagcaca

SEQ ID NO: 3780273 - RNA, 15 nt, Human
uucacuggagcacaa

SEQ ID NO: 3780274 - RNA, 17 nt, Human
uucacuggaguuacauu

SEQ ID NO: 3780275 - RNA, 20 nt, Human
uucacuggccacaguuguuu

SEQ ID NO: 3780276 - RNA, 13 nt, Human
uucacugggccaa

SEQ ID NO: 3780277 - RNA, 18 nt, Human
uucacugguacucugcca

SEQ ID NO: 3780278 - RNA, 18 nt, Human
uucacuguauaaauagga

SEQ ID NO: 3780279 - RNA, 22 nt, Human
uucacuguauaaauaggagagg

SEQ ID NO: 3780280 - RNA, 23 nt, Human
uucacuguauaaauaggagagga

SEQ ID NO: 3780281 - RNA, 22 nt, Human
uucacuguccuccaagccagcg

SEQ ID NO: 3780282 - RNA, 16 nt, Human
uucacugucuuuaauu

SEQ ID NO: 3780283 - RNA, 23 nt, Human
uucacuguuucaucuaagugccu

SEQ ID NO: 3780284 - RNA, 15 nt, Human
uucacuuacagcacc

SEQ ID NO: 3780285 - RNA, 15 nt, Human
uucacuucacugugc

SEQ ID NO: 3780286 - RNA, 15 nt, Human
uucacuucaucuucu

SEQ ID NO: 3780287 - RNA, 18 nt, Human
uucacuucaucuucucag

SEQ ID NO: 3780288 - RNA, 15 nt, Human
uucacuucuuucccu

SEQ ID NO: 3780289 - RNA, 13 nt, Human
uucacuuuaauuc

SEQ ID NO: 3780290 - RNA, 14 nt, Human
uucacuuucauuuu

SEQ ID NO: 3780291 - RNA, 17 nt, Human
uucacuuuugacaaagg

SEQ ID NO: 3780292 - RNA, 14 nt, Human
uucagaaaaagaaa

SEQ ID NO: 3780293 - RNA, 16 nt, Human
uucagaaaaagaaaug

SEQ ID NO: 3780294 - RNA, 22 nt, Human
uucagaaaacugagcugcaauc

SEQ ID NO: 3780295 - RNA, 14 nt, Human
uucagaaaauauua

SEQ ID NO: 3780296 - RNA, 19 nt, Human
uucagaaaauguucuguuu

SEQ ID NO: 3780297 - RNA, 13 nt, Human
uucagaaagcauu

SEQ ID NO: 3780298 - RNA, 19 nt, Human
uucagaaagccuuucauuu

SEQ ID NO: 3780299 - RNA, 20 nt, Human
uucagaaagccuuucauuuu

SEQ ID NO: 3780300 - RNA, 19 nt, Human
uucagaaauacagauaaau

SEQ ID NO: 3780301 - RNA, 22 nt, Human
uucagaaaugaggccauggacu

SEQ ID NO: 3780302 - RNA, 16 nt, Human
uucagaaauguguuau

SEQ ID NO: 3780303 - RNA, 22 nt, Human
uucagaacaacugcaaagaaag

SEQ ID NO: 3780304 - RNA, 16 nt, Human
uucagaaccauccaua

SEQ ID NO: 3780305 - RNA, 15 nt, Human
uucagaaccucuucc

SEQ ID NO: 3780306 - RNA, 12 nt, Human
uucagaagaaaa

SEQ ID NO: 3780307 - RNA, 16 nt, Human
uucagaagaaauaaau

SEQ ID NO: 3780308 - RNA, 11 nt, Human
uucagaagacc

SEQ ID NO: 3780309 - RNA, 17 nt, Human
uucagaagucacacauu

SEQ ID NO: 3780310 - RNA, 21 nt, Human
uucagaagugagcuuugcugc

SEQ ID NO: 3780311 - RNA, 15 nt, Human
uucagaaguuuaaau

SEQ ID NO: 3780312 - RNA, 21 nt, Human
uucagaauaugucagugcuga

SEQ ID NO: 3780313 - RNA, 13 nt, Human
uucagaauauuca

SEQ ID NO: 3780314 - RNA, 16 nt, Human
uucagaauuaaacuuu

SEQ ID NO: 3780315 - RNA, 21 nt, Human
uucagaauuuaguguauccau

SEQ ID NO: 3780316 - RNA, 19 nt, Human
uucagacaaaauggauaca

SEQ ID NO: 3780317 - RNA, 15 nt, Human
uucagacaagcaaca

SEQ ID NO: 3780318 - RNA, 16 nt, Human
uucagacacuuuggaa

SEQ ID NO: 3780319 - RNA, 20 nt, Human
uucagacaucugagguuuua

SEQ ID NO: 3780320 - RNA, 12 nt, Human
uucagacucaga

SEQ ID NO: 3780321 - RNA, 14 nt, Human
uucagacuugucaa

SEQ ID NO: 3780322 - RNA, 19 nt, Human
uucagagacuccugcaggc

SEQ ID NO: 3780323 - RNA, 19 nt, Human
uucagagagcagugcuuuu

SEQ ID NO: 3780324 - RNA, 21 nt, Human
uucagagagcagugcuuuugg

SEQ ID NO: 3780325 - RNA, 17 nt, Human
uucagagggaaaguaaa

SEQ ID NO: 3780326 - RNA, 21 nt, Human
uucagaguucuuuuugaagua

SEQ ID NO: 3780327 - RNA, 23 nt, Human
uucagauaacuguuauuuauaau

SEQ ID NO: 3780328 - RNA, 17 nt, Human
uucagauacaaacugca

SEQ ID NO: 3780329 - RNA, 12 nt, Human
uucagauacaug

SEQ ID NO: 3780330 - RNA, 14 nt, Human
uucagauauaaaag

SEQ ID NO: 3780331 - RNA, 15 nt, Human
uucagauauaaaaga

SEQ ID NO: 3780332 - RNA, 19 nt, Human
uucagauauaaaagacuga

SEQ ID NO: 3780333 - RNA, 16 nt, Human
uucagauauauuuuuc

SEQ ID NO: 3780334 - RNA, 15 nt, Human
uucagaucacugaau

SEQ ID NO: 3780335 - RNA, 21 nt, Human
uucagaucacugaauuuauaa

SEQ ID NO: 3780336 - RNA, 17 nt, Human
uucaguuccucuuugca

SEQ ID NO: 3780337 - RNA, 22 nt, Human
uucaguuccucuuugcauggaa

SEQ ID NO: 3780338 - RNA, 18 nt, Human
uucaguugaucacuggca

SEQ ID NO: 3780339 - RNA, 16 nt, Human
uucaguugauuuuaca

SEQ ID NO: 3780340 - RNA, 22 nt, Human
uucaguugguucguucuguacu

SEQ ID NO: 3780341 - RNA, 15 nt, Human
uucaguugucucuga

SEQ ID NO: 3780342 - RNA, 23 nt, Human
uucaguuguuuguuuuugcuugu

SEQ ID NO: 3780343 - RNA, 15 nt, Human
uucaguuuaucuguu

SEQ ID NO: 3780344 - RNA, 18 nt, Human
uucaguuuaucuguucau

SEQ ID NO: 3780345 - RNA, 16 nt, Human
uucaguuucauaaaag

SEQ ID NO: 3780346 - RNA, 18 nt, Human
uucaguuucuaaaauuga

SEQ ID NO: 3780347 - RNA, 17 nt, Human
uucaguuucuucugcgc

SEQ ID NO: 3780348 - RNA, 19 nt, Human
uucaguuuuaccagaugau

SEQ ID NO: 3780349 - RNA, 16 nt, Human
uucaguuuugauauuu

SEQ ID NO: 3780350 - RNA, 15 nt, Human
uucauaaagaauugu

SEQ ID NO: 3780351 - RNA, 14 nt, Human
uucauaaagauuca

SEQ ID NO: 3780352 - RNA, 12 nt, Human
uucauaaaugaa

SEQ ID NO: 3780353 - RNA, 14 nt, Human
uucauaaauuauuu

SEQ ID NO: 3780354 - RNA, 20 nt, Human
uucauaaauuauuugauuau

SEQ ID NO: 3780355 - RNA, 18 nt, Human
uucauaacagugccauug

SEQ ID NO: 3780356 - RNA, 22 nt, Human
uucauaacagugccauugucuu

SEQ ID NO: 3780357 - RNA, 15 nt, Human
uucauaaccuagccu

SEQ ID NO: 3780358 - RNA, 22 nt, Human
uucauaacuuauugcugauuuu

SEQ ID NO: 3780359 - RNA, 14 nt, Human
uucauaagauauuu

SEQ ID NO: 3780360 - RNA, 15 nt, Human
uucauaaucacucua

SEQ ID NO: 3780361 - RNA, 13 nt, Human
uucauaaugacuu

SEQ ID NO: 3780362 - RNA, 13 nt, Human
uucauaauuuguu

SEQ ID NO: 3780363 - RNA, 23 nt, Human
uucauacauauuuuuguagcacu

SEQ ID NO: 3780364 - RNA, 14 nt, Human
uucauaccuaagua

SEQ ID NO: 3780365 - RNA, 21 nt, Human
uucauaccuaaguacuguaau

SEQ ID NO: 3780366 - RNA, 23 nt, Human
uucauacuccuuuuaagcaguga

SEQ ID NO: 3780367 - RNA, 14 nt, Human
uucauacucuagau

SEQ ID NO: 3780368 - RNA, 17 nt, Human
uucauacucuagauuuu

SEQ ID NO: 3780369 - RNA, 18 nt, Human
uucauacuuaaaaauuua

SEQ ID NO: 3780370 - RNA, 15 nt, Human
uucauagaauacuca

SEQ ID NO: 3780371 - RNA, 16 nt, Human
uucauagacccucuca

SEQ ID NO: 3780372 - RNA, 17 nt, Human
uucauagacccucucaa

SEQ ID NO: 3780373 - RNA, 18 nt, Human
uucauagagaauauaaaa

SEQ ID NO: 3780374 - RNA, 14 nt, Human
uucauagauuuccu

SEQ ID NO: 3780375 - RNA, 23 nt, Human
uucauaguauccauauuuuauua

SEQ ID NO: 3780376 - RNA, 14 nt, Human
uucauaguucagaa

SEQ ID NO: 3780377 - RNA, 19 nt, Human
uucauaguucagaauuuag

SEQ ID NO: 3780378 - RNA, 23 nt, Human
uucauaucacacuguuaaaaguu

SEQ ID NO: 3780379 - RNA, 20 nt, Human
uucauaucuauuuauuaaau

SEQ ID NO: 3780380 - RNA, 22 nt, Human
uucauaucuauuuauuaaauuu

SEQ ID NO: 3780381 - RNA, 21 nt, Human
uucauaugaaaggugccaugg

SEQ ID NO: 3780382 - RNA, 13 nt, Human
uucauauguaauc

SEQ ID NO: 3780383 - RNA, 20 nt, Human
uucauauguaccauguacau

SEQ ID NO: 3780384 - RNA, 18 nt, Human
uucauauucaugcaagua

SEQ ID NO: 3780385 - RNA, 14 nt, Human
uucauauuggaaaa

SEQ ID NO: 3780386 - RNA, 20 nt, Human
uucauauuuaauuugaaggu

SEQ ID NO: 3780387 - RNA, 15 nt, Human
uucauauuucuuugg

SEQ ID NO: 3780388 - RNA, 14 nt, Human
uucauauuuguacu

SEQ ID NO: 3780389 - RNA, 15 nt, Human
uucauauuuguacuu

SEQ ID NO: 3780390 - RNA, 17 nt, Human
uucauauuuuaaacaga

SEQ ID NO: 3780391 - RNA, 19 nt, Human
uucauauuuuucaaaauag

SEQ ID NO: 3780392 - RNA, 21 nt, Human
uucauauuuuucauagcuaaa

SEQ ID NO: 3780393 - RNA, 16 nt, Human
uucaucaaauggaaga

SEQ ID NO: 3780394 - RNA, 19 nt, Human
uucaucaaauggaagacac

SEQ ID NO: 3780395 - RNA, 13 nt, Human
uucaucaaucauu

SEQ ID NO: 3780396 - RNA, 22 nt, Human
uucaucaaucauuguacaguuu

SEQ ID NO: 3780397 - RNA, 15 nt, Human
uucaucaaugaauga

SEQ ID NO: 3780398 - RNA, 13 nt, Human
uucaucagcauuu

SEQ ID NO: 3780399 - RNA, 15 nt, Human
uucaucaguguuaaa

SEQ ID NO: 3780400 - RNA, 18 nt, Human
uucaucauccuaagcuau

SEQ ID NO: 3780401 - RNA, 20 nt, Human
uucaucauucacuucacugu

SEQ ID NO: 3780402 - RNA, 17 nt, Human
uucaucauucccucuca

SEQ ID NO: 3780403 - RNA, 20 nt, Human
uucaucauucccucucaucu

SEQ ID NO: 3780404 - RNA, 21 nt, Human
uucauccaauccucacugggu

SEQ ID NO: 3780405 - RNA, 22 nt, Human
uucauccaauccucacugggug

SEQ ID NO: 3780406 - RNA, 24 nt, Human
uucaucccaaaggacagccgccug

SEQ ID NO: 3780407 - RNA, 19 nt, Human
uucaucccaacugucuuuu

SEQ ID NO: 3780408 - RNA, 14 nt, Human
uucaucccagcccc

SEQ ID NO: 3780409 - RNA, 16 nt, Human
uucaucccagccccaa

SEQ ID NO: 3780410 - RNA, 19 nt, Human
uucaucccaugauguagug

SEQ ID NO: 3780411 - RNA, 14 nt, Human
uucauccccucaga

SEQ ID NO: 3780412 - RNA, 14 nt, Human
uucauccccuuacc

SEQ ID NO: 3780413 - RNA, 15 nt, Human
uucauccccuuaccc

SEQ ID NO: 3780414 - RNA, 16 nt, Human
uucaucccuucucuuc

SEQ ID NO: 3780415 - RNA, 18 nt, Human
uucaucccuucucuucca

SEQ ID NO: 3780416 - RNA, 18 nt, Human
uucauccugacucugccc

SEQ ID NO: 3780417 - RNA, 18 nt, Human
uucaucgaaucuacuaau

SEQ ID NO: 3780418 - RNA, 20 nt, Human
uucaucuaccauuuucuggu

SEQ ID NO: 3780419 - RNA, 15 nt, Human
uucaucuaggauuuu

SEQ ID NO: 3780420 - RNA, 23 nt, Human
uucaucuauuuuuggcagucuga

SEQ ID NO: 3780421 - RNA, 12 nt, Human
uucaucucauuu

SEQ ID NO: 3780422 - RNA, 16 nt, Human
uucaucucauuuaagg

SEQ ID NO: 3780423 - RNA, 19 nt, Human
uucaucucauuuaagggaa

SEQ ID NO: 3780424 - RNA, 23 nt, Human
uucaucucauuuaagggaaaaau

SEQ ID NO: 3780425 - RNA, 22 nt, Human
uucaucuccagggaguccccuc

SEQ ID NO: 3780426 - RNA, 12 nt, Human
uucaucuggaac

SEQ ID NO: 3780427 - RNA, 17 nt, Human
uucaucuggaaccauca

SEQ ID NO: 3780428 - RNA, 17 nt, Human
uucaucuucaguugucu

SEQ ID NO: 3780429 - RNA, 13 nt, Human
uucaucuuccugu

SEQ ID NO: 3780430 - RNA, 18 nt, Human
uucaucuuccuguguccu

SEQ ID NO: 3780431 - RNA, 12 nt, Human
uucaucuugaau

SEQ ID NO: 3780432 - RNA, 18 nt, Human
uucaugaaaauccuacca

SEQ ID NO: 3780433 - RNA, 13 nt, Human
uucaugaaaugcu

SEQ ID NO: 3780434 - RNA, 23 nt, Human
uucaugaaaugcuaugucauuuc

SEQ ID NO: 3780435 - RNA, 21 nt, Human
uucaugaacuucgcaucaaaa

SEQ ID NO: 3780436 - RNA, 15 nt, Human
uucaugacagccucc

SEQ ID NO: 3780437 - RNA, 16 nt, Human
uucaugacagccucca

SEQ ID NO: 3780438 - RNA, 12 nt, Human
uucaugauaaug

SEQ ID NO: 3780439 - RNA, 12 nt, Human
uucaugaugcag

SEQ ID NO: 3780440 - RNA, 16 nt, Human
uucaugaugcagucuc

SEQ ID NO: 3780441 - RNA, 23 nt, Human
uucaugauuagaaauuaccugug

SEQ ID NO: 3780442 - RNA, 23 nt, Human
uucaugauuucauuucaacuguu

SEQ ID NO: 3780443 - RNA, 15 nt, Human
uucaugcaaacucuu

SEQ ID NO: 3780444 - RNA, 16 nt, Human
uucaugcaaacucuuu

SEQ ID NO: 3780445 - RNA, 20 nt, Human
uucaugcaaacucuuugguc

SEQ ID NO: 3780446 - RNA, 14 nt, Human
uucaugcaaguauu

SEQ ID NO: 3780447 - RNA, 15 nt, Human
uucaugcacuuaaag

SEQ ID NO: 3780448 - RNA, 19 nt, Human
uucaugcacuuaaagaagu

SEQ ID NO: 3780449 - RNA, 23 nt, Human
uucaugcacuuaaagaaguauuu

SEQ ID NO: 3780450 - RNA, 13 nt, Human
uucaugcagcugu

SEQ ID NO: 3780451 - RNA, 14 nt, Human
uucaugccuuugua

SEQ ID NO: 3780452 - RNA, 18 nt, Human
uucaugccuuuguaaguu

SEQ ID NO: 3780453 - RNA, 21 nt, Human
uucaugccuuuguaaguuauu

SEQ ID NO: 3780454 - RNA, 17 nt, Human
uucaugcuaucucugug

SEQ ID NO: 3780455 - RNA, 15 nt, Human
uucaugcucugcaaa

SEQ ID NO: 3780456 - RNA, 21 nt, Human
uucauggaacgcguugaaauu

SEQ ID NO: 3780457 - RNA, 22 nt, Human
uucauggaacgcguugaaauug

SEQ ID NO: 3780458 - RNA, 18 nt, Human
uucauggaauggacaucc

SEQ ID NO: 3780459 - RNA, 15 nt, Human
uucauggacacuuug

SEQ ID NO: 3780460 - RNA, 21 nt, Human
uucauggacacuuugaaaugu

SEQ ID NO: 3780461 - RNA, 17 nt, Human
uucauggaccacuguuu

SEQ ID NO: 3780462 - RNA, 13 nt, Human
uucauggaucaga

SEQ ID NO: 3780463 - RNA, 16 nt, Human
uucauggaucagaucu

SEQ ID NO: 3780464 - RNA, 14 nt, Human
uucauguaaacugu

SEQ ID NO: 3780465 - RNA, 16 nt, Human
uucauguaaaguguca

SEQ ID NO: 3780466 - RNA, 21 nt, Human
uucauguaauuuuauuuuaaa

SEQ ID NO: 3780467 - RNA, 20 nt, Human
uucauguagagaaaagcaca

SEQ ID NO: 3780468 - RNA, 21 nt, Human
uucauguagagaaaagcacac

SEQ ID NO: 3780469 - RNA, 19 nt, Human
uucauguccugugucaguu

SEQ ID NO: 3780470 - RNA, 22 nt, Human
uucauguccugugucaguuuau

SEQ ID NO: 3780471 - RNA, 15 nt, Human
uucaugugucccaga

SEQ ID NO: 3780472 - RNA, 18 nt, Human
uucaugugucccagaaga

SEQ ID NO: 3780473 - RNA, 21 nt, Human
uucaugugugccaaggcugau

SEQ ID NO: 3780474 - RNA, 13 nt, Human
uucauguuaguua

SEQ ID NO: 3780475 - RNA, 16 nt, Human
uucauguuaguuaccu

SEQ ID NO: 3780476 - RNA, 19 nt, Human
uucauguuuggugcauaga

SEQ ID NO: 3780477 - RNA, 15 nt, Human
uucauguuuuaacaa

SEQ ID NO: 3780478 - RNA, 15 nt, Human
uucauuaaaagcuac

SEQ ID NO: 3780479 - RNA, 13 nt, Human
uucauuaaauaaa

SEQ ID NO: 3780480 - RNA, 14 nt, Human
uucauuaaauaaau

SEQ ID NO: 3780481 - RNA, 18 nt, Human
uucauuaauaauaaauuc

SEQ ID NO: 3780482 - RNA, 21 nt, Human
uucauuaauaauaaauucccu

SEQ ID NO: 3780483 - RNA, 20 nt, Human
uucauuacaauggaaacaau

SEQ ID NO: 3780484 - RNA, 13 nt, Human
uucauuacagcuu

SEQ ID NO: 3780485 - RNA, 18 nt, Human
uucauuacagcuuaauca

SEQ ID NO: 3780486 - RNA, 17 nt, Human
uguaguguuggagaaga

SEQ ID NO: 3780487 - RNA, 20 nt, Human
uguaguguuggagaagaacu

SEQ ID NO: 3780488 - RNA, 13 nt, Human
uguaguuaaugau

SEQ ID NO: 3780489 - RNA, 17 nt, Human
uguaguuaauuuaucua

SEQ ID NO: 3780490 - RNA, 13 nt, Human
uguaguucaugua

SEQ ID NO: 3780491 - RNA, 20 nt, Human
uguaguucauguaaauaaua

SEQ ID NO: 3780492 - RNA, 14 nt, Human
uguaguucuuuaaa

SEQ ID NO: 3780493 - RNA, 14 nt, Human
uguaguugaacuga

SEQ ID NO: 3780494 - RNA, 21 nt, Human
uguaguuguucguugguuaua

SEQ ID NO: 3780495 - RNA, 19 nt, Human
uguaguuuaccucuuuaaa

SEQ ID NO: 3780496 - RNA, 19 nt, Human
uguaguuuuucuucaacau

SEQ ID NO: 3780497 - RNA, 22 nt, Human
uguauaaaaauaaaaaagaucc

SEQ ID NO: 3780498 - RNA, 13 nt, Human
uguauaaaagugu

SEQ ID NO: 3780499 - RNA, 19 nt, Human
uguauaaaggugugcugug

SEQ ID NO: 3780500 - RNA, 18 nt, Human
uguauaaauaggagagga

SEQ ID NO: 3780501 - RNA, 19 nt, Human
uguauaaauauacaguaua

SEQ ID NO: 3780502 - RNA, 12 nt, Human
uguauaaaugua

SEQ ID NO: 3780503 - RNA, 18 nt, Human
uguauaaauguauauaca

SEQ ID NO: 3780504 - RNA, 15 nt, Human
uguauaacuaggagc

SEQ ID NO: 3780505 - RNA, 18 nt, Human
uguauaacuuuaacuucu

SEQ ID NO: 3780506 - RNA, 16 nt, Human
uguauaagcacugaaa

SEQ ID NO: 3780507 - RNA, 18 nt, Human
uguauaagcacugaaaaa

SEQ ID NO: 3780508 - RNA, 14 nt, Human
uguauaaggacagu

SEQ ID NO: 3780509 - RNA, 17 nt, Human
uguauaaguaagaaaau

SEQ ID NO: 3780510 - RNA, 18 nt, Human
uguauaaguaagaaaaua

SEQ ID NO: 3780511 - RNA, 16 nt, Human
uguauaaguccuugca

SEQ ID NO: 3780512 - RNA, 19 nt, Human
uguauaaguccuugcaaga

SEQ ID NO: 3780513 - RNA, 18 nt, Human
uguauaagugcacacaga

SEQ ID NO: 3780514 - RNA, 20 nt, Human
uguauaagugcacacagaaa

SEQ ID NO: 3780515 - RNA, 23 nt, Human
uguauaaguuauuuuuguacaug

SEQ ID NO: 3780516 - RNA, 20 nt, Human
uguauaauauugaaaauuga

SEQ ID NO: 3780517 - RNA, 15 nt, Human
uguauaauauuuuua

SEQ ID NO: 3780518 - RNA, 21 nt, Human
uguauaauuggauuuccuaau

SEQ ID NO: 3780519 - RNA, 18 nt, Human
uguauacaaguacuggua

SEQ ID NO: 3780520 - RNA, 12 nt, Human
uguauacaugug

SEQ ID NO: 3780521 - RNA, 15 nt, Human
uguauacuauaguac

SEQ ID NO: 3780522 - RNA, 15 nt, Human
uguauacuuuaaaua

SEQ ID NO: 3780523 - RNA, 17 nt, Human
uguauacuuuaaauaau

SEQ ID NO: 3780524 - RNA, 13 nt, Human
uguauacuuuagu

SEQ ID NO: 3780525 - RNA, 23 nt, Human
uguauagaaccucuuugucuaca

SEQ ID NO: 3780526 - RNA, 18 nt, Human
uguauagcucuuuuccua

SEQ ID NO: 3780527 - RNA, 15 nt, Human
uguauaguauuugaa

SEQ ID NO: 3780528 - RNA, 19 nt, Human
uguauaguauuugaaaaca

SEQ ID NO: 3780529 - RNA, 21 nt, Human
uguauaguauuugaaaacaga

SEQ ID NO: 3780530 - RNA, 16 nt, Human
uguauaguguaaaaua

SEQ ID NO: 3780531 - RNA, 16 nt, Human
uguauaguuaacacac

SEQ ID NO: 3780532 - RNA, 13 nt, Human
uguauaguuaugu

SEQ ID NO: 3780533 - RNA, 14 nt, Human
uguauaguuaugua

SEQ ID NO: 3780534 - RNA, 19 nt, Human
uguauaguuauguaaauaa

SEQ ID NO: 3780535 - RNA, 18 nt, Human
uguauaguugcuugccug

SEQ ID NO: 3780536 - RNA, 15 nt, Human
uguauaguugcuuuu

SEQ ID NO: 3780537 - RNA, 17 nt, Human
uguauaguugcuuuuga

SEQ ID NO: 3780538 - RNA, 21 nt, Human
uguauaguuguggacauuuaa

SEQ ID NO: 3780539 - RNA, 12 nt, Human
uguauauaaaaa

SEQ ID NO: 3780540 - RNA, 14 nt, Human
uguauauaaaaaug

SEQ ID NO: 3780541 - RNA, 16 nt, Human
uguauauaaaaauggc

SEQ ID NO: 3780542 - RNA, 15 nt, Human
uguauauacaauaac

SEQ ID NO: 3780543 - RNA, 14 nt, Human
uguauauacacaua

SEQ ID NO: 3780544 - RNA, 18 nt, Human
uguauauacacauauacc

SEQ ID NO: 3780545 - RNA, 17 nt, Human
uguuuauuaaucuuagu

SEQ ID NO: 3780546 - RNA, 13 nt, Human
uguuuauucauau

SEQ ID NO: 3780547 - RNA, 17 nt, Human
uguuuauucauaugcau

SEQ ID NO: 3780548 - RNA, 18 nt, Human
uguuuauucauaugcaua

SEQ ID NO: 3780549 - RNA, 13 nt, Human
uguuuauuccuga

SEQ ID NO: 3780550 - RNA, 17 nt, Human
uguuuauucuucuagag

SEQ ID NO: 3780551 - RNA, 20 nt, Human
uguuuauugaauucauuuca

SEQ ID NO: 3780552 - RNA, 23 nt, Human
uguuuauugaauucauuucacug

SEQ ID NO: 3780553 - RNA, 19 nt, Human
uguuuauugucaaaguggu

SEQ ID NO: 3780554 - RNA, 20 nt, Human
uguuuauuguugcugguuau

SEQ ID NO: 3780555 - RNA, 13 nt, Human
uguuuauuuacaa

SEQ ID NO: 3780556 - RNA, 12 nt, Human
uguuuauuuucu

SEQ ID NO: 3780557 - RNA, 22 nt, Human
uguuuauuuuuauauagcuuga

SEQ ID NO: 3780558 - RNA, 12 nt, Human
uguuuauuuuuc

SEQ ID NO: 3780559 - RNA, 14 nt, Human
uguuuauuuuucau

SEQ ID NO: 3780560 - RNA, 15 nt, Human
uguuuauuuuucaua

SEQ ID NO: 3780561 - RNA, 19 nt, Human
uguuuauuuuucauauugu

SEQ ID NO: 3780562 - RNA, 19 nt, Human
uguuuauuuuucuugucuu

SEQ ID NO: 3780563 - RNA, 23 nt, Human
uguuuauuuuucuugucuuuauu

SEQ ID NO: 3780564 - RNA, 16 nt, Human
uguuucaaaauaaaaa

SEQ ID NO: 3780565 - RNA, 15 nt, Human
uguuucaaggcacuc

SEQ ID NO: 3780566 - RNA, 19 nt, Human
uguuucaaggcacucuaga

SEQ ID NO: 3780567 - RNA, 20 nt, Human
uguuucaaggcacucuagau

SEQ ID NO: 3780568 - RNA, 21 nt, Human
uguuucaaggcacucuagauu

SEQ ID NO: 3780569 - RNA, 17 nt, Human
uguuucaaguggggcuc

SEQ ID NO: 3780570 - RNA, 16 nt, Human
uguuucaauugcaucu

SEQ ID NO: 3780571 - RNA, 13 nt, Human
uguuucacaaggu

SEQ ID NO: 3780572 - RNA, 16 nt, Human
uguuucacaaggucuu

SEQ ID NO: 3780573 - RNA, 17 nt, Human
uguuucacaguuugaaa

SEQ ID NO: 3780574 - RNA, 18 nt, Human
uguuucacgaaguuuguu

SEQ ID NO: 3780575 - RNA, 22 nt, Human
uguuucagcuaagggaagacau

SEQ ID NO: 3780576 - RNA, 24 nt, Human
uguuucagcuaagggaagacauuu

SEQ ID NO: 3780577 - RNA, 15 nt, Human
uguuucauccuuccc

SEQ ID NO: 3780578 - RNA, 19 nt, Human
uguuucauguuuugugacu

SEQ ID NO: 3780579 - RNA, 16 nt, Human
uguuucauuaacugug

SEQ ID NO: 3780580 - RNA, 15 nt, Human
uguuuccaauguuua

SEQ ID NO: 3780581 - RNA, 23 nt, Human
uguuuccaauguuuagcaaauac

SEQ ID NO: 3780582 - RNA, 20 nt, Human
uguuuccagcagaagacaaa

SEQ ID NO: 3780583 - RNA, 20 nt, Human
uguuuccagcauucccaggu

SEQ ID NO: 3780584 - RNA, 22 nt, Human
uguuucccaggcccacugugcc

SEQ ID NO: 3780585 - RNA, 18 nt, Human
uguuucccuucccuucca

SEQ ID NO: 3780586 - RNA, 15 nt, Human
uguuuccuggcacug

SEQ ID NO: 3780587 - RNA, 20 nt, Human
uguuuccuggcacugcuucc

SEQ ID NO: 3780588 - RNA, 12 nt, Human
uguuuccuucag

SEQ ID NO: 3780589 - RNA, 15 nt, Human
uguuuccuucagugc

SEQ ID NO: 3780590 - RNA, 13 nt, Human
uguuuccuucccu

SEQ ID NO: 3780591 - RNA, 23 nt, Human
uguuuccuugaggggagccagga

SEQ ID NO: 3780592 - RNA, 23 nt, Human
uguuuccuuguuuaucagauaca

SEQ ID NO: 3780593 - RNA, 16 nt, Human
uguuuccuuuuucaga

SEQ ID NO: 3780594 - RNA, 16 nt, Human
uguuuccuuuuuuccc

SEQ ID NO: 3780595 - RNA, 19 nt, Human
uguuucgugaaguauacug

SEQ ID NO: 3780596 - RNA, 20 nt, Human
uguuucuaccggagagagaa

SEQ ID NO: 3780597 - RNA, 23 nt, Human
uguuucuagagccugcuggaucu

SEQ ID NO: 3780598 - RNA, 16 nt, Human
uguuucuagaguuccu

SEQ ID NO: 3780599 - RNA, 13 nt, Human
uguuucuccccca

SEQ ID NO: 3780600 - RNA, 21 nt, Human
uguuucucccccauguucugu

SEQ ID NO: 3780601 - RNA, 15 nt, Human
uguuucuccugagcu

SEQ ID NO: 3780602 - RNA, 18 nt, Human
uguuucucuugagcuggc

SEQ ID NO: 3780603 - RNA, 12 nt, Human
uguuucugaaaa

SEQ ID NO: 3780604 - RNA, 13 nt, Human
uguuucugaaaag

SEQ ID NO: 3780605 - RNA, 16 nt, Human
uguuucugaaaagaaa

SEQ ID NO: 3780606 - RNA, 22 nt, Human
uguuucugaaaagaaauaauaa

SEQ ID NO: 3780607 - RNA, 23 nt, Human
uguuucugaaaagaaauaauaau

SEQ ID NO: 3780608 - RNA, 23 nt, Human
uguuucuggacccuuauaaaauc

SEQ ID NO: 3780609 - RNA, 17 nt, Human
uguuucuggauuucaua

SEQ ID NO: 3780610 - RNA, 11 nt, Human
uguuucuguac

SEQ ID NO: 3780611 - RNA, 14 nt, Human
uguuucugucagga

SEQ ID NO: 3780612 - RNA, 14 nt, Human
uguuucugugggcg

SEQ ID NO: 3780613 - RNA, 15 nt, Human
uguggggugaaaagu

SEQ ID NO: 3780614 - RNA, 21 nt, Human
uguggguacagagaggucaag

SEQ ID NO: 3780615 - RNA, 15 nt, Human
ugugggucaaggaau

SEQ ID NO: 3780616 - RNA, 17 nt, Human
ugugggugauggggagg

SEQ ID NO: 3780617 - RNA, 14 nt, Human
uguggguguccugc

SEQ ID NO: 3780618 - RNA, 23 nt, Human
uguggguguccugccugucugcc

SEQ ID NO: 3780619 - RNA, 21 nt, Human
uguggguuucuaaagcugcca

SEQ ID NO: 3780620 - RNA, 21 nt, Human
ugugguaagcaacauggcuuu

SEQ ID NO: 3780621 - RNA, 16 nt, Human
ugugguacaaucucaa

SEQ ID NO: 3780622 - RNA, 12 nt, Human
ugugguacagag

SEQ ID NO: 3780623 - RNA, 15 nt, Human
ugugguacagagaag

SEQ ID NO: 3780624 - RNA, 16 nt, Human
ugugguacagagaagc

SEQ ID NO: 3780625 - RNA, 13 nt, Human
ugugguagaaaca

SEQ ID NO: 3780626 - RNA, 22 nt, Human
ugugguagggacuuaaaaaacu

SEQ ID NO: 3780627 - RNA, 23 nt, Human
uguggucacagcuguauagcugc

SEQ ID NO: 3780628 - RNA, 14 nt, Human
ugugguccaaauag

SEQ ID NO: 3780629 - RNA, 16 nt, Human
uguggucccaacagga

SEQ ID NO: 3780630 - RNA, 16 nt, Human
uguggucccaccccac

SEQ ID NO: 3780631 - RNA, 11 nt, Human
uguggucucag

SEQ ID NO: 3780632 - RNA, 14 nt, Human
uguggucucaggau

SEQ ID NO: 3780633 - RNA, 13 nt, Human
uguggucuccacu

SEQ ID NO: 3780634 - RNA, 17 nt, Human
uguggugaaaagcaggu

SEQ ID NO: 3780635 - RNA, 17 nt, Human
uguggugacuuuggaua

SEQ ID NO: 3780636 - RNA, 16 nt, Human
uguggugcagugugaa

SEQ ID NO: 3780637 - RNA, 19 nt, Human
uguggugccugaggucugu

SEQ ID NO: 3780638 - RNA, 13 nt, Human
uguggugcugaca

SEQ ID NO: 3780639 - RNA, 14 nt, Human
ugugguggccucag

SEQ ID NO: 3780640 - RNA, 13 nt, Human
ugugguguaauuu

SEQ ID NO: 3780641 - RNA, 14 nt, Human
uguggugucugugu

SEQ ID NO: 3780642 - RNA, 16 nt, Human
uguggugugagcuuca

SEQ ID NO: 3780643 - RNA, 14 nt, Human
ugugguuaaugcca

SEQ ID NO: 3780644 - RNA, 20 nt, Human
ugugguuauaacuuaaugaa

SEQ ID NO: 3780645 - RNA, 20 nt, Human
ugugguuauuuuuauacagu

SEQ ID NO: 3780646 - RNA, 21 nt, Human
ugugguuauuuuuauacagua

SEQ ID NO: 3780647 - RNA, 15 nt, Human
ugugguuuauauauu

SEQ ID NO: 3780648 - RNA, 14 nt, Human
ugugguuuauguca

SEQ ID NO: 3780649 - RNA, 22 nt, Human
ugugguuucauguuaguuaccu

SEQ ID NO: 3780650 - RNA, 12 nt, Human
ugugguuucuuu

SEQ ID NO: 3780651 - RNA, 16 nt, Human
ugugguuucuuuuuga

SEQ ID NO: 3780652 - RNA, 18 nt, Human
ugugguuuggaauauuaa

SEQ ID NO: 3780653 - RNA, 12 nt, Human
ugugguuuguug

SEQ ID NO: 3780654 - RNA, 21 nt, Human
ugugguuuuccccucccuggg

SEQ ID NO: 3780655 - RNA, 23 nt, Human
ugugguuuuccccucccuggguu

SEQ ID NO: 3780656 - RNA, 19 nt, Human
ugugguuuucuuuugccau

SEQ ID NO: 3780657 - RNA, 16 nt, Human
uguguaaaaaaaccac

SEQ ID NO: 3780658 - RNA, 20 nt, Human
uguguaaacaaaaugaagcu

SEQ ID NO: 3780659 - RNA, 14 nt, Human
uguguaaaguuagu

SEQ ID NO: 3780660 - RNA, 19 nt, Human
uguguaagagaauguugaa

SEQ ID NO: 3780661 - RNA, 13 nt, Human
uguguaaguagau

SEQ ID NO: 3780662 - RNA, 15 nt, Human
uguguaauaaagugu

SEQ ID NO: 3780663 - RNA, 19 nt, Human
uguguaauaaaguguuuuc

SEQ ID NO: 3780664 - RNA, 20 nt, Human
uguguaauaaaguguuuuca

SEQ ID NO: 3780665 - RNA, 22 nt, Human
uguguaauaaaguguuuucaga

SEQ ID NO: 3780666 - RNA, 15 nt, Human
uguguaaucaauaaa

SEQ ID NO: 3780667 - RNA, 20 nt, Human
uguguaaucaauaaacgauu

SEQ ID NO: 3780668 - RNA, 13 nt, Human
uguguaaugaaaa

SEQ ID NO: 3780669 - RNA, 21 nt, Human
uguguaauuagugccacuuaa

SEQ ID NO: 3780670 - RNA, 23 nt, Human
uguguaauuuaaaauugugaugu

SEQ ID NO: 3780671 - RNA, 16 nt, Human
uguguaauuuuguucu

SEQ ID NO: 3780672 - RNA, 17 nt, Human
uguguacaauguacaca

SEQ ID NO: 3780673 - RNA, 21 nt, Human
uguguacagaauucugcuacc

SEQ ID NO: 3780674 - RNA, 23 nt, Human
uguguacagaauucugcuaccuc

SEQ ID NO: 3780675 - RNA, 18 nt, Human
uguguacauaacucugua

SEQ ID NO: 3780676 - RNA, 22 nt, Human
uguguacucacugaagccugcg

SEQ ID NO: 3780677 - RNA, 16 nt, Human
uguguacucuggccuc

SEQ ID NO: 3780678 - RNA, 17 nt, Human
uguguacucuggccucu

SEQ ID NO: 3780679 - RNA, 18 nt, Human
uguguacucuggccucug

SEQ ID NO: 3780680 - RNA, 10 nt, Human
uguguacugu

SEQ ID NO: 3780681 - RNA, 17 nt, Human
uguguacuguauagaca

SEQ ID NO: 3780682 - RNA, 17 nt, Human
uguguagaaaaaaaaac

SEQ ID NO: 3780683 - RNA, 21 nt, Human
uguguagaguuaagaagcugu

SEQ ID NO: 3780684 - RNA, 15 nt, Human
uguguagccugugca

SEQ ID NO: 3780685 - RNA, 20 nt, Human
uguguagccuuuuuguauaa

SEQ ID NO: 3780686 - RNA, 19 nt, Human
uguguagcugugaccugcu

SEQ ID NO: 3780687 - RNA, 17 nt, Human
uguguagcuuugcucuu

SEQ ID NO: 3780688 - RNA, 14 nt, Human
uguguaguucaugu

SEQ ID NO: 3780689 - RNA, 14 nt, Human
uguguaguuccagc

SEQ ID NO: 3780690 - RNA, 13 nt, Human
uguguauaaacaa

SEQ ID NO: 3780691 - RNA, 22 nt, Human
uguguauacagcccugacgcaa

SEQ ID NO: 3780692 - RNA, 15 nt, Human
uguguauauaguuuu

SEQ ID NO: 3780693 - RNA, 13 nt, Human
uguguauauauac

SEQ ID NO: 3780694 - RNA, 18 nt, Human
uguguauauauguguaua

SEQ ID NO: 3780695 - RNA, 13 nt, Human
uguguauauggac

SEQ ID NO: 3780696 - RNA, 14 nt, Human
uguguauauggaca

SEQ ID NO: 3780697 - RNA, 15 nt, Human
uguguauauuugauu

SEQ ID NO: 3780698 - RNA, 21 nt, Human
uguguauauuugauuuauuaa

SEQ ID NO: 3780699 - RNA, 23 nt, Human
uguguaugcacaugaacuuagau

SEQ ID NO: 3780700 - RNA, 14 nt, Human
uguguaugccaaga

SEQ ID NO: 3780701 - RNA, 18 nt, Human
uguguaugcgugugugug

SEQ ID NO: 3780702 - RNA, 13 nt, Human
uguguaugcugcu

SEQ ID NO: 3780703 - RNA, 15 nt, Human
uguguauguacauau

SEQ ID NO: 3780704 - RNA, 19 nt, Human
uguguaugugcgugugugc

SEQ ID NO: 3780705 - RNA, 12 nt, Human
uguguauguggg

SEQ ID NO: 3780706 - RNA, 22 nt, Human
uguguauguguacgugugugug

SEQ ID NO: 3780707 - RNA, 16 nt, Human
uguguauguguauuua

SEQ ID NO: 3780708 - RNA, 16 nt, Human
uguguaugugugugug

SEQ ID NO: 3780709 - RNA, 19 nt, Human
uguguauucauugaaguca

SEQ ID NO: 3780710 - RNA, 14 nt, Human
uguguauuccaaga

SEQ ID NO: 3780711 - RNA, 15 nt, Human
uguguauuguuccca

SEQ ID NO: 3780712 - RNA, 22 nt, Human
uguguauuuaacagggagggga

SEQ ID NO: 3780713 - RNA, 23 nt, Human
uguguauuuaauuguaaacugua

SEQ ID NO: 3780714 - RNA, 23 nt, Human
uguguauuucaguuauugucccu

SEQ ID NO: 3780715 - RNA, 11 nt, Human
uguguauuugc

SEQ ID NO: 3780716 - RNA, 13 nt, Human
uguguauuugcua

SEQ ID NO: 3780717 - RNA, 15 nt, Human
uguguauuuucaguc

SEQ ID NO: 3780718 - RNA, 23 nt, Human
ugugucacaaugagauugaauuu

SEQ ID NO: 3780719 - RNA, 15 nt, Human
ugugucacuggcugc

SEQ ID NO: 3780720 - RNA, 14 nt, Human
ugugucacuugugc

SEQ ID NO: 3780721 - RNA, 17 nt, Human
ugugucacuugugcuuu

SEQ ID NO: 3780722 - RNA, 21 nt, Human
ugugucacuugugcuuugcuc

SEQ ID NO: 3780723 - RNA, 14 nt, Human
ugugucagcugagg

SEQ ID NO: 3780724 - RNA, 19 nt, Human
ugugucagguggggcagcu

SEQ ID NO: 3780725 - RNA, 22 nt, Human
ugugucaguggggcucucugag

SEQ ID NO: 3780726 - RNA, 14 nt, Human
ugugucauuucaaa

SEQ ID NO: 3780727 - RNA, 16 nt, Human
uguguccaccuguggg

SEQ ID NO: 3780728 - RNA, 19 nt, Human
uguguccaccugugggugu

SEQ ID NO: 3780729 - RNA, 14 nt, Human
uguuggcagccucu

SEQ ID NO: 3780730 - RNA, 21 nt, Human
uguuggcagugagugagccug

SEQ ID NO: 3780731 - RNA, 15 nt, Human
uguuggccaaagcca

SEQ ID NO: 3780732 - RNA, 13 nt, Human
uguuggccaggcu

SEQ ID NO: 3780733 - RNA, 23 nt, Human
uguuggccaggcuggucuaaaac

SEQ ID NO: 3780734 - RNA, 16 nt, Human
uguuggccuccggccu

SEQ ID NO: 3780735 - RNA, 15 nt, Human
uguuggcgagaggag

SEQ ID NO: 3780736 - RNA, 20 nt, Human
uguuggcgagaggaggggcc

SEQ ID NO: 3780737 - RNA, 22 nt, Human
uguuggcguaggcuacagagaa

SEQ ID NO: 3780738 - RNA, 17 nt, Human
uguuggcugggggccuc

SEQ ID NO: 3780739 - RNA, 19 nt, Human
uguuggcugggggccucag

SEQ ID NO: 3780740 - RNA, 13 nt, Human
uguugggaaaaag

SEQ ID NO: 3780741 - RNA, 14 nt, Human
uguugggacugcua

SEQ ID NO: 3780742 - RNA, 19 nt, Human
uguugggacugcuaaauaa

SEQ ID NO: 3780743 - RNA, 14 nt, Human
uguuggggcugcuc

SEQ ID NO: 3780744 - RNA, 21 nt, Human
uguugguaauuauuuugguac

SEQ ID NO: 3780745 - RNA, 18 nt, Human
uguugguauuuaucuauu

SEQ ID NO: 3780746 - RNA, 14 nt, Human
uguuggugcacagc

SEQ ID NO: 3780747 - RNA, 18 nt, Human
uguuggugcacagcacaa

SEQ ID NO: 3780748 - RNA, 16 nt, Human
uguugguuguuuuuuc

SEQ ID NO: 3780749 - RNA, 14 nt, Human
uguugguuuaauau

SEQ ID NO: 3780750 - RNA, 14 nt, Human
uguugguuuacuuu

SEQ ID NO: 3780751 - RNA, 19 nt, Human
uguugguuuacuuucaaau

SEQ ID NO: 3780752 - RNA, 20 nt, Human
uguugguuuacuuucaaauc

SEQ ID NO: 3780753 - RNA, 13 nt, Human
uguuguaaaacaa

SEQ ID NO: 3780754 - RNA, 23 nt, Human
uguuguaaaacaaaauuugacua

SEQ ID NO: 3780755 - RNA, 13 nt, Human
uguuguaaagcaa

SEQ ID NO: 3780756 - RNA, 14 nt, Human
uguuguaaauauuu

SEQ ID NO: 3780757 - RNA, 13 nt, Human
uguuguaaauuag

SEQ ID NO: 3780758 - RNA, 18 nt, Human
uguuguaagaauucugau

SEQ ID NO: 3780759 - RNA, 17 nt, Human
uguuguaagcaacaggc

SEQ ID NO: 3780760 - RNA, 22 nt, Human
uguuguaaugcugcacuuccug

SEQ ID NO: 3780761 - RNA, 18 nt, Human
uguuguaauucuucaguu

SEQ ID NO: 3780762 - RNA, 21 nt, Human
uguuguacauacgauuuaagg

SEQ ID NO: 3780763 - RNA, 22 nt, Human
uguuguacauuuaugauuuaau

SEQ ID NO: 3780764 - RNA, 15 nt, Human
uguuguacuuaaaug

SEQ ID NO: 3780765 - RNA, 16 nt, Human
uguuguacuuaaaugg

SEQ ID NO: 3780766 - RNA, 17 nt, Human
uguuguagagaaaacau

SEQ ID NO: 3780767 - RNA, 22 nt, Human
uguuguagauacaaucagcugc

SEQ ID NO: 3780768 - RNA, 21 nt, Human
uguuguagauugauuguauug

SEQ ID NO: 3780769 - RNA, 13 nt, Human
uguuguauuaaca

SEQ ID NO: 3780770 - RNA, 11 nt, Human
uguugucaaga

SEQ ID NO: 3780771 - RNA, 16 nt, Human
uguugucaagaauagc

SEQ ID NO: 3780772 - RNA, 13 nt, Human
uguugucaccaga

SEQ ID NO: 3780773 - RNA, 15 nt, Human
uguugucagcaucuu

SEQ ID NO: 3780774 - RNA, 14 nt, Human
uguugucagcugaa

SEQ ID NO: 3780775 - RNA, 14 nt, Human
uguugucauugcug

SEQ ID NO: 3780776 - RNA, 15 nt, Human
uguugucauugcugu

SEQ ID NO: 3780777 - RNA, 14 nt, Human
uguuguccuuuuca

SEQ ID NO: 3780778 - RNA, 20 nt, Human
uguugucguaaagauuuggg

SEQ ID NO: 3780779 - RNA, 17 nt, Human
uguugucuguuuguucu

SEQ ID NO: 3780780 - RNA, 16 nt, Human
uguugucuugaaagau

SEQ ID NO: 3780781 - RNA, 12 nt, Human
uguugugccaca

SEQ ID NO: 3780782 - RNA, 22 nt, Human
uguuguggguucuauguuuacu

SEQ ID NO: 3780783 - RNA, 15 nt, Human
uguugugugugggag

SEQ ID NO: 3780784 - RNA, 14 nt, Human
uguuguuaaaauua

SEQ ID NO: 3780785 - RNA, 14 nt, Human
uguuguuaaauauc

SEQ ID NO: 3780786 - RNA, 17 nt, Human
uguuguuaaugaaaaug

SEQ ID NO: 3780787 - RNA, 20 nt, Human
uguuguuaaugaaaauguca

SEQ ID NO: 3780788 - RNA, 12 nt, Human
uguuguuagaga

SEQ ID NO: 3780789 - RNA, 19 nt, Human
uguuguuaugaugugcuua

SEQ ID NO: 3780790 - RNA, 11 nt, Human
uguuguuauuu

SEQ ID NO: 3780791 - RNA, 17 nt, Human
uguauguguaauaaaua

SEQ ID NO: 3780792 - RNA, 12 nt, Human
uguauguguauu

SEQ ID NO: 3780793 - RNA, 14 nt, Human
uguauguguguaug

SEQ ID NO: 3780794 - RNA, 19 nt, Human
uguauguguguuucugucc

SEQ ID NO: 3780795 - RNA, 20 nt, Human
uguauguguguuucuguccu

SEQ ID NO: 3780796 - RNA, 11 nt, Human
uguauguguuu

SEQ ID NO: 3780797 - RNA, 19 nt, Human
uguauguguuuagaauuga

SEQ ID NO: 3780798 - RNA, 22 nt, Human
uguauguuaaagagaaugaguc

SEQ ID NO: 3780799 - RNA, 15 nt, Human
uguauguuauagaua

SEQ ID NO: 3780800 - RNA, 14 nt, Human
uguauguugugaag

SEQ ID NO: 3780801 - RNA, 13 nt, Human
uguauguuuacau

SEQ ID NO: 3780802 - RNA, 15 nt, Human
uguauguuuacauau

SEQ ID NO: 3780803 - RNA, 18 nt, Human
uguauguuuuucaguuca

SEQ ID NO: 3780804 - RNA, 22 nt, Human
uguauguuuuucaguucaaagu

SEQ ID NO: 3780805 - RNA, 14 nt, Human
uguauuaaauuaca

SEQ ID NO: 3780806 - RNA, 14 nt, Human
uguauuaacaaaag

SEQ ID NO: 3780807 - RNA, 22 nt, Human
uguauuaacacuacucaaagca

SEQ ID NO: 3780808 - RNA, 18 nt, Human
uguauuaagagugaaaau

SEQ ID NO: 3780809 - RNA, 19 nt, Human
uguauuaagggauuuagua

SEQ ID NO: 3780810 - RNA, 22 nt, Human
uguauuaauaaauagagcaauu

SEQ ID NO: 3780811 - RNA, 13 nt, Human
uguauuacaaauc

SEQ ID NO: 3780812 - RNA, 15 nt, Human
uguauuacauaaaua

SEQ ID NO: 3780813 - RNA, 16 nt, Human
uguauuagauguucuc

SEQ ID NO: 3780814 - RNA, 15 nt, Human
uguauuagucacaga

SEQ ID NO: 3780815 - RNA, 19 nt, Human
uguauuauacuuagucaaa

SEQ ID NO: 3780816 - RNA, 15 nt, Human
uguauuauguccugu

SEQ ID NO: 3780817 - RNA, 21 nt, Human
uguauuauuuacauuuaauag

SEQ ID NO: 3780818 - RNA, 13 nt, Human
uguauuauuucau

SEQ ID NO: 3780819 - RNA, 21 nt, Human
uguauuauuucauuauguaaa

SEQ ID NO: 3780820 - RNA, 14 nt, Human
uguauucaauuaaa

SEQ ID NO: 3780821 - RNA, 23 nt, Human
uguauucacgugcagcagcaaca

SEQ ID NO: 3780822 - RNA, 18 nt, Human
uguauucagacagaugag

SEQ ID NO: 3780823 - RNA, 17 nt, Human
uguauucaucuuuugua

SEQ ID NO: 3780824 - RNA, 19 nt, Human
uguauuccaguuuguuuau

SEQ ID NO: 3780825 - RNA, 20 nt, Human
uguauucucugagcugugca

SEQ ID NO: 3780826 - RNA, 17 nt, Human
uguauucuuugauguua

SEQ ID NO: 3780827 - RNA, 18 nt, Human
uguauucuuuucucagug

SEQ ID NO: 3780828 - RNA, 20 nt, Human
uguauugaaucauguaguau

SEQ ID NO: 3780829 - RNA, 15 nt, Human
uguauugagauuucu

SEQ ID NO: 3780830 - RNA, 23 nt, Human
uguauugaugacaguaguaccaa

SEQ ID NO: 3780831 - RNA, 14 nt, Human
uguauugcuguccu

SEQ ID NO: 3780832 - RNA, 19 nt, Human
uguauuggauauauaagag

SEQ ID NO: 3780833 - RNA, 14 nt, Human
uguauuggccugga

SEQ ID NO: 3780834 - RNA, 16 nt, Human
uguauugguuaaaacu

SEQ ID NO: 3780835 - RNA, 18 nt, Human
uguauugguuaaaacugu

SEQ ID NO: 3780836 - RNA, 19 nt, Human
uguauuguaaacauguguu

SEQ ID NO: 3780837 - RNA, 17 nt, Human
uguauuguaacuauguu

SEQ ID NO: 3780838 - RNA, 11 nt, Human
uguauuguacc

SEQ ID NO: 3780839 - RNA, 19 nt, Human
uguauuguaccuuuuaaca

SEQ ID NO: 3780840 - RNA, 15 nt, Human
ugucacuuugcucug

SEQ ID NO: 3780841 - RNA, 18 nt, Human
ugucacuuugcucugggu

SEQ ID NO: 3780842 - RNA, 21 nt, Human
ugucacuuuuugaggcaaaag

SEQ ID NO: 3780843 - RNA, 22 nt, Human
ugucagaaaaacaauaagagcg

SEQ ID NO: 3780844 - RNA, 12 nt, Human
ugucagacacag

SEQ ID NO: 3780845 - RNA, 14 nt, Human
ugucagacacagau

SEQ ID NO: 3780846 - RNA, 21 nt, Human
ugucagacagaacuugaaugu

SEQ ID NO: 3780847 - RNA, 20 nt, Human
ugucagaccuauuugacaua

SEQ ID NO: 3780848 - RNA, 14 nt, Human
ugucagacuuuaaa

SEQ ID NO: 3780849 - RNA, 15 nt, Human
ugucagauacaaugu

SEQ ID NO: 3780850 - RNA, 15 nt, Human
ugucagauaugauau

SEQ ID NO: 3780851 - RNA, 21 nt, Human
ugucagauauuuuuucagaaa

SEQ ID NO: 3780852 - RNA, 18 nt, Human
ugucagauccaggagcuc

SEQ ID NO: 3780853 - RNA, 21 nt, Human
ugucagauccaggagcuccag

SEQ ID NO: 3780854 - RNA, 18 nt, Human
ugucagaugagaacaaag

SEQ ID NO: 3780855 - RNA, 21 nt, Human
ugucagaugcccgagggaggg

SEQ ID NO: 3780856 - RNA, 14 nt, Human
ugucagauuccuuu

SEQ ID NO: 3780857 - RNA, 17 nt, Human
ugucagauuccuuuccc

SEQ ID NO: 3780858 - RNA, 13 nt, Human
ugucagcaggaag

SEQ ID NO: 3780859 - RNA, 16 nt, Human
ugucagcagggacugu

SEQ ID NO: 3780860 - RNA, 20 nt, Human
ugucagcaguugcugguaaa

SEQ ID NO: 3780861 - RNA, 16 nt, Human
ugucagccauuccugu

SEQ ID NO: 3780862 - RNA, 19 nt, Human
ugucagcuacuaaugaugu

SEQ ID NO: 3780863 - RNA, 21 nt, Human
ugucagcuacuaaugauguuu

SEQ ID NO: 3780864 - RNA, 20 nt, Human
ugucagcuccccucggagaa

SEQ ID NO: 3780865 - RNA, 19 nt, Human
ugucagcugaggcuggggg

SEQ ID NO: 3780866 - RNA, 24 nt, Human
ugucagcugaggcugggggagagc

SEQ ID NO: 3780867 - RNA, 17 nt, Human
ugucaggaacagaagga

SEQ ID NO: 3780868 - RNA, 18 nt, Human
ugucaggaacagaaggau

SEQ ID NO: 3780869 - RNA, 16 nt, Human
ugucaggagagcagcg

SEQ ID NO: 3780870 - RNA, 11 nt, Human
ugucaggaggc

SEQ ID NO: 3780871 - RNA, 14 nt, Human
ugucaggcacuggg

SEQ ID NO: 3780872 - RNA, 14 nt, Human
ugucaggccugugu

SEQ ID NO: 3780873 - RNA, 15 nt, Human
ugucaggcugcuggc

SEQ ID NO: 3780874 - RNA, 24 nt, Human
ugucaggcugcuggcgccucugca

SEQ ID NO: 3780875 - RNA, 23 nt, Human
ugucagggaguguucccuaucca

SEQ ID NO: 3780876 - RNA, 20 nt, Human
ugucagguggggcagcuuga

SEQ ID NO: 3780877 - RNA, 15 nt, Human
ugucaguauccaggc

SEQ ID NO: 3780878 - RNA, 18 nt, Human
ugucaguauguggaagug

SEQ ID NO: 3780879 - RNA, 20 nt, Human
ugucaguauguggaagugug

SEQ ID NO: 3780880 - RNA, 15 nt, Human
ugucaguauuucaac

SEQ ID NO: 3780881 - RNA, 18 nt, Human
ugucaguauuucagugua

SEQ ID NO: 3780882 - RNA, 14 nt, Human
ugucagucacagcc

SEQ ID NO: 3780883 - RNA, 18 nt, Human
ugucagucacagccaccc

SEQ ID NO: 3780884 - RNA, 13 nt, Human
ugucagucugcuu

SEQ ID NO: 3780885 - RNA, 15 nt, Human
ugucaguggaagaag

SEQ ID NO: 3780886 - RNA, 12 nt, Human
ugucagugugac

SEQ ID NO: 3780887 - RNA, 14 nt, Human
ugucagugugacug

SEQ ID NO: 3780888 - RNA, 22 nt, Human
ugucaguuuauguuuuggucca

SEQ ID NO: 3780889 - RNA, 21 nt, Human
ugucauaacauccagagcuuu

SEQ ID NO: 3780890 - RNA, 15 nt, Human
ugucauaagaaugaa

SEQ ID NO: 3780891 - RNA, 14 nt, Human
ugucauacagagaa

SEQ ID NO: 3780892 - RNA, 16 nt, Human
ugucauauacugccau

SEQ ID NO: 3780893 - RNA, 22 nt, Human
ugucauauauggggggccaaca

SEQ ID NO: 3780894 - RNA, 19 nt, Human
ugucauauauuacuagcau

SEQ ID NO: 3780895 - RNA, 13 nt, Human
ugucauaucagca

SEQ ID NO: 3780896 - RNA, 17 nt, Human
ugucauaucagcacaua

SEQ ID NO: 3780897 - RNA, 23 nt, Human
ugucauaucagcacauauuuucu

SEQ ID NO: 3780898 - RNA, 14 nt, Human
ugucaucaauuaaa

SEQ ID NO: 3780899 - RNA, 15 nt, Human
ugucaucaauuaaag

SEQ ID NO: 3780900 - RNA, 19 nt, Human
ugucaucagaagauaacuu

SEQ ID NO: 3780901 - RNA, 18 nt, Human
ugucaucagccaccaucc

SEQ ID NO: 3780902 - RNA, 19 nt, Human
ugucaucauuguauauaug

SEQ ID NO: 3780903 - RNA, 23 nt, Human
ugucauccucaaagaaaguguau

SEQ ID NO: 3780904 - RNA, 23 nt, Human
ugucauccuuggucuuuguaucu

SEQ ID NO: 3780905 - RNA, 13 nt, Human
ugucaucugagaa

SEQ ID NO: 3780906 - RNA, 16 nt, Human
ugucaugaacauguuc

SEQ ID NO: 3780907 - RNA, 20 nt, Human
ugucaugcagaguauuucua

SEQ ID NO: 3780908 - RNA, 15 nt, Human
ugucaugccccccuc

SEQ ID NO: 3780909 - RNA, 16 nt, Human
ugucaugccccccuca

SEQ ID NO: 3780910 - RNA, 14 nt, Human
ugucaugcugccuu

SEQ ID NO: 3780911 - RNA, 15 nt, Human
ugucaugcugccuua

SEQ ID NO: 3780912 - RNA, 11 nt, Human
ugucaugugua

SEQ ID NO: 3780913 - RNA, 13 nt, Human
ugucauguguaua

SEQ ID NO: 3780914 - RNA, 16 nt, Human
ugucauguguucccuu

SEQ ID NO: 3780915 - RNA, 18 nt, Human
ugucauguguucccuuug

SEQ ID NO: 3780916 - RNA, 22 nt, Human
ugucauguguucccuuugucuu

SEQ ID NO: 3780917 - RNA, 13 nt, Human
ugucauuaaaggu

SEQ ID NO: 3780918 - RNA, 18 nt, Human
ugucauuaaauaaaaauu

SEQ ID NO: 3780919 - RNA, 19 nt, Human
ugucauuaccagacgguuc

SEQ ID NO: 3780920 - RNA, 22 nt, Human
ugucauuagugagacauauuua

SEQ ID NO: 3780921 - RNA, 16 nt, Human
ugucauucaaaugggu

SEQ ID NO: 3780922 - RNA, 21 nt, Human
ugucauucaaaugggugauau

SEQ ID NO: 3780923 - RNA, 15 nt, Human
ugucauucagaaaaa

SEQ ID NO: 3780924 - RNA, 23 nt, Human
ugucauucgcuacuaugauuuaa

SEQ ID NO: 3780925 - RNA, 12 nt, Human
ugucauuguuau

SEQ ID NO: 3780926 - RNA, 17 nt, Human
ugucauuuaugugucag

SEQ ID NO: 3780927 - RNA, 16 nt, Human
ugucauuucauuuccu

SEQ ID NO: 3780928 - RNA, 17 nt, Human
ugucauuucauuuccua

SEQ ID NO: 3780929 - RNA, 23 nt, Human
ugucauuugcuggagcucugccc

SEQ ID NO: 3780930 - RNA, 12 nt, Human
ugucauuugcuu

SEQ ID NO: 3780931 - RNA, 13 nt, Human
ugucauuuguuaa

SEQ ID NO: 3780932 - RNA, 20 nt, Human
ugucauuuucauuagcaaaa

SEQ ID NO: 3780933 - RNA, 14 nt, Human
ugucauuuucucca

SEQ ID NO: 3780934 - RNA, 15 nt, Human
ugucauuuuugcagu

SEQ ID NO: 3780935 - RNA, 15 nt, Human
ugucauuuuuuuucu

SEQ ID NO: 3780936 - RNA, 17 nt, Human
uguccaaacguccucuu

SEQ ID NO: 3780937 - RNA, 17 nt, Human
uguccaaacugccuaag

SEQ ID NO: 3780938 - RNA, 19 nt, Human
uguccaaagaggcugcccc

SEQ ID NO: 3780939 - RNA, 20 nt, Human
uguccaaagaggcugccccu

SEQ ID NO: 3780940 - RNA, 17 nt, Human
uguccaaagcagggucu

SEQ ID NO: 3780941 - RNA, 19 nt, Human
uguccaaaggaggcuggca

SEQ ID NO: 3780942 - RNA, 21 nt, Human
uguccaaccuaaccccuuucc

SEQ ID NO: 3780943 - RNA, 14 nt, Human
uguccaacuaaaaa

SEQ ID NO: 3780944 - RNA, 14 nt, Human
uguccaacuggccc

SEQ ID NO: 3780945 - RNA, 19 nt, Human
uguccaacuggcccuauuu

SEQ ID NO: 3780946 - RNA, 20 nt, Human
ugugaagaugcauuguaguu

SEQ ID NO: 3780947 - RNA, 17 nt, Human
ugugaagauguuugcaa

SEQ ID NO: 3780948 - RNA, 15 nt, Human
ugugaagcauuuaca

SEQ ID NO: 3780949 - RNA, 14 nt, Human
ugugaagcccuguu

SEQ ID NO: 3780950 - RNA, 12 nt, Human
ugugaagcugga

SEQ ID NO: 3780951 - RNA, 21 nt, Human
ugugaagcuggaacugcggga

SEQ ID NO: 3780952 - RNA, 22 nt, Human
ugugaagcuuaagggucauaug

SEQ ID NO: 3780953 - RNA, 18 nt, Human
ugugaaggaccuucacuc

SEQ ID NO: 3780954 - RNA, 23 nt, Human
ugugaaggcagagaaagggacaa

SEQ ID NO: 3780955 - RNA, 14 nt, Human
ugugaagggaagga

SEQ ID NO: 3780956 - RNA, 17 nt, Human
ugugaaggugauuuaag

SEQ ID NO: 3780957 - RNA, 18 nt, Human
ugugaaguguuaauacua

SEQ ID NO: 3780958 - RNA, 14 nt, Human
ugugaaguuuacau

SEQ ID NO: 3780959 - RNA, 20 nt, Human
ugugaaguuuacauuguaaa

SEQ ID NO: 3780960 - RNA, 16 nt, Human
ugugaauaauuacagu

SEQ ID NO: 3780961 - RNA, 16 nt, Human
ugugaauaccccaaga

SEQ ID NO: 3780962 - RNA, 18 nt, Human
ugugaauauaaaugugug

SEQ ID NO: 3780963 - RNA, 20 nt, Human
ugugaauauggacucaguuu

SEQ ID NO: 3780964 - RNA, 16 nt, Human
ugugaaucaaggguca

SEQ ID NO: 3780965 - RNA, 22 nt, Human
ugugaaucaagggucaggccuu

SEQ ID NO: 3780966 - RNA, 14 nt, Human
ugugaaucagaccc

SEQ ID NO: 3780967 - RNA, 15 nt, Human
ugugaaucagacccu

SEQ ID NO: 3780968 - RNA, 20 nt, Human
ugugaaugcagguuuuauca

SEQ ID NO: 3780969 - RNA, 15 nt, Human
ugugaaugcuucuca

SEQ ID NO: 3780970 - RNA, 16 nt, Human
ugugaaugggaaaaga

SEQ ID NO: 3780971 - RNA, 13 nt, Human
ugugaauuacuaa

SEQ ID NO: 3780972 - RNA, 15 nt, Human
ugugaauuacuaacu

SEQ ID NO: 3780973 - RNA, 22 nt, Human
ugugaauuaggcuguaacuacu

SEQ ID NO: 3780974 - RNA, 19 nt, Human
ugugaauuauugacacuga

SEQ ID NO: 3780975 - RNA, 13 nt, Human
ugugaauucagau

SEQ ID NO: 3780976 - RNA, 14 nt, Human
ugugaauucagauu

SEQ ID NO: 3780977 - RNA, 19 nt, Human
ugugaauugaaauguucgu

SEQ ID NO: 3780978 - RNA, 16 nt, Human
ugugaauugauaauaa

SEQ ID NO: 3780979 - RNA, 17 nt, Human
ugugaauugauaauaaa

SEQ ID NO: 3780980 - RNA, 18 nt, Human
ugugaauugccugcagag

SEQ ID NO: 3780981 - RNA, 22 nt, Human
ugugaauuuuuaagcugcaaau

SEQ ID NO: 3780982 - RNA, 15 nt, Human
ugugacaaaaaauua

SEQ ID NO: 3780983 - RNA, 21 nt, Human
ugugacaaaaaauuaaagcau

SEQ ID NO: 3780984 - RNA, 21 nt, Human
ugugacaauucuguuuuuaau

SEQ ID NO: 3780985 - RNA, 19 nt, Human
ugugacaauuuuguacaaa

SEQ ID NO: 3780986 - RNA, 15 nt, Human
ugugacacacuacac

SEQ ID NO: 3780987 - RNA, 17 nt, Human
ugugacaggcagcagag

SEQ ID NO: 3780988 - RNA, 12 nt, Human
ugugacagggcc

SEQ ID NO: 3780989 - RNA, 13 nt, Human
ugugacagggcca

SEQ ID NO: 3780990 - RNA, 14 nt, Human
ugugacagggccag

SEQ ID NO: 3780991 - RNA, 21 nt, Human
ugugacauacccccuccccca

SEQ ID NO: 3780992 - RNA, 21 nt, Human
ugugacaucucuauuccccac

SEQ ID NO: 3780993 - RNA, 21 nt, Human
ugugacaugcgggcugggcag

SEQ ID NO: 3780994 - RNA, 20 nt, Human
ugugacauggugccugagag

SEQ ID NO: 3780995 - RNA, 15 nt, Human
ugugacauguuuuau

SEQ ID NO: 3780996 - RNA, 10 nt, Human
ugugacauuu

SEQ ID NO: 3780997 - RNA, 17 nt, Human
ugugacauuuauauauu

SEQ ID NO: 3780998 - RNA, 22 nt, Human
ugugacauuuggagagggggcc

SEQ ID NO: 3780999 - RNA, 18 nt, Human
ugugacauuugucauuuu

SEQ ID NO: 3781000 - RNA, 22 nt, Human
ugugacauuugucauuuucauu

SEQ ID NO: 3781001 - RNA, 18 nt, Human
ugugaccaaaaguuacau

SEQ ID NO: 3781002 - RNA, 13 nt, Human
ugugaccaacugu

SEQ ID NO: 3781003 - RNA, 17 nt, Human
ugugaccaacuguguug

SEQ ID NO: 3781004 - RNA, 19 nt, Human
ugugaccaacuguguugua

SEQ ID NO: 3781005 - RNA, 21 nt, Human
ugugaccaacuguguuguauu

SEQ ID NO: 3781006 - RNA, 22 nt, Human
ugugaccacugcagaagacagu

SEQ ID NO: 3781007 - RNA, 21 nt, Human
ugugacccacuucucaucaca

SEQ ID NO: 3781008 - RNA, 17 nt, Human
ugugacccagcacugcc

SEQ ID NO: 3781009 - RNA, 20 nt, Human
ugugacccagcacugcccaa

SEQ ID NO: 3781010 - RNA, 17 nt, Human
ugugacccccagcuccg

SEQ ID NO: 3781011 - RNA, 20 nt, Human
ugugacccccagcuccggcc

SEQ ID NO: 3781012 - RNA, 16 nt, Human
ugugaccccuccuggg

SEQ ID NO: 3781013 - RNA, 17 nt, Human
ugugaccccuccugggg

SEQ ID NO: 3781014 - RNA, 21 nt, Human
ugugaccccuccuggggccag

SEQ ID NO: 3781015 - RNA, 23 nt, Human
ugugaccccuccuggggccaggc

SEQ ID NO: 3781016 - RNA, 15 nt, Human
ugugaccugaaguuc

SEQ ID NO: 3781017 - RNA, 22 nt, Human
ugugaccugcugagcucugaga

SEQ ID NO: 3781018 - RNA, 17 nt, Human
ugugaccuuaggcccgg

SEQ ID NO: 3781019 - RNA, 16 nt, Human
ugugacgcgcaagucu

SEQ ID NO: 3781020 - RNA, 18 nt, Human
ugugacuaauuguauaac

SEQ ID NO: 3781021 - RNA, 19 nt, Human
ugugacuagugcugaagcu

SEQ ID NO: 3781022 - RNA, 20 nt, Human
ugugacuauauagagauguu

SEQ ID NO: 3781023 - RNA, 16 nt, Human
ugugacucuaaauucu

SEQ ID NO: 3781024 - RNA, 16 nt, Human
ugugacugaucucucg

SEQ ID NO: 3781025 - RNA, 20 nt, Human
ugugacuggcuaaagcucga

SEQ ID NO: 3781026 - RNA, 20 nt, Human
ugugacuguacccaaaugga

SEQ ID NO: 3781027 - RNA, 15 nt, Human
ugugacuucuccagg

SEQ ID NO: 3781028 - RNA, 14 nt, Human
ugugacuuugaaaa

SEQ ID NO: 3781029 - RNA, 20 nt, Human
ugugacuuugaaaauauaua

SEQ ID NO: 3781030 - RNA, 15 nt, Human
ugugacuuugacgcu

SEQ ID NO: 3781031 - RNA, 14 nt, Human
ugugacuuuugcuu

SEQ ID NO: 3781032 - RNA, 16 nt, Human
ugugacuuuugcuuua

SEQ ID NO: 3781033 - RNA, 17 nt, Human
ugugacuuuugcuuuaa

SEQ ID NO: 3781034 - RNA, 16 nt, Human
ugugacuuuugugaaa

SEQ ID NO: 3781035 - RNA, 20 nt, Human
ugugagaaaaccccuuccca

SEQ ID NO: 3781036 - RNA, 19 nt, Human
ugugagaagguuuauuguu

SEQ ID NO: 3781037 - RNA, 14 nt, Human
ugugagaaucaaaa

SEQ ID NO: 3781038 - RNA, 18 nt, Human
ugugagauguguaucagu

SEQ ID NO: 3781039 - RNA, 20 nt, Human
ugugagauuuuuuauugcua

SEQ ID NO: 3781040 - RNA, 14 nt, Human
ugugagcaagaagu

SEQ ID NO: 3781041 - RNA, 14 nt, Human
ugugagcagugagu

SEQ ID NO: 3781042 - RNA, 14 nt, Human
ugugagcccagcug

SEQ ID NO: 3781043 - RNA, 18 nt, Human
ugugagcccagcuggguc

SEQ ID NO: 3781044 - RNA, 13 nt, Human
ugugaggagcugc

SEQ ID NO: 3781045 - RNA, 17 nt, Human
ugugaggagcugcuggc

SEQ ID NO: 3781046 - RNA, 12 nt, Human
ugugaggcaggg

SEQ ID NO: 3781047 - RNA, 13 nt, Human
ugugaggcagggg

SEQ ID NO: 3781048 - RNA, 18 nt, Human
ugugaggcaggggcggag

SEQ ID NO: 3781049 - RNA, 14 nt, Human
ugugaggccagggc

SEQ ID NO: 3781050 - RNA, 15 nt, Human
ugugagggaaagagc

SEQ ID NO: 3781051 - RNA, 14 nt, Human
ugugagggagggga

SEQ ID NO: 3781052 - RNA, 22 nt, Human
ugugagggaggggaaaagcauu

SEQ ID NO: 3781053 - RNA, 12 nt, Human
ugugagggcagu

SEQ ID NO: 3781054 - RNA, 17 nt, Human
ugugaggguccugcagc

SEQ ID NO: 3781055 - RNA, 19 nt, Human
ugugaguaaaucagauguu

SEQ ID NO: 3781056 - RNA, 16 nt, Human
ugugaguaucagaauu

SEQ ID NO: 3781057 - RNA, 17 nt, Human
ugugaguaucagaauug

SEQ ID NO: 3781058 - RNA, 18 nt, Human
ugugaguaucagaauuga

SEQ ID NO: 3781059 - RNA, 23 nt, Human
ugugaguauucucauucuuccca

SEQ ID NO: 3781060 - RNA, 16 nt, Human
ugugagucaauacaua

SEQ ID NO: 3781061 - RNA, 19 nt, Human
ugugagucaccaagcccag

SEQ ID NO: 3781062 - RNA, 21 nt, Human
ugugagugccuuuugcagaag

SEQ ID NO: 3781063 - RNA, 11 nt, Human
ugugaguguga

SEQ ID NO: 3781064 - RNA, 13 nt, Human
ugugagugugaau

SEQ ID NO: 3781065 - RNA, 14 nt, Human
ugugagugugacag

SEQ ID NO: 3781066 - RNA, 15 nt, Human
ugugagugugacagg

SEQ ID NO: 3781067 - RNA, 23 nt, Human
ugugaguguguccaagugugugu

SEQ ID NO: 3781068 - RNA, 14 nt, Human
ugugagugugugca

SEQ ID NO: 3781069 - RNA, 16 nt, Human
ugugaguuuaaagcaa

SEQ ID NO: 3781070 - RNA, 19 nt, Human
ugugaguuuaccuuguaua

SEQ ID NO: 3781071 - RNA, 22 nt, Human
ugugaguuuaccuuguauacug

SEQ ID NO: 3781072 - RNA, 19 nt, Human
ugugaguuuggucuggacu

SEQ ID NO: 3781073 - RNA, 20 nt, Human
ugugaguuuggucuggacug

SEQ ID NO: 3781074 - RNA, 17 nt, Human
ugugaguuuguuucuuu

SEQ ID NO: 3781075 - RNA, 19 nt, Human
ugugaguuuguuucuuuga

SEQ ID NO: 3781076 - RNA, 21 nt, Human
ugugauacauuuuuuaagcuu

SEQ ID NO: 3781077 - RNA, 13 nt, Human
ugugauauauaag

SEQ ID NO: 3781078 - RNA, 14 nt, Human
ugugauauauaagu

SEQ ID NO: 3781079 - RNA, 15 nt, Human
ugugauauggagccc

SEQ ID NO: 3781080 - RNA, 14 nt, Human
ugugauauuaacag

SEQ ID NO: 3781081 - RNA, 15 nt, Human
ugugauauuccccuu

SEQ ID NO: 3781082 - RNA, 19 nt, Human
ugugauauucuaagacuua

SEQ ID NO: 3781083 - RNA, 23 nt, Human
ugugaucagcuuucaaagcauuu

SEQ ID NO: 3781084 - RNA, 17 nt, Human
ugugauccuuuuauguu

SEQ ID NO: 3781085 - RNA, 13 nt, Human
ugugaucugggaa

SEQ ID NO: 3781086 - RNA, 15 nt, Human
ugugaucugucuugu

SEQ ID NO: 3781087 - RNA, 18 nt, Human
ugugaucugucuuguaau

SEQ ID NO: 3781088 - RNA, 14 nt, Human
ugugaugagcugau

SEQ ID NO: 3781089 - RNA, 16 nt, Human
ugugaugaggcagagg

SEQ ID NO: 3781090 - RNA, 14 nt, Human
ugugaugaggggag

SEQ ID NO: 3781091 - RNA, 23 nt, Human
uuaauauaacugccuuaaaacuu

SEQ ID NO: 3781092 - RNA, 20 nt, Human
uuaauauauauuaucuuuuc

SEQ ID NO: 3781093 - RNA, 13 nt, Human
uuaauauauuucc

SEQ ID NO: 3781094 - RNA, 17 nt, Human
uuaauaucacucauuaa

SEQ ID NO: 3781095 - RNA, 18 nt, Human
uuaauaucaucaguauug

SEQ ID NO: 3781096 - RNA, 20 nt, Human
uuaauaucccuacauguauu

SEQ ID NO: 3781097 - RNA, 23 nt, Human
uuaauaugaaauuuuuuuucaug

SEQ ID NO: 3781098 - RNA, 18 nt, Human
uuaauaugcugcaacaaa

SEQ ID NO: 3781099 - RNA, 12 nt, Human
uuaauauggauu

SEQ ID NO: 3781100 - RNA, 22 nt, Human
uuaauauggggaugcagcauua

SEQ ID NO: 3781101 - RNA, 22 nt, Human
uuaauauguauuuuauguaugu

SEQ ID NO: 3781102 - RNA, 16 nt, Human
uuaauauuaaagccau

SEQ ID NO: 3781103 - RNA, 21 nt, Human
uuaauauuaaagccauguuua

SEQ ID NO: 3781104 - RNA, 22 nt, Human
uuaauauuaaagccauguuuau

SEQ ID NO: 3781105 - RNA, 21 nt, Human
uuaauauuaccuaaugaaagu

SEQ ID NO: 3781106 - RNA, 15 nt, Human
uuaauauucuauuaa

SEQ ID NO: 3781107 - RNA, 18 nt, Human
uuaauauugauaugcuua

SEQ ID NO: 3781108 - RNA, 16 nt, Human
uuaauauugauuuauu

SEQ ID NO: 3781109 - RNA, 14 nt, Human
uuaauauuucuuca

SEQ ID NO: 3781110 - RNA, 16 nt, Human
uuaauauuuguuuagu

SEQ ID NO: 3781111 - RNA, 20 nt, Human
uuacuccccuugagcugaga

SEQ ID NO: 3781112 - RNA, 15 nt, Human
uuacuccucacacuu

SEQ ID NO: 3781113 - RNA, 21 nt, Human
uuacuccucacacuuacugua

SEQ ID NO: 3781114 - RNA, 14 nt, Human
uuacucuaagaucu

SEQ ID NO: 3781115 - RNA, 21 nt, Human
uuacucuaagaucuuagauuc

SEQ ID NO: 3781116 - RNA, 22 nt, Human
uuacucuaagaucuuagauucu

SEQ ID NO: 3781117 - RNA, 18 nt, Human
uuacucuagauaccuaaa

SEQ ID NO: 3781118 - RNA, 19 nt, Human
uuacucuccaaccuggaca

SEQ ID NO: 3781119 - RNA, 18 nt, Human
uuacucugccuacagaac

SEQ ID NO: 3781120 - RNA, 23 nt, Human
uuacucuuguaagauuuugaaaa

SEQ ID NO: 3781121 - RNA, 23 nt, Human
uuacugaacaguaacauagcugu

SEQ ID NO: 3781122 - RNA, 18 nt, Human
uuacugaagguaaaauug

SEQ ID NO: 3781123 - RNA, 14 nt, Human
uuacugacauuucu

SEQ ID NO: 3781124 - RNA, 13 nt, Human
uuacugagcuucu

SEQ ID NO: 3781125 - RNA, 14 nt, Human
uuacugagcuucuc

SEQ ID NO: 3781126 - RNA, 13 nt, Human
uuacugaucaugc

SEQ ID NO: 3781127 - RNA, 15 nt, Human
uuacugaucaugcau

SEQ ID NO: 3781128 - RNA, 18 nt, Human
uuacugaucaugcauugu

SEQ ID NO: 3781129 - RNA, 19 nt, Human
uuacugaucaugcauuguu

SEQ ID NO: 3781130 - RNA, 13 nt, Human
uuacugcaaaugu

SEQ ID NO: 3781131 - RNA, 21 nt, Human
uuacugccaaagggaaauauc

SEQ ID NO: 3781132 - RNA, 19 nt, Human
uuacugccgguuugaaaau

SEQ ID NO: 3781133 - RNA, 20 nt, Human
uuacugcuuaauucaaauaa

SEQ ID NO: 3781134 - RNA, 17 nt, Human
uuacugcuuuaaucaga

SEQ ID NO: 3781135 - RNA, 22 nt, Human
uuacugcuuuuaacuucugaua

SEQ ID NO: 3781136 - RNA, 22 nt, Human
uuacuggaucucuuaagacagc

SEQ ID NO: 3781137 - RNA, 18 nt, Human
uuacuggccuuuuucauu

SEQ ID NO: 3781138 - RNA, 15 nt, Human
uuacuggcguggauu

SEQ ID NO: 3781139 - RNA, 22 nt, Human
uuacuggggcuggggaaggaag

SEQ ID NO: 3781140 - RNA, 16 nt, Human
uuacuguaaaaugcaa

SEQ ID NO: 3781141 - RNA, 15 nt, Human
uuacuguaagacauu

SEQ ID NO: 3781142 - RNA, 12 nt, Human
uuacuguacaug

SEQ ID NO: 3781143 - RNA, 23 nt, Human
uuacuguacaugaaaacacauuu

SEQ ID NO: 3781144 - RNA, 20 nt, Human
uuacugucaauaaacagcuu

SEQ ID NO: 3781145 - RNA, 19 nt, Human
uuacugucuuaauuaagua

SEQ ID NO: 3781146 - RNA, 17 nt, Human
uuacugucuuuuuucua

SEQ ID NO: 3781147 - RNA, 21 nt, Human
uuacugugcauugggauuuua

SEQ ID NO: 3781148 - RNA, 16 nt, Human
uuacuguggaggaagg

SEQ ID NO: 3781149 - RNA, 23 nt, Human
uuacuguggaggaaggauuguaa

SEQ ID NO: 3781150 - RNA, 14 nt, Human
uuacuguguaaacu

SEQ ID NO: 3781151 - RNA, 16 nt, Human
uuacuguguaaacuca

SEQ ID NO: 3781152 - RNA, 13 nt, Human
uuacuguguaauu

SEQ ID NO: 3781153 - RNA, 14 nt, Human
uuacugugucuuug

SEQ ID NO: 3781154 - RNA, 11 nt, Human
uuacuguguua

SEQ ID NO: 3781155 - RNA, 15 nt, Human
uuacuguuaaccauu

SEQ ID NO: 3781156 - RNA, 16 nt, Human
uuacuguucuugcugc

SEQ ID NO: 3781157 - RNA, 14 nt, Human
uuacuguugauaau

SEQ ID NO: 3781158 - RNA, 15 nt, Human
uuacuguuucuguca

SEQ ID NO: 3781159 - RNA, 16 nt, Human
uuacuguuucugucag

SEQ ID NO: 3781160 - RNA, 14 nt, Human
uuacuuacagcaua

SEQ ID NO: 3781161 - RNA, 14 nt, Human
uuacuuagcaaugu

SEQ ID NO: 3781162 - RNA, 23 nt, Human
uuacuuaucauccacauuguuuu

SEQ ID NO: 3781163 - RNA, 21 nt, Human
uuacuucacuauacaaacaaa

SEQ ID NO: 3781164 - RNA, 11 nt, Human
uuacuucauau

SEQ ID NO: 3781165 - RNA, 22 nt, Human
uuacuucguguccgacucuucu

SEQ ID NO: 3781166 - RNA, 15 nt, Human
uuacuucucuauaaa

SEQ ID NO: 3781167 - RNA, 11 nt, Human
uuacuucugcu

SEQ ID NO: 3781168 - RNA, 17 nt, Human
uuacuugauaagggacu

SEQ ID NO: 3781169 - RNA, 15 nt, Human
uuacuugcuucucua

SEQ ID NO: 3781170 - RNA, 18 nt, Human
uuacuuggaaauauuaaa

SEQ ID NO: 3781171 - RNA, 21 nt, Human
uuacuuggaaauauuaaaaga

SEQ ID NO: 3781172 - RNA, 16 nt, Human
uuacuuguaaauauaa

SEQ ID NO: 3781173 - RNA, 21 nt, Human
uuacuuguaaauauaaagacg

SEQ ID NO: 3781174 - RNA, 15 nt, Human
uuacuuguuuuggau

SEQ ID NO: 3781175 - RNA, 17 nt, Human
uuacuuuaaaaggagcc

SEQ ID NO: 3781176 - RNA, 13 nt, Human
uuacuuuaaacua

SEQ ID NO: 3781177 - RNA, 15 nt, Human
uuacuuuaacaugcc

SEQ ID NO: 3781178 - RNA, 13 nt, Human
uuacuuuagaaaa

SEQ ID NO: 3781179 - RNA, 18 nt, Human
uuacuuuagaagccugca

SEQ ID NO: 3781180 - RNA, 15 nt, Human
uuacuuuccauugcu

SEQ ID NO: 3781181 - RNA, 13 nt, Human
uuacuuucuuaau

SEQ ID NO: 3781182 - RNA, 21 nt, Human
uuacuuuggggcuaauuuaac

SEQ ID NO: 3781183 - RNA, 22 nt, Human
uuacuuuguaaauucugauuuc

SEQ ID NO: 3781184 - RNA, 11 nt, Human
uuacuuuguau

SEQ ID NO: 3781185 - RNA, 12 nt, Human
uuacuuuguaug

SEQ ID NO: 3781186 - RNA, 14 nt, Human
uuacuuuuaaacug

SEQ ID NO: 3781187 - RNA, 22 nt, Human
uuacuuuuauaauaaaaggaaa

SEQ ID NO: 3781188 - RNA, 23 nt, Human
uuacuuuuauaauaaaaggaaaa

SEQ ID NO: 3781189 - RNA, 16 nt, Human
uuacuuuucauauuug

SEQ ID NO: 3781190 - RNA, 18 nt, Human
uuacuuuuccucuuagaa

SEQ ID NO: 3781191 - RNA, 22 nt, Human
uuacuuuuuuuuuuuuuuggua

SEQ ID NO: 3781192 - RNA, 23 nt, Human
uuacuuuuuuuuuuuuuugguag

SEQ ID NO: 3781193 - RNA, 15 nt, Human
uuagaaaacaaaauu

SEQ ID NO: 3781194 - RNA, 20 nt, Human
uuagaaaaggugauaaaauc

SEQ ID NO: 3781195 - RNA, 13 nt, Human
uuagaaaaugugu

SEQ ID NO: 3781196 - RNA, 13 nt, Human
uuagaaacauaaa

SEQ ID NO: 3781197 - RNA, 12 nt, Human
uuagaaacugga

SEQ ID NO: 3781198 - RNA, 19 nt, Human
uuagaaacuggaaauacua

SEQ ID NO: 3781199 - RNA, 16 nt, Human
uuagaaagauaauuca

SEQ ID NO: 3781200 - RNA, 16 nt, Human
uuagaaagcauuugaa

SEQ ID NO: 3781201 - RNA, 17 nt, Human
uuagaaagcauuugaau

SEQ ID NO: 3781202 - RNA, 15 nt, Human
uuagaaauagacagu

SEQ ID NO: 3781203 - RNA, 13 nt, Human
uuagaaaucauuu

SEQ ID NO: 3781204 - RNA, 20 nt, Human
uuagaaauguaaacugccau

SEQ ID NO: 3781205 - RNA, 14 nt, Human
uuagaaauuagaaa

SEQ ID NO: 3781206 - RNA, 17 nt, Human
uuagaaauuuauuuccu

SEQ ID NO: 3781207 - RNA, 17 nt, Human
uuagaacacacacacuu

SEQ ID NO: 3781208 - RNA, 20 nt, Human
uuagaacacacacacuuacu

SEQ ID NO: 3781209 - RNA, 13 nt, Human
uuagaacacuauu

SEQ ID NO: 3781210 - RNA, 14 nt, Human
uuagaacacuauuu

SEQ ID NO: 3781211 - RNA, 21 nt, Human
uuagaacacuauuuucagaau

SEQ ID NO: 3781212 - RNA, 15 nt, Human
uuagaacagguuuuu

SEQ ID NO: 3781213 - RNA, 13 nt, Human
uuagaaccuuucu

SEQ ID NO: 3781214 - RNA, 14 nt, Human
uuagaauaaaauug

SEQ ID NO: 3781215 - RNA, 13 nt, Human
uuagaauaaauuc

SEQ ID NO: 3781216 - RNA, 19 nt, Human
uuagaauauuaucuucaua

SEQ ID NO: 3781217 - RNA, 18 nt, Human
uuagaaucaaacauuuug

SEQ ID NO: 3781218 - RNA, 23 nt, Human
uuagaaucaaacauuuugaaagu

SEQ ID NO: 3781219 - RNA, 18 nt, Human
uuagaauccaaacuugga

SEQ ID NO: 3781220 - RNA, 15 nt, Human
uuagaaucuauuuuc

SEQ ID NO: 3781221 - RNA, 21 nt, Human
uuagaaucuauuuucuaugua

SEQ ID NO: 3781222 - RNA, 13 nt, Human
uuagaaugaaaau

SEQ ID NO: 3781223 - RNA, 14 nt, Human
uuagaauucuguau

SEQ ID NO: 3781224 - RNA, 15 nt, Human
uuagaauucuguaua

SEQ ID NO: 3781225 - RNA, 17 nt, Human
uuagaauugaagguuuu

SEQ ID NO: 3781226 - RNA, 14 nt, Human
uuagacaaaucuaa

SEQ ID NO: 3781227 - RNA, 16 nt, Human
uuagacaagagauggg

SEQ ID NO: 3781228 - RNA, 12 nt, Human
uuagacagaggc

SEQ ID NO: 3781229 - RNA, 20 nt, Human
uuagacagagucucacuguu

SEQ ID NO: 3781230 - RNA, 13 nt, Human
uuagacagccaaa

SEQ ID NO: 3781231 - RNA, 23 nt, Human
uuagacagucaaggaguggcuua

SEQ ID NO: 3781232 - RNA, 14 nt, Human
uuagacagucccug

SEQ ID NO: 3781233 - RNA, 16 nt, Human
uuagacagucccugcc

SEQ ID NO: 3781234 - RNA, 18 nt, Human
uuagacagucccugccaa

SEQ ID NO: 3781235 - RNA, 13 nt, Human
uuagacauaacaa

SEQ ID NO: 3781236 - RNA, 19 nt, Human
uuagacccucaugcugcca

SEQ ID NO: 3781237 - RNA, 15 nt, Human
uuagaccgcucucuu

SEQ ID NO: 3781238 - RNA, 16 nt, Human
uuagaccgcucucuuu

SEQ ID NO: 3781239 - RNA, 22 nt, Human
uuagaccgcucucuuuucugua

SEQ ID NO: 3781240 - RNA, 11 nt, Human
uuagaccucag

SEQ ID NO: 3781241 - RNA, 13 nt, Human
uuagaccucagcc

SEQ ID NO: 3781242 - RNA, 16 nt, Human
uuagaccuguguuacu

SEQ ID NO: 3781243 - RNA, 18 nt, Human
uuagacuaaggccauuau

SEQ ID NO: 3781244 - RNA, 14 nt, Human
uuagacuacauuua

SEQ ID NO: 3781245 - RNA, 14 nt, Human
uuagacugccagcu

SEQ ID NO: 3781246 - RNA, 17 nt, Human
uuagacuggaacuugaa

SEQ ID NO: 3781247 - RNA, 18 nt, Human
uuagacugugauucagaa

SEQ ID NO: 3781248 - RNA, 18 nt, Human
uuagacuucuguuuucaa

SEQ ID NO: 3781249 - RNA, 13 nt, Human
uuagacuugaaaa

SEQ ID NO: 3781250 - RNA, 17 nt, Human
uuagacuugaaauacua

SEQ ID NO: 3781251 - RNA, 12 nt, Human
uuagagaaaaua

SEQ ID NO: 3781252 - RNA, 13 nt, Human
uuagagaacuaaa

SEQ ID NO: 3781253 - RNA, 12 nt, Human
uuagagaauaaa

SEQ ID NO: 3781254 - RNA, 24 nt, Human
uuagagacagagcgacagagcagu

SEQ ID NO: 3781255 - RNA, 20 nt, Human
uuagagacaggguccugcua

SEQ ID NO: 3781256 - RNA, 14 nt, Human
uuagagaguguuga

SEQ ID NO: 3781257 - RNA, 16 nt, Human
uuagagaguguugaaa

SEQ ID NO: 3781258 - RNA, 17 nt, Human
uuagagaguguugaaac

SEQ ID NO: 3781259 - RNA, 13 nt, Human
uuagagaugaauu

SEQ ID NO: 3781260 - RNA, 20 nt, Human
uuagagcaacuuucuggggc

SEQ ID NO: 3781261 - RNA, 18 nt, Human
uuagaggaaaaaaaugac

SEQ ID NO: 3781262 - RNA, 16 nt, Human
uuagaggaaaaauauu

SEQ ID NO: 3781263 - RNA, 17 nt, Human
uuauauuaaccagauau

SEQ ID NO: 3781264 - RNA, 19 nt, Human
uuauauuacugacauuucu

SEQ ID NO: 3781265 - RNA, 17 nt, Human
uuauauucaaccaugga

SEQ ID NO: 3781266 - RNA, 23 nt, Human
uuauauucaaccauggacuuuau

SEQ ID NO: 3781267 - RNA, 20 nt, Human
uuauauugaagacaauuuga

SEQ ID NO: 3781268 - RNA, 15 nt, Human
uuauauugagacaaa

SEQ ID NO: 3781269 - RNA, 22 nt, Human
uuauauuguaagaaauacugua

SEQ ID NO: 3781270 - RNA, 13 nt, Human
uuauauuuaucca

SEQ ID NO: 3781271 - RNA, 15 nt, Human
uuauauuuauugacu

SEQ ID NO: 3781272 - RNA, 20 nt, Human
uuauauuuauugacucuuga

SEQ ID NO: 3781273 - RNA, 10 nt, Human
uuauauuuca

SEQ ID NO: 3781274 - RNA, 18 nt, Human
uuauauuucaaguacacu

SEQ ID NO: 3781275 - RNA, 11 nt, Human
uuauauuucca

SEQ ID NO: 3781276 - RNA, 15 nt, Human
uuauauuuggaugca

SEQ ID NO: 3781277 - RNA, 18 nt, Human
uuauauuugugcuauagu

SEQ ID NO: 3781278 - RNA, 15 nt, Human
uuauauuuuuauaga

SEQ ID NO: 3781279 - RNA, 17 nt, Human
uuauauuuuucuuaaaa

SEQ ID NO: 3781280 - RNA, 16 nt, Human
uuauauuuuuucaguu

SEQ ID NO: 3781281 - RNA, 20 nt, Human
uuaucaaaauagucuaaggc

SEQ ID NO: 3781282 - RNA, 18 nt, Human
uuaucaaacccuagccuu

SEQ ID NO: 3781283 - RNA, 21 nt, Human
uuaucaaacccuagccuugcu

SEQ ID NO: 3781284 - RNA, 22 nt, Human
uuaucaagaguugugacaacuu

SEQ ID NO: 3781285 - RNA, 13 nt, Human
uuaucaagcuaau

SEQ ID NO: 3781286 - RNA, 17 nt, Human
uuaucaaggacucuggu

SEQ ID NO: 3781287 - RNA, 19 nt, Human
uuaucaauaucuaauauau

SEQ ID NO: 3781288 - RNA, 14 nt, Human
uuaucaauuuguca

SEQ ID NO: 3781289 - RNA, 21 nt, Human
uuaucaauuugucauuuugaa

SEQ ID NO: 3781290 - RNA, 17 nt, Human
uuaucacauguauguuu

SEQ ID NO: 3781291 - RNA, 21 nt, Human
uuaucaccagcugccucuucu

SEQ ID NO: 3781292 - RNA, 17 nt, Human
uuaucacccagaagaaa

SEQ ID NO: 3781293 - RNA, 19 nt, Human
uuaucacccagaagaaaau

SEQ ID NO: 3781294 - RNA, 19 nt, Human
uuaucaccuggcuuguuua

SEQ ID NO: 3781295 - RNA, 20 nt, Human
uuaucacuuuuugaacuaag

SEQ ID NO: 3781296 - RNA, 17 nt, Human
uuaucagauacaucacu

SEQ ID NO: 3781297 - RNA, 14 nt, Human
uuaucagcaaaaaa

SEQ ID NO: 3781298 - RNA, 14 nt, Human
uuaucagcaaagaa

SEQ ID NO: 3781299 - RNA, 14 nt, Human
uuaucagugcuucc

SEQ ID NO: 3781300 - RNA, 13 nt, Human
uuaucaguuucca

SEQ ID NO: 3781301 - RNA, 20 nt, Human
uuaucauccacauuguuuua

SEQ ID NO: 3781302 - RNA, 14 nt, Human
uuaucaugaagccu

SEQ ID NO: 3781303 - RNA, 16 nt, Human
uuaucaugaagccugu

SEQ ID NO: 3781304 - RNA, 14 nt, Human
uuaucaugaauuuu

SEQ ID NO: 3781305 - RNA, 19 nt, Human
uuaucaugaauuuuaaagu

SEQ ID NO: 3781306 - RNA, 16 nt, Human
uuaucaugcugucuuu

SEQ ID NO: 3781307 - RNA, 22 nt, Human
uuaucaugugaaaucauucauu

SEQ ID NO: 3781308 - RNA, 14 nt, Human
uuaucauguguaau

SEQ ID NO: 3781309 - RNA, 19 nt, Human
uuaucauucauucuuagcu

SEQ ID NO: 3781310 - RNA, 19 nt, Human
uuaucauuuuuuccuguuu

SEQ ID NO: 3781311 - RNA, 15 nt, Human
uuauccaaaaugugu

SEQ ID NO: 3781312 - RNA, 16 nt, Human
uuauccaaaaugugua

SEQ ID NO: 3781313 - RNA, 18 nt, Human
uuauccaaaauguguauu

SEQ ID NO: 3781314 - RNA, 22 nt, Human
uuauccaaaauguguauuucuu

SEQ ID NO: 3781315 - RNA, 18 nt, Human
uuauccaggacucuguca

SEQ ID NO: 3781316 - RNA, 17 nt, Human
uuauccaugacaggccu

SEQ ID NO: 3781317 - RNA, 23 nt, Human
uuaucccaaaguuguuguaaccu

SEQ ID NO: 3781318 - RNA, 13 nt, Human
uuaucccagcugc

SEQ ID NO: 3781319 - RNA, 15 nt, Human
uuaucccucaccugu

SEQ ID NO: 3781320 - RNA, 17 nt, Human
uuaucccucaccuguag

SEQ ID NO: 3781321 - RNA, 14 nt, Human
uuaucccuuaagaa

SEQ ID NO: 3781322 - RNA, 15 nt, Human
uuaucccuuaagaau

SEQ ID NO: 3781323 - RNA, 16 nt, Human
uuauccuccaccgucu

SEQ ID NO: 3781324 - RNA, 14 nt, Human
uuauccucccugua

SEQ ID NO: 3781325 - RNA, 15 nt, Human
uuauccucuuuagag

SEQ ID NO: 3781326 - RNA, 16 nt, Human
uuauccugcauuguua

SEQ ID NO: 3781327 - RNA, 15 nt, Human
uuauccuuucauaua

SEQ ID NO: 3781328 - RNA, 24 nt, Human
uuauccuuuuuuaaaaguaaaugu

SEQ ID NO: 3781329 - RNA, 14 nt, Human
uuaucgaaacucau

SEQ ID NO: 3781330 - RNA, 13 nt, Human
uuaucgaaauaac

SEQ ID NO: 3781331 - RNA, 19 nt, Human
uuaucgaaauaacaauguu

SEQ ID NO: 3781332 - RNA, 20 nt, Human
uuaucgcccuggcaggcagg

SEQ ID NO: 3781333 - RNA, 16 nt, Human
uuaucggaagcagugc

SEQ ID NO: 3781334 - RNA, 16 nt, Human
uuaucguuuucuuaaa

SEQ ID NO: 3781335 - RNA, 15 nt, Human
uuaucguuuuuguau

SEQ ID NO: 3781336 - RNA, 14 nt, Human
uuaucuaaauuaaa

SEQ ID NO: 3781337 - RNA, 18 nt, Human
uuaucuaccaacuuucaa

SEQ ID NO: 3781338 - RNA, 14 nt, Human
uuaucuagauacug

SEQ ID NO: 3781339 - RNA, 14 nt, Human
uuaucuagauguaa

SEQ ID NO: 3781340 - RNA, 18 nt, Human
uuaucuagauguaaauuu

SEQ ID NO: 3781341 - RNA, 14 nt, Human
uuaucuagcugcau

SEQ ID NO: 3781342 - RNA, 17 nt, Human
uuaucuauaauuuaccu

SEQ ID NO: 3781343 - RNA, 17 nt, Human
uuaucuauuguaagaua

SEQ ID NO: 3781344 - RNA, 19 nt, Human
uuaucucagauauuugcac

SEQ ID NO: 3781345 - RNA, 17 nt, Human
uuaucucagauguuaaa

SEQ ID NO: 3781346 - RNA, 22 nt, Human
uuaucucagauguuaaaauaaa

SEQ ID NO: 3781347 - RNA, 19 nt, Human
uuaucucagucaugcauaa

SEQ ID NO: 3781348 - RNA, 20 nt, Human
uuaucucagucaugcauaaa

SEQ ID NO: 3781349 - RNA, 14 nt, Human
uuaucucucugugc

SEQ ID NO: 3781350 - RNA, 19 nt, Human
uuaucucuuuuauauuugu

SEQ ID NO: 3781351 - RNA, 18 nt, Human
uuaucugaauuuuuaaac

SEQ ID NO: 3781352 - RNA, 18 nt, Human
uuaucugagucaacuccu

SEQ ID NO: 3781353 - RNA, 21 nt, Human
uuaucugccucucuuguaauu

SEQ ID NO: 3781354 - RNA, 20 nt, Human
uuaucugggcauagaugcag

SEQ ID NO: 3781355 - RNA, 16 nt, Human
uuaucugucagcugca

SEQ ID NO: 3781356 - RNA, 18 nt, Human
uuaucugugcgugaaaca

SEQ ID NO: 3781357 - RNA, 16 nt, Human
uuaucuguuugagaaa

SEQ ID NO: 3781358 - RNA, 20 nt, Human
uuaucuguuugagaaaguca

SEQ ID NO: 3781359 - RNA, 20 nt, Human
uuaucuuacaauauugauug

SEQ ID NO: 3781360 - RNA, 13 nt, Human
uuaucuuacgaaa

SEQ ID NO: 3781361 - RNA, 21 nt, Human
uuaucuuauacuguacaauaa

SEQ ID NO: 3781362 - RNA, 18 nt, Human
uuaucuucucaaguucua

SEQ ID NO: 3781363 - RNA, 22 nt, Human
uuaucuucuggacuauagcugu

SEQ ID NO: 3781364 - RNA, 14 nt, Human
uuaucuugauacau

SEQ ID NO: 3781365 - RNA, 16 nt, Human
uuaucuuggacugaca

SEQ ID NO: 3781366 - RNA, 17 nt, Human
uuaucuuggacugacau

SEQ ID NO: 3781367 - RNA, 17 nt, Human
uuaucuugucucugggc

SEQ ID NO: 3781368 - RNA, 12 nt, Human
uuaucuuuauau

SEQ ID NO: 3781369 - RNA, 24 nt, Human
uuaucuuucgugauaaacuuugcu

SEQ ID NO: 3781370 - RNA, 14 nt, Human
uuaucuuugaauau

SEQ ID NO: 3781371 - RNA, 11 nt, Human
uuaucuuugau

SEQ ID NO: 3781372 - RNA, 17 nt, Human
uuaucuuuucuacagca

SEQ ID NO: 3781373 - RNA, 15 nt, Human
uuaucuuuuuaccuu

SEQ ID NO: 3781374 - RNA, 15 nt, Human
uuaugaaaauaaaua

SEQ ID NO: 3781375 - RNA, 14 nt, Human
uuaugaaacuuuug

SEQ ID NO: 3781376 - RNA, 18 nt, Human
uuaugaaacuuuuggaag

SEQ ID NO: 3781377 - RNA, 15 nt, Human
uuaugaaagaauaua

SEQ ID NO: 3781378 - RNA, 20 nt, Human
uuaugaaauaaagaaauugc

SEQ ID NO: 3781379 - RNA, 20 nt, Human
uuaugaacccuuccugagcu

SEQ ID NO: 3781380 - RNA, 22 nt, Human
uuaugaacugcauguauaaaug

SEQ ID NO: 3781381 - RNA, 23 nt, Human
uuaugaacugcauguauaaauga

SEQ ID NO: 3781382 - RNA, 20 nt, Human
uuaugaagaaaauacuuaaa

SEQ ID NO: 3781383 - RNA, 23 nt, Human
uuaugaagaaaauacuuaaaugu

SEQ ID NO: 3781384 - RNA, 23 nt, Human
uuaugaagaugggggccucuuuc

SEQ ID NO: 3781385 - RNA, 11 nt, Human
uuaugaaguuu

SEQ ID NO: 3781386 - RNA, 16 nt, Human
uuaugaaguuuaaaac

SEQ ID NO: 3781387 - RNA, 22 nt, Human
uuaugaaguuuaaaacaguauu

SEQ ID NO: 3781388 - RNA, 19 nt, Human
uuaugaauauuuauaacag

SEQ ID NO: 3781389 - RNA, 22 nt, Human
uuaugaauauuuauaacagcau

SEQ ID NO: 3781390 - RNA, 17 nt, Human
uuaugaaugugaagccu

SEQ ID NO: 3781391 - RNA, 16 nt, Human
uuaugaauuacauuug

SEQ ID NO: 3781392 - RNA, 14 nt, Human
uuaugacaguuaua

SEQ ID NO: 3781393 - RNA, 18 nt, Human
uuaugaccucuuccuuua

SEQ ID NO: 3781394 - RNA, 13 nt, Human
uuaugagaaacug

SEQ ID NO: 3781395 - RNA, 15 nt, Human
uuaugagaaagccuu

SEQ ID NO: 3781396 - RNA, 11 nt, Human
uuaugagaaau

SEQ ID NO: 3781397 - RNA, 12 nt, Human
uuaugagaaaug

SEQ ID NO: 3781398 - RNA, 13 nt, Human
uuaugagaaaugu

SEQ ID NO: 3781399 - RNA, 20 nt, Human
uuaugagauugguuuuccug

SEQ ID NO: 3781400 - RNA, 13 nt, Human
uuaugagccaggc

SEQ ID NO: 3781401 - RNA, 17 nt, Human
uuaugaggagcugcaga

SEQ ID NO: 3781402 - RNA, 18 nt, Human
uuaugaggagugaacauu

SEQ ID NO: 3781403 - RNA, 22 nt, Human
uuaugaggcaaccugauuguaa

SEQ ID NO: 3781404 - RNA, 20 nt, Human
uuaugaguaacuauuauuau

SEQ ID NO: 3781405 - RNA, 15 nt, Human
uuaugaguuugcuua

SEQ ID NO: 3781406 - RNA, 13 nt, Human
uuaugauaaaaaa

SEQ ID NO: 3781407 - RNA, 19 nt, Human
uuaugauaaaaaauuuugu

SEQ ID NO: 3781408 - RNA, 22 nt, Human
uuaugauagcaaauggccucau

SEQ ID NO: 3781409 - RNA, 18 nt, Human
uuaugauauuuuuuuaag

SEQ ID NO: 3781410 - RNA, 13 nt, Human
uuaugauccagca

SEQ ID NO: 3781411 - RNA, 22 nt, Human
uuaugauccagcagauuauuca

SEQ ID NO: 3781412 - RNA, 13 nt, Human
uuaugaugaugaa

SEQ ID NO: 3781413 - RNA, 14 nt, Human
uuaugaugaugaaa

SEQ ID NO: 3781414 - RNA, 23 nt, Human
uuaugaugaugaaaauuuuacca

SEQ ID NO: 3781415 - RNA, 11 nt, Human
uuaugaugugc

SEQ ID NO: 3781416 - RNA, 14 nt, Human
uuaugaugugcuua

SEQ ID NO: 3781417 - RNA, 16 nt, Human
uuaugaugugcuuaac

SEQ ID NO: 3781418 - RNA, 20 nt, Human
uuaugaugugggucaaggaa

SEQ ID NO: 3781419 - RNA, 13 nt, Human
uuaugauuuaaua

SEQ ID NO: 3781420 - RNA, 17 nt, Human
uuaugauuuaauaaaau

SEQ ID NO: 3781421 - RNA, 14 nt, Human
uuaugauuuucaua

SEQ ID NO: 3781422 - RNA, 15 nt, Human
uuaugcaaaagcaag

SEQ ID NO: 3781423 - RNA, 17 nt, Human
uuaugcaaauucccaga

SEQ ID NO: 3781424 - RNA, 17 nt, Human
uuaugcaaggaaggaaa

SEQ ID NO: 3781425 - RNA, 18 nt, Human
uuaugcaaggaaggaaag

SEQ ID NO: 3781426 - RNA, 22 nt, Human
uuaugcaaggucuugcauuuaa

SEQ ID NO: 3781427 - RNA, 23 nt, Human
uuaugcaauuagguuuuuccuua

SEQ ID NO: 3781428 - RNA, 19 nt, Human
uuaugcacuaaauaugaac

SEQ ID NO: 3781429 - RNA, 18 nt, Human
uuaugcagauagaaucaa

SEQ ID NO: 3781430 - RNA, 14 nt, Human
uuaugcauagauaa

SEQ ID NO: 3781431 - RNA, 13 nt, Human
uuaugccaccccc

SEQ ID NO: 3781432 - RNA, 22 nt, Human
uuaugccacuuccuuuuaacug

SEQ ID NO: 3781433 - RNA, 18 nt, Human
uuaugccauuuguuuauu

SEQ ID NO: 3781434 - RNA, 21 nt, Human
uuaugcccaguuucugccucu

SEQ ID NO: 3781435 - RNA, 17 nt, Human
uuaugccggaugugcuu

SEQ ID NO: 3781436 - RNA, 15 nt, Human
uuaugccuuuuauuu

SEQ ID NO: 3781437 - RNA, 19 nt, Human
uuaugcgguuaauuuugaa

SEQ ID NO: 3781438 - RNA, 17 nt, Human
uuaugcucucacuguuu

SEQ ID NO: 3781439 - RNA, 17 nt, Human
uuaugcucuuaauugcc

SEQ ID NO: 3781440 - RNA, 16 nt, Human
uuaugcuuaaauucaa

SEQ ID NO: 3781441 - RNA, 14 nt, Human
uuaugcuucuugga

SEQ ID NO: 3781442 - RNA, 13 nt, Human
uuaugcuuuaaac

SEQ ID NO: 3781443 - RNA, 13 nt, Human
uuauggaaaacug

SEQ ID NO: 3781444 - RNA, 21 nt, Human
uuauggaauugauuugcauug

SEQ ID NO: 3781445 - RNA, 21 nt, Human
uuauggacaaugacccagugg

SEQ ID NO: 3781446 - RNA, 18 nt, Human
uuauggagucauuuuuac

SEQ ID NO: 3781447 - RNA, 21 nt, Human
uuauggcacuaguauuucuau

SEQ ID NO: 3781448 - RNA, 12 nt, Human
uuauggccucag

SEQ ID NO: 3781449 - RNA, 18 nt, Human
uuauggcuauaggugcua

SEQ ID NO: 3781450 - RNA, 21 nt, Human
uuauggcucacuaugaaucua

SEQ ID NO: 3781451 - RNA, 18 nt, Human
uuauggcuuuugugcauu

SEQ ID NO: 3781452 - RNA, 11 nt, Human
uuaugggucac

SEQ ID NO: 3781453 - RNA, 23 nt, Human
uuaugguaacugcuuucuguucc

SEQ ID NO: 3781454 - RNA, 13 nt, Human
uuaugguagaaaa

SEQ ID NO: 3781455 - RNA, 15 nt, Human
uuaugguuauguuuu

SEQ ID NO: 3781456 - RNA, 16 nt, Human
uuaugguuauguuuuu

SEQ ID NO: 3781457 - RNA, 20 nt, Human
uuauguaaaauguuuuagca

SEQ ID NO: 3781458 - RNA, 15 nt, Human
uuauguaaacaaauc

SEQ ID NO: 3781459 - RNA, 17 nt, Human
uuauguaaacaaaucuu

SEQ ID NO: 3781460 - RNA, 19 nt, Human
uuauguaaaucccauuauu

SEQ ID NO: 3781461 - RNA, 22 nt, Human
uuauguaaaucccauuauucaa

SEQ ID NO: 3781462 - RNA, 17 nt, Human
uuauguaaauuauguaa

SEQ ID NO: 3781463 - RNA, 18 nt, Human
uuauguaagagcaccuuc

SEQ ID NO: 3781464 - RNA, 15 nt, Human
uuauguaaucuaugu

SEQ ID NO: 3781465 - RNA, 13 nt, Human
uuauguacuguac

SEQ ID NO: 3781466 - RNA, 15 nt, Human
uuauguacuguacua

SEQ ID NO: 3781467 - RNA, 17 nt, Human
uuauguacuguacuaau

SEQ ID NO: 3781468 - RNA, 22 nt, Human
uuauguagauauuuggcuuaaa

SEQ ID NO: 3781469 - RNA, 16 nt, Human
uuauguaguaauugac

SEQ ID NO: 3781470 - RNA, 11 nt, Human
uuauguauuuc

SEQ ID NO: 3781471 - RNA, 20 nt, Human
uuauguauuuccuggauguu

SEQ ID NO: 3781472 - RNA, 20 nt, Human
uuaugucauucucuuucuca

SEQ ID NO: 3781473 - RNA, 22 nt, Human
uuaugucccuucacauaguuuu

SEQ ID NO: 3781474 - RNA, 20 nt, Human
uuauguccugugagaugugu

SEQ ID NO: 3781475 - RNA, 13 nt, Human
uuaugucuaaaga

SEQ ID NO: 3781476 - RNA, 15 nt, Human
uuaugugaaacaugu

SEQ ID NO: 3781477 - RNA, 20 nt, Human
uuaugugaauuuuuaagcug

SEQ ID NO: 3781478 - RNA, 15 nt, Human
uuaugugacauuaac

SEQ ID NO: 3781479 - RNA, 14 nt, Human
uuaugugaucaauu

SEQ ID NO: 3781480 - RNA, 19 nt, Human
uuauguguaugugccauuu

SEQ ID NO: 3781481 - RNA, 21 nt, Human
uuaugugugcauguguguaua

SEQ ID NO: 3781482 - RNA, 10 nt, Human
uuaugugugu

SEQ ID NO: 3781483 - RNA, 13 nt, Human
uuauguuaaaauc

SEQ ID NO: 3781484 - RNA, 14 nt, Human
uuauguuaaacuag

SEQ ID NO: 3781485 - RNA, 17 nt, Human
uuauguuaaaucaauaa

SEQ ID NO: 3781486 - RNA, 14 nt, Human
uugggaauuuuauu

SEQ ID NO: 3781487 - RNA, 22 nt, Human
uugggaccgccagauggggccu

SEQ ID NO: 3781488 - RNA, 22 nt, Human
uugggacugcuaaauaaaauuu

SEQ ID NO: 3781489 - RNA, 14 nt, Human
uugggagacaugug

SEQ ID NO: 3781490 - RNA, 17 nt, Human
uugggagacaugugaca

SEQ ID NO: 3781491 - RNA, 15 nt, Human
uugggagagccccug

SEQ ID NO: 3781492 - RNA, 13 nt, Human
uugggaggaagca

SEQ ID NO: 3781493 - RNA, 14 nt, Human
uugggaggaagcag

SEQ ID NO: 3781494 - RNA, 18 nt, Human
uugggaggaagcagaaua

SEQ ID NO: 3781495 - RNA, 23 nt, Human
uugggaggaagcagaauaaagca

SEQ ID NO: 3781496 - RNA, 16 nt, Human
uugggaggccauuugu

SEQ ID NO: 3781497 - RNA, 19 nt, Human
uugggagggaaaagggaag

SEQ ID NO: 3781498 - RNA, 15 nt, Human
uugggagugagaugc

SEQ ID NO: 3781499 - RNA, 15 nt, Human
uugggauaucuccug

SEQ ID NO: 3781500 - RNA, 17 nt, Human
uugggaugucuuauuuu

SEQ ID NO: 3781501 - RNA, 18 nt, Human
uugggaugucuuauuuuu

SEQ ID NO: 3781502 - RNA, 15 nt, Human
uuguagcuccucccc

SEQ ID NO: 3781503 - RNA, 20 nt, Human
uuguaggcgaaucauuuguu

SEQ ID NO: 3781504 - RNA, 17 nt, Human
uuguaggggucaaagaa

SEQ ID NO: 3781505 - RNA, 19 nt, Human
uuguaggggucaaagaaau

SEQ ID NO: 3781506 - RNA, 14 nt, Human
uuguaggguuucua

SEQ ID NO: 3781507 - RNA, 18 nt, Human
uuguagguacuuuuggaa

SEQ ID NO: 3781508 - RNA, 20 nt, Human
uuguagguacuuuuggaauc

SEQ ID NO: 3781509 - RNA, 18 nt, Human
uuguaguaaagaaauuua

SEQ ID NO: 3781510 - RNA, 15 nt, Human
uuguaguagucucau

SEQ ID NO: 3781511 - RNA, 19 nt, Human
uuguaguuccacuuauagc

SEQ ID NO: 3781512 - RNA, 13 nt, Human
uuguaguugaaua

SEQ ID NO: 3781513 - RNA, 20 nt, Human
uuguauaaaaauagaagaau

SEQ ID NO: 3781514 - RNA, 12 nt, Human
uuguauaaaaua

SEQ ID NO: 3781515 - RNA, 16 nt, Human
uuguauaaaauaauuu

SEQ ID NO: 3781516 - RNA, 12 nt, Human
uuguauaaauuu

SEQ ID NO: 3781517 - RNA, 15 nt, Human
uuguauaacagguua

SEQ ID NO: 3781518 - RNA, 16 nt, Human
uuguauaacuaacagc

SEQ ID NO: 3781519 - RNA, 20 nt, Human
uuguauaauuggauuuccua

SEQ ID NO: 3781520 - RNA, 12 nt, Human
uuguauaauugu

SEQ ID NO: 3781521 - RNA, 12 nt, Human
uuguauaauuuc

SEQ ID NO: 3781522 - RNA, 15 nt, Human
uuguauacauccugg

SEQ ID NO: 3781523 - RNA, 17 nt, Human
uuguauagagauaugca

SEQ ID NO: 3781524 - RNA, 16 nt, Human
uuguauaguguaaaau

SEQ ID NO: 3781525 - RNA, 16 nt, Human
uuguauaguuaacaca

SEQ ID NO: 3781526 - RNA, 17 nt, Human
uuguauaguuauguaaa

SEQ ID NO: 3781527 - RNA, 18 nt, Human
uuguauaguuauguaaau

SEQ ID NO: 3781528 - RNA, 15 nt, Human
uuguauauaugugug

SEQ ID NO: 3781529 - RNA, 13 nt, Human
uuguauauuacaa

SEQ ID NO: 3781530 - RNA, 16 nt, Human
uuguauauuacaauga

SEQ ID NO: 3781531 - RNA, 18 nt, Human
uuguauauuauggaagau

SEQ ID NO: 3781532 - RNA, 22 nt, Human
uuguauauucuauuuuacaacu

SEQ ID NO: 3781533 - RNA, 16 nt, Human
uuguauauugucagau

SEQ ID NO: 3781534 - RNA, 15 nt, Human
uuguauauuuguaca

SEQ ID NO: 3781535 - RNA, 15 nt, Human
uuguaucagaggccu

SEQ ID NO: 3781536 - RNA, 14 nt, Human
uuguauccccugca

SEQ ID NO: 3781537 - RNA, 15 nt, Human
uuguauccccugcag

SEQ ID NO: 3781538 - RNA, 20 nt, Human
uuguaucguauagcuguauu

SEQ ID NO: 3781539 - RNA, 22 nt, Human
uuguaucguauagcuguauuga

SEQ ID NO: 3781540 - RNA, 20 nt, Human
uuguaucuagugcagcugau

SEQ ID NO: 3781541 - RNA, 13 nt, Human
uuguaucucuuuu

SEQ ID NO: 3781542 - RNA, 20 nt, Human
uuguaugauccuaaugaaug

SEQ ID NO: 3781543 - RNA, 13 nt, Human
uuguaugaugugu

SEQ ID NO: 3781544 - RNA, 24 nt, Human
uuguaugcaagcaguuucaauaaa

SEQ ID NO: 3781545 - RNA, 20 nt, Human
uuguauggggaggcaagugu

SEQ ID NO: 3781546 - RNA, 13 nt, Human
uuguauuaaacuc

SEQ ID NO: 3781547 - RNA, 14 nt, Human
uuguauuacagaug

SEQ ID NO: 3781548 - RNA, 13 nt, Human
uuguauuagaugu

SEQ ID NO: 3781549 - RNA, 15 nt, Human
uuguauuagauguuc

SEQ ID NO: 3781550 - RNA, 17 nt, Human
uuguauuauuuuuguag

SEQ ID NO: 3781551 - RNA, 22 nt, Human
uuguauucaaaaauuaucuaua

SEQ ID NO: 3781552 - RNA, 15 nt, Human
uuguauucucuccug

SEQ ID NO: 3781553 - RNA, 20 nt, Human
uuguauucucugagcugugc

SEQ ID NO: 3781554 - RNA, 18 nt, Human
uuguauucuuugauguua

SEQ ID NO: 3781555 - RNA, 19 nt, Human
uuguauugugguauugaau

SEQ ID NO: 3781556 - RNA, 18 nt, Human
uuguauuguuagauguuu

SEQ ID NO: 3781557 - RNA, 16 nt, Human
uuguauuuauguguau

SEQ ID NO: 3781558 - RNA, 14 nt, Human
uuguauuuauucaa

SEQ ID NO: 3781559 - RNA, 20 nt, Human
uuguauuuuacuaauaaaau

SEQ ID NO: 3781560 - RNA, 14 nt, Human
uuguauuuuaguau

SEQ ID NO: 3781561 - RNA, 18 nt, Human
uuguauuuucaugaaaau

SEQ ID NO: 3781562 - RNA, 18 nt, Human
uuguauuuugauuauuuu

SEQ ID NO: 3781563 - RNA, 15 nt, Human
uuguauuuuuaaugg

SEQ ID NO: 3781564 - RNA, 22 nt, Human
uuguauuuuuuugcaagugaag

SEQ ID NO: 3781565 - RNA, 22 nt, Human
uugucaaacuguagaaaugaug

SEQ ID NO: 3781566 - RNA, 20 nt, Human
uugucaagucucugcuggcc

SEQ ID NO: 3781567 - RNA, 19 nt, Human
uugucaauauuaaauacag

SEQ ID NO: 3781568 - RNA, 19 nt, Human
uugucaauauuuaaacaug

SEQ ID NO: 3781569 - RNA, 18 nt, Human
uugucaaugcuggagaaa

SEQ ID NO: 3781570 - RNA, 23 nt, Human
uugucacaauccuaacacauuau

SEQ ID NO: 3781571 - RNA, 17 nt, Human
uugucacacacuuuggc

SEQ ID NO: 3781572 - RNA, 22 nt, Human
uugucacaugaaacauuugcaa

SEQ ID NO: 3781573 - RNA, 15 nt, Human
uugucaccugcuucu

SEQ ID NO: 3781574 - RNA, 18 nt, Human
uugucacgcuucuucuuu

SEQ ID NO: 3781575 - RNA, 13 nt, Human
uugucagacauaa

SEQ ID NO: 3781576 - RNA, 18 nt, Human
uugucagacuuuaaagaa

SEQ ID NO: 3781577 - RNA, 15 nt, Human
uugucaguaucugua

SEQ ID NO: 3781578 - RNA, 15 nt, Human
uugucagugacagua

SEQ ID NO: 3781579 - RNA, 16 nt, Human
uugucaucaccaugga

SEQ ID NO: 3781580 - RNA, 19 nt, Human
uugucaucagccaaaacgu

SEQ ID NO: 3781581 - RNA, 21 nt, Human
uugucaucauuguauauaugu

SEQ ID NO: 3781582 - RNA, 14 nt, Human
uugucauguguaua

SEQ ID NO: 3781583 - RNA, 22 nt, Human
uugucauguguauaaaaauaaa

SEQ ID NO: 3781584 - RNA, 14 nt, Human
uugucauuaaaggu

SEQ ID NO: 3781585 - RNA, 19 nt, Human
uugucauuagccugaguag

SEQ ID NO: 3781586 - RNA, 22 nt, Human
uugucauuguaaacaaacucuu

SEQ ID NO: 3781587 - RNA, 20 nt, Human
uugucauuuucauuagcaaa

SEQ ID NO: 3781588 - RNA, 12 nt, Human
uugucauuuucu

SEQ ID NO: 3781589 - RNA, 19 nt, Human
uugucauuuugaagcuaau

SEQ ID NO: 3781590 - RNA, 19 nt, Human
uuguccaauuguugacagu

SEQ ID NO: 3781591 - RNA, 14 nt, Human
uuguccacccaccu

SEQ ID NO: 3781592 - RNA, 13 nt, Human
uuguccagagaca

SEQ ID NO: 3781593 - RNA, 13 nt, Human
uuguccagagcug

SEQ ID NO: 3781594 - RNA, 19 nt, Human
uuguccagcugagcgccag

SEQ ID NO: 3781595 - RNA, 16 nt, Human
uuguccauauuuucac

SEQ ID NO: 3781596 - RNA, 14 nt, Human
uuguccauuuguaa

SEQ ID NO: 3781597 - RNA, 20 nt, Human
uugucccacucaagccaagc

SEQ ID NO: 3781598 - RNA, 21 nt, Human
uugucccagaggcugccccac

SEQ ID NO: 3781599 - RNA, 17 nt, Human
uuguccccaaugaauau

SEQ ID NO: 3781600 - RNA, 11 nt, Human
uuguccccaca

SEQ ID NO: 3781601 - RNA, 17 nt, Human
uuguccccacacuccua

SEQ ID NO: 3781602 - RNA, 11 nt, Human
uuguccccagu

SEQ ID NO: 3781603 - RNA, 15 nt, Human
uuguccccguggucu

SEQ ID NO: 3781604 - RNA, 13 nt, Human
uuguccccugcuu

SEQ ID NO: 3781605 - RNA, 15 nt, Human
uugucccugugccua

SEQ ID NO: 3781606 - RNA, 16 nt, Human
uuguccgcuggguggu

SEQ ID NO: 3781607 - RNA, 17 nt, Human
uuguccgguuuacuuua

SEQ ID NO: 3781608 - RNA, 21 nt, Human
uuguccgguuuacuuuaacuu

SEQ ID NO: 3781609 - RNA, 16 nt, Human
uuguccuaugggaguc

SEQ ID NO: 3781610 - RNA, 19 nt, Human
uuguccuauuaguguuaua

SEQ ID NO: 3781611 - RNA, 22 nt, Human
uuguccucagccccgcguggaa

SEQ ID NO: 3781612 - RNA, 16 nt, Human
uuguccuccugcugcc

SEQ ID NO: 3781613 - RNA, 16 nt, Human
uuguccuuagccugga

SEQ ID NO: 3781614 - RNA, 14 nt, Human
uuguccuugcuggu

SEQ ID NO: 3781615 - RNA, 20 nt, Human
uuguccuuuaaaaaagaaaa

SEQ ID NO: 3781616 - RNA, 15 nt, Human
uuguccuuugauucc

SEQ ID NO: 3781617 - RNA, 14 nt, Human
uugucggcuccagu

SEQ ID NO: 3781618 - RNA, 20 nt, Human
uugucgggcaccagccagcg

SEQ ID NO: 3781619 - RNA, 11 nt, Human
uugucuaaaau

SEQ ID NO: 3781620 - RNA, 22 nt, Human
uugucuaaaaugccucagugua

SEQ ID NO: 3781621 - RNA, 15 nt, Human
uugucuaacucagaa

SEQ ID NO: 3781622 - RNA, 13 nt, Human
uugucuaagaaau

SEQ ID NO: 3781623 - RNA, 19 nt, Human
uugucuacaccauuaugug

SEQ ID NO: 3781624 - RNA, 15 nt, Human
uugucuauucuccag

SEQ ID NO: 3781625 - RNA, 12 nt, Human
uugucuauuuua

SEQ ID NO: 3781626 - RNA, 23 nt, Human
uugucuauuuuucucuucauauu

SEQ ID NO: 3781627 - RNA, 16 nt, Human
uugucuauuuuugucu

SEQ ID NO: 3781628 - RNA, 18 nt, Human
uugucuauuuuugucuua

SEQ ID NO: 3781629 - RNA, 18 nt, Human
uugucucaaugcucauaa

SEQ ID NO: 3781630 - RNA, 12 nt, Human
uugucucagaag

SEQ ID NO: 3781631 - RNA, 22 nt, Human
uugucucagauuuuauuaugua

SEQ ID NO: 3781632 - RNA, 22 nt, Human
uugucuccccuguuccccucuc

SEQ ID NO: 3781633 - RNA, 23 nt, Human
uugucuccccuguuccccucucc

SEQ ID NO: 3781634 - RNA, 14 nt, Human
uugucucccuggcc

SEQ ID NO: 3781635 - RNA, 15 nt, Human
uugucucccuggccc

SEQ ID NO: 3781636 - RNA, 18 nt, Human
uugucucccuggcccuca

SEQ ID NO: 3781637 - RNA, 14 nt, Human
uugucucuacuuuu

SEQ ID NO: 3781638 - RNA, 19 nt, Human
uugucucuaugccagcuca

SEQ ID NO: 3781639 - RNA, 13 nt, Human
uugucucuccuuu

SEQ ID NO: 3781640 - RNA, 13 nt, Human
uugucucugaugc

SEQ ID NO: 3781641 - RNA, 23 nt, Human
uugucucuguuuuacaaguugga

SEQ ID NO: 3781642 - RNA, 17 nt, Human
uugucugaaacauuuca

SEQ ID NO: 3781643 - RNA, 21 nt, Human
uugucugaagucacugcacag

SEQ ID NO: 3781644 - RNA, 20 nt, Human
uugucuggcaaggacuuugu

SEQ ID NO: 3781645 - RNA, 21 nt, Human
uugucuggcaaggacuuugua

SEQ ID NO: 3781646 - RNA, 17 nt, Human
uugucugguuaaaaaau

SEQ ID NO: 3781647 - RNA, 18 nt, Human
uugucugguuaaaaaaua

SEQ ID NO: 3781648 - RNA, 20 nt, Human
uugucuguuuguuucaagaa

SEQ ID NO: 3781649 - RNA, 15 nt, Human
uugucuuaucuggcc

SEQ ID NO: 3781650 - RNA, 19 nt, Human
uugucuuccuauuucagaa

SEQ ID NO: 3781651 - RNA, 23 nt, Human
uugucuuccuauuucagaaguuu

SEQ ID NO: 3781652 - RNA, 15 nt, Human
uugucuucuccccag

SEQ ID NO: 3781653 - RNA, 13 nt, Human
uuggacccuucca

SEQ ID NO: 3781654 - RNA, 17 nt, Human
uuggaccuaauccaagc

SEQ ID NO: 3781655 - RNA, 17 nt, Human
uuggaccucgugcuuua

SEQ ID NO: 3781656 - RNA, 16 nt, Human
uuggaccucugcucug

SEQ ID NO: 3781657 - RNA, 13 nt, Human
uuggacggccuga

SEQ ID NO: 3781658 - RNA, 17 nt, Human
uuggacuaaaugccuag

SEQ ID NO: 3781659 - RNA, 13 nt, Human
uuggacuauuaua

SEQ ID NO: 3781660 - RNA, 14 nt, Human
uuggacugacauuu

SEQ ID NO: 3781661 - RNA, 15 nt, Human
uuggacuggaugcau

SEQ ID NO: 3781662 - RNA, 20 nt, Human
uuggacuuuucguuaacauu

SEQ ID NO: 3781663 - RNA, 18 nt, Human
uuggagaaaugaaaacag

SEQ ID NO: 3781664 - RNA, 17 nt, Human
uuggagacauuccuggg

SEQ ID NO: 3781665 - RNA, 15 nt, Human
uuggagaccuuaccc

SEQ ID NO: 3781666 - RNA, 20 nt, Human
uuggagacucuguggggccu

SEQ ID NO: 3781667 - RNA, 22 nt, Human
uuggagacuuucuuuaaauuau

SEQ ID NO: 3781668 - RNA, 15 nt, Human
uuggagagacacagc

SEQ ID NO: 3781669 - RNA, 15 nt, Human
uuggagaguuuccug

SEQ ID NO: 3781670 - RNA, 21 nt, Human
uuggagaguuuccugaaacaa

SEQ ID NO: 3781671 - RNA, 20 nt, Human
uuggagauaaucuagaacac

SEQ ID NO: 3781672 - RNA, 11 nt, Human
uuggagcauug

SEQ ID NO: 3781673 - RNA, 15 nt, Human
uuggagcccagggca

SEQ ID NO: 3781674 - RNA, 16 nt, Human
uuggagcguggacugg

SEQ ID NO: 3781675 - RNA, 14 nt, Human
uuggagcugagccu

SEQ ID NO: 3781676 - RNA, 15 nt, Human
uuggagcuuacauag

SEQ ID NO: 3781677 - RNA, 21 nt, Human
uuggagcuuuuuucuuuaaga

SEQ ID NO: 3781678 - RNA, 14 nt, Human
uuggaggaaguugg

SEQ ID NO: 3781679 - RNA, 19 nt, Human
uuggaggaccaaaaaaaua

SEQ ID NO: 3781680 - RNA, 15 nt, Human
uuggaggccagccag

SEQ ID NO: 3781681 - RNA, 14 nt, Human
uuggagggccuggg

SEQ ID NO: 3781682 - RNA, 23 nt, Human
uuggagggugggagagcccagcc

SEQ ID NO: 3781683 - RNA, 13 nt, Human
uugucuugaaaga

SEQ ID NO: 3781684 - RNA, 14 nt, Human
uugucuugaaagau

SEQ ID NO: 3781685 - RNA, 15 nt, Human
uugucuugaaugucu

SEQ ID NO: 3781686 - RNA, 18 nt, Human
uugucuuguguauuucag

SEQ ID NO: 3781687 - RNA, 13 nt, Human
uugucuuuauaug

SEQ ID NO: 3781688 - RNA, 12 nt, Human
uugucuuuauuu

SEQ ID NO: 3781689 - RNA, 17 nt, Human
uugugaaacacagcugu

SEQ ID NO: 3781690 - RNA, 18 nt, Human
uugugaaacacagcuguu

SEQ ID NO: 3781691 - RNA, 19 nt, Human
uugugaaacagacuuguau

SEQ ID NO: 3781692 - RNA, 21 nt, Human
uugugaaauaaaacuggcuuu

SEQ ID NO: 3781693 - RNA, 13 nt, Human
uugugaaauuauu

SEQ ID NO: 3781694 - RNA, 15 nt, Human
uugugaaauuuuuca

SEQ ID NO: 3781695 - RNA, 19 nt, Human
uugugaaauuuuucauauu

SEQ ID NO: 3781696 - RNA, 19 nt, Human
uugugaacaagucccugua

SEQ ID NO: 3781697 - RNA, 11 nt, Human
uugugaacaga

SEQ ID NO: 3781698 - RNA, 13 nt, Human
uugugaaccaaug

SEQ ID NO: 3781699 - RNA, 17 nt, Human
uugugaaccaaugcaag

SEQ ID NO: 3781700 - RNA, 19 nt, Human
uugugaacucagccaagca

SEQ ID NO: 3781701 - RNA, 22 nt, Human
uugugaagaacuauuuuauucu

SEQ ID NO: 3781702 - RNA, 11 nt, Human
uugugaagagg

SEQ ID NO: 3781703 - RNA, 21 nt, Human
uugugaaggauuauggaaaaa

SEQ ID NO: 3781704 - RNA, 13 nt, Human
uugugaaggcagg

SEQ ID NO: 3781705 - RNA, 22 nt, Human
uugugaaggcaggggaauguau

SEQ ID NO: 3781706 - RNA, 23 nt, Human
uugugaagugaaggauuuguguu

SEQ ID NO: 3781707 - RNA, 23 nt, Human
uugugaauauguacauaggcagc

SEQ ID NO: 3781708 - RNA, 16 nt, Human
uugugaaugcuucuca

SEQ ID NO: 3781709 - RNA, 14 nt, Human
uugugaauggauug

SEQ ID NO: 3781710 - RNA, 15 nt, Human
uugugaauggauugg

SEQ ID NO: 3781711 - RNA, 18 nt, Human
uugugaauugauaauaaa

SEQ ID NO: 3781712 - RNA, 22 nt, Human
uugugacaaaaaauuaaagcau

SEQ ID NO: 3781713 - RNA, 18 nt, Human
uugugacagcucuuuuug

SEQ ID NO: 3781714 - RNA, 21 nt, Human
uugugacagggcggggguggc

SEQ ID NO: 3781715 - RNA, 16 nt, Human
uugugaccuuaguguu

SEQ ID NO: 3781716 - RNA, 19 nt, Human
uugugaccuuaguguuucu

SEQ ID NO: 3781717 - RNA, 22 nt, Human
uugugacuaauuguauaacagg

SEQ ID NO: 3781718 - RNA, 13 nt, Human
uugugacuagugc

SEQ ID NO: 3781719 - RNA, 16 nt, Human
uugugacuagugcuga

SEQ ID NO: 3781720 - RNA, 17 nt, Human
uugugacuagugcugaa

SEQ ID NO: 3781721 - RNA, 21 nt, Human
uugugacuagugcugaagcuu

SEQ ID NO: 3781722 - RNA, 22 nt, Human
uugugacuagugcugaagcuua

SEQ ID NO: 3781723 - RNA, 18 nt, Human
uugugacuuuugcuuuaa

SEQ ID NO: 3781724 - RNA, 12 nt, Human
uugugagauggg

SEQ ID NO: 3781725 - RNA, 18 nt, Human
uugugaggaagccgcugg

SEQ ID NO: 3781726 - RNA, 21 nt, Human
uugugaggaagccgcuggggc

SEQ ID NO: 3781727 - RNA, 19 nt, Human
uugugaguuuguuucuuug

SEQ ID NO: 3781728 - RNA, 21 nt, Human
uugugaguuuguuucuuugaa

SEQ ID NO: 3781729 - RNA, 22 nt, Human
uugugauaaguucuaguugcuu

SEQ ID NO: 3781730 - RNA, 13 nt, Human
uugugauaauuua

SEQ ID NO: 3781731 - RNA, 14 nt, Human
uugugauaauuuaa

SEQ ID NO: 3781732 - RNA, 15 nt, Human
uugugauagcacuuu

SEQ ID NO: 3781733 - RNA, 21 nt, Human
uugugauaugcacaauguaga

SEQ ID NO: 3781734 - RNA, 23 nt, Human
uugugaucagaccauaauguuac

SEQ ID NO: 3781735 - RNA, 14 nt, Human
uugugaucuugcuc

SEQ ID NO: 3781736 - RNA, 16 nt, Human
uugugauggagugcug

SEQ ID NO: 3781737 - RNA, 17 nt, Human
uugugauggagugcugu

SEQ ID NO: 3781738 - RNA, 18 nt, Human
uugugaugucccaacuug

SEQ ID NO: 3781739 - RNA, 22 nt, Human
uugugaugucccaacuuguaaa

SEQ ID NO: 3781740 - RNA, 18 nt, Human
uugugauuauuucacuuu

SEQ ID NO: 3781741 - RNA, 19 nt, Human
uugugauucaaucuguaaa

SEQ ID NO: 3781742 - RNA, 23 nt, Human
uugugauucaaucuguaaacugu

SEQ ID NO: 3781743 - RNA, 21 nt, Human
uugugauucuuccagauguga

SEQ ID NO: 3781744 - RNA, 14 nt, Human
uugugauuucuuua

SEQ ID NO: 3781745 - RNA, 16 nt, Human
uugugauuugacuguu

SEQ ID NO: 3781746 - RNA, 22 nt, Human
uugugauuugacuguuuuuacc

SEQ ID NO: 3781747 - RNA, 21 nt, Human
uugugcaaaauauuugacuau

SEQ ID NO: 3781748 - RNA, 23 nt, Human
uugugcaauguaaauauuuuaaa

SEQ ID NO: 3781749 - RNA, 20 nt, Human
uugugcaguaacuugggagu

SEQ ID NO: 3781750 - RNA, 14 nt, Human
uugugcauucugga

SEQ ID NO: 3781751 - RNA, 12 nt, Human
uugugcauuugg

SEQ ID NO: 3781752 - RNA, 19 nt, Human
uugugcauuuguaaaugcu

SEQ ID NO: 3781753 - RNA, 22 nt, Human
uugugccaauauguauuguaaa

SEQ ID NO: 3781754 - RNA, 17 nt, Human
uugugcccacugucucu

SEQ ID NO: 3781755 - RNA, 15 nt, Human
uugugccuaaugugu

SEQ ID NO: 3781756 - RNA, 16 nt, Human
uugugccuuuuauagc

SEQ ID NO: 3781757 - RNA, 14 nt, Human
uugugcuacagaug

SEQ ID NO: 3781758 - RNA, 18 nt, Human
uugugcuagaaauuuuca

SEQ ID NO: 3781759 - RNA, 11 nt, Human
uugugcugcca

SEQ ID NO: 3781760 - RNA, 13 nt, Human
uugugcugcuucu

SEQ ID NO: 3781761 - RNA, 11 nt, Human
uugugcuucuc

SEQ ID NO: 3781762 - RNA, 16 nt, Human
uugugcuucuccccag

SEQ ID NO: 3781763 - RNA, 23 nt, Human
uugugcuucuuucuuugggaaua

SEQ ID NO: 3781764 - RNA, 15 nt, Human
uugugcuuugcucuu

SEQ ID NO: 3781765 - RNA, 15 nt, Human
uugugcuuuuccuga

SEQ ID NO: 3781766 - RNA, 19 nt, Human
uuguggaauguuggauaag

SEQ ID NO: 3781767 - RNA, 16 nt, Human
uuguggauaacaaaga

SEQ ID NO: 3781768 - RNA, 18 nt, Human
uuguggauauaaaaugug

SEQ ID NO: 3781769 - RNA, 23 nt, Human
uuguggauuuaacagaaauguac

SEQ ID NO: 3781770 - RNA, 16 nt, Human
uuguggauuucaguuu

SEQ ID NO: 3781771 - RNA, 18 nt, Human
uuguggccaaggagcugc

SEQ ID NO: 3781772 - RNA, 11 nt, Human
uuguggccuca

SEQ ID NO: 3781773 - RNA, 13 nt, Human
uuguggccucaga

SEQ ID NO: 3781774 - RNA, 13 nt, Human
uuguggccuggga

SEQ ID NO: 3781775 - RNA, 17 nt, Human
uuguggcuauccugauu

SEQ ID NO: 3781776 - RNA, 15 nt, Human
uugugggccugggcu

SEQ ID NO: 3781777 - RNA, 19 nt, Human
uugugggccugggcuccug

SEQ ID NO: 3781778 - RNA, 15 nt, Human
uuguggggacccagg

SEQ ID NO: 3781779 - RNA, 16 nt, Human
uugugggggacuguaa

SEQ ID NO: 3781780 - RNA, 20 nt, Human
uuguggguucuauguuuacu

SEQ ID NO: 3781781 - RNA, 21 nt, Human
uuguggugugaguaucagaau

SEQ ID NO: 3781782 - RNA, 14 nt, Human
uugugguuauuuuu

SEQ ID NO: 3781783 - RNA, 19 nt, Human
uugugguuauuuuuauaca

SEQ ID NO: 3781784 - RNA, 16 nt, Human
uugugguuuuauggag

SEQ ID NO: 3781785 - RNA, 19 nt, Human
uuguguaauagaaaacuga

SEQ ID NO: 3781786 - RNA, 21 nt, Human
uuguguaauagaaaacugaaa

SEQ ID NO: 3781787 - RNA, 13 nt, Human
uuguguaauuuau

SEQ ID NO: 3781788 - RNA, 15 nt, Human
uuguguacagugugu

SEQ ID NO: 3781789 - RNA, 23 nt, Human
uuguguacucggaaauuaaaguu

SEQ ID NO: 3781790 - RNA, 15 nt, Human
uuguguacucuggcc

SEQ ID NO: 3781791 - RNA, 16 nt, Human
uuguguacuuuuaaga

SEQ ID NO: 3781792 - RNA, 14 nt, Human
uuguguagccuuuu

SEQ ID NO: 3781793 - RNA, 20 nt, Human
uuguguauccauuaucaugu

SEQ ID NO: 3781794 - RNA, 21 nt, Human
uuguguauccauuaucaugug

SEQ ID NO: 3781795 - RNA, 22 nt, Human
uuguguauuuacgcuuugauuc

SEQ ID NO: 3781796 - RNA, 22 nt, Human
uugugucaacaugaacaaauuu

SEQ ID NO: 3781797 - RNA, 21 nt, Human
uugugucaaugggcaaugaca

SEQ ID NO: 3781798 - RNA, 18 nt, Human
uugugucccauuccccca

SEQ ID NO: 3781799 - RNA, 13 nt, Human
uugugucugcagg

SEQ ID NO: 3781800 - RNA, 17 nt, Human
uugugucugcaggauug

SEQ ID NO: 3781801 - RNA, 23 nt, Human
uugugugaaagguacuucaaauc

SEQ ID NO: 3781802 - RNA, 17 nt, Human
uugugugauauuucaga

SEQ ID NO: 3781803 - RNA, 21 nt, Human
uugugugauauuucagaaaua

SEQ ID NO: 3781804 - RNA, 13 nt, Human
uugugugauugaa

SEQ ID NO: 3781805 - RNA, 15 nt, Human
uugugugccucuagc

SEQ ID NO: 3781806 - RNA, 17 nt, Human
uugugugccucuagcug

SEQ ID NO: 3781807 - RNA, 21 nt, Human
uugugugcggagucauuuugu

SEQ ID NO: 3781808 - RNA, 15 nt, Human
uuguguguaugugua

SEQ ID NO: 3781809 - RNA, 15 nt, Human
uugugugucaugcca

SEQ ID NO: 3781810 - RNA, 19 nt, Human
uugugugucuuaauuauua

SEQ ID NO: 3781811 - RNA, 19 nt, Human
uugugugugcucugcuuca

SEQ ID NO: 3781812 - RNA, 16 nt, Human
uuguguguuauuuaaa

SEQ ID NO: 3781813 - RNA, 20 nt, Human
uuguguguuauuuaaaugag

SEQ ID NO: 3781814 - RNA, 13 nt, Human
uuguguguugucu

SEQ ID NO: 3781815 - RNA, 17 nt, Human
uuguguguuuauuguca

SEQ ID NO: 3781816 - RNA, 18 nt, Human
uuguguguuuauuucacu

SEQ ID NO: 3781817 - RNA, 20 nt, Human
uuguguucccauuucagcug

SEQ ID NO: 3781818 - RNA, 13 nt, Human
uuguguucuaaua

SEQ ID NO: 3781819 - RNA, 20 nt, Human
uuguguugaagagguuuuaa

SEQ ID NO: 3781820 - RNA, 12 nt, Human
uuguguugacau

SEQ ID NO: 3781821 - RNA, 12 nt, Human
uuguguuguaau

SEQ ID NO: 3781822 - RNA, 14 nt, Human
uuguguuguaauuc

SEQ ID NO: 3781823 - RNA, 13 nt, Human
uuguguugugaau

SEQ ID NO: 3781824 - RNA, 16 nt, Human
uuguguuuauucuuga

SEQ ID NO: 3781825 - RNA, 19 nt, Human
uuguguuucuuuaguuuuu

SEQ ID NO: 3781826 - RNA, 21 nt, Human
uuguguuuuuuaagauagugu

SEQ ID NO: 3781827 - RNA, 23 nt, Human
uuguuaaaaaaaaaaagauugua

SEQ ID NO: 3781828 - RNA, 20 nt, Human
uuguuaaaauuaugaaucug

SEQ ID NO: 3781829 - RNA, 12 nt, Human
uuguuaaauuuu

SEQ ID NO: 3781830 - RNA, 18 nt, Human
uuguuaacucuugucuau

SEQ ID NO: 3781831 - RNA, 22 nt, Human
uuguuaacucuugucuauuuuu

SEQ ID NO: 3781832 - RNA, 18 nt, Human
uuguuaauacaagguaua

SEQ ID NO: 3781833 - RNA, 23 nt, Human
uuuaaauguguacaauguacaca

SEQ ID NO: 3781834 - RNA, 20 nt, Human
uuuaaauuaauaucuuucug

SEQ ID NO: 3781835 - RNA, 22 nt, Human
uuuaaauuagauaacaaaauuu

SEQ ID NO: 3781836 - RNA, 16 nt, Human
uuuaaauuauaaggac

SEQ ID NO: 3781837 - RNA, 21 nt, Human
uuuaaauuauaaggacugcau

SEQ ID NO: 3781838 - RNA, 22 nt, Human
uuuaaauuauaaggacugcaug

SEQ ID NO: 3781839 - RNA, 14 nt, Human
uuuaaauucugaga

SEQ ID NO: 3781840 - RNA, 22 nt, Human
uuuaaauuuuacccuuuagacu

SEQ ID NO: 3781841 - RNA, 22 nt, Human
uuuaaauuuucuucaguuggug

SEQ ID NO: 3781842 - RNA, 15 nt, Human
uuuaacaaaagcaag

SEQ ID NO: 3781843 - RNA, 14 nt, Human
uuuaacaacauguu

SEQ ID NO: 3781844 - RNA, 12 nt, Human
uuuaacaagaag

SEQ ID NO: 3781845 - RNA, 21 nt, Human
uuuaacaagaagaugaauggc

SEQ ID NO: 3781846 - RNA, 21 nt, Human
uuuaacaauaacuacuguguu

SEQ ID NO: 3781847 - RNA, 14 nt, Human
uuuaacaaugcgaa

SEQ ID NO: 3781848 - RNA, 20 nt, Human
uuuaacaaugcgaaugguag

SEQ ID NO: 3781849 - RNA, 17 nt, Human
uuuaacaccugaugugu

SEQ ID NO: 3781850 - RNA, 21 nt, Human
uuuaacaccugauguguacau

SEQ ID NO: 3781851 - RNA, 13 nt, Human
uuuaacagaaaug

SEQ ID NO: 3781852 - RNA, 15 nt, Human
uuuaacagaaaugua

SEQ ID NO: 3781853 - RNA, 19 nt, Human
uuuaacagaaauuguauau

SEQ ID NO: 3781854 - RNA, 17 nt, Human
uuuaacagcugaauuau

SEQ ID NO: 3781855 - RNA, 14 nt, Human
uuuaacagggucuc

SEQ ID NO: 3781856 - RNA, 16 nt, Human
uuuaacagucauuuaa

SEQ ID NO: 3781857 - RNA, 17 nt, Human
uuuaacagucauuuaaa

SEQ ID NO: 3781858 - RNA, 22 nt, Human
uuuaacauaaagguuauuuucu

SEQ ID NO: 3781859 - RNA, 14 nt, Human
uuuaacauaagcua

SEQ ID NO: 3781860 - RNA, 18 nt, Human
uuuaacauaagcuauuuu

SEQ ID NO: 3781861 - RNA, 19 nt, Human
uuuaacauaagcuauuuuu

SEQ ID NO: 3781862 - RNA, 13 nt, Human
uuuaacauuccuc

SEQ ID NO: 3781863 - RNA, 22 nt, Human
uuuaacauuccucaugaaugua

SEQ ID NO: 3781864 - RNA, 23 nt, Human
uuuaacauuccucaugaauguaa

SEQ ID NO: 3781865 - RNA, 21 nt, Human
uuuaacauuugccuugcagaa

SEQ ID NO: 3781866 - RNA, 19 nt, Human
uuuaaccaaaacaugucuc

SEQ ID NO: 3781867 - RNA, 12 nt, Human
uuuaaccaaagg

SEQ ID NO: 3781868 - RNA, 23 nt, Human
uuuaaccaaaggugaaggaauau

SEQ ID NO: 3781869 - RNA, 21 nt, Human
uuuaaccauggugcuuguuaa

SEQ ID NO: 3781870 - RNA, 20 nt, Human
uuuaaccauuaaaacugaag

SEQ ID NO: 3781871 - RNA, 22 nt, Human
uuuaaccauugucuuguucugu

SEQ ID NO: 3781872 - RNA, 17 nt, Human
uuuaaccucuuuaagua

SEQ ID NO: 3781873 - RNA, 16 nt, Human
uuuaacuaugaacuga

SEQ ID NO: 3781874 - RNA, 23 nt, Human
uuuaacucagaucacuacugcag

SEQ ID NO: 3781875 - RNA, 19 nt, Human
uuuaacucaggacuccagc

SEQ ID NO: 3781876 - RNA, 20 nt, Human
uuuaacucccauuaccaugu

SEQ ID NO: 3781877 - RNA, 18 nt, Human
uuuaacuccucaauucca

SEQ ID NO: 3781878 - RNA, 12 nt, Human
uuuaacucuguc

SEQ ID NO: 3781879 - RNA, 14 nt, Human
uuuaacugagaaau

SEQ ID NO: 3781880 - RNA, 21 nt, Human
uuuaacugccguaauuuaacu

SEQ ID NO: 3781881 - RNA, 19 nt, Human
uuuaacuggugcacuuugu

SEQ ID NO: 3781882 - RNA, 13 nt, Human
uuuaacuguggau

SEQ ID NO: 3781883 - RNA, 12 nt, Human
uuuaacuugagc

SEQ ID NO: 3781884 - RNA, 18 nt, Human
uuuaacuuuaaguuucag

SEQ ID NO: 3781885 - RNA, 23 nt, Human
uuuaacuuuaccaugcucaauga

SEQ ID NO: 3781886 - RNA, 19 nt, Human
uuuaacuuuaucacauuau

SEQ ID NO: 3781887 - RNA, 19 nt, Human
uuuaagaaaagcccugaga

SEQ ID NO: 3781888 - RNA, 15 nt, Human
uuuaagaauugagua

SEQ ID NO: 3781889 - RNA, 20 nt, Human
uuuaagacgaaacauuuguu

SEQ ID NO: 3781890 - RNA, 13 nt, Human
uuuaagagagaaa

SEQ ID NO: 3781891 - RNA, 14 nt, Human
uuuaagauaauuau

SEQ ID NO: 3781892 - RNA, 15 nt, Human
uuuaagauaauuaua

SEQ ID NO: 3781893 - RNA, 14 nt, Human
uuuaagauagugua

SEQ ID NO: 3781894 - RNA, 13 nt, Human
uuuaagaugugaa

SEQ ID NO: 3781895 - RNA, 11 nt, Human
uuuaagauuua

SEQ ID NO: 3781896 - RNA, 17 nt, Human
uuuaagcaacaucuuuu

SEQ ID NO: 3781897 - RNA, 13 nt, Human
uuuaagcagcucu

SEQ ID NO: 3781898 - RNA, 15 nt, Human
uuuaagcauuacucu

SEQ ID NO: 3781899 - RNA, 16 nt, Human
uuuaagcauuacucuu

SEQ ID NO: 3781900 - RNA, 23 nt, Human
uuuaagcauuguuugcuuauugu

SEQ ID NO: 3781901 - RNA, 18 nt, Human
uuuaagccaaaacaaugu

SEQ ID NO: 3781902 - RNA, 21 nt, Human
uuuaagccuaaagauuuugau

SEQ ID NO: 3781903 - RNA, 19 nt, Human
uuuaagccucauauuuaaa

SEQ ID NO: 3781904 - RNA, 18 nt, Human
uuuaagccuuuguugaac

SEQ ID NO: 3781905 - RNA, 23 nt, Human
uuuaagccuuuguugaacuguua

SEQ ID NO: 3781906 - RNA, 18 nt, Human
uuuaagcucugagcuguc

SEQ ID NO: 3781907 - RNA, 14 nt, Human
uuuaagcuucaguu

SEQ ID NO: 3781908 - RNA, 21 nt, Human
uuuaagcuucaguugcuuguc

SEQ ID NO: 3781909 - RNA, 12 nt, Human
uuuaaggaauau

SEQ ID NO: 3781910 - RNA, 15 nt, Human
uuuaaggauaaauuu

SEQ ID NO: 3781911 - RNA, 20 nt, Human
uuuaaggaugcuuguacaua

SEQ ID NO: 3781912 - RNA, 21 nt, Human
uuuaaggaugcuuguacauaa

SEQ ID NO: 3781913 - RNA, 22 nt, Human
uuuaaggaugcuuguacauaau

SEQ ID NO: 3781914 - RNA, 20 nt, Human
uuuaaggaugggguuaugaa

SEQ ID NO: 3781915 - RNA, 20 nt, Human
uuuaagggcccuuuuucaau

SEQ ID NO: 3781916 - RNA, 22 nt, Human
uuuaaggguuuguggaaaauga

SEQ ID NO: 3781917 - RNA, 17 nt, Human
uuuaaggucuguuugcu

SEQ ID NO: 3781918 - RNA, 16 nt, Human
uuuaagguuuuuacug

SEQ ID NO: 3781919 - RNA, 13 nt, Human
uuuaaguauuuau

SEQ ID NO: 3781920 - RNA, 20 nt, Human
uuuaagucaguauggucuaa

SEQ ID NO: 3781921 - RNA, 18 nt, Human
uuuaagugcguguguaga

SEQ ID NO: 3781922 - RNA, 18 nt, Human
uuuaagugcuuuguaaug

SEQ ID NO: 3781923 - RNA, 20 nt, Human
uuuaaguguuguaaauauuu

SEQ ID NO: 3781924 - RNA, 19 nt, Human
uuuaaguucuuaugaggag

SEQ ID NO: 3781925 - RNA, 22 nt, Human
uuuaaguuucaaacuuacuauu

SEQ ID NO: 3781926 - RNA, 18 nt, Human
uuuaaguuuugacaagcu

SEQ ID NO: 3781927 - RNA, 21 nt, Human
uuucuuaacuucuugcuucuu

SEQ ID NO: 3781928 - RNA, 13 nt, Human
uuucuuaauauau

SEQ ID NO: 3781929 - RNA, 22 nt, Human
uuucuuaauauauagcauuuau

SEQ ID NO: 3781930 - RNA, 21 nt, Human
uuucuuaaucauuuuuuauau

SEQ ID NO: 3781931 - RNA, 22 nt, Human
uuucuuacaggcacaaaaugau

SEQ ID NO: 3781932 - RNA, 15 nt, Human
uuucuuacuccuccu

SEQ ID NO: 3781933 - RNA, 20 nt, Human
uuucuuacugauuuuuaagu

SEQ ID NO: 3781934 - RNA, 12 nt, Human
uuucuuagcuuu

SEQ ID NO: 3781935 - RNA, 19 nt, Human
uuucuuagcuuuuuaauug

SEQ ID NO: 3781936 - RNA, 17 nt, Human
uuucuuaucuucugcaa

SEQ ID NO: 3781937 - RNA, 13 nt, Human
uuucuuaugugac

SEQ ID NO: 3781938 - RNA, 17 nt, Human
uuucuuaugugacauua

SEQ ID NO: 3781939 - RNA, 12 nt, Human
uuucccuggucc

SEQ ID NO: 3781940 - RNA, 14 nt, Human
uuucccuuaucaaa

SEQ ID NO: 3781941 - RNA, 16 nt, Human
uuucccuucaguaccc

SEQ ID NO: 3781942 - RNA, 20 nt, Human
uuucccuucaguacccucuc

SEQ ID NO: 3781943 - RNA, 13 nt, Human
uuucccuuccagu

SEQ ID NO: 3781944 - RNA, 15 nt, Human
uuucccuugaggaaa

SEQ ID NO: 3781945 - RNA, 18 nt, Human
uuucccuuuagcuguguu

SEQ ID NO: 3781946 - RNA, 19 nt, Human
uuucccuuuagcuguguua

SEQ ID NO: 3781947 - RNA, 22 nt, Human
uuuccguaauaacacccuuccu

SEQ ID NO: 3781948 - RNA, 15 nt, Human
uuuccguuaaaauac

SEQ ID NO: 3781949 - RNA, 23 nt, Human
uuuccguuugauuugucacugcu

SEQ ID NO: 3781950 - RNA, 20 nt, Human
uuuccuaaauauauuuuaag

SEQ ID NO: 3781951 - RNA, 17 nt, Human
uuuccuaaaugcaguga

SEQ ID NO: 3781952 - RNA, 14 nt, Human
uuuccuaaauguuu

SEQ ID NO: 3781953 - RNA, 19 nt, Human
uuuccuaagugauuguaug

SEQ ID NO: 3781954 - RNA, 21 nt, Human
uuuccuacuugcacucuucua

SEQ ID NO: 3781955 - RNA, 18 nt, Human
uuuccuagcacacacuuu

SEQ ID NO: 3781956 - RNA, 14 nt, Human
uuuccuaugaugua

SEQ ID NO: 3781957 - RNA, 18 nt, Human
uuuccuaugauguauacu

SEQ ID NO: 3781958 - RNA, 15 nt, Human
uuuccuaugcuauug

SEQ ID NO: 3781959 - RNA, 15 nt, Human
uuuccuaugcuuuga

SEQ ID NO: 3781960 - RNA, 16 nt, Human
uuuccuauuucagugu

SEQ ID NO: 3781961 - RNA, 11 nt, Human
uuuccucagug

SEQ ID NO: 3781962 - RNA, 14 nt, Human
uuuccucaucuguc

SEQ ID NO: 3781963 - RNA, 19 nt, Human
uuuccucauuccugaaaga

SEQ ID NO: 3781964 - RNA, 15 nt, Human
uuuccucccuugggu

SEQ ID NO: 3781965 - RNA, 22 nt, Human
uuuccucccuuggguucugaua

SEQ ID NO: 3781966 - RNA, 18 nt, Human
uuuccuccucaggcacac

SEQ ID NO: 3781967 - RNA, 12 nt, Human
uuuccuccucug

SEQ ID NO: 3781968 - RNA, 21 nt, Human
uuuccuccugaggcuuuggau

SEQ ID NO: 3781969 - RNA, 22 nt, Human
uuuccucuauacaucucucccc

SEQ ID NO: 3781970 - RNA, 20 nt, Human
uuuccucuauugauguacag

SEQ ID NO: 3781971 - RNA, 14 nt, Human
uuuccucuccacac

SEQ ID NO: 3781972 - RNA, 19 nt, Human
uuuccucucuuuguucuca

SEQ ID NO: 3781973 - RNA, 23 nt, Human
uuuccucucuuuguucucagcuc

SEQ ID NO: 3781974 - RNA, 23 nt, Human
uuuccucugaggaugauguacuu

SEQ ID NO: 3781975 - RNA, 23 nt, Human
uuuccucuguucaaagcugccug

SEQ ID NO: 3781976 - RNA, 15 nt, Human
uuuccucuuccaaag

SEQ ID NO: 3781977 - RNA, 12 nt, Human
uuuccucuugaa

SEQ ID NO: 3781978 - RNA, 13 nt, Human
uuuccucuuguga

SEQ ID NO: 3781979 - RNA, 22 nt, Human
uuuccugagcuuggccagaagg

SEQ ID NO: 3781980 - RNA, 16 nt, Human
uuuccugaggcugggc

SEQ ID NO: 3781981 - RNA, 23 nt, Human
uuuccugccuuuuaguuccugug

SEQ ID NO: 3781982 - RNA, 19 nt, Human
uuuccuggaauugccagcu

SEQ ID NO: 3781983 - RNA, 20 nt, Human
uuuccuggacacucagaccu

SEQ ID NO: 3781984 - RNA, 16 nt, Human
uuuccuggaugucuga

SEQ ID NO: 3781985 - RNA, 23 nt, Human
uuuccuggcacugcuuccaguga

SEQ ID NO: 3781986 - RNA, 23 nt, Human
uuuccuggcacuggaccccagca

SEQ ID NO: 3781987 - RNA, 19 nt, Human
uuuccugggacaucuucug

SEQ ID NO: 3781988 - RNA, 12 nt, Human
uuuccuguccuc

SEQ ID NO: 3781989 - RNA, 12 nt, Human
uuuccugugucu

SEQ ID NO: 3781990 - RNA, 15 nt, Human
uuuccuguuugggaa

SEQ ID NO: 3781991 - RNA, 16 nt, Human
uuuccuuaaacugugu

SEQ ID NO: 3781992 - RNA, 17 nt, Human
uuuccuuacauaaacau

SEQ ID NO: 3781993 - RNA, 20 nt, Human
uuuccuucaagaaugcagua

SEQ ID NO: 3781994 - RNA, 18 nt, Human
uuuccuucagugccuuau

SEQ ID NO: 3781995 - RNA, 16 nt, Human
uuuccuuccagcccag

SEQ ID NO: 3781996 - RNA, 19 nt, Human
uuuccuuccaucccuaccc

SEQ ID NO: 3781997 - RNA, 19 nt, Human
uuuccuucccuuuucuguu

SEQ ID NO: 3781998 - RNA, 20 nt, Human
uuuccuucccuuuucuguuc

SEQ ID NO: 3781999 - RNA, 16 nt, Human
uuuccuuccuucccug

SEQ ID NO: 3782000 - RNA, 18 nt, Human
uuuccuuccuucccuggc

SEQ ID NO: 3782001 - RNA, 12 nt, Human
uuuccuucuuug

SEQ ID NO: 3782002 - RNA, 14 nt, Human
uuuccuugaagccg

SEQ ID NO: 3782003 - RNA, 16 nt, Human
uuuccuuggcuggugc

SEQ ID NO: 3782004 - RNA, 18 nt, Human
uuuccuuggggcaggcag

SEQ ID NO: 3782005 - RNA, 13 nt, Human
uuuccuugugcaa

SEQ ID NO: 3782006 - RNA, 23 nt, Human
uuuccuuuaaaaaaauuuaagug

SEQ ID NO: 3782007 - RNA, 19 nt, Human
uuuccuuuauauuuaguga

SEQ ID NO: 3782008 - RNA, 21 nt, Human
uuuccuuuaugugaauuuuua

SEQ ID NO: 3782009 - RNA, 23 nt, Human
uuuccuuuaugugaauuuuuaag

SEQ ID NO: 3782010 - RNA, 16 nt, Human
uuuccuuuccccagcc

SEQ ID NO: 3782011 - RNA, 17 nt, Human
uuuccuuuccccagccc

SEQ ID NO: 3782012 - RNA, 20 nt, Human
uuuccuuuccccagcccagg

SEQ ID NO: 3782013 - RNA, 9 nt, Human
uuuccuuug

SEQ ID NO: 3782014 - RNA, 21 nt, Human
uuuccuuuuaaaacacuucca

SEQ ID NO: 3782015 - RNA, 21 nt, Human
uuuccuuuucuauuccuucug

SEQ ID NO: 3782016 - RNA, 16 nt, Human
uuuccuuuuugacacu

SEQ ID NO: 3782017 - RNA, 18 nt, Human
uuuccuuuuuuauacaca

SEQ ID NO: 3782018 - RNA, 13 nt, Human
uuucgauaaacaa

SEQ ID NO: 3782019 - RNA, 15 nt, Human
uuucgauguuuuuga

SEQ ID NO: 3782020 - RNA, 13 nt, Human
uuucgccuuuccu

SEQ ID NO: 3782021 - RNA, 14 nt, Human
uuucguaugaaaau

SEQ ID NO: 3782022 - RNA, 19 nt, Human
uuucguccacagcuuccug

SEQ ID NO: 3782023 - RNA, 13 nt, Human
uuucguggggagg

SEQ ID NO: 3782024 - RNA, 21 nt, Human
uuucgugggucuguuuuccuu

SEQ ID NO: 3782025 - RNA, 13 nt, Human
uuucguucaguua

SEQ ID NO: 3782026 - RNA, 15 nt, Human
uuucuaaaacuaaau

SEQ ID NO: 3782027 - RNA, 12 nt, Human
uuucuaaaagaa

SEQ ID NO: 3782028 - RNA, 20 nt, Human
uuucuaaaagaauauucaga

SEQ ID NO: 3782029 - RNA, 19 nt, Human
uuucuaaaagcuuucaugu

SEQ ID NO: 3782030 - RNA, 22 nt, Human
uuucuaaacguaagcacuguuu

SEQ ID NO: 3782031 - RNA, 16 nt, Human
uuucuaaacuggagac

SEQ ID NO: 3782032 - RNA, 19 nt, Human
uuucuaaacuggagacugu

SEQ ID NO: 3782033 - RNA, 14 nt, Human
uuucuaaaggcuac

SEQ ID NO: 3782034 - RNA, 15 nt, Human
uuucuaaccaagagg

SEQ ID NO: 3782035 - RNA, 19 nt, Human
uuucuaaccaagaggcugg

SEQ ID NO: 3782036 - RNA, 13 nt, Human
uuucuaaccuuga

SEQ ID NO: 3782037 - RNA, 20 nt, Human
uuucuaacuacaaagguuua

SEQ ID NO: 3782038 - RNA, 16 nt, Human
uuucuaacucugaugu

SEQ ID NO: 3782039 - RNA, 13 nt, Human
uuucuaagagaag

SEQ ID NO: 3782040 - RNA, 13 nt, Human
uuucuaaucaaaa

SEQ ID NO: 3782041 - RNA, 14 nt, Human
uuucuaaugagaua

SEQ ID NO: 3782042 - RNA, 19 nt, Human
uuucuaaugaggagagaaa

SEQ ID NO: 3782043 - RNA, 15 nt, Human
uuucuaaugugugaa

SEQ ID NO: 3782044 - RNA, 14 nt, Human
uuucuaauuaugua

SEQ ID NO: 3782045 - RNA, 17 nt, Human
uuucuaauuauguagcu

SEQ ID NO: 3782046 - RNA, 13 nt, Human
uuucuaauugcuu

SEQ ID NO: 3782047 - RNA, 14 nt, Human
uuucuaauugcuua

SEQ ID NO: 3782048 - RNA, 23 nt, Human
uuucuaauugcuuauuuauugua

SEQ ID NO: 3782049 - RNA, 20 nt, Human
uuucuacaaauaauuuuagu

SEQ ID NO: 3782050 - RNA, 17 nt, Human
uuucuacaaugugaacu

SEQ ID NO: 3782051 - RNA, 21 nt, Human
uuucuacaaugugaacuuuau

SEQ ID NO: 3782052 - RNA, 20 nt, Human
uuucuacacuguauuacaua

SEQ ID NO: 3782053 - RNA, 22 nt, Human
uuucuacagcaaauuuauaauu

SEQ ID NO: 3782054 - RNA, 23 nt, Human
uuucuacagcaaauuuauaauuu

SEQ ID NO: 3782055 - RNA, 18 nt, Human
uuucuacaguauuaugua

SEQ ID NO: 3782056 - RNA, 19 nt, Human
uuucuacagugguuuuaua

SEQ ID NO: 3782057 - RNA, 15 nt, Human
uuucuacccagcgag

SEQ ID NO: 3782058 - RNA, 17 nt, Human
uuucuacccuagccauu

SEQ ID NO: 3782059 - RNA, 23 nt, Human
uuucuacucgaguuacagacaaa

SEQ ID NO: 3782060 - RNA, 18 nt, Human
uuucuacuuugaagucau

SEQ ID NO: 3782061 - RNA, 19 nt, Human
uuucuagaauuauuuuuca

SEQ ID NO: 3782062 - RNA, 21 nt, Human
uuucuagaauuuaucacacuu

SEQ ID NO: 3782063 - RNA, 21 nt, Human
uuucuagacuauaaauguugc

SEQ ID NO: 3782064 - RNA, 16 nt, Human
uuucuagagcacugcc

SEQ ID NO: 3782065 - RNA, 15 nt, Human
uuucuagauacaaua

SEQ ID NO: 3782066 - RNA, 17 nt, Human
uuucuagauacaauaaa

SEQ ID NO: 3782067 - RNA, 20 nt, Human
uuucuagauacaauaaauug

SEQ ID NO: 3782068 - RNA, 20 nt, Human
uuucuagcccgaauacaaac

SEQ ID NO: 3782069 - RNA, 14 nt, Human
uuucuaggaagaau

SEQ ID NO: 3782070 - RNA, 22 nt, Human
uuucuaggaagaauuuuaaaaa

SEQ ID NO: 3782071 - RNA, 16 nt, Human
uuucuaggacugaauu

SEQ ID NO: 3782072 - RNA, 15 nt, Human
uuucuagggaaauga

SEQ ID NO: 3782073 - RNA, 18 nt, Human
uuucuagggaaaugaaag

SEQ ID NO: 3782074 - RNA, 17 nt, Human
uuucuagguaggaaaug

SEQ ID NO: 3782075 - RNA, 15 nt, Human
uuucuaguccaaaau

SEQ ID NO: 3782076 - RNA, 14 nt, Human
uuucuaguggucuu

SEQ ID NO: 3782077 - RNA, 18 nt, Human
uuucuaguggucuuugua

SEQ ID NO: 3782078 - RNA, 23 nt, Human
uuucuaguggucuuuguaagagu

SEQ ID NO: 3782079 - RNA, 16 nt, Human
uuucuaguguaucaaa

SEQ ID NO: 3782080 - RNA, 14 nt, Human
uuucuaguugagga

SEQ ID NO: 3782081 - RNA, 15 nt, Human
uuucuauaacagaua

SEQ ID NO: 3782082 - RNA, 13 nt, Human
uuucuauauuuuc

SEQ ID NO: 3782083 - RNA, 14 nt, Human
uuugccaugugcuu

SEQ ID NO: 3782084 - RNA, 21 nt, Human
uuugcccaacaccagccccug

SEQ ID NO: 3782085 - RNA, 13 nt, Human
uuugcccauuuug

SEQ ID NO: 3782086 - RNA, 22 nt, Human
uuugcccccaaacccccauucu

SEQ ID NO: 3782087 - RNA, 21 nt, Human
uuugcccugguagggcaguaa

SEQ ID NO: 3782088 - RNA, 15 nt, Human
uuugcccuuaaggac

SEQ ID NO: 3782089 - RNA, 23 nt, Human
uuugcccuuuacuugucuuucug

SEQ ID NO: 3782090 - RNA, 22 nt, Human
uuugccuccagaagcacuggga

SEQ ID NO: 3782091 - RNA, 21 nt, Human
uuugccuccuguguacugugu

SEQ ID NO: 3782092 - RNA, 17 nt, Human
uuugccucuuccagucu

SEQ ID NO: 3782093 - RNA, 21 nt, Human
uuugccuguaacaagccagau

SEQ ID NO: 3782094 - RNA, 11 nt, Human
uuugccugugc

SEQ ID NO: 3782095 - RNA, 14 nt, Human
uuugccuguucagu

SEQ ID NO: 3782096 - RNA, 15 nt, Human
uuugccuguucaguu

SEQ ID NO: 3782097 - RNA, 16 nt, Human
uuugccuguucaguua

SEQ ID NO: 3782098 - RNA, 14 nt, Human
uuugccuugcagaa

SEQ ID NO: 3782099 - RNA, 19 nt, Human
uuugccuugcagaacugcc

SEQ ID NO: 3782100 - RNA, 15 nt, Human
uuugcgcuccuggcc

SEQ ID NO: 3782101 - RNA, 19 nt, Human
uuugcuaagcauuccaacu

SEQ ID NO: 3782102 - RNA, 14 nt, Human
uuugcuaauuaaaa

SEQ ID NO: 3782103 - RNA, 20 nt, Human
uuugcuagcaguaaaagaug

SEQ ID NO: 3782104 - RNA, 16 nt, Human
uuugcuaucugggcug

SEQ ID NO: 3782105 - RNA, 19 nt, Human
uuugcuaugagcuggggau

SEQ ID NO: 3782106 - RNA, 16 nt, Human
uuugcuauuguaaaua

SEQ ID NO: 3782107 - RNA, 19 nt, Human
uuugcucagaacacauucu

SEQ ID NO: 3782108 - RNA, 18 nt, Human
uuugcucagcuucuccaa

SEQ ID NO: 3782109 - RNA, 23 nt, Human
uuugcucagugucuggcugcaga

SEQ ID NO: 3782110 - RNA, 16 nt, Human
uuugcucauauuuccc

SEQ ID NO: 3782111 - RNA, 13 nt, Human
uuugcucauggaa

SEQ ID NO: 3782112 - RNA, 19 nt, Human
uuugcuccaccccacucac

SEQ ID NO: 3782113 - RNA, 19 nt, Human
uuugcucuaaaauauuuau

SEQ ID NO: 3782114 - RNA, 21 nt, Human
uuugcucuucagaugccacuu

SEQ ID NO: 3782115 - RNA, 17 nt, Human
uuugcucuuguuuuuau

SEQ ID NO: 3782116 - RNA, 13 nt, Human
uuugcucuuucuu

SEQ ID NO: 3782117 - RNA, 17 nt, Human
uuugcugacccucccca

SEQ ID NO: 3782118 - RNA, 21 nt, Human
uuugcugacccuccccaaagg

SEQ ID NO: 3782119 - RNA, 19 nt, Human
uuugcugagcauguacuga

SEQ ID NO: 3782120 - RNA, 21 nt, Human
uuugcugauuuccccucuucc

SEQ ID NO: 3782121 - RNA, 10 nt, Human
uuugcugcca

SEQ ID NO: 3782122 - RNA, 12 nt, Human
uuugcugggaga

SEQ ID NO: 3782123 - RNA, 19 nt, Human
uuugcuggggccgaaagaa

SEQ ID NO: 3782124 - RNA, 13 nt, Human
uuugcuguagaag

SEQ ID NO: 3782125 - RNA, 23 nt, Human
uuugcugucccauagucccugcc

SEQ ID NO: 3782126 - RNA, 16 nt, Human
uuugcugucccuuuuc

SEQ ID NO: 3782127 - RNA, 17 nt, Human
uuugcugugaggcuguc

SEQ ID NO: 3782128 - RNA, 19 nt, Human
uuugcugugaggcuguccu

SEQ ID NO: 3782129 - RNA, 21 nt, Human
uuugcugugaggcuguccugu

SEQ ID NO: 3782130 - RNA, 21 nt, Human
uuugcuguuuuaaacauuaau

SEQ ID NO: 3782131 - RNA, 12 nt, Human
uuugcuuagaaa

SEQ ID NO: 3782132 - RNA, 15 nt, Human
uuugcuucaaaaaca

SEQ ID NO: 3782133 - RNA, 19 nt, Human
uuugcuucaugugucccag

SEQ ID NO: 3782134 - RNA, 20 nt, Human
uuugcuucauuguacuaccu

SEQ ID NO: 3782135 - RNA, 14 nt, Human
uuugcuucuagagc

SEQ ID NO: 3782136 - RNA, 16 nt, Human
uuugcuucucucucua

SEQ ID NO: 3782137 - RNA, 19 nt, Human
uuugcuugcucauaugcau

SEQ ID NO: 3782138 - RNA, 15 nt, Human
uuugcuuucugcuca

SEQ ID NO: 3782139 - RNA, 14 nt, Human
uuugcuuuuucuga

SEQ ID NO: 3782140 - RNA, 13 nt, Human
uuuggaaacuaau

SEQ ID NO: 3782141 - RNA, 15 nt, Human
uuuggaaacuaauaa

SEQ ID NO: 3782142 - RNA, 17 nt, Human
uuuggaaacuaauaaaa

SEQ ID NO: 3782143 - RNA, 15 nt, Human
uuuggaaaguacacu

SEQ ID NO: 3782144 - RNA, 20 nt, Human
uuuggaaaguacacucugcu

SEQ ID NO: 3782145 - RNA, 21 nt, Human
uuuggaaaguacacucugcug

SEQ ID NO: 3782146 - RNA, 15 nt, Human
uuuggaaaucucuuu

SEQ ID NO: 3782147 - RNA, 16 nt, Human
uuuggaaaucuuuaaa

SEQ ID NO: 3782148 - RNA, 21 nt, Human
uuuggaacagugcuacugaaa

SEQ ID NO: 3782149 - RNA, 21 nt, Human
uuuggaaccagacucuugccu

SEQ ID NO: 3782150 - RNA, 18 nt, Human
uuuggaacccuaaauaau

SEQ ID NO: 3782151 - RNA, 12 nt, Human
uuuggaagaagg

SEQ ID NO: 3782152 - RNA, 11 nt, Human
uuuggaaggag

SEQ ID NO: 3782153 - RNA, 14 nt, Human
uuuggaaguuuuca

SEQ ID NO: 3782154 - RNA, 15 nt, Human
uuuggaauacuuuuu

SEQ ID NO: 3782155 - RNA, 17 nt, Human
uuuggaauacuuuuugu

SEQ ID NO: 3782156 - RNA, 15 nt, Human
uuuggaauauuaaaa

SEQ ID NO: 3782157 - RNA, 14 nt, Human
uuuggaaucuagaa

SEQ ID NO: 3782158 - RNA, 20 nt, Human
uuuggaaucuagaagaaaug

SEQ ID NO: 3782159 - RNA, 19 nt, Human
uuuggacaaaauggaauac

SEQ ID NO: 3782160 - RNA, 17 nt, Human
uuuggacacacacagcu

SEQ ID NO: 3782161 - RNA, 16 nt, Human
uuuggaccccagcugg

SEQ ID NO: 3782162 - RNA, 15 nt, Human
uuuggacccugaggc

SEQ ID NO: 3782163 - RNA, 16 nt, Human
uuuggacuguuuuguu

SEQ ID NO: 3782164 - RNA, 21 nt, Human
uuuggacuuuguauacuuuaa

SEQ ID NO: 3782165 - RNA, 15 nt, Human
uuuggacuuuguuac

SEQ ID NO: 3782166 - RNA, 15 nt, Human
uuuggagacuuucuu

SEQ ID NO: 3782167 - RNA, 18 nt, Human
uuuggagaguuuccugaa

SEQ ID NO: 3782168 - RNA, 17 nt, Human
uuuggagguuuauuacg

SEQ ID NO: 3782169 - RNA, 17 nt, Human
uuuggaguccccucacc

SEQ ID NO: 3782170 - RNA, 20 nt, Human
uuuggauauaggucagugag

SEQ ID NO: 3782171 - RNA, 15 nt, Human
uuuggaucuugaaug

SEQ ID NO: 3782172 - RNA, 10 nt, Human
uuuggaugcc

SEQ ID NO: 3782173 - RNA, 19 nt, Human
uuuggaugggagugagaca

SEQ ID NO: 3782174 - RNA, 21 nt, Human
uuuggaugggagugagacaga

SEQ ID NO: 3782175 - RNA, 14 nt, Human
uuuggauuaaauua

SEQ ID NO: 3782176 - RNA, 18 nt, Human
uuuggauuauucuuucuc

SEQ ID NO: 3782177 - RNA, 18 nt, Human
uuuggauucuaaauacau

SEQ ID NO: 3782178 - RNA, 14 nt, Human
uuuggauuguauau

SEQ ID NO: 3782179 - RNA, 18 nt, Human
uuuggauuuuuaauuaaa

SEQ ID NO: 3782180 - RNA, 17 nt, Human
uuuggcaaugccaucau

SEQ ID NO: 3782181 - RNA, 14 nt, Human
uuuggcacucugac

SEQ ID NO: 3782182 - RNA, 15 nt, Human
uuuggcacucugacu

SEQ ID NO: 3782183 - RNA, 17 nt, Human
uuuggcacuggggcacu

SEQ ID NO: 3782184 - RNA, 23 nt, Human
uuuggcauguaaauguaaacuca

SEQ ID NO: 3782185 - RNA, 13 nt, Human
uuuggcauuugca

SEQ ID NO: 3782186 - RNA, 14 nt, Human
uuuggccagaaguc

SEQ ID NO: 3782187 - RNA, 23 nt, Human
uuuggccaucucuggaugccuga

SEQ ID NO: 3782188 - RNA, 12 nt, Human
uuuggcccaggg

SEQ ID NO: 3782189 - RNA, 12 nt, Human
uuuggcccccga

SEQ ID NO: 3782190 - RNA, 19 nt, Human
uuuggcgggccaaggacug

SEQ ID NO: 3782191 - RNA, 13 nt, Human
uuugguguguucc

SEQ ID NO: 3782192 - RNA, 19 nt, Human
uuugguuaaguuggcuucu

SEQ ID NO: 3782193 - RNA, 20 nt, Human
uuugguuaugaauacuuugc

SEQ ID NO: 3782194 - RNA, 13 nt, Human
uuugguucccuuc

SEQ ID NO: 3782195 - RNA, 13 nt, Human
uuugguuccucuc

SEQ ID NO: 3782196 - RNA, 11 nt, Human
uuugguucuaa

SEQ ID NO: 3782197 - RNA, 13 nt, Human
uuugguucuaagg

SEQ ID NO: 3782198 - RNA, 13 nt, Human
uuugguucuaaua

SEQ ID NO: 3782199 - RNA, 14 nt, Human
uuugguucuggggc

SEQ ID NO: 3782200 - RNA, 15 nt, Human
uuugguugaauaaac

SEQ ID NO: 3782201 - RNA, 17 nt, Human
uuugguugaauaaacua

SEQ ID NO: 3782202 - RNA, 18 nt, Human
uuugguuguauucuuuga

SEQ ID NO: 3782203 - RNA, 14 nt, Human
uuugguuuacauuu

SEQ ID NO: 3782204 - RNA, 19 nt, Human
uuugguuucccaagagcua

SEQ ID NO: 3782205 - RNA, 13 nt, Human
uuugguuucuagc

SEQ ID NO: 3782206 - RNA, 18 nt, Human
uuugguuuuaaaauacug

SEQ ID NO: 3782207 - RNA, 22 nt, Human
uuugguuuuaaaauacuguaga

SEQ ID NO: 3782208 - RNA, 22 nt, Human
uuuguaaaaacagcauugcuuu

SEQ ID NO: 3782209 - RNA, 13 nt, Human
uuuguaaaaugua

SEQ ID NO: 3782210 - RNA, 14 nt, Human
uuuguaaacauuua

SEQ ID NO: 3782211 - RNA, 16 nt, Human
uuuguaaacucaaaau

SEQ ID NO: 3782212 - RNA, 16 nt, Human
uuuguaaacuggaauu

SEQ ID NO: 3782213 - RNA, 15 nt, Human
uuuguaaacuuugaa

SEQ ID NO: 3782214 - RNA, 17 nt, Human
uuuguaaagaaaaauau

SEQ ID NO: 3782215 - RNA, 18 nt, Human
uuuguaaagauuucuguu

SEQ ID NO: 3782216 - RNA, 22 nt, Human
uuuguaaaguguggucccaaca

SEQ ID NO: 3782217 - RNA, 21 nt, Human
uuuguaaaguugguuggauaa

SEQ ID NO: 3782218 - RNA, 14 nt, Human
uuuguaaauaagag

SEQ ID NO: 3782219 - RNA, 15 nt, Human
uuuguaaaucacauc

SEQ ID NO: 3782220 - RNA, 14 nt, Human
uuuguaaauguuau

SEQ ID NO: 3782221 - RNA, 18 nt, Human
uuuguaaauguuauuucu

SEQ ID NO: 3782222 - RNA, 15 nt, Human
uuuguaaauuaacuu

SEQ ID NO: 3782223 - RNA, 22 nt, Human
uuuguaaauuaacuuuuauaaa

SEQ ID NO: 3782224 - RNA, 18 nt, Human
uuuguaaauuauuuaugu

SEQ ID NO: 3782225 - RNA, 12 nt, Human
uuuguaaauucu

SEQ ID NO: 3782226 - RNA, 16 nt, Human
uuuguaaauucugauu

SEQ ID NO: 3782227 - RNA, 19 nt, Human
uuuguaaauucugauuucu

SEQ ID NO: 3782228 - RNA, 20 nt, Human
uuuguaaauucugauuucuu

SEQ ID NO: 3782229 - RNA, 16 nt, Human
uuuguaaauuuagugu

SEQ ID NO: 3782230 - RNA, 19 nt, Human
uuuguaacccacugagagg

SEQ ID NO: 3782231 - RNA, 20 nt, Human
uuuguaacccagauuuugcu

SEQ ID NO: 3782232 - RNA, 22 nt, Human
uuuguaacuguuuagaugaaug

SEQ ID NO: 3782233 - RNA, 18 nt, Human
uuuguaagaacuaaagaa

SEQ ID NO: 3782234 - RNA, 20 nt, Human
uuuguaagaaggcaauauua

SEQ ID NO: 3782235 - RNA, 21 nt, Human
uuuguaagaguguagaagcau

SEQ ID NO: 3782236 - RNA, 15 nt, Human
uuuguaagaugcugg

SEQ ID NO: 3782237 - RNA, 17 nt, Human
uuuguaaggcuuguucc

SEQ ID NO: 3782238 - RNA, 21 nt, Human
uuuguaagucaguguugagau

SEQ ID NO: 3782239 - RNA, 13 nt, Human
uuuguaaguuauu

SEQ ID NO: 3782240 - RNA, 21 nt, Human
uuuguaauaauaaagaauagc

SEQ ID NO: 3782241 - RNA, 14 nt, Human
uuuguaaugaauuc

SEQ ID NO: 3782242 - RNA, 23 nt, Human
uuuguaaugucaccaccuuccca

SEQ ID NO: 3782243 - RNA, 18 nt, Human
uuuguaaugugugaaaaa

SEQ ID NO: 3782244 - RNA, 23 nt, Human
uuuguaauuaaaagcaaaucauu

SEQ ID NO: 3782245 - RNA, 14 nt, Human
uuuguaauuauugu

SEQ ID NO: 3782246 - RNA, 13 nt, Human
uuuguaauugcuu

SEQ ID NO: 3782247 - RNA, 23 nt, Human
uuuguacaaaaaaaaaguuuuau

SEQ ID NO: 3782248 - RNA, 12 nt, Human
uuuguacagaau

SEQ ID NO: 3782249 - RNA, 14 nt, Human
uuuguacagacaac

SEQ ID NO: 3782250 - RNA, 22 nt, Human
uuuguacagacguaugcuuauu

SEQ ID NO: 3782251 - RNA, 18 nt, Human
uuuguacaguuugcugua

SEQ ID NO: 3782252 - RNA, 12 nt, Human
uuuguaccagug

SEQ ID NO: 3782253 - RNA, 17 nt, Human
uuuguaccaugguguga

SEQ ID NO: 3782254 - RNA, 15 nt, Human
uuuguacugaaaaau

SEQ ID NO: 3782255 - RNA, 16 nt, Human
uuuguacuguaaagag

SEQ ID NO: 3782256 - RNA, 13 nt, Human
uuuguacuguuua

SEQ ID NO: 3782257 - RNA, 20 nt, Human
uuuguacuuuaucaugaaug

SEQ ID NO: 3782258 - RNA, 17 nt, Human
uuuguagcacugacaga

SEQ ID NO: 3782259 - RNA, 14 nt, Human
uuuguagguaaaau

SEQ ID NO: 3782260 - RNA, 14 nt, Human
uuuguagguacuuu

SEQ ID NO: 3782261 - RNA, 17 nt, Human
uuuguaguagcguuuuu

SEQ ID NO: 3782262 - RNA, 19 nt, Human
uuuguaguagcguuuuuua

SEQ ID NO: 3782263 - RNA, 14 nt, Human
uuuguaguugaaua

SEQ ID NO: 3782264 - RNA, 15 nt, Human
uuuguaguugaauau

SEQ ID NO: 3782265 - RNA, 19 nt, Human
uuuguauaaaauaauuuuu

SEQ ID NO: 3782266 - RNA, 18 nt, Human
uuuguauaacuucuuaaa

SEQ ID NO: 3782267 - RNA, 21 nt, Human
uuuguauaauuggauuuccua

SEQ ID NO: 3782268 - RNA, 16 nt, Human
uuuguauaauuguauc

SEQ ID NO: 3782269 - RNA, 17 nt, Human
uuuguauaauuguaucg

SEQ ID NO: 3782270 - RNA, 20 nt, Human
uuuguauaauuguaucguau

SEQ ID NO: 3782271 - RNA, 14 nt, Human
uuuguauacuuuaa

SEQ ID NO: 3782272 - RNA, 22 nt, Human
uuuguauacuuuaaauaauuua

SEQ ID NO: 3782273 - RNA, 15 nt, Human
uuuguauaguugcuu

SEQ ID NO: 3782274 - RNA, 21 nt, Human
uuuguauaguugcuugccuga

SEQ ID NO: 3782275 - RNA, 14 nt, Human
uuuguauauauauu

SEQ ID NO: 3782276 - RNA, 14 nt, Human
uuuguauauuacac

SEQ ID NO: 3782277 - RNA, 19 nt, Human
uuuguauauuacacauuug

SEQ ID NO: 3782278 - RNA, 20 nt, Human
uuuguaucucugaagcaugu

SEQ ID NO: 3782279 - RNA, 21 nt, Human
uuuguaucucugaagcauguu

SEQ ID NO: 3782280 - RNA, 22 nt, Human
uuuguaucuuccauauuuggaa

SEQ ID NO: 3782281 - RNA, 12 nt, Human
uuuguaugcaag

SEQ ID NO: 3782282 - RNA, 23 nt, Human
uuuguaugcaagcaguuucaaua

SEQ ID NO: 3782283 - RNA, 15 nt, Human
uuuguauguauaauu

SEQ ID NO: 3782284 - RNA, 13 nt, Human
uuuguaugugugu

SEQ ID NO: 3782285 - RNA, 22 nt, Human
uuuguauguugugaagauguuu

SEQ ID NO: 3782286 - RNA, 16 nt, Human
uuuguauuaagaaagg

SEQ ID NO: 3782287 - RNA, 23 nt, Human
uuuguauuauugcuguugcuuga

SEQ ID NO: 3782288 - RNA, 15 nt, Human
uuuguauucucuccu

SEQ ID NO: 3782289 - RNA, 18 nt, Human
uuucaaggcccucagcau

SEQ ID NO: 3782290 - RNA, 20 nt, Human
uuucaagguaauuucuugug

SEQ ID NO: 3782291 - RNA, 11 nt, Human
uuucaaguagc

SEQ ID NO: 3782292 - RNA, 17 nt, Human
uuucaaguauuuaagcc

SEQ ID NO: 3782293 - RNA, 23 nt, Human
uuucaaguauuuaagccuaaaga

SEQ ID NO: 3782294 - RNA, 20 nt, Human
uuucaagucaaauuaauaau

SEQ ID NO: 3782295 - RNA, 23 nt, Human
uuucaagucaaauuaauaaucuu

SEQ ID NO: 3782296 - RNA, 22 nt, Human
uuucaaguuccaaguugcuaau

SEQ ID NO: 3782297 - RNA, 16 nt, Human
uuucaaguuguaaaua

SEQ ID NO: 3782298 - RNA, 13 nt, Human
uuucaauaaaguu

SEQ ID NO: 3782299 - RNA, 15 nt, Human
uuucaauaaaguuug

SEQ ID NO: 3782300 - RNA, 21 nt, Human
uuucaauaaaguuugaucuuc

SEQ ID NO: 3782301 - RNA, 21 nt, Human
uuucaauaacgaaguugggca

SEQ ID NO: 3782302 - RNA, 15 nt, Human
uuucaauagcacaua

SEQ ID NO: 3782303 - RNA, 13 nt, Human
uuucaauagccac

SEQ ID NO: 3782304 - RNA, 12 nt, Human
uuucaauaggaa

SEQ ID NO: 3782305 - RNA, 17 nt, Human
uuucaauaggaaaaacu

SEQ ID NO: 3782306 - RNA, 13 nt, Human
uuucaauauauug

SEQ ID NO: 3782307 - RNA, 14 nt, Human
uuucaauauauuga

SEQ ID NO: 3782308 - RNA, 18 nt, Human
uuucaauauauugaacuu

SEQ ID NO: 3782309 - RNA, 14 nt, Human
uuucaaucacuguc

SEQ ID NO: 3782310 - RNA, 23 nt, Human
uuucaaucacuguccuccacaca

SEQ ID NO: 3782311 - RNA, 13 nt, Human
uuucaaucuucaa

SEQ ID NO: 3782312 - RNA, 14 nt, Human
uuucaaugacauuu

SEQ ID NO: 3782313 - RNA, 21 nt, Human
uuucaaugguuugcaaggaag

SEQ ID NO: 3782314 - RNA, 15 nt, Human
uuucaauguaauuaa

SEQ ID NO: 3782315 - RNA, 20 nt, Human
uuucaauguaauuaaacugu

SEQ ID NO: 3782316 - RNA, 20 nt, Human
uuucaaugugauucuaaugu

SEQ ID NO: 3782317 - RNA, 14 nt, Human
uuucaauguguaua

SEQ ID NO: 3782318 - RNA, 15 nt, Human
uuucaauuaaacgga

SEQ ID NO: 3782319 - RNA, 16 nt, Human
uuucaauuaaacggau

SEQ ID NO: 3782320 - RNA, 21 nt, Human
uuucaauuaaacggauuauuu

SEQ ID NO: 3782321 - RNA, 16 nt, Human
uuucaauucaaaaaug

SEQ ID NO: 3782322 - RNA, 19 nt, Human
uuucaauucaaaaauguac

SEQ ID NO: 3782323 - RNA, 20 nt, Human
uuucaauucaaaaauguaca

SEQ ID NO: 3782324 - RNA, 12 nt, Human
uuuuauucuugu

SEQ ID NO: 3782325 - RNA, 19 nt, Human
uuuuauugaaucuauuuaa

SEQ ID NO: 3782326 - RNA, 19 nt, Human
uuuuauugagaauuuuaaa

SEQ ID NO: 3782327 - RNA, 15 nt, Human
uuuuauugccuucuc

SEQ ID NO: 3782328 - RNA, 17 nt, Human
uuuuauugcuaguauuu

SEQ ID NO: 3782329 - RNA, 20 nt, Human
uuuuauugcuaguauuugaa

SEQ ID NO: 3782330 - RNA, 19 nt, Human
uuuuauuguaacagacauu

SEQ ID NO: 3782331 - RNA, 11 nt, Human
uuuuauugugu

SEQ ID NO: 3782332 - RNA, 10 nt, Human
uuuuauuguu

SEQ ID NO: 3782333 - RNA, 13 nt, Human
uuuuauuguugaa

SEQ ID NO: 3782334 - RNA, 14 nt, Human
uuuuauuguuuuca

SEQ ID NO: 3782335 - RNA, 22 nt, Human
uuuuauuucauugguuaauuuu

SEQ ID NO: 3782336 - RNA, 11 nt, Human
uuuuauuuccu

SEQ ID NO: 3782337 - RNA, 14 nt, Human
uuuuauuucuccuu

SEQ ID NO: 3782338 - RNA, 18 nt, Human
uuuuauuucuccuuuugu

SEQ ID NO: 3782339 - RNA, 15 nt, Human
uuuuauuugacaaaa

SEQ ID NO: 3782340 - RNA, 15 nt, Human
uuuuauuuuacuauu

SEQ ID NO: 3782341 - RNA, 11 nt, Human
uuuuauuuuau

SEQ ID NO: 3782342 - RNA, 17 nt, Human
uuuuauuuuuagaauuu

SEQ ID NO: 3782343 - RNA, 17 nt, Human
uuuuauuuuuuucuacc

SEQ ID NO: 3782344 - RNA, 17 nt, Human
uuuucaaaagguauuau

SEQ ID NO: 3782345 - RNA, 20 nt, Human
uuuucaaaauccaaaaagaa

SEQ ID NO: 3782346 - RNA, 16 nt, Human
uuuucaaacaaagaug

SEQ ID NO: 3782347 - RNA, 12 nt, Human
uuuucaaagcaa

SEQ ID NO: 3782348 - RNA, 15 nt, Human
uuuucaaauguucuc

SEQ ID NO: 3782349 - RNA, 22 nt, Human
uuuucaacaaauaucuuguguu

SEQ ID NO: 3782350 - RNA, 13 nt, Human
uuuucaacuuuga

SEQ ID NO: 3782351 - RNA, 24 nt, Human
uuuucaacuuugaauaaagaauac

SEQ ID NO: 3782352 - RNA, 16 nt, Human
uuuucaagaaguucuu

SEQ ID NO: 3782353 - RNA, 22 nt, Human
uuuucaagcagcaucuucuggu

SEQ ID NO: 3782354 - RNA, 22 nt, Human
uuuucaagcaucuccugaggau

SEQ ID NO: 3782355 - RNA, 16 nt, Human
uuuucaaggcccucag

SEQ ID NO: 3782356 - RNA, 16 nt, Human
uuuucaaguauuuaag

SEQ ID NO: 3782357 - RNA, 13 nt, Human
uuuucaaguugua

SEQ ID NO: 3782358 - RNA, 13 nt, Human
uuuucaauaacug

SEQ ID NO: 3782359 - RNA, 16 nt, Human
uuuucaauaacuggaa

SEQ ID NO: 3782360 - RNA, 14 nt, Human
uuuucaauauauug

SEQ ID NO: 3782361 - RNA, 20 nt, Human
uuuucaauauauugaacuuu

SEQ ID NO: 3782362 - RNA, 22 nt, Human
uuuucaauauauugaacuuuug

SEQ ID NO: 3782363 - RNA, 14 nt, Human
uuuucaauauuuau

SEQ ID NO: 3782364 - RNA, 16 nt, Human
uuuucaauauuuauua

SEQ ID NO: 3782365 - RNA, 18 nt, Human
uuuucaaugaauuuuaua

SEQ ID NO: 3782366 - RNA, 14 nt, Human
uuuucaauuaaacg

SEQ ID NO: 3782367 - RNA, 18 nt, Human
uuuucaauuaaacggauu

SEQ ID NO: 3782368 - RNA, 18 nt, Human
uuuucaauucaaaaaugu

SEQ ID NO: 3782369 - RNA, 17 nt, Human
uuuucaauuuuaaacau

SEQ ID NO: 3782370 - RNA, 14 nt, Human
uuuucacaaauaaa

SEQ ID NO: 3782371 - RNA, 15 nt, Human
uuuucacaguucucu

SEQ ID NO: 3782372 - RNA, 15 nt, Human
uuuucacauaaaugc

SEQ ID NO: 3782373 - RNA, 22 nt, Human
uuuucacauaaaugcagcccau

SEQ ID NO: 3782374 - RNA, 18 nt, Human
uuuucacauucuuauaaa

SEQ ID NO: 3782375 - RNA, 13 nt, Human
uuuucaccccacc

SEQ ID NO: 3782376 - RNA, 20 nt, Human
uuuucaccccacccuucccc

SEQ ID NO: 3782377 - RNA, 17 nt, Human
uuuucaccuccuucaau

SEQ ID NO: 3782378 - RNA, 18 nt, Human
uuuucacggaaguuuuca

SEQ ID NO: 3782379 - RNA, 19 nt, Human
uuuucacggaaguuuucaa

SEQ ID NO: 3782380 - RNA, 20 nt, Human
uuuucacggaaguuuucaau

SEQ ID NO: 3782381 - RNA, 20 nt, Human
uuuucacugcuggcugccuu

SEQ ID NO: 3782382 - RNA, 16 nt, Human
uuuucacuguagaaug

SEQ ID NO: 3782383 - RNA, 18 nt, Human
uuuucacuuugugauuau

SEQ ID NO: 3782384 - RNA, 22 nt, Human
uuuucagaaccucuuccccaga

SEQ ID NO: 3782385 - RNA, 20 nt, Human
uuuucagaagaaauaaauau

SEQ ID NO: 3782386 - RNA, 21 nt, Human
uuuucagaaucugaauguaau

SEQ ID NO: 3782387 - RNA, 22 nt, Human
uuuucagaaucugaauguaauu

SEQ ID NO: 3782388 - RNA, 23 nt, Human
uuuucagaaucugaauguaauuu

SEQ ID NO: 3782389 - RNA, 14 nt, Human
uuuucagacugcuu

SEQ ID NO: 3782390 - RNA, 22 nt, Human
uuuucagagauuuauauaaaug

SEQ ID NO: 3782391 - RNA, 17 nt, Human
uuuucagauauaaaaga

SEQ ID NO: 3782392 - RNA, 14 nt, Human
uuuucagauucagg

SEQ ID NO: 3782393 - RNA, 17 nt, Human
uuuucagauuugcacaa

SEQ ID NO: 3782394 - RNA, 13 nt, Human
uuuucagcauuga

SEQ ID NO: 3782395 - RNA, 21 nt, Human
uuuucagcuaggaacaaaucu

SEQ ID NO: 3782396 - RNA, 12 nt, Human
uuuucagcuucu

SEQ ID NO: 3782397 - RNA, 15 nt, Human
uuuucagcuucugcu

SEQ ID NO: 3782398 - RNA, 20 nt, Human
uuuucagcuucugcugggcu

SEQ ID NO: 3782399 - RNA, 23 nt, Human
uuuucaguauuuuggagaaauua

SEQ ID NO: 3782400 - RNA, 23 nt, Human
uuuucagucauauaaaagcuaug

SEQ ID NO: 3782401 - RNA, 15 nt, Human
uuuucaguuguucuu

SEQ ID NO: 3782402 - RNA, 16 nt, Human
uuuucaguuguuuguu

SEQ ID NO: 3782403 - RNA, 22 nt, Human
uuuucaguuuauuugaaccaau

SEQ ID NO: 3782404 - RNA, 20 nt, Human
uuuucaguuucaauucagug

SEQ ID NO: 3782405 - RNA, 14 nt, Human
uuuucaguuuucag

SEQ ID NO: 3782406 - RNA, 13 nt, Human
uuuucauaacuua

SEQ ID NO: 3782407 - RNA, 21 nt, Human
uuuucauaacuuauugcugau

SEQ ID NO: 3782408 - RNA, 16 nt, Human
uuuucauaagauauuu

SEQ ID NO: 3782409 - RNA, 21 nt, Human
uuuucauagauugagaaguuu

SEQ ID NO: 3782410 - RNA, 15 nt, Human
uuuucauaggucuga

SEQ ID NO: 3782411 - RNA, 16 nt, Human
uuuucauaggucugaa

SEQ ID NO: 3782412 - RNA, 16 nt, Human
uuuucauaucauuucu

SEQ ID NO: 3782413 - RNA, 14 nt, Human
uuuucauauugugc

SEQ ID NO: 3782414 - RNA, 22 nt, Human
agacuguguaaaauguaaugca

SEQ ID NO: 3782415 - RNA, 19 nt, Human
agacugugugugcccucug

SEQ ID NO: 3782416 - RNA, 20 nt, Human
agacugugugugcccucugg

SEQ ID NO: 3782417 - RNA, 18 nt, Human
agacuguuaaaugaaacc

SEQ ID NO: 3782418 - RNA, 15 nt, Human
agacuguugcucaaa

SEQ ID NO: 3782419 - RNA, 18 nt, Human
agacuuaagcccagugca

SEQ ID NO: 3782420 - RNA, 15 nt, Human
agacuuacagcaaau

SEQ ID NO: 3782421 - RNA, 18 nt, Human
agacuuacagcaaauccu

SEQ ID NO: 3782422 - RNA, 21 nt, Human
agacuuacuuuacucauuuuu

SEQ ID NO: 3782423 - RNA, 16 nt, Human
agacuuagggcaccag

SEQ ID NO: 3782424 - RNA, 14 nt, Human
agacuuaucaacau

SEQ ID NO: 3782425 - RNA, 17 nt, Human
agacuuauuuucacaug

SEQ ID NO: 3782426 - RNA, 18 nt, Human
agacuucaaaauauugag

SEQ ID NO: 3782427 - RNA, 22 nt, Human
agacuucaagcauggcuauuuu

SEQ ID NO: 3782428 - RNA, 22 nt, Human
agacuucaguauguugucaaag

SEQ ID NO: 3782429 - RNA, 14 nt, Human
agacuucaucccuc

SEQ ID NO: 3782430 - RNA, 21 nt, Human
agacuucauugucccucuuca

SEQ ID NO: 3782431 - RNA, 19 nt, Human
agacuuccaaaccugacag

SEQ ID NO: 3782432 - RNA, 19 nt, Human
agacuucccacggcuccuc

SEQ ID NO: 3782433 - RNA, 15 nt, Human
agacuucccagcuuc

SEQ ID NO: 3782434 - RNA, 18 nt, Human
agacuucccagcuucugc

SEQ ID NO: 3782435 - RNA, 15 nt, Human
agacuucccugaaug

SEQ ID NO: 3782436 - RNA, 19 nt, Human
agacuucccugaauguauu

SEQ ID NO: 3782437 - RNA, 14 nt, Human
agacuuccuagacu

SEQ ID NO: 3782438 - RNA, 18 nt, Human
agacuucucuuugccuca

SEQ ID NO: 3782439 - RNA, 17 nt, Human
aggaaggagcugccugg

SEQ ID NO: 3782440 - RNA, 20 nt, Human
aggaaggagcugccuggacc

SEQ ID NO: 3782441 - RNA, 18 nt, Human
aggaaggaggacccagga

SEQ ID NO: 3782442 - RNA, 19 nt, Human
aggaaggaggacccaggac

SEQ ID NO: 3782443 - RNA, 22 nt, Human
aggaaggaggacccaggacagg

SEQ ID NO: 3782444 - RNA, 21 nt, Human
aggaaggaggggaagcugcag

SEQ ID NO: 3782445 - RNA, 14 nt, Human
aggaaggaugagca

SEQ ID NO: 3782446 - RNA, 17 nt, Human
aggaaggaugagcauuu

SEQ ID NO: 3782447 - RNA, 16 nt, Human
aggaaggauuguaaaa

SEQ ID NO: 3782448 - RNA, 17 nt, Human
aggaaggauuguaaaaa

SEQ ID NO: 3782449 - RNA, 15 nt, Human
aggaaggcacuucug

SEQ ID NO: 3782450 - RNA, 17 nt, Human
aggaaggcaggaagaga

SEQ ID NO: 3782451 - RNA, 19 nt, Human
aggaaggcaggaagagagc

SEQ ID NO: 3782452 - RNA, 13 nt, Human
aggaaggccuggg

SEQ ID NO: 3782453 - RNA, 13 nt, Human
aggaaggcggggc

SEQ ID NO: 3782454 - RNA, 20 nt, Human
aggaaggcucuucuccccag

SEQ ID NO: 3782455 - RNA, 15 nt, Human
aggaaggcugagagg

SEQ ID NO: 3782456 - RNA, 21 nt, Human
aggaaggcuuguugugcuuuu

SEQ ID NO: 3782457 - RNA, 18 nt, Human
aggaagggcauccuucug

SEQ ID NO: 3782458 - RNA, 16 nt, Human
aggaaggggccagagg

SEQ ID NO: 3782459 - RNA, 18 nt, Human
aggaaggggccagaggcu

SEQ ID NO: 3782460 - RNA, 14 nt, Human
aggaaggggcugga

SEQ ID NO: 3782461 - RNA, 14 nt, Human
aggaagguacugua

SEQ ID NO: 3782462 - RNA, 18 nt, Human
aggaagguacuguaugau

SEQ ID NO: 3782463 - RNA, 19 nt, Human
aggaaggugaaucugcccu

SEQ ID NO: 3782464 - RNA, 11 nt, Human
aggaaguacug

SEQ ID NO: 3782465 - RNA, 15 nt, Human
aggaaguagcacagg

SEQ ID NO: 3782466 - RNA, 19 nt, Human
aggaaguagcacaggcuga

SEQ ID NO: 3782467 - RNA, 16 nt, Human
aggaagucucaucugg

SEQ ID NO: 3782468 - RNA, 14 nt, Human
aggaagugaagaau

SEQ ID NO: 3782469 - RNA, 14 nt, Human
aggaaguguuuaug

SEQ ID NO: 3782470 - RNA, 14 nt, Human
aggaaguucagauc

SEQ ID NO: 3782471 - RNA, 17 nt, Human
aggaauaauuauuuauu

SEQ ID NO: 3782472 - RNA, 22 nt, Human
aggaauaccugucccccugaca

SEQ ID NO: 3782473 - RNA, 17 nt, Human
aggaauacugaacaucu

SEQ ID NO: 3782474 - RNA, 18 nt, Human
aggaauagcaugucacua

SEQ ID NO: 3782475 - RNA, 17 nt, Human
aggaauaguugagcccc

SEQ ID NO: 3782476 - RNA, 21 nt, Human
aggaauaguugagccccaagu

SEQ ID NO: 3782477 - RNA, 12 nt, Human
aggaauauaugg

SEQ ID NO: 3782478 - RNA, 22 nt, Human
aggaauaucaauauaauguuuu

SEQ ID NO: 3782479 - RNA, 22 nt, Human
aggaauaugacggaagaacaua

SEQ ID NO: 3782480 - RNA, 18 nt, Human
aggaauaugggagaaaua

SEQ ID NO: 3782481 - RNA, 14 nt, Human
aggaauauuauauu

SEQ ID NO: 3782482 - RNA, 16 nt, Human
aggaaucaagagcugc

SEQ ID NO: 3782483 - RNA, 16 nt, Human
aggaaucacucuugug

SEQ ID NO: 3782484 - RNA, 21 nt, Human
aggaaucaugucaggccugug

SEQ ID NO: 3782485 - RNA, 21 nt, Human
aggaaucaugugccaagcaga

SEQ ID NO: 3782486 - RNA, 22 nt, Human
aggaaucauucagaaauguuga

SEQ ID NO: 3782487 - RNA, 23 nt, Human
aggaaucauucagaaauguugag

SEQ ID NO: 3782488 - RNA, 21 nt, Human
aggaauccacucccaggcagc

SEQ ID NO: 3782489 - RNA, 23 nt, Human
aggaauccagacccggcugcgug

SEQ ID NO: 3782490 - RNA, 14 nt, Human
aggaauccuggcag

SEQ ID NO: 3782491 - RNA, 18 nt, Human
aggaauccuggcagccca

SEQ ID NO: 3782492 - RNA, 19 nt, Human
aggaaucgaggaaccagag

SEQ ID NO: 3782493 - RNA, 22 nt, Human
aggaaucugugggucugggagu

SEQ ID NO: 3782494 - RNA, 16 nt, Human
aggaaugaaaaaagcu

SEQ ID NO: 3782495 - RNA, 13 nt, Human
aggaaugagaagu

SEQ ID NO: 3782496 - RNA, 14 nt, Human
aggaaugagaagua

SEQ ID NO: 3782497 - RNA, 16 nt, Human
aggaaugauauugcug

SEQ ID NO: 3782498 - RNA, 17 nt, Human
aggaaugcaaagaugaa

SEQ ID NO: 3782499 - RNA, 17 nt, Human
aggaaugcuggacugga

SEQ ID NO: 3782500 - RNA, 15 nt, Human
aggaauggacauuuc

SEQ ID NO: 3782501 - RNA, 17 nt, Human
aggaauggacauuucua

SEQ ID NO: 3782502 - RNA, 21 nt, Human
aggaauggaggcucuaauuga

SEQ ID NO: 3782503 - RNA, 23 nt, Human
aggaaugggaaggaugaagggcc

SEQ ID NO: 3782504 - RNA, 15 nt, Human
aggaaugucuuuggu

SEQ ID NO: 3782505 - RNA, 22 nt, Human
aggaauguuuuguagcucuagg

SEQ ID NO: 3782506 - RNA, 16 nt, Human
aggaauuacgugcucu

SEQ ID NO: 3782507 - RNA, 22 nt, Human
aggaauucuaggcaucccaggg

SEQ ID NO: 3782508 - RNA, 13 nt, Human
aggaauucuguau

SEQ ID NO: 3782509 - RNA, 22 nt, Human
aggaauucuguauagauuagaa

SEQ ID NO: 3782510 - RNA, 23 nt, Human
aggaauugacccacaagaaauga

SEQ ID NO: 3782511 - RNA, 23 nt, Human
aggaauuguguuuauaauuuuaa

SEQ ID NO: 3782512 - RNA, 18 nt, Human
aggaauuucaccuguaaa

SEQ ID NO: 3782513 - RNA, 15 nt, Human
aggaauuucccagga

SEQ ID NO: 3782514 - RNA, 21 nt, Human
aggaauuucccaggacccuga

SEQ ID NO: 3782515 - RNA, 16 nt, Human
aggaauuuucuccaau

SEQ ID NO: 3782516 - RNA, 13 nt, Human
aggaauuuugcua

SEQ ID NO: 3782517 - RNA, 16 nt, Human
aggacaaaacuucuug

SEQ ID NO: 3782518 - RNA, 20 nt, Human
aggacaaaacuucuugucag

SEQ ID NO: 3782519 - RNA, 16 nt, Human
aggacaaacagcucag

SEQ ID NO: 3782520 - RNA, 16 nt, Human
aggacaaagucuccag

SEQ ID NO: 3782521 - RNA, 17 nt, Human
aggacaaagucuccagc

SEQ ID NO: 3782522 - RNA, 17 nt, Human
aggacaaagugccaaag

SEQ ID NO: 3782523 - RNA, 22 nt, Human
aggacaaagugccaaagaaagu

SEQ ID NO: 3782524 - RNA, 20 nt, Human
aggacaaaucugcaaagcau

SEQ ID NO: 3782525 - RNA, 23 nt, Human
aggacaaauugagacagugcaca

SEQ ID NO: 3782526 - RNA, 14 nt, Human
aggacaaggcuaga

SEQ ID NO: 3782527 - RNA, 18 nt, Human
aggacaaucaguccccuc

SEQ ID NO: 3782528 - RNA, 18 nt, Human
aggacaauucaugaacuu

SEQ ID NO: 3782529 - RNA, 15 nt, Human
aggacaauuucaaaa

SEQ ID NO: 3782530 - RNA, 13 nt, Human
aggacacacuaau

SEQ ID NO: 3782531 - RNA, 23 nt, Human
aggacacagaugaaacacaaaca

SEQ ID NO: 3782532 - RNA, 13 nt, Human
aggacacagucag

SEQ ID NO: 3782533 - RNA, 18 nt, Human
aggacacaguuccuggga

SEQ ID NO: 3782534 - RNA, 19 nt, Human
aggacaccacacccagccu

SEQ ID NO: 3782535 - RNA, 20 nt, Human
aggacaccuguacuggagag

SEQ ID NO: 3782536 - RNA, 23 nt, Human
aggacacgcgccccccucccaga

SEQ ID NO: 3782537 - RNA, 23 nt, Human
aggacacgggccuguccacaggc

SEQ ID NO: 3782538 - RNA, 18 nt, Human
aggacacuaaccacgcug

SEQ ID NO: 3782539 - RNA, 12 nt, Human
aggacacucccg

SEQ ID NO: 3782540 - RNA, 14 nt, Human
aggacacugauaug

SEQ ID NO: 3782541 - RNA, 15 nt, Human
aggacacuuccugcc

SEQ ID NO: 3782542 - RNA, 22 nt, Human
aggacagaaggcuccugccccc

SEQ ID NO: 3782543 - RNA, 15 nt, Human
aggacagagagaaau

SEQ ID NO: 3782544 - RNA, 15 nt, Human
aggacagcacagacu

SEQ ID NO: 3782545 - RNA, 22 nt, Human
aggacagccuguggcggugccu

SEQ ID NO: 3782546 - RNA, 12 nt, Human
aggacagcuguc

SEQ ID NO: 3782547 - RNA, 13 nt, Human
aggacagcugucc

SEQ ID NO: 3782548 - RNA, 20 nt, Human
aggacaggaaaguggcaccu

SEQ ID NO: 3782549 - RNA, 14 nt, Human
aggacaggauccag

SEQ ID NO: 3782550 - RNA, 16 nt, Human
aggacaggcagaaaga

SEQ ID NO: 3782551 - RNA, 16 nt, Human
aggacagggguuccuu

SEQ ID NO: 3782552 - RNA, 21 nt, Human
aggacauagagguauauugga

SEQ ID NO: 3782553 - RNA, 14 nt, Human
aggacaucagcaaa

SEQ ID NO: 3782554 - RNA, 13 nt, Human
aggacaugaaacu

SEQ ID NO: 3782555 - RNA, 18 nt, Human
aggacaugaaacuccacc

SEQ ID NO: 3782556 - RNA, 20 nt, Human
aggacaugcaauaaaauuua

SEQ ID NO: 3782557 - RNA, 17 nt, Human
aggacaugcugaagcca

SEQ ID NO: 3782558 - RNA, 16 nt, Human
agggccacgugccagg

SEQ ID NO: 3782559 - RNA, 18 nt, Human
agggccacgugccaggcc

SEQ ID NO: 3782560 - RNA, 20 nt, Human
agggccacgugccaggcccg

SEQ ID NO: 3782561 - RNA, 18 nt, Human
agggccacucugccucug

SEQ ID NO: 3782562 - RNA, 23 nt, Human
agggccacugguccccaacaaug

SEQ ID NO: 3782563 - RNA, 17 nt, Human
agggccagaaguagcuu

SEQ ID NO: 3782564 - RNA, 11 nt, Human
agggccagagc

SEQ ID NO: 3782565 - RNA, 14 nt, Human
agggccagagccag

SEQ ID NO: 3782566 - RNA, 16 nt, Human
agggccagagccaggg

SEQ ID NO: 3782567 - RNA, 12 nt, Human
agggccaggacu

SEQ ID NO: 3782568 - RNA, 19 nt, Human
agggccaggacugagcccc

SEQ ID NO: 3782569 - RNA, 21 nt, Human
agggccaggacugagccccgc

SEQ ID NO: 3782570 - RNA, 12 nt, Human
agggccaggcag

SEQ ID NO: 3782571 - RNA, 22 nt, Human
agggccaggcaggugccuggac

SEQ ID NO: 3782572 - RNA, 12 nt, Human
agggccagggcc

SEQ ID NO: 3782573 - RNA, 14 nt, Human
agggccagggcccu

SEQ ID NO: 3782574 - RNA, 15 nt, Human
agggccagggcccug

SEQ ID NO: 3782575 - RNA, 22 nt, Human
agggccagggcccugcagaggg

SEQ ID NO: 3782576 - RNA, 17 nt, Human
agggccaguccugccug

SEQ ID NO: 3782577 - RNA, 21 nt, Human
agggccaguccugccuggcca

SEQ ID NO: 3782578 - RNA, 22 nt, Human
agggccaguccugccuggccag

SEQ ID NO: 3782579 - RNA, 23 nt, Human
agggccaguggggccuguggaau

SEQ ID NO: 3782580 - RNA, 17 nt, Human
agggccaugccugcccc

SEQ ID NO: 3782581 - RNA, 23 nt, Human
agggccaugcugaggccugggcc

SEQ ID NO: 3782582 - RNA, 21 nt, Human
agggccauggcucaggguggu

SEQ ID NO: 3782583 - RNA, 19 nt, Human
agggcccaagucccuguuu

SEQ ID NO: 3782584 - RNA, 23 nt, Human
agggcccagagaggguggugacc

SEQ ID NO: 3782585 - RNA, 13 nt, Human
agggcccagagca

SEQ ID NO: 3782586 - RNA, 18 nt, Human
agggcccagagcaggaag

SEQ ID NO: 3782587 - RNA, 17 nt, Human
agggcccagagcccagc

SEQ ID NO: 3782588 - RNA, 20 nt, Human
agggcccagagcccagcucc

SEQ ID NO: 3782589 - RNA, 21 nt, Human
agggcccagagcccagcucca

SEQ ID NO: 3782590 - RNA, 17 nt, Human
agggcccaggcaggcca

SEQ ID NO: 3782591 - RNA, 17 nt, Human
agggcccaugggaggga

SEQ ID NO: 3782592 - RNA, 19 nt, Human
agggccccucacccugccu

SEQ ID NO: 3782593 - RNA, 14 nt, Human
agggccccucugcc

SEQ ID NO: 3782594 - RNA, 15 nt, Human
agggccccucugccc

SEQ ID NO: 3782595 - RNA, 16 nt, Human
agggccccucugccca

SEQ ID NO: 3782596 - RNA, 19 nt, Human
agggccccucugcccagcu

SEQ ID NO: 3782597 - RNA, 16 nt, Human
agggcccgggaagcaa

SEQ ID NO: 3782598 - RNA, 15 nt, Human
agggcccuccuuccu

SEQ ID NO: 3782599 - RNA, 15 nt, Human
agggcccugagcuga

SEQ ID NO: 3782600 - RNA, 14 nt, Human
agggcccuggaggc

SEQ ID NO: 3782601 - RNA, 13 nt, Human
agggcccuggugu

SEQ ID NO: 3782602 - RNA, 24 nt, Human
agggcccugguguuucuagcacug

SEQ ID NO: 3782603 - RNA, 15 nt, Human
agggcccuucacugc

SEQ ID NO: 3782604 - RNA, 19 nt, Human
aggucaccuuuauucuggc

SEQ ID NO: 3782605 - RNA, 19 nt, Human
aggucacuccuggggccuc

SEQ ID NO: 3782606 - RNA, 16 nt, Human
aggucacuggaaaggg

SEQ ID NO: 3782607 - RNA, 20 nt, Human
aggucacuggaaaggggaga

SEQ ID NO: 3782608 - RNA, 14 nt, Human
aggucacuggcucu

SEQ ID NO: 3782609 - RNA, 12 nt, Human
aggucagagccu

SEQ ID NO: 3782610 - RNA, 19 nt, Human
aggucagcauuugaucugu

SEQ ID NO: 3782611 - RNA, 12 nt, Human
aggucaggaaac

SEQ ID NO: 3782612 - RNA, 12 nt, Human
aggucaggcccu

SEQ ID NO: 3782613 - RNA, 19 nt, Human
aggucaggggugacacaga

SEQ ID NO: 3782614 - RNA, 21 nt, Human
aggucaggggugacacagacu

SEQ ID NO: 3782615 - RNA, 15 nt, Human
aggucaguacccacc

SEQ ID NO: 3782616 - RNA, 15 nt, Human
aggucagugcaaaua

SEQ ID NO: 3782617 - RNA, 17 nt, Human
aggucauagcugagauu

SEQ ID NO: 3782618 - RNA, 21 nt, Human
aggucauuaaggccacaucca

SEQ ID NO: 3782619 - RNA, 18 nt, Human
aggucauuuccauguaug

SEQ ID NO: 3782620 - RNA, 17 nt, Human
aggucauuuuuuuuaag

SEQ ID NO: 3782621 - RNA, 23 nt, Human
aggucauuuuuuuuaagaaaaag

SEQ ID NO: 3782622 - RNA, 16 nt, Human
agguccaaugagcuuu

SEQ ID NO: 3782623 - RNA, 14 nt, Human
agguccacaggucu

SEQ ID NO: 3782624 - RNA, 15 nt, Human
agguccacaggucua

SEQ ID NO: 3782625 - RNA, 19 nt, Human
agguccacaggucuagacu

SEQ ID NO: 3782626 - RNA, 21 nt, Human
agguccacggucuguucuuga

SEQ ID NO: 3782627 - RNA, 22 nt, Human
agguccacggucuguucuugaa

SEQ ID NO: 3782628 - RNA, 20 nt, Human
agguccagagagaccgagga

SEQ ID NO: 3782629 - RNA, 15 nt, Human
agguccagcccaucu

SEQ ID NO: 3782630 - RNA, 16 nt, Human
agguccagcccaucuc

SEQ ID NO: 3782631 - RNA, 23 nt, Human
agguccagcccaucucggagcau

SEQ ID NO: 3782632 - RNA, 17 nt, Human
agguccagcccuggcug

SEQ ID NO: 3782633 - RNA, 20 nt, Human
agguccagcccuggcugaag

SEQ ID NO: 3782634 - RNA, 13 nt, Human
agguccagcucug

SEQ ID NO: 3782635 - RNA, 14 nt, Human
agguccagcucugg

SEQ ID NO: 3782636 - RNA, 17 nt, Human
agguccagcucuggagg

SEQ ID NO: 3782637 - RNA, 11 nt, Human
aggucccaggc

SEQ ID NO: 3782638 - RNA, 17 nt, Human
agguccccagcuuuggc

SEQ ID NO: 3782639 - RNA, 18 nt, Human
agguccccagcuuuggcu

SEQ ID NO: 3782640 - RNA, 14 nt, Human
aggucccccugcag

SEQ ID NO: 3782641 - RNA, 10 nt, Human
aggucccuaa

SEQ ID NO: 3782642 - RNA, 15 nt, Human
aggucccuaauaaag

SEQ ID NO: 3782643 - RNA, 13 nt, Human
agguccuaaggca

SEQ ID NO: 3782644 - RNA, 16 nt, Human
agguccuacagggcca

SEQ ID NO: 3782645 - RNA, 18 nt, Human
agguccuccccucucuug

SEQ ID NO: 3782646 - RNA, 15 nt, Human
agguccucuggagcc

SEQ ID NO: 3782647 - RNA, 16 nt, Human
agguccugagcacugc

SEQ ID NO: 3782648 - RNA, 17 nt, Human
agguccugagcacugcc

SEQ ID NO: 3782649 - RNA, 19 nt, Human
agguccugagcacugccag

SEQ ID NO: 3782650 - RNA, 23 nt, Human
agguccugagcacugccaggagg

SEQ ID NO: 3782651 - RNA, 21 nt, Human
agguccugcagucuggcugag

SEQ ID NO: 3782652 - RNA, 19 nt, Human
agguccugcucagcaguga

SEQ ID NO: 3782653 - RNA, 16 nt, Human
agguccugggggccug

SEQ ID NO: 3782654 - RNA, 18 nt, Human
agguccugggggccugac

SEQ ID NO: 3782655 - RNA, 21 nt, Human
agguccugggggccugaccuc

SEQ ID NO: 3782656 - RNA, 22 nt, Human
agguccugggggccugaccucc

SEQ ID NO: 3782657 - RNA, 20 nt, Human
agguccugugaucuuauuuu

SEQ ID NO: 3782658 - RNA, 23 nt, Human
agguccugugaucuuauuuuucu

SEQ ID NO: 3782659 - RNA, 14 nt, Human
agguccuuuagaaa

SEQ ID NO: 3782660 - RNA, 15 nt, Human
agguccuuuagaaac

SEQ ID NO: 3782661 - RNA, 20 nt, Human
aggucgcuugggaauuuuau

SEQ ID NO: 3782662 - RNA, 17 nt, Human
aggucggaggcuuggga

SEQ ID NO: 3782663 - RNA, 15 nt, Human
aggucgggcucagcu

SEQ ID NO: 3782664 - RNA, 18 nt, Human
aggucgggcucagcucug

SEQ ID NO: 3782665 - RNA, 21 nt, Human
aggucuauuuaaaaaaaaagu

SEQ ID NO: 3782666 - RNA, 12 nt, Human
aggucucagccc

SEQ ID NO: 3782667 - RNA, 13 nt, Human
aggucucccggga

SEQ ID NO: 3782668 - RNA, 16 nt, Human
aggucucccgggaagc

SEQ ID NO: 3782669 - RNA, 15 nt, Human
aggucuccuccaccg

SEQ ID NO: 3782670 - RNA, 13 nt, Human
aggucuccucuua

SEQ ID NO: 3782671 - RNA, 23 nt, Human
aggucuccucuuaaaaaauaaaa

SEQ ID NO: 3782672 - RNA, 20 nt, Human
aggucucgcugaugcugggc

SEQ ID NO: 3782673 - RNA, 21 nt, Human
aggucucgcugaugcugggcu

SEQ ID NO: 3782674 - RNA, 23 nt, Human
aggucucgcugaugcugggcugg

SEQ ID NO: 3782675 - RNA, 16 nt, Human
aggucucugccggcuc

SEQ ID NO: 3782676 - RNA, 13 nt, Human
aggucucuucccc

SEQ ID NO: 3782677 - RNA, 16 nt, Human
aggucucuucucccag

SEQ ID NO: 3782678 - RNA, 17 nt, Human
aggucucuucucccaga

SEQ ID NO: 3782679 - RNA, 19 nt, Human
aggucucuucucccagaau

SEQ ID NO: 3782680 - RNA, 23 nt, Human
aggucucuucucccagaauccca

SEQ ID NO: 3782681 - RNA, 20 nt, Human
aggucugacacgucugccua

SEQ ID NO: 3782682 - RNA, 22 nt, Human
aggucugagcacuggaguggcu

SEQ ID NO: 3782683 - RNA, 18 nt, Human
aggucugagccacagcag

SEQ ID NO: 3782684 - RNA, 20 nt, Human
aggucugaguuguuacccca

SEQ ID NO: 3782685 - RNA, 16 nt, Human
aggucuggccucaggu

SEQ ID NO: 3782686 - RNA, 14 nt, Human
aggucugugcugag

SEQ ID NO: 3782687 - RNA, 13 nt, Human
aggucuguucuuu

SEQ ID NO: 3782688 - RNA, 22 nt, Human
aggucuguucuuuccaaaguac

SEQ ID NO: 3782689 - RNA, 12 nt, Human
aggucuguuuaa

SEQ ID NO: 3782690 - RNA, 14 nt, Human
aggucuguuugcug

SEQ ID NO: 3782691 - RNA, 22 nt, Human
aggucuguuuuguguacuuuua

SEQ ID NO: 3782692 - RNA, 16 nt, Human
aggucuucagccauca

SEQ ID NO: 3782693 - RNA, 19 nt, Human
aggucuuggagcugagccu

SEQ ID NO: 3782694 - RNA, 22 nt, Human
aggucuuggagcugagccucuc

SEQ ID NO: 3782695 - RNA, 13 nt, Human
aggucuuggugcc

SEQ ID NO: 3782696 - RNA, 11 nt, Human
aggucuuuccu

SEQ ID NO: 3782697 - RNA, 21 nt, Human
aggucuuuguaagaacuaaag

SEQ ID NO: 3782698 - RNA, 15 nt, Human
aggucuuuugacaug

SEQ ID NO: 3782699 - RNA, 21 nt, Human
aggugaaaaaagcuuuuauga

SEQ ID NO: 3782700 - RNA, 13 nt, Human
aggugaaaauguu

SEQ ID NO: 3782701 - RNA, 16 nt, Human
aggugaaacauuuucu

SEQ ID NO: 3782702 - RNA, 21 nt, Human
aggugaaacuccagaugccac

SEQ ID NO: 3782703 - RNA, 16 nt, Human
aggugaaagggagcua

SEQ ID NO: 3782704 - RNA, 19 nt, Human
aggugaaaguuaauccacu

SEQ ID NO: 3782705 - RNA, 14 nt, Human
aggugaaggaauau

SEQ ID NO: 3782706 - RNA, 17 nt, Human
aggugaaggaauauaug

SEQ ID NO: 3782707 - RNA, 21 nt, Human
aggugaaggaggcuccaggca

SEQ ID NO: 3782708 - RNA, 19 nt, Human
aggugacacuauaguuuaa

SEQ ID NO: 3782709 - RNA, 19 nt, Human
aggugacagaaggaccagc

SEQ ID NO: 3782710 - RNA, 22 nt, Human
aggugacagagugagacucugu

SEQ ID NO: 3782711 - RNA, 21 nt, Human
aggugacagugagguccuggg

SEQ ID NO: 3782712 - RNA, 15 nt, Human
aggugacauauacau

SEQ ID NO: 3782713 - RNA, 14 nt, Human
aggugacaugugaa

SEQ ID NO: 3782714 - RNA, 20 nt, Human
aggugaccaaaauccccuuc

SEQ ID NO: 3782715 - RNA, 13 nt, Human
aggugaccccagg

SEQ ID NO: 3782716 - RNA, 21 nt, Human
aggugaccccagggcacagga

SEQ ID NO: 3782717 - RNA, 18 nt, Human
aggugacccugaugaaaa

SEQ ID NO: 3782718 - RNA, 19 nt, Human
aggugacugggcccugccu

SEQ ID NO: 3782719 - RNA, 14 nt, Human
aggugagaaaaaaa

SEQ ID NO: 3782720 - RNA, 15 nt, Human
aggugagaaaaaaac

SEQ ID NO: 3782721 - RNA, 13 nt, Human
aggugagaaauuu

SEQ ID NO: 3782722 - RNA, 16 nt, Human
aggugagaagcagagg

SEQ ID NO: 3782723 - RNA, 16 nt, Human
aggugagaccaccucu

SEQ ID NO: 3782724 - RNA, 18 nt, Human
aggugagcacggccaaca

SEQ ID NO: 3782725 - RNA, 18 nt, Human
aggugaggagcagagcag

SEQ ID NO: 3782726 - RNA, 13 nt, Human
aggugaggccugu

SEQ ID NO: 3782727 - RNA, 17 nt, Human
aggugaggccugucugu

SEQ ID NO: 3782728 - RNA, 13 nt, Human
aggugagggaagc

SEQ ID NO: 3782729 - RNA, 17 nt, Human
aggugaggucuguuccu

SEQ ID NO: 3782730 - RNA, 19 nt, Human
aggugaguuugagcugccu

SEQ ID NO: 3782731 - RNA, 22 nt, Human
aggugaguuugagcugccuucc

SEQ ID NO: 3782732 - RNA, 14 nt, Human
aggugauaaaauca

SEQ ID NO: 3782733 - RNA, 17 nt, Human
aggugauagcauugcuu

SEQ ID NO: 3782734 - RNA, 16 nt, Human
aggugauauauuuaaa

SEQ ID NO: 3782735 - RNA, 18 nt, Human
aggugauauuuuucuuau

SEQ ID NO: 3782736 - RNA, 23 nt, Human
aggugauccacccaccucagccu

SEQ ID NO: 3782737 - RNA, 22 nt, Human
aggugauccacucgccuucauc

SEQ ID NO: 3782738 - RNA, 15 nt, Human
aggugauccauguaa

SEQ ID NO: 3782739 - RNA, 22 nt, Human
aggugcaacaagguccucuguc

SEQ ID NO: 3782740 - RNA, 13 nt, Human
aggugcaaccagg

SEQ ID NO: 3782741 - RNA, 21 nt, Human
aggugcaauuucaagguucua

SEQ ID NO: 3782742 - RNA, 22 nt, Human
aggugcaauuucaagguucuaa

SEQ ID NO: 3782743 - RNA, 20 nt, Human
aggugcacaagcuccaagcu

SEQ ID NO: 3782744 - RNA, 22 nt, Human
aggugcacagacgucccuccac

SEQ ID NO: 3782745 - RNA, 15 nt, Human
aggugcacugggagg

SEQ ID NO: 3782746 - RNA, 23 nt, Human
aggugcacugggaggcuccccuu

SEQ ID NO: 3782747 - RNA, 13 nt, Human
aggugcagaggaa

SEQ ID NO: 3782748 - RNA, 18 nt, Human
aggugcagagugcccaga

SEQ ID NO: 3782749 - RNA, 19 nt, Human
aggugcagagugcccagaa

SEQ ID NO: 3782750 - RNA, 11 nt, Human
aggugcagugg

SEQ ID NO: 3782751 - RNA, 16 nt, Human
aggugcaguggcucac

SEQ ID NO: 3782752 - RNA, 16 nt, Human
aggugcaguuccccca

SEQ ID NO: 3782753 - RNA, 23 nt, Human
aggugcaucuggggaacuagagg

SEQ ID NO: 3782754 - RNA, 22 nt, Human
agcaaggcccgagcagcugagc

SEQ ID NO: 3782755 - RNA, 19 nt, Human
agcaaggcccugcugccca

SEQ ID NO: 3782756 - RNA, 17 nt, Human
agcaaggcgcuaacuug

SEQ ID NO: 3782757 - RNA, 20 nt, Human
agcaaggguucccucaagag

SEQ ID NO: 3782758 - RNA, 19 nt, Human
agcaaggucuugcucuccu

SEQ ID NO: 3782759 - RNA, 20 nt, Human
agcaaguagauaaauauuug

SEQ ID NO: 3782760 - RNA, 15 nt, Human
agcaagucagaauag

SEQ ID NO: 3782761 - RNA, 13 nt, Human
agcaagucucuuu

SEQ ID NO: 3782762 - RNA, 13 nt, Human
agcaagucugcag

SEQ ID NO: 3782763 - RNA, 16 nt, Human
agcaagugagacccug

SEQ ID NO: 3782764 - RNA, 20 nt, Human
agcaagugagacccugucuc

SEQ ID NO: 3782765 - RNA, 17 nt, Human
agcaagugagagcuggg

SEQ ID NO: 3782766 - RNA, 21 nt, Human
agcaagugauugggacagagg

SEQ ID NO: 3782767 - RNA, 15 nt, Human
agcaagugugaauac

SEQ ID NO: 3782768 - RNA, 15 nt, Human
agcaaguucgucugu

SEQ ID NO: 3782769 - RNA, 15 nt, Human
agcaauaaaugaaug

SEQ ID NO: 3782770 - RNA, 19 nt, Human
agcaauaauggucccaucc

SEQ ID NO: 3782771 - RNA, 20 nt, Human
agcaauaauggucccaucca

SEQ ID NO: 3782772 - RNA, 21 nt, Human
agcaauaauggucccauccag

SEQ ID NO: 3782773 - RNA, 16 nt, Human
agcaauauauuaccag

SEQ ID NO: 3782774 - RNA, 24 nt, Human
agcaauauauuaccagcaagaaua

SEQ ID NO: 3782775 - RNA, 12 nt, Human
agcaauauguca

SEQ ID NO: 3782776 - RNA, 12 nt, Human
agcaauauucuu

SEQ ID NO: 3782777 - RNA, 15 nt, Human
agcaauauuuaugga

SEQ ID NO: 3782778 - RNA, 22 nt, Human
agcaauauuuauggaugcaaca

SEQ ID NO: 3782779 - RNA, 19 nt, Human
agcaauccuagguaggguu

SEQ ID NO: 3782780 - RNA, 17 nt, Human
agcaauccuccugagug

SEQ ID NO: 3782781 - RNA, 23 nt, Human
agcaaucucuucauuauucucug

SEQ ID NO: 3782782 - RNA, 18 nt, Human
agcaaugauguccagaag

SEQ ID NO: 3782783 - RNA, 23 nt, Human
agcaaugauguccagaagaauau

SEQ ID NO: 3782784 - RNA, 20 nt, Human
agcaaugcccguaaugcuua

SEQ ID NO: 3782785 - RNA, 16 nt, Human
agcaaugucugugcua

SEQ ID NO: 3782786 - RNA, 17 nt, Human
agcaauguuaucuuggu

SEQ ID NO: 3782787 - RNA, 19 nt, Human
agcaauucauaaaaacugc

SEQ ID NO: 3782788 - RNA, 15 nt, Human
agcaauucuccugcc

SEQ ID NO: 3782789 - RNA, 17 nt, Human
agcaauugcugcaucuu

SEQ ID NO: 3782790 - RNA, 20 nt, Human
agcaauugcugcaucuuagu

SEQ ID NO: 3782791 - RNA, 16 nt, Human
agcaauugugugguca

SEQ ID NO: 3782792 - RNA, 16 nt, Human
agcaauuuaaauguua

SEQ ID NO: 3782793 - RNA, 17 nt, Human
agcaauuuaaauguuau

SEQ ID NO: 3782794 - RNA, 23 nt, Human
agcaauuuaauauuuugcacagu

SEQ ID NO: 3782795 - RNA, 21 nt, Human
agcaauuucgccguugaagag

SEQ ID NO: 3782796 - RNA, 22 nt, Human
agcaauuucgccguugaagagg

SEQ ID NO: 3782797 - RNA, 13 nt, Human
agcaauuucuaau

SEQ ID NO: 3782798 - RNA, 21 nt, Human
agcaauuuuccuugaagccga

SEQ ID NO: 3782799 - RNA, 14 nt, Human
agcacaaaauucaa

SEQ ID NO: 3782800 - RNA, 19 nt, Human
agcacaacuuuaagaggac

SEQ ID NO: 3782801 - RNA, 19 nt, Human
agcacaaguuauuuaaauc

SEQ ID NO: 3782802 - RNA, 18 nt, Human
agcacaauaaauggcugu

SEQ ID NO: 3782803 - RNA, 23 nt, Human
agcacaaugucucacaugggaca

SEQ ID NO: 3782804 - RNA, 12 nt, Human
agcacacuggcu

SEQ ID NO: 3782805 - RNA, 19 nt, Human
agcacacuggcucacccag

SEQ ID NO: 3782806 - RNA, 20 nt, Human
agcacacuggcucacccagu

SEQ ID NO: 3782807 - RNA, 14 nt, Human
agcacacuguagca

SEQ ID NO: 3782808 - RNA, 19 nt, Human
agcacacuguagcauuaca

SEQ ID NO: 3782809 - RNA, 13 nt, Human
agcacagaaggag

SEQ ID NO: 3782810 - RNA, 14 nt, Human
agcacagacccugc

SEQ ID NO: 3782811 - RNA, 20 nt, Human
agcacagacccugcccugug

SEQ ID NO: 3782812 - RNA, 21 nt, Human
agcacagacccugcccugugg

SEQ ID NO: 3782813 - RNA, 15 nt, Human
agcacagagaagaca

SEQ ID NO: 3782814 - RNA, 20 nt, Human
agcacagauaaaaaguggaa

SEQ ID NO: 3782815 - RNA, 16 nt, Human
agcacagauggccagc

SEQ ID NO: 3782816 - RNA, 22 nt, Human
agcacagauuuuaauugucaug

SEQ ID NO: 3782817 - RNA, 23 nt, Human
agcacagauuuuaauugucaugg

SEQ ID NO: 3782818 - RNA, 12 nt, Human
agcacagcagcc

SEQ ID NO: 3782819 - RNA, 12 nt, Human
agcacagcccuc

SEQ ID NO: 3782820 - RNA, 14 nt, Human
agcacagcccuccc

SEQ ID NO: 3782821 - RNA, 15 nt, Human
agcacagcccucccg

SEQ ID NO: 3782822 - RNA, 16 nt, Human
agcacagcccucccgc

SEQ ID NO: 3782823 - RNA, 21 nt, Human
agcacagcccucccgccccuu

SEQ ID NO: 3782824 - RNA, 22 nt, Human
agcacagcccucccgccccuuc

SEQ ID NO: 3782825 - RNA, 12 nt, Human
agcacagccuag

SEQ ID NO: 3782826 - RNA, 22 nt, Human
agcacagccucuuagaugcagu

SEQ ID NO: 3782827 - RNA, 21 nt, Human
agcacagcucaggaacuagac

SEQ ID NO: 3782828 - RNA, 12 nt, Human
agcacagcuccc

SEQ ID NO: 3782829 - RNA, 17 nt, Human
agcacagcucccugcca

SEQ ID NO: 3782830 - RNA, 20 nt, Human
agcacagcuuagauuucaua

SEQ ID NO: 3782831 - RNA, 14 nt, Human
agcacagcuugacc

SEQ ID NO: 3782832 - RNA, 15 nt, Human
agcacaggucccacc

SEQ ID NO: 3782833 - RNA, 23 nt, Human
agcacaggucccaccuccagccc

SEQ ID NO: 3782834 - RNA, 21 nt, Human
agcacaggugggcuucccagu

SEQ ID NO: 3782835 - RNA, 18 nt, Human
agcacagucagguugaag

SEQ ID NO: 3782836 - RNA, 15 nt, Human
agcacagugaucaag

SEQ ID NO: 3782837 - RNA, 15 nt, Human
agcacagugguggca

SEQ ID NO: 3782838 - RNA, 23 nt, Human
agcacagugguggcagggccuag

SEQ ID NO: 3782839 - RNA, 12 nt, Human
agcacaguuuga

SEQ ID NO: 3782840 - RNA, 14 nt, Human
agcacauccaggca

SEQ ID NO: 3782841 - RNA, 22 nt, Human
agcacauccaggcaauggccua

SEQ ID NO: 3782842 - RNA, 19 nt, Human
agcacaucucaacaggccu

SEQ ID NO: 3782843 - RNA, 15 nt, Human
agcacaucugcauuu

SEQ ID NO: 3782844 - RNA, 16 nt, Human
agcacaucugcauuuu

SEQ ID NO: 3782845 - RNA, 23 nt, Human
agcacaugaaaccuuauuuuuuc

SEQ ID NO: 3782846 - RNA, 20 nt, Human
agcacaugccucucucaggc

SEQ ID NO: 3782847 - RNA, 22 nt, Human
aggugggguugggauugggggc

SEQ ID NO: 3782848 - RNA, 23 nt, Human
agguggguuuucuucccaucacu

SEQ ID NO: 3782849 - RNA, 21 nt, Human
aggugguaguaaaacacagag

SEQ ID NO: 3782850 - RNA, 22 nt, Human
aggugguaguaaaacacagagg

SEQ ID NO: 3782851 - RNA, 18 nt, Human
aggugguaugugugugua

SEQ ID NO: 3782852 - RNA, 19 nt, Human
aggugguccugagaccuga

SEQ ID NO: 3782853 - RNA, 15 nt, Human
agguggugcuuacau

SEQ ID NO: 3782854 - RNA, 20 nt, Human
aggugguggcacugagcccc

SEQ ID NO: 3782855 - RNA, 18 nt, Human
agguggugucacuguccc

SEQ ID NO: 3782856 - RNA, 16 nt, Human
agguggugugaucuua

SEQ ID NO: 3782857 - RNA, 17 nt, Human
aggugguuauggagagg

SEQ ID NO: 3782858 - RNA, 19 nt, Human
agguguagccacaccagga

SEQ ID NO: 3782859 - RNA, 13 nt, Human
agguguauuuaaa

SEQ ID NO: 3782860 - RNA, 17 nt, Human
aggugucaggcugcugg

SEQ ID NO: 3782861 - RNA, 19 nt, Human
aggugucaggcugcuggcg

SEQ ID NO: 3782862 - RNA, 21 nt, Human
aggugucauacagauuugcaa

SEQ ID NO: 3782863 - RNA, 17 nt, Human
aggugucauuuccauua

SEQ ID NO: 3782864 - RNA, 17 nt, Human
agguguccccagcccac

SEQ ID NO: 3782865 - RNA, 16 nt, Human
aggugucccugcacuu

SEQ ID NO: 3782866 - RNA, 14 nt, Human
agguguccuacaga

SEQ ID NO: 3782867 - RNA, 17 nt, Human
agguguccuacagaaaa

SEQ ID NO: 3782868 - RNA, 17 nt, Human
aggugucucaggcugcc

SEQ ID NO: 3782869 - RNA, 14 nt, Human
aggugucugcaccc

SEQ ID NO: 3782870 - RNA, 20 nt, Human
aggugucuuccucccaagug

SEQ ID NO: 3782871 - RNA, 20 nt, Human
aggugugagccaccacgccc

SEQ ID NO: 3782872 - RNA, 21 nt, Human
aggugugagucaccaagccca

SEQ ID NO: 3782873 - RNA, 20 nt, Human
aggugugcucugaucaucca

SEQ ID NO: 3782874 - RNA, 23 nt, Human
agguguggcuuuaggagcagugg

SEQ ID NO: 3782875 - RNA, 16 nt, Human
aggugugugagacuac

SEQ ID NO: 3782876 - RNA, 16 nt, Human
agguguuggugacaau

SEQ ID NO: 3782877 - RNA, 16 nt, Human
agguguugucccuucu

SEQ ID NO: 3782878 - RNA, 13 nt, Human
agguguuuaaaga

SEQ ID NO: 3782879 - RNA, 14 nt, Human
agguguuuauacag

SEQ ID NO: 3782880 - RNA, 15 nt, Human
agguguuugaacaga

SEQ ID NO: 3782881 - RNA, 13 nt, Human
agguguuuucugu

SEQ ID NO: 3782882 - RNA, 15 nt, Human
agguguuuucugugu

SEQ ID NO: 3782883 - RNA, 16 nt, Human
agguguuuucugugua

SEQ ID NO: 3782884 - RNA, 22 nt, Human
agguguuuuguucaccauuaua

SEQ ID NO: 3782885 - RNA, 22 nt, Human
agguuaaaaaaaggcauuguuu

SEQ ID NO: 3782886 - RNA, 23 nt, Human
agguuaaaaaaauggcagugaug

SEQ ID NO: 3782887 - RNA, 22 nt, Human
agguuaaaagaccauaagcaaa

SEQ ID NO: 3782888 - RNA, 14 nt, Human
agguuaaauguuuu

SEQ ID NO: 3782889 - RNA, 18 nt, Human
agguuaaauguuuuguaa

SEQ ID NO: 3782890 - RNA, 16 nt, Human
agguuaaggcugagga

SEQ ID NO: 3782891 - RNA, 21 nt, Human
agguuaggaguucgagaccag

SEQ ID NO: 3782892 - RNA, 18 nt, Human
agguuaggauuuaacagu

SEQ ID NO: 3782893 - RNA, 23 nt, Human
agguuaggcaguauaaagaauag

SEQ ID NO: 3782894 - RNA, 14 nt, Human
agguuauaggucac

SEQ ID NO: 3782895 - RNA, 15 nt, Human
agguuaucagugcuu

SEQ ID NO: 3782896 - RNA, 14 nt, Human
agguuaucgaaaua

SEQ ID NO: 3782897 - RNA, 20 nt, Human
agguuaucgaaauaacaaug

SEQ ID NO: 3782898 - RNA, 19 nt, Human
agguuaucuacuuuuacuc

SEQ ID NO: 3782899 - RNA, 16 nt, Human
agguuauuuauuuaaa

SEQ ID NO: 3782900 - RNA, 17 nt, Human
agguuauuuuaguuucu

SEQ ID NO: 3782901 - RNA, 15 nt, Human
agguucaaagauauu

SEQ ID NO: 3782902 - RNA, 16 nt, Human
agguucacgugcagcu

SEQ ID NO: 3782903 - RNA, 18 nt, Human
agguucauggauuuucca

SEQ ID NO: 3782904 - RNA, 18 nt, Human
agguuccaacuguauaua

SEQ ID NO: 3782905 - RNA, 14 nt, Human
agguucccucccag

SEQ ID NO: 3782906 - RNA, 18 nt, Human
agguucccuguucuuccu

SEQ ID NO: 3782907 - RNA, 16 nt, Human
agguuccgauguuauu

SEQ ID NO: 3782908 - RNA, 13 nt, Human
agguuccucugcc

SEQ ID NO: 3782909 - RNA, 16 nt, Human
agguuccucugccugc

SEQ ID NO: 3782910 - RNA, 18 nt, Human
agguuccucugccugccc

SEQ ID NO: 3782911 - RNA, 17 nt, Human
agguucuaaaguucuaa

SEQ ID NO: 3782912 - RNA, 16 nt, Human
agcacucuuaaagcaa

SEQ ID NO: 3782913 - RNA, 20 nt, Human
agcacugaaaguauguuuua

SEQ ID NO: 3782914 - RNA, 20 nt, Human
agcacugaccugucaugccc

SEQ ID NO: 3782915 - RNA, 10 nt, Human
agcacugagg

SEQ ID NO: 3782916 - RNA, 21 nt, Human
agcacugaggaagaacggggc

SEQ ID NO: 3782917 - RNA, 17 nt, Human
agcacugauuucacaac

SEQ ID NO: 3782918 - RNA, 18 nt, Human
agcacugauuucacaaca

SEQ ID NO: 3782919 - RNA, 15 nt, Human
agcacugccugcucc

SEQ ID NO: 3782920 - RNA, 20 nt, Human
agcacugccugcucccaucc

SEQ ID NO: 3782921 - RNA, 21 nt, Human
agcacugcuaggcgagugcca

SEQ ID NO: 3782922 - RNA, 22 nt, Human
agcacugcuaggcgagugccag

SEQ ID NO: 3782923 - RNA, 23 nt, Human
agcacugcuaggcgagugccagg

SEQ ID NO: 3782924 - RNA, 23 nt, Human
agcacuggagugcagggaggaga

SEQ ID NO: 3782925 - RNA, 12 nt, Human
agcacuggccug

SEQ ID NO: 3782926 - RNA, 12 nt, Human
agcacugggcuc

SEQ ID NO: 3782927 - RNA, 18 nt, Human
agcacugggcucccgggc

SEQ ID NO: 3782928 - RNA, 15 nt, Human
agcacuguaaacuuc

SEQ ID NO: 3782929 - RNA, 15 nt, Human
agcacugucccuugc

SEQ ID NO: 3782930 - RNA, 16 nt, Human
agcacugucccuugcc

SEQ ID NO: 3782931 - RNA, 20 nt, Human
agcacugucucaguuucacu

SEQ ID NO: 3782932 - RNA, 15 nt, Human
agcacugugcucagg

SEQ ID NO: 3782933 - RNA, 18 nt, Human
agcacugugcucagggcu

SEQ ID NO: 3782934 - RNA, 17 nt, Human
agcacuguuccagccug

SEQ ID NO: 3782935 - RNA, 20 nt, Human
agcacuguuccagccugccc

SEQ ID NO: 3782936 - RNA, 15 nt, Human
agcacuguugaugua

SEQ ID NO: 3782937 - RNA, 18 nt, Human
agcacuguugauguaucu

SEQ ID NO: 3782938 - RNA, 20 nt, Human
agcacuguuuucuaguguau

SEQ ID NO: 3782939 - RNA, 21 nt, Human
agcacuguuuuuccauaguuu

SEQ ID NO: 3782940 - RNA, 17 nt, Human
agcacuuaagagaauau

SEQ ID NO: 3782941 - RNA, 20 nt, Human
agcacuuacagauaggccuu

SEQ ID NO: 3782942 - RNA, 18 nt, Human
agcacuuccaaaauucuu

SEQ ID NO: 3782943 - RNA, 16 nt, Human
agcacuuccuugccag

SEQ ID NO: 3782944 - RNA, 21 nt, Human
agcacuuggacucuugcucuu

SEQ ID NO: 3782945 - RNA, 14 nt, Human
agcacuuggcccuu

SEQ ID NO: 3782946 - RNA, 19 nt, Human
agcacuugucucauuuuaa

SEQ ID NO: 3782947 - RNA, 20 nt, Human
agcacuuuagaauaugccuu

SEQ ID NO: 3782948 - RNA, 18 nt, Human
agcacuuugaaauaccuc

SEQ ID NO: 3782949 - RNA, 19 nt, Human
agcacuuugaaauaccuca

SEQ ID NO: 3782950 - RNA, 19 nt, Human
agcacuuugcaaggaaugu

SEQ ID NO: 3782951 - RNA, 22 nt, Human
agcacuuugggaggccaaggug

SEQ ID NO: 3782952 - RNA, 19 nt, Human
agcacuuugggaggcugag

SEQ ID NO: 3782953 - RNA, 23 nt, Human
agcagaaaaaggcugugcugccc

SEQ ID NO: 3782954 - RNA, 22 nt, Human
agcagaaaacccuugggccaga

SEQ ID NO: 3782955 - RNA, 13 nt, Human
agcagaaaauaca

SEQ ID NO: 3782956 - RNA, 14 nt, Human
agcagaaagugccu

SEQ ID NO: 3782957 - RNA, 18 nt, Human
agcagaaagugccuuuca

SEQ ID NO: 3782958 - RNA, 15 nt, Human
agcagaaaucuagaa

SEQ ID NO: 3782959 - RNA, 20 nt, Human
agcagaacaguuaagcagcc

SEQ ID NO: 3782960 - RNA, 13 nt, Human
agcagaagacaaa

SEQ ID NO: 3782961 - RNA, 14 nt, Human
agcagaagcagcaa

SEQ ID NO: 3782962 - RNA, 14 nt, Human
agcagaagcucucg

SEQ ID NO: 3782963 - RNA, 13 nt, Human
agcagaaggaagg

SEQ ID NO: 3782964 - RNA, 17 nt, Human
agcagaaggggagaugg

SEQ ID NO: 3782965 - RNA, 23 nt, Human
agcagaaggggguggugucucca

SEQ ID NO: 3782966 - RNA, 22 nt, Human
agcagaauaaagcaauuuuccu

SEQ ID NO: 3782967 - RNA, 23 nt, Human
agcagaauaaagcaauuuuccuu

SEQ ID NO: 3782968 - RNA, 13 nt, Human
agcagaaugugau

SEQ ID NO: 3782969 - RNA, 22 nt, Human
agcagaauguucuggaaaugaa

SEQ ID NO: 3782970 - RNA, 15 nt, Human
agcagaauucauuca

SEQ ID NO: 3782971 - RNA, 17 nt, Human
agcagaauuggaaaaga

SEQ ID NO: 3782972 - RNA, 11 nt, Human
agcagacacau

SEQ ID NO: 3782973 - RNA, 12 nt, Human
agcagacacaug

SEQ ID NO: 3782974 - RNA, 16 nt, Human
agcagacacaugccag

SEQ ID NO: 3782975 - RNA, 15 nt, Human
agcagacagagccag

SEQ ID NO: 3782976 - RNA, 23 nt, Human
agcagacagagccaggagaagcu

SEQ ID NO: 3782977 - RNA, 12 nt, Human
agcagacaggcc

SEQ ID NO: 3782978 - RNA, 22 nt, Human
agcagaccaccccgccugcccu

SEQ ID NO: 3782979 - RNA, 22 nt, Human
agcagaccauuggggcucccag

SEQ ID NO: 3782980 - RNA, 22 nt, Human
agcagacgauaguuaucuguuc

SEQ ID NO: 3782981 - RNA, 17 nt, Human
agcagacugaucaggac

SEQ ID NO: 3782982 - RNA, 14 nt, Human
agcagacuggugag

SEQ ID NO: 3782983 - RNA, 18 nt, Human
agcagacuuuuaaagacu

SEQ ID NO: 3782984 - RNA, 16 nt, Human
agcagagaaggccagg

SEQ ID NO: 3782985 - RNA, 13 nt, Human
agcagagaagggc

SEQ ID NO: 3782986 - RNA, 16 nt, Human
agcagagaauauaaca

SEQ ID NO: 3782987 - RNA, 21 nt, Human
agcagagaaugaaagggccca

SEQ ID NO: 3782988 - RNA, 23 nt, Human
agcagagaaugaaagggcccaga

SEQ ID NO: 3782989 - RNA, 14 nt, Human
agcagagaauucuc

SEQ ID NO: 3782990 - RNA, 15 nt, Human
agcagagacacuaac

SEQ ID NO: 3782991 - RNA, 19 nt, Human
aguauuuauauauuuauaa

SEQ ID NO: 3782992 - RNA, 17 nt, Human
aguauuuauuuauguac

SEQ ID NO: 3782993 - RNA, 14 nt, Human
aguauuuauuuugu

SEQ ID NO: 3782994 - RNA, 15 nt, Human
aguauuuauuuugua

SEQ ID NO: 3782995 - RNA, 13 nt, Human
aguauuucagugu

SEQ ID NO: 3782996 - RNA, 20 nt, Human
aguauuucaguguaguuaau

SEQ ID NO: 3782997 - RNA, 15 nt, Human
aguauuucauugccu

SEQ ID NO: 3782998 - RNA, 13 nt, Human
aguauuucccagc

SEQ ID NO: 3782999 - RNA, 18 nt, Human
aguauuugaaaacagaaa

SEQ ID NO: 3783000 - RNA, 20 nt, Human
aguauuugaaaacagaaauu

SEQ ID NO: 3783001 - RNA, 21 nt, Human
aguauuugaaaacagaaauug

SEQ ID NO: 3783002 - RNA, 15 nt, Human
aguauuugaauuaaa

SEQ ID NO: 3783003 - RNA, 13 nt, Human
aguauuugauuca

SEQ ID NO: 3783004 - RNA, 17 nt, Human
aguauuugggaagugaa

SEQ ID NO: 3783005 - RNA, 21 nt, Human
aguauuugggaagugaagacu

SEQ ID NO: 3783006 - RNA, 21 nt, Human
aguauuugucguguguagaaa

SEQ ID NO: 3783007 - RNA, 14 nt, Human
aguauuuguuaauu

SEQ ID NO: 3783008 - RNA, 17 nt, Human
aguauuuuaaaauagcg

SEQ ID NO: 3783009 - RNA, 12 nt, Human
aguauuuuagug

SEQ ID NO: 3783010 - RNA, 18 nt, Human
aguauuuuagugaacuug

SEQ ID NO: 3783011 - RNA, 20 nt, Human
aguauuuuagugaacuugaa

SEQ ID NO: 3783012 - RNA, 21 nt, Human
aguauuuuaguggacccugaa

SEQ ID NO: 3783013 - RNA, 19 nt, Human
aguauuuucccugcuaggg

SEQ ID NO: 3783014 - RNA, 14 nt, Human
aguauuuuccugua

SEQ ID NO: 3783015 - RNA, 17 nt, Human
aguauuuugcuggaaua

SEQ ID NO: 3783016 - RNA, 14 nt, Human
aguauuuuuaaagg

SEQ ID NO: 3783017 - RNA, 13 nt, Human
aguauuuuuauaa

SEQ ID NO: 3783018 - RNA, 22 nt, Human
aguauuuuuauaaauauaagcc

SEQ ID NO: 3783019 - RNA, 14 nt, Human
aguauuuuugcugc

SEQ ID NO: 3783020 - RNA, 19 nt, Human
aguauuuuuuacauuuuac

SEQ ID NO: 3783021 - RNA, 16 nt, Human
aguauuuuuucaguau

SEQ ID NO: 3783022 - RNA, 15 nt, Human
agucaaaaauuaaac

SEQ ID NO: 3783023 - RNA, 19 nt, Human
agucaaaacacuuguaauu

SEQ ID NO: 3783024 - RNA, 14 nt, Human
agucaaaacagaga

SEQ ID NO: 3783025 - RNA, 21 nt, Human
agucaaaacagagaugugaua

SEQ ID NO: 3783026 - RNA, 13 nt, Human
agucaaaacuuua

SEQ ID NO: 3783027 - RNA, 18 nt, Human
agucaaaaggugccugug

SEQ ID NO: 3783028 - RNA, 19 nt, Human
agucaaaauauuuuuaaaa

SEQ ID NO: 3783029 - RNA, 19 nt, Human
agucaaacacuugugacuu

SEQ ID NO: 3783030 - RNA, 15 nt, Human
agucaaacugugcca

SEQ ID NO: 3783031 - RNA, 22 nt, Human
agucaaaugguaggcauuuccu

SEQ ID NO: 3783032 - RNA, 22 nt, Human
agucaaauguaauguggcuucu

SEQ ID NO: 3783033 - RNA, 15 nt, Human
agucaaauuaauaau

SEQ ID NO: 3783034 - RNA, 17 nt, Human
agucaaauugugugaaa

SEQ ID NO: 3783035 - RNA, 18 nt, Human
agucaacaguaaaccacu

SEQ ID NO: 3783036 - RNA, 12 nt, Human
agucaacaguac

SEQ ID NO: 3783037 - RNA, 15 nt, Human
agucaaccaacccca

SEQ ID NO: 3783038 - RNA, 22 nt, Human
agucaacccuccuaaaaguuca

SEQ ID NO: 3783039 - RNA, 19 nt, Human
agucaagaaaaauuauugu

SEQ ID NO: 3783040 - RNA, 14 nt, Human
agucaagaagaaaa

SEQ ID NO: 3783041 - RNA, 13 nt, Human
agucaagcuccuc

SEQ ID NO: 3783042 - RNA, 22 nt, Human
agucaagcuguugaagucucag

SEQ ID NO: 3783043 - RNA, 14 nt, Human
agucaaggccugcu

SEQ ID NO: 3783044 - RNA, 19 nt, Human
agucaaggccugcucccug

SEQ ID NO: 3783045 - RNA, 20 nt, Human
agucaagugcguccacgagc

SEQ ID NO: 3783046 - RNA, 14 nt, Human
agucaauaagaaaa

SEQ ID NO: 3783047 - RNA, 17 nt, Human
agucaaucauuucucac

SEQ ID NO: 3783048 - RNA, 15 nt, Human
agucaaugacaugaa

SEQ ID NO: 3783049 - RNA, 14 nt, Human
agucaauggcuugu

SEQ ID NO: 3783050 - RNA, 18 nt, Human
agucacaaagaacaugua

SEQ ID NO: 3783051 - RNA, 23 nt, Human
agucacaauguucuuuauauaca

SEQ ID NO: 3783052 - RNA, 11 nt, Human
agucacacagu

SEQ ID NO: 3783053 - RNA, 22 nt, Human
agucacacaguauuacuucugc

SEQ ID NO: 3783054 - RNA, 15 nt, Human
agucacacagugagu

SEQ ID NO: 3783055 - RNA, 17 nt, Human
agucacacaguguugga

SEQ ID NO: 3783056 - RNA, 21 nt, Human
agucacagaacaaauguuugu

SEQ ID NO: 3783057 - RNA, 17 nt, Human
agucacagggcaguacc

SEQ ID NO: 3783058 - RNA, 20 nt, Human
agucacauuccugaacagga

SEQ ID NO: 3783059 - RNA, 22 nt, Human
agucaccaaaagacacugcaga

SEQ ID NO: 3783060 - RNA, 19 nt, Human
agucaccacuccauuccca

SEQ ID NO: 3783061 - RNA, 14 nt, Human
agucaccagagacu

SEQ ID NO: 3783062 - RNA, 20 nt, Human
agucacccuaccugugccug

SEQ ID NO: 3783063 - RNA, 24 nt, Human
agucacccuuccaccauuguccua

SEQ ID NO: 3783064 - RNA, 14 nt, Human
agucaccucaugga

SEQ ID NO: 3783065 - RNA, 13 nt, Human
agucaccucuguc

SEQ ID NO: 3783066 - RNA, 20 nt, Human
agucaccuuccaggaccccu

SEQ ID NO: 3783067 - RNA, 15 nt, Human
agucaccuucccuug

SEQ ID NO: 3783068 - RNA, 16 nt, Human
agucaccuucccuugc

SEQ ID NO: 3783069 - RNA, 18 nt, Human
agucaccuucccuugcca

SEQ ID NO: 3783070 - RNA, 21 nt, Human
agucacggcugcgcacugugu

SEQ ID NO: 3783071 - RNA, 18 nt, Human
agucacuaccuucaugca

SEQ ID NO: 3783072 - RNA, 20 nt, Human
agucacucuagucaaugaca

SEQ ID NO: 3783073 - RNA, 15 nt, Human
agucacugagacagc

SEQ ID NO: 3783074 - RNA, 19 nt, Human
agucacugagacagcccgg

SEQ ID NO: 3783075 - RNA, 13 nt, Human
agucacugcacag

SEQ ID NO: 3783076 - RNA, 21 nt, Human
agucacugcacguuuucaucu

SEQ ID NO: 3783077 - RNA, 21 nt, Human
agucacugccacuuugcacau

SEQ ID NO: 3783078 - RNA, 20 nt, Human
agucacugccucucccuggc

SEQ ID NO: 3783079 - RNA, 23 nt, Human
agucacuggagguugaagccaag

SEQ ID NO: 3783080 - RNA, 23 nt, Human
agucacuggucuguuugcauuug

SEQ ID NO: 3783081 - RNA, 16 nt, Human
agucacuuacuauugu

SEQ ID NO: 3783082 - RNA, 24 nt, Human
agucacuucgugggaucugccccu

SEQ ID NO: 3783083 - RNA, 23 nt, Human
agucacuugaugugccauuuuaa

SEQ ID NO: 3783084 - RNA, 17 nt, Human
agucacuuuuuuuuucc

SEQ ID NO: 3783085 - RNA, 13 nt, Human
agucagaaaacuu

SEQ ID NO: 3783086 - RNA, 15 nt, Human
agucagaaaacuuua

SEQ ID NO: 3783087 - RNA, 23 nt, Human
agucagaaaacuuuaaaaaauau

SEQ ID NO: 3783088 - RNA, 22 nt, Human
agucagaaguuucugccgcagc

SEQ ID NO: 3783089 - RNA, 16 nt, Human
agucagacagaugugg

SEQ ID NO: 3783090 - RNA, 15 nt, Human
agucagacugcuggg

SEQ ID NO: 3783091 - RNA, 23 nt, Human
agucagagccaugucuucucccu

SEQ ID NO: 3783092 - RNA, 18 nt, Human
agucagaggauggccagu

SEQ ID NO: 3783093 - RNA, 12 nt, Human
agucagauguuu

SEQ ID NO: 3783094 - RNA, 16 nt, Human
agucagauucuugcau

SEQ ID NO: 3783095 - RNA, 16 nt, Human
agucagccucgcaggc

SEQ ID NO: 3783096 - RNA, 23 nt, Human
agucagccuucccccucccaggg

SEQ ID NO: 3783097 - RNA, 14 nt, Human
agucagcucucugc

SEQ ID NO: 3783098 - RNA, 17 nt, Human
agucagcucuucaucug

SEQ ID NO: 3783099 - RNA, 22 nt, Human
agucagcucuucaucugcccaa

SEQ ID NO: 3783100 - RNA, 22 nt, Human
agucaggaguccaagaccagac

SEQ ID NO: 3783101 - RNA, 11 nt, Human
agucaggauga

SEQ ID NO: 3783102 - RNA, 22 nt, Human
agucaggccuuaauuuucagua

SEQ ID NO: 3783103 - RNA, 19 nt, Human
agucagggguucccuuuuu

SEQ ID NO: 3783104 - RNA, 19 nt, Human
agucaguaggacuccuuau

SEQ ID NO: 3783105 - RNA, 15 nt, Human
aggugcagccagagg

SEQ ID NO: 3783106 - RNA, 16 nt, Human
aggugcagccagaggc

SEQ ID NO: 3783107 - RNA, 17 nt, Human
aggugcagccagaggca

SEQ ID NO: 3783108 - RNA, 15 nt, Human
aggugcaggcaggcu

SEQ ID NO: 3783109 - RNA, 23 nt, Human
aggugcaguucccccaaccucag

SEQ ID NO: 3783110 - RNA, 20 nt, Human
aggugcauauuuauaaaaau

SEQ ID NO: 3783111 - RNA, 15 nt, Human
aggugccagcaacug

SEQ ID NO: 3783112 - RNA, 21 nt, Human
aggugccagcaacugaauaaa

SEQ ID NO: 3783113 - RNA, 21 nt, Human
aggugccagccugaggcagcc

SEQ ID NO: 3783114 - RNA, 20 nt, Human
aggugcccuuggaggccagc

SEQ ID NO: 3783115 - RNA, 22 nt, Human
aggugcccuuggaggccagcca

SEQ ID NO: 3783116 - RNA, 17 nt, Human
aggugccugucccaccc

SEQ ID NO: 3783117 - RNA, 18 nt, Human
aggugccugugaggcagg

SEQ ID NO: 3783118 - RNA, 11 nt, Human
aggugccuucu

SEQ ID NO: 3783119 - RNA, 16 nt, Human
aggugccuucuucagg

SEQ ID NO: 3783120 - RNA, 18 nt, Human
aggugccuucuucagggc

SEQ ID NO: 3783121 - RNA, 20 nt, Human
aggugccuucuucagggccu

SEQ ID NO: 3783122 - RNA, 17 nt, Human
aggugcuaauuuguuuu

SEQ ID NO: 3783123 - RNA, 24 nt, Human
aggugcuacaaaaacacagcaagg

SEQ ID NO: 3783124 - RNA, 18 nt, Human
aggugcucucuuucuguc

SEQ ID NO: 3783125 - RNA, 16 nt, Human
aggugcugccauccag

SEQ ID NO: 3783126 - RNA, 20 nt, Human
aggugcugcuacccucccug

SEQ ID NO: 3783127 - RNA, 22 nt, Human
aggugcugcuacccucccugcu

SEQ ID NO: 3783128 - RNA, 22 nt, Human
aggugcuggagcacugggcucc

SEQ ID NO: 3783129 - RNA, 14 nt, Human
aggugcuggaggug

SEQ ID NO: 3783130 - RNA, 17 nt, Human
aggugcuggagguggga

SEQ ID NO: 3783131 - RNA, 13 nt, Human
aggugcugggagg

SEQ ID NO: 3783132 - RNA, 22 nt, Human
aggugcuucuaguucugccagg

SEQ ID NO: 3783133 - RNA, 13 nt, Human
agguggaaaaaca

SEQ ID NO: 3783134 - RNA, 15 nt, Human
agguggaaauaaacu

SEQ ID NO: 3783135 - RNA, 15 nt, Human
aguguaugauuacug

SEQ ID NO: 3783136 - RNA, 19 nt, Human
aguguaugauuacuggccu

SEQ ID NO: 3783137 - RNA, 16 nt, Human
aguguaugucuuguau

SEQ ID NO: 3783138 - RNA, 21 nt, Human
aguguauuuuucaauaaagca

SEQ ID NO: 3783139 - RNA, 15 nt, Human
agugucaaauaaaca

SEQ ID NO: 3783140 - RNA, 19 nt, Human
agugucaaguugugcuugu

SEQ ID NO: 3783141 - RNA, 19 nt, Human
agugucacuuaccuagauu

SEQ ID NO: 3783142 - RNA, 17 nt, Human
aguguccaaagcagggu

SEQ ID NO: 3783143 - RNA, 21 nt, Human
aguguccaaagcagggucugg

SEQ ID NO: 3783144 - RNA, 21 nt, Human
aguguccauugacauguacag

SEQ ID NO: 3783145 - RNA, 22 nt, Human
aguguccauugacauguacaga

SEQ ID NO: 3783146 - RNA, 23 nt, Human
aguguccauugacauguacagag

SEQ ID NO: 3783147 - RNA, 22 nt, Human
aguguccauuuugugaagcccu

SEQ ID NO: 3783148 - RNA, 18 nt, Human
agugucccccacccccac

SEQ ID NO: 3783149 - RNA, 14 nt, Human
agugucccccaggu

SEQ ID NO: 3783150 - RNA, 13 nt, Human
aguguccccucca

SEQ ID NO: 3783151 - RNA, 19 nt, Human
aguguccuaugcaauaaaa

SEQ ID NO: 3783152 - RNA, 15 nt, Human
aguguccugagcuca

SEQ ID NO: 3783153 - RNA, 14 nt, Human
agugucuaaaaaca

SEQ ID NO: 3783154 - RNA, 15 nt, Human
agugucucacacugg

SEQ ID NO: 3783155 - RNA, 19 nt, Human
agugucucaguccaccuga

SEQ ID NO: 3783156 - RNA, 22 nt, Human
agugucucaguccaccugagcu

SEQ ID NO: 3783157 - RNA, 18 nt, Human
agugucugcuggagacau

SEQ ID NO: 3783158 - RNA, 21 nt, Human
agugucuggaauuguggcuau

SEQ ID NO: 3783159 - RNA, 18 nt, Human
agugucuggaucaguaaa

SEQ ID NO: 3783160 - RNA, 14 nt, Human
agugucugggcuga

SEQ ID NO: 3783161 - RNA, 22 nt, Human
agugucuguaucggagacagug

SEQ ID NO: 3783162 - RNA, 14 nt, Human
agugucuuccugug

SEQ ID NO: 3783163 - RNA, 23 nt, Human
agugucuuuccacggagccacuc

SEQ ID NO: 3783164 - RNA, 23 nt, Human
agugucuuucuuuggugccuuuc

SEQ ID NO: 3783165 - RNA, 17 nt, Human
agugucuuuuuuuguau

SEQ ID NO: 3783166 - RNA, 20 nt, Human
agugucuuuuuuuguauagu

SEQ ID NO: 3783167 - RNA, 14 nt, Human
agugugaacuggac

SEQ ID NO: 3783168 - RNA, 17 nt, Human
agugugaaguacaauaa

SEQ ID NO: 3783169 - RNA, 13 nt, Human
agugugaaguuag

SEQ ID NO: 3783170 - RNA, 22 nt, Human
agugugaaguuagaauuccuuc

SEQ ID NO: 3783171 - RNA, 14 nt, Human
agugugaauauaaa

SEQ ID NO: 3783172 - RNA, 18 nt, Human
agugugaauauaaaugug

SEQ ID NO: 3783173 - RNA, 16 nt, Human
agugugacagggccag

SEQ ID NO: 3783174 - RNA, 12 nt, Human
agugugagaauc

SEQ ID NO: 3783175 - RNA, 16 nt, Human
agugugagcagugagu

SEQ ID NO: 3783176 - RNA, 21 nt, Human
agugugagcagugaguuacag

SEQ ID NO: 3783177 - RNA, 16 nt, Human
agugugaguaagagcu

SEQ ID NO: 3783178 - RNA, 18 nt, Human
agugugaguaaucugaga

SEQ ID NO: 3783179 - RNA, 18 nt, Human
agugugauguauguguaa

SEQ ID NO: 3783180 - RNA, 22 nt, Human
agugugauguauguguaauaaa

SEQ ID NO: 3783181 - RNA, 23 nt, Human
agugugauguauguguaauaaau

SEQ ID NO: 3783182 - RNA, 20 nt, Human
agugugauugggaauaaaua

SEQ ID NO: 3783183 - RNA, 14 nt, Human
agugugcaaaauau

SEQ ID NO: 3783184 - RNA, 15 nt, Human
agugugcaaggcagc

SEQ ID NO: 3783185 - RNA, 17 nt, Human
agugugcaguaucugug

SEQ ID NO: 3783186 - RNA, 15 nt, Human
agugugccacaugga

SEQ ID NO: 3783187 - RNA, 14 nt, Human
agcccugaguuccu

SEQ ID NO: 3783188 - RNA, 18 nt, Human
agcccugaguuccuagcc

SEQ ID NO: 3783189 - RNA, 20 nt, Human
agcccugaguuccuagccac

SEQ ID NO: 3783190 - RNA, 21 nt, Human
agcccugauugcgcaaaacug

SEQ ID NO: 3783191 - RNA, 14 nt, Human
agcccugcagaggg

SEQ ID NO: 3783192 - RNA, 22 nt, Human
agcccugccucuccgccccuga

SEQ ID NO: 3783193 - RNA, 11 nt, Human
agcccugcucc

SEQ ID NO: 3783194 - RNA, 12 nt, Human
agcccugcuggc

SEQ ID NO: 3783195 - RNA, 16 nt, Human
agcccugcuggccgcc

SEQ ID NO: 3783196 - RNA, 17 nt, Human
agcccugcuggccgccu

SEQ ID NO: 3783197 - RNA, 21 nt, Human
agcccugcuggccgccucacc

SEQ ID NO: 3783198 - RNA, 21 nt, Human
agcccugcuuugggcugcccu

SEQ ID NO: 3783199 - RNA, 12 nt, Human
agcccuggagac

SEQ ID NO: 3783200 - RNA, 21 nt, Human
agcccuggagccaacugcugc

SEQ ID NO: 3783201 - RNA, 12 nt, Human
agcccuggaggu

SEQ ID NO: 3783202 - RNA, 21 nt, Human
agcccuggaggugccagcaaa

SEQ ID NO: 3783203 - RNA, 19 nt, Human
agcccuggagucaugccaa

SEQ ID NO: 3783204 - RNA, 12 nt, Human
agcccuggcagg

SEQ ID NO: 3783205 - RNA, 13 nt, Human
agcccuggcagga

SEQ ID NO: 3783206 - RNA, 16 nt, Human
agcccuggccagaggc

SEQ ID NO: 3783207 - RNA, 12 nt, Human
agcccuggcccc

SEQ ID NO: 3783208 - RNA, 15 nt, Human
agcccuggcucugca

SEQ ID NO: 3783209 - RNA, 13 nt, Human
agcccuggcugaa

SEQ ID NO: 3783210 - RNA, 14 nt, Human
agcccugggaccgc

SEQ ID NO: 3783211 - RNA, 18 nt, Human
agcccugggaucacugug

SEQ ID NO: 3783212 - RNA, 16 nt, Human
agcccugggccccacc

SEQ ID NO: 3783213 - RNA, 14 nt, Human
agcccuggucucag

SEQ ID NO: 3783214 - RNA, 17 nt, Human
agcccuggucucagcag

SEQ ID NO: 3783215 - RNA, 15 nt, Human
agcccugguggcagu

SEQ ID NO: 3783216 - RNA, 22 nt, Human
agcccugguggcagugggagcu

SEQ ID NO: 3783217 - RNA, 15 nt, Human
agcccuguaauuuuu

SEQ ID NO: 3783218 - RNA, 19 nt, Human
agcccugucagugcagccc

SEQ ID NO: 3783219 - RNA, 14 nt, Human
agcccuguccuggu

SEQ ID NO: 3783220 - RNA, 23 nt, Human
agcccuguccuggugguauuuuc

SEQ ID NO: 3783221 - RNA, 23 nt, Human
agcccugucgagacacuugccuu

SEQ ID NO: 3783222 - RNA, 14 nt, Human
agcccugucgggcu

SEQ ID NO: 3783223 - RNA, 18 nt, Human
agcccugucgggcuuugu

SEQ ID NO: 3783224 - RNA, 22 nt, Human
agcccugucgggcuuuguguga

SEQ ID NO: 3783225 - RNA, 18 nt, Human
agcccugucuccucucuc

SEQ ID NO: 3783226 - RNA, 17 nt, Human
agcccuguugacacagg

SEQ ID NO: 3783227 - RNA, 19 nt, Human
agcccuguugugccacaga

SEQ ID NO: 3783228 - RNA, 21 nt, Human
agcccuuagcagggaaacagc

SEQ ID NO: 3783229 - RNA, 22 nt, Human
agcccuuccaugucgccucugc

SEQ ID NO: 3783230 - RNA, 16 nt, Human
agcccuuccucugcuc

SEQ ID NO: 3783231 - RNA, 18 nt, Human
agcccuuccucugcuccc

SEQ ID NO: 3783232 - RNA, 19 nt, Human
agcccuuccucugcucccc

SEQ ID NO: 3783233 - RNA, 20 nt, Human
agcccuucuauacccaccca

SEQ ID NO: 3783234 - RNA, 19 nt, Human
agcccuucuuuccacagaa

SEQ ID NO: 3783235 - RNA, 20 nt, Human
agcccuugagcuccccaaaa

SEQ ID NO: 3783236 - RNA, 17 nt, Human
agcccuugcauugcaga

SEQ ID NO: 3783237 - RNA, 23 nt, Human
agcccuugccuccccauuuccca

SEQ ID NO: 3783238 - RNA, 11 nt, Human
agcccuuggcc

SEQ ID NO: 3783239 - RNA, 13 nt, Human
agcccuuucugug

SEQ ID NO: 3783240 - RNA, 18 nt, Human
agcccuuucugugugcac

SEQ ID NO: 3783241 - RNA, 16 nt, Human
agccgaccucagccuu

SEQ ID NO: 3783242 - RNA, 12 nt, Human
agccgacucugg

SEQ ID NO: 3783243 - RNA, 18 nt, Human
agccgacucuggcccugg

SEQ ID NO: 3783244 - RNA, 20 nt, Human
agccgacucuggcccuggcc

SEQ ID NO: 3783245 - RNA, 23 nt, Human
agccgacugcacagcggccccug

SEQ ID NO: 3783246 - RNA, 14 nt, Human
agccgagagccugc

SEQ ID NO: 3783247 - RNA, 18 nt, Human
agccgagagccugcuccc

SEQ ID NO: 3783248 - RNA, 20 nt, Human
agccgagauagccaaggcca

SEQ ID NO: 3783249 - RNA, 17 nt, Human
agccgagaucacgccac

SEQ ID NO: 3783250 - RNA, 20 nt, Human
agccgagaucacgccacugc

SEQ ID NO: 3783251 - RNA, 21 nt, Human
agccgagaucacgccacugca

SEQ ID NO: 3783252 - RNA, 19 nt, Human
agccgagauugcaccacug

SEQ ID NO: 3783253 - RNA, 16 nt, Human
agccgagccgggccug

SEQ ID NO: 3783254 - RNA, 16 nt, Human
agccgcaucuucucca

SEQ ID NO: 3783255 - RNA, 17 nt, Human
agccgcaucuucuccau

SEQ ID NO: 3783256 - RNA, 14 nt, Human
agccgccaggaccg

SEQ ID NO: 3783257 - RNA, 21 nt, Human
agccgccaggaccgccaaaga

SEQ ID NO: 3783258 - RNA, 17 nt, Human
agccgccaucagcccaa

SEQ ID NO: 3783259 - RNA, 21 nt, Human
agccgccauugccaccaggag

SEQ ID NO: 3783260 - RNA, 22 nt, Human
agccgccauugccaccaggaga

SEQ ID NO: 3783261 - RNA, 13 nt, Human
agccgcccaaggc

SEQ ID NO: 3783262 - RNA, 16 nt, Human
agccgcccaaggccuu

SEQ ID NO: 3783263 - RNA, 16 nt, Human
agccgccuucacagca

SEQ ID NO: 3783264 - RNA, 16 nt, Human
agccgcuccugucugc

SEQ ID NO: 3783265 - RNA, 12 nt, Human
agccgcucggag

SEQ ID NO: 3783266 - RNA, 19 nt, Human
agccgcugagcgaggagau

SEQ ID NO: 3783267 - RNA, 13 nt, Human
agccgcuggggcc

SEQ ID NO: 3783268 - RNA, 14 nt, Human
agccgcuggggcca

SEQ ID NO: 3783269 - RNA, 19 nt, Human
agccgcugugagccccugg

SEQ ID NO: 3783270 - RNA, 21 nt, Human
agccgcuuggcgaugccagcc

SEQ ID NO: 3783271 - RNA, 15 nt, Human
agccggcacaggguc

SEQ ID NO: 3783272 - RNA, 14 nt, Human
agccggccucucug

SEQ ID NO: 3783273 - RNA, 19 nt, Human
agccggccucucuggccuc

SEQ ID NO: 3783274 - RNA, 22 nt, Human
agccggccucucuggccuccca

SEQ ID NO: 3783275 - RNA, 13 nt, Human
agccggcggccca

SEQ ID NO: 3783276 - RNA, 18 nt, Human
agccggcggcccaagccc

SEQ ID NO: 3783277 - RNA, 19 nt, Human
agccggcguggcaaauaua

SEQ ID NO: 3783278 - RNA, 11 nt, Human
agccgggccgc

SEQ ID NO: 3783279 - RNA, 18 nt, Human
aguucaguggcagggcuc

SEQ ID NO: 3783280 - RNA, 23 nt, Human
aguucaguggcagggcucaggau

SEQ ID NO: 3783281 - RNA, 16 nt, Human
aguucaguuccucuuu

SEQ ID NO: 3783282 - RNA, 23 nt, Human
aguucaguuccucuuugcaugga

SEQ ID NO: 3783283 - RNA, 24 nt, Human
aguucaguuccucuuugcauggaa

SEQ ID NO: 3783284 - RNA, 15 nt, Human
aguucauacauugua

SEQ ID NO: 3783285 - RNA, 14 nt, Human
aguucauacccugu

SEQ ID NO: 3783286 - RNA, 12 nt, Human
aguucauacuug

SEQ ID NO: 3783287 - RNA, 18 nt, Human
aguucauauguaccaugu

SEQ ID NO: 3783288 - RNA, 22 nt, Human
aguucauauguaccauguacau

SEQ ID NO: 3783289 - RNA, 19 nt, Human
aguucauauuccauauuua

SEQ ID NO: 3783290 - RNA, 20 nt, Human
aguucauccaauccucacug

SEQ ID NO: 3783291 - RNA, 18 nt, Human
aguucaucgauuuucuau

SEQ ID NO: 3783292 - RNA, 15 nt, Human
aguucaucuugaauu

SEQ ID NO: 3783293 - RNA, 19 nt, Human
aguucaucuugaauuguaa

SEQ ID NO: 3783294 - RNA, 21 nt, Human
aguucaugagaaucuauauuu

SEQ ID NO: 3783295 - RNA, 14 nt, Human
aguucauguaaaua

SEQ ID NO: 3783296 - RNA, 16 nt, Human
aguucaugucugcuau

SEQ ID NO: 3783297 - RNA, 17 nt, Human
aguucauguuugcuuca

SEQ ID NO: 3783298 - RNA, 14 nt, Human
aguuccacagauug

SEQ ID NO: 3783299 - RNA, 21 nt, Human
aguuccacagauuguuucuau

SEQ ID NO: 3783300 - RNA, 21 nt, Human
aguuccaccaucaagccacca

SEQ ID NO: 3783301 - RNA, 14 nt, Human
aguuccagaagugu

SEQ ID NO: 3783302 - RNA, 18 nt, Human
aguuccagaagugugacu

SEQ ID NO: 3783303 - RNA, 14 nt, Human
aguucccaagaaag

SEQ ID NO: 3783304 - RNA, 23 nt, Human
aguucccaagaaaggaaaccuuu

SEQ ID NO: 3783305 - RNA, 17 nt, Human
aguucccacauuaaaga

SEQ ID NO: 3783306 - RNA, 13 nt, Human
aguucccagaauc

SEQ ID NO: 3783307 - RNA, 15 nt, Human
aguucccagaaucaa

SEQ ID NO: 3783308 - RNA, 18 nt, Human
aguucccaguuggagcuc

SEQ ID NO: 3783309 - RNA, 15 nt, Human
aguucccauguuaaa

SEQ ID NO: 3783310 - RNA, 17 nt, Human
aguuccccaugcagaca

SEQ ID NO: 3783311 - RNA, 22 nt, Human
aguuccccuggaagcagugccc

SEQ ID NO: 3783312 - RNA, 18 nt, Human
aguuccccuguuuauuca

SEQ ID NO: 3783313 - RNA, 19 nt, Human
aguuccccuguuuauucau

SEQ ID NO: 3783314 - RNA, 20 nt, Human
aguuccccuguuuauucaua

SEQ ID NO: 3783315 - RNA, 17 nt, Human
aguucccuacuuccugu

SEQ ID NO: 3783316 - RNA, 17 nt, Human
aguucccucugcucagc

SEQ ID NO: 3783317 - RNA, 20 nt, Human
aguucccucugcucagccaa

SEQ ID NO: 3783318 - RNA, 14 nt, Human
aguucccugaaaac

SEQ ID NO: 3783319 - RNA, 24 nt, Human
aguucccugaaaacccagagagga

SEQ ID NO: 3783320 - RNA, 16 nt, Human
aguucccuuggccuca

SEQ ID NO: 3783321 - RNA, 15 nt, Human
aguuccuaagaagcu

SEQ ID NO: 3783322 - RNA, 16 nt, Human
aguuccuaagaagcuu

SEQ ID NO: 3783323 - RNA, 17 nt, Human
aguuccuagccaccgcc

SEQ ID NO: 3783324 - RNA, 23 nt, Human
aguuccucauuagcauuuugcua

SEQ ID NO: 3783325 - RNA, 17 nt, Human
aguuccucgcccugggu

SEQ ID NO: 3783326 - RNA, 14 nt, Human
aguuccucuuuugu

SEQ ID NO: 3783327 - RNA, 13 nt, Human
aguuccugcuaaa

SEQ ID NO: 3783328 - RNA, 20 nt, Human
aguuccugucccuucucuua

SEQ ID NO: 3783329 - RNA, 16 nt, Human
aguuccugugcacagc

SEQ ID NO: 3783330 - RNA, 17 nt, Human
aguuccugugcacagcc

SEQ ID NO: 3783331 - RNA, 17 nt, Human
aguuccuguggcucccu

SEQ ID NO: 3783332 - RNA, 18 nt, Human
aguucgagaccaaccuga

SEQ ID NO: 3783333 - RNA, 17 nt, Human
aguucgcagccacccug

SEQ ID NO: 3783334 - RNA, 23 nt, Human
aguucuaacagugaaguuuuacu

SEQ ID NO: 3783335 - RNA, 19 nt, Human
aguucuaagauucuaauga

SEQ ID NO: 3783336 - RNA, 17 nt, Human
aguucuaauaauuucua

SEQ ID NO: 3783337 - RNA, 20 nt, Human
aguucuaauaauuucuaaug

SEQ ID NO: 3783338 - RNA, 14 nt, Human
aguucuaccggcuu

SEQ ID NO: 3783339 - RNA, 20 nt, Human
aguucuaccucaggcagcuc

SEQ ID NO: 3783340 - RNA, 22 nt, Human
aguucuaccucaggcagcucaa

SEQ ID NO: 3783341 - RNA, 22 nt, Human
aguucuacuauggcugaguucu

SEQ ID NO: 3783342 - RNA, 21 nt, Human
aguucuagacauggagguucu

SEQ ID NO: 3783343 - RNA, 15 nt, Human
aguucuagagaagag

SEQ ID NO: 3783344 - RNA, 20 nt, Human
aguucuagagaagaggcugg

SEQ ID NO: 3783345 - RNA, 18 nt, Human
aguucuagugcagcugaa

SEQ ID NO: 3783346 - RNA, 22 nt, Human
aguucuagugcagcugaaauug

SEQ ID NO: 3783347 - RNA, 23 nt, Human
aguucuagugcagcugaaauuga

SEQ ID NO: 3783348 - RNA, 16 nt, Human
aguucuaguuugcauu

SEQ ID NO: 3783349 - RNA, 17 nt, Human
aguucuaguuugcauuc

SEQ ID NO: 3783350 - RNA, 20 nt, Human
aguucuauacuguaaagcgc

SEQ ID NO: 3783351 - RNA, 23 nt, Human
aguucuauuuauuugugagacug

SEQ ID NO: 3783352 - RNA, 15 nt, Human
aguucucaaugugaa

SEQ ID NO: 3783353 - RNA, 18 nt, Human
aguucucacuguucccuc

SEQ ID NO: 3783354 - RNA, 15 nt, Human
aguucucagggcucc

SEQ ID NO: 3783355 - RNA, 18 nt, Human
aguucucagggcuccugc

SEQ ID NO: 3783356 - RNA, 13 nt, Human
aguucucuccuuc

SEQ ID NO: 3783357 - RNA, 15 nt, Human
agucugaacagcugu

SEQ ID NO: 3783358 - RNA, 16 nt, Human
agucugaacagcugua

SEQ ID NO: 3783359 - RNA, 12 nt, Human
agucugaaggcu

SEQ ID NO: 3783360 - RNA, 16 nt, Human
agucugaaggcugggu

SEQ ID NO: 3783361 - RNA, 17 nt, Human
agucugaaggcuggguu

SEQ ID NO: 3783362 - RNA, 17 nt, Human
agucugaaguuucauuu

SEQ ID NO: 3783363 - RNA, 21 nt, Human
agucugagggcuuguaguucu

SEQ ID NO: 3783364 - RNA, 22 nt, Human
agucugagguccugagcacugc

SEQ ID NO: 3783365 - RNA, 15 nt, Human
agucugauccaggag

SEQ ID NO: 3783366 - RNA, 16 nt, Human
agucugauucccaagc

SEQ ID NO: 3783367 - RNA, 18 nt, Human
agucugauucccaagcuc

SEQ ID NO: 3783368 - RNA, 21 nt, Human
agucugcagauagaaagcauu

SEQ ID NO: 3783369 - RNA, 13 nt, Human
agucugcauuaca

SEQ ID NO: 3783370 - RNA, 23 nt, Human
agucugcgucucugcuuuaaagu

SEQ ID NO: 3783371 - RNA, 23 nt, Human
agucugcucuagaugagcugggc

SEQ ID NO: 3783372 - RNA, 13 nt, Human
agucugcugcccu

SEQ ID NO: 3783373 - RNA, 22 nt, Human
agucuggcccuagacucggggu

SEQ ID NO: 3783374 - RNA, 19 nt, Human
agucuggcuguacccagga

SEQ ID NO: 3783375 - RNA, 22 nt, Human
agucugggacacaaaacuccgc

SEQ ID NO: 3783376 - RNA, 14 nt, Human
agucugggcugccg

SEQ ID NO: 3783377 - RNA, 16 nt, Human
agucugggcugccggg

SEQ ID NO: 3783378 - RNA, 17 nt, Human
agucuggggaccagcuu

SEQ ID NO: 3783379 - RNA, 15 nt, Human
agucugguuucuaga

SEQ ID NO: 3783380 - RNA, 20 nt, Human
agucugguuucuagacuugu

SEQ ID NO: 3783381 - RNA, 15 nt, Human
agucuguccaggcuc

SEQ ID NO: 3783382 - RNA, 15 nt, Human
agucugucucuguca

SEQ ID NO: 3783383 - RNA, 16 nt, Human
agucugucuuuccuga

SEQ ID NO: 3783384 - RNA, 21 nt, Human
agucugugagauucauucaug

SEQ ID NO: 3783385 - RNA, 20 nt, Human
agucugugccacguguuugu

SEQ ID NO: 3783386 - RNA, 16 nt, Human
agucugugccuggagc

SEQ ID NO: 3783387 - RNA, 21 nt, Human
agucugugccuggagcuccug

SEQ ID NO: 3783388 - RNA, 22 nt, Human
agucugugccuggagcuccugg

SEQ ID NO: 3783389 - RNA, 11 nt, Human
agucugugugc

SEQ ID NO: 3783390 - RNA, 18 nt, Human
agucugugugggacugua

SEQ ID NO: 3783391 - RNA, 22 nt, Human
agucugugugggacuguacaca

SEQ ID NO: 3783392 - RNA, 16 nt, Human
agucuguucugguaau

SEQ ID NO: 3783393 - RNA, 15 nt, Human
agucuguuuuguaaa

SEQ ID NO: 3783394 - RNA, 17 nt, Human
agucuuaacauuucuaa

SEQ ID NO: 3783395 - RNA, 14 nt, Human
agucuuaacugguc

SEQ ID NO: 3783396 - RNA, 18 nt, Human
agucuuacuacagaaaug

SEQ ID NO: 3783397 - RNA, 19 nt, Human
agucuuacuacagaaauga

SEQ ID NO: 3783398 - RNA, 21 nt, Human
agucuuagaucauaguuuuau

SEQ ID NO: 3783399 - RNA, 15 nt, Human
agucuuaucaagcag

SEQ ID NO: 3783400 - RNA, 21 nt, Human
agucuuaucugagcugagcca

SEQ ID NO: 3783401 - RNA, 22 nt, Human
agucuuaucugagcugagccag

SEQ ID NO: 3783402 - RNA, 17 nt, Human
agucuuaugcuuccaga

SEQ ID NO: 3783403 - RNA, 16 nt, Human
agucuucaagggcugc

SEQ ID NO: 3783404 - RNA, 20 nt, Human
agucuucaagggcugcuuca

SEQ ID NO: 3783405 - RNA, 20 nt, Human
agucuucaguuugcagagua

SEQ ID NO: 3783406 - RNA, 21 nt, Human
agucuucaguuugcagaguag

SEQ ID NO: 3783407 - RNA, 14 nt, Human
agucuucaugaaau

SEQ ID NO: 3783408 - RNA, 18 nt, Human
agucuucauguucccacu

SEQ ID NO: 3783409 - RNA, 14 nt, Human
agucuuccaaacca

SEQ ID NO: 3783410 - RNA, 19 nt, Human
agucuuccacaaagaaaau

SEQ ID NO: 3783411 - RNA, 20 nt, Human
agucuuccacaaagaaaauu

SEQ ID NO: 3783412 - RNA, 18 nt, Human
agucuucccuagggcugg

SEQ ID NO: 3783413 - RNA, 16 nt, Human
agucuuccugacacuu

SEQ ID NO: 3783414 - RNA, 17 nt, Human
agucuuccugacacuuu

SEQ ID NO: 3783415 - RNA, 14 nt, Human
agucuucuauuuau

SEQ ID NO: 3783416 - RNA, 21 nt, Human
agucuugcuaccucagucagu

SEQ ID NO: 3783417 - RNA, 20 nt, Human
agucuugcuguggucucuuu

SEQ ID NO: 3783418 - RNA, 21 nt, Human
agucuugcuguggucucuuug

SEQ ID NO: 3783419 - RNA, 23 nt, Human
agucuugcuguggucucuuugug

SEQ ID NO: 3783420 - RNA, 22 nt, Human
agucuuggcggcagcagccauc

SEQ ID NO: 3783421 - RNA, 17 nt, Human
agucuugugacuagugc

SEQ ID NO: 3783422 - RNA, 23 nt, Human
agcuccacucugcuucucugacu

SEQ ID NO: 3783423 - RNA, 24 nt, Human
agcuccacucugcuucucugacuu

SEQ ID NO: 3783424 - RNA, 14 nt, Human
agcuccagaccccc

SEQ ID NO: 3783425 - RNA, 16 nt, Human
agcuccagacccccag

SEQ ID NO: 3783426 - RNA, 14 nt, Human
agcuccagccccuu

SEQ ID NO: 3783427 - RNA, 18 nt, Human
agcuccagccccuuucca

SEQ ID NO: 3783428 - RNA, 20 nt, Human
agcuccagccccuuuccaaa

SEQ ID NO: 3783429 - RNA, 16 nt, Human
agcuccagccugacau

SEQ ID NO: 3783430 - RNA, 13 nt, Human
agcuccagcucac

SEQ ID NO: 3783431 - RNA, 18 nt, Human
agcuccagcucaccagcc

SEQ ID NO: 3783432 - RNA, 21 nt, Human
agcuccagggaauccaagccu

SEQ ID NO: 3783433 - RNA, 13 nt, Human
agcuccagggcca

SEQ ID NO: 3783434 - RNA, 14 nt, Human
agcuccaguggaag

SEQ ID NO: 3783435 - RNA, 19 nt, Human
agcuccaguggaagaagaa

SEQ ID NO: 3783436 - RNA, 16 nt, Human
agcuccaguguccuga

SEQ ID NO: 3783437 - RNA, 21 nt, Human
agcuccaguguccugagcuca

SEQ ID NO: 3783438 - RNA, 23 nt, Human
agcuccaguguccugagcucagc

SEQ ID NO: 3783439 - RNA, 13 nt, Human
agcuccaguucga

SEQ ID NO: 3783440 - RNA, 20 nt, Human
agcuccauacacacgcugcc

SEQ ID NO: 3783441 - RNA, 18 nt, Human
agcucccaagggauggug

SEQ ID NO: 3783442 - RNA, 22 nt, Human
agcucccaagggauggugcccu

SEQ ID NO: 3783443 - RNA, 16 nt, Human
agcucccacaagccuc

SEQ ID NO: 3783444 - RNA, 17 nt, Human
agcucccacaagccuga

SEQ ID NO: 3783445 - RNA, 13 nt, Human
agcucccacccca

SEQ ID NO: 3783446 - RNA, 17 nt, Human
agcucccaccccacccc

SEQ ID NO: 3783447 - RNA, 23 nt, Human
agcucccaccccacccccuucag

SEQ ID NO: 3783448 - RNA, 11 nt, Human
agcucccaccu

SEQ ID NO: 3783449 - RNA, 19 nt, Human
agcucccaccuccccuugg

SEQ ID NO: 3783450 - RNA, 14 nt, Human
agcucccaggaaca

SEQ ID NO: 3783451 - RNA, 16 nt, Human
agcucccauuucuacu

SEQ ID NO: 3783452 - RNA, 16 nt, Human
agcucccccagcuccc

SEQ ID NO: 3783453 - RNA, 14 nt, Human
agcuccccccaccu

SEQ ID NO: 3783454 - RNA, 23 nt, Human
agcucccccucccccacugccau

SEQ ID NO: 3783455 - RNA, 19 nt, Human
agcucccccuguccccuca

SEQ ID NO: 3783456 - RNA, 14 nt, Human
agcuccccucccca

SEQ ID NO: 3783457 - RNA, 15 nt, Human
agcuccccuccccaa

SEQ ID NO: 3783458 - RNA, 17 nt, Human
agcuccccucggagaag

SEQ ID NO: 3783459 - RNA, 19 nt, Human
agcuccccucggagaagag

SEQ ID NO: 3783460 - RNA, 22 nt, Human
agcuccccucggagaagagcug

SEQ ID NO: 3783461 - RNA, 18 nt, Human
agcucccgcuccgggcuc

SEQ ID NO: 3783462 - RNA, 15 nt, Human
agcucccuaggagac

SEQ ID NO: 3783463 - RNA, 17 nt, Human
agcucccuaggagacca

SEQ ID NO: 3783464 - RNA, 13 nt, Human
agcucccucugcc

SEQ ID NO: 3783465 - RNA, 13 nt, Human
agcucccugcccc

SEQ ID NO: 3783466 - RNA, 18 nt, Human
agcucccuggcuucugug

SEQ ID NO: 3783467 - RNA, 23 nt, Human
agcucccuggcuucuguggggcc

SEQ ID NO: 3783468 - RNA, 16 nt, Human
agcucccuucuucccu

SEQ ID NO: 3783469 - RNA, 17 nt, Human
agcuccgccucccgggu

SEQ ID NO: 3783470 - RNA, 19 nt, Human
agcuccggcguguguucag

SEQ ID NO: 3783471 - RNA, 15 nt, Human
agcuccguggagcag

SEQ ID NO: 3783472 - RNA, 17 nt, Human
agcuccuagcagagaga

SEQ ID NO: 3783473 - RNA, 16 nt, Human
agcuccucaacucacc

SEQ ID NO: 3783474 - RNA, 14 nt, Human
agcuccucacugug

SEQ ID NO: 3783475 - RNA, 11 nt, Human
agcuccucccc

SEQ ID NO: 3783476 - RNA, 13 nt, Human
agcuccuccccuu

SEQ ID NO: 3783477 - RNA, 13 nt, Human
agcuccucccucu

SEQ ID NO: 3783478 - RNA, 16 nt, Human
agcuccuccucccugc

SEQ ID NO: 3783479 - RNA, 23 nt, Human
agcuccuccucccugcaucugac

SEQ ID NO: 3783480 - RNA, 20 nt, Human
agcuccuccucggaaccgcu

SEQ ID NO: 3783481 - RNA, 21 nt, Human
agcuccuccuugucuuggcag

SEQ ID NO: 3783482 - RNA, 21 nt, Human
agcuccucuccccagcccaga

SEQ ID NO: 3783483 - RNA, 24 nt, Human
agcuccucuccccagcccagagac

SEQ ID NO: 3783484 - RNA, 13 nt, Human
agcuccucuccug

SEQ ID NO: 3783485 - RNA, 14 nt, Human
agcuccucuccugg

SEQ ID NO: 3783486 - RNA, 12 nt, Human
agcuccucuguc

SEQ ID NO: 3783487 - RNA, 15 nt, Human
agcuccucuguccug

SEQ ID NO: 3783488 - RNA, 21 nt, Human
agcuccucuguccugcuucug

SEQ ID NO: 3783489 - RNA, 24 nt, Human
agcuccucugucucgagcgcccug

SEQ ID NO: 3783490 - RNA, 18 nt, Human
agcuccucuuccaugcug

SEQ ID NO: 3783491 - RNA, 15 nt, Human
agcuccugaccaguu

SEQ ID NO: 3783492 - RNA, 19 nt, Human
agcuccugaccaguugcag

SEQ ID NO: 3783493 - RNA, 23 nt, Human
agcuccugcuccacagccauccc

SEQ ID NO: 3783494 - RNA, 18 nt, Human
agcuccuguccccugcua

SEQ ID NO: 3783495 - RNA, 24 nt, Human
agcuccuguccccugcuacaccua

SEQ ID NO: 3783496 - RNA, 12 nt, Human
agcuccuguccu

SEQ ID NO: 3783497 - RNA, 12 nt, Human
agcuccuguggc

SEQ ID NO: 3783498 - RNA, 13 nt, Human
agcuccuguggcc

SEQ ID NO: 3783499 - RNA, 12 nt, Human
agcuccuucugu

SEQ ID NO: 3783500 - RNA, 23 nt, Human
agcuccuucuguccuacucugug

SEQ ID NO: 3783501 - RNA, 21 nt, Human
agcuccuugggaggaagcaga

SEQ ID NO: 3783502 - RNA, 19 nt, Human
agcucgaauuaagaauaug

SEQ ID NO: 3783503 - RNA, 23 nt, Human
agcucgauguggucacagcugua

SEQ ID NO: 3783504 - RNA, 14 nt, Human
agcucgcacccccc

SEQ ID NO: 3783505 - RNA, 13 nt, Human
agcucgcuaaagu

SEQ ID NO: 3783506 - RNA, 16 nt, Human
agcucggggagccuua

SEQ ID NO: 3783507 - RNA, 15 nt, Human
agcucgguacccggg

SEQ ID NO: 3783508 - RNA, 15 nt, Human
agcucgguggaccca

SEQ ID NO: 3783509 - RNA, 19 nt, Human
agcucgguggacccaggga

SEQ ID NO: 3783510 - RNA, 17 nt, Human
agcucuaauguuugcau

SEQ ID NO: 3783511 - RNA, 20 nt, Human
agcucuaauguuugcauaua

SEQ ID NO: 3783512 - RNA, 22 nt, Human
agcucuaauguuugcauauaag

SEQ ID NO: 3783513 - RNA, 13 nt, Human
agcucuacccagg

SEQ ID NO: 3783514 - RNA, 15 nt, Human
agcucuacccagggc

SEQ ID NO: 3783515 - RNA, 21 nt, Human
agcucuacccagggccugcag

SEQ ID NO: 3783516 - RNA, 15 nt, Human
agcucuagaaucugc

SEQ ID NO: 3783517 - RNA, 16 nt, Human
agcucuagacaacccu

SEQ ID NO: 3783518 - RNA, 22 nt, Human
agcucuauguuuacaaauggac

SEQ ID NO: 3783519 - RNA, 22 nt, Human
agcucucaugcugccccugccu

SEQ ID NO: 3783520 - RNA, 14 nt, Human
agcucuccagcucc

SEQ ID NO: 3783521 - RNA, 17 nt, Human
agcucuccagcuccaag

SEQ ID NO: 3783522 - RNA, 13 nt, Human
agcucucccucug

SEQ ID NO: 3783523 - RNA, 14 nt, Human
agcucucccucugg

SEQ ID NO: 3783524 - RNA, 15 nt, Human
agcucucccucuggc

SEQ ID NO: 3783525 - RNA, 17 nt, Human
agcucucccucuggccc

SEQ ID NO: 3783526 - RNA, 18 nt, Human
agcucucccucuggcccu

SEQ ID NO: 3783527 - RNA, 19 nt, Human
agcucucccucuggcccug

SEQ ID NO: 3783528 - RNA, 23 nt, Human
agcucucccucuggcccugccuu

SEQ ID NO: 3783529 - RNA, 18 nt, Human
agcucuccggucucucuc

SEQ ID NO: 3783530 - RNA, 13 nt, Human
agcucucugcccu

SEQ ID NO: 3783531 - RNA, 17 nt, Human
agcucucuguauaaaca

SEQ ID NO: 3783532 - RNA, 18 nt, Human
agcucugaaaccaguguu

SEQ ID NO: 3783533 - RNA, 19 nt, Human
agcucugaaaccaguguua

SEQ ID NO: 3783534 - RNA, 16 nt, Human
agcucugaaagagaaa

SEQ ID NO: 3783535 - RNA, 16 nt, Human
agcucugaaaucuucc

SEQ ID NO: 3783536 - RNA, 22 nt, Human
agcucugaagaacucucuggaa

SEQ ID NO: 3783537 - RNA, 23 nt, Human
agcucugaagucacaucacagga

SEQ ID NO: 3783538 - RNA, 21 nt, Human
agcucugaccacuugaggccu

SEQ ID NO: 3783539 - RNA, 17 nt, Human
agcucugagaggcccug

SEQ ID NO: 3783540 - RNA, 18 nt, Human
agcucugagaggcccugg

SEQ ID NO: 3783541 - RNA, 19 nt, Human
agcucugagaggcccugga

SEQ ID NO: 3783542 - RNA, 12 nt, Human
agcucugagcug

SEQ ID NO: 3783543 - RNA, 13 nt, Human
agcucugagcugu

SEQ ID NO: 3783544 - RNA, 22 nt, Human
agcucugcagagcaggaaacau

SEQ ID NO: 3783545 - RNA, 19 nt, Human
agcucugcaucuccugucu

SEQ ID NO: 3783546 - RNA, 19 nt, Human
agcucugccgucucuggag

SEQ ID NO: 3783547 - RNA, 20 nt, Human
agcucugccgucucuggagc

SEQ ID NO: 3783548 - RNA, 11 nt, Human
agcucugccuu

SEQ ID NO: 3783549 - RNA, 22 nt, Human
agcucugcuugccgaaacugga

SEQ ID NO: 3783550 - RNA, 17 nt, Human
agcucuggacagcccca

SEQ ID NO: 3783551 - RNA, 17 nt, Human
agcucuggagccaccug

SEQ ID NO: 3783552 - RNA, 18 nt, Human
agcucuggcugaacccug

SEQ ID NO: 3783553 - RNA, 20 nt, Human
agcucuggcuuccagaaaac

SEQ ID NO: 3783554 - RNA, 23 nt, Human
agcucuguaucaggacccagagg

SEQ ID NO: 3783555 - RNA, 16 nt, Human
agcucuguccugggag

SEQ ID NO: 3783556 - RNA, 12 nt, Human
agcucugucugu

SEQ ID NO: 3783557 - RNA, 16 nt, Human
agcucuguguugccau

SEQ ID NO: 3783558 - RNA, 17 nt, Human
agcucuguucuuccuca

SEQ ID NO: 3783559 - RNA, 23 nt, Human
agcucuguucuuccucagccagc

SEQ ID NO: 3783560 - RNA, 20 nt, Human
agcucuuaauuguucauuuu

SEQ ID NO: 3783561 - RNA, 15 nt, Human
agcucuucaggccuc

SEQ ID NO: 3783562 - RNA, 17 nt, Human
agcucuucaucugccca

SEQ ID NO: 3783563 - RNA, 18 nt, Human
agcucuucaucugcccaa

SEQ ID NO: 3783564 - RNA, 19 nt, Human
agcucuucaucugcccaac

SEQ ID NO: 3783565 - RNA, 14 nt, Human
agcucuuccuagcu

SEQ ID NO: 3783566 - RNA, 22 nt, Human
agcucuuccuaucccucuccua

SEQ ID NO: 3783567 - RNA, 15 nt, Human
auaaaagauacauuu

SEQ ID NO: 3783568 - RNA, 18 nt, Human
auaaaagauacauuugua

SEQ ID NO: 3783569 - RNA, 20 nt, Human
auaaaagaugaaagagcagu

SEQ ID NO: 3783570 - RNA, 21 nt, Human
auaaaagauggggucuguaaa

SEQ ID NO: 3783571 - RNA, 19 nt, Human
auaaaagcaauuccaaccu

SEQ ID NO: 3783572 - RNA, 20 nt, Human
auaaaagcagcaucugcuaa

SEQ ID NO: 3783573 - RNA, 16 nt, Human
auaaaagcccaggagc

SEQ ID NO: 3783574 - RNA, 13 nt, Human
auaaaagccuguu

SEQ ID NO: 3783575 - RNA, 19 nt, Human
auaaaagccuguuuaagag

SEQ ID NO: 3783576 - RNA, 15 nt, Human
auaaaagcuauggug

SEQ ID NO: 3783577 - RNA, 22 nt, Human
auaaaagcugaaguuacuuuau

SEQ ID NO: 3783578 - RNA, 12 nt, Human
auaaaaggaaaa

SEQ ID NO: 3783579 - RNA, 20 nt, Human
auaaaaggaagccaaagagu

SEQ ID NO: 3783580 - RNA, 20 nt, Human
auaaaaggcaaauguguaca

SEQ ID NO: 3783581 - RNA, 19 nt, Human
auaaaaggugucuuucccu

SEQ ID NO: 3783582 - RNA, 17 nt, Human
auaaaagugaucaauaa

SEQ ID NO: 3783583 - RNA, 22 nt, Human
auaaaagugaucaauaaaaugu

SEQ ID NO: 3783584 - RNA, 21 nt, Human
auaaaagugauuguuggcaca

SEQ ID NO: 3783585 - RNA, 13 nt, Human
auaaaauaaagua

SEQ ID NO: 3783586 - RNA, 14 nt, Human
auaaaauaaaguau

SEQ ID NO: 3783587 - RNA, 16 nt, Human
auaaaauaaaguauau

SEQ ID NO: 3783588 - RNA, 19 nt, Human
auaaaauaacuaaaaugua

SEQ ID NO: 3783589 - RNA, 15 nt, Human
auaaaauaauucuaa

SEQ ID NO: 3783590 - RNA, 16 nt, Human
auaaaauaauucuaaa

SEQ ID NO: 3783591 - RNA, 17 nt, Human
auaaaauacauagugaa

SEQ ID NO: 3783592 - RNA, 22 nt, Human
auaaaauagauauaaauuuuua

SEQ ID NO: 3783593 - RNA, 18 nt, Human
auaaaauaguaugaaaau

SEQ ID NO: 3783594 - RNA, 18 nt, Human
auaaaauaguuguccaua

SEQ ID NO: 3783595 - RNA, 15 nt, Human
auaaaauauaaacaa

SEQ ID NO: 3783596 - RNA, 15 nt, Human
auaaaauauaauugu

SEQ ID NO: 3783597 - RNA, 20 nt, Human
auaaaauaucauucagcaac

SEQ ID NO: 3783598 - RNA, 14 nt, Human
auaaaauauuuucu

SEQ ID NO: 3783599 - RNA, 23 nt, Human
auaaaauauuuucuguguguucc

SEQ ID NO: 3783600 - RNA, 16 nt, Human
auaaaaucaaguuuua

SEQ ID NO: 3783601 - RNA, 20 nt, Human
auaaaaucaauuuuuaggaa

SEQ ID NO: 3783602 - RNA, 23 nt, Human
auaaaaucagccaauuauguuaa

SEQ ID NO: 3783603 - RNA, 12 nt, Human
auaaaaucauaa

SEQ ID NO: 3783604 - RNA, 15 nt, Human
auaaaaucauaagua

SEQ ID NO: 3783605 - RNA, 21 nt, Human
auaaaauccuaagacacaaau

SEQ ID NO: 3783606 - RNA, 16 nt, Human
auaaaauccugugcaa

SEQ ID NO: 3783607 - RNA, 17 nt, Human
auaaaaucugauaugua

SEQ ID NO: 3783608 - RNA, 18 nt, Human
auaaaaugaaaauuguau

SEQ ID NO: 3783609 - RNA, 19 nt, Human
auaaaaugcuagguucuac

SEQ ID NO: 3783610 - RNA, 22 nt, Human
auaaaauggcaacaaacugcac

SEQ ID NO: 3783611 - RNA, 22 nt, Human
auaaaaugguguuuucauguaa

SEQ ID NO: 3783612 - RNA, 16 nt, Human
auaaaauguaaacugu

SEQ ID NO: 3783613 - RNA, 18 nt, Human
auaaaauguaaacuguuu

SEQ ID NO: 3783614 - RNA, 11 nt, Human
auaaaauguac

SEQ ID NO: 3783615 - RNA, 15 nt, Human
auaaaaugucuucaa

SEQ ID NO: 3783616 - RNA, 13 nt, Human
auaaaaugugauu

SEQ ID NO: 3783617 - RNA, 11 nt, Human
auaaaaugugc

SEQ ID NO: 3783618 - RNA, 17 nt, Human
auaaaauguugaaaagu

SEQ ID NO: 3783619 - RNA, 17 nt, Human
auaaaauuaaagaaaau

SEQ ID NO: 3783620 - RNA, 21 nt, Human
auaaaauuaaagaaaauaaaa

SEQ ID NO: 3783621 - RNA, 13 nt, Human
auaaaauuaagaa

SEQ ID NO: 3783622 - RNA, 16 nt, Human
auaaaauuagaaagca

SEQ ID NO: 3783623 - RNA, 20 nt, Human
auaaaauuauagaugggaau

SEQ ID NO: 3783624 - RNA, 23 nt, Human
auaaaauuauagaugggaaugaa

SEQ ID NO: 3783625 - RNA, 13 nt, Human
auaaaauuauucc

SEQ ID NO: 3783626 - RNA, 20 nt, Human
auaccaaaauguugcugaaa

SEQ ID NO: 3783627 - RNA, 18 nt, Human
auaccaaaauuauuucag

SEQ ID NO: 3783628 - RNA, 18 nt, Human
auaccaaagcacauuuua

SEQ ID NO: 3783629 - RNA, 24 nt, Human
auaccaaauagcuucuguuuuguu

SEQ ID NO: 3783630 - RNA, 17 nt, Human
auaccaaauuaaaaaaa

SEQ ID NO: 3783631 - RNA, 17 nt, Human
auaccaaggaacaggaa

SEQ ID NO: 3783632 - RNA, 19 nt, Human
auaccaaguugauacuuga

SEQ ID NO: 3783633 - RNA, 13 nt, Human
auaccaauaaagu

SEQ ID NO: 3783634 - RNA, 21 nt, Human
auaccaaugaaaaaauguaua

SEQ ID NO: 3783635 - RNA, 22 nt, Human
auaccacaggaaccacaagacu

SEQ ID NO: 3783636 - RNA, 17 nt, Human
auaccacgcuagggcug

SEQ ID NO: 3783637 - RNA, 15 nt, Human
auaccacucuguaau

SEQ ID NO: 3783638 - RNA, 22 nt, Human
auaccagccccuguauggcacu

SEQ ID NO: 3783639 - RNA, 16 nt, Human
auaccagcgaggaggc

SEQ ID NO: 3783640 - RNA, 16 nt, Human
auaccaggauuuuuuu

SEQ ID NO: 3783641 - RNA, 17 nt, Human
auaccaggccgccccag

SEQ ID NO: 3783642 - RNA, 16 nt, Human
auaccagguugaaaga

SEQ ID NO: 3783643 - RNA, 12 nt, Human
auaccagugugg

SEQ ID NO: 3783644 - RNA, 17 nt, Human
auaccauuaaaacugcu

SEQ ID NO: 3783645 - RNA, 11 nt, Human
auacccacccc

SEQ ID NO: 3783646 - RNA, 15 nt, Human
auacccaugaacuua

SEQ ID NO: 3783647 - RNA, 17 nt, Human
auaccccaagacuccca

SEQ ID NO: 3783648 - RNA, 19 nt, Human
auaccccaagacucccaug

SEQ ID NO: 3783649 - RNA, 16 nt, Human
auaccccaucauucau

SEQ ID NO: 3783650 - RNA, 13 nt, Human
auaccccccucug

SEQ ID NO: 3783651 - RNA, 19 nt, Human
auacccccugcaaagccca

SEQ ID NO: 3783652 - RNA, 16 nt, Human
auaccccgugaagcau

SEQ ID NO: 3783653 - RNA, 19 nt, Human
auaccccuuacuuagcaug

SEQ ID NO: 3783654 - RNA, 18 nt, Human
auacccgccuagcugcug

SEQ ID NO: 3783655 - RNA, 14 nt, Human
auacccucccuccc

SEQ ID NO: 3783656 - RNA, 15 nt, Human
auaccggaauuacuu

SEQ ID NO: 3783657 - RNA, 16 nt, Human
auaccggaauuacuuu

SEQ ID NO: 3783658 - RNA, 13 nt, Human
auaccuaaaacau

SEQ ID NO: 3783659 - RNA, 14 nt, Human
auaccuaacugaau

SEQ ID NO: 3783660 - RNA, 15 nt, Human
auaccuaagaaguac

SEQ ID NO: 3783661 - RNA, 13 nt, Human
auaccuaagcaaa

SEQ ID NO: 3783662 - RNA, 13 nt, Human
auaccuaaguacu

SEQ ID NO: 3783663 - RNA, 20 nt, Human
auaccuaaguacuguaauaa

SEQ ID NO: 3783664 - RNA, 17 nt, Human
auaccuacauguauuug

SEQ ID NO: 3783665 - RNA, 13 nt, Human
auaccuauaaugu

SEQ ID NO: 3783666 - RNA, 16 nt, Human
auaccuauaaugugug

SEQ ID NO: 3783667 - RNA, 16 nt, Human
auaccucaaacuaucu

SEQ ID NO: 3783668 - RNA, 18 nt, Human
auaccucaaccuauggua

SEQ ID NO: 3783669 - RNA, 12 nt, Human
auaccucacuuu

SEQ ID NO: 3783670 - RNA, 15 nt, Human
auaccucaggaaaga

SEQ ID NO: 3783671 - RNA, 17 nt, Human
auaccucaggaaagaau

SEQ ID NO: 3783672 - RNA, 18 nt, Human
auaccucaggaaagaaua

SEQ ID NO: 3783673 - RNA, 21 nt, Human
auaccucauguuuaugaaaau

SEQ ID NO: 3783674 - RNA, 15 nt, Human
auaccucuuagcuga

SEQ ID NO: 3783675 - RNA, 17 nt, Human
auaccucuuagcugagu

SEQ ID NO: 3783676 - RNA, 17 nt, Human
auaccucuuugaaagaa

SEQ ID NO: 3783677 - RNA, 19 nt, Human
auaccugaaugcucuguag

SEQ ID NO: 3783678 - RNA, 17 nt, Human
auaccugcuaucagcag

SEQ ID NO: 3783679 - RNA, 17 nt, Human
auaccugggauacugug

SEQ ID NO: 3783680 - RNA, 20 nt, Human
auaccugggauacugugccc

SEQ ID NO: 3783681 - RNA, 12 nt, Human
auaccugucccc

SEQ ID NO: 3783682 - RNA, 16 nt, Human
auaccugugccucggc

SEQ ID NO: 3783683 - RNA, 19 nt, Human
auaccuguguuucuugccu

SEQ ID NO: 3783684 - RNA, 20 nt, Human
auaccuguguuucuugccuc

SEQ ID NO: 3783685 - RNA, 15 nt, Human
auaccuuaaaauuug

SEQ ID NO: 3783686 - RNA, 17 nt, Human
auaccuuaaaauuugaa

SEQ ID NO: 3783687 - RNA, 19 nt, Human
auaccuuaaaauuugaaac

SEQ ID NO: 3783688 - RNA, 23 nt, Human
auaccuuaaaauuugaaacauug

SEQ ID NO: 3783689 - RNA, 14 nt, Human
auaccuuagaaggu

SEQ ID NO: 3783690 - RNA, 19 nt, Human
auacgaaauaauuguuguu

SEQ ID NO: 3783691 - RNA, 21 nt, Human
auacgaaauaauuguuguucu

SEQ ID NO: 3783692 - RNA, 13 nt, Human
auacgaacaaaac

SEQ ID NO: 3783693 - RNA, 16 nt, Human
auacgacaguacacug

SEQ ID NO: 3783694 - RNA, 13 nt, Human
auacgauuuaagg

SEQ ID NO: 3783695 - RNA, 17 nt, Human
auacgcacuacaugugg

SEQ ID NO: 3783696 - RNA, 21 nt, Human
auacgcucagcucauccaugc

SEQ ID NO: 3783697 - RNA, 23 nt, Human
auacgcucagcucauccaugccu

SEQ ID NO: 3783698 - RNA, 21 nt, Human
auacgcuggcaacacagaggc

SEQ ID NO: 3783699 - RNA, 18 nt, Human
auacggucagguuuaaca

SEQ ID NO: 3783700 - RNA, 21 nt, Human
auacgugaaaauuauuugaaa

SEQ ID NO: 3783701 - RNA, 13 nt, Human
auacguuugauaa

SEQ ID NO: 3783702 - RNA, 13 nt, Human
auacuaaaaagaa

SEQ ID NO: 3783703 - RNA, 18 nt, Human
auacuaaaaaucaugaga

SEQ ID NO: 3783704 - RNA, 16 nt, Human
auacuaaaauaugucu

SEQ ID NO: 3783705 - RNA, 13 nt, Human
auacuacaguuug

SEQ ID NO: 3783706 - RNA, 16 nt, Human
auacuacaguuuguua

SEQ ID NO: 3783707 - RNA, 20 nt, Human
auacuacaguuuguuaguau

SEQ ID NO: 3783708 - RNA, 12 nt, Human
auacuacaucuu

SEQ ID NO: 3783709 - RNA, 16 nt, Human
auacuacaucuuuaaa

SEQ ID NO: 3783710 - RNA, 14 nt, Human
auacuaccuugaaa

SEQ ID NO: 3783711 - RNA, 13 nt, Human
auacuacuccugu

SEQ ID NO: 3783712 - RNA, 19 nt, Human
auacuacugaaacagauuu

SEQ ID NO: 3783713 - RNA, 16 nt, Human
auagaaaugccaagca

SEQ ID NO: 3783714 - RNA, 13 nt, Human
auagaaaugcugg

SEQ ID NO: 3783715 - RNA, 15 nt, Human
auagaaauguagguc

SEQ ID NO: 3783716 - RNA, 21 nt, Human
auagaaauguagguccucaga

SEQ ID NO: 3783717 - RNA, 12 nt, Human
auagaaaugucu

SEQ ID NO: 3783718 - RNA, 17 nt, Human
auagaaauuuuguaaga

SEQ ID NO: 3783719 - RNA, 16 nt, Human
auagaacuucauggau

SEQ ID NO: 3783720 - RNA, 19 nt, Human
auagaagaaaaaagaaugu

SEQ ID NO: 3783721 - RNA, 18 nt, Human
auagaagaaugcaugcuu

SEQ ID NO: 3783722 - RNA, 14 nt, Human
auagaagauguuug

SEQ ID NO: 3783723 - RNA, 16 nt, Human
auagaagcuguaguag

SEQ ID NO: 3783724 - RNA, 12 nt, Human
auagaaggaaac

SEQ ID NO: 3783725 - RNA, 14 nt, Human
auagaaggaaacua

SEQ ID NO: 3783726 - RNA, 10 nt, Human
auagaaggag

SEQ ID NO: 3783727 - RNA, 19 nt, Human
auagaaggauguacauuuc

SEQ ID NO: 3783728 - RNA, 19 nt, Human
auagaaggcuauggggaua

SEQ ID NO: 3783729 - RNA, 13 nt, Human
auagaaggugaug

SEQ ID NO: 3783730 - RNA, 18 nt, Human
auagaaguauaaagaauu

SEQ ID NO: 3783731 - RNA, 18 nt, Human
auagaagucuucaugaaa

SEQ ID NO: 3783732 - RNA, 12 nt, Human
auagaauaaagg

SEQ ID NO: 3783733 - RNA, 19 nt, Human
auagaauaaaggcaguuuu

SEQ ID NO: 3783734 - RNA, 13 nt, Human
auagaauagcaug

SEQ ID NO: 3783735 - RNA, 18 nt, Human
auagaauaggcacuuuaa

SEQ ID NO: 3783736 - RNA, 12 nt, Human
auagaauauuua

SEQ ID NO: 3783737 - RNA, 13 nt, Human
auagaaugacagu

SEQ ID NO: 3783738 - RNA, 20 nt, Human
auagaauguaaaugucucac

SEQ ID NO: 3783739 - RNA, 17 nt, Human
auagaauuaacacauga

SEQ ID NO: 3783740 - RNA, 13 nt, Human
auagaauuagcuu

SEQ ID NO: 3783741 - RNA, 13 nt, Human
auagaauugacau

SEQ ID NO: 3783742 - RNA, 18 nt, Human
auagaauugacauugaaa

SEQ ID NO: 3783743 - RNA, 18 nt, Human
auagaauugcaaucuaua

SEQ ID NO: 3783744 - RNA, 18 nt, Human
auagaauugcaauuuuaa

SEQ ID NO: 3783745 - RNA, 17 nt, Human
auagaauuuuuaauguu

SEQ ID NO: 3783746 - RNA, 15 nt, Human
auagacaaaaaguau

SEQ ID NO: 3783747 - RNA, 16 nt, Human
auagacaaaaaguaua

SEQ ID NO: 3783748 - RNA, 21 nt, Human
auagacaauugagguaaguuu

SEQ ID NO: 3783749 - RNA, 12 nt, Human
auagacacgcac

SEQ ID NO: 3783750 - RNA, 13 nt, Human
auagacagaagaa

SEQ ID NO: 3783751 - RNA, 16 nt, Human
auagacagaagaaaca

SEQ ID NO: 3783752 - RNA, 19 nt, Human
auagacagaagaaacaagg

SEQ ID NO: 3783753 - RNA, 21 nt, Human
auagacagaauagauagcacu

SEQ ID NO: 3783754 - RNA, 22 nt, Human
auagacaggagaagaaagaacu

SEQ ID NO: 3783755 - RNA, 13 nt, Human
auagacagguccu

SEQ ID NO: 3783756 - RNA, 20 nt, Human
auagacaguauauuuauagu

SEQ ID NO: 3783757 - RNA, 16 nt, Human
auagacaguuuguaaa

SEQ ID NO: 3783758 - RNA, 19 nt, Human
auagacgaguugauuuccu

SEQ ID NO: 3783759 - RNA, 14 nt, Human
auagagaauguucc

SEQ ID NO: 3783760 - RNA, 18 nt, Human
auagagagggagaagaag

SEQ ID NO: 3783761 - RNA, 14 nt, Human
auagagaucauccu

SEQ ID NO: 3783762 - RNA, 22 nt, Human
auagagcaaaauugauguguuu

SEQ ID NO: 3783763 - RNA, 16 nt, Human
auagagcagaaauucu

SEQ ID NO: 3783764 - RNA, 19 nt, Human
auagagcagaaauucuguu

SEQ ID NO: 3783765 - RNA, 13 nt, Human
auagagcuguauu

SEQ ID NO: 3783766 - RNA, 16 nt, Human
auagagcuuuuaaaaa

SEQ ID NO: 3783767 - RNA, 22 nt, Human
auagaggcuucuccgccagccu

SEQ ID NO: 3783768 - RNA, 23 nt, Human
auagaguaaaaagaaaacaaaac

SEQ ID NO: 3783769 - RNA, 14 nt, Human
auagaguauaugca

SEQ ID NO: 3783770 - RNA, 14 nt, Human
auagaguguacuua

SEQ ID NO: 3783771 - RNA, 22 nt, Human
auagagugugauguauguguaa

SEQ ID NO: 3783772 - RNA, 14 nt, Human
auagaguguuauca

SEQ ID NO: 3783773 - RNA, 13 nt, Human
auagaguucaucc

SEQ ID NO: 3783774 - RNA, 15 nt, Human
auagauaacucuuug

SEQ ID NO: 3783775 - RNA, 20 nt, Human
auagauaagaguagaaacug

SEQ ID NO: 3783776 - RNA, 16 nt, Human
auagauaauauuguuu

SEQ ID NO: 3783777 - RNA, 13 nt, Human
auagauauuuuca

SEQ ID NO: 3783778 - RNA, 17 nt, Human
auagauauuuucacaau

SEQ ID NO: 3783779 - RNA, 19 nt, Human
auagaucacauaacagaau

SEQ ID NO: 3783780 - RNA, 16 nt, Human
auagaucccccagacu

SEQ ID NO: 3783781 - RNA, 13 nt, Human
auagaucuccagc

SEQ ID NO: 3783782 - RNA, 13 nt, Human
auagaucuucuga

SEQ ID NO: 3783783 - RNA, 14 nt, Human
auagaucuucugaa

SEQ ID NO: 3783784 - RNA, 21 nt, Human
auagaucuucugaaaugaaac

SEQ ID NO: 3783785 - RNA, 15 nt, Human
auagaugcuggccca

SEQ ID NO: 3783786 - RNA, 18 nt, Human
auagaugcuguguauaug

SEQ ID NO: 3783787 - RNA, 22 nt, Human
auagaugggucuggcugagcug

SEQ ID NO: 3783788 - RNA, 14 nt, Human
auagaugucuuuua

SEQ ID NO: 3783789 - RNA, 19 nt, Human
auagaugucuuuuauagug

SEQ ID NO: 3783790 - RNA, 11 nt, Human
auagaugugug

SEQ ID NO: 3783791 - RNA, 14 nt, Human
auagauguguggac

SEQ ID NO: 3783792 - RNA, 12 nt, Human
auagauguuuga

SEQ ID NO: 3783793 - RNA, 14 nt, Human
auagauuaaaucau

SEQ ID NO: 3783794 - RNA, 18 nt, Human
auaaaucauaaagucagu

SEQ ID NO: 3783795 - RNA, 18 nt, Human
auaaaucauauugaugaa

SEQ ID NO: 3783796 - RNA, 19 nt, Human
auaaaucauucuuacuaaa

SEQ ID NO: 3783797 - RNA, 14 nt, Human
auaaaucauuuuau

SEQ ID NO: 3783798 - RNA, 18 nt, Human
auaaaucauuuuauguca

SEQ ID NO: 3783799 - RNA, 13 nt, Human
auaaauccaguga

SEQ ID NO: 3783800 - RNA, 23 nt, Human
auaaauccagugaccucucucuc

SEQ ID NO: 3783801 - RNA, 15 nt, Human
auaaauccaguucua

SEQ ID NO: 3783802 - RNA, 18 nt, Human
auaaauccaguucuacua

SEQ ID NO: 3783803 - RNA, 21 nt, Human
auaaaucgcuuuugauaauca

SEQ ID NO: 3783804 - RNA, 19 nt, Human
auaaaucugacccagugcc

SEQ ID NO: 3783805 - RNA, 16 nt, Human
auaaaucugugaacuu

SEQ ID NO: 3783806 - RNA, 19 nt, Human
auaaaucugugaacuugaa

SEQ ID NO: 3783807 - RNA, 20 nt, Human
auaaaucugugaacuugaaa

SEQ ID NO: 3783808 - RNA, 21 nt, Human
auaaaucugugaacuugaaau

SEQ ID NO: 3783809 - RNA, 22 nt, Human
auaaaucuguucugggcucuuu

SEQ ID NO: 3783810 - RNA, 14 nt, Human
auaaaucuguugcc

SEQ ID NO: 3783811 - RNA, 13 nt, Human
auaaaucuuaaaa

SEQ ID NO: 3783812 - RNA, 20 nt, Human
auaaaugaagcagcuuuaaa

SEQ ID NO: 3783813 - RNA, 16 nt, Human
auaaaugaaguuuaua

SEQ ID NO: 3783814 - RNA, 18 nt, Human
auaaaugaaguuuauaca

SEQ ID NO: 3783815 - RNA, 12 nt, Human
auaaaugagcaa

SEQ ID NO: 3783816 - RNA, 18 nt, Human
auaaaugauucaaaaagu

SEQ ID NO: 3783817 - RNA, 12 nt, Human
auaaaugcaaau

SEQ ID NO: 3783818 - RNA, 14 nt, Human
auaaaugcaaauaa

SEQ ID NO: 3783819 - RNA, 20 nt, Human
auaaaugcaauauguauuaa

SEQ ID NO: 3783820 - RNA, 15 nt, Human
auaaaugcaauauua

SEQ ID NO: 3783821 - RNA, 21 nt, Human
auaaaugcuauuuuuuauuuu

SEQ ID NO: 3783822 - RNA, 15 nt, Human
auaaauggaaaucau

SEQ ID NO: 3783823 - RNA, 13 nt, Human
auaaauggcuggu

SEQ ID NO: 3783824 - RNA, 17 nt, Human
auaaaugggaacauuua

SEQ ID NO: 3783825 - RNA, 22 nt, Human
auaaaugguauagcaaauguuu

SEQ ID NO: 3783826 - RNA, 15 nt, Human
auaaauguacauuaa

SEQ ID NO: 3783827 - RNA, 14 nt, Human
auaaauguauauac

SEQ ID NO: 3783828 - RNA, 18 nt, Human
auaaauguauauacacau

SEQ ID NO: 3783829 - RNA, 19 nt, Human
auaaauguauauacacaua

SEQ ID NO: 3783830 - RNA, 21 nt, Human
auaaauguaucauagaaaugu

SEQ ID NO: 3783831 - RNA, 18 nt, Human
auaaauguaucuuauuca

SEQ ID NO: 3783832 - RNA, 22 nt, Human
auaaauguauucaaauaccaau

SEQ ID NO: 3783833 - RNA, 23 nt, Human
auaaaugucuuuuuuuuaaugug

SEQ ID NO: 3783834 - RNA, 11 nt, Human
auaaauuaaau

SEQ ID NO: 3783835 - RNA, 12 nt, Human
auaaauuaaaua

SEQ ID NO: 3783836 - RNA, 14 nt, Human
auaaauuaguuguu

SEQ ID NO: 3783837 - RNA, 13 nt, Human
auaaauuauaagu

SEQ ID NO: 3783838 - RNA, 14 nt, Human
auaaauuauguuua

SEQ ID NO: 3783839 - RNA, 21 nt, Human
auaaauuauuaguuuacauca

SEQ ID NO: 3783840 - RNA, 19 nt, Human
auaaauucaccuagucuaa

SEQ ID NO: 3783841 - RNA, 15 nt, Human
auaaauuccacugga

SEQ ID NO: 3783842 - RNA, 13 nt, Human
auaaauuccucuu

SEQ ID NO: 3783843 - RNA, 16 nt, Human
auaaauucuauaggaa

SEQ ID NO: 3783844 - RNA, 18 nt, Human
auaaauugcauaaagcau

SEQ ID NO: 3783845 - RNA, 19 nt, Human
auaaauugcaugcugcuuu

SEQ ID NO: 3783846 - RNA, 19 nt, Human
auaaauugcuaauguugcu

SEQ ID NO: 3783847 - RNA, 13 nt, Human
auaaauuguauau

SEQ ID NO: 3783848 - RNA, 18 nt, Human
auaaauuguauauucacu

SEQ ID NO: 3783849 - RNA, 18 nt, Human
auaaauugucuuaaugga

SEQ ID NO: 3783850 - RNA, 13 nt, Human
auaaauugucuuu

SEQ ID NO: 3783851 - RNA, 22 nt, Human
auaaauugucuuuaaaaacugu

SEQ ID NO: 3783852 - RNA, 13 nt, Human
auaaauuguuuga

SEQ ID NO: 3783853 - RNA, 17 nt, Human
auaaauuguuugaccau

SEQ ID NO: 3783854 - RNA, 20 nt, Human
auaaauuugacuuuucugua

SEQ ID NO: 3783855 - RNA, 21 nt, Human
auaaauuugacuuuucuguaa

SEQ ID NO: 3783856 - RNA, 13 nt, Human
auaaauuuugaaa

SEQ ID NO: 3783857 - RNA, 14 nt, Human
auaaauuuugaaaa

SEQ ID NO: 3783858 - RNA, 15 nt, Human
auaaauuuuuuauaa

SEQ ID NO: 3783859 - RNA, 13 nt, Human
auaacaaaaugga

SEQ ID NO: 3783860 - RNA, 15 nt, Human
acuguaggcacacuu

SEQ ID NO: 3783861 - RNA, 15 nt, Human
acuguagucucagga

SEQ ID NO: 3783862 - RNA, 18 nt, Human
acuguaguuuuucuucaa

SEQ ID NO: 3783863 - RNA, 13 nt, Human
acuguauaaauag

SEQ ID NO: 3783864 - RNA, 20 nt, Human
acuguauaaauaggagagga

SEQ ID NO: 3783865 - RNA, 21 nt, Human
acuguauaaauaggagaggau

SEQ ID NO: 3783866 - RNA, 18 nt, Human
acuguauagacaguuugu

SEQ ID NO: 3783867 - RNA, 20 nt, Human
acuguauagcucuuuuccua

SEQ ID NO: 3783868 - RNA, 16 nt, Human
acuguauauuacagau

SEQ ID NO: 3783869 - RNA, 14 nt, Human
acuguauauucagg

SEQ ID NO: 3783870 - RNA, 19 nt, Human
acuguauauuuguaugaua

SEQ ID NO: 3783871 - RNA, 14 nt, Human
acuguaucaugaca

SEQ ID NO: 3783872 - RNA, 15 nt, Human
acuguaucuaggcaa

SEQ ID NO: 3783873 - RNA, 14 nt, Human
acuguaucugugua

SEQ ID NO: 3783874 - RNA, 16 nt, Human
acuguaugaucaaaug

SEQ ID NO: 3783875 - RNA, 17 nt, Human
acuguaugaucaaaugu

SEQ ID NO: 3783876 - RNA, 18 nt, Human
acuguaugaucaaauguu

SEQ ID NO: 3783877 - RNA, 14 nt, Human
acuguaugugauga

SEQ ID NO: 3783878 - RNA, 16 nt, Human
acuguaugugaugaau

SEQ ID NO: 3783879 - RNA, 20 nt, Human
acuguauuacauaaauaaau

SEQ ID NO: 3783880 - RNA, 23 nt, Human
acuguauugggaaguuacuguua

SEQ ID NO: 3783881 - RNA, 13 nt, Human
acuguauuuguga

SEQ ID NO: 3783882 - RNA, 20 nt, Human
acuguauuuuuaccuuuuuc

SEQ ID NO: 3783883 - RNA, 20 nt, Human
acugucaaagaaucaaucca

SEQ ID NO: 3783884 - RNA, 15 nt, Human
acugucaaaugaugu

SEQ ID NO: 3783885 - RNA, 13 nt, Human
acugucaauaaac

SEQ ID NO: 3783886 - RNA, 15 nt, Human
acugucacucauugc

SEQ ID NO: 3783887 - RNA, 21 nt, Human
acugucacuguuucucugcug

SEQ ID NO: 3783888 - RNA, 18 nt, Human
acuguccccuugaaggag

SEQ ID NO: 3783889 - RNA, 21 nt, Human
acugucccuccuggugucacc

SEQ ID NO: 3783890 - RNA, 15 nt, Human
acuguccuaacaugg

SEQ ID NO: 3783891 - RNA, 23 nt, Human
acuguccuacccacccuccuuuc

SEQ ID NO: 3783892 - RNA, 18 nt, Human
acuguccucuccccucca

SEQ ID NO: 3783893 - RNA, 19 nt, Human
acuguccucuccccuccag

SEQ ID NO: 3783894 - RNA, 20 nt, Human
acuguccucuccccuccagc

SEQ ID NO: 3783895 - RNA, 14 nt, Human
acuguccucuuuca

SEQ ID NO: 3783896 - RNA, 23 nt, Human
acuguccucuuucagaaaacaga

SEQ ID NO: 3783897 - RNA, 16 nt, Human
acuguccugggccugc

SEQ ID NO: 3783898 - RNA, 12 nt, Human
acuguccugucc

SEQ ID NO: 3783899 - RNA, 13 nt, Human
acuguccuguccu

SEQ ID NO: 3783900 - RNA, 17 nt, Human
acuguccuguugauuaa

SEQ ID NO: 3783901 - RNA, 14 nt, Human
acuguccuuuccuu

SEQ ID NO: 3783902 - RNA, 17 nt, Human
acugucgcugcuucgug

SEQ ID NO: 3783903 - RNA, 20 nt, Human
acugucggaggaaagacaac

SEQ ID NO: 3783904 - RNA, 16 nt, Human
acugucuaacuuuaga

SEQ ID NO: 3783905 - RNA, 18 nt, Human
acugucucaguuucacuu

SEQ ID NO: 3783906 - RNA, 22 nt, Human
acugucuccauggcccugcaaa

SEQ ID NO: 3783907 - RNA, 15 nt, Human
acugucucuccugau

SEQ ID NO: 3783908 - RNA, 15 nt, Human
acugucugagaguuu

SEQ ID NO: 3783909 - RNA, 22 nt, Human
acugucuggggagcgggucugc

SEQ ID NO: 3783910 - RNA, 23 nt, Human
acugucuguguuuuuuuggcagu

SEQ ID NO: 3783911 - RNA, 14 nt, Human
acugucuuaauuaa

SEQ ID NO: 3783912 - RNA, 13 nt, Human
acugucuuccuca

SEQ ID NO: 3783913 - RNA, 14 nt, Human
acugucuuccucaa

SEQ ID NO: 3783914 - RNA, 19 nt, Human
acugucuuuaaaagagaga

SEQ ID NO: 3783915 - RNA, 12 nt, Human
acugucuuucag

SEQ ID NO: 3783916 - RNA, 14 nt, Human
acugucuuuccuag

SEQ ID NO: 3783917 - RNA, 23 nt, Human
acugucuuuuuucuaaaguaaaa

SEQ ID NO: 3783918 - RNA, 21 nt, Human
acugucuuuuuuucccuacca

SEQ ID NO: 3783919 - RNA, 22 nt, Human
acugugaaguuuacauuguaaa

SEQ ID NO: 3783920 - RNA, 14 nt, Human
acugugacaggcag

SEQ ID NO: 3783921 - RNA, 22 nt, Human
acugugaccaaguauaaacuuu

SEQ ID NO: 3783922 - RNA, 21 nt, Human
acugugagcucccaggugcag

SEQ ID NO: 3783923 - RNA, 13 nt, Human
acugugaugaagc

SEQ ID NO: 3783924 - RNA, 13 nt, Human
acugugcacaccc

SEQ ID NO: 3783925 - RNA, 19 nt, Human
acugugcacaucugugucu

SEQ ID NO: 3783926 - RNA, 13 nt, Human
agcucagccccag

SEQ ID NO: 3783927 - RNA, 15 nt, Human
agcucagccccagcc

SEQ ID NO: 3783928 - RNA, 19 nt, Human
agcucagcugcauuccgca

SEQ ID NO: 3783929 - RNA, 18 nt, Human
agcucaggacagaugcca

SEQ ID NO: 3783930 - RNA, 14 nt, Human
agcucaggaccagg

SEQ ID NO: 3783931 - RNA, 14 nt, Human
agcucagggccugg

SEQ ID NO: 3783932 - RNA, 18 nt, Human
agcucagggccuggcuca

SEQ ID NO: 3783933 - RNA, 20 nt, Human
agcucagggccuggcucagg

SEQ ID NO: 3783934 - RNA, 16 nt, Human
agcucaggggcagcuc

SEQ ID NO: 3783935 - RNA, 13 nt, Human
agcucagucccau

SEQ ID NO: 3783936 - RNA, 22 nt, Human
agcucaguucuagucucucugg

SEQ ID NO: 3783937 - RNA, 16 nt, Human
agcucaucuucacugc

SEQ ID NO: 3783938 - RNA, 17 nt, Human
agcucaucuucacugca

SEQ ID NO: 3783939 - RNA, 19 nt, Human
agcucauguagcaaucaga

SEQ ID NO: 3783940 - RNA, 18 nt, Human
agcucauuaaacuuuuuu

SEQ ID NO: 3783941 - RNA, 21 nt, Human
agcucauuaaacuuuuuuaac

SEQ ID NO: 3783942 - RNA, 21 nt, Human
agcucauuauaaugucauuaa

SEQ ID NO: 3783943 - RNA, 13 nt, Human
agcuccaaccugc

SEQ ID NO: 3783944 - RNA, 22 nt, Human
agcuccaaccugcaaagaucug

SEQ ID NO: 3783945 - RNA, 23 nt, Human
agcuccaagaccuguugguucca

SEQ ID NO: 3783946 - RNA, 15 nt, Human
agcuccaagccccau

SEQ ID NO: 3783947 - RNA, 15 nt, Human
agcuccaagcuccca

SEQ ID NO: 3783948 - RNA, 16 nt, Human
agcuccaagcucccag

SEQ ID NO: 3783949 - RNA, 21 nt, Human
agcuccacacccucucccagg

SEQ ID NO: 3783950 - RNA, 21 nt, Human
agcuccaccccgcaagcacca

SEQ ID NO: 3783951 - RNA, 18 nt, Human
agcuccacucugcuucuc

SEQ ID NO: 3783952 - RNA, 19 nt, Human
agcuccagacccccagcaa

SEQ ID NO: 3783953 - RNA, 13 nt, Human
agcuccagagcaa

SEQ ID NO: 3783954 - RNA, 16 nt, Human
agcuccagccccuuuc

SEQ ID NO: 3783955 - RNA, 21 nt, Human
agcuccagccccuuuccaaaa

SEQ ID NO: 3783956 - RNA, 19 nt, Human
agcuccagcuccuuugggc

SEQ ID NO: 3783957 - RNA, 15 nt, Human
agcuccaguccugcu

SEQ ID NO: 3783958 - RNA, 17 nt, Human
agcuccaguccugcucu

SEQ ID NO: 3783959 - RNA, 18 nt, Human
agcuccaguguccugagc

SEQ ID NO: 3783960 - RNA, 19 nt, Human
agcuccaguguccugagcu

SEQ ID NO: 3783961 - RNA, 20 nt, Human
agcuccaguguccugagcuc

SEQ ID NO: 3783962 - RNA, 22 nt, Human
agcuccaguguccugagcucag

SEQ ID NO: 3783963 - RNA, 23 nt, Human
agcuccauacacacgcugccuuc

SEQ ID NO: 3783964 - RNA, 19 nt, Human
agcuccaugugccucuuug

SEQ ID NO: 3783965 - RNA, 21 nt, Human
agcuccauuuaaacagauguc

SEQ ID NO: 3783966 - RNA, 13 nt, Human
agcuccauuuucu

SEQ ID NO: 3783967 - RNA, 23 nt, Human
agcucccaagggauggugcccug

SEQ ID NO: 3783968 - RNA, 15 nt, Human
agcucccaccccacc

SEQ ID NO: 3783969 - RNA, 21 nt, Human
agcucccaccuccccuugggc

SEQ ID NO: 3783970 - RNA, 12 nt, Human
agcucccaggaa

SEQ ID NO: 3783971 - RNA, 13 nt, Human
agcucccaggaac

SEQ ID NO: 3783972 - RNA, 14 nt, Human
agcucccaggccga

SEQ ID NO: 3783973 - RNA, 20 nt, Human
agcucccaggugcagccaga

SEQ ID NO: 3783974 - RNA, 17 nt, Human
agcucccauuucuacuc

SEQ ID NO: 3783975 - RNA, 14 nt, Human
agcuccccaccacc

SEQ ID NO: 3783976 - RNA, 21 nt, Human
agcuccccaccaccccagcug

SEQ ID NO: 3783977 - RNA, 23 nt, Human
agcucccccagcaaagcccccag

SEQ ID NO: 3783978 - RNA, 15 nt, Human
agcucccccagcucc

SEQ ID NO: 3783979 - RNA, 20 nt, Human
agcuccccccaccuccccca

SEQ ID NO: 3783980 - RNA, 16 nt, Human
agcucccccugucccc

SEQ ID NO: 3783981 - RNA, 21 nt, Human
agcuccccgcuucugccugca

SEQ ID NO: 3783982 - RNA, 14 nt, Human
agcuccccuccucu

SEQ ID NO: 3783983 - RNA, 19 nt, Human
agcuccccuccucuccccu

SEQ ID NO: 3783984 - RNA, 14 nt, Human
agcucccucugccu

SEQ ID NO: 3783985 - RNA, 11 nt, Human
agcucccugcc

SEQ ID NO: 3783986 - RNA, 14 nt, Human
agcucccuggcuuc

SEQ ID NO: 3783987 - RNA, 21 nt, Human
agcucccugugcccccagggu

SEQ ID NO: 3783988 - RNA, 16 nt, Human
agcucccuucucugua

SEQ ID NO: 3783989 - RNA, 23 nt, Human
agcucccuucucuguagggaacu

SEQ ID NO: 3783990 - RNA, 23 nt, Human
agcuccgcaggacuuccccggag

SEQ ID NO: 3783991 - RNA, 16 nt, Human
agcuccgccucugucc

SEQ ID NO: 3783992 - RNA, 21 nt, Human
agcuccgcuuucuacccagcg

SEQ ID NO: 3783993 - RNA, 23 nt, Human
agcuccucaacucaccuaauguu

SEQ ID NO: 3783994 - RNA, 15 nt, Human
agcuccucauccagg

SEQ ID NO: 3783995 - RNA, 21 nt, Human
agcuccucauccagggcucug

SEQ ID NO: 3783996 - RNA, 19 nt, Human
agcuccuccccuuccucuu

SEQ ID NO: 3783997 - RNA, 14 nt, Human
agcuccucccucuc

SEQ ID NO: 3783998 - RNA, 15 nt, Human
agcuccucccucuca

SEQ ID NO: 3783999 - RNA, 16 nt, Human
agcuccucccuuguuc

SEQ ID NO: 3784000 - RNA, 20 nt, Human
agcuccucccuuguucucua

SEQ ID NO: 3784001 - RNA, 20 nt, Human
agcuccuccgugcuuccuca

SEQ ID NO: 3784002 - RNA, 15 nt, Human
agcuccuccucccug

SEQ ID NO: 3784003 - RNA, 15 nt, Human
agcuccucuccugga

SEQ ID NO: 3784004 - RNA, 19 nt, Human
agcuccucugggcaggacc

SEQ ID NO: 3784005 - RNA, 14 nt, Human
agcuccucuuccau

SEQ ID NO: 3784006 - RNA, 15 nt, Human
agcuccucuuccaug

SEQ ID NO: 3784007 - RNA, 15 nt, Human
agcuccugaaaaaug

SEQ ID NO: 3784008 - RNA, 24 nt, Human
agcuccugaccaguugcagucacu

SEQ ID NO: 3784009 - RNA, 23 nt, Human
agcuccugggaaggcuacucacc

SEQ ID NO: 3784010 - RNA, 22 nt, Human
agcuccuggucuugagaugucu

SEQ ID NO: 3784011 - RNA, 16 nt, Human
agcuccuguccccugc

SEQ ID NO: 3784012 - RNA, 13 nt, Human
agcuccuguccuc

SEQ ID NO: 3784013 - RNA, 16 nt, Human
agcuccuguccuccca

SEQ ID NO: 3784014 - RNA, 16 nt, Human
agcuccuguggcccca

SEQ ID NO: 3784015 - RNA, 15 nt, Human
agaagugcauuucug

SEQ ID NO: 3784016 - RNA, 16 nt, Human
agaagugccccugcug

SEQ ID NO: 3784017 - RNA, 15 nt, Human
agaaguggaccagga

SEQ ID NO: 3784018 - RNA, 17 nt, Human
agaaguggaccaggaca

SEQ ID NO: 3784019 - RNA, 18 nt, Human
agaaguggaccaggacag

SEQ ID NO: 3784020 - RNA, 23 nt, Human
agaaguggaccaggacaggacca

SEQ ID NO: 3784021 - RNA, 18 nt, Human
agaagugggccaggacag

SEQ ID NO: 3784022 - RNA, 18 nt, Human
agaagugucauguuuaua

SEQ ID NO: 3784023 - RNA, 12 nt, Human
agaagugugauu

SEQ ID NO: 3784024 - RNA, 21 nt, Human
agaagugugccuucucucucc

SEQ ID NO: 3784025 - RNA, 15 nt, Human
agaaguuaguuugua

SEQ ID NO: 3784026 - RNA, 15 nt, Human
agaaguucuuugauu

SEQ ID NO: 3784027 - RNA, 20 nt, Human
agaaguugaggauuguugaa

SEQ ID NO: 3784028 - RNA, 14 nt, Human
agaaguuguuuguc

SEQ ID NO: 3784029 - RNA, 13 nt, Human
agaaguuuaaaua

SEQ ID NO: 3784030 - RNA, 15 nt, Human
agaaguuuaaggaau

SEQ ID NO: 3784031 - RNA, 17 nt, Human
agaaguuuaaggaauau

SEQ ID NO: 3784032 - RNA, 19 nt, Human
agaaguuucaucauuuuuu

SEQ ID NO: 3784033 - RNA, 16 nt, Human
agaaguuucccuuccu

SEQ ID NO: 3784034 - RNA, 23 nt, Human
agaaguuucuggcccuggcugac

SEQ ID NO: 3784035 - RNA, 15 nt, Human
agaaguuugaacauu

SEQ ID NO: 3784036 - RNA, 16 nt, Human
agaaguuuuuguacug

SEQ ID NO: 3784037 - RNA, 19 nt, Human
agaaguuuuuguacuguaa

SEQ ID NO: 3784038 - RNA, 14 nt, Human
agaauaaacauuug

SEQ ID NO: 3784039 - RNA, 16 nt, Human
agaauaaacauuuguu

SEQ ID NO: 3784040 - RNA, 13 nt, Human
agaauaaacuggc

SEQ ID NO: 3784041 - RNA, 12 nt, Human
agaauaaagcaa

SEQ ID NO: 3784042 - RNA, 15 nt, Human
agaauaaagcaauuu

SEQ ID NO: 3784043 - RNA, 17 nt, Human
agaauaaagcaauuuuc

SEQ ID NO: 3784044 - RNA, 21 nt, Human
agaauaaaguucugaguguuu

SEQ ID NO: 3784045 - RNA, 13 nt, Human
agaauaagaauuu

SEQ ID NO: 3784046 - RNA, 14 nt, Human
agaauaagagaaag

SEQ ID NO: 3784047 - RNA, 12 nt, Human
agaauaaguuau

SEQ ID NO: 3784048 - RNA, 17 nt, Human
agaauaaguuauugcag

SEQ ID NO: 3784049 - RNA, 14 nt, Human
agaauaauaagagg

SEQ ID NO: 3784050 - RNA, 22 nt, Human
agaauaauaugcugccaaauuu

SEQ ID NO: 3784051 - RNA, 16 nt, Human
agaauaauguucuauu

SEQ ID NO: 3784052 - RNA, 21 nt, Human
agaauaauucaauuuuaaaga

SEQ ID NO: 3784053 - RNA, 16 nt, Human
agaauaauuuauagua

SEQ ID NO: 3784054 - RNA, 14 nt, Human
agaauacagcuuuc

SEQ ID NO: 3784055 - RNA, 15 nt, Human
agaauacagcuuucu

SEQ ID NO: 3784056 - RNA, 17 nt, Human
agaauacagcuuucuga

SEQ ID NO: 3784057 - RNA, 14 nt, Human
agaauacugaugga

SEQ ID NO: 3784058 - RNA, 15 nt, Human
agaauacugauggaa

SEQ ID NO: 3784059 - RNA, 16 nt, Human
agaauacuuuucucuu

SEQ ID NO: 3784060 - RNA, 12 nt, Human
agaauagaaaca

SEQ ID NO: 3784061 - RNA, 13 nt, Human
agaauagaaacaa

SEQ ID NO: 3784062 - RNA, 17 nt, Human
agaauagaacacaguuu

SEQ ID NO: 3784063 - RNA, 12 nt, Human
agaauagaagga

SEQ ID NO: 3784064 - RNA, 13 nt, Human
agaauagaaggaa

SEQ ID NO: 3784065 - RNA, 16 nt, Human
agaauagaaggaaacu

SEQ ID NO: 3784066 - RNA, 17 nt, Human
agaauagaaggaaacua

SEQ ID NO: 3784067 - RNA, 20 nt, Human
agaauagaaggaaacuagcu

SEQ ID NO: 3784068 - RNA, 18 nt, Human
agaauagcaucuguacaa

SEQ ID NO: 3784069 - RNA, 16 nt, Human
agaauaggacuuguuu

SEQ ID NO: 3784070 - RNA, 17 nt, Human
agaauaggcacuuuaaa

SEQ ID NO: 3784071 - RNA, 20 nt, Human
agaauaggcacuuuaaaaca

SEQ ID NO: 3784072 - RNA, 22 nt, Human
agaauaggcacuuuaaaacacu

SEQ ID NO: 3784073 - RNA, 18 nt, Human
agaauaggcauuaacaca

SEQ ID NO: 3784074 - RNA, 23 nt, Human
agaauagggcccaugggagggag

SEQ ID NO: 3784075 - RNA, 20 nt, Human
agaauaguugaaccuauuuc

SEQ ID NO: 3784076 - RNA, 21 nt, Human
agaauaguugaaccuauuucu

SEQ ID NO: 3784077 - RNA, 23 nt, Human
agaauaguugaaccuauuucucu

SEQ ID NO: 3784078 - RNA, 13 nt, Human
agaauauaacaug

SEQ ID NO: 3784079 - RNA, 15 nt, Human
agaauauaauuaucg

SEQ ID NO: 3784080 - RNA, 14 nt, Human
agaauauaggucuc

SEQ ID NO: 3784081 - RNA, 19 nt, Human
agaauauaggucucuucuc

SEQ ID NO: 3784082 - RNA, 12 nt, Human
agaauauauaua

SEQ ID NO: 3784083 - RNA, 13 nt, Human
agaauauauuuau

SEQ ID NO: 3784084 - RNA, 22 nt, Human
agaauauccuuuaaaauuuaaa

SEQ ID NO: 3784085 - RNA, 13 nt, Human
agaauauguuuca

SEQ ID NO: 3784086 - RNA, 18 nt, Human
agaauauuaucuucauaa

SEQ ID NO: 3784087 - RNA, 18 nt, Human
agaauauucagagaauau

SEQ ID NO: 3784088 - RNA, 12 nt, Human
agaauauucagg

SEQ ID NO: 3784089 - RNA, 21 nt, Human
agaauauugaaguacuugcca

SEQ ID NO: 3784090 - RNA, 21 nt, Human
agaauauugcaaaauacauga

SEQ ID NO: 3784091 - RNA, 22 nt, Human
agaauauugcaaaauacaugaa

SEQ ID NO: 3784092 - RNA, 16 nt, Human
agaauauuguauuguu

SEQ ID NO: 3784093 - RNA, 18 nt, Human
agaauauuguauuguuag

SEQ ID NO: 3784094 - RNA, 21 nt, Human
agaauauuguuccuaaguucu

SEQ ID NO: 3784095 - RNA, 11 nt, Human
agaauauuuau

SEQ ID NO: 3784096 - RNA, 16 nt, Human
agaauauuucuauuga

SEQ ID NO: 3784097 - RNA, 22 nt, Human
agaauauuuuuauauuuccuuu

SEQ ID NO: 3784098 - RNA, 23 nt, Human
agaauauuuuuauauuuccuuua

SEQ ID NO: 3784099 - RNA, 21 nt, Human
agaaucaaagcaaugcauuuu

SEQ ID NO: 3784100 - RNA, 23 nt, Human
agaaucaacauuucucaauaauu

SEQ ID NO: 3784101 - RNA, 16 nt, Human
agaaucaauuuaagug

SEQ ID NO: 3784102 - RNA, 13 nt, Human
agaaucacaggcu

SEQ ID NO: 3784103 - RNA, 22 nt, Human
agaaucaccuaauuaauuucag

SEQ ID NO: 3784104 - RNA, 22 nt, Human
agaaucacuucugagaacucau

SEQ ID NO: 3784105 - RNA, 13 nt, Human
agaaucagagaag

SEQ ID NO: 3784106 - RNA, 23 nt, Human
agaaucagagaaggaacauaccc

SEQ ID NO: 3784107 - RNA, 16 nt, Human
agaaucagaguagaaa

SEQ ID NO: 3784108 - RNA, 22 nt, Human
agaaucagcacagauaaaaagu

SEQ ID NO: 3784109 - RNA, 17 nt, Human
agaaucauaugauucug

SEQ ID NO: 3784110 - RNA, 21 nt, Human
agaaucauaugauucugcuuu

SEQ ID NO: 3784111 - RNA, 22 nt, Human
agaaucauaugauucugcuuuu

SEQ ID NO: 3784112 - RNA, 13 nt, Human
agaaucaucagga

SEQ ID NO: 3784113 - RNA, 15 nt, Human
agaaucauguuucuu

SEQ ID NO: 3784114 - RNA, 14 nt, Human
agaaucauuauuua

SEQ ID NO: 3784115 - RNA, 20 nt, Human
agaaucauuauuuauuaaau

SEQ ID NO: 3784116 - RNA, 20 nt, Human
agaauccacguauuccccuu

SEQ ID NO: 3784117 - RNA, 19 nt, Human
agaaucccucuacauggac

SEQ ID NO: 3784118 - RNA, 15 nt, Human
agaaucccuguguua

SEQ ID NO: 3784119 - RNA, 19 nt, Human
agaaucccuguguuaauuu

SEQ ID NO: 3784120 - RNA, 20 nt, Human
agaauccuggcccucugugu

SEQ ID NO: 3784121 - RNA, 22 nt, Human
agaauccuggcccucuguguug

SEQ ID NO: 3784122 - RNA, 22 nt, Human
agaauccuuuuguagaaugaac

SEQ ID NO: 3784123 - RNA, 13 nt, Human
agaaucucuuucg

SEQ ID NO: 3784124 - RNA, 18 nt, Human
agaaucugaauguaauuu

SEQ ID NO: 3784125 - RNA, 19 nt, Human
agaaucuguuucccagcag

SEQ ID NO: 3784126 - RNA, 19 nt, Human
agaaucuugguuugccuuc

SEQ ID NO: 3784127 - RNA, 17 nt, Human
agaaucuuuauugagaa

SEQ ID NO: 3784128 - RNA, 18 nt, Human
agaaucuuuauugagaaa

SEQ ID NO: 3784129 - RNA, 19 nt, Human
agaaucuuuccuuccucuc

SEQ ID NO: 3784130 - RNA, 18 nt, Human
agaaugaaaaaugaaaga

SEQ ID NO: 3784131 - RNA, 16 nt, Human
agaaugaaaacucauu

SEQ ID NO: 3784132 - RNA, 16 nt, Human
agaaugaaagcuguuc

SEQ ID NO: 3784133 - RNA, 21 nt, Human
agaaugaaagcuguuccuugg

SEQ ID NO: 3784134 - RNA, 15 nt, Human
agaaugaaauguaug

SEQ ID NO: 3784135 - RNA, 12 nt, Human
agaaugaacaaa

SEQ ID NO: 3784136 - RNA, 19 nt, Human
agaaugaagguuuuuguaa

SEQ ID NO: 3784137 - RNA, 13 nt, Human
agaaugaccuugu

SEQ ID NO: 3784138 - RNA, 14 nt, Human
agaaugaccuugua

SEQ ID NO: 3784139 - RNA, 14 nt, Human
agaaugagagugug

SEQ ID NO: 3784140 - RNA, 13 nt, Human
agaaugaggagga

SEQ ID NO: 3784141 - RNA, 13 nt, Human
agaaugaggcugc

SEQ ID NO: 3784142 - RNA, 20 nt, Human
agaaugaggcugcuuuccaa

SEQ ID NO: 3784143 - RNA, 21 nt, Human
agaaugaguccuugauuucaa

SEQ ID NO: 3784144 - RNA, 22 nt, Human
agaaugaguccuugauuucaaa

SEQ ID NO: 3784145 - RNA, 14 nt, Human
agaaugaucugauu

SEQ ID NO: 3784146 - RNA, 17 nt, Human
agaaugaucugauugac

SEQ ID NO: 3784147 - RNA, 20 nt, Human
agaaugaugauaacagaacu

SEQ ID NO: 3784148 - RNA, 19 nt, Human
agaaugaugcacauuucau

SEQ ID NO: 3784149 - RNA, 14 nt, Human
agaaugauuucaug

SEQ ID NO: 3784150 - RNA, 19 nt, Human
agaaugcacaaacagaggc

SEQ ID NO: 3784151 - RNA, 23 nt, Human
agaaugcacaaacagaggccgcc

SEQ ID NO: 3784152 - RNA, 22 nt, Human
agaaugcauugauauugugaac

SEQ ID NO: 3784153 - RNA, 16 nt, Human
agaaugccauucucuu

SEQ ID NO: 3784154 - RNA, 12 nt, Human
agaaugcugaaa

SEQ ID NO: 3784155 - RNA, 13 nt, Human
agaaugcugguuu

SEQ ID NO: 3784156 - RNA, 15 nt, Human
agaaugcuguacauc

SEQ ID NO: 3784157 - RNA, 20 nt, Human
agaaugcuguacaucuauuu

SEQ ID NO: 3784158 - RNA, 20 nt, Human
agaauggaucacaagaugga

SEQ ID NO: 3784159 - RNA, 18 nt, Human
agaauggcauuugcaaua

SEQ ID NO: 3784160 - RNA, 17 nt, Human
agaaugggaauauuuua

SEQ ID NO: 3784161 - RNA, 17 nt, Human
agaaugggcaguuacau

SEQ ID NO: 3784162 - RNA, 18 nt, Human
agaauggggaucacagag

SEQ ID NO: 3784163 - RNA, 16 nt, Human
agaauggugauuuuaa

SEQ ID NO: 3784164 - RNA, 18 nt, Human
agaauggugauuuuaaau

SEQ ID NO: 3784165 - RNA, 19 nt, Human
agcuccuguggccccaccc

SEQ ID NO: 3784166 - RNA, 18 nt, Human
agcuccuuaaggcucuuu

SEQ ID NO: 3784167 - RNA, 13 nt, Human
agcuccuuccugg

SEQ ID NO: 3784168 - RNA, 15 nt, Human
agcuccuuccuggag

SEQ ID NO: 3784169 - RNA, 13 nt, Human
agcuccuucuguc

SEQ ID NO: 3784170 - RNA, 21 nt, Human
agcuccuucuguccuacucug

SEQ ID NO: 3784171 - RNA, 22 nt, Human
agcuccuucuguccuacucugu

SEQ ID NO: 3784172 - RNA, 18 nt, Human
agcuccuugggaggaagc

SEQ ID NO: 3784173 - RNA, 22 nt, Human
agcuccuugggaggaagcagaa

SEQ ID NO: 3784174 - RNA, 14 nt, Human
agcuccuuuuccag

SEQ ID NO: 3784175 - RNA, 13 nt, Human
agcucgauccaaa

SEQ ID NO: 3784176 - RNA, 16 nt, Human
agcucgauccaaauug

SEQ ID NO: 3784177 - RNA, 22 nt, Human
agcucgauguggucacagcugu

SEQ ID NO: 3784178 - RNA, 20 nt, Human
agcucgcaccccccuguucu

SEQ ID NO: 3784179 - RNA, 21 nt, Human
agcucgcaccccccuguucua

SEQ ID NO: 3784180 - RNA, 15 nt, Human
agcucggggagccuu

SEQ ID NO: 3784181 - RNA, 22 nt, Human
agcucgguacccggggcccagg

SEQ ID NO: 3784182 - RNA, 14 nt, Human
agcucgguggaccc

SEQ ID NO: 3784183 - RNA, 17 nt, Human
agcucguguauccuggg

SEQ ID NO: 3784184 - RNA, 19 nt, Human
agcucguguauccuggggc

SEQ ID NO: 3784185 - RNA, 14 nt, Human
agcucuaaaaucug

SEQ ID NO: 3784186 - RNA, 22 nt, Human
agcucuaauaaaacagcugucu

SEQ ID NO: 3784187 - RNA, 18 nt, Human
agcucuaauguuugcaua

SEQ ID NO: 3784188 - RNA, 19 nt, Human
agcucuacccagggccugc

SEQ ID NO: 3784189 - RNA, 14 nt, Human
agcucuacccugca

SEQ ID NO: 3784190 - RNA, 17 nt, Human
agcucuacugccucaac

SEQ ID NO: 3784191 - RNA, 13 nt, Human
agcucuagaaucu

SEQ ID NO: 3784192 - RNA, 19 nt, Human
agcucuagacaacccugca

SEQ ID NO: 3784193 - RNA, 20 nt, Human
agcucuagacaacccugcaa

SEQ ID NO: 3784194 - RNA, 17 nt, Human
agcucuaucaccaagga

SEQ ID NO: 3784195 - RNA, 22 nt, Human
agcucuaucaccaaggagccaa

SEQ ID NO: 3784196 - RNA, 22 nt, Human
agcucuauuaagauuuccaagu

SEQ ID NO: 3784197 - RNA, 16 nt, Human
agcucuauuaugaaug

SEQ ID NO: 3784198 - RNA, 18 nt, Human
agcucuauugauacucuu

SEQ ID NO: 3784199 - RNA, 13 nt, Human
agcucucagccaa

SEQ ID NO: 3784200 - RNA, 21 nt, Human
agcucucaguugcagcccugc

SEQ ID NO: 3784201 - RNA, 15 nt, Human
agcucucaucugagg

SEQ ID NO: 3784202 - RNA, 13 nt, Human
agcucuccagcuc

SEQ ID NO: 3784203 - RNA, 16 nt, Human
agcucuccagcuccaa

SEQ ID NO: 3784204 - RNA, 19 nt, Human
agcucuccagucaggaggc

SEQ ID NO: 3784205 - RNA, 15 nt, Human
agcucuccccucaga

SEQ ID NO: 3784206 - RNA, 11 nt, Human
agcucucccuc

SEQ ID NO: 3784207 - RNA, 16 nt, Human
agcucucccucuggcc

SEQ ID NO: 3784208 - RNA, 14 nt, Human
agcucuccugacuu

SEQ ID NO: 3784209 - RNA, 17 nt, Human
agcucuccugacuuuua

SEQ ID NO: 3784210 - RNA, 18 nt, Human
agcucucggaacugcaug

SEQ ID NO: 3784211 - RNA, 23 nt, Human
agcucucggaacugcaugcugcu

SEQ ID NO: 3784212 - RNA, 16 nt, Human
agcucucuaggccucu

SEQ ID NO: 3784213 - RNA, 18 nt, Human
agcucucuaggccucucc

SEQ ID NO: 3784214 - RNA, 15 nt, Human
agcucucugcaucua

SEQ ID NO: 3784215 - RNA, 12 nt, Human
agcuuggcagcc

SEQ ID NO: 3784216 - RNA, 15 nt, Human
agcuuggcagccgag

SEQ ID NO: 3784217 - RNA, 20 nt, Human
agcuuggcagccgagcucgu

SEQ ID NO: 3784218 - RNA, 14 nt, Human
agcuuggccagaag

SEQ ID NO: 3784219 - RNA, 24 nt, Human
agcuugggagagccccuggggccu

SEQ ID NO: 3784220 - RNA, 11 nt, Human
agcuugggcag

SEQ ID NO: 3784221 - RNA, 22 nt, Human
agcuuggggccaccaaagcugc

SEQ ID NO: 3784222 - RNA, 18 nt, Human
agcuugguucugugaaca

SEQ ID NO: 3784223 - RNA, 22 nt, Human
agcuuguccaacccgaggcccg

SEQ ID NO: 3784224 - RNA, 22 nt, Human
agcuugucuaugguacaaaaau

SEQ ID NO: 3784225 - RNA, 17 nt, Human
agcuuguggcaagugaa

SEQ ID NO: 3784226 - RNA, 20 nt, Human
agcuugugugcaaaagcagu

SEQ ID NO: 3784227 - RNA, 13 nt, Human
agcuuguuuacau

SEQ ID NO: 3784228 - RNA, 23 nt, Human
agcuuguuuacaugcuuauucca

SEQ ID NO: 3784229 - RNA, 13 nt, Human
agcuuguuuugga

SEQ ID NO: 3784230 - RNA, 20 nt, Human
agcuuguuuuggacuuuguu

SEQ ID NO: 3784231 - RNA, 21 nt, Human
agcuuguuuuggacuuuguua

SEQ ID NO: 3784232 - RNA, 13 nt, Human
agcuuuaaaagaa

SEQ ID NO: 3784233 - RNA, 15 nt, Human
agcuuuaaacaaauu

SEQ ID NO: 3784234 - RNA, 17 nt, Human
agcuuuaaauuauguga

SEQ ID NO: 3784235 - RNA, 20 nt, Human
agcuuuacacacacagaugu

SEQ ID NO: 3784236 - RNA, 15 nt, Human
agcuuuacaugcaau

SEQ ID NO: 3784237 - RNA, 17 nt, Human
agcuuuacccucaggca

SEQ ID NO: 3784238 - RNA, 20 nt, Human
agcuuuacccucaggcauag

SEQ ID NO: 3784239 - RNA, 18 nt, Human
agcuuuagaaacagugca

SEQ ID NO: 3784240 - RNA, 18 nt, Human
agcuuuagaaucccagcc

SEQ ID NO: 3784241 - RNA, 16 nt, Human
agcuuuagacccuggg

SEQ ID NO: 3784242 - RNA, 14 nt, Human
agcuuuauacgugu

SEQ ID NO: 3784243 - RNA, 18 nt, Human
agcuuuauauauggacau

SEQ ID NO: 3784244 - RNA, 21 nt, Human
agcuuuaugguccuaaaagca

SEQ ID NO: 3784245 - RNA, 22 nt, Human
agcuuuauuuuuuaaguauuua

SEQ ID NO: 3784246 - RNA, 17 nt, Human
agcuuucaaagaaggaa

SEQ ID NO: 3784247 - RNA, 16 nt, Human
agcuuucaaagcauuu

SEQ ID NO: 3784248 - RNA, 15 nt, Human
agcuuucaauuccgu

SEQ ID NO: 3784249 - RNA, 19 nt, Human
agcuuuccauguugcugcc

SEQ ID NO: 3784250 - RNA, 20 nt, Human
agcuuuccauguugcugcca

SEQ ID NO: 3784251 - RNA, 15 nt, Human
agcuuuccugcccca

SEQ ID NO: 3784252 - RNA, 22 nt, Human
agcuuuccuuuuucccaauaaa

SEQ ID NO: 3784253 - RNA, 23 nt, Human
agcuuuccuuuuucccaauaaau

SEQ ID NO: 3784254 - RNA, 18 nt, Human
agcuuucugaacagcugg

SEQ ID NO: 3784255 - RNA, 20 nt, Human
agcuuucugaacagcuggug

SEQ ID NO: 3784256 - RNA, 19 nt, Human
agcuuucugaccuucagcu

SEQ ID NO: 3784257 - RNA, 22 nt, Human
agcuuucugagcaagaggauuu

SEQ ID NO: 3784258 - RNA, 17 nt, Human
agcuuucuugcucccuu

SEQ ID NO: 3784259 - RNA, 20 nt, Human
agcuuucuuucacaaaaaag

SEQ ID NO: 3784260 - RNA, 12 nt, Human
agcuuugaaaau

SEQ ID NO: 3784261 - RNA, 16 nt, Human
agcuuugaaaauucag

SEQ ID NO: 3784262 - RNA, 19 nt, Human
agcuuugaaggccgaaggc

SEQ ID NO: 3784263 - RNA, 16 nt, Human
agcuuugacucaggag

SEQ ID NO: 3784264 - RNA, 21 nt, Human
agcuuugacuggaggguccau

SEQ ID NO: 3784265 - RNA, 17 nt, Human
agcuuugagaagccuuc

SEQ ID NO: 3784266 - RNA, 19 nt, Human
agcuuugagaagccuucag

SEQ ID NO: 3784267 - RNA, 15 nt, Human
agcuuugauuuuuac

SEQ ID NO: 3784268 - RNA, 17 nt, Human
agcuuugccagcugcug

SEQ ID NO: 3784269 - RNA, 20 nt, Human
agcuuugccagcugcugcug

SEQ ID NO: 3784270 - RNA, 13 nt, Human
agcuuugcugcua

SEQ ID NO: 3784271 - RNA, 22 nt, Human
agcuuugcugcugaaggcucau

SEQ ID NO: 3784272 - RNA, 19 nt, Human
agcuuuggacacacacagc

SEQ ID NO: 3784273 - RNA, 18 nt, Human
agcuuuggaccuaaucca

SEQ ID NO: 3784274 - RNA, 13 nt, Human
agcuuuggcagug

SEQ ID NO: 3784275 - RNA, 17 nt, Human
agcuuuggucugugugu

SEQ ID NO: 3784276 - RNA, 22 nt, Human
agcuuugucacuguuucacuac

SEQ ID NO: 3784277 - RNA, 22 nt, Human
agcuuuguguuugguuuacauu

SEQ ID NO: 3784278 - RNA, 12 nt, Human
agcuuuguucuu

SEQ ID NO: 3784279 - RNA, 18 nt, Human
agcuuuguucuucuuaaa

SEQ ID NO: 3784280 - RNA, 18 nt, Human
agcuuuguuuagucuuua

SEQ ID NO: 3784281 - RNA, 20 nt, Human
agcuuuguuuagucuuuaua

SEQ ID NO: 3784282 - RNA, 15 nt, Human
agcuuuguuuguucu

SEQ ID NO: 3784283 - RNA, 22 nt, Human
agcuuuguuuguugucagcuga

SEQ ID NO: 3784284 - RNA, 17 nt, Human
agcuuuuaguacccacc

SEQ ID NO: 3784285 - RNA, 19 nt, Human
agcuuuuaguacccaccug

SEQ ID NO: 3784286 - RNA, 17 nt, Human
agcuuuuauuguauaaa

SEQ ID NO: 3784287 - RNA, 19 nt, Human
agcuuuuauuguauaaacu

SEQ ID NO: 3784288 - RNA, 12 nt, Human
agcuuuucaccu

SEQ ID NO: 3784289 - RNA, 14 nt, Human
agcuuuuccucccu

SEQ ID NO: 3784290 - RNA, 13 nt, Human
agcuuuugucuac

SEQ ID NO: 3784291 - RNA, 22 nt, Human
agcuuuugugggggacuguaag

SEQ ID NO: 3784292 - RNA, 24 nt, Human
agcuuuugugggggacuguaaguu

SEQ ID NO: 3784293 - RNA, 14 nt, Human
agcuuuuuaauugu

SEQ ID NO: 3784294 - RNA, 22 nt, Human
agcuuuuuaauuguuguuucuu

SEQ ID NO: 3784295 - RNA, 19 nt, Human
agcuuuuuccagaggcuau

SEQ ID NO: 3784296 - RNA, 15 nt, Human
agcuuuuuccuccug

SEQ ID NO: 3784297 - RNA, 14 nt, Human
agcuuuuuggaauc

SEQ ID NO: 3784298 - RNA, 20 nt, Human
agcuuuuuuauuuuuuauac

SEQ ID NO: 3784299 - RNA, 22 nt, Human
agcuuuuuucucugauacagaa

SEQ ID NO: 3784300 - RNA, 23 nt, Human
agcuuuuuucucugauacagaaa

SEQ ID NO: 3784301 - RNA, 10 nt, Human
aggaaaaaaa

SEQ ID NO: 3784302 - RNA, 14 nt, Human
aggaaaaaaacuuu

SEQ ID NO: 3784303 - RNA, 14 nt, Human
aggaaaaaaagacu

SEQ ID NO: 3784304 - RNA, 13 nt, Human
aggaaaaaaauag

SEQ ID NO: 3784305 - RNA, 21 nt, Human
aggaaaaaaaucguccaggga

SEQ ID NO: 3784306 - RNA, 15 nt, Human
aggaaaaaauaaaca

SEQ ID NO: 3784307 - RNA, 15 nt, Human
aggaaaaacugauuu

SEQ ID NO: 3784308 - RNA, 15 nt, Human
aggaaaaagcacaag

SEQ ID NO: 3784309 - RNA, 13 nt, Human
aggaaaaagcucc

SEQ ID NO: 3784310 - RNA, 22 nt, Human
aggaaaaaggacaggcagaaag

SEQ ID NO: 3784311 - RNA, 15 nt, Human
aggaaaaauauguga

SEQ ID NO: 3784312 - RNA, 16 nt, Human
aggaaaaauaugugaa

SEQ ID NO: 3784313 - RNA, 20 nt, Human
aggaaaaccaagccguggcu

SEQ ID NO: 3784314 - RNA, 21 nt, Human
aggaaaaccaagccguggcuu

SEQ ID NO: 3784315 - RNA, 10 nt, Human
aggaaaagaa

SEQ ID NO: 3784316 - RNA, 13 nt, Human
aggaaaagaaaaa

SEQ ID NO: 3784317 - RNA, 15 nt, Human
aggaaaagaaaaaaa

SEQ ID NO: 3784318 - RNA, 15 nt, Human
aggaaaagaaaucua

SEQ ID NO: 3784319 - RNA, 23 nt, Human
agaauggugauuuuaaaugugug

SEQ ID NO: 3784320 - RNA, 13 nt, Human
agaaugguggcuu

SEQ ID NO: 3784321 - RNA, 17 nt, Human
agaaugguggcuucuuu

SEQ ID NO: 3784322 - RNA, 19 nt, Human
agaauggugugaacccggg

SEQ ID NO: 3784323 - RNA, 23 nt, Human
agaaugguugccuuaaagaaagu

SEQ ID NO: 3784324 - RNA, 17 nt, Human
agaauguaaaagaacuu

SEQ ID NO: 3784325 - RNA, 13 nt, Human
agaauguaaagcu

SEQ ID NO: 3784326 - RNA, 16 nt, Human
agaauguaaagcuugu

SEQ ID NO: 3784327 - RNA, 17 nt, Human
agaauguaaagcuuguc

SEQ ID NO: 3784328 - RNA, 13 nt, Human
agaauguaaaugu

SEQ ID NO: 3784329 - RNA, 22 nt, Human
agaauguaaaugucucacugag

SEQ ID NO: 3784330 - RNA, 14 nt, Human
agaauguaucccca

SEQ ID NO: 3784331 - RNA, 21 nt, Human
agaauguauccccaaaagcgu

SEQ ID NO: 3784332 - RNA, 15 nt, Human
agaauguaucuguga

SEQ ID NO: 3784333 - RNA, 16 nt, Human
agaauguaucugugaa

SEQ ID NO: 3784334 - RNA, 16 nt, Human
agaauguauuguaccu

SEQ ID NO: 3784335 - RNA, 17 nt, Human
agaauguauuguaccuu

SEQ ID NO: 3784336 - RNA, 21 nt, Human
agaauguauuguaccuuuuaa

SEQ ID NO: 3784337 - RNA, 15 nt, Human
agaaugucagaaaaa

SEQ ID NO: 3784338 - RNA, 15 nt, Human
agaaugucaguaugu

SEQ ID NO: 3784339 - RNA, 16 nt, Human
agaaugucauuuuggu

SEQ ID NO: 3784340 - RNA, 18 nt, Human
agaaugugcucaugcauu

SEQ ID NO: 3784341 - RNA, 16 nt, Human
agaauguguuucaaac

SEQ ID NO: 3784342 - RNA, 19 nt, Human
agaauguuaagacuugaca

SEQ ID NO: 3784343 - RNA, 17 nt, Human
agaauguuacugccuua

SEQ ID NO: 3784344 - RNA, 16 nt, Human
agaauguuagagcaca

SEQ ID NO: 3784345 - RNA, 14 nt, Human
agaauguuccagac

SEQ ID NO: 3784346 - RNA, 14 nt, Human
agaauguucucaau

SEQ ID NO: 3784347 - RNA, 16 nt, Human
agaauguugguuuacu

SEQ ID NO: 3784348 - RNA, 13 nt, Human
agaauguuucauu

SEQ ID NO: 3784349 - RNA, 21 nt, Human
agaauguuuucaaauguucuc

SEQ ID NO: 3784350 - RNA, 14 nt, Human
agaauguuuuccuu

SEQ ID NO: 3784351 - RNA, 15 nt, Human
agaauuaaacuuuua

SEQ ID NO: 3784352 - RNA, 22 nt, Human
agaauuaaacuuuuaauucauu

SEQ ID NO: 3784353 - RNA, 14 nt, Human
agaauuagauuaua

SEQ ID NO: 3784354 - RNA, 22 nt, Human
agaauuagugccagaauuuuag

SEQ ID NO: 3784355 - RNA, 13 nt, Human
agaauuauauagg

SEQ ID NO: 3784356 - RNA, 17 nt, Human
agaauuaucuaauuuau

SEQ ID NO: 3784357 - RNA, 21 nt, Human
agaauuaucuaauuuauaaaa

SEQ ID NO: 3784358 - RNA, 11 nt, Human
agaauuauuua

SEQ ID NO: 3784359 - RNA, 15 nt, Human
agaauuauuuuguga

SEQ ID NO: 3784360 - RNA, 20 nt, Human
agcugcaucauccuugcagg

SEQ ID NO: 3784361 - RNA, 15 nt, Human
agcugcaucuacuca

SEQ ID NO: 3784362 - RNA, 14 nt, Human
agcugccaagagug

SEQ ID NO: 3784363 - RNA, 17 nt, Human
agcugccaccugccugu

SEQ ID NO: 3784364 - RNA, 12 nt, Human
agcugccagaga

SEQ ID NO: 3784365 - RNA, 13 nt, Human
agcugccagagaa

SEQ ID NO: 3784366 - RNA, 23 nt, Human
agcugccaggagcacggcucugu

SEQ ID NO: 3784367 - RNA, 15 nt, Human
agcugccaguguccu

SEQ ID NO: 3784368 - RNA, 17 nt, Human
agcugccauccagggau

SEQ ID NO: 3784369 - RNA, 19 nt, Human
agcugcccccgcucauggg

SEQ ID NO: 3784370 - RNA, 17 nt, Human
agcugccccggccccuc

SEQ ID NO: 3784371 - RNA, 13 nt, Human
agcugccccuccc

SEQ ID NO: 3784372 - RNA, 14 nt, Human
agcugccccuggcu

SEQ ID NO: 3784373 - RNA, 21 nt, Human
agcugcccuaugggccugccg

SEQ ID NO: 3784374 - RNA, 11 nt, Human
agcugcccucc

SEQ ID NO: 3784375 - RNA, 23 nt, Human
agcugcccuccccuccggacugg

SEQ ID NO: 3784376 - RNA, 20 nt, Human
agcugcccucuccugggcag

SEQ ID NO: 3784377 - RNA, 15 nt, Human
agcugcccuuccgca

SEQ ID NO: 3784378 - RNA, 13 nt, Human
agcugccucacuu

SEQ ID NO: 3784379 - RNA, 15 nt, Human
agcugccuccccucc

SEQ ID NO: 3784380 - RNA, 18 nt, Human
agcugccuccccuccucu

SEQ ID NO: 3784381 - RNA, 17 nt, Human
agcugccugaaaaucaa

SEQ ID NO: 3784382 - RNA, 21 nt, Human
agcugccugggaucccucauc

SEQ ID NO: 3784383 - RNA, 15 nt, Human
agcugccuguaguua

SEQ ID NO: 3784384 - RNA, 18 nt, Human
agcugccuguaguuagga

SEQ ID NO: 3784385 - RNA, 23 nt, Human
agcugccuguaguuaggaaauaa

SEQ ID NO: 3784386 - RNA, 23 nt, Human
agcugccugucccuaccccaugg

SEQ ID NO: 3784387 - RNA, 21 nt, Human
agcugccuguucagcuccagc

SEQ ID NO: 3784388 - RNA, 16 nt, Human
agcugccuuagcuuca

SEQ ID NO: 3784389 - RNA, 12 nt, Human
agcugccuuccc

SEQ ID NO: 3784390 - RNA, 13 nt, Human
agcugccuucccu

SEQ ID NO: 3784391 - RNA, 18 nt, Human
agcugccuucccuagcuu

SEQ ID NO: 3784392 - RNA, 16 nt, Human
agcugccuuggcucag

SEQ ID NO: 3784393 - RNA, 17 nt, Human
agcugccuuggcucaga

SEQ ID NO: 3784394 - RNA, 15 nt, Human
agcugcgggcugggu

SEQ ID NO: 3784395 - RNA, 18 nt, Human
agcugcgguccacccagg

SEQ ID NO: 3784396 - RNA, 13 nt, Human
agcugcuaaaucu

SEQ ID NO: 3784397 - RNA, 15 nt, Human
agcugcuaaaucucc

SEQ ID NO: 3784398 - RNA, 14 nt, Human
agcugcuacaaaga

SEQ ID NO: 3784399 - RNA, 15 nt, Human
agcugcuacaaagaa

SEQ ID NO: 3784400 - RNA, 17 nt, Human
agcugcuacaaagaaga

SEQ ID NO: 3784401 - RNA, 18 nt, Human
agcugcuacaaagaagac

SEQ ID NO: 3784402 - RNA, 19 nt, Human
agcugcuauccccaucucc

SEQ ID NO: 3784403 - RNA, 16 nt, Human
agcugcucaacuugca

SEQ ID NO: 3784404 - RNA, 16 nt, Human
agcugcuccaggccug

SEQ ID NO: 3784405 - RNA, 17 nt, Human
agcugcuccaggccugc

SEQ ID NO: 3784406 - RNA, 19 nt, Human
agcugcuccaggccugcag

SEQ ID NO: 3784407 - RNA, 20 nt, Human
agcugcuccccagcagcgga

SEQ ID NO: 3784408 - RNA, 14 nt, Human
agcugcuccccucc

SEQ ID NO: 3784409 - RNA, 15 nt, Human
agcugcuccccuccc

SEQ ID NO: 3784410 - RNA, 12 nt, Human
agcugcucugcc

SEQ ID NO: 3784411 - RNA, 13 nt, Human
agcugcucugccc

SEQ ID NO: 3784412 - RNA, 19 nt, Human
agcugcucugcccagagcu

SEQ ID NO: 3784413 - RNA, 21 nt, Human
agcugcucugcccagagcugg

SEQ ID NO: 3784414 - RNA, 15 nt, Human
agcugcucuggaaaa

SEQ ID NO: 3784415 - RNA, 20 nt, Human
agcugcugaaacaacaaaua

SEQ ID NO: 3784416 - RNA, 13 nt, Human
agcugcugacagu

SEQ ID NO: 3784417 - RNA, 22 nt, Human
agcugcugaccaauugugcugc

SEQ ID NO: 3784418 - RNA, 17 nt, Human
agcugcugagccgcaga

SEQ ID NO: 3784419 - RNA, 14 nt, Human
agcugcuggagacu

SEQ ID NO: 3784420 - RNA, 23 nt, Human
agcugcuggagacuccuaggcag

SEQ ID NO: 3784421 - RNA, 17 nt, Human
agcugcuggcuugcagu

SEQ ID NO: 3784422 - RNA, 20 nt, Human
agcugcuugggcuucauccu

SEQ ID NO: 3784423 - RNA, 14 nt, Human
agcugcuugugucc

SEQ ID NO: 3784424 - RNA, 15 nt, Human
agcugcuuguguccc

SEQ ID NO: 3784425 - RNA, 20 nt, Human
agcugcuugugucccuccug

SEQ ID NO: 3784426 - RNA, 14 nt, Human
agcugcuuuguuac

SEQ ID NO: 3784427 - RNA, 20 nt, Human
agcugcuuuguuaccuuaaa

SEQ ID NO: 3784428 - RNA, 23 nt, Human
agcugcuuuugucuaugggacuc

SEQ ID NO: 3784429 - RNA, 13 nt, Human
agcuggacagagg

SEQ ID NO: 3784430 - RNA, 21 nt, Human
agcuggacagaggggacucug

SEQ ID NO: 3784431 - RNA, 15 nt, Human
agcuggacccugacc

SEQ ID NO: 3784432 - RNA, 17 nt, Human
agcuggacccugaccag

SEQ ID NO: 3784433 - RNA, 16 nt, Human
agcuggacuacccacg

SEQ ID NO: 3784434 - RNA, 17 nt, Human
agcuggagaaauauggu

SEQ ID NO: 3784435 - RNA, 15 nt, Human
agcuggagaagaccc

SEQ ID NO: 3784436 - RNA, 23 nt, Human
agcuggagaggagcccugccucu

SEQ ID NO: 3784437 - RNA, 18 nt, Human
agcuggagaugaggccag

SEQ ID NO: 3784438 - RNA, 14 nt, Human
agcuggagccuggu

SEQ ID NO: 3784439 - RNA, 13 nt, Human
agcuggaggcagg

SEQ ID NO: 3784440 - RNA, 17 nt, Human
agcuggaggcaggggcu

SEQ ID NO: 3784441 - RNA, 23 nt, Human
agcuggaggcaggggcuuccugg

SEQ ID NO: 3784442 - RNA, 20 nt, Human
agcuggaugauggucuucag

SEQ ID NO: 3784443 - RNA, 16 nt, Human
agcuggcagcagagug

SEQ ID NO: 3784444 - RNA, 20 nt, Human
agcuggccgaggguccuggc

SEQ ID NO: 3784445 - RNA, 19 nt, Human
agcuggccgggagccugau

SEQ ID NO: 3784446 - RNA, 19 nt, Human
agcuggccgugggccuggg

SEQ ID NO: 3784447 - RNA, 22 nt, Human
agcuggccucucacugccuccc

SEQ ID NO: 3784448 - RNA, 21 nt, Human
agcuggcgucaugcaaaguca

SEQ ID NO: 3784449 - RNA, 11 nt, Human
agcuggcucua

SEQ ID NO: 3784450 - RNA, 22 nt, Human
agcuggcucuauaaggcagccu

SEQ ID NO: 3784451 - RNA, 21 nt, Human
agcuggcucugugagggugcu

SEQ ID NO: 3784452 - RNA, 13 nt, Human
agcuggcuggggu

SEQ ID NO: 3784453 - RNA, 19 nt, Human
agcuggcugggguggccug

SEQ ID NO: 3784454 - RNA, 20 nt, Human
agcuggcuuacacuggcaau

SEQ ID NO: 3784455 - RNA, 14 nt, Human
agcugggaaagcau

SEQ ID NO: 3784456 - RNA, 21 nt, Human
agcugggacaccccgacuuuu

SEQ ID NO: 3784457 - RNA, 18 nt, Human
agcugggacuacaggcac

SEQ ID NO: 3784458 - RNA, 23 nt, Human
agcugggacuacaggcacccacc

SEQ ID NO: 3784459 - RNA, 17 nt, Human
agcugggacuacaggug

SEQ ID NO: 3784460 - RNA, 19 nt, Human
agcugggacuacaggugug

SEQ ID NO: 3784461 - RNA, 14 nt, Human
agcugggagccggg

SEQ ID NO: 3784462 - RNA, 15 nt, Human
agcugggagccgggc

SEQ ID NO: 3784463 - RNA, 12 nt, Human
agcugggaggaa

SEQ ID NO: 3784464 - RNA, 14 nt, Human
agcugggaggaaaa

SEQ ID NO: 3784465 - RNA, 16 nt, Human
agcugggaggcaagag

SEQ ID NO: 3784466 - RNA, 17 nt, Human
agcugggaggcaagagg

SEQ ID NO: 3784467 - RNA, 20 nt, Human
agcugggaggcauggcccug

SEQ ID NO: 3784468 - RNA, 22 nt, Human
agcugggaggcauggcccuggg

SEQ ID NO: 3784469 - RNA, 21 nt, Human
agcugggaucugacugcacgu

SEQ ID NO: 3784470 - RNA, 18 nt, Human
agcugggauuacaggcuc

SEQ ID NO: 3784471 - RNA, 21 nt, Human
agcugggauuacaggcuccug

SEQ ID NO: 3784472 - RNA, 23 nt, Human
agcugggauuacaggcuccugcc

SEQ ID NO: 3784473 - RNA, 15 nt, Human
agcugggauuuuaaa

SEQ ID NO: 3784474 - RNA, 16 nt, Human
aggaaaagaaaucuau

SEQ ID NO: 3784475 - RNA, 14 nt, Human
aggaaaagacacau

SEQ ID NO: 3784476 - RNA, 17 nt, Human
aggaaaagccucugugu

SEQ ID NO: 3784477 - RNA, 14 nt, Human
aggaaaaggccugg

SEQ ID NO: 3784478 - RNA, 24 nt, Human
aggaaaaguuuaauauuaaagcca

SEQ ID NO: 3784479 - RNA, 14 nt, Human
aggaaaaugucugu

SEQ ID NO: 3784480 - RNA, 11 nt, Human
aggaaaauuau

SEQ ID NO: 3784481 - RNA, 14 nt, Human
aggaaaauugaaug

SEQ ID NO: 3784482 - RNA, 21 nt, Human
aggaaaauuuuagcgugcuca

SEQ ID NO: 3784483 - RNA, 19 nt, Human
aggaaacaaccaugucauu

SEQ ID NO: 3784484 - RNA, 14 nt, Human
aggaaacaagugaa

SEQ ID NO: 3784485 - RNA, 17 nt, Human
aggaaacaauauuuaua

SEQ ID NO: 3784486 - RNA, 12 nt, Human
aggaaacaguua

SEQ ID NO: 3784487 - RNA, 16 nt, Human
aggaaaccacagcugc

SEQ ID NO: 3784488 - RNA, 17 nt, Human
aggaaaccacagcugcu

SEQ ID NO: 3784489 - RNA, 20 nt, Human
aggaaaccacagcugcugga

SEQ ID NO: 3784490 - RNA, 23 nt, Human
aggaaaccaguuaggucucaaua

SEQ ID NO: 3784491 - RNA, 16 nt, Human
aggaaacccagcucug

SEQ ID NO: 3784492 - RNA, 18 nt, Human
aggaaacccagcucuggu

SEQ ID NO: 3784493 - RNA, 22 nt, Human
aggaaaccgccuaguuuacugu

SEQ ID NO: 3784494 - RNA, 18 nt, Human
aggaaacuagcuuacaug

SEQ ID NO: 3784495 - RNA, 16 nt, Human
aggaaacucaccugcu

SEQ ID NO: 3784496 - RNA, 23 nt, Human
aggaaacucaccugcuggccccu

SEQ ID NO: 3784497 - RNA, 20 nt, Human
aggaaacuccacaucugccu

SEQ ID NO: 3784498 - RNA, 22 nt, Human
aggaaacuccacaucugccuua

SEQ ID NO: 3784499 - RNA, 12 nt, Human
aggaaagaauag

SEQ ID NO: 3784500 - RNA, 12 nt, Human
aggaaagagagc

SEQ ID NO: 3784501 - RNA, 17 nt, Human
aggaaagaggaagcaaa

SEQ ID NO: 3784502 - RNA, 13 nt, Human
aggaaagaggcuc

SEQ ID NO: 3784503 - RNA, 17 nt, Human
aggaaagagucuucaac

SEQ ID NO: 3784504 - RNA, 17 nt, Human
aggaaagcaaaggagau

SEQ ID NO: 3784505 - RNA, 21 nt, Human
agcuggugcauuacagagagg

SEQ ID NO: 3784506 - RNA, 22 nt, Human
agcuggugcauuacagagagga

SEQ ID NO: 3784507 - RNA, 14 nt, Human
agcuggugcccgga

SEQ ID NO: 3784508 - RNA, 13 nt, Human
agcuggugcggcu

SEQ ID NO: 3784509 - RNA, 17 nt, Human
agcuggugcggcuggcc

SEQ ID NO: 3784510 - RNA, 13 nt, Human
agcuggugggaag

SEQ ID NO: 3784511 - RNA, 14 nt, Human
agcuggugguuuca

SEQ ID NO: 3784512 - RNA, 17 nt, Human
agcugguguagcuacag

SEQ ID NO: 3784513 - RNA, 19 nt, Human
agcugguguagcuacagag

SEQ ID NO: 3784514 - RNA, 18 nt, Human
agcuggugucugauuguu

SEQ ID NO: 3784515 - RNA, 22 nt, Human
agcugguuccugcuagaaaugg

SEQ ID NO: 3784516 - RNA, 22 nt, Human
agcugguuuccucauuccugaa

SEQ ID NO: 3784517 - RNA, 15 nt, Human
agcuguaaaaagaga

SEQ ID NO: 3784518 - RNA, 19 nt, Human
agcuguaaaaagagagaaa

SEQ ID NO: 3784519 - RNA, 16 nt, Human
agcuguaaaccagaga

SEQ ID NO: 3784520 - RNA, 13 nt, Human
agcuguaaggcau

SEQ ID NO: 3784521 - RNA, 17 nt, Human
agcuguaaggcaugaag

SEQ ID NO: 3784522 - RNA, 22 nt, Human
agcuguacaaauauaagaauaa

SEQ ID NO: 3784523 - RNA, 19 nt, Human
agcuguacuucgucuucua

SEQ ID NO: 3784524 - RNA, 11 nt, Human
agcuguaucaa

SEQ ID NO: 3784525 - RNA, 14 nt, Human
agcuguaugauucc

SEQ ID NO: 3784526 - RNA, 17 nt, Human
agcuguaugauucccag

SEQ ID NO: 3784527 - RNA, 11 nt, Human
agcuguauuga

SEQ ID NO: 3784528 - RNA, 16 nt, Human
agcuguauugaaucau

SEQ ID NO: 3784529 - RNA, 15 nt, Human
agcuguauuuugaaa

SEQ ID NO: 3784530 - RNA, 16 nt, Human
agcugucaaggcucag

SEQ ID NO: 3784531 - RNA, 20 nt, Human
agcugucacuuuugcuccga

SEQ ID NO: 3784532 - RNA, 19 nt, Human
agcugucaucaauuaaagg

SEQ ID NO: 3784533 - RNA, 14 nt, Human
agcuguccagagaa

SEQ ID NO: 3784534 - RNA, 18 nt, Human
agcugucccugucaccaa

SEQ ID NO: 3784535 - RNA, 14 nt, Human
agcugucccuugcu

SEQ ID NO: 3784536 - RNA, 15 nt, Human
agcuguccucccucc

SEQ ID NO: 3784537 - RNA, 14 nt, Human
agcuguccugcagc

SEQ ID NO: 3784538 - RNA, 15 nt, Human
agcuguccugcagca

SEQ ID NO: 3784539 - RNA, 14 nt, Human
agcuguccuuuuuc

SEQ ID NO: 3784540 - RNA, 19 nt, Human
agcugucucaaaccuccaa

SEQ ID NO: 3784541 - RNA, 16 nt, Human
agcugucuuuuggagg

SEQ ID NO: 3784542 - RNA, 15 nt, Human
agcugugaacaggcu

SEQ ID NO: 3784543 - RNA, 18 nt, Human
agcugugaccugcugagc

SEQ ID NO: 3784544 - RNA, 22 nt, Human
agcugugaccugcugagcucug

SEQ ID NO: 3784545 - RNA, 23 nt, Human
agcugugaccugcugagcucuga

SEQ ID NO: 3784546 - RNA, 18 nt, Human
agcugugacuucuccagg

SEQ ID NO: 3784547 - RNA, 16 nt, Human
agcugugagccuuggc

SEQ ID NO: 3784548 - RNA, 18 nt, Human
agcugugagccuuggcug

SEQ ID NO: 3784549 - RNA, 19 nt, Human
agcugugaguucucccugu

SEQ ID NO: 3784550 - RNA, 20 nt, Human
agcugugcacaaaguggcau

SEQ ID NO: 3784551 - RNA, 12 nt, Human
agcugugcaggu

SEQ ID NO: 3784552 - RNA, 12 nt, Human
agcugugccacc

SEQ ID NO: 3784553 - RNA, 16 nt, Human
agcugugcgugugugu

SEQ ID NO: 3784554 - RNA, 17 nt, Human
agcugugcgugugugug

SEQ ID NO: 3784555 - RNA, 17 nt, Human
agcugugcucuggacag

SEQ ID NO: 3784556 - RNA, 18 nt, Human
agcugugcucuggacagg

SEQ ID NO: 3784557 - RNA, 19 nt, Human
agcugugcucuggacaggc

SEQ ID NO: 3784558 - RNA, 20 nt, Human
agcugugcucuggacaggca

SEQ ID NO: 3784559 - RNA, 18 nt, Human
agcuguggcagaguuaca

SEQ ID NO: 3784560 - RNA, 21 nt, Human
agcuguggcagaguuacaguu

SEQ ID NO: 3784561 - RNA, 18 nt, Human
agcuguguccuugcaccu

SEQ ID NO: 3784562 - RNA, 20 nt, Human
agcuguguccuugcaccugc

SEQ ID NO: 3784563 - RNA, 21 nt, Human
agcuguguccuugcaccugca

SEQ ID NO: 3784564 - RNA, 18 nt, Human
agcuguuacugucuucag

SEQ ID NO: 3784565 - RNA, 14 nt, Human
agcuguucacagcc

SEQ ID NO: 3784566 - RNA, 16 nt, Human
agcuguuccuguucag

SEQ ID NO: 3784567 - RNA, 20 nt, Human
agcuguuccuugguccuagu

SEQ ID NO: 3784568 - RNA, 13 nt, Human
agcuguucuuccu

SEQ ID NO: 3784569 - RNA, 14 nt, Human
agcuguucuuccug

SEQ ID NO: 3784570 - RNA, 21 nt, Human
agcuguugacucuaguacugu

SEQ ID NO: 3784571 - RNA, 16 nt, Human
agcuguugagcuguuu

SEQ ID NO: 3784572 - RNA, 23 nt, Human
agcuguuguacauuuaugauuua

SEQ ID NO: 3784573 - RNA, 19 nt, Human
agcuguugucucuucuccu

SEQ ID NO: 3784574 - RNA, 12 nt, Human
agcuguuuaaga

SEQ ID NO: 3784575 - RNA, 16 nt, Human
agcuguuuaagauggg

SEQ ID NO: 3784576 - RNA, 16 nt, Human
agcuguuuggaaaaga

SEQ ID NO: 3784577 - RNA, 17 nt, Human
agcuguuugguuuuaaa

SEQ ID NO: 3784578 - RNA, 19 nt, Human
agcuguuugguuuuaaaau

SEQ ID NO: 3784579 - RNA, 24 nt, Human
agcuguuugguuuuaaaauacugu

SEQ ID NO: 3784580 - RNA, 20 nt, Human
agcuguuuuaguuaaauuuc

SEQ ID NO: 3784581 - RNA, 15 nt, Human
agcuguuuucccuga

SEQ ID NO: 3784582 - RNA, 14 nt, Human
agcuguuuuguuga

SEQ ID NO: 3784583 - RNA, 23 nt, Human
agcuguuuuguugacauucugaa

SEQ ID NO: 3784584 - RNA, 14 nt, Human
agcuuaaaaaaaac

SEQ ID NO: 3784585 - RNA, 22 nt, Human
agcuuaaaacuuugaaguuagc

SEQ ID NO: 3784586 - RNA, 14 nt, Human
agcuuaaaauacaa

SEQ ID NO: 3784587 - RNA, 18 nt, Human
agcuuaaaauacaagacu

SEQ ID NO: 3784588 - RNA, 16 nt, Human
agcuuaagggucauau

SEQ ID NO: 3784589 - RNA, 20 nt, Human
agcuuaagggucauauguuu

SEQ ID NO: 3784590 - RNA, 19 nt, Human
agcuuaauggcugauaauu

SEQ ID NO: 3784591 - RNA, 16 nt, Human
agcuuacauaguuuua

SEQ ID NO: 3784592 - RNA, 22 nt, Human
agcuuacauaguuuuaaacuca

SEQ ID NO: 3784593 - RNA, 17 nt, Human
agcuuaccucccaccuu

SEQ ID NO: 3784594 - RNA, 15 nt, Human
agcuuacguaguucu

SEQ ID NO: 3784595 - RNA, 21 nt, Human
agcuuacucuguccauuuauc

SEQ ID NO: 3784596 - RNA, 15 nt, Human
agcuuagaaacugga

SEQ ID NO: 3784597 - RNA, 14 nt, Human
agcuuagaccucag

SEQ ID NO: 3784598 - RNA, 17 nt, Human
agcuuagaccucagccu

SEQ ID NO: 3784599 - RNA, 18 nt, Human
agcuuagaccucagccug

SEQ ID NO: 3784600 - RNA, 18 nt, Human
agcuuagcuuuagaaaca

SEQ ID NO: 3784601 - RNA, 19 nt, Human
agcuuagcuuuagaaacag

SEQ ID NO: 3784602 - RNA, 14 nt, Human
agcuuagggcccug

SEQ ID NO: 3784603 - RNA, 18 nt, Human
agcuuagggcccuggagg

SEQ ID NO: 3784604 - RNA, 16 nt, Human
agcuuagggucucagg

SEQ ID NO: 3784605 - RNA, 13 nt, Human
agcuuaucaauuu

SEQ ID NO: 3784606 - RNA, 17 nt, Human
agcuuaucaauuuguca

SEQ ID NO: 3784607 - RNA, 18 nt, Human
agcuuauccauaaaaaaa

SEQ ID NO: 3784608 - RNA, 15 nt, Human
agcuuaucucagggg

SEQ ID NO: 3784609 - RNA, 19 nt, Human
agcuuaucucuuuuauauu

SEQ ID NO: 3784610 - RNA, 15 nt, Human
agcuuaugaaaagaa

SEQ ID NO: 3784611 - RNA, 20 nt, Human
agcuuauuaaaacucauuuu

SEQ ID NO: 3784612 - RNA, 18 nt, Human
agcuuauuaaugcuaagg

SEQ ID NO: 3784613 - RNA, 22 nt, Human
agcuuauuaaugcuaagggcag

SEQ ID NO: 3784614 - RNA, 21 nt, Human
agcuuauugucuagugaaacu

SEQ ID NO: 3784615 - RNA, 18 nt, Human
agcuucacaguacccaaa

SEQ ID NO: 3784616 - RNA, 13 nt, Human
agcuucacuucug

SEQ ID NO: 3784617 - RNA, 21 nt, Human
agcuucagaaguuuggcaaua

SEQ ID NO: 3784618 - RNA, 21 nt, Human
agcuucagauggugaagcauu

SEQ ID NO: 3784619 - RNA, 13 nt, Human
agcuucaggaacc

SEQ ID NO: 3784620 - RNA, 16 nt, Human
agcuucaggaaccucg

SEQ ID NO: 3784621 - RNA, 23 nt, Human
agcuucagguuaucgaaauaaca

SEQ ID NO: 3784622 - RNA, 21 nt, Human
agcuucaguaaguuaucuuug

SEQ ID NO: 3784623 - RNA, 19 nt, Human
agcuucaguugcuugucuu

SEQ ID NO: 3784624 - RNA, 15 nt, Human
agcuucaguuuccug

SEQ ID NO: 3784625 - RNA, 20 nt, Human
agcuucaugcacuuaaagaa

SEQ ID NO: 3784626 - RNA, 15 nt, Human
agcuucaugccuuug

SEQ ID NO: 3784627 - RNA, 18 nt, Human
agcuucaugccuuuguaa

SEQ ID NO: 3784628 - RNA, 20 nt, Human
agcuucaugccuuuguaagu

SEQ ID NO: 3784629 - RNA, 18 nt, Human
acuguuagcacuguugau

SEQ ID NO: 3784630 - RNA, 21 nt, Human
acuguuagcacuguugaugua

SEQ ID NO: 3784631 - RNA, 13 nt, Human
acuguuagcuuuu

SEQ ID NO: 3784632 - RNA, 19 nt, Human
acuguuauccuauuuagau

SEQ ID NO: 3784633 - RNA, 12 nt, Human
acuguuauucuu

SEQ ID NO: 3784634 - RNA, 13 nt, Human
acuguuauuuaua

SEQ ID NO: 3784635 - RNA, 14 nt, Human
acuguuauuuauaa

SEQ ID NO: 3784636 - RNA, 15 nt, Human
acuguuauuuauaau

SEQ ID NO: 3784637 - RNA, 17 nt, Human
acuguuauuuauaauca

SEQ ID NO: 3784638 - RNA, 20 nt, Human
acuguuauuuauaaucacuu

SEQ ID NO: 3784639 - RNA, 23 nt, Human
acuguucaaugguucugaaauaa

SEQ ID NO: 3784640 - RNA, 17 nt, Human
acuguucagcuguccuc

SEQ ID NO: 3784641 - RNA, 15 nt, Human
acuguucccccugug

SEQ ID NO: 3784642 - RNA, 18 nt, Human
acuguucccccugugcag

SEQ ID NO: 3784643 - RNA, 20 nt, Human
acuguucccucugcuccugg

SEQ ID NO: 3784644 - RNA, 16 nt, Human
acuguucucugcccuc

SEQ ID NO: 3784645 - RNA, 21 nt, Human
acuguucucuucuugaacacu

SEQ ID NO: 3784646 - RNA, 13 nt, Human
acuguucuguguc

SEQ ID NO: 3784647 - RNA, 16 nt, Human
acuguucugugucuuu

SEQ ID NO: 3784648 - RNA, 13 nt, Human
acuguucuuagcu

SEQ ID NO: 3784649 - RNA, 21 nt, Human
acuguucuuagcucaaugagc

SEQ ID NO: 3784650 - RNA, 23 nt, Human
acuguucuuagcucaaugagcau

SEQ ID NO: 3784651 - RNA, 10 nt, Human
acuguucuug

SEQ ID NO: 3784652 - RNA, 14 nt, Human
acuguucuugcugc

SEQ ID NO: 3784653 - RNA, 17 nt, Human
acuguucuugcugcuag

SEQ ID NO: 3784654 - RNA, 15 nt, Human
acuguugauaaaaac

SEQ ID NO: 3784655 - RNA, 15 nt, Human
acuguugauguaucu

SEQ ID NO: 3784656 - RNA, 16 nt, Human
acuguugauguaucug

SEQ ID NO: 3784657 - RNA, 20 nt, Human
acuguugauguaucugaguu

SEQ ID NO: 3784658 - RNA, 12 nt, Human
acuguugcacgu

SEQ ID NO: 3784659 - RNA, 16 nt, Human
acuguugcacgugugu

SEQ ID NO: 3784660 - RNA, 14 nt, Human
acuguugccagaga

SEQ ID NO: 3784661 - RNA, 13 nt, Human
acuguugcccagg

SEQ ID NO: 3784662 - RNA, 20 nt, Human
acuguugggguggguauaaa

SEQ ID NO: 3784663 - RNA, 21 nt, Human
acuguugggguggguauaaaa

SEQ ID NO: 3784664 - RNA, 20 nt, Human
acuguuguaacuaggcucag

SEQ ID NO: 3784665 - RNA, 12 nt, Human
acuguuguauaa

SEQ ID NO: 3784666 - RNA, 15 nt, Human
acuguuguauaaauu

SEQ ID NO: 3784667 - RNA, 14 nt, Human
acuguuuaaucaua

SEQ ID NO: 3784668 - RNA, 20 nt, Human
acuguuuaaucauaguuacu

SEQ ID NO: 3784669 - RNA, 18 nt, Human
acuguuuaauguucugug

SEQ ID NO: 3784670 - RNA, 20 nt, Human
acuguuuagauuugccauag

SEQ ID NO: 3784671 - RNA, 14 nt, Human
acuguuuauacacu

SEQ ID NO: 3784672 - RNA, 17 nt, Human
acuguuuauacacugug

SEQ ID NO: 3784673 - RNA, 24 nt, Human
acuguuuauuacuuccaugaauuu

SEQ ID NO: 3784674 - RNA, 15 nt, Human
acuguuuauuucugu

SEQ ID NO: 3784675 - RNA, 19 nt, Human
acuguuuauuucuguuucu

SEQ ID NO: 3784676 - RNA, 15 nt, Human
acuguuucaaacuuu

SEQ ID NO: 3784677 - RNA, 20 nt, Human
acuguuucacuacucagcau

SEQ ID NO: 3784678 - RNA, 12 nt, Human
acuguuucucug

SEQ ID NO: 3784679 - RNA, 16 nt, Human
acuguuucucuugagc

SEQ ID NO: 3784680 - RNA, 20 nt, Human
acuguuucucuugagcuggc

SEQ ID NO: 3784681 - RNA, 21 nt, Human
acuguuucucuugagcuggcc

SEQ ID NO: 3784682 - RNA, 13 nt, Human
acuguuucuugcu

SEQ ID NO: 3784683 - RNA, 16 nt, Human
acuguuucuugcuugu

SEQ ID NO: 3784684 - RNA, 20 nt, Human
acuguuucuugcuuguaccu

SEQ ID NO: 3784685 - RNA, 21 nt, Human
acuguuugaaaacuucagaag

SEQ ID NO: 3784686 - RNA, 18 nt, Human
acuguuugagguuuuuaa

SEQ ID NO: 3784687 - RNA, 21 nt, Human
acuguuugccuucuacuuuua

SEQ ID NO: 3784688 - RNA, 19 nt, Human
acuguuuggaaauaaaucu

SEQ ID NO: 3784689 - RNA, 23 nt, Human
acuguuuggaaauugauuuugaa

SEQ ID NO: 3784690 - RNA, 20 nt, Human
acuguuuguuuacaaaauca

SEQ ID NO: 3784691 - RNA, 21 nt, Human
acuguuuguuuuuauuuaaau

SEQ ID NO: 3784692 - RNA, 22 nt, Human
acuguuuguuuuuauuuaaauu

SEQ ID NO: 3784693 - RNA, 23 nt, Human
acuguuuucuaguguaucaaaau

SEQ ID NO: 3784694 - RNA, 22 nt, Human
acuguuuucucucggcucccca

SEQ ID NO: 3784695 - RNA, 20 nt, Human
acuguuuucuuuaugucuuu

SEQ ID NO: 3784696 - RNA, 18 nt, Human
acuguuuuggguagcugc

SEQ ID NO: 3784697 - RNA, 19 nt, Human
acuguuuuggguagcugcc

SEQ ID NO: 3784698 - RNA, 17 nt, Human
acuguuuuuacccauau

SEQ ID NO: 3784699 - RNA, 19 nt, Human
acuguuuuuagacaccuuc

SEQ ID NO: 3784700 - RNA, 12 nt, Human
acuguuuuucca

SEQ ID NO: 3784701 - RNA, 22 nt, Human
acuguuuuuccauaguuuugau

SEQ ID NO: 3784702 - RNA, 20 nt, Human
acuguuuuuuaaacuaggaa

SEQ ID NO: 3784703 - RNA, 13 nt, Human
acuguuuuuuaag

SEQ ID NO: 3784704 - RNA, 17 nt, Human
acuguuuuuuccugagc

SEQ ID NO: 3784705 - RNA, 20 nt, Human
acuuaaaaaaaaaaaaaagc

SEQ ID NO: 3784706 - RNA, 13 nt, Human
acuuaaaaaaaug

SEQ ID NO: 3784707 - RNA, 16 nt, Human
acuuaaaaaaaugaca

SEQ ID NO: 3784708 - RNA, 13 nt, Human
acuuaaaaaacuu

SEQ ID NO: 3784709 - RNA, 13 nt, Human
acuuaaaaauggu

SEQ ID NO: 3784710 - RNA, 22 nt, Human
acuuaaaaaugguuuaaauggu

SEQ ID NO: 3784711 - RNA, 18 nt, Human
acuuaaaaauguaaauau

SEQ ID NO: 3784712 - RNA, 12 nt, Human
acuuaaaacacg

SEQ ID NO: 3784713 - RNA, 14 nt, Human
acuuaaaaugugca

SEQ ID NO: 3784714 - RNA, 16 nt, Human
acuuaaaaugugcagu

SEQ ID NO: 3784715 - RNA, 18 nt, Human
acuuaaaaugugcaguaa

SEQ ID NO: 3784716 - RNA, 14 nt, Human
agccagcucucagc

SEQ ID NO: 3784717 - RNA, 16 nt, Human
agccagcucugcauua

SEQ ID NO: 3784718 - RNA, 16 nt, Human
agccagcugccgacca

SEQ ID NO: 3784719 - RNA, 12 nt, Human
agccagcuuguu

SEQ ID NO: 3784720 - RNA, 20 nt, Human
agccagcuuguuuacaugcu

SEQ ID NO: 3784721 - RNA, 20 nt, Human
agccaggaagaucccccaga

SEQ ID NO: 3784722 - RNA, 22 nt, Human
agccaggacaccgggcagggcc

SEQ ID NO: 3784723 - RNA, 15 nt, Human
agccaggacagucag

SEQ ID NO: 3784724 - RNA, 14 nt, Human
agccaggagaagcu

SEQ ID NO: 3784725 - RNA, 20 nt, Human
agccaggagaagcucagcug

SEQ ID NO: 3784726 - RNA, 14 nt, Human
agccaggagcuggg

SEQ ID NO: 3784727 - RNA, 18 nt, Human
agccaggagcugggcaga

SEQ ID NO: 3784728 - RNA, 11 nt, Human
agccaggaggg

SEQ ID NO: 3784729 - RNA, 15 nt, Human
agccaggaucauggu

SEQ ID NO: 3784730 - RNA, 20 nt, Human
agccaggaucaugguguaau

SEQ ID NO: 3784731 - RNA, 22 nt, Human
agccaggaucaugguguaauaa

SEQ ID NO: 3784732 - RNA, 22 nt, Human
agccaggcaacuucaguccugg

SEQ ID NO: 3784733 - RNA, 11 nt, Human
agccaggcaca

SEQ ID NO: 3784734 - RNA, 20 nt, Human
agccaggcacacacugugcu

SEQ ID NO: 3784735 - RNA, 21 nt, Human
agccaggccacaagacccuug

SEQ ID NO: 3784736 - RNA, 14 nt, Human
agccaggcccagcc

SEQ ID NO: 3784737 - RNA, 15 nt, Human
agccaggccccaggc

SEQ ID NO: 3784738 - RNA, 19 nt, Human
agccaggcgcuagcacagc

SEQ ID NO: 3784739 - RNA, 14 nt, Human
agccaggcgggcuc

SEQ ID NO: 3784740 - RNA, 18 nt, Human
agccaggcgggcucaagg

SEQ ID NO: 3784741 - RNA, 19 nt, Human
agccaggcgggcucaagga

SEQ ID NO: 3784742 - RNA, 20 nt, Human
agccaggcuagcuggagccu

SEQ ID NO: 3784743 - RNA, 18 nt, Human
agccaggcucacucacag

SEQ ID NO: 3784744 - RNA, 15 nt, Human
agccaggcucaggcc

SEQ ID NO: 3784745 - RNA, 16 nt, Human
agccaggcucugugcu

SEQ ID NO: 3784746 - RNA, 17 nt, Human
agccaggcucugugcug

SEQ ID NO: 3784747 - RNA, 21 nt, Human
agccaggcucugugcugaccc

SEQ ID NO: 3784748 - RNA, 19 nt, Human
agccagggagagcccagga

SEQ ID NO: 3784749 - RNA, 21 nt, Human
agccagggagagcccaggagc

SEQ ID NO: 3784750 - RNA, 12 nt, Human
agccagggccag

SEQ ID NO: 3784751 - RNA, 19 nt, Human
agccagggcccgggaagca

SEQ ID NO: 3784752 - RNA, 23 nt, Human
agccagggcuaugggagcagcuu

SEQ ID NO: 3784753 - RNA, 11 nt, Human
agccagggcug

SEQ ID NO: 3784754 - RNA, 12 nt, Human
agccagggcugc

SEQ ID NO: 3784755 - RNA, 17 nt, Human
agccaggggagcagagg

SEQ ID NO: 3784756 - RNA, 21 nt, Human
agccagggggagcugggccug

SEQ ID NO: 3784757 - RNA, 14 nt, Human
agccagggucucca

SEQ ID NO: 3784758 - RNA, 15 nt, Human
agccagggucuccag

SEQ ID NO: 3784759 - RNA, 17 nt, Human
agccaggucccccugca

SEQ ID NO: 3784760 - RNA, 18 nt, Human
agccaggucccccugcag

SEQ ID NO: 3784761 - RNA, 15 nt, Human
agccaggucccucuc

SEQ ID NO: 3784762 - RNA, 14 nt, Human
agccagucccaggg

SEQ ID NO: 3784763 - RNA, 15 nt, Human
agccagucuuaacau

SEQ ID NO: 3784764 - RNA, 19 nt, Human
agccagugaccugaggaag

SEQ ID NO: 3784765 - RNA, 18 nt, Human
agccagugacuccaggag

SEQ ID NO: 3784766 - RNA, 22 nt, Human
agccagugacuccaggagagga

SEQ ID NO: 3784767 - RNA, 18 nt, Human
agccagugcccugagcca

SEQ ID NO: 3784768 - RNA, 21 nt, Human
agccaguuugccggauacaaa

SEQ ID NO: 3784769 - RNA, 19 nt, Human
agccauacuuaucucucug

SEQ ID NO: 3784770 - RNA, 14 nt, Human
agccauaggcccuu

SEQ ID NO: 3784771 - RNA, 21 nt, Human
agccauauaaguuugaaggaa

SEQ ID NO: 3784772 - RNA, 14 nt, Human
agccauauuuguaa

SEQ ID NO: 3784773 - RNA, 16 nt, Human
agccaucaccucagau

SEQ ID NO: 3784774 - RNA, 18 nt, Human
agccccaaaacucuccuc

SEQ ID NO: 3784775 - RNA, 24 nt, Human
agccccaaaacucuccucugcugc

SEQ ID NO: 3784776 - RNA, 23 nt, Human
agccccaaagucaauuaaaggcu

SEQ ID NO: 3784777 - RNA, 21 nt, Human
agccccaaauugucaccugcu

SEQ ID NO: 3784778 - RNA, 22 nt, Human
agccccaacccaaaccuggaga

SEQ ID NO: 3784779 - RNA, 16 nt, Human
agccccaagaaggcug

SEQ ID NO: 3784780 - RNA, 14 nt, Human
agccccaaguccug

SEQ ID NO: 3784781 - RNA, 14 nt, Human
agccccacacagcu

SEQ ID NO: 3784782 - RNA, 23 nt, Human
agccccacaccagggccagccuc

SEQ ID NO: 3784783 - RNA, 20 nt, Human
agccccacacuggggugccg

SEQ ID NO: 3784784 - RNA, 14 nt, Human
agccccacagccca

SEQ ID NO: 3784785 - RNA, 16 nt, Human
agccccacagcccacg

SEQ ID NO: 3784786 - RNA, 17 nt, Human
agccccacagcccacgu

SEQ ID NO: 3784787 - RNA, 16 nt, Human
agccccacccaggcca

SEQ ID NO: 3784788 - RNA, 20 nt, Human
agccccacccaggccaggca

SEQ ID NO: 3784789 - RNA, 23 nt, Human
agccccaccccagggcagccagg

SEQ ID NO: 3784790 - RNA, 17 nt, Human
agccccacccuggccua

SEQ ID NO: 3784791 - RNA, 15 nt, Human
agccccacucucaga

SEQ ID NO: 3784792 - RNA, 17 nt, Human
agccccacucucagagg

SEQ ID NO: 3784793 - RNA, 19 nt, Human
agccccacucucagaggcc

SEQ ID NO: 3784794 - RNA, 14 nt, Human
agccccacugccag

SEQ ID NO: 3784795 - RNA, 19 nt, Human
agccccacugccagcagca

SEQ ID NO: 3784796 - RNA, 20 nt, Human
agccccacugccagcagcag

SEQ ID NO: 3784797 - RNA, 13 nt, Human
agccccacuuacc

SEQ ID NO: 3784798 - RNA, 21 nt, Human
agccccagcaccaccaggucu

SEQ ID NO: 3784799 - RNA, 14 nt, Human
agccccagccaggg

SEQ ID NO: 3784800 - RNA, 11 nt, Human
agccccagccc

SEQ ID NO: 3784801 - RNA, 15 nt, Human
agccccagcccagcc

SEQ ID NO: 3784802 - RNA, 17 nt, Human
agccccagcccagccca

SEQ ID NO: 3784803 - RNA, 19 nt, Human
agccccagcccagccccac

SEQ ID NO: 3784804 - RNA, 21 nt, Human
agccccagcccagccccacuc

SEQ ID NO: 3784805 - RNA, 15 nt, Human
agccccagccugcua

SEQ ID NO: 3784806 - RNA, 17 nt, Human
agccccagccugcuagc

SEQ ID NO: 3784807 - RNA, 16 nt, Human
agccccaggccucugu

SEQ ID NO: 3784808 - RNA, 21 nt, Human
agccccaggccucuguguccu

SEQ ID NO: 3784809 - RNA, 16 nt, Human
agccccaggggacaag

SEQ ID NO: 3784810 - RNA, 23 nt, Human
agccccagugccaagcacagugc

SEQ ID NO: 3784811 - RNA, 13 nt, Human
agccccagugccc

SEQ ID NO: 3784812 - RNA, 23 nt, Human
agccccauaauuuuuuuuuuccu

SEQ ID NO: 3784813 - RNA, 15 nt, Human
agccccauccucugu

SEQ ID NO: 3784814 - RNA, 23 nt, Human
agccccauccucuguacagagcc

SEQ ID NO: 3784815 - RNA, 18 nt, Human
agccccauccugccgccc

SEQ ID NO: 3784816 - RNA, 14 nt, Human
agccccaucugugc

SEQ ID NO: 3784817 - RNA, 19 nt, Human
agccccaugcuggagccug

SEQ ID NO: 3784818 - RNA, 21 nt, Human
agccccaugcuggagccugug

SEQ ID NO: 3784819 - RNA, 22 nt, Human
agccccaugcuggagccugugu

SEQ ID NO: 3784820 - RNA, 23 nt, Human
agccccaugcuggagccugugua

SEQ ID NO: 3784821 - RNA, 14 nt, Human
agccccauuaacug

SEQ ID NO: 3784822 - RNA, 15 nt, Human
agccccauuaacugc

SEQ ID NO: 3784823 - RNA, 16 nt, Human
agccccauuccuggga

SEQ ID NO: 3784824 - RNA, 22 nt, Human
agcccccacccuguuccugcug

SEQ ID NO: 3784825 - RNA, 23 nt, Human
agcccccacccuguuccugcugc

SEQ ID NO: 3784826 - RNA, 19 nt, Human
agcccccaccgugggcagg

SEQ ID NO: 3784827 - RNA, 18 nt, Human
agcccccagccccucccc

SEQ ID NO: 3784828 - RNA, 13 nt, Human
agcccccagccug

SEQ ID NO: 3784829 - RNA, 12 nt, Human
agcccccagcua

SEQ ID NO: 3784830 - RNA, 19 nt, Human
agcccccagcuaagaaccu

SEQ ID NO: 3784831 - RNA, 20 nt, Human
agcccccagcuaagaaccug

SEQ ID NO: 3784832 - RNA, 20 nt, Human
agcccccagcuuccagcagg

SEQ ID NO: 3784833 - RNA, 17 nt, Human
agcccccaggcugcugg

SEQ ID NO: 3784834 - RNA, 20 nt, Human
agcccccccaacacugugcc

SEQ ID NO: 3784835 - RNA, 14 nt, Human
agcccccucacagu

SEQ ID NO: 3784836 - RNA, 13 nt, Human
agcccccuccugg

SEQ ID NO: 3784837 - RNA, 20 nt, Human
agcccccugaccacucagag

SEQ ID NO: 3784838 - RNA, 16 nt, Human
agcccccuggccucug

SEQ ID NO: 3784839 - RNA, 17 nt, Human
agcccccuggccucugu

SEQ ID NO: 3784840 - RNA, 16 nt, Human
agccccgacuccagcc

SEQ ID NO: 3784841 - RNA, 22 nt, Human
agccccgacuccagccagcgcc

SEQ ID NO: 3784842 - RNA, 23 nt, Human
agccccgacuccagccagcgccu

SEQ ID NO: 3784843 - RNA, 17 nt, Human
agccccgaggccuucuc

SEQ ID NO: 3784844 - RNA, 20 nt, Human
agccccgcaaaacccacuga

SEQ ID NO: 3784845 - RNA, 22 nt, Human
agccccgcagaccuccccagcc

SEQ ID NO: 3784846 - RNA, 15 nt, Human
agccccgcccucuuc

SEQ ID NO: 3784847 - RNA, 16 nt, Human
agccccgcccucuucc

SEQ ID NO: 3784848 - RNA, 18 nt, Human
agccccgcccucuuccug

SEQ ID NO: 3784849 - RNA, 16 nt, Human
agccccgccuccaggc

SEQ ID NO: 3784850 - RNA, 20 nt, Human
agccccgcgaccauguggcc

SEQ ID NO: 3784851 - RNA, 18 nt, Human
agccccggcccugggcuc

SEQ ID NO: 3784852 - RNA, 19 nt, Human
agccccgguggcugggcag

SEQ ID NO: 3784853 - RNA, 17 nt, Human
agccccuaccccacacc

SEQ ID NO: 3784854 - RNA, 21 nt, Human
agccccuaccccacaccaggc

SEQ ID NO: 3784855 - RNA, 18 nt, Human
agccccuagaaacccaag

SEQ ID NO: 3784856 - RNA, 13 nt, Human
agccccuccaucu

SEQ ID NO: 3784857 - RNA, 16 nt, Human
agccccuccaucugua

SEQ ID NO: 3784858 - RNA, 13 nt, Human
agccccucccaag

SEQ ID NO: 3784859 - RNA, 20 nt, Human
agccccucccaagcuggcug

SEQ ID NO: 3784860 - RNA, 21 nt, Human
agccccucccaagcuggcugg

SEQ ID NO: 3784861 - RNA, 22 nt, Human
agccccucccaagcuggcuggg

SEQ ID NO: 3784862 - RNA, 15 nt, Human
agccccucccuccuc

SEQ ID NO: 3784863 - RNA, 22 nt, Human
agccccuccuccagccccuguc

SEQ ID NO: 3784864 - RNA, 14 nt, Human
agccccuccucugc

SEQ ID NO: 3784865 - RNA, 16 nt, Human
agccccuccucugcca

SEQ ID NO: 3784866 - RNA, 18 nt, Human
agccccuccucugccacc

SEQ ID NO: 3784867 - RNA, 23 nt, Human
agccccuccucugccaccucccc

SEQ ID NO: 3784868 - RNA, 21 nt, Human
agccccucuccccgcaguguu

SEQ ID NO: 3784869 - RNA, 16 nt, Human
agccccucuggucgcu

SEQ ID NO: 3784870 - RNA, 22 nt, Human
agccccucuuucuguccccucu

SEQ ID NO: 3784871 - RNA, 15 nt, Human
agccccugccccagc

SEQ ID NO: 3784872 - RNA, 17 nt, Human
agccccugccccagccc

SEQ ID NO: 3784873 - RNA, 18 nt, Human
agccccugccccagccca

SEQ ID NO: 3784874 - RNA, 16 nt, Human
agccccugggcccagu

SEQ ID NO: 3784875 - RNA, 19 nt, Human
agccacuugccugugcuac

SEQ ID NO: 3784876 - RNA, 23 nt, Human
agccacuuucaaucuucaauccu

SEQ ID NO: 3784877 - RNA, 20 nt, Human
agccagaaccccgagcccua

SEQ ID NO: 3784878 - RNA, 14 nt, Human
agccagaaccugga

SEQ ID NO: 3784879 - RNA, 21 nt, Human
agccagaacguggcucugcug

SEQ ID NO: 3784880 - RNA, 22 nt, Human
agccagaagccacccaaagcag

SEQ ID NO: 3784881 - RNA, 14 nt, Human
agccagaagcugag

SEQ ID NO: 3784882 - RNA, 20 nt, Human
agccagaagcugagcaccag

SEQ ID NO: 3784883 - RNA, 19 nt, Human
agccagaaucagcacagau

SEQ ID NO: 3784884 - RNA, 19 nt, Human
agccagacacucugcucug

SEQ ID NO: 3784885 - RNA, 19 nt, Human
agccagaccuauuccuccu

SEQ ID NO: 3784886 - RNA, 18 nt, Human
agccagacucuggucuuc

SEQ ID NO: 3784887 - RNA, 19 nt, Human
agccagacuggcacaguuu

SEQ ID NO: 3784888 - RNA, 11 nt, Human
agccagagaag

SEQ ID NO: 3784889 - RNA, 14 nt, Human
agccagaggacugu

SEQ ID NO: 3784890 - RNA, 17 nt, Human
agccagaggacugugau

SEQ ID NO: 3784891 - RNA, 13 nt, Human
agccagaggagag

SEQ ID NO: 3784892 - RNA, 18 nt, Human
agccagaggagagaggac

SEQ ID NO: 3784893 - RNA, 20 nt, Human
agccagaggagagaggaccc

SEQ ID NO: 3784894 - RNA, 14 nt, Human
agccagaggcuggg

SEQ ID NO: 3784895 - RNA, 13 nt, Human
agccagaggucug

SEQ ID NO: 3784896 - RNA, 15 nt, Human
agccagauccucuug

SEQ ID NO: 3784897 - RNA, 17 nt, Human
agccagauccucuuggu

SEQ ID NO: 3784898 - RNA, 15 nt, Human
agccagcacacaggg

SEQ ID NO: 3784899 - RNA, 13 nt, Human
agccagcaccugg

SEQ ID NO: 3784900 - RNA, 18 nt, Human
agccagcaccuguaagaa

SEQ ID NO: 3784901 - RNA, 20 nt, Human
agccagcacuuguccagcug

SEQ ID NO: 3784902 - RNA, 14 nt, Human
agccagcagacauu

SEQ ID NO: 3784903 - RNA, 15 nt, Human
agccagcagacauug

SEQ ID NO: 3784904 - RNA, 14 nt, Human
agccagcagccagc

SEQ ID NO: 3784905 - RNA, 20 nt, Human
agccagcagccagcucucag

SEQ ID NO: 3784906 - RNA, 14 nt, Human
agccagcaggcucu

SEQ ID NO: 3784907 - RNA, 17 nt, Human
agccagcaggcucucag

SEQ ID NO: 3784908 - RNA, 19 nt, Human
agccagcaggcucucaggc

SEQ ID NO: 3784909 - RNA, 22 nt, Human
agccagcaggcucucaggccag

SEQ ID NO: 3784910 - RNA, 15 nt, Human
agccagcaguucaga

SEQ ID NO: 3784911 - RNA, 21 nt, Human
agccagcaguucagagcugcc

SEQ ID NO: 3784912 - RNA, 22 nt, Human
agccagcaguucagagcugccc

SEQ ID NO: 3784913 - RNA, 14 nt, Human
agccagcaucggaa

SEQ ID NO: 3784914 - RNA, 19 nt, Human
agccagccaagcuuuaaau

SEQ ID NO: 3784915 - RNA, 14 nt, Human
agccagccacucua

SEQ ID NO: 3784916 - RNA, 14 nt, Human
agccagcccagccc

SEQ ID NO: 3784917 - RNA, 15 nt, Human
agccagcccagccca

SEQ ID NO: 3784918 - RNA, 16 nt, Human
agccagcccagcccag

SEQ ID NO: 3784919 - RNA, 17 nt, Human
agccagcccagcccagc

SEQ ID NO: 3784920 - RNA, 12 nt, Human
agccagcccucc

SEQ ID NO: 3784921 - RNA, 13 nt, Human
agccagcccuccc

SEQ ID NO: 3784922 - RNA, 22 nt, Human
agccagcccucccuguccuccu

SEQ ID NO: 3784923 - RNA, 17 nt, Human
agccagcccugccugga

SEQ ID NO: 3784924 - RNA, 20 nt, Human
agccagcccugccuggagga

SEQ ID NO: 3784925 - RNA, 21 nt, Human
agccagcccugccuggaggac

SEQ ID NO: 3784926 - RNA, 19 nt, Human
agccagccgagcaggaggc

SEQ ID NO: 3784927 - RNA, 19 nt, Human
agccagccggggcgagugg

SEQ ID NO: 3784928 - RNA, 18 nt, Human
agccagccucgcccaucc

SEQ ID NO: 3784929 - RNA, 14 nt, Human
agccagccugaccu

SEQ ID NO: 3784930 - RNA, 15 nt, Human
agccagccugaccuu

SEQ ID NO: 3784931 - RNA, 23 nt, Human
agccagccugaccuuccuuccug

SEQ ID NO: 3784932 - RNA, 12 nt, Human
agccagcgccuc

SEQ ID NO: 3784933 - RNA, 15 nt, Human
agccagcgccucccu

SEQ ID NO: 3784934 - RNA, 16 nt, Human
agccagcgccucccuc

SEQ ID NO: 3784935 - RNA, 22 nt, Human
agccagcgccucccuccacccc

SEQ ID NO: 3784936 - RNA, 22 nt, Human
agccagcgggaauggcagcugc

SEQ ID NO: 3784937 - RNA, 18 nt, Human
agccagcguccuccucug

SEQ ID NO: 3784938 - RNA, 15 nt, Human
agccagcucacagug

SEQ ID NO: 3784939 - RNA, 21 nt, Human
agccagcucacagugcugugu

SEQ ID NO: 3784940 - RNA, 19 nt, Human
agccagcucccucuauuua

SEQ ID NO: 3784941 - RNA, 20 nt, Human
agccagcugcagcugggcug

SEQ ID NO: 3784942 - RNA, 11 nt, Human
agccagcugcc

SEQ ID NO: 3784943 - RNA, 20 nt, Human
agccagcugcccccagagcc

SEQ ID NO: 3784944 - RNA, 13 nt, Human
agccagcuuuccc

SEQ ID NO: 3784945 - RNA, 14 nt, Human
agccagcuuucccu

SEQ ID NO: 3784946 - RNA, 17 nt, Human
agccaggaauuucccag

SEQ ID NO: 3784947 - RNA, 22 nt, Human
agccaggaauuucccaggaccc

SEQ ID NO: 3784948 - RNA, 16 nt, Human
agccaggaggccugcu

SEQ ID NO: 3784949 - RNA, 23 nt, Human
agccaggaucaugguguaauaag

SEQ ID NO: 3784950 - RNA, 23 nt, Human
agccaggcacacacugugcuuuc

SEQ ID NO: 3784951 - RNA, 13 nt, Human
agccaggcccagc

SEQ ID NO: 3784952 - RNA, 14 nt, Human
agccaggccccagg

SEQ ID NO: 3784953 - RNA, 12 nt, Human
agccaggccugg

SEQ ID NO: 3784954 - RNA, 23 nt, Human
agccaggcgcuagcacagcuccc

SEQ ID NO: 3784955 - RNA, 18 nt, Human
agccaggcucaggccaug

SEQ ID NO: 3784956 - RNA, 20 nt, Human
agccaggcugccaaggccag

SEQ ID NO: 3784957 - RNA, 16 nt, Human
agccagggaaagacug

SEQ ID NO: 3784958 - RNA, 16 nt, Human
agccagggagagccca

SEQ ID NO: 3784959 - RNA, 17 nt, Human
agccagggagagcccag

SEQ ID NO: 3784960 - RNA, 22 nt, Human
agccagggagagcccaggagcu

SEQ ID NO: 3784961 - RNA, 20 nt, Human
agccagggauggggccacag

SEQ ID NO: 3784962 - RNA, 21 nt, Human
agccagggauggggccacagc

SEQ ID NO: 3784963 - RNA, 11 nt, Human
agccagggcca

SEQ ID NO: 3784964 - RNA, 21 nt, Human
agccagggcugcuagacggag

SEQ ID NO: 3784965 - RNA, 14 nt, Human
agccagggcuggag

SEQ ID NO: 3784966 - RNA, 16 nt, Human
agccagggcuggagaa

SEQ ID NO: 3784967 - RNA, 18 nt, Human
agccaggggagcagaggg

SEQ ID NO: 3784968 - RNA, 22 nt, Human
agccagggggacuagccccugu

SEQ ID NO: 3784969 - RNA, 12 nt, Human
agccagggucuc

SEQ ID NO: 3784970 - RNA, 16 nt, Human
agccagggucuccaga

SEQ ID NO: 3784971 - RNA, 21 nt, Human
agccagggucucucccucagg

SEQ ID NO: 3784972 - RNA, 21 nt, Human
agccaggguguggcccugcca

SEQ ID NO: 3784973 - RNA, 19 nt, Human
agccagguauggcucugca

SEQ ID NO: 3784974 - RNA, 15 nt, Human
agccaggucccccug

SEQ ID NO: 3784975 - RNA, 16 nt, Human
agccaggucccccugc

SEQ ID NO: 3784976 - RNA, 16 nt, Human
agccaggugccuugga

SEQ ID NO: 3784977 - RNA, 16 nt, Human
agccaguaaacagagg

SEQ ID NO: 3784978 - RNA, 18 nt, Human
agccaguaaacagaggag

SEQ ID NO: 3784979 - RNA, 14 nt, Human
agccaguaauccug

SEQ ID NO: 3784980 - RNA, 15 nt, Human
agccaguaauccugu

SEQ ID NO: 3784981 - RNA, 13 nt, Human
agccagucuuuac

SEQ ID NO: 3784982 - RNA, 18 nt, Human
agccagugaccugaggaa

SEQ ID NO: 3784983 - RNA, 21 nt, Human
agccagugaccugaggaagcg

SEQ ID NO: 3784984 - RNA, 15 nt, Human
agccagugacuccag

SEQ ID NO: 3784985 - RNA, 15 nt, Human
agccagugcccugag

SEQ ID NO: 3784986 - RNA, 17 nt, Human
agccaguucaguaccug

SEQ ID NO: 3784987 - RNA, 22 nt, Human
agccaguucaguaccuggagga

SEQ ID NO: 3784988 - RNA, 13 nt, Human
agccauaaaugau

SEQ ID NO: 3784989 - RNA, 17 nt, Human
agccauacauaaaagaa

SEQ ID NO: 3784990 - RNA, 18 nt, Human
agccauacauaaaagaaa

SEQ ID NO: 3784991 - RNA, 21 nt, Human
agccauacauaaaagaaauaa

SEQ ID NO: 3784992 - RNA, 21 nt, Human
agccauauuuguaaaaugaca

SEQ ID NO: 3784993 - RNA, 13 nt, Human
agccaucaaaaug

SEQ ID NO: 3784994 - RNA, 15 nt, Human
agccaucaccucaga

SEQ ID NO: 3784995 - RNA, 19 nt, Human
agccaucaccucagauggc

SEQ ID NO: 3784996 - RNA, 22 nt, Human
agccaucaccucagauggcagc

SEQ ID NO: 3784997 - RNA, 18 nt, Human
agccaucccagccuuggc

SEQ ID NO: 3784998 - RNA, 19 nt, Human
agccaucccagccuuggca

SEQ ID NO: 3784999 - RNA, 22 nt, Human
agccaucuccaucuugaaggaa

SEQ ID NO: 3785000 - RNA, 14 nt, Human
agccaucugcccag

SEQ ID NO: 3785001 - RNA, 20 nt, Human
agccaugacuugagaaacaa

SEQ ID NO: 3785002 - RNA, 18 nt, Human
agccaugaggaguugcug

SEQ ID NO: 3785003 - RNA, 20 nt, Human
agccaugaggaguugcuguu

SEQ ID NO: 3785004 - RNA, 23 nt, Human
agccaugaguuccagaaaguaaa

SEQ ID NO: 3785005 - RNA, 17 nt, Human
agccaugccagcuggcc

SEQ ID NO: 3785006 - RNA, 21 nt, Human
agccaugccgucugccggacc

SEQ ID NO: 3785007 - RNA, 23 nt, Human
agccaugcgcccccuccgcccug

SEQ ID NO: 3785008 - RNA, 20 nt, Human
agccauggagauucucauaa

SEQ ID NO: 3785009 - RNA, 22 nt, Human
agccauggagauucucauaacu

SEQ ID NO: 3785010 - RNA, 12 nt, Human
agccaugggacc

SEQ ID NO: 3785011 - RNA, 13 nt, Human
agccauguacaga

SEQ ID NO: 3785012 - RNA, 15 nt, Human
agccauguauaaaug

SEQ ID NO: 3785013 - RNA, 18 nt, Human
agccauguauaaauguga

SEQ ID NO: 3785014 - RNA, 14 nt, Human
agccaugucugcau

SEQ ID NO: 3785015 - RNA, 21 nt, Human
agccaugucuucucccuggaa

SEQ ID NO: 3785016 - RNA, 23 nt, Human
agccaugugcugcgugccugugg

SEQ ID NO: 3785017 - RNA, 20 nt, Human
agccauguuuaagauuuaau

SEQ ID NO: 3785018 - RNA, 17 nt, Human
agccauuaaaugaauau

SEQ ID NO: 3785019 - RNA, 18 nt, Human
agccauuaccauggagac

SEQ ID NO: 3785020 - RNA, 14 nt, Human
agccauucacugcc

SEQ ID NO: 3785021 - RNA, 23 nt, Human
agccauuccugguacccagccau

SEQ ID NO: 3785022 - RNA, 16 nt, Human
agccauugcacccagc

SEQ ID NO: 3785023 - RNA, 15 nt, Human
agccauuuuuacugu

SEQ ID NO: 3785024 - RNA, 21 nt, Human
acuuaaagggcccaaugaauu

SEQ ID NO: 3785025 - RNA, 17 nt, Human
acuuaaauaaugugaaa

SEQ ID NO: 3785026 - RNA, 20 nt, Human
acuuaaauaaugugaaacug

SEQ ID NO: 3785027 - RNA, 16 nt, Human
acuuaaauaguauuuc

SEQ ID NO: 3785028 - RNA, 19 nt, Human
acuuaaaugguaauaagca

SEQ ID NO: 3785029 - RNA, 15 nt, Human
acuuaaauguuauua

SEQ ID NO: 3785030 - RNA, 17 nt, Human
acuuaaauuuuaauuua

SEQ ID NO: 3785031 - RNA, 20 nt, Human
acuuaacaagcucccaggcc

SEQ ID NO: 3785032 - RNA, 14 nt, Human
acuuaacagaugca

SEQ ID NO: 3785033 - RNA, 17 nt, Human
acuuaacggaccaaagc

SEQ ID NO: 3785034 - RNA, 23 nt, Human
acuuaacuauucaggagaguaga

SEQ ID NO: 3785035 - RNA, 14 nt, Human
acuuaacuguuuca

SEQ ID NO: 3785036 - RNA, 14 nt, Human
acuuaagagaaaug

SEQ ID NO: 3785037 - RNA, 15 nt, Human
acuuaagagaauauu

SEQ ID NO: 3785038 - RNA, 18 nt, Human
acuuaagagaauauuuua

SEQ ID NO: 3785039 - RNA, 15 nt, Human
acuuaagcaaaagaa

SEQ ID NO: 3785040 - RNA, 15 nt, Human
acuuaagcacaagca

SEQ ID NO: 3785041 - RNA, 17 nt, Human
acuuaagcauuuaggaa

SEQ ID NO: 3785042 - RNA, 21 nt, Human
acuuaagcccagugcacugaa

SEQ ID NO: 3785043 - RNA, 19 nt, Human
acuuaaguugguccuuuac

SEQ ID NO: 3785044 - RNA, 13 nt, Human
acuuaauaaauuc

SEQ ID NO: 3785045 - RNA, 18 nt, Human
acuuaauaacuguguacu

SEQ ID NO: 3785046 - RNA, 19 nt, Human
acuuaauaaucaagagccu

SEQ ID NO: 3785047 - RNA, 13 nt, Human
acuuaauaaugug

SEQ ID NO: 3785048 - RNA, 19 nt, Human
acuuaauacuaccuugaaa

SEQ ID NO: 3785049 - RNA, 19 nt, Human
acuuaauacucaaaugagu

SEQ ID NO: 3785050 - RNA, 15 nt, Human
acuuaauagaaacau

SEQ ID NO: 3785051 - RNA, 23 nt, Human
acuuaauaucuucauuucuaaau

SEQ ID NO: 3785052 - RNA, 19 nt, Human
acuuaaucaauuaauuuuu

SEQ ID NO: 3785053 - RNA, 19 nt, Human
acuuaaucuaaauggaacc

SEQ ID NO: 3785054 - RNA, 15 nt, Human
acuuaaugaaaacaa

SEQ ID NO: 3785055 - RNA, 19 nt, Human
acuuaaugagacuuuaaaa

SEQ ID NO: 3785056 - RNA, 15 nt, Human
acuuaauguauguua

SEQ ID NO: 3785057 - RNA, 16 nt, Human
acuuacacuuuaugca

SEQ ID NO: 3785058 - RNA, 19 nt, Human
acuuacaugauucauuuua

SEQ ID NO: 3785059 - RNA, 23 nt, Human
acuuacauuguucaauuagaaua

SEQ ID NO: 3785060 - RNA, 19 nt, Human
acuuacauuuacaaacuga

SEQ ID NO: 3785061 - RNA, 23 nt, Human
acuuacccaggugggucccggcu

SEQ ID NO: 3785062 - RNA, 17 nt, Human
agcccgggcucugccuc

SEQ ID NO: 3785063 - RNA, 12 nt, Human
agcccgggcugc

SEQ ID NO: 3785064 - RNA, 15 nt, Human
agcccgggcugccug

SEQ ID NO: 3785065 - RNA, 18 nt, Human
agcccgggcugccugggc

SEQ ID NO: 3785066 - RNA, 16 nt, Human
agcccgguaagagcaa

SEQ ID NO: 3785067 - RNA, 14 nt, Human
agcccgucucagug

SEQ ID NO: 3785068 - RNA, 15 nt, Human
agcccgucucagugu

SEQ ID NO: 3785069 - RNA, 15 nt, Human
agcccguguggcccc

SEQ ID NO: 3785070 - RNA, 19 nt, Human
agcccguguggccccuuca

SEQ ID NO: 3785071 - RNA, 13 nt, Human
agcccuaaacauc

SEQ ID NO: 3785072 - RNA, 14 nt, Human
agcccuaaacauca

SEQ ID NO: 3785073 - RNA, 19 nt, Human
agcccuaaaucuagacuca

SEQ ID NO: 3785074 - RNA, 17 nt, Human
agcccuaaccccuucca

SEQ ID NO: 3785075 - RNA, 19 nt, Human
agcccuaagguccuaaggc

SEQ ID NO: 3785076 - RNA, 15 nt, Human
agcccuacucccugc

SEQ ID NO: 3785077 - RNA, 14 nt, Human
agcccuagagccug

SEQ ID NO: 3785078 - RNA, 20 nt, Human
agcccuagagccugccugga

SEQ ID NO: 3785079 - RNA, 14 nt, Human
agcccuauggaugu

SEQ ID NO: 3785080 - RNA, 16 nt, Human
agcccuauuucuugau

SEQ ID NO: 3785081 - RNA, 15 nt, Human
agcccucagaacccu

SEQ ID NO: 3785082 - RNA, 18 nt, Human
agcccucagaacccuugg

SEQ ID NO: 3785083 - RNA, 19 nt, Human
agcccucagaacccuuggc

SEQ ID NO: 3785084 - RNA, 15 nt, Human
agcccuccaaaagca

SEQ ID NO: 3785085 - RNA, 12 nt, Human
agcccucccacu

SEQ ID NO: 3785086 - RNA, 22 nt, Human
agcccucccacuuugcuguucc

SEQ ID NO: 3785087 - RNA, 15 nt, Human
agcccuccccaggaa

SEQ ID NO: 3785088 - RNA, 20 nt, Human
agcccuccccauggagccag

SEQ ID NO: 3785089 - RNA, 16 nt, Human
agcccucccugccccu

SEQ ID NO: 3785090 - RNA, 17 nt, Human
agcccucccugccccuc

SEQ ID NO: 3785091 - RNA, 23 nt, Human
agcccucccugccccucccuuca

SEQ ID NO: 3785092 - RNA, 15 nt, Human
agcccucccuguccu

SEQ ID NO: 3785093 - RNA, 20 nt, Human
agcccucccuguccuccucg

SEQ ID NO: 3785094 - RNA, 16 nt, Human
agcccuccgccuucac

SEQ ID NO: 3785095 - RNA, 14 nt, Human
agcccuccucaccc

SEQ ID NO: 3785096 - RNA, 17 nt, Human
agcccuccucugcacuc

SEQ ID NO: 3785097 - RNA, 12 nt, Human
agcccuccuucc

SEQ ID NO: 3785098 - RNA, 16 nt, Human
agcccucucacugugu

SEQ ID NO: 3785099 - RNA, 11 nt, Human
agcccucuucc

SEQ ID NO: 3785100 - RNA, 12 nt, Human
agcccucuucca

SEQ ID NO: 3785101 - RNA, 16 nt, Human
agcccucuuccaucau

SEQ ID NO: 3785102 - RNA, 23 nt, Human
agcccucuuccaucaugucccca

SEQ ID NO: 3785103 - RNA, 17 nt, Human
agcccugacuggugcua

SEQ ID NO: 3785104 - RNA, 18 nt, Human
agcccugagaaagcccug

SEQ ID NO: 3785105 - RNA, 19 nt, Human
agcccugaggacagaugcc

SEQ ID NO: 3785106 - RNA, 22 nt, Human
agcccugaggacagaugccucc

SEQ ID NO: 3785107 - RNA, 21 nt, Human
agcccugaggugaaagggagc

SEQ ID NO: 3785108 - RNA, 23 nt, Human
agcccugaguuucaaguauccuu

SEQ ID NO: 3785109 - RNA, 23 nt, Human
agcccugauguguccucagggag

SEQ ID NO: 3785110 - RNA, 12 nt, Human
agcccugcacca

SEQ ID NO: 3785111 - RNA, 13 nt, Human
agcccugcaccau

SEQ ID NO: 3785112 - RNA, 14 nt, Human
agcccugcaccaug

SEQ ID NO: 3785113 - RNA, 22 nt, Human
agcccugcaccaugcugcuggg

SEQ ID NO: 3785114 - RNA, 16 nt, Human
agcccugcauuuucau

SEQ ID NO: 3785115 - RNA, 12 nt, Human
agcccugcccca

SEQ ID NO: 3785116 - RNA, 20 nt, Human
agcccugccccacaccuccu

SEQ ID NO: 3785117 - RNA, 13 nt, Human
agcccugccucuc

SEQ ID NO: 3785118 - RNA, 15 nt, Human
agcccugccucuccg

SEQ ID NO: 3785119 - RNA, 14 nt, Human
agcccugccuggag

SEQ ID NO: 3785120 - RNA, 17 nt, Human
agcccugccuggaggac

SEQ ID NO: 3785121 - RNA, 20 nt, Human
agcccugccuggaggaccug

SEQ ID NO: 3785122 - RNA, 12 nt, Human
agcccugcuccc

SEQ ID NO: 3785123 - RNA, 19 nt, Human
agcccugcugcugccugcc

SEQ ID NO: 3785124 - RNA, 22 nt, Human
agcccugcuuugggcugcccug

SEQ ID NO: 3785125 - RNA, 23 nt, Human
agcccugcuuugggcugcccugg

SEQ ID NO: 3785126 - RNA, 18 nt, Human
agcccuggagccaacugc

SEQ ID NO: 3785127 - RNA, 22 nt, Human
agcccuggagccaacugcugcu

SEQ ID NO: 3785128 - RNA, 11 nt, Human
agcccuggagg

SEQ ID NO: 3785129 - RNA, 15 nt, Human
agcccuggaggugcc

SEQ ID NO: 3785130 - RNA, 22 nt, Human
agcccuggaggugccagcaaag

SEQ ID NO: 3785131 - RNA, 23 nt, Human
agcccuggauuucagaaagagca

SEQ ID NO: 3785132 - RNA, 11 nt, Human
agcccuggcag

SEQ ID NO: 3785133 - RNA, 17 nt, Human
agcccuggcaggaugac

SEQ ID NO: 3785134 - RNA, 11 nt, Human
agcccuggccc

SEQ ID NO: 3785135 - RNA, 15 nt, Human
agcccuggcccccug

SEQ ID NO: 3785136 - RNA, 12 nt, Human
agcccuggcuga

SEQ ID NO: 3785137 - RNA, 16 nt, Human
agcccuggcugaagga

SEQ ID NO: 3785138 - RNA, 18 nt, Human
agcccuggcugaaggacu

SEQ ID NO: 3785139 - RNA, 20 nt, Human
agcccuggcugaaggacugu

SEQ ID NO: 3785140 - RNA, 12 nt, Human
agcccuggcugu

SEQ ID NO: 3785141 - RNA, 20 nt, Human
agcccugggaccgcuacacc

SEQ ID NO: 3785142 - RNA, 17 nt, Human
agcccugggaggcucug

SEQ ID NO: 3785143 - RNA, 18 nt, Human
agcccugggaggcucugg

SEQ ID NO: 3785144 - RNA, 20 nt, Human
agcccugggaggcucuggag

SEQ ID NO: 3785145 - RNA, 16 nt, Human
agcccugggaucacug

SEQ ID NO: 3785146 - RNA, 23 nt, Human
agcccugggccccaccaccuagg

SEQ ID NO: 3785147 - RNA, 12 nt, Human
agcccuggggcu

SEQ ID NO: 3785148 - RNA, 23 nt, Human
agcccugguggcagugggagcug

SEQ ID NO: 3785149 - RNA, 20 nt, Human
agcccugucagugcagcccg

SEQ ID NO: 3785150 - RNA, 17 nt, Human
agcccuguccugguggu

SEQ ID NO: 3785151 - RNA, 20 nt, Human
agcccuguugacacaggucu

SEQ ID NO: 3785152 - RNA, 14 nt, Human
agcccuucauuugg

SEQ ID NO: 3785153 - RNA, 12 nt, Human
agcccuuccucu

SEQ ID NO: 3785154 - RNA, 21 nt, Human
agcccuuccucugcucccccu

SEQ ID NO: 3785155 - RNA, 23 nt, Human
agcccuucuaccuuccugcaaca

SEQ ID NO: 3785156 - RNA, 19 nt, Human
agcccuucuauacccaccc

SEQ ID NO: 3785157 - RNA, 23 nt, Human
agcccuucuauacccacccagaa

SEQ ID NO: 3785158 - RNA, 17 nt, Human
agcccuucuuuccacag

SEQ ID NO: 3785159 - RNA, 18 nt, Human
agcccuucuuuccacaga

SEQ ID NO: 3785160 - RNA, 16 nt, Human
agcccuugaagauauc

SEQ ID NO: 3785161 - RNA, 22 nt, Human
agcccuugcccaugcugggcuc

SEQ ID NO: 3785162 - RNA, 12 nt, Human
agcccuugccuc

SEQ ID NO: 3785163 - RNA, 23 nt, Human
agcccuuggggguccuccuccag

SEQ ID NO: 3785164 - RNA, 12 nt, Human
agcccuuggguu

SEQ ID NO: 3785165 - RNA, 21 nt, Human
agcccuugugaaucaaggguc

SEQ ID NO: 3785166 - RNA, 15 nt, Human
agcccuuuccaagcu

SEQ ID NO: 3785167 - RNA, 14 nt, Human
agcccuuuugucuc

SEQ ID NO: 3785168 - RNA, 16 nt, Human
agccgaauagcugaug

SEQ ID NO: 3785169 - RNA, 22 nt, Human
agccgacaacuauuucggccuu

SEQ ID NO: 3785170 - RNA, 13 nt, Human
agccgacccccuc

SEQ ID NO: 3785171 - RNA, 20 nt, Human
agccgacccccucucccugc

SEQ ID NO: 3785172 - RNA, 12 nt, Human
agccgaccucag

SEQ ID NO: 3785173 - RNA, 19 nt, Human
agccgacucuggcccuggc

SEQ ID NO: 3785174 - RNA, 15 nt, Human
agccgagagccugcu

SEQ ID NO: 3785175 - RNA, 21 nt, Human
agccgagagccugcuccccca

SEQ ID NO: 3785176 - RNA, 18 nt, Human
agccgagaucacgccacu

SEQ ID NO: 3785177 - RNA, 21 nt, Human
agccgagccgggccuggggcu

SEQ ID NO: 3785178 - RNA, 18 nt, Human
agccgauucaccugagca

SEQ ID NO: 3785179 - RNA, 14 nt, Human
agccgcagccuccc

SEQ ID NO: 3785180 - RNA, 16 nt, Human
agccgcaucccagacu

SEQ ID NO: 3785181 - RNA, 16 nt, Human
agccauuuuucaaagc

SEQ ID NO: 3785182 - RNA, 19 nt, Human
agcccaaaccaccagaagc

SEQ ID NO: 3785183 - RNA, 22 nt, Human
agcccaaaccaccagaagccca

SEQ ID NO: 3785184 - RNA, 14 nt, Human
agcccaaagaagga

SEQ ID NO: 3785185 - RNA, 16 nt, Human
agcccaaagcuguugg

SEQ ID NO: 3785186 - RNA, 20 nt, Human
agcccaaaggggacaggccu

SEQ ID NO: 3785187 - RNA, 20 nt, Human
agcccaaagugguauagaaa

SEQ ID NO: 3785188 - RNA, 23 nt, Human
agcccaaagugguauagaaaugc

SEQ ID NO: 3785189 - RNA, 11 nt, Human
agcccaaccuc

SEQ ID NO: 3785190 - RNA, 23 nt, Human
agcccaaccucuuccuccugaca

SEQ ID NO: 3785191 - RNA, 19 nt, Human
agcccaagcuucccuccau

SEQ ID NO: 3785192 - RNA, 22 nt, Human
agcccaagguuuaaacuucucu

SEQ ID NO: 3785193 - RNA, 14 nt, Human
agcccaaguccaaa

SEQ ID NO: 3785194 - RNA, 17 nt, Human
agcccaaguccaaaugu

SEQ ID NO: 3785195 - RNA, 16 nt, Human
agcccaaugaaaugaa

SEQ ID NO: 3785196 - RNA, 23 nt, Human
agcccacacuugagaggaugaau

SEQ ID NO: 3785197 - RNA, 21 nt, Human
agcccaccauuuggcaucccu

SEQ ID NO: 3785198 - RNA, 14 nt, Human
agcccaccccccuc

SEQ ID NO: 3785199 - RNA, 14 nt, Human
agcccacccuccug

SEQ ID NO: 3785200 - RNA, 19 nt, Human
agcccacccuccugucuuc

SEQ ID NO: 3785201 - RNA, 21 nt, Human
agcccacccuccugucuuccc

SEQ ID NO: 3785202 - RNA, 13 nt, Human
agcccacccugcu

SEQ ID NO: 3785203 - RNA, 19 nt, Human
agcccacgacacugcagcc

SEQ ID NO: 3785204 - RNA, 14 nt, Human
agcccacgccccca

SEQ ID NO: 3785205 - RNA, 23 nt, Human
agcccacgcccccacuggugaca

SEQ ID NO: 3785206 - RNA, 20 nt, Human
agcccacgcugacuacaggg

SEQ ID NO: 3785207 - RNA, 20 nt, Human
agccuccccugccagggcag

SEQ ID NO: 3785208 - RNA, 20 nt, Human
agccucccgaauagcuggga

SEQ ID NO: 3785209 - RNA, 19 nt, Human
agccucccgaguagcuggg

SEQ ID NO: 3785210 - RNA, 20 nt, Human
agccucccgaguagcuggga

SEQ ID NO: 3785211 - RNA, 19 nt, Human
agccucccgaguagggagg

SEQ ID NO: 3785212 - RNA, 23 nt, Human
agccucccuauuuuuuuucuguu

SEQ ID NO: 3785213 - RNA, 21 nt, Human
agccucccucugaccugcagg

SEQ ID NO: 3785214 - RNA, 22 nt, Human
agccucccucugaccugcaggc

SEQ ID NO: 3785215 - RNA, 13 nt, Human
agccucccugaag

SEQ ID NO: 3785216 - RNA, 18 nt, Human
agccucccugucggccug

SEQ ID NO: 3785217 - RNA, 14 nt, Human
agccuccgagaggg

SEQ ID NO: 3785218 - RNA, 18 nt, Human
agccuccgagagggagag

SEQ ID NO: 3785219 - RNA, 16 nt, Human
agccuccgcuucccug

SEQ ID NO: 3785220 - RNA, 17 nt, Human
agccuccguauuucaga

SEQ ID NO: 3785221 - RNA, 12 nt, Human
agccuccuccug

SEQ ID NO: 3785222 - RNA, 19 nt, Human
agccuccuccugaccacgg

SEQ ID NO: 3785223 - RNA, 11 nt, Human
agccuccucug

SEQ ID NO: 3785224 - RNA, 18 nt, Human
agccuccucuggacggca

SEQ ID NO: 3785225 - RNA, 13 nt, Human
agcggcuggcagc

SEQ ID NO: 3785226 - RNA, 23 nt, Human
agcggcuggcagcccaccccuca

SEQ ID NO: 3785227 - RNA, 19 nt, Human
agcggcuggugcagggccu

SEQ ID NO: 3785228 - RNA, 20 nt, Human
agcgggaauggcagcugcca

SEQ ID NO: 3785229 - RNA, 19 nt, Human
agcgggcagguucugccug

SEQ ID NO: 3785230 - RNA, 15 nt, Human
agcggggacagcucc

SEQ ID NO: 3785231 - RNA, 20 nt, Human
agcggggacagcuccuucug

SEQ ID NO: 3785232 - RNA, 21 nt, Human
agcggggccccagggcuaccc

SEQ ID NO: 3785233 - RNA, 19 nt, Human
agcggggcgaagcccaggc

SEQ ID NO: 3785234 - RNA, 14 nt, Human
agcgggggaggccc

SEQ ID NO: 3785235 - RNA, 13 nt, Human
agcggucucaggc

SEQ ID NO: 3785236 - RNA, 22 nt, Human
agcggugcuguccucagguggc

SEQ ID NO: 3785237 - RNA, 12 nt, Human
agcgguggcccu

SEQ ID NO: 3785238 - RNA, 20 nt, Human
agcggugggggaggaggguu

SEQ ID NO: 3785239 - RNA, 14 nt, Human
agcggugucucucc

SEQ ID NO: 3785240 - RNA, 20 nt, Human
agcggugucucuccugcccc

SEQ ID NO: 3785241 - RNA, 15 nt, Human
agcguagugcagcag

SEQ ID NO: 3785242 - RNA, 15 nt, Human
agcgucagcugcucc

SEQ ID NO: 3785243 - RNA, 15 nt, Human
agcguccagaaaugg

SEQ ID NO: 3785244 - RNA, 19 nt, Human
agcgucccagucucuggca

SEQ ID NO: 3785245 - RNA, 17 nt, Human
agcgucccuagcaguga

SEQ ID NO: 3785246 - RNA, 13 nt, Human
agcgucccuggcg

SEQ ID NO: 3785247 - RNA, 17 nt, Human
agcguccuccucuguga

SEQ ID NO: 3785248 - RNA, 19 nt, Human
agcgugaagccagggcccg

SEQ ID NO: 3785249 - RNA, 22 nt, Human
agcgugagacgccaccauuccu

SEQ ID NO: 3785250 - RNA, 22 nt, Human
agcgugagccacugcaccgggc

SEQ ID NO: 3785251 - RNA, 17 nt, Human
agcgugcuuuaaaaaau

SEQ ID NO: 3785252 - RNA, 18 nt, Human
agcguggccuuguucugu

SEQ ID NO: 3785253 - RNA, 22 nt, Human
agcguggccuuguucugucacc

SEQ ID NO: 3785254 - RNA, 18 nt, Human
agcguucuuguaauuuua

SEQ ID NO: 3785255 - RNA, 14 nt, Human
agcguuuugcaagg

SEQ ID NO: 3785256 - RNA, 11 nt, Human
agcguuuuuua

SEQ ID NO: 3785257 - RNA, 17 nt, Human
agcguuuuuuaaaugua

SEQ ID NO: 3785258 - RNA, 23 nt, Human
agcguuuuuuaaauguauacuau

SEQ ID NO: 3785259 - RNA, 15 nt, Human
agcuaaaaccugagc

SEQ ID NO: 3785260 - RNA, 16 nt, Human
agcuaaaaugauuuua

SEQ ID NO: 3785261 - RNA, 18 nt, Human
agcuaaaccaaggacuga

SEQ ID NO: 3785262 - RNA, 19 nt, Human
agcuaaaccaaggacugag

SEQ ID NO: 3785263 - RNA, 16 nt, Human
agcuaaagaaguuuga

SEQ ID NO: 3785264 - RNA, 20 nt, Human
agcuaaauaccucaaucagu

SEQ ID NO: 3785265 - RNA, 13 nt, Human
agcuaaauccuuu

SEQ ID NO: 3785266 - RNA, 16 nt, Human
agcuaacacuggcccc

SEQ ID NO: 3785267 - RNA, 17 nt, Human
agcuaacacuggccccu

SEQ ID NO: 3785268 - RNA, 18 nt, Human
agcuaacagggaaggcag

SEQ ID NO: 3785269 - RNA, 12 nt, Human
agcuaagaaccu

SEQ ID NO: 3785270 - RNA, 14 nt, Human
agcuaagaaccugg

SEQ ID NO: 3785271 - RNA, 17 nt, Human
agcuaagcuaggaauga

SEQ ID NO: 3785272 - RNA, 23 nt, Human
agcuaaggaggggaaaaaaaugu

SEQ ID NO: 3785273 - RNA, 10 nt, Human
agcuaaggcu

SEQ ID NO: 3785274 - RNA, 13 nt, Human
agcuaaggcucua

SEQ ID NO: 3785275 - RNA, 15 nt, Human
agcuaaggcucuaug

SEQ ID NO: 3785276 - RNA, 19 nt, Human
agcuaagguuuagauaaau

SEQ ID NO: 3785277 - RNA, 19 nt, Human
agcuaagugaaaaggucau

SEQ ID NO: 3785278 - RNA, 16 nt, Human
agcuaauaaaaagcuu

SEQ ID NO: 3785279 - RNA, 21 nt, Human
agcuaauaaaaagcuuuuguc

SEQ ID NO: 3785280 - RNA, 23 nt, Human
agcuaauaaaauaucauucagca

SEQ ID NO: 3785281 - RNA, 18 nt, Human
agcuaauaacaugugaaa

SEQ ID NO: 3785282 - RNA, 21 nt, Human
agcuaauaauguuaaccaagg

SEQ ID NO: 3785283 - RNA, 17 nt, Human
agcuaauggaaaaugau

SEQ ID NO: 3785284 - RNA, 12 nt, Human
agcuaauuauuu

SEQ ID NO: 3785285 - RNA, 21 nt, Human
agcuaauuauuuuaauuaggu

SEQ ID NO: 3785286 - RNA, 19 nt, Human
agcuaauucuuugaccugu

SEQ ID NO: 3785287 - RNA, 13 nt, Human
agcuaauuugcau

SEQ ID NO: 3785288 - RNA, 14 nt, Human
agcuaauuugcauu

SEQ ID NO: 3785289 - RNA, 16 nt, Human
agcuacaacagccuca

SEQ ID NO: 3785290 - RNA, 19 nt, Human
agcuacaacagccucacuu

SEQ ID NO: 3785291 - RNA, 13 nt, Human
agcuacagagaaa

SEQ ID NO: 3785292 - RNA, 16 nt, Human
agcuacagagaaacca

SEQ ID NO: 3785293 - RNA, 17 nt, Human
agcuacagagaaaccag

SEQ ID NO: 3785294 - RNA, 21 nt, Human
agcuacagagaaaccagcuuc

SEQ ID NO: 3785295 - RNA, 22 nt, Human
agcuacagcuuucuugcucccu

SEQ ID NO: 3785296 - RNA, 18 nt, Human
agcuacagguuacaacag

SEQ ID NO: 3785297 - RNA, 22 nt, Human
agcuacagguuacaacagauuu

SEQ ID NO: 3785298 - RNA, 14 nt, Human
agcuaccaugacaa

SEQ ID NO: 3785299 - RNA, 22 nt, Human
agcuacccaggaggcugaggug

SEQ ID NO: 3785300 - RNA, 19 nt, Human
agcuacccuuuuccuuugu

SEQ ID NO: 3785301 - RNA, 21 nt, Human
agcuacccuuuuccuuugugg

SEQ ID NO: 3785302 - RNA, 22 nt, Human
agcuacccuuuuccuuuguggu

SEQ ID NO: 3785303 - RNA, 22 nt, Human
agcuaccuguguggacaggacu

SEQ ID NO: 3785304 - RNA, 16 nt, Human
agcuacuaaugauguu

SEQ ID NO: 3785305 - RNA, 15 nt, Human
agcuacucgggaggc

SEQ ID NO: 3785306 - RNA, 23 nt, Human
agcuacugauuuccuuuggagcu

SEQ ID NO: 3785307 - RNA, 18 nt, Human
agcuacugccauccuggc

SEQ ID NO: 3785308 - RNA, 18 nt, Human
agcuacuggauucuuauu

SEQ ID NO: 3785309 - RNA, 20 nt, Human
agcuacugugugugugaaug

SEQ ID NO: 3785310 - RNA, 23 nt, Human
agcuacugugugugugaaugaac

SEQ ID NO: 3785311 - RNA, 21 nt, Human
agcuacuuaagagaaauggca

SEQ ID NO: 3785312 - RNA, 16 nt, Human
agcuacuuccuccucc

SEQ ID NO: 3785313 - RNA, 21 nt, Human
agcuacuuccuccuccccacu

SEQ ID NO: 3785314 - RNA, 14 nt, Human
agcuacuugggagg

SEQ ID NO: 3785315 - RNA, 14 nt, Human
agcuacuugguuug

SEQ ID NO: 3785316 - RNA, 17 nt, Human
agcuagaaaacauuuuu

SEQ ID NO: 3785317 - RNA, 15 nt, Human
agcuagaaauaugau

SEQ ID NO: 3785318 - RNA, 16 nt, Human
agcuagaaggccacau

SEQ ID NO: 3785319 - RNA, 18 nt, Human
agcuagacgagcaggcuu

SEQ ID NO: 3785320 - RNA, 16 nt, Human
agcuagacuggugacu

SEQ ID NO: 3785321 - RNA, 17 nt, Human
agcuagacuggugacug

SEQ ID NO: 3785322 - RNA, 20 nt, Human
agcuagaggaaccaaccccc

SEQ ID NO: 3785323 - RNA, 13 nt, Human
agcuagaugcuuu

SEQ ID NO: 3785324 - RNA, 12 nt, Human
agcuagccagag

SEQ ID NO: 3785325 - RNA, 19 nt, Human
agcuagccagaggacugug

SEQ ID NO: 3785326 - RNA, 21 nt, Human
agcuagcgcugccgcacccca

SEQ ID NO: 3785327 - RNA, 14 nt, Human
agcuagcuccccuc

SEQ ID NO: 3785328 - RNA, 18 nt, Human
agcuagcuccccuccucu

SEQ ID NO: 3785329 - RNA, 16 nt, Human
agcuagcuuuuaggaa

SEQ ID NO: 3785330 - RNA, 20 nt, Human
agcuagcuuuuaggaaaauc

SEQ ID NO: 3785331 - RNA, 12 nt, Human
agcuaggaauga

SEQ ID NO: 3785332 - RNA, 19 nt, Human
agcuaggagcaaagccugu

SEQ ID NO: 3785333 - RNA, 20 nt, Human
agcuaggagcaaagccuguu

SEQ ID NO: 3785334 - RNA, 20 nt, Human
agcuaggauuugaacacuug

SEQ ID NO: 3785335 - RNA, 13 nt, Human
agcuaggcagggu

SEQ ID NO: 3785336 - RNA, 16 nt, Human
agcuaggccuggccag

SEQ ID NO: 3785337 - RNA, 14 nt, Human
agcuaggugacaua

SEQ ID NO: 3785338 - RNA, 19 nt, Human
agcuaggugacauauacau

SEQ ID NO: 3785339 - RNA, 16 nt, Human
agcuagucuuuugcuu

SEQ ID NO: 3785340 - RNA, 19 nt, Human
agcuaguggcuucaaaaua

SEQ ID NO: 3785341 - RNA, 19 nt, Human
agcuaguugaauacuugaa

SEQ ID NO: 3785342 - RNA, 23 nt, Human
agcuaguugaauacuugaaccau

SEQ ID NO: 3785343 - RNA, 17 nt, Human
agcuauaccugugccuc

SEQ ID NO: 3785344 - RNA, 17 nt, Human
agcuauagacccgagga

SEQ ID NO: 3785345 - RNA, 19 nt, Human
agcuauagacccgaggaaa

SEQ ID NO: 3785346 - RNA, 17 nt, Human
agcuauauccauguacu

SEQ ID NO: 3785347 - RNA, 19 nt, Human
agcuauaucuauauauaau

SEQ ID NO: 3785348 - RNA, 23 nt, Human
agcuaucaagugugcuuuagcuu

SEQ ID NO: 3785349 - RNA, 18 nt, Human
agcuauccggacagagca

SEQ ID NO: 3785350 - RNA, 15 nt, Human
agcuauccuggcucu

SEQ ID NO: 3785351 - RNA, 18 nt, Human
agcuccucauccagggcu

SEQ ID NO: 3785352 - RNA, 19 nt, Human
agcuccucauccagggcuc

SEQ ID NO: 3785353 - RNA, 14 nt, Human
agcuccuccccugg

SEQ ID NO: 3785354 - RNA, 17 nt, Human
agcuccuccccuggagg

SEQ ID NO: 3785355 - RNA, 16 nt, Human
agcuccuccucggaac

SEQ ID NO: 3785356 - RNA, 17 nt, Human
agcuccucuccccagcc

SEQ ID NO: 3785357 - RNA, 18 nt, Human
agcuccucuccccagccc

SEQ ID NO: 3785358 - RNA, 20 nt, Human
agcuccucuccccagcccag

SEQ ID NO: 3785359 - RNA, 23 nt, Human
agcuccucuccccagcccagaga

SEQ ID NO: 3785360 - RNA, 18 nt, Human
agcuccucuccuggagga

SEQ ID NO: 3785361 - RNA, 12 nt, Human
agcuccucuggg

SEQ ID NO: 3785362 - RNA, 14 nt, Human
agcuccucugggca

SEQ ID NO: 3785363 - RNA, 15 nt, Human
agcuccucugggcag

SEQ ID NO: 3785364 - RNA, 17 nt, Human
agcuccucugggcagga

SEQ ID NO: 3785365 - RNA, 13 nt, Human
agcuccucuucca

SEQ ID NO: 3785366 - RNA, 13 nt, Human
agcuccucuuccu

SEQ ID NO: 3785367 - RNA, 14 nt, Human
agcuccugaccagu

SEQ ID NO: 3785368 - RNA, 16 nt, Human
agcuccugggaaggcu

SEQ ID NO: 3785369 - RNA, 22 nt, Human
agcuccuggggcguccaggccg

SEQ ID NO: 3785370 - RNA, 11 nt, Human
agcuccuguaa

SEQ ID NO: 3785371 - RNA, 17 nt, Human
agcuccuguccccugcu

SEQ ID NO: 3785372 - RNA, 20 nt, Human
agcuccuguccccugcuaca

SEQ ID NO: 3785373 - RNA, 14 nt, Human
agcuccuguccucc

SEQ ID NO: 3785374 - RNA, 15 nt, Human
agcuccuguccuccc

SEQ ID NO: 3785375 - RNA, 17 nt, Human
agcuccuguccucccau

SEQ ID NO: 3785376 - RNA, 22 nt, Human
agcuccuguggccccacccugg

SEQ ID NO: 3785377 - RNA, 16 nt, Human
agcuccuuaaggcucu

SEQ ID NO: 3785378 - RNA, 22 nt, Human
agcuccuuaaggcucuuuugua

SEQ ID NO: 3785379 - RNA, 19 nt, Human
agcuccuuccuagccuugc

SEQ ID NO: 3785380 - RNA, 19 nt, Human
agcuccuuccuggagacug

SEQ ID NO: 3785381 - RNA, 22 nt, Human
agcuccuugagggcaagagcca

SEQ ID NO: 3785382 - RNA, 16 nt, Human
acuuuguucuggcucu

SEQ ID NO: 3785383 - RNA, 20 nt, Human
acuuuguucuggcucuucca

SEQ ID NO: 3785384 - RNA, 15 nt, Human
acuuuguucuuuagg

SEQ ID NO: 3785385 - RNA, 20 nt, Human
acuuuguucuuuaggagauu

SEQ ID NO: 3785386 - RNA, 13 nt, Human
acuuuuaaacugu

SEQ ID NO: 3785387 - RNA, 14 nt, Human
acuuuuacaaguaa

SEQ ID NO: 3785388 - RNA, 16 nt, Human
acuuuuacucugccua

SEQ ID NO: 3785389 - RNA, 13 nt, Human
acuuuuauaaacu

SEQ ID NO: 3785390 - RNA, 19 nt, Human
acuuuuauaaacuuuaccu

SEQ ID NO: 3785391 - RNA, 16 nt, Human
acuuuuauaaauuaaa

SEQ ID NO: 3785392 - RNA, 21 nt, Human
acuuuuauaaauuaaauauau

SEQ ID NO: 3785393 - RNA, 11 nt, Human
acuuuuauaau

SEQ ID NO: 3785394 - RNA, 19 nt, Human
acuuuuauaauaaaaggaa

SEQ ID NO: 3785395 - RNA, 21 nt, Human
acuuuuaucuauucugagaaa

SEQ ID NO: 3785396 - RNA, 20 nt, Human
acuuuuaugagcuuccaagg

SEQ ID NO: 3785397 - RNA, 16 nt, Human
acuuuuaugauacuug

SEQ ID NO: 3785398 - RNA, 20 nt, Human
acuuuuaugauguauauuua

SEQ ID NO: 3785399 - RNA, 15 nt, Human
acuuuuauuugcaac

SEQ ID NO: 3785400 - RNA, 22 nt, Human
acuuuuauuugcaacauuuaca

SEQ ID NO: 3785401 - RNA, 22 nt, Human
acuuuucaaggcuuauauucaa

SEQ ID NO: 3785402 - RNA, 20 nt, Human
acuuuucauucucuuuuaau

SEQ ID NO: 3785403 - RNA, 21 nt, Human
acuuuuccaauaugugauuuu

SEQ ID NO: 3785404 - RNA, 15 nt, Human
acuuuuccaguauuu

SEQ ID NO: 3785405 - RNA, 18 nt, Human
acuuuuccaguauuuuag

SEQ ID NO: 3785406 - RNA, 21 nt, Human
acuuuuccauguaucuaccuc

SEQ ID NO: 3785407 - RNA, 17 nt, Human
acuuuuccauucccaau

SEQ ID NO: 3785408 - RNA, 17 nt, Human
acuuuuccccuguccug

SEQ ID NO: 3785409 - RNA, 20 nt, Human
acuuuuccguuucagcggaa

SEQ ID NO: 3785410 - RNA, 13 nt, Human
acuuuuccucuua

SEQ ID NO: 3785411 - RNA, 20 nt, Human
acuuuuccucuuagaagaau

SEQ ID NO: 3785412 - RNA, 18 nt, Human
acuuuuccuugcauacaa

SEQ ID NO: 3785413 - RNA, 12 nt, Human
acuuuucguuaa

SEQ ID NO: 3785414 - RNA, 16 nt, Human
acuuuucguuaacauu

SEQ ID NO: 3785415 - RNA, 22 nt, Human
acuuuucguuaacauugaccaa

SEQ ID NO: 3785416 - RNA, 23 nt, Human
acuuuucuaaacuaggcuccuuc

SEQ ID NO: 3785417 - RNA, 23 nt, Human
acuuuucuagaauuauuuuucac

SEQ ID NO: 3785418 - RNA, 12 nt, Human
acuuuucugaua

SEQ ID NO: 3785419 - RNA, 20 nt, Human
acuuuucuguaauucagguu

SEQ ID NO: 3785420 - RNA, 12 nt, Human
acuuuucuucua

SEQ ID NO: 3785421 - RNA, 20 nt, Human
acuuuucuucuauugccucu

SEQ ID NO: 3785422 - RNA, 16 nt, Human
acuuuucuuucagcca

SEQ ID NO: 3785423 - RNA, 12 nt, Human
acuuuugcuuua

SEQ ID NO: 3785424 - RNA, 23 nt, Human
acuuuuggaaucuagaagaaaug

SEQ ID NO: 3785425 - RNA, 16 nt, Human
acuuuugguuaagucu

SEQ ID NO: 3785426 - RNA, 12 nt, Human
acuuuugugaaa

SEQ ID NO: 3785427 - RNA, 19 nt, Human
acuuuuuaacuauuaagag

SEQ ID NO: 3785428 - RNA, 17 nt, Human
acuuuuuaguaauuucu

SEQ ID NO: 3785429 - RNA, 15 nt, Human
acuuuuuauauauau

SEQ ID NO: 3785430 - RNA, 22 nt, Human
acuuuuuauauucucagcagag

SEQ ID NO: 3785431 - RNA, 12 nt, Human
acuuuuuauugc

SEQ ID NO: 3785432 - RNA, 15 nt, Human
acuuuuuauugccuu

SEQ ID NO: 3785433 - RNA, 16 nt, Human
acuuuuuauugccuuc

SEQ ID NO: 3785434 - RNA, 18 nt, Human
acuuuuuauugccuucuc

SEQ ID NO: 3785435 - RNA, 18 nt, Human
acuuuuucauuugccuau

SEQ ID NO: 3785436 - RNA, 11 nt, Human
acuuuuuccag

SEQ ID NO: 3785437 - RNA, 19 nt, Human
acuuuuucuuaaucauuuu

SEQ ID NO: 3785438 - RNA, 17 nt, Human
acuuuuucuuuuguaag

SEQ ID NO: 3785439 - RNA, 16 nt, Human
acuuuuugaggcaaaa

SEQ ID NO: 3785440 - RNA, 15 nt, Human
acuuuuugcagcuuu

SEQ ID NO: 3785441 - RNA, 19 nt, Human
acuuuuugguggauguaaa

SEQ ID NO: 3785442 - RNA, 13 nt, Human
acuuuuugugaag

SEQ ID NO: 3785443 - RNA, 13 nt, Human
acuuuuuuaaaua

SEQ ID NO: 3785444 - RNA, 15 nt, Human
acuuuuuuaaauaaa

SEQ ID NO: 3785445 - RNA, 21 nt, Human
acuuuuuuaaauaaacuuuuu

SEQ ID NO: 3785446 - RNA, 19 nt, Human
acuuuuuuaaauauuuucu

SEQ ID NO: 3785447 - RNA, 23 nt, Human
acuuuuuuauuuaaaaaacuaaa

SEQ ID NO: 3785448 - RNA, 23 nt, Human
acuuuuuugcuauccagcuauuu

SEQ ID NO: 3785449 - RNA, 21 nt, Human
acuuuuuuggggauaugcuua

SEQ ID NO: 3785450 - RNA, 13 nt, Human
acuuuuuuucaau

SEQ ID NO: 3785451 - RNA, 15 nt, Human
acuuuuuuucaaugu

SEQ ID NO: 3785452 - RNA, 15 nt, Human
acuuuuuuuuaaguu

SEQ ID NO: 3785453 - RNA, 22 nt, Human
acuuuuuuuuuccaaaaaaaua

SEQ ID NO: 3785454 - RNA, 20 nt, Human
agaaaaaaaaaaacuuacac

SEQ ID NO: 3785455 - RNA, 13 nt, Human
agaaaaaaaaaag

SEQ ID NO: 3785456 - RNA, 15 nt, Human
agaaaaaaaaaagaa

SEQ ID NO: 3785457 - RNA, 16 nt, Human
agaaaaaaaaaagaag

SEQ ID NO: 3785458 - RNA, 17 nt, Human
agaaaaaaaaaagaaga

SEQ ID NO: 3785459 - RNA, 15 nt, Human
agaaaaaaaaagaaa

SEQ ID NO: 3785460 - RNA, 16 nt, Human
agaaaaaaaaagaaaa

SEQ ID NO: 3785461 - RNA, 18 nt, Human
agaaaaaaaaagaaaaaa

SEQ ID NO: 3785462 - RNA, 21 nt, Human
agaaaaaaaaaugccauaaua

SEQ ID NO: 3785463 - RNA, 22 nt, Human
agaaaaaaaaaugccauaauac

SEQ ID NO: 3785464 - RNA, 19 nt, Human
agaaaaaaaaauucacaug

SEQ ID NO: 3785465 - RNA, 20 nt, Human
agaaaaaaaauaacacagag

SEQ ID NO: 3785466 - RNA, 12 nt, Human
agaaaaaaacaa

SEQ ID NO: 3785467 - RNA, 18 nt, Human
agaaaaaaacauucuauc

SEQ ID NO: 3785468 - RNA, 13 nt, Human
agaaaaaaaccau

SEQ ID NO: 3785469 - RNA, 12 nt, Human
agaaaaaaacga

SEQ ID NO: 3785470 - RNA, 18 nt, Human
agaaaaaaacgaaaacag

SEQ ID NO: 3785471 - RNA, 17 nt, Human
agaaaaaaagauuuauu

SEQ ID NO: 3785472 - RNA, 16 nt, Human
agaaaaaaaucuucuc

SEQ ID NO: 3785473 - RNA, 22 nt, Human
agaaaaaaauguauuuuauguu

SEQ ID NO: 3785474 - RNA, 13 nt, Human
agaaaaaaauuca

SEQ ID NO: 3785475 - RNA, 14 nt, Human
agaaaaaaguugua

SEQ ID NO: 3785476 - RNA, 13 nt, Human
agaaaaaauaaau

SEQ ID NO: 3785477 - RNA, 11 nt, Human
agaaaaaauac

SEQ ID NO: 3785478 - RNA, 23 nt, Human
agaaaaacaaacucguuuuuuac

SEQ ID NO: 3785479 - RNA, 13 nt, Human
agaaaaacaauaa

SEQ ID NO: 3785480 - RNA, 16 nt, Human
agaaaaacaauaagag

SEQ ID NO: 3785481 - RNA, 15 nt, Human
agaaaaagaaaugca

SEQ ID NO: 3785482 - RNA, 22 nt, Human
agaaaaagaacaugcaguuuga

SEQ ID NO: 3785483 - RNA, 20 nt, Human
agaaaaagcaauaaccucaa

SEQ ID NO: 3785484 - RNA, 18 nt, Human
agaaaaaggaugcacaga

SEQ ID NO: 3785485 - RNA, 13 nt, Human
agaaaaaggguca

SEQ ID NO: 3785486 - RNA, 14 nt, Human
agaaaaauaaagaa

SEQ ID NO: 3785487 - RNA, 11 nt, Human
agaaaaauauu

SEQ ID NO: 3785488 - RNA, 21 nt, Human
agaaaaaucuugugcuagaau

SEQ ID NO: 3785489 - RNA, 18 nt, Human
agaaaaaugagccuggca

SEQ ID NO: 3785490 - RNA, 15 nt, Human
agaaaaauuauugua

SEQ ID NO: 3785491 - RNA, 20 nt, Human
agaaaacaaaaaaaccucua

SEQ ID NO: 3785492 - RNA, 21 nt, Human
agaaaacaaaaaacgaaugaa

SEQ ID NO: 3785493 - RNA, 22 nt, Human
agaaaacaagaugagauuggca

SEQ ID NO: 3785494 - RNA, 13 nt, Human
agaaaacagaaaa

SEQ ID NO: 3785495 - RNA, 20 nt, Human
agaaaacaggaaaaaaacuu

SEQ ID NO: 3785496 - RNA, 18 nt, Human
agccugggcagccaggcu

SEQ ID NO: 3785497 - RNA, 21 nt, Human
agccugggcagccaggcugcc

SEQ ID NO: 3785498 - RNA, 17 nt, Human
agccugggcccaucucc

SEQ ID NO: 3785499 - RNA, 19 nt, Human
agccugggcccaucucccu

SEQ ID NO: 3785500 - RNA, 20 nt, Human
agccugggcccaucucccug

SEQ ID NO: 3785501 - RNA, 21 nt, Human
agccugggcccaucucccugc

SEQ ID NO: 3785502 - RNA, 12 nt, Human
agccugggccua

SEQ ID NO: 3785503 - RNA, 20 nt, Human
agccugggccuauggagagc

SEQ ID NO: 3785504 - RNA, 21 nt, Human
agccugggccuauggagagcc

SEQ ID NO: 3785505 - RNA, 14 nt, Human
agccugggcgacag

SEQ ID NO: 3785506 - RNA, 18 nt, Human
agccugggcgcugguccu

SEQ ID NO: 3785507 - RNA, 16 nt, Human
agccuggggccuggca

SEQ ID NO: 3785508 - RNA, 18 nt, Human
agccuggggccuggcagg

SEQ ID NO: 3785509 - RNA, 17 nt, Human
agccuggggcugaggcu

SEQ ID NO: 3785510 - RNA, 14 nt, Human
agccugggggccug

SEQ ID NO: 3785511 - RNA, 15 nt, Human
agccugggggccugg

SEQ ID NO: 3785512 - RNA, 17 nt, Human
agccugggggccuggcu

SEQ ID NO: 3785513 - RNA, 23 nt, Human
agccugggguggggucaugcccu

SEQ ID NO: 3785514 - RNA, 21 nt, Human
agccugguaggaaagggcaag

SEQ ID NO: 3785515 - RNA, 15 nt, Human
agccuggucagccca

SEQ ID NO: 3785516 - RNA, 20 nt, Human
agccuggucagcccaaacca

SEQ ID NO: 3785517 - RNA, 14 nt, Human
agccuggugcugcu

SEQ ID NO: 3785518 - RNA, 15 nt, Human
agccuggugcugcug

SEQ ID NO: 3785519 - RNA, 21 nt, Human
agccugguuuagccuggaugu

SEQ ID NO: 3785520 - RNA, 20 nt, Human
agccuguaacacuccucugc

SEQ ID NO: 3785521 - RNA, 17 nt, Human
agccuguaagccugcaa

SEQ ID NO: 3785522 - RNA, 16 nt, Human
agccuguaaucccagc

SEQ ID NO: 3785523 - RNA, 20 nt, Human
agccugucagauccaggagc

SEQ ID NO: 3785524 - RNA, 22 nt, Human
agccugucagauccaggagcuc

SEQ ID NO: 3785525 - RNA, 22 nt, Human
agccugucauccuuggucuuug

SEQ ID NO: 3785526 - RNA, 19 nt, Human
agccugucccauggacacu

SEQ ID NO: 3785527 - RNA, 18 nt, Human
agccuguccugggcuggu

SEQ ID NO: 3785528 - RNA, 14 nt, Human
agccuguccuguca

SEQ ID NO: 3785529 - RNA, 22 nt, Human
agccugugaacccaggacaagc

SEQ ID NO: 3785530 - RNA, 19 nt, Human
agccugugacauacccccu

SEQ ID NO: 3785531 - RNA, 16 nt, Human
agccugugcaaaaaaa

SEQ ID NO: 3785532 - RNA, 21 nt, Human
agccugugcaaaaaaauuaaa

SEQ ID NO: 3785533 - RNA, 12 nt, Human
agccugugccuc

SEQ ID NO: 3785534 - RNA, 15 nt, Human
agccuguggaugauc

SEQ ID NO: 3785535 - RNA, 11 nt, Human
agccuguggca

SEQ ID NO: 3785536 - RNA, 22 nt, Human
agccuguggcaguaaagagaaa

SEQ ID NO: 3785537 - RNA, 12 nt, Human
agcuccuuggga

SEQ ID NO: 3785538 - RNA, 15 nt, Human
agcuccuugggaggc

SEQ ID NO: 3785539 - RNA, 20 nt, Human
agcuccuugggaggccccac

SEQ ID NO: 3785540 - RNA, 22 nt, Human
agcuccuuugggcuucagcugc

SEQ ID NO: 3785541 - RNA, 18 nt, Human
agcuccuuuuccagagca

SEQ ID NO: 3785542 - RNA, 14 nt, Human
agcucggcucagcu

SEQ ID NO: 3785543 - RNA, 12 nt, Human
agcucgguggac

SEQ ID NO: 3785544 - RNA, 16 nt, Human
agcucgguggacccag

SEQ ID NO: 3785545 - RNA, 18 nt, Human
agcucguguauccugggg

SEQ ID NO: 3785546 - RNA, 17 nt, Human
agcucuaaaaucugcuu

SEQ ID NO: 3785547 - RNA, 14 nt, Human
agcucuaauguuug

SEQ ID NO: 3785548 - RNA, 21 nt, Human
agcucuaauguuugcauauaa

SEQ ID NO: 3785549 - RNA, 14 nt, Human
agcucuagaaucug

SEQ ID NO: 3785550 - RNA, 19 nt, Human
agcucuauuaugaauguga

SEQ ID NO: 3785551 - RNA, 23 nt, Human
agcucucaucugaggcauccagc

SEQ ID NO: 3785552 - RNA, 22 nt, Human
agcucucccucuggcccugccu

SEQ ID NO: 3785553 - RNA, 20 nt, Human
agcucucggaacugcaugcu

SEQ ID NO: 3785554 - RNA, 22 nt, Human
agcucucggaacugcaugcugc

SEQ ID NO: 3785555 - RNA, 13 nt, Human
agcucucuaggcc

SEQ ID NO: 3785556 - RNA, 17 nt, Human
agcucucuaggccucuc

SEQ ID NO: 3785557 - RNA, 19 nt, Human
agcucucuaggccucucca

SEQ ID NO: 3785558 - RNA, 16 nt, Human
agcucucuccucccuu

SEQ ID NO: 3785559 - RNA, 11 nt, Human
agcucucugca

SEQ ID NO: 3785560 - RNA, 14 nt, Human
agcucucugcccug

SEQ ID NO: 3785561 - RNA, 18 nt, Human
agcucucugcccugugua

SEQ ID NO: 3785562 - RNA, 19 nt, Human
agcucucuguauaaacauu

SEQ ID NO: 3785563 - RNA, 19 nt, Human
agcucucuucaaugacaua

SEQ ID NO: 3785564 - RNA, 21 nt, Human
agcucugaagucacaucacag

SEQ ID NO: 3785565 - RNA, 10 nt, Human
agcucugaga

SEQ ID NO: 3785566 - RNA, 16 nt, Human
agcucugagaggcccu

SEQ ID NO: 3785567 - RNA, 10 nt, Human
agcucugagc

SEQ ID NO: 3785568 - RNA, 14 nt, Human
agcucugagcuguc

SEQ ID NO: 3785569 - RNA, 12 nt, Human
agcucugaggga

SEQ ID NO: 3785570 - RNA, 23 nt, Human
agcucugaguuccggcaccagua

SEQ ID NO: 3785571 - RNA, 21 nt, Human
agcucugcagagcaggaaaca

SEQ ID NO: 3785572 - RNA, 14 nt, Human
agcucugcagccca

SEQ ID NO: 3785573 - RNA, 13 nt, Human
agcucugcauuau

SEQ ID NO: 3785574 - RNA, 23 nt, Human
agcucugcccauccugccccuga

SEQ ID NO: 3785575 - RNA, 22 nt, Human
agcucugcgucgguccuggugc

SEQ ID NO: 3785576 - RNA, 12 nt, Human
agcucugcuccu

SEQ ID NO: 3785577 - RNA, 13 nt, Human
agcucugcuugcc

SEQ ID NO: 3785578 - RNA, 12 nt, Human
agcucuggacca

SEQ ID NO: 3785579 - RNA, 15 nt, Human
agcucuggaccagcc

SEQ ID NO: 3785580 - RNA, 17 nt, Human
agcucuggaccagccug

SEQ ID NO: 3785581 - RNA, 14 nt, Human
agcucuggagccac

SEQ ID NO: 3785582 - RNA, 18 nt, Human
agcucuggagccaccugu

SEQ ID NO: 3785583 - RNA, 17 nt, Human
agcucuggaggggaggg

SEQ ID NO: 3785584 - RNA, 19 nt, Human
agcucuggcucacagacug

SEQ ID NO: 3785585 - RNA, 19 nt, Human
agcucuggcugaacccugu

SEQ ID NO: 3785586 - RNA, 12 nt, Human
agcucuggcuuc

SEQ ID NO: 3785587 - RNA, 18 nt, Human
agcucugggagaggauuu

SEQ ID NO: 3785588 - RNA, 19 nt, Human
agcucuggggugggcaguu

SEQ ID NO: 3785589 - RNA, 20 nt, Human
agcucuggggugggcaguuu

SEQ ID NO: 3785590 - RNA, 22 nt, Human
agcucuggggugggcaguuuuu

SEQ ID NO: 3785591 - RNA, 17 nt, Human
agcucugguccauagag

SEQ ID NO: 3785592 - RNA, 20 nt, Human
agcucugguccauagagagc

SEQ ID NO: 3785593 - RNA, 22 nt, Human
agcucuguaucaggacccagag

SEQ ID NO: 3785594 - RNA, 14 nt, Human
agcucuguccuggg

SEQ ID NO: 3785595 - RNA, 23 nt, Human
agcucuguccugggagugagcug

SEQ ID NO: 3785596 - RNA, 14 nt, Human
agcucugucugucc

SEQ ID NO: 3785597 - RNA, 15 nt, Human
agcucuguguugcca

SEQ ID NO: 3785598 - RNA, 18 nt, Human
agcucuguucuuccucag

SEQ ID NO: 3785599 - RNA, 19 nt, Human
agcucuguucuuccucagc

SEQ ID NO: 3785600 - RNA, 20 nt, Human
agcucuguucuuccucagcc

SEQ ID NO: 3785601 - RNA, 16 nt, Human
agcucuguugcaauua

SEQ ID NO: 3785602 - RNA, 16 nt, Human
agcucuuaacuacagu

SEQ ID NO: 3785603 - RNA, 13 nt, Human
agcucuucaggcc

SEQ ID NO: 3785604 - RNA, 17 nt, Human
agcucuucaggccuccc

SEQ ID NO: 3785605 - RNA, 18 nt, Human
agcucuucaggccucccu

SEQ ID NO: 3785606 - RNA, 14 nt, Human
agcucuucaucugc

SEQ ID NO: 3785607 - RNA, 13 nt, Human
agcucuucauguu

SEQ ID NO: 3785608 - RNA, 16 nt, Human
agcucuucauguuuca

SEQ ID NO: 3785609 - RNA, 22 nt, Human
agcucuuccuggacaggccagg

SEQ ID NO: 3785610 - RNA, 14 nt, Human
agcucuucuccauc

SEQ ID NO: 3785611 - RNA, 23 nt, Human
agcucuucugccggcccuggggc

SEQ ID NO: 3785612 - RNA, 18 nt, Human
agcucuucuuaaaguauu

SEQ ID NO: 3785613 - RNA, 16 nt, Human
agcucuucuucccagc

SEQ ID NO: 3785614 - RNA, 14 nt, Human
agcucuugcccuuc

SEQ ID NO: 3785615 - RNA, 13 nt, Human
agcucuuuccucc

SEQ ID NO: 3785616 - RNA, 14 nt, Human
agcucuuugcacua

SEQ ID NO: 3785617 - RNA, 22 nt, Human
agcucuuuggcagucuauaugu

SEQ ID NO: 3785618 - RNA, 22 nt, Human
agcugaaaaccuaaguccuuua

SEQ ID NO: 3785619 - RNA, 12 nt, Human
agcugaaaauau

SEQ ID NO: 3785620 - RNA, 20 nt, Human
agcugaaaauauaaaacaaa

SEQ ID NO: 3785621 - RNA, 17 nt, Human
agcugaaaguugggacu

SEQ ID NO: 3785622 - RNA, 18 nt, Human
agcugaaauaugcuggcu

SEQ ID NO: 3785623 - RNA, 20 nt, Human
agcugaaauaugcuggcugg

SEQ ID NO: 3785624 - RNA, 20 nt, Human
agcugaaaugcugcauuuua

SEQ ID NO: 3785625 - RNA, 21 nt, Human
agcugaacaauaggcuguucc

SEQ ID NO: 3785626 - RNA, 22 nt, Human
agcugaacaauaggcuguuccc

SEQ ID NO: 3785627 - RNA, 14 nt, Human
agcugaacacauuu

SEQ ID NO: 3785628 - RNA, 16 nt, Human
agcugaacacauuucu

SEQ ID NO: 3785629 - RNA, 18 nt, Human
agcugaagaauugaaaag

SEQ ID NO: 3785630 - RNA, 15 nt, Human
agcugaagagcuggg

SEQ ID NO: 3785631 - RNA, 16 nt, Human
agcugaagauuuugga

SEQ ID NO: 3785632 - RNA, 19 nt, Human
agcugaagccgccaggacc

SEQ ID NO: 3785633 - RNA, 18 nt, Human
agcugaaugccuccugug

SEQ ID NO: 3785634 - RNA, 22 nt, Human
agcugaauguuuuucuaaagga

SEQ ID NO: 3785635 - RNA, 20 nt, Human
agcugaauugagccuaaaaa

SEQ ID NO: 3785636 - RNA, 19 nt, Human
agcugacaaaauuuugcuc

SEQ ID NO: 3785637 - RNA, 20 nt, Human
agcugacacaaaccugccug

SEQ ID NO: 3785638 - RNA, 23 nt, Human
agcugacacaaaccugccugggu

SEQ ID NO: 3785639 - RNA, 16 nt, Human
agcugacaguccucuc

SEQ ID NO: 3785640 - RNA, 13 nt, Human
auaugauuguuuc

SEQ ID NO: 3785641 - RNA, 19 nt, Human
auaugauuuuuuaaaagaa

SEQ ID NO: 3785642 - RNA, 16 nt, Human
auaugcaaugugaagc

SEQ ID NO: 3785643 - RNA, 16 nt, Human
auaugcacacauuuuu

SEQ ID NO: 3785644 - RNA, 17 nt, Human
auaugcaccuugugucu

SEQ ID NO: 3785645 - RNA, 23 nt, Human
auaugcacuaagucucuuuuuua

SEQ ID NO: 3785646 - RNA, 17 nt, Human
auaugcagauuuugccc

SEQ ID NO: 3785647 - RNA, 20 nt, Human
auaugcagugauauggcaga

SEQ ID NO: 3785648 - RNA, 17 nt, Human
auaugcaguuuuccuua

SEQ ID NO: 3785649 - RNA, 19 nt, Human
auaugcauauauauaugug

SEQ ID NO: 3785650 - RNA, 19 nt, Human
auaugcccacauuuagucu

SEQ ID NO: 3785651 - RNA, 21 nt, Human
auaugcccacauuuagucucu

SEQ ID NO: 3785652 - RNA, 22 nt, Human
auaugcccacauuuagucucuu

SEQ ID NO: 3785653 - RNA, 15 nt, Human
auaugccugcucuuu

SEQ ID NO: 3785654 - RNA, 22 nt, Human
auaugccugggcagaaggaaga

SEQ ID NO: 3785655 - RNA, 14 nt, Human
auaugccuuguaua

SEQ ID NO: 3785656 - RNA, 15 nt, Human
auaugcguauuauac

SEQ ID NO: 3785657 - RNA, 14 nt, Human
auaugcuaauuugg

SEQ ID NO: 3785658 - RNA, 19 nt, Human
auaugcuaccaccagcugu

SEQ ID NO: 3785659 - RNA, 16 nt, Human
auaugcuauuucuaua

SEQ ID NO: 3785660 - RNA, 21 nt, Human
auaugcuauuucuauauuuuc

SEQ ID NO: 3785661 - RNA, 23 nt, Human
auaugcuauuucuauauuuucau

SEQ ID NO: 3785662 - RNA, 20 nt, Human
auaugcucugauuuaucuga

SEQ ID NO: 3785663 - RNA, 16 nt, Human
auaugcucugcauguu

SEQ ID NO: 3785664 - RNA, 18 nt, Human
auaugcucuuuuguuugg

SEQ ID NO: 3785665 - RNA, 14 nt, Human
auaugcuuacugau

SEQ ID NO: 3785666 - RNA, 20 nt, Human
auaugcuucuguuuuauaau

SEQ ID NO: 3785667 - RNA, 22 nt, Human
auaugcuucuguuuuauaauuu

SEQ ID NO: 3785668 - RNA, 13 nt, Human
auaugcuucuuua

SEQ ID NO: 3785669 - RNA, 19 nt, Human
auaugcuuguaacuaaaau

SEQ ID NO: 3785670 - RNA, 14 nt, Human
auaugcuuuauuaa

SEQ ID NO: 3785671 - RNA, 15 nt, Human
auauggaaauauaua

SEQ ID NO: 3785672 - RNA, 16 nt, Human
auauggaaauauauau

SEQ ID NO: 3785673 - RNA, 20 nt, Human
auauggaacuucuaauauau

SEQ ID NO: 3785674 - RNA, 19 nt, Human
auauggaauuuugcaaaga

SEQ ID NO: 3785675 - RNA, 19 nt, Human
auauggacauaucaucugu

SEQ ID NO: 3785676 - RNA, 11 nt, Human
auauggagccc

SEQ ID NO: 3785677 - RNA, 15 nt, Human
auauggcaagaaagc

SEQ ID NO: 3785678 - RNA, 17 nt, Human
auauggcaagaaagcug

SEQ ID NO: 3785679 - RNA, 18 nt, Human
auauggcaagaaagcugg

SEQ ID NO: 3785680 - RNA, 19 nt, Human
auauggcagaguuguaaau

SEQ ID NO: 3785681 - RNA, 23 nt, Human
auauggcagaguuguaaauauau

SEQ ID NO: 3785682 - RNA, 13 nt, Human
auauggccacagu

SEQ ID NO: 3785683 - RNA, 23 nt, Human
auauggccacaguagucuugaug

SEQ ID NO: 3785684 - RNA, 22 nt, Human
auauggcucuucauaauucuaa

SEQ ID NO: 3785685 - RNA, 17 nt, Human
auaugggcauuguaguu

SEQ ID NO: 3785686 - RNA, 17 nt, Human
auauggggggccaacac

SEQ ID NO: 3785687 - RNA, 22 nt, Human
auaugggguauuggacauagau

SEQ ID NO: 3785688 - RNA, 22 nt, Human
auauggguuuauaauuuucuga

SEQ ID NO: 3785689 - RNA, 14 nt, Human
auaugguauauaua

SEQ ID NO: 3785690 - RNA, 14 nt, Human
auauggucuaaugu

SEQ ID NO: 3785691 - RNA, 16 nt, Human
auauggucuaauguuu

SEQ ID NO: 3785692 - RNA, 15 nt, Human
auauguaaaacauuu

SEQ ID NO: 3785693 - RNA, 13 nt, Human
auauguaaaauaa

SEQ ID NO: 3785694 - RNA, 15 nt, Human
auauguaaaauaaaa

SEQ ID NO: 3785695 - RNA, 20 nt, Human
auauguaaucucuaggaagu

SEQ ID NO: 3785696 - RNA, 17 nt, Human
auauguacaauuguggg

SEQ ID NO: 3785697 - RNA, 14 nt, Human
auauguacaugaga

SEQ ID NO: 3785698 - RNA, 11 nt, Human
auauguaccaa

SEQ ID NO: 3785699 - RNA, 13 nt, Human
auauguacuguuu

SEQ ID NO: 3785700 - RNA, 21 nt, Human
auauguacuugucaaagaagg

SEQ ID NO: 3785701 - RNA, 19 nt, Human
auauguagacuauauacau

SEQ ID NO: 3785702 - RNA, 18 nt, Human
auauguagauguaugcac

SEQ ID NO: 3785703 - RNA, 23 nt, Human
auauguagauguaugcacacaca

SEQ ID NO: 3785704 - RNA, 18 nt, Human
auauguagccuucacaca

SEQ ID NO: 3785705 - RNA, 15 nt, Human
auauguauacaugug

SEQ ID NO: 3785706 - RNA, 21 nt, Human
auauguauauauauauaugca

SEQ ID NO: 3785707 - RNA, 18 nt, Human
auauguauccaguacauu

SEQ ID NO: 3785708 - RNA, 19 nt, Human
auauguauccaguacauuu

SEQ ID NO: 3785709 - RNA, 12 nt, Human
auauguaugggu

SEQ ID NO: 3785710 - RNA, 15 nt, Human
auauguauguaaaaa

SEQ ID NO: 3785711 - RNA, 11 nt, Human
auauguaugug

SEQ ID NO: 3785712 - RNA, 13 nt, Human
auauguauguguu

SEQ ID NO: 3785713 - RNA, 15 nt, Human
auauguauguguuua

SEQ ID NO: 3785714 - RNA, 20 nt, Human
auauguauguguuuagaauu

SEQ ID NO: 3785715 - RNA, 21 nt, Human
auauguauguguuuagaauug

SEQ ID NO: 3785716 - RNA, 23 nt, Human
auauguauguguuuagaauugaa

SEQ ID NO: 3785717 - RNA, 17 nt, Human
auauguauuauuuauaa

SEQ ID NO: 3785718 - RNA, 23 nt, Human
auauguauuauuuauaauuccua

SEQ ID NO: 3785719 - RNA, 21 nt, Human
auauguauuguaaacaugugu

SEQ ID NO: 3785720 - RNA, 15 nt, Human
auauguauuuaccaa

SEQ ID NO: 3785721 - RNA, 16 nt, Human
auauguauuuaccaaa

SEQ ID NO: 3785722 - RNA, 18 nt, Human
auauguauuuaccaaaaa

SEQ ID NO: 3785723 - RNA, 11 nt, Human
auauguauuuu

SEQ ID NO: 3785724 - RNA, 13 nt, Human
auauguauuuuau

SEQ ID NO: 3785725 - RNA, 19 nt, Human
auauguauuuuauguaugu

SEQ ID NO: 3785726 - RNA, 22 nt, Human
auauguauuuuauguauguuua

SEQ ID NO: 3785727 - RNA, 15 nt, Human
auaugucacuagaau

SEQ ID NO: 3785728 - RNA, 17 nt, Human
auaugucacuagaaugg

SEQ ID NO: 3785729 - RNA, 14 nt, Human
auaugucagggcgu

SEQ ID NO: 3785730 - RNA, 18 nt, Human
auaugucagucacuaaaa

SEQ ID NO: 3785731 - RNA, 20 nt, Human
auaugucucgcuagugaugu

SEQ ID NO: 3785732 - RNA, 16 nt, Human
auaugucugcuccuuu

SEQ ID NO: 3785733 - RNA, 13 nt, Human
auaugugaacauu

SEQ ID NO: 3785734 - RNA, 11 nt, Human
auaugugaauc

SEQ ID NO: 3785735 - RNA, 22 nt, Human
auaugugagauuuuuuauugcu

SEQ ID NO: 3785736 - RNA, 13 nt, Human
auaugugaucugu

SEQ ID NO: 3785737 - RNA, 16 nt, Human
auaugugaucugucuu

SEQ ID NO: 3785738 - RNA, 20 nt, Human
auaugugaucugucuuguaa

SEQ ID NO: 3785739 - RNA, 19 nt, Human
auaugugccaaucaauagc

SEQ ID NO: 3785740 - RNA, 21 nt, Human
auauguggaguucaucuugaa

SEQ ID NO: 3785741 - RNA, 15 nt, Human
auauguguauauaua

SEQ ID NO: 3785742 - RNA, 18 nt, Human
auauguguauauauacau

SEQ ID NO: 3785743 - RNA, 14 nt, Human
auauguguauguac

SEQ ID NO: 3785744 - RNA, 16 nt, Human
auauguguauguacgu

SEQ ID NO: 3785745 - RNA, 21 nt, Human
auaugugugccuauuugugug

SEQ ID NO: 3785746 - RNA, 16 nt, Human
auauguguguguaugu

SEQ ID NO: 3785747 - RNA, 23 nt, Human
auauguguguguguguguugcuu

SEQ ID NO: 3785748 - RNA, 19 nt, Human
auauguguguuuaaauaaa

SEQ ID NO: 3785749 - RNA, 20 nt, Human
auauguguguuuaaauaaag

SEQ ID NO: 3785750 - RNA, 18 nt, Human
auauguguuuuucacauu

SEQ ID NO: 3785751 - RNA, 18 nt, Human
auauguucuuuaaaaaua

SEQ ID NO: 3785752 - RNA, 14 nt, Human
auauguugaauacu

SEQ ID NO: 3785753 - RNA, 15 nt, Human
auauguugaauacuu

SEQ ID NO: 3785754 - RNA, 22 nt, Human
auauguugaugaaaaauagcaa

SEQ ID NO: 3785755 - RNA, 20 nt, Human
auauguugcuauaauaaaga

SEQ ID NO: 3785756 - RNA, 13 nt, Human
auauguuguucuu

SEQ ID NO: 3785757 - RNA, 14 nt, Human
auauguuguucuua

SEQ ID NO: 3785758 - RNA, 21 nt, Human
auauguuuaaaauaaaaugaa

SEQ ID NO: 3785759 - RNA, 18 nt, Human
auauguuucacacaaaca

SEQ ID NO: 3785760 - RNA, 13 nt, Human
auauguuuccuug

SEQ ID NO: 3785761 - RNA, 17 nt, Human
auauguuuuuuagauca

SEQ ID NO: 3785762 - RNA, 21 nt, Human
auauguuuuuuagaucaaaua

SEQ ID NO: 3785763 - RNA, 17 nt, Human
auauuaaaaaacuucau

SEQ ID NO: 3785764 - RNA, 24 nt, Human
auauuaaaaaacuucauguaauuu

SEQ ID NO: 3785765 - RNA, 17 nt, Human
auauuaaaaaagagaca

SEQ ID NO: 3785766 - RNA, 12 nt, Human
auauuaaaaagu

SEQ ID NO: 3785767 - RNA, 16 nt, Human
auauuaaaaagucuuu

SEQ ID NO: 3785768 - RNA, 13 nt, Human
auauuaaaaauau

SEQ ID NO: 3785769 - RNA, 21 nt, Human
auauuaaaaauauaaaacugc

SEQ ID NO: 3785770 - RNA, 21 nt, Human
auauuaaaaaugguaaaauug

SEQ ID NO: 3785771 - RNA, 23 nt, Human
auauuaaaagaaaggguucugua

SEQ ID NO: 3785772 - RNA, 15 nt, Human
auauuaaaagucaca

SEQ ID NO: 3785773 - RNA, 21 nt, Human
auauuaaaauaagcacugugc

SEQ ID NO: 3785774 - RNA, 15 nt, Human
auauuaaaauuccaa

SEQ ID NO: 3785775 - RNA, 21 nt, Human
auauuaaaauuccaaauucau

SEQ ID NO: 3785776 - RNA, 17 nt, Human
auauuaaacauccacaa

SEQ ID NO: 3785777 - RNA, 19 nt, Human
auauuaaauacagacacua

SEQ ID NO: 3785778 - RNA, 18 nt, Human
auauuaaauuuuuuguug

SEQ ID NO: 3785779 - RNA, 24 nt, Human
auauuaagaaagacuaucuaaaug

SEQ ID NO: 3785780 - RNA, 22 nt, Human
auauuaaggaagacaaugugaa

SEQ ID NO: 3785781 - RNA, 20 nt, Human
auauuaaguaagucucaagg

SEQ ID NO: 3785782 - RNA, 12 nt, Human
auauuaauguac

SEQ ID NO: 3785783 - RNA, 21 nt, Human
auacuuaaauguuauguauau

SEQ ID NO: 3785784 - RNA, 14 nt, Human
auauugucuuuuug

SEQ ID NO: 3785785 - RNA, 18 nt, Human
auauugugccaauaugua

SEQ ID NO: 3785786 - RNA, 21 nt, Human
auauugugccaauauguauug

SEQ ID NO: 3785787 - RNA, 19 nt, Human
auauuguggguguuaauuu

SEQ ID NO: 3785788 - RNA, 17 nt, Human
auauuguguuuguguau

SEQ ID NO: 3785789 - RNA, 18 nt, Human
auauuguucaaacaauau

SEQ ID NO: 3785790 - RNA, 21 nt, Human
auauuguucaaacaauaucau

SEQ ID NO: 3785791 - RNA, 18 nt, Human
auauuguuccuaaguucu

SEQ ID NO: 3785792 - RNA, 19 nt, Human
auauuguuccuaaguucuu

SEQ ID NO: 3785793 - RNA, 13 nt, Human
auauuguugacaa

SEQ ID NO: 3785794 - RNA, 17 nt, Human
aggacuagaaccuggag

SEQ ID NO: 3785795 - RNA, 18 nt, Human
aggacuagaaccuggagg

SEQ ID NO: 3785796 - RNA, 15 nt, Human
aggacuaggguccug

SEQ ID NO: 3785797 - RNA, 19 nt, Human
aggacuaggguccugggga

SEQ ID NO: 3785798 - RNA, 16 nt, Human
aggacuauagcccagg

SEQ ID NO: 3785799 - RNA, 19 nt, Human
aggacuauagcccaggucc

SEQ ID NO: 3785800 - RNA, 22 nt, Human
aggacucacagguuggaagaga

SEQ ID NO: 3785801 - RNA, 19 nt, Human
aggacucagcuccccagag

SEQ ID NO: 3785802 - RNA, 18 nt, Human
aggacuccaggcagcaga

SEQ ID NO: 3785803 - RNA, 15 nt, Human
aggacuccaggccca

SEQ ID NO: 3785804 - RNA, 16 nt, Human
aggacuccaggcccaa

SEQ ID NO: 3785805 - RNA, 23 nt, Human
aggacuccaggcccaaggcuccc

SEQ ID NO: 3785806 - RNA, 17 nt, Human
aggacucccaacccugg

SEQ ID NO: 3785807 - RNA, 20 nt, Human
aggacucccaacccuggcuu

SEQ ID NO: 3785808 - RNA, 16 nt, Human
aggacuccccaggcca

SEQ ID NO: 3785809 - RNA, 14 nt, Human
aggacucccuccuc

SEQ ID NO: 3785810 - RNA, 16 nt, Human
aggacucccuccucac

SEQ ID NO: 3785811 - RNA, 19 nt, Human
aggacucccuccucaccuc

SEQ ID NO: 3785812 - RNA, 20 nt, Human
aggacucgcuuguaaauacc

SEQ ID NO: 3785813 - RNA, 21 nt, Human
aggacucgcuuguaaauacca

SEQ ID NO: 3785814 - RNA, 21 nt, Human
aggacucucacgauaugcaag

SEQ ID NO: 3785815 - RNA, 14 nt, Human
aggacucugcagcc

SEQ ID NO: 3785816 - RNA, 16 nt, Human
aggacucugcagccuc

SEQ ID NO: 3785817 - RNA, 13 nt, Human
aggacucugccuc

SEQ ID NO: 3785818 - RNA, 14 nt, Human
aggacucugccucc

SEQ ID NO: 3785819 - RNA, 19 nt, Human
aggacucugccuccucuuc

SEQ ID NO: 3785820 - RNA, 20 nt, Human
aggacugaauuaugaaacuu

SEQ ID NO: 3785821 - RNA, 17 nt, Human
aggacugacugaggcag

SEQ ID NO: 3785822 - RNA, 13 nt, Human
aggacugagcccc

SEQ ID NO: 3785823 - RNA, 24 nt, Human
aggacugagccccgcagaccuccc

SEQ ID NO: 3785824 - RNA, 17 nt, Human
aggacugaugucuccua

SEQ ID NO: 3785825 - RNA, 18 nt, Human
aggacugauuucagagug

SEQ ID NO: 3785826 - RNA, 20 nt, Human
aggacugcaccauugcugcu

SEQ ID NO: 3785827 - RNA, 20 nt, Human
aggacugcaugguaauuuau

SEQ ID NO: 3785828 - RNA, 21 nt, Human
aggacugccccgugcagacug

SEQ ID NO: 3785829 - RNA, 19 nt, Human
aggacugggagcccccagc

SEQ ID NO: 3785830 - RNA, 12 nt, Human
aggacugggcca

SEQ ID NO: 3785831 - RNA, 15 nt, Human
aggacugggccacuu

SEQ ID NO: 3785832 - RNA, 15 nt, Human
aggacuguauuugug

SEQ ID NO: 3785833 - RNA, 18 nt, Human
aggacuguauuugugacu

SEQ ID NO: 3785834 - RNA, 16 nt, Human
aggacugugacaggca

SEQ ID NO: 3785835 - RNA, 18 nt, Human
aggacugugacaggcagc

SEQ ID NO: 3785836 - RNA, 21 nt, Human
aggacugugacaggcagcaga

SEQ ID NO: 3785837 - RNA, 19 nt, Human
aggacuguuucaaacaugc

SEQ ID NO: 3785838 - RNA, 21 nt, Human
aggacuguuuuuuccugagcu

SEQ ID NO: 3785839 - RNA, 21 nt, Human
aggacuuaacggcuccaggau

SEQ ID NO: 3785840 - RNA, 20 nt, Human
aggacuuccuguccagcucc

SEQ ID NO: 3785841 - RNA, 14 nt, Human
aggacuucuuuaau

SEQ ID NO: 3785842 - RNA, 16 nt, Human
aggacuucuuuaauuu

SEQ ID NO: 3785843 - RNA, 16 nt, Human
aggacuugaaagcauc

SEQ ID NO: 3785844 - RNA, 19 nt, Human
aggacuugaaagcauccau

SEQ ID NO: 3785845 - RNA, 21 nt, Human
aggacuugaaagcauccaugu

SEQ ID NO: 3785846 - RNA, 16 nt, Human
aggacuuggucugauu

SEQ ID NO: 3785847 - RNA, 23 nt, Human
aggacuuggucugauuucaggau

SEQ ID NO: 3785848 - RNA, 16 nt, Human
aggacuuguuagaucu

SEQ ID NO: 3785849 - RNA, 20 nt, Human
aggacuuuauagaucagcca

SEQ ID NO: 3785850 - RNA, 17 nt, Human
aggacuuucugaagccu

SEQ ID NO: 3785851 - RNA, 22 nt, Human
aggacuuuucuuuguggcuucc

SEQ ID NO: 3785852 - RNA, 23 nt, Human
aggacuuuucuuuguggcuuccu

SEQ ID NO: 3785853 - RNA, 11 nt, Human
aggagaaacug

SEQ ID NO: 3785854 - RNA, 18 nt, Human
aggagaaacuggaacucu

SEQ ID NO: 3785855 - RNA, 19 nt, Human
aggagaaacuggaacucuc

SEQ ID NO: 3785856 - RNA, 12 nt, Human
aggagaacaaau

SEQ ID NO: 3785857 - RNA, 13 nt, Human
aggagaacaaaua

SEQ ID NO: 3785858 - RNA, 14 nt, Human
aggagaaccacuac

SEQ ID NO: 3785859 - RNA, 16 nt, Human
aggagaaccagauucu

SEQ ID NO: 3785860 - RNA, 15 nt, Human
aggagaacuugcugc

SEQ ID NO: 3785861 - RNA, 19 nt, Human
aggagaacuugcugccucg

SEQ ID NO: 3785862 - RNA, 13 nt, Human
aggagaagaaaau

SEQ ID NO: 3785863 - RNA, 16 nt, Human
aggagaagaaggaaau

SEQ ID NO: 3785864 - RNA, 15 nt, Human
aggagaagaguugag

SEQ ID NO: 3785865 - RNA, 11 nt, Human
aggagaagcca

SEQ ID NO: 3785866 - RNA, 12 nt, Human
aggagaagccag

SEQ ID NO: 3785867 - RNA, 15 nt, Human
aggagaagccaggaa

SEQ ID NO: 3785868 - RNA, 12 nt, Human
aggagaagcuca

SEQ ID NO: 3785869 - RNA, 14 nt, Human
aggagaagcucagc

SEQ ID NO: 3785870 - RNA, 20 nt, Human
aggagaauggcgugaacccg

SEQ ID NO: 3785871 - RNA, 16 nt, Human
aggagacaaaagagca

SEQ ID NO: 3785872 - RNA, 15 nt, Human
aggagacacagaugu

SEQ ID NO: 3785873 - RNA, 16 nt, Human
aggagacacagauguu

SEQ ID NO: 3785874 - RNA, 20 nt, Human
aggagacagguuagcugcuc

SEQ ID NO: 3785875 - RNA, 16 nt, Human
aggagacggaggggag

SEQ ID NO: 3785876 - RNA, 15 nt, Human
aggagacucaccucu

SEQ ID NO: 3785877 - RNA, 22 nt, Human
aggagagaaaauauauguauuu

SEQ ID NO: 3785878 - RNA, 15 nt, Human
aggagagaagaauga

SEQ ID NO: 3785879 - RNA, 12 nt, Human
aggagagagaaa

SEQ ID NO: 3785880 - RNA, 21 nt, Human
aggagagagaaagccaggcag

SEQ ID NO: 3785881 - RNA, 20 nt, Human
aggagagagcagcuucugcc

SEQ ID NO: 3785882 - RNA, 10 nt, Human
aggagagagg

SEQ ID NO: 3785883 - RNA, 18 nt, Human
aggagagauagccugugg

SEQ ID NO: 3785884 - RNA, 12 nt, Human
aggagagcagcg

SEQ ID NO: 3785885 - RNA, 14 nt, Human
aggagagccagaga

SEQ ID NO: 3785886 - RNA, 23 nt, Human
aggagagccagagaagugacagg

SEQ ID NO: 3785887 - RNA, 14 nt, Human
aggagagccagccc

SEQ ID NO: 3785888 - RNA, 15 nt, Human
aggagagccagcccu

SEQ ID NO: 3785889 - RNA, 16 nt, Human
aggagagccagcccuc

SEQ ID NO: 3785890 - RNA, 12 nt, Human
aggagagccugc

SEQ ID NO: 3785891 - RNA, 16 nt, Human
aggagagccugcugca

SEQ ID NO: 3785892 - RNA, 20 nt, Human
aggagagccugcugcauggg

SEQ ID NO: 3785893 - RNA, 13 nt, Human
aggagaggagaga

SEQ ID NO: 3785894 - RNA, 16 nt, Human
aggagaggagagccag

SEQ ID NO: 3785895 - RNA, 17 nt, Human
aggagaggagagccaga

SEQ ID NO: 3785896 - RNA, 15 nt, Human
aggagaggaugagag

SEQ ID NO: 3785897 - RNA, 19 nt, Human
aggagaggaugagagccca

SEQ ID NO: 3785898 - RNA, 20 nt, Human
aggagaggaugagagcccag

SEQ ID NO: 3785899 - RNA, 16 nt, Human
aggagaggauggccca

SEQ ID NO: 3785900 - RNA, 21 nt, Human
aggagaggcaacauccaaaau

SEQ ID NO: 3785901 - RNA, 16 nt, Human
aggagagggaaaaugu

SEQ ID NO: 3785902 - RNA, 17 nt, Human
aggagagggaaaauguu

SEQ ID NO: 3785903 - RNA, 14 nt, Human
aggagaggggcaca

SEQ ID NO: 3785904 - RNA, 16 nt, Human
aggagaggggcacagg

SEQ ID NO: 3785905 - RNA, 13 nt, Human
aggagaggggcag

SEQ ID NO: 3785906 - RNA, 19 nt, Human
aggagaggggcagaacagc

SEQ ID NO: 3785907 - RNA, 17 nt, Human
aggagaguagaacagau

SEQ ID NO: 3785908 - RNA, 24 nt, Human
aggagagucccagagcaggaggcc

SEQ ID NO: 3785909 - RNA, 14 nt, Human
aggagaguggccau

SEQ ID NO: 3785910 - RNA, 18 nt, Human
aggagauaucugagggag

SEQ ID NO: 3785911 - RNA, 23 nt, Human
aggagaucgagaccauccuggcu

SEQ ID NO: 3785912 - RNA, 18 nt, Human
aggagaugcuccuugggc

SEQ ID NO: 3785913 - RNA, 22 nt, Human
aggagaugcuccuugggcccuu

SEQ ID NO: 3785914 - RNA, 14 nt, Human
aggagaugggccuu

SEQ ID NO: 3785915 - RNA, 17 nt, Human
aggagauguaagagcuu

SEQ ID NO: 3785916 - RNA, 16 nt, Human
aggagauucugccuuu

SEQ ID NO: 3785917 - RNA, 21 nt, Human
aggagauucugccuuugccag

SEQ ID NO: 3785918 - RNA, 15 nt, Human
aggagauugagaagg

SEQ ID NO: 3785919 - RNA, 22 nt, Human
aggagauugagaaggagagaaa

SEQ ID NO: 3785920 - RNA, 16 nt, Human
aggagcaaagccuguu

SEQ ID NO: 3785921 - RNA, 16 nt, Human
aggagcaaaggcugag

SEQ ID NO: 3785922 - RNA, 22 nt, Human
aggagcaaaggcugagaacacu

SEQ ID NO: 3785923 - RNA, 17 nt, Human
aggagcaaauguuucug

SEQ ID NO: 3785924 - RNA, 16 nt, Human
aggagcacagguccca

SEQ ID NO: 3785925 - RNA, 16 nt, Human
aggagcacggcucugu

SEQ ID NO: 3785926 - RNA, 13 nt, Human
aggagcagccaca

SEQ ID NO: 3785927 - RNA, 16 nt, Human
aggagcagccucagaa

SEQ ID NO: 3785928 - RNA, 16 nt, Human
aggagcagcuucaguu

SEQ ID NO: 3785929 - RNA, 21 nt, Human
auaguaccauuuauacaaauu

SEQ ID NO: 3785930 - RNA, 15 nt, Human
auaguaccuuugcuc

SEQ ID NO: 3785931 - RNA, 18 nt, Human
auaguaccuuugcucuug

SEQ ID NO: 3785932 - RNA, 18 nt, Human
auaguacucuuuguagca

SEQ ID NO: 3785933 - RNA, 14 nt, Human
auaguacuggcaug

SEQ ID NO: 3785934 - RNA, 16 nt, Human
auaguagcauacauuu

SEQ ID NO: 3785935 - RNA, 12 nt, Human
auaguauaaacc

SEQ ID NO: 3785936 - RNA, 15 nt, Human
auaguauaucuggac

SEQ ID NO: 3785937 - RNA, 23 nt, Human
auaguauccauauuuuauuacug

SEQ ID NO: 3785938 - RNA, 16 nt, Human
auaguauccuccaggu

SEQ ID NO: 3785939 - RNA, 19 nt, Human
auaguauccuccagguuuu

SEQ ID NO: 3785940 - RNA, 20 nt, Human
auaguauccuccagguuuuu

SEQ ID NO: 3785941 - RNA, 17 nt, Human
auaguaugguggcuggg

SEQ ID NO: 3785942 - RNA, 18 nt, Human
auaguaugguggcugggu

SEQ ID NO: 3785943 - RNA, 21 nt, Human
auaguauuccauugugugagu

SEQ ID NO: 3785944 - RNA, 13 nt, Human
auaguauuugaaa

SEQ ID NO: 3785945 - RNA, 22 nt, Human
auaguauuugaaaacagaaauu

SEQ ID NO: 3785946 - RNA, 20 nt, Human
auaguauuugauucaaaaua

SEQ ID NO: 3785947 - RNA, 16 nt, Human
auaguauuuuuaucca

SEQ ID NO: 3785948 - RNA, 19 nt, Human
auagucaaaccauaaacuu

SEQ ID NO: 3785949 - RNA, 22 nt, Human
auagucaaaccauaaacuucau

SEQ ID NO: 3785950 - RNA, 16 nt, Human
auauuguugcauugcu

SEQ ID NO: 3785951 - RNA, 22 nt, Human
auauuguuguauaauuucgaga

SEQ ID NO: 3785952 - RNA, 19 nt, Human
auauuguuucugcauucau

SEQ ID NO: 3785953 - RNA, 18 nt, Human
auauuguuugguaaaugu

SEQ ID NO: 3785954 - RNA, 23 nt, Human
auauuuaaacaugguuacaauca

SEQ ID NO: 3785955 - RNA, 14 nt, Human
auauuuaaagacag

SEQ ID NO: 3785956 - RNA, 12 nt, Human
auauuuaaaggg

SEQ ID NO: 3785957 - RNA, 19 nt, Human
auauuuaacauuauuuaua

SEQ ID NO: 3785958 - RNA, 22 nt, Human
auauuuaacauuauuuauaugg

SEQ ID NO: 3785959 - RNA, 13 nt, Human
auauuuaacuggu

SEQ ID NO: 3785960 - RNA, 16 nt, Human
auauuuaacuggugca

SEQ ID NO: 3785961 - RNA, 16 nt, Human
auauuuaagaaaauac

SEQ ID NO: 3785962 - RNA, 19 nt, Human
auauuuaaguauucaagaa

SEQ ID NO: 3785963 - RNA, 9 nt, Human
auauuuaau

SEQ ID NO: 3785964 - RNA, 21 nt, Human
auauuuaaugcauuaaaccug

SEQ ID NO: 3785965 - RNA, 15 nt, Human
auauuuaauguuuua

SEQ ID NO: 3785966 - RNA, 14 nt, Human
auauuuaauuauua

SEQ ID NO: 3785967 - RNA, 22 nt, Human
auauuuacaacacuuuaauggg

SEQ ID NO: 3785968 - RNA, 13 nt, Human
auauuuacaaccu

SEQ ID NO: 3785969 - RNA, 23 nt, Human
auauuuacagugaaaauguaagc

SEQ ID NO: 3785970 - RNA, 15 nt, Human
auauuuacauaugaa

SEQ ID NO: 3785971 - RNA, 20 nt, Human
auauuuacauaugaaauuua

SEQ ID NO: 3785972 - RNA, 19 nt, Human
auauuuaccucagccuggg

SEQ ID NO: 3785973 - RNA, 14 nt, Human
auauuuacguauga

SEQ ID NO: 3785974 - RNA, 22 nt, Human
auauuuagauguaauuuugugu

SEQ ID NO: 3785975 - RNA, 19 nt, Human
auauuuagauuguuaaaau

SEQ ID NO: 3785976 - RNA, 19 nt, Human
auauuuagcaaauaauuuc

SEQ ID NO: 3785977 - RNA, 17 nt, Human
auauuuaguauugaaua

SEQ ID NO: 3785978 - RNA, 11 nt, Human
auauuuauaac

SEQ ID NO: 3785979 - RNA, 15 nt, Human
auauuuauaacucau

SEQ ID NO: 3785980 - RNA, 22 nt, Human
auauuuauauaauuauguuauu

SEQ ID NO: 3785981 - RNA, 12 nt, Human
auauuuauccaa

SEQ ID NO: 3785982 - RNA, 21 nt, Human
auauuuaugaagaaaauacuu

SEQ ID NO: 3785983 - RNA, 18 nt, Human
auauuuaugucuauuuaa

SEQ ID NO: 3785984 - RNA, 16 nt, Human
auauuuauucauuauu

SEQ ID NO: 3785985 - RNA, 14 nt, Human
auauuuauugugcu

SEQ ID NO: 3785986 - RNA, 13 nt, Human
auauuuauuuaaa

SEQ ID NO: 3785987 - RNA, 15 nt, Human
auauuuauuuuaaua

SEQ ID NO: 3785988 - RNA, 19 nt, Human
auauuuauuuuuuuuaagu

SEQ ID NO: 3785989 - RNA, 18 nt, Human
auauuucaaguacacuga

SEQ ID NO: 3785990 - RNA, 15 nt, Human
auauuucagauguaa

SEQ ID NO: 3785991 - RNA, 18 nt, Human
auauuucagauguaaugu

SEQ ID NO: 3785992 - RNA, 21 nt, Human
auauuucagauguaauguuuu

SEQ ID NO: 3785993 - RNA, 20 nt, Human
auauuucagguucuucagaa

SEQ ID NO: 3785994 - RNA, 21 nt, Human
auauuuccauauggauuuucu

SEQ ID NO: 3785995 - RNA, 20 nt, Human
auauuucccuaaaauacauu

SEQ ID NO: 3785996 - RNA, 19 nt, Human
auauuucccugaaggaacc

SEQ ID NO: 3785997 - RNA, 21 nt, Human
auauuucccugaaggaaccaa

SEQ ID NO: 3785998 - RNA, 18 nt, Human
auauuuccuauaccauuu

SEQ ID NO: 3785999 - RNA, 21 nt, Human
auauuuccuuaaacugugugg

SEQ ID NO: 3786000 - RNA, 14 nt, Human
auauuuccuuuaug

SEQ ID NO: 3786001 - RNA, 19 nt, Human
auauuuccuuuaugugaau

SEQ ID NO: 3786002 - RNA, 15 nt, Human
auauuucugauauaa

SEQ ID NO: 3786003 - RNA, 13 nt, Human
auauuucuucaaa

SEQ ID NO: 3786004 - RNA, 18 nt, Human
auauuucuucaaauaucu

SEQ ID NO: 3786005 - RNA, 19 nt, Human
auauuucuucguucuuuuu

SEQ ID NO: 3786006 - RNA, 19 nt, Human
auauuugaaauauugacuu

SEQ ID NO: 3786007 - RNA, 14 nt, Human
auauuugaaucuug

SEQ ID NO: 3786008 - RNA, 18 nt, Human
auauuugaaucuugucuc

SEQ ID NO: 3786009 - RNA, 15 nt, Human
auauuugacuugcau

SEQ ID NO: 3786010 - RNA, 15 nt, Human
auauuugauuuauua

SEQ ID NO: 3786011 - RNA, 20 nt, Human
auauuugcaaaguguauuag

SEQ ID NO: 3786012 - RNA, 13 nt, Human
auauuugcuuuuu

SEQ ID NO: 3786013 - RNA, 14 nt, Human
auauuuggaauaaa

SEQ ID NO: 3786014 - RNA, 23 nt, Human
auauuuggaauaaaaauuccaga

SEQ ID NO: 3786015 - RNA, 18 nt, Human
auauuuggcuuaaauaua

SEQ ID NO: 3786016 - RNA, 17 nt, Human
auauuuguaaaaugaca

SEQ ID NO: 3786017 - RNA, 19 nt, Human
auauuuguaaaaugacaau

SEQ ID NO: 3786018 - RNA, 11 nt, Human
auauuuguaca

SEQ ID NO: 3786019 - RNA, 20 nt, Human
auauuuguacuuucuguuaa

SEQ ID NO: 3786020 - RNA, 12 nt, Human
auauuuguagaa

SEQ ID NO: 3786021 - RNA, 20 nt, Human
auauuuguauuuaaaugaaa

SEQ ID NO: 3786022 - RNA, 19 nt, Human
auauuuguauuuauucuuu

SEQ ID NO: 3786023 - RNA, 22 nt, Human
auauuugugauagcacuuucua

SEQ ID NO: 3786024 - RNA, 17 nt, Human
auauuugugcuauagua

SEQ ID NO: 3786025 - RNA, 21 nt, Human
auauuuguuaaauauuuacau

SEQ ID NO: 3786026 - RNA, 23 nt, Human
auauuuguuuaguucagcaaaac

SEQ ID NO: 3786027 - RNA, 20 nt, Human
auauuuuaaaaucuccuaaa

SEQ ID NO: 3786028 - RNA, 14 nt, Human
auauuuuaaaauga

SEQ ID NO: 3786029 - RNA, 15 nt, Human
auauuuuaaaauuug

SEQ ID NO: 3786030 - RNA, 14 nt, Human
auauuuuaaacaga

SEQ ID NO: 3786031 - RNA, 14 nt, Human
auauuuuaagacga

SEQ ID NO: 3786032 - RNA, 14 nt, Human
auauuuuaagcauu

SEQ ID NO: 3786033 - RNA, 23 nt, Human
auauuuuaagcauuacucuugua

SEQ ID NO: 3786034 - RNA, 15 nt, Human
auauuuuaauuucaa

SEQ ID NO: 3786035 - RNA, 16 nt, Human
auauuuuacauaaauu

SEQ ID NO: 3786036 - RNA, 20 nt, Human
auauuuuacauaaauuuagu

SEQ ID NO: 3786037 - RNA, 17 nt, Human
auauuuuaccucuuauu

SEQ ID NO: 3786038 - RNA, 14 nt, Human
auauuuuauaauuu

SEQ ID NO: 3786039 - RNA, 13 nt, Human
auauuuuaugauc

SEQ ID NO: 3786040 - RNA, 14 nt, Human
auauuuuaugguua

SEQ ID NO: 3786041 - RNA, 15 nt, Human
auauuuuaugguuau

SEQ ID NO: 3786042 - RNA, 21 nt, Human
auauuuuauuucaauguaauu

SEQ ID NO: 3786043 - RNA, 14 nt, Human
auauuuuauuuuua

SEQ ID NO: 3786044 - RNA, 19 nt, Human
auauuuucaacgcagcccu

SEQ ID NO: 3786045 - RNA, 13 nt, Human
auauuuucacaau

SEQ ID NO: 3786046 - RNA, 21 nt, Human
auauuuucaccauuugauuau

SEQ ID NO: 3786047 - RNA, 18 nt, Human
auauuuucaugcuguuca

SEQ ID NO: 3786048 - RNA, 17 nt, Human
auauuuucguaugaaaa

SEQ ID NO: 3786049 - RNA, 19 nt, Human
auauuuucguaugaaaaug

SEQ ID NO: 3786050 - RNA, 13 nt, Human
auauuuucucuag

SEQ ID NO: 3786051 - RNA, 19 nt, Human
auauuuucucuaggaaaua

SEQ ID NO: 3786052 - RNA, 18 nt, Human
auauuuucucuguacuuu

SEQ ID NO: 3786053 - RNA, 12 nt, Human
auauuuucugug

SEQ ID NO: 3786054 - RNA, 21 nt, Human
auauuuucugugcagccacug

SEQ ID NO: 3786055 - RNA, 12 nt, Human
auauuuucuuuc

SEQ ID NO: 3786056 - RNA, 14 nt, Human
auauuuugauaaua

SEQ ID NO: 3786057 - RNA, 15 nt, Human
auauuuugaucuuca

SEQ ID NO: 3786058 - RNA, 20 nt, Human
auauuuuguaaaauguauua

SEQ ID NO: 3786059 - RNA, 14 nt, Human
auauuuuguaugca

SEQ ID NO: 3786060 - RNA, 17 nt, Human
auauuuuguaugcaagc

SEQ ID NO: 3786061 - RNA, 14 nt, Human
auauuuugucuaaa

SEQ ID NO: 3786062 - RNA, 22 nt, Human
auauuuugugugaaauugcaua

SEQ ID NO: 3786063 - RNA, 17 nt, Human
auauuuuuaaaaaauga

SEQ ID NO: 3786064 - RNA, 14 nt, Human
auauuuuuaaagau

SEQ ID NO: 3786065 - RNA, 14 nt, Human
auauuuuuaagaua

SEQ ID NO: 3786066 - RNA, 20 nt, Human
auauuuuuaagauaauaaua

SEQ ID NO: 3786067 - RNA, 13 nt, Human
auauuuuuauaga

SEQ ID NO: 3786068 - RNA, 19 nt, Human
auauuuuuauagacaaaua

SEQ ID NO: 3786069 - RNA, 16 nt, Human
auauuuuuauauuuac

SEQ ID NO: 3786070 - RNA, 18 nt, Human
auauuuuuauauuuaguu

SEQ ID NO: 3786071 - RNA, 20 nt, Human
auauuuuuauauuuccuuua

SEQ ID NO: 3786072 - RNA, 14 nt, Human
auauuuuuaucuuu

SEQ ID NO: 3786073 - RNA, 14 nt, Human
auauuuuucacaua

SEQ ID NO: 3786074 - RNA, 16 nt, Human
aggauuccucuuuucu

SEQ ID NO: 3786075 - RNA, 14 nt, Human
aggauucuaaaaug

SEQ ID NO: 3786076 - RNA, 20 nt, Human
aggauucucaccagcugugu

SEQ ID NO: 3786077 - RNA, 21 nt, Human
aggauucugcuggccucugcg

SEQ ID NO: 3786078 - RNA, 17 nt, Human
aggauucuuccucccuc

SEQ ID NO: 3786079 - RNA, 24 nt, Human
aggauugaaaauguccaggaaagu

SEQ ID NO: 3786080 - RNA, 19 nt, Human
aggauugaacuucuuugaa

SEQ ID NO: 3786081 - RNA, 13 nt, Human
aggauugaagagc

SEQ ID NO: 3786082 - RNA, 17 nt, Human
aggauugauuaugcaga

SEQ ID NO: 3786083 - RNA, 16 nt, Human
aggauugcgagagaug

SEQ ID NO: 3786084 - RNA, 23 nt, Human
aggauugcgagagauguguguug

SEQ ID NO: 3786085 - RNA, 17 nt, Human
aggauugcuacuguccu

SEQ ID NO: 3786086 - RNA, 22 nt, Human
aggauugcuacuguccuaccca

SEQ ID NO: 3786087 - RNA, 19 nt, Human
aggauugcuugagcccagg

SEQ ID NO: 3786088 - RNA, 20 nt, Human
aggauugcuugagcccagga

SEQ ID NO: 3786089 - RNA, 21 nt, Human
aggauuggggaagagagccug

SEQ ID NO: 3786090 - RNA, 18 nt, Human
aggauuuaaaaacuggaa

SEQ ID NO: 3786091 - RNA, 12 nt, Human
aggauuuaacag

SEQ ID NO: 3786092 - RNA, 18 nt, Human
aggauuuaacagucauuu

SEQ ID NO: 3786093 - RNA, 21 nt, Human
aggauuuaacagucauuuaaa

SEQ ID NO: 3786094 - RNA, 14 nt, Human
aggauuucaagccu

SEQ ID NO: 3786095 - RNA, 15 nt, Human
aggauuucaagccug

SEQ ID NO: 3786096 - RNA, 20 nt, Human
aggauuucaugauuucauuu

SEQ ID NO: 3786097 - RNA, 20 nt, Human
aggauuugguccgucauaac

SEQ ID NO: 3786098 - RNA, 19 nt, Human
aggauuuuaacaaaagcaa

SEQ ID NO: 3786099 - RNA, 23 nt, Human
aggauuuuaacaaaagcaagacu

SEQ ID NO: 3786100 - RNA, 23 nt, Human
aggauuuuaacuuaacugaaaug

SEQ ID NO: 3786101 - RNA, 22 nt, Human
aggauuuuagcuaggauuugaa

SEQ ID NO: 3786102 - RNA, 14 nt, Human
aggauuuuaugcuu

SEQ ID NO: 3786103 - RNA, 20 nt, Human
aggauuuuaugcuuuaaaca

SEQ ID NO: 3786104 - RNA, 19 nt, Human
aggauuuugauccaagcug

SEQ ID NO: 3786105 - RNA, 21 nt, Human
aggauuuuuuuuaauguuuaa

SEQ ID NO: 3786106 - RNA, 21 nt, Human
aggauuuuuuuuuuuuuuuga

SEQ ID NO: 3786107 - RNA, 15 nt, Human
aggcaaaaauguaaa

SEQ ID NO: 3786108 - RNA, 17 nt, Human
aggcaaaauccuugcuu

SEQ ID NO: 3786109 - RNA, 19 nt, Human
aggcaaaauccuugcuuau

SEQ ID NO: 3786110 - RNA, 18 nt, Human
aggcaaacauuuucucuu

SEQ ID NO: 3786111 - RNA, 22 nt, Human
aggcaaacauuuucucuuagaa

SEQ ID NO: 3786112 - RNA, 14 nt, Human
aggcaaagcuggcu

SEQ ID NO: 3786113 - RNA, 16 nt, Human
aggcaaaggguccaga

SEQ ID NO: 3786114 - RNA, 15 nt, Human
aggcaaauaaaauuc

SEQ ID NO: 3786115 - RNA, 15 nt, Human
aggcaaauuugcauu

SEQ ID NO: 3786116 - RNA, 17 nt, Human
aggcaacucaucuuagg

SEQ ID NO: 3786117 - RNA, 17 nt, Human
aggcaacugaacaaaaa

SEQ ID NO: 3786118 - RNA, 18 nt, Human
aggcaacugaacaaaaaa

SEQ ID NO: 3786119 - RNA, 19 nt, Human
aggcaacugaggcagacag

SEQ ID NO: 3786120 - RNA, 19 nt, Human
aggcaacugcauuggcuuu

SEQ ID NO: 3786121 - RNA, 12 nt, Human
aggcaagagaau

SEQ ID NO: 3786122 - RNA, 14 nt, Human
aggcaagcaccucc

SEQ ID NO: 3786123 - RNA, 14 nt, Human
aggcaagccaggcu

SEQ ID NO: 3786124 - RNA, 16 nt, Human
aggcaagccaggcuca

SEQ ID NO: 3786125 - RNA, 14 nt, Human
aggcaaggcaggug

SEQ ID NO: 3786126 - RNA, 20 nt, Human
aggcaaggcaggugccucca

SEQ ID NO: 3786127 - RNA, 18 nt, Human
aggcaaggcuaugugauu

SEQ ID NO: 3786128 - RNA, 17 nt, Human
aggcaaggcugucaauu

SEQ ID NO: 3786129 - RNA, 19 nt, Human
aggcaaguuaagagaaacu

SEQ ID NO: 3786130 - RNA, 20 nt, Human
aggcaaguuaagagaaacuu

SEQ ID NO: 3786131 - RNA, 18 nt, Human
aggcaaguuucuagcuag

SEQ ID NO: 3786132 - RNA, 17 nt, Human
aggcaauaaaaaucaua

SEQ ID NO: 3786133 - RNA, 14 nt, Human
aggcaaugcuggcu

SEQ ID NO: 3786134 - RNA, 15 nt, Human
aggcaaugcuggcug

SEQ ID NO: 3786135 - RNA, 16 nt, Human
aggcaaugcuggcugu

SEQ ID NO: 3786136 - RNA, 19 nt, Human
aggcaauggccuaaacuuc

SEQ ID NO: 3786137 - RNA, 17 nt, Human
aggcaaugucaggaaca

SEQ ID NO: 3786138 - RNA, 22 nt, Human
aggcaaugucaggaacagaagg

SEQ ID NO: 3786139 - RNA, 14 nt, Human
aggcaauucuccug

SEQ ID NO: 3786140 - RNA, 13 nt, Human
aggcacaaaauga

SEQ ID NO: 3786141 - RNA, 17 nt, Human
aggcacaaaaugaugga

SEQ ID NO: 3786142 - RNA, 14 nt, Human
aggcacaauauggg

SEQ ID NO: 3786143 - RNA, 22 nt, Human
aggcacacaaggggcccuugga

SEQ ID NO: 3786144 - RNA, 13 nt, Human
aggcacacagcua

SEQ ID NO: 3786145 - RNA, 14 nt, Human
aggcacacagcugc

SEQ ID NO: 3786146 - RNA, 16 nt, Human
aucauuauaaacguga

SEQ ID NO: 3786147 - RNA, 16 nt, Human
aucauuauguaauguc

SEQ ID NO: 3786148 - RNA, 22 nt, Human
aucauucacuucacugugcugu

SEQ ID NO: 3786149 - RNA, 14 nt, Human
aucauucagaaaug

SEQ ID NO: 3786150 - RNA, 21 nt, Human
aucauucaucuucuucuuuaa

SEQ ID NO: 3786151 - RNA, 13 nt, Human
aucauucccucuc

SEQ ID NO: 3786152 - RNA, 22 nt, Human
aucauucccucucaucucaggu

SEQ ID NO: 3786153 - RNA, 14 nt, Human
aucauuccuuuuua

SEQ ID NO: 3786154 - RNA, 21 nt, Human
aucauuccuuuuuauuuauau

SEQ ID NO: 3786155 - RNA, 12 nt, Human
aucauucucugu

SEQ ID NO: 3786156 - RNA, 14 nt, Human
aucauucucugucu

SEQ ID NO: 3786157 - RNA, 23 nt, Human
aucauucuuacuaaaaaguauaa

SEQ ID NO: 3786158 - RNA, 14 nt, Human
aucauugaaaucuu

SEQ ID NO: 3786159 - RNA, 21 nt, Human
aucauugaaaucuuuuugcuu

SEQ ID NO: 3786160 - RNA, 21 nt, Human
aucauugcacucuagccuggg

SEQ ID NO: 3786161 - RNA, 22 nt, Human
aucauugcugucugcagccuug

SEQ ID NO: 3786162 - RNA, 23 nt, Human
aucauugcuuugaagcaguugug

SEQ ID NO: 3786163 - RNA, 20 nt, Human
aucauuggaacaacugauac

SEQ ID NO: 3786164 - RNA, 21 nt, Human
aucauuggauucugagagcug

SEQ ID NO: 3786165 - RNA, 16 nt, Human
aucauuguacaguuug

SEQ ID NO: 3786166 - RNA, 18 nt, Human
aucauuguacaguuuguu

SEQ ID NO: 3786167 - RNA, 22 nt, Human
aucauuguacauagcauguuua

SEQ ID NO: 3786168 - RNA, 16 nt, Human
aucauuguccagagcu

SEQ ID NO: 3786169 - RNA, 23 nt, Human
aucauuguccagagcugcuuccc

SEQ ID NO: 3786170 - RNA, 13 nt, Human
aucauugugaaau

SEQ ID NO: 3786171 - RNA, 18 nt, Human
aucauuguucuuuucaau

SEQ ID NO: 3786172 - RNA, 13 nt, Human
aucauuuaauaau

SEQ ID NO: 3786173 - RNA, 22 nt, Human
aucauuuauuuuuuacauuauu

SEQ ID NO: 3786174 - RNA, 22 nt, Human
aucauuucaccugcugcuugcc

SEQ ID NO: 3786175 - RNA, 15 nt, Human
aucauuucuugggcc

SEQ ID NO: 3786176 - RNA, 18 nt, Human
aucauuucuugggcccuc

SEQ ID NO: 3786177 - RNA, 19 nt, Human
aucauuucuugggcccucc

SEQ ID NO: 3786178 - RNA, 22 nt, Human
aucauuucuugggcccuccuga

SEQ ID NO: 3786179 - RNA, 23 nt, Human
aucauuucuuuuugggagagacu

SEQ ID NO: 3786180 - RNA, 11 nt, Human
aucauuugagu

SEQ ID NO: 3786181 - RNA, 15 nt, Human
aucauuugcccuuaa

SEQ ID NO: 3786182 - RNA, 19 nt, Human
aucauuuuauaugucaaag

SEQ ID NO: 3786183 - RNA, 14 nt, Human
aucauuuucccccc

SEQ ID NO: 3786184 - RNA, 17 nt, Human
aucauuuuccccccacu

SEQ ID NO: 3786185 - RNA, 22 nt, Human
aucauuuugcaaucccuuaaua

SEQ ID NO: 3786186 - RNA, 17 nt, Human
aucauuuugcauucaaa

SEQ ID NO: 3786187 - RNA, 16 nt, Human
aucauuuuuguacagu

SEQ ID NO: 3786188 - RNA, 22 nt, Human
aucauuuuuguacaguuugcug

SEQ ID NO: 3786189 - RNA, 14 nt, Human
aucauuuuuguauc

SEQ ID NO: 3786190 - RNA, 14 nt, Human
aucauuuuuuccug

SEQ ID NO: 3786191 - RNA, 19 nt, Human
auccaaaagaagcccccag

SEQ ID NO: 3786192 - RNA, 13 nt, Human
auccaaaagcuuu

SEQ ID NO: 3786193 - RNA, 16 nt, Human
auccaaaaguggaagu

SEQ ID NO: 3786194 - RNA, 19 nt, Human
auccaaaaucuugaucagu

SEQ ID NO: 3786195 - RNA, 14 nt, Human
auccaaaaugugua

SEQ ID NO: 3786196 - RNA, 17 nt, Human
auccaaaauguguauuu

SEQ ID NO: 3786197 - RNA, 18 nt, Human
auccaaacaauuuaaaaa

SEQ ID NO: 3786198 - RNA, 21 nt, Human
auccaaacauguauuuaugua

SEQ ID NO: 3786199 - RNA, 13 nt, Human
auccaaauauugu

SEQ ID NO: 3786200 - RNA, 20 nt, Human
auccaaauugugcuucuccc

SEQ ID NO: 3786201 - RNA, 22 nt, Human
auccaaauuuuuuuuuaaagca

SEQ ID NO: 3786202 - RNA, 17 nt, Human
auccaaccauuuucauu

SEQ ID NO: 3786203 - RNA, 18 nt, Human
auccaaccccccaccugc

SEQ ID NO: 3786204 - RNA, 20 nt, Human
auccaaccccccaccugcca

SEQ ID NO: 3786205 - RNA, 16 nt, Human
auccaacuaaugccuu

SEQ ID NO: 3786206 - RNA, 19 nt, Human
auccaagauauuuuaaaau

SEQ ID NO: 3786207 - RNA, 16 nt, Human
auccaagcaaauguga

SEQ ID NO: 3786208 - RNA, 16 nt, Human
auccaagcaagacuga

SEQ ID NO: 3786209 - RNA, 15 nt, Human
auccaagccuccaca

SEQ ID NO: 3786210 - RNA, 18 nt, Human
auccaagccuccacagcg

SEQ ID NO: 3786211 - RNA, 13 nt, Human
auccaagcucccu

SEQ ID NO: 3786212 - RNA, 14 nt, Human
auccaagcucccug

SEQ ID NO: 3786213 - RNA, 17 nt, Human
auccaagcucccugccc

SEQ ID NO: 3786214 - RNA, 18 nt, Human
auccaagcucccugcccc

SEQ ID NO: 3786215 - RNA, 12 nt, Human
auccaagugaac

SEQ ID NO: 3786216 - RNA, 17 nt, Human
auccaauccucacuggg

SEQ ID NO: 3786217 - RNA, 18 nt, Human
auccaauccucacugggu

SEQ ID NO: 3786218 - RNA, 21 nt, Human
auauugcugauggugcaauga

SEQ ID NO: 3786219 - RNA, 21 nt, Human
auauugcuuuuucuaaugugg

SEQ ID NO: 3786220 - RNA, 19 nt, Human
auauuggacaaagaaccuu

SEQ ID NO: 3786221 - RNA, 13 nt, Human
auauugguauuca

SEQ ID NO: 3786222 - RNA, 19 nt, Human
auauugguugggaugacuu

SEQ ID NO: 3786223 - RNA, 20 nt, Human
auauugguugggaugacuug

SEQ ID NO: 3786224 - RNA, 13 nt, Human
auauugguuuuau

SEQ ID NO: 3786225 - RNA, 12 nt, Human
auauuguaagaa

SEQ ID NO: 3786226 - RNA, 15 nt, Human
auauuguaagaaaua

SEQ ID NO: 3786227 - RNA, 16 nt, Human
auauuguaagaaauac

SEQ ID NO: 3786228 - RNA, 15 nt, Human
auauuguacacuuuu

SEQ ID NO: 3786229 - RNA, 12 nt, Human
auauuguacagu

SEQ ID NO: 3786230 - RNA, 16 nt, Human
auauugucagauauuu

SEQ ID NO: 3786231 - RNA, 17 nt, Human
auauugucagauauuuu

SEQ ID NO: 3786232 - RNA, 17 nt, Human
auauugucuuuuuguau

SEQ ID NO: 3786233 - RNA, 14 nt, Human
auauugugaacauu

SEQ ID NO: 3786234 - RNA, 21 nt, Human
auauuguggguguuaauuuuu

SEQ ID NO: 3786235 - RNA, 12 nt, Human
auauuguuaagg

SEQ ID NO: 3786236 - RNA, 20 nt, Human
auauuguucaaacaauauca

SEQ ID NO: 3786237 - RNA, 22 nt, Human
auauuguucaaacaauaucaua

SEQ ID NO: 3786238 - RNA, 13 nt, Human
auauuguuccuaa

SEQ ID NO: 3786239 - RNA, 14 nt, Human
auauuguuugcuaa

SEQ ID NO: 3786240 - RNA, 19 nt, Human
auauuguuuuacaauaguu

SEQ ID NO: 3786241 - RNA, 19 nt, Human
auauuuaaaaacaaaaggc

SEQ ID NO: 3786242 - RNA, 22 nt, Human
auauuuaaaaacaaaaggcaau

SEQ ID NO: 3786243 - RNA, 16 nt, Human
auauuuaaaaauaagu

SEQ ID NO: 3786244 - RNA, 18 nt, Human
auauuuaaaaaugucuug

SEQ ID NO: 3786245 - RNA, 16 nt, Human
auauuuaaaaguguca

SEQ ID NO: 3786246 - RNA, 14 nt, Human
auauuuaaacagca

SEQ ID NO: 3786247 - RNA, 15 nt, Human
auauuuaaacucaag

SEQ ID NO: 3786248 - RNA, 23 nt, Human
auauuuaaacucaagacaaugca

SEQ ID NO: 3786249 - RNA, 19 nt, Human
auauuuaaagggaaauuga

SEQ ID NO: 3786250 - RNA, 19 nt, Human
auauuuaaauguaaagaca

SEQ ID NO: 3786251 - RNA, 19 nt, Human
auauuuaagaaaauacaau

SEQ ID NO: 3786252 - RNA, 20 nt, Human
auauuuaagaaaauacaaua

SEQ ID NO: 3786253 - RNA, 18 nt, Human
auauuuaagcaacaucuu

SEQ ID NO: 3786254 - RNA, 23 nt, Human
auauuuaaggagauguaagagcu

SEQ ID NO: 3786255 - RNA, 21 nt, Human
auauuuaaguauaaaauacaa

SEQ ID NO: 3786256 - RNA, 20 nt, Human
auauuuaaguauucaagaaa

SEQ ID NO: 3786257 - RNA, 13 nt, Human
auauuuaaucuuu

SEQ ID NO: 3786258 - RNA, 12 nt, Human
auauuuaaugau

SEQ ID NO: 3786259 - RNA, 13 nt, Human
auauuuaaugaua

SEQ ID NO: 3786260 - RNA, 23 nt, Human
auauuuaaugauaaguaaaugcu

SEQ ID NO: 3786261 - RNA, 15 nt, Human
auauuuaauguugaa

SEQ ID NO: 3786262 - RNA, 16 nt, Human
auauuuaauguugaac

SEQ ID NO: 3786263 - RNA, 20 nt, Human
auauuuaauguugaacaaaa

SEQ ID NO: 3786264 - RNA, 17 nt, Human
auauuuacaauguauua

SEQ ID NO: 3786265 - RNA, 21 nt, Human
auauuuacaauguauuaagcc

SEQ ID NO: 3786266 - RNA, 16 nt, Human
auauuuaccucagccu

SEQ ID NO: 3786267 - RNA, 18 nt, Human
auauuuacuaaaauggac

SEQ ID NO: 3786268 - RNA, 16 nt, Human
auauuuauaaaaauaa

SEQ ID NO: 3786269 - RNA, 22 nt, Human
auauuuauaacucaucauaaaa

SEQ ID NO: 3786270 - RNA, 19 nt, Human
auauuuauagguacccaau

SEQ ID NO: 3786271 - RNA, 14 nt, Human
auauuuauauaauu

SEQ ID NO: 3786272 - RNA, 15 nt, Human
auauuuauauauauu

SEQ ID NO: 3786273 - RNA, 14 nt, Human
auauuuauccacua

SEQ ID NO: 3786274 - RNA, 15 nt, Human
auauuuaugaagaaa

SEQ ID NO: 3786275 - RNA, 19 nt, Human
auauuuaugaagaaaauac

SEQ ID NO: 3786276 - RNA, 14 nt, Human
auauuuauguagau

SEQ ID NO: 3786277 - RNA, 20 nt, Human
auauuuauguagaugugcau

SEQ ID NO: 3786278 - RNA, 19 nt, Human
auauuuaugucuauuuaag

SEQ ID NO: 3786279 - RNA, 21 nt, Human
auauuuaugucuauuuaagcc

SEQ ID NO: 3786280 - RNA, 16 nt, Human
auauuuauuaaauaaa

SEQ ID NO: 3786281 - RNA, 18 nt, Human
auauuuauuaaauaaaau

SEQ ID NO: 3786282 - RNA, 20 nt, Human
auauuuauuaaauaaaauca

SEQ ID NO: 3786283 - RNA, 23 nt, Human
auauuuauuaaauaaaaucaauu

SEQ ID NO: 3786284 - RNA, 14 nt, Human
auauuuauuaccuc

SEQ ID NO: 3786285 - RNA, 19 nt, Human
auauuuauuacuguaagaa

SEQ ID NO: 3786286 - RNA, 22 nt, Human
auauuuauuacuguaagaaaau

SEQ ID NO: 3786287 - RNA, 23 nt, Human
auauuuauucauuauuugucaaa

SEQ ID NO: 3786288 - RNA, 13 nt, Human
auauuuauugacu

SEQ ID NO: 3786289 - RNA, 21 nt, Human
auauuuauugcuuuauaaaua

SEQ ID NO: 3786290 - RNA, 13 nt, Human
auauuuauuguau

SEQ ID NO: 3786291 - RNA, 17 nt, Human
auauuuauuuaaagcau

SEQ ID NO: 3786292 - RNA, 17 nt, Human
auauuuauuuauuuauu

SEQ ID NO: 3786293 - RNA, 17 nt, Human
auauuuauuuuaauaau

SEQ ID NO: 3786294 - RNA, 21 nt, Human
auauuuauuuucuuucuguaa

SEQ ID NO: 3786295 - RNA, 13 nt, Human
auauuuauuuuua

SEQ ID NO: 3786296 - RNA, 12 nt, Human
auauuucagaaa

SEQ ID NO: 3786297 - RNA, 14 nt, Human
auauuucagaaaua

SEQ ID NO: 3786298 - RNA, 15 nt, Human
auauuucagaaauac

SEQ ID NO: 3786299 - RNA, 20 nt, Human
auauuucagaaauacagaua

SEQ ID NO: 3786300 - RNA, 22 nt, Human
auccaugacaggccugaagaua

SEQ ID NO: 3786301 - RNA, 24 nt, Human
auccaugacaggccugaagauauu

SEQ ID NO: 3786302 - RNA, 20 nt, Human
auccaugaccuaguuuucca

SEQ ID NO: 3786303 - RNA, 17 nt, Human
auccauggccagcagca

SEQ ID NO: 3786304 - RNA, 23 nt, Human
auccauggccagcagcaccugcc

SEQ ID NO: 3786305 - RNA, 19 nt, Human
auccaugggggcagggcau

SEQ ID NO: 3786306 - RNA, 13 nt, Human
auccauguaacug

SEQ ID NO: 3786307 - RNA, 22 nt, Human
auccauguacuguaguuuuucu

SEQ ID NO: 3786308 - RNA, 13 nt, Human
auccauuaauuua

SEQ ID NO: 3786309 - RNA, 16 nt, Human
auccauuaggccagca

SEQ ID NO: 3786310 - RNA, 17 nt, Human
auccauuaggccagcaa

SEQ ID NO: 3786311 - RNA, 17 nt, Human
auccauucccaagaaau

SEQ ID NO: 3786312 - RNA, 14 nt, Human
auccauuccucagg

SEQ ID NO: 3786313 - RNA, 18 nt, Human
auccauuccucagggaca

SEQ ID NO: 3786314 - RNA, 13 nt, Human
auccauucuuucu

SEQ ID NO: 3786315 - RNA, 16 nt, Human
auccauucuuucugau

SEQ ID NO: 3786316 - RNA, 21 nt, Human
auccauuucaucuauuucuga

SEQ ID NO: 3786317 - RNA, 22 nt, Human
auccauuucaucuauuucugag

SEQ ID NO: 3786318 - RNA, 23 nt, Human
auccauuucaucuauuucugaga

SEQ ID NO: 3786319 - RNA, 13 nt, Human
auccauuucuaau

SEQ ID NO: 3786320 - RNA, 14 nt, Human
auccauuucuaauu

SEQ ID NO: 3786321 - RNA, 23 nt, Human
auccauuugcguuccaugaugcu

SEQ ID NO: 3786322 - RNA, 19 nt, Human
auccauuuggaaaucuuua

SEQ ID NO: 3786323 - RNA, 21 nt, Human
auccauuuggaaaucuuuaaa

SEQ ID NO: 3786324 - RNA, 19 nt, Human
aucccaaacccuucagugc

SEQ ID NO: 3786325 - RNA, 22 nt, Human
aucccaaagccuugugucuaca

SEQ ID NO: 3786326 - RNA, 22 nt, Human
aucccaaaguuguuguaaccug

SEQ ID NO: 3786327 - RNA, 16 nt, Human
aucccaacacugccag

SEQ ID NO: 3786328 - RNA, 20 nt, Human
aucccaaccagugccaagga

SEQ ID NO: 3786329 - RNA, 23 nt, Human
aucccaacugucuuuuuuucccu

SEQ ID NO: 3786330 - RNA, 17 nt, Human
aucccaaucauuguugc

SEQ ID NO: 3786331 - RNA, 14 nt, Human
aucccacccacaug

SEQ ID NO: 3786332 - RNA, 23 nt, Human
aucccacccacaugugacacaua

SEQ ID NO: 3786333 - RNA, 18 nt, Human
aucccaccuccaucccag

SEQ ID NO: 3786334 - RNA, 18 nt, Human
aucccacgcuucucuuug

SEQ ID NO: 3786335 - RNA, 18 nt, Human
aucccacucacaacagcu

SEQ ID NO: 3786336 - RNA, 22 nt, Human
aucccacuuucuauagcagauu

SEQ ID NO: 3786337 - RNA, 16 nt, Human
aucccagcaccugccu

SEQ ID NO: 3786338 - RNA, 21 nt, Human
aucccagcaccugccuccucg

SEQ ID NO: 3786339 - RNA, 17 nt, Human
aucccagcacuuuggga

SEQ ID NO: 3786340 - RNA, 19 nt, Human
aucccagcacuuugggagg

SEQ ID NO: 3786341 - RNA, 21 nt, Human
aucccagcacuuugggaggcc

SEQ ID NO: 3786342 - RNA, 22 nt, Human
aucccagcacuuugggaggcug

SEQ ID NO: 3786343 - RNA, 14 nt, Human
aucccagcccccug

SEQ ID NO: 3786344 - RNA, 19 nt, Human
aucccagcccccugaccac

SEQ ID NO: 3786345 - RNA, 22 nt, Human
aucccagccggccaauggaaac

SEQ ID NO: 3786346 - RNA, 18 nt, Human
aucccagcggcuggugca

SEQ ID NO: 3786347 - RNA, 23 nt, Human
aucccagcggcuggugcagggcc

SEQ ID NO: 3786348 - RNA, 18 nt, Human
aucccagcuacuugggaa

SEQ ID NO: 3786349 - RNA, 13 nt, Human
aucccagcugccu

SEQ ID NO: 3786350 - RNA, 22 nt, Human
aucccaggacaccacacccagc

SEQ ID NO: 3786351 - RNA, 23 nt, Human
aucccaggaucgcaagagccaug

SEQ ID NO: 3786352 - RNA, 19 nt, Human
aucccaggcuucacccuga

SEQ ID NO: 3786353 - RNA, 17 nt, Human
aucccaggggcccaagg

SEQ ID NO: 3786354 - RNA, 19 nt, Human
aucccaggggcccaaggcg

SEQ ID NO: 3786355 - RNA, 11 nt, Human
aucccauccca

SEQ ID NO: 3786356 - RNA, 15 nt, Human
aucccaucccgcucu

SEQ ID NO: 3786357 - RNA, 20 nt, Human
aucccaucccgcucuuuucc

SEQ ID NO: 3786358 - RNA, 21 nt, Human
aucccaucgucucggccuuca

SEQ ID NO: 3786359 - RNA, 19 nt, Human
aucccaugagacccuggug

SEQ ID NO: 3786360 - RNA, 16 nt, Human
aucccaugagccucag

SEQ ID NO: 3786361 - RNA, 20 nt, Human
aggcagaucugugccccaug

SEQ ID NO: 3786362 - RNA, 16 nt, Human
aggcagauugaaaagg

SEQ ID NO: 3786363 - RNA, 22 nt, Human
aggcagauuuuacagagcgcac

SEQ ID NO: 3786364 - RNA, 23 nt, Human
aggcagcaaggcccgagcagcug

SEQ ID NO: 3786365 - RNA, 19 nt, Human
aggcagcagugugaggcca

SEQ ID NO: 3786366 - RNA, 20 nt, Human
aggcagcagugugaggccag

SEQ ID NO: 3786367 - RNA, 22 nt, Human
aggcagcagugugaggccaggg

SEQ ID NO: 3786368 - RNA, 13 nt, Human
aggcagccagcca

SEQ ID NO: 3786369 - RNA, 17 nt, Human
aggcagccagugcccug

SEQ ID NO: 3786370 - RNA, 19 nt, Human
aggcagccagugcccugag

SEQ ID NO: 3786371 - RNA, 12 nt, Human
aggcagcccagg

SEQ ID NO: 3786372 - RNA, 16 nt, Human
aggcagccccauucug

SEQ ID NO: 3786373 - RNA, 17 nt, Human
aggcagccccauucugc

SEQ ID NO: 3786374 - RNA, 20 nt, Human
aggcagccccauucugccug

SEQ ID NO: 3786375 - RNA, 21 nt, Human
aggcagccccauucugccugc

SEQ ID NO: 3786376 - RNA, 22 nt, Human
aggcagccccauucugccugcc

SEQ ID NO: 3786377 - RNA, 15 nt, Human
aggcagcccugccau

SEQ ID NO: 3786378 - RNA, 20 nt, Human
aggcagcccugucugaagga

SEQ ID NO: 3786379 - RNA, 13 nt, Human
aggcagccgcccu

SEQ ID NO: 3786380 - RNA, 23 nt, Human
aggcagccgugggccccacccuc

SEQ ID NO: 3786381 - RNA, 15 nt, Human
aggcagccucugggg

SEQ ID NO: 3786382 - RNA, 16 nt, Human
aggcagccucuggggg

SEQ ID NO: 3786383 - RNA, 22 nt, Human
aggcagccucugggggguggcc

SEQ ID NO: 3786384 - RNA, 22 nt, Human
aggcagccuggacauagagagg

SEQ ID NO: 3786385 - RNA, 19 nt, Human
aggcagcgccaagcaaccu

SEQ ID NO: 3786386 - RNA, 17 nt, Human
aggcagcugccugcucu

SEQ ID NO: 3786387 - RNA, 23 nt, Human
aggcagcuuuaaccauuaaaacu

SEQ ID NO: 3786388 - RNA, 20 nt, Human
aggcagcuuuuucucuccca

SEQ ID NO: 3786389 - RNA, 16 nt, Human
aggcaggaagggcagg

SEQ ID NO: 3786390 - RNA, 17 nt, Human
aggcaggaagggcagga

SEQ ID NO: 3786391 - RNA, 20 nt, Human
aggcaggaagggcaggaagg

SEQ ID NO: 3786392 - RNA, 23 nt, Human
aggcaggaccuucgggcugugcc

SEQ ID NO: 3786393 - RNA, 12 nt, Human
aggcaggaggau

SEQ ID NO: 3786394 - RNA, 20 nt, Human
aggcaggaguuucguuuuca

SEQ ID NO: 3786395 - RNA, 22 nt, Human
aggcaggcauagaggcuucucc

SEQ ID NO: 3786396 - RNA, 14 nt, Human
aggcaggcauggcc

SEQ ID NO: 3786397 - RNA, 23 nt, Human
aggcaggcauugaggaagagucu

SEQ ID NO: 3786398 - RNA, 14 nt, Human
aggcaggccgacug

SEQ ID NO: 3786399 - RNA, 23 nt, Human
aggcaggcuaaggcguggagcug

SEQ ID NO: 3786400 - RNA, 16 nt, Human
aggcaggcucccaggg

SEQ ID NO: 3786401 - RNA, 21 nt, Human
aggcagggaacauggggagga

SEQ ID NO: 3786402 - RNA, 23 nt, Human
aggcagggaacauggggaggagg

SEQ ID NO: 3786403 - RNA, 19 nt, Human
aggcagggaaguccccagg

SEQ ID NO: 3786404 - RNA, 23 nt, Human
aggcagggaaguccccaggcccc

SEQ ID NO: 3786405 - RNA, 19 nt, Human
aggcagggaggcagccgcc

SEQ ID NO: 3786406 - RNA, 12 nt, Human
aggcagggaggg

SEQ ID NO: 3786407 - RNA, 13 nt, Human
aggcagggagggg

SEQ ID NO: 3786408 - RNA, 14 nt, Human
aggcagggagggga

SEQ ID NO: 3786409 - RNA, 12 nt, Human
aggcagggcagg

SEQ ID NO: 3786410 - RNA, 15 nt, Human
aggcagggcaggacc

SEQ ID NO: 3786411 - RNA, 17 nt, Human
aggcagggcaggaccag

SEQ ID NO: 3786412 - RNA, 19 nt, Human
aggcagggccuugcccaga

SEQ ID NO: 3786413 - RNA, 12 nt, Human
aggcagggcucu

SEQ ID NO: 3786414 - RNA, 13 nt, Human
aggcagggcucuc

SEQ ID NO: 3786415 - RNA, 14 nt, Human
aggcagggcucucc

SEQ ID NO: 3786416 - RNA, 15 nt, Human
aggcagggcucuccu

SEQ ID NO: 3786417 - RNA, 19 nt, Human
aggcaggggaauguaugug

SEQ ID NO: 3786418 - RNA, 16 nt, Human
aggcaggggccuccau

SEQ ID NO: 3786419 - RNA, 13 nt, Human
aggcaggggcgga

SEQ ID NO: 3786420 - RNA, 17 nt, Human
aggcaggggcuuccugg

SEQ ID NO: 3786421 - RNA, 18 nt, Human
aggcaggggcuuccuggu

SEQ ID NO: 3786422 - RNA, 20 nt, Human
aggcagggucaggagagggg

SEQ ID NO: 3786423 - RNA, 21 nt, Human
aggcagggucccauuucucac

SEQ ID NO: 3786424 - RNA, 14 nt, Human
aggcagggugcagu

SEQ ID NO: 3786425 - RNA, 23 nt, Human
aggcaggguuuuaucucugucua

SEQ ID NO: 3786426 - RNA, 16 nt, Human
aggcagguagccaggg

SEQ ID NO: 3786427 - RNA, 14 nt, Human
aggcagguccaggg

SEQ ID NO: 3786428 - RNA, 16 nt, Human
aggcagguccccagac

SEQ ID NO: 3786429 - RNA, 16 nt, Human
aggcaggugacaguga

SEQ ID NO: 3786430 - RNA, 18 nt, Human
aggcaggugacagugagg

SEQ ID NO: 3786431 - RNA, 13 nt, Human
aggcaggugccug

SEQ ID NO: 3786432 - RNA, 15 nt, Human
aggcaggugccugga

SEQ ID NO: 3786433 - RNA, 17 nt, Human
aggcaggugggauggau

SEQ ID NO: 3786434 - RNA, 15 nt, Human
aggcaguaggccggu

SEQ ID NO: 3786435 - RNA, 16 nt, Human
aggcaguauaaagaau

SEQ ID NO: 3786436 - RNA, 19 nt, Human
aggcagucgggggcuggcc

SEQ ID NO: 3786437 - RNA, 19 nt, Human
aggcagugggucccacuuc

SEQ ID NO: 3786438 - RNA, 15 nt, Human
aggcagugucauuug

SEQ ID NO: 3786439 - RNA, 19 nt, Human
aggcaguucaaagcaggau

SEQ ID NO: 3786440 - RNA, 19 nt, Human
aggcaguugcccagccucu

SEQ ID NO: 3786441 - RNA, 16 nt, Human
aggcaguuuagugcau

SEQ ID NO: 3786442 - RNA, 21 nt, Human
aggcauacgagagcagagguc

SEQ ID NO: 3786443 - RNA, 22 nt, Human
aggcauagaggcuucuccgcca

SEQ ID NO: 3786444 - RNA, 20 nt, Human
aggcauauugcuuuuucuaa

SEQ ID NO: 3786445 - RNA, 12 nt, Human
aggcauauuuua

SEQ ID NO: 3786446 - RNA, 14 nt, Human
aggcaucacagcua

SEQ ID NO: 3786447 - RNA, 20 nt, Human
aggcauccagcagucucugc

SEQ ID NO: 3786448 - RNA, 23 nt, Human
aggcauccagcagucucugccuu

SEQ ID NO: 3786449 - RNA, 20 nt, Human
aggcauccuuccucacacca

SEQ ID NO: 3786450 - RNA, 21 nt, Human
aggcaucucuguacuuugcuu

SEQ ID NO: 3786451 - RNA, 11 nt, Human
aggcaugaagg

SEQ ID NO: 3786452 - RNA, 15 nt, Human
aggcaugagggauca

SEQ ID NO: 3786453 - RNA, 19 nt, Human
auauuucagauguaauguu

SEQ ID NO: 3786454 - RNA, 19 nt, Human
auauuucccaugauuucau

SEQ ID NO: 3786455 - RNA, 19 nt, Human
auauuucccuaaaauacau

SEQ ID NO: 3786456 - RNA, 23 nt, Human
auauuuccuauaccauuuccgua

SEQ ID NO: 3786457 - RNA, 17 nt, Human
auauuuccuuuauguga

SEQ ID NO: 3786458 - RNA, 18 nt, Human
auauuuccuuuaugugaa

SEQ ID NO: 3786459 - RNA, 20 nt, Human
auauuuccuuuaugugaauu

SEQ ID NO: 3786460 - RNA, 15 nt, Human
auauuucgaaagcug

SEQ ID NO: 3786461 - RNA, 13 nt, Human
auauuucucuagu

SEQ ID NO: 3786462 - RNA, 23 nt, Human
auauuucugaggagccugcaaca

SEQ ID NO: 3786463 - RNA, 23 nt, Human
auauuucuguaauuauaucuaaa

SEQ ID NO: 3786464 - RNA, 12 nt, Human
auauuucuucaa

SEQ ID NO: 3786465 - RNA, 14 nt, Human
auauuucuucaaau

SEQ ID NO: 3786466 - RNA, 15 nt, Human
auauuucuucaaaua

SEQ ID NO: 3786467 - RNA, 23 nt, Human
auauuugaaaaaaacuucauucu

SEQ ID NO: 3786468 - RNA, 15 nt, Human
auauuugaaucuugu

SEQ ID NO: 3786469 - RNA, 17 nt, Human
auauuugaaucuugucu

SEQ ID NO: 3786470 - RNA, 21 nt, Human
auauuugaaucuugucucaau

SEQ ID NO: 3786471 - RNA, 13 nt, Human
auauuugaauuuu

SEQ ID NO: 3786472 - RNA, 14 nt, Human
auauuugauuuauu

SEQ ID NO: 3786473 - RNA, 21 nt, Human
auauuugcuagacucuagaca

SEQ ID NO: 3786474 - RNA, 21 nt, Human
auauuuggaagaaaaaaaucu

SEQ ID NO: 3786475 - RNA, 23 nt, Human
auauuuggaagaaaaaaaucuuc

SEQ ID NO: 3786476 - RNA, 16 nt, Human
auauuugguuuuccug

SEQ ID NO: 3786477 - RNA, 15 nt, Human
auauuuguaaaauga

SEQ ID NO: 3786478 - RNA, 16 nt, Human
auauuuguaaaaugac

SEQ ID NO: 3786479 - RNA, 15 nt, Human
auauuuguaaagcua

SEQ ID NO: 3786480 - RNA, 13 nt, Human
auauuuguacaua

SEQ ID NO: 3786481 - RNA, 14 nt, Human
auauuuguacuuuc

SEQ ID NO: 3786482 - RNA, 15 nt, Human
auauuuguacuuucu

SEQ ID NO: 3786483 - RNA, 22 nt, Human
auauuuguaucacaaaucuuaa

SEQ ID NO: 3786484 - RNA, 12 nt, Human
auauuuguaucg

SEQ ID NO: 3786485 - RNA, 17 nt, Human
auauuugugcauuuucu

SEQ ID NO: 3786486 - RNA, 21 nt, Human
auauuugugcauuuucuaaac

SEQ ID NO: 3786487 - RNA, 14 nt, Human
auauuuguggaaua

SEQ ID NO: 3786488 - RNA, 23 nt, Human
auauuugugugcuaaacguguau

SEQ ID NO: 3786489 - RNA, 14 nt, Human
auauuuguuuaguu

SEQ ID NO: 3786490 - RNA, 16 nt, Human
auauuuuaaagaauug

SEQ ID NO: 3786491 - RNA, 12 nt, Human
auauuuuaaaua

SEQ ID NO: 3786492 - RNA, 16 nt, Human
auauuuuaaccugcau

SEQ ID NO: 3786493 - RNA, 19 nt, Human
auauuuuaaccugcauaaa

SEQ ID NO: 3786494 - RNA, 17 nt, Human
auauuuuaagcauuacu

SEQ ID NO: 3786495 - RNA, 19 nt, Human
auauuuuaaugcaguugcu

SEQ ID NO: 3786496 - RNA, 13 nt, Human
auauuuuaaugua

SEQ ID NO: 3786497 - RNA, 11 nt, Human
auauuuuaauu

SEQ ID NO: 3786498 - RNA, 12 nt, Human
auauuuuacuug

SEQ ID NO: 3786499 - RNA, 22 nt, Human
auauuuuaugauccagcagauu

SEQ ID NO: 3786500 - RNA, 20 nt, Human
auauuuuaugugagagaaag

SEQ ID NO: 3786501 - RNA, 19 nt, Human
auauuuuauucaagguaaa

SEQ ID NO: 3786502 - RNA, 17 nt, Human
auauuuucaaauuguau

SEQ ID NO: 3786503 - RNA, 24 nt, Human
auauuuucaaauuguaucuagugc

SEQ ID NO: 3786504 - RNA, 20 nt, Human
auauuuucaacgcagcccug

SEQ ID NO: 3786505 - RNA, 14 nt, Human
auccuaugugauuu

SEQ ID NO: 3786506 - RNA, 16 nt, Human
auccuaugugauuuua

SEQ ID NO: 3786507 - RNA, 18 nt, Human
auccuauucucaccagga

SEQ ID NO: 3786508 - RNA, 20 nt, Human
auccuauucucaccaggaag

SEQ ID NO: 3786509 - RNA, 22 nt, Human
auccuauuucaguacuucagca

SEQ ID NO: 3786510 - RNA, 16 nt, Human
auccucaaacacugca

SEQ ID NO: 3786511 - RNA, 18 nt, Human
auccucaaaugcggggug

SEQ ID NO: 3786512 - RNA, 16 nt, Human
auccucacugcccucc

SEQ ID NO: 3786513 - RNA, 14 nt, Human
auccucagaugcuc

SEQ ID NO: 3786514 - RNA, 14 nt, Human
auccucaguuccug

SEQ ID NO: 3786515 - RNA, 19 nt, Human
auccucauacccaccccca

SEQ ID NO: 3786516 - RNA, 19 nt, Human
auccuccaaccaggcuccu

SEQ ID NO: 3786517 - RNA, 19 nt, Human
auccuccacguucugcuca

SEQ ID NO: 3786518 - RNA, 12 nt, Human
auccuccagcuu

SEQ ID NO: 3786519 - RNA, 14 nt, Human
auccuccagcuucu

SEQ ID NO: 3786520 - RNA, 12 nt, Human
auccuccagggc

SEQ ID NO: 3786521 - RNA, 14 nt, Human
auccuccaggugca

SEQ ID NO: 3786522 - RNA, 18 nt, Human
auccuccagguuuuucaa

SEQ ID NO: 3786523 - RNA, 22 nt, Human
auccuccagguuuuucaauuaa

SEQ ID NO: 3786524 - RNA, 23 nt, Human
auccuccagguuuuucaauuaaa

SEQ ID NO: 3786525 - RNA, 21 nt, Human
auccuccaguaccuugcuucu

SEQ ID NO: 3786526 - RNA, 15 nt, Human
auccucccaccucag

SEQ ID NO: 3786527 - RNA, 18 nt, Human
auccucccaccucagccu

SEQ ID NO: 3786528 - RNA, 13 nt, Human
auccucccagaaa

SEQ ID NO: 3786529 - RNA, 12 nt, Human
auccucccaggc

SEQ ID NO: 3786530 - RNA, 22 nt, Human
auccuccccuggacucccgugu

SEQ ID NO: 3786531 - RNA, 18 nt, Human
auccuccccuucccugca

SEQ ID NO: 3786532 - RNA, 14 nt, Human
auccuccuccuucc

SEQ ID NO: 3786533 - RNA, 11 nt, Human
auccuccugca

SEQ ID NO: 3786534 - RNA, 14 nt, Human
auccuccuggaacc

SEQ ID NO: 3786535 - RNA, 21 nt, Human
auccuccuggaaccuugcugu

SEQ ID NO: 3786536 - RNA, 18 nt, Human
auccuccugggauuggcu

SEQ ID NO: 3786537 - RNA, 20 nt, Human
auccucucaaccaccuuuca

SEQ ID NO: 3786538 - RNA, 16 nt, Human
auccucuccuuugaaa

SEQ ID NO: 3786539 - RNA, 12 nt, Human
auccucucuggg

SEQ ID NO: 3786540 - RNA, 17 nt, Human
auccucucuuccucuuc

SEQ ID NO: 3786541 - RNA, 18 nt, Human
auccucugagugugacca

SEQ ID NO: 3786542 - RNA, 12 nt, Human
auccucugaucu

SEQ ID NO: 3786543 - RNA, 20 nt, Human
auccucuguaaacuuuuugu

SEQ ID NO: 3786544 - RNA, 16 nt, Human
auccucuguacagagc

SEQ ID NO: 3786545 - RNA, 20 nt, Human
auccucuguacagagcccac

SEQ ID NO: 3786546 - RNA, 15 nt, Human
auccucuuccucuga

SEQ ID NO: 3786547 - RNA, 16 nt, Human
auccucuuccucugag

SEQ ID NO: 3786548 - RNA, 17 nt, Human
auccucuuccucugagg

SEQ ID NO: 3786549 - RNA, 18 nt, Human
auccucuucuuuuagcag

SEQ ID NO: 3786550 - RNA, 20 nt, Human
auccucuucuuuuagcagua

SEQ ID NO: 3786551 - RNA, 15 nt, Human
auccucuuuagaguu

SEQ ID NO: 3786552 - RNA, 21 nt, Human
auccugaaauagaggcuaaau

SEQ ID NO: 3786553 - RNA, 14 nt, Human
auccugaacagcau

SEQ ID NO: 3786554 - RNA, 13 nt, Human
auccugaagagca

SEQ ID NO: 3786555 - RNA, 14 nt, Human
auccugacucugcc

SEQ ID NO: 3786556 - RNA, 13 nt, Human
auccugagccaga

SEQ ID NO: 3786557 - RNA, 14 nt, Human
auccugagccagau

SEQ ID NO: 3786558 - RNA, 21 nt, Human
auccugagccagauuucacuc

SEQ ID NO: 3786559 - RNA, 24 nt, Human
auccugagccaucggugaaacuaa

SEQ ID NO: 3786560 - RNA, 14 nt, Human
auccugagccccgc

SEQ ID NO: 3786561 - RNA, 20 nt, Human
auccugagccccgcccucuu

SEQ ID NO: 3786562 - RNA, 22 nt, Human
auccugagccccgcccucuucc

SEQ ID NO: 3786563 - RNA, 19 nt, Human
auccugaugagguuucuac

SEQ ID NO: 3786564 - RNA, 20 nt, Human
auccugauuccucucuaagu

SEQ ID NO: 3786565 - RNA, 17 nt, Human
auccugcaaugaaaggu

SEQ ID NO: 3786566 - RNA, 16 nt, Human
auccugcaauuccacu

SEQ ID NO: 3786567 - RNA, 16 nt, Human
auccugcacugacucu

SEQ ID NO: 3786568 - RNA, 23 nt, Human
auccugccagccccacacagcua

SEQ ID NO: 3786569 - RNA, 14 nt, Human
auccugcccagugu

SEQ ID NO: 3786570 - RNA, 15 nt, Human
auccugcccaguguu

SEQ ID NO: 3786571 - RNA, 21 nt, Human
auccugcuucugauaugcagu

SEQ ID NO: 3786572 - RNA, 22 nt, Human
auccuggacaugaagauucuuu

SEQ ID NO: 3786573 - RNA, 16 nt, Human
auccuggacugagggg

SEQ ID NO: 3786574 - RNA, 16 nt, Human
auccuggagaagccuc

SEQ ID NO: 3786575 - RNA, 19 nt, Human
auccuggcacccggccccu

SEQ ID NO: 3786576 - RNA, 20 nt, Human
auccuggcacccggccccug

SEQ ID NO: 3786577 - RNA, 22 nt, Human
auccuggcacccggccccugcu

SEQ ID NO: 3786578 - RNA, 23 nt, Human
auccuggcacccggccccugcug

SEQ ID NO: 3786579 - RNA, 11 nt, Human
auccuggcagc

SEQ ID NO: 3786580 - RNA, 18 nt, Human
auccuggcagcccagaga

SEQ ID NO: 3786581 - RNA, 20 nt, Human
auccuggcagcccagagacu

SEQ ID NO: 3786582 - RNA, 17 nt, Human
auccuggcccagggcau

SEQ ID NO: 3786583 - RNA, 18 nt, Human
auccuggcccagggcauc

SEQ ID NO: 3786584 - RNA, 18 nt, Human
auccuggcuaacauggug

SEQ ID NO: 3786585 - RNA, 15 nt, Human
auccuggcuggagaa

SEQ ID NO: 3786586 - RNA, 15 nt, Human
auccuggcuuugccc

SEQ ID NO: 3786587 - RNA, 18 nt, Human
auccuggcuuugcccaac

SEQ ID NO: 3786588 - RNA, 15 nt, Human
auccuggggcucccu

SEQ ID NO: 3786589 - RNA, 21 nt, Human
auccugggggacccaauguag

SEQ ID NO: 3786590 - RNA, 18 nt, Human
auccugggggccuggguu

SEQ ID NO: 3786591 - RNA, 12 nt, Human
auccuggguaau

SEQ ID NO: 3786592 - RNA, 19 nt, Human
auccuguaggaagguacug

SEQ ID NO: 3786593 - RNA, 21 nt, Human
auccuguaggaagguacugua

SEQ ID NO: 3786594 - RNA, 22 nt, Human
auccuguaggaagguacuguau

SEQ ID NO: 3786595 - RNA, 18 nt, Human
auccuguauucagacaga

SEQ ID NO: 3786596 - RNA, 18 nt, Human
auccugucaucugagaau

SEQ ID NO: 3786597 - RNA, 19 nt, Human
auccugucgauuagacugg

SEQ ID NO: 3786598 - RNA, 19 nt, Human
auccugucuuuaaggaaaa

SEQ ID NO: 3786599 - RNA, 23 nt, Human
auccugucuuucugagcacacuu

SEQ ID NO: 3786600 - RNA, 18 nt, Human
auccugugacauguaaca

SEQ ID NO: 3786601 - RNA, 11 nt, Human
auccugugacu

SEQ ID NO: 3786602 - RNA, 21 nt, Human
auccugugaggagccccaucu

SEQ ID NO: 3786603 - RNA, 15 nt, Human
auccugugcaauaga

SEQ ID NO: 3786604 - RNA, 17 nt, Human
auccuguggucacugac

SEQ ID NO: 3786605 - RNA, 20 nt, Human
auccugugugguuuagugua

SEQ ID NO: 3786606 - RNA, 13 nt, Human
auccuguguguua

SEQ ID NO: 3786607 - RNA, 15 nt, Human
aucaacuaguauuug

SEQ ID NO: 3786608 - RNA, 13 nt, Human
aucaacucuaaua

SEQ ID NO: 3786609 - RNA, 22 nt, Human
aucaacuuagucaauaagaaaa

SEQ ID NO: 3786610 - RNA, 15 nt, Human
aucaacuugcuuauc

SEQ ID NO: 3786611 - RNA, 15 nt, Human
aucaacuuuaaucaa

SEQ ID NO: 3786612 - RNA, 13 nt, Human
aucaagaagggcu

SEQ ID NO: 3786613 - RNA, 20 nt, Human
aucaagaagggcugcaugau

SEQ ID NO: 3786614 - RNA, 22 nt, Human
aucaagaugagagaacuggagg

SEQ ID NO: 3786615 - RNA, 21 nt, Human
aucaagaugugacauguuuua

SEQ ID NO: 3786616 - RNA, 13 nt, Human
aucaagcccuuua

SEQ ID NO: 3786617 - RNA, 17 nt, Human
aucaagcuagaaggcca

SEQ ID NO: 3786618 - RNA, 12 nt, Human
aucaagcuguga

SEQ ID NO: 3786619 - RNA, 22 nt, Human
aucaaggaagaaaugguucaga

SEQ ID NO: 3786620 - RNA, 21 nt, Human
aucaaggacucugguuucuca

SEQ ID NO: 3786621 - RNA, 15 nt, Human
aucaaggcacugccu

SEQ ID NO: 3786622 - RNA, 18 nt, Human
aucaaggccuuauuggaa

SEQ ID NO: 3786623 - RNA, 21 nt, Human
aucaaggguacacugccuucu

SEQ ID NO: 3786624 - RNA, 15 nt, Human
aucaagggucaggcc

SEQ ID NO: 3786625 - RNA, 19 nt, Human
aucaagggugcgucuggga

SEQ ID NO: 3786626 - RNA, 23 nt, Human
aucaagguuauaauuuuuuuuaa

SEQ ID NO: 3786627 - RNA, 13 nt, Human
aucaaguaaugaa

SEQ ID NO: 3786628 - RNA, 17 nt, Human
aucaaguagacuacugu

SEQ ID NO: 3786629 - RNA, 13 nt, Human
aucaaguauagaa

SEQ ID NO: 3786630 - RNA, 16 nt, Human
aucaaguauagaaaau

SEQ ID NO: 3786631 - RNA, 20 nt, Human
aucaaguauuacuaaauuga

SEQ ID NO: 3786632 - RNA, 19 nt, Human
aucaagucaaucauuucuc

SEQ ID NO: 3786633 - RNA, 13 nt, Human
aucaagugucuuc

SEQ ID NO: 3786634 - RNA, 16 nt, Human
aucaaguucuuaaaau

SEQ ID NO: 3786635 - RNA, 23 nt, Human
aucaaguuggcuucuaaucaaag

SEQ ID NO: 3786636 - RNA, 15 nt, Human
aucaaguuuccaagc

SEQ ID NO: 3786637 - RNA, 22 nt, Human
aucaaguuuccaagcaaauguu

SEQ ID NO: 3786638 - RNA, 23 nt, Human
aucaaguuuccaagcaaauguua

SEQ ID NO: 3786639 - RNA, 17 nt, Human
aucaauaaaaugugauu

SEQ ID NO: 3786640 - RNA, 16 nt, Human
aucaauaauauauuuu

SEQ ID NO: 3786641 - RNA, 20 nt, Human
aucaauaauauauuuucugu

SEQ ID NO: 3786642 - RNA, 12 nt, Human
aucaauacacua

SEQ ID NO: 3786643 - RNA, 22 nt, Human
aucaauaguguccuaugcaaua

SEQ ID NO: 3786644 - RNA, 15 nt, Human
aucaauaugcagaau

SEQ ID NO: 3786645 - RNA, 18 nt, Human
aucaauauugucauuccu

SEQ ID NO: 3786646 - RNA, 22 nt, Human
aucaauauugucauuccuguau

SEQ ID NO: 3786647 - RNA, 13 nt, Human
aucaaucauugua

SEQ ID NO: 3786648 - RNA, 16 nt, Human
aucaaucauuguacag

SEQ ID NO: 3786649 - RNA, 17 nt, Human
aucaaucauuguacagu

SEQ ID NO: 3786650 - RNA, 23 nt, Human
aucuucaucugagagaggcuaaa

SEQ ID NO: 3786651 - RNA, 17 nt, Human
aggccuuccagcugcug

SEQ ID NO: 3786652 - RNA, 18 nt, Human
aggccuuccagcugcugu

SEQ ID NO: 3786653 - RNA, 19 nt, Human
aggccuuccccuggcacug

SEQ ID NO: 3786654 - RNA, 16 nt, Human
aggccuuccucucucc

SEQ ID NO: 3786655 - RNA, 19 nt, Human
aggccuuccucucuccaga

SEQ ID NO: 3786656 - RNA, 17 nt, Human
aggccuucucugaagga

SEQ ID NO: 3786657 - RNA, 14 nt, Human
aggccuucuuguga

SEQ ID NO: 3786658 - RNA, 18 nt, Human
aggccuucuugugaucuu

SEQ ID NO: 3786659 - RNA, 9 nt, Human
aggccuugc

SEQ ID NO: 3786660 - RNA, 18 nt, Human
aggccuugggcucugcug

SEQ ID NO: 3786661 - RNA, 16 nt, Human
aggccuuucccuaagc

SEQ ID NO: 3786662 - RNA, 22 nt, Human
aggcgaccaccgccccuggccg

SEQ ID NO: 3786663 - RNA, 19 nt, Human
aggcgcaagggaggcccag

SEQ ID NO: 3786664 - RNA, 22 nt, Human
aggcgcacuuuccuccuggcag

SEQ ID NO: 3786665 - RNA, 21 nt, Human
aggcgcagugcuucucuacag

SEQ ID NO: 3786666 - RNA, 19 nt, Human
aggcgcugagacugugcug

SEQ ID NO: 3786667 - RNA, 22 nt, Human
aggcgcugcccaccugccggcc

SEQ ID NO: 3786668 - RNA, 18 nt, Human
aggcggacguuccagccg

SEQ ID NO: 3786669 - RNA, 24 nt, Human
aggcggagaguacagugagccaag

SEQ ID NO: 3786670 - RNA, 21 nt, Human
aggcgggaaaagcagcccuug

SEQ ID NO: 3786671 - RNA, 15 nt, Human
aggcgggaaggaggg

SEQ ID NO: 3786672 - RNA, 12 nt, Human
aggcgggccagc

SEQ ID NO: 3786673 - RNA, 16 nt, Human
aggcggggcuugccuu

SEQ ID NO: 3786674 - RNA, 16 nt, Human
aggcggugggccuggu

SEQ ID NO: 3786675 - RNA, 21 nt, Human
aggcgucccgcaccugucuga

SEQ ID NO: 3786676 - RNA, 21 nt, Human
aggcgucuguauauuuuggga

SEQ ID NO: 3786677 - RNA, 13 nt, Human
aggcgugaggaug

SEQ ID NO: 3786678 - RNA, 15 nt, Human
aggcguggagcugcc

SEQ ID NO: 3786679 - RNA, 16 nt, Human
aggcguggagcugccu

SEQ ID NO: 3786680 - RNA, 19 nt, Human
aggcguucuucgaggugga

SEQ ID NO: 3786681 - RNA, 14 nt, Human
aggcuaaaaagcaa

SEQ ID NO: 3786682 - RNA, 13 nt, Human
aggcuaaacaucc

SEQ ID NO: 3786683 - RNA, 21 nt, Human
aggcuaaacauccaauauuuu

SEQ ID NO: 3786684 - RNA, 19 nt, Human
aggcuaaauuacucaggaa

SEQ ID NO: 3786685 - RNA, 19 nt, Human
aggcuaaggcaggaaaauu

SEQ ID NO: 3786686 - RNA, 23 nt, Human
aggcuaaggcguggagcugccug

SEQ ID NO: 3786687 - RNA, 24 nt, Human
aggcuaaguugggaucuaggagag

SEQ ID NO: 3786688 - RNA, 19 nt, Human
aggcuaauguuggcagaug

SEQ ID NO: 3786689 - RNA, 18 nt, Human
aggcuacaauuuucuccc

SEQ ID NO: 3786690 - RNA, 19 nt, Human
aggcuacaauuuucuccca

SEQ ID NO: 3786691 - RNA, 19 nt, Human
aggcuacacugacacuggu

SEQ ID NO: 3786692 - RNA, 19 nt, Human
aggcuacagagaagccuuc

SEQ ID NO: 3786693 - RNA, 22 nt, Human
aggcuacagagaagccuucaag

SEQ ID NO: 3786694 - RNA, 12 nt, Human
aggcuacagggc

SEQ ID NO: 3786695 - RNA, 14 nt, Human
aggcuaccuuugua

SEQ ID NO: 3786696 - RNA, 20 nt, Human
aggcuacuucggggcuggga

SEQ ID NO: 3786697 - RNA, 22 nt, Human
aggcuacuucggggcugggaag

SEQ ID NO: 3786698 - RNA, 15 nt, Human
aggcuagauguaugu

SEQ ID NO: 3786699 - RNA, 16 nt, Human
aggcuagauguaugua

SEQ ID NO: 3786700 - RNA, 21 nt, Human
aggcuagguggguugaaagcc

SEQ ID NO: 3786701 - RNA, 19 nt, Human
aggcuauggggauagaugu

SEQ ID NO: 3786702 - RNA, 21 nt, Human
aggcuauggggauagaugugu

SEQ ID NO: 3786703 - RNA, 18 nt, Human
aggcuauguauaaaauac

SEQ ID NO: 3786704 - RNA, 18 nt, Human
aggcuauuauuuucacug

SEQ ID NO: 3786705 - RNA, 19 nt, Human
aggcuauuauuuucacugu

SEQ ID NO: 3786706 - RNA, 22 nt, Human
aggcuauuccugagagcugcau

SEQ ID NO: 3786707 - RNA, 22 nt, Human
aggcuauuuguaaaucugccac

SEQ ID NO: 3786708 - RNA, 17 nt, Human
aggcuauuuucuaaaga

SEQ ID NO: 3786709 - RNA, 17 nt, Human
aggcucaacaauaaaac

SEQ ID NO: 3786710 - RNA, 15 nt, Human
aggcucaacuaggga

SEQ ID NO: 3786711 - RNA, 16 nt, Human
aggcucaacuagggag

SEQ ID NO: 3786712 - RNA, 22 nt, Human
aggcucacugcaacuucugccu

SEQ ID NO: 3786713 - RNA, 15 nt, Human
aggcucacugccagg

SEQ ID NO: 3786714 - RNA, 19 nt, Human
aggcucacugccaggccag

SEQ ID NO: 3786715 - RNA, 20 nt, Human
aggcucacugccaggccagc

SEQ ID NO: 3786716 - RNA, 14 nt, Human
aggcucacugguca

SEQ ID NO: 3786717 - RNA, 21 nt, Human
aggcucaggcaggggccucca

SEQ ID NO: 3786718 - RNA, 19 nt, Human
aggcucagucucaggagca

SEQ ID NO: 3786719 - RNA, 20 nt, Human
aggcucauagggaagaccug

SEQ ID NO: 3786720 - RNA, 21 nt, Human
aggcucauagggaagaccugc

SEQ ID NO: 3786721 - RNA, 14 nt, Human
aggcucauuuacug

SEQ ID NO: 3786722 - RNA, 12 nt, Human
aggcucauuuua

SEQ ID NO: 3786723 - RNA, 22 nt, Human
aggcuccaccccauccaguuca

SEQ ID NO: 3786724 - RNA, 13 nt, Human
aggcuccaggagc

SEQ ID NO: 3786725 - RNA, 14 nt, Human
aggcuccaggagca

SEQ ID NO: 3786726 - RNA, 23 nt, Human
aggcuccaggagcagccacauuc

SEQ ID NO: 3786727 - RNA, 15 nt, Human
aggcucccagggaca

SEQ ID NO: 3786728 - RNA, 14 nt, Human
aggcuccccugagg

SEQ ID NO: 3786729 - RNA, 13 nt, Human
aggcuccccuucu

SEQ ID NO: 3786730 - RNA, 15 nt, Human
aggcuccgcccuuag

SEQ ID NO: 3786731 - RNA, 21 nt, Human
aggcuccuguuagcuccucac

SEQ ID NO: 3786732 - RNA, 22 nt, Human
aggcuccuguuuugcacagcca

SEQ ID NO: 3786733 - RNA, 21 nt, Human
aggcucgagcaugccuggaug

SEQ ID NO: 3786734 - RNA, 16 nt, Human
aggcucgauuuuguau

SEQ ID NO: 3786735 - RNA, 20 nt, Human
aggcucgccuucccuccugc

SEQ ID NO: 3786736 - RNA, 18 nt, Human
aggcucuaaccacacagc

SEQ ID NO: 3786737 - RNA, 17 nt, Human
aggcucuagaucauaag

SEQ ID NO: 3786738 - RNA, 11 nt, Human
aggcucucagg

SEQ ID NO: 3786739 - RNA, 18 nt, Human
aggcucucaggccagcug

SEQ ID NO: 3786740 - RNA, 21 nt, Human
aggcucucaggccagcugcuu

SEQ ID NO: 3786741 - RNA, 23 nt, Human
aggcucuccuugcuccuggccuu

SEQ ID NO: 3786742 - RNA, 19 nt, Human
aggcucugacccagugaga

SEQ ID NO: 3786743 - RNA, 19 nt, Human
aggcucugagagucuagau

SEQ ID NO: 3786744 - RNA, 15 nt, Human
aggcucugcacagau

SEQ ID NO: 3786745 - RNA, 11 nt, Human
aggcucugccu

SEQ ID NO: 3786746 - RNA, 13 nt, Human
aggcucugccuuc

SEQ ID NO: 3786747 - RNA, 22 nt, Human
aggcucugugcugacccuccug

SEQ ID NO: 3786748 - RNA, 19 nt, Human
aggcucuuagcagcuucca

SEQ ID NO: 3786749 - RNA, 19 nt, Human
aggcucuucuccccagagu

SEQ ID NO: 3786750 - RNA, 14 nt, Human
aggcucuucuccuu

SEQ ID NO: 3786751 - RNA, 21 nt, Human
aggcucuuuggggucagccag

SEQ ID NO: 3786752 - RNA, 13 nt, Human
aggcugaaagagg

SEQ ID NO: 3786753 - RNA, 21 nt, Human
aggcugacaccuaacucuucu

SEQ ID NO: 3786754 - RNA, 19 nt, Human
aggcugaccaagagagaaa

SEQ ID NO: 3786755 - RNA, 14 nt, Human
aggcugaccacagc

SEQ ID NO: 3786756 - RNA, 16 nt, Human
aggcugaccacagcac

SEQ ID NO: 3786757 - RNA, 17 nt, Human
aggcugaccacagcaca

SEQ ID NO: 3786758 - RNA, 18 nt, Human
aggcugaccacagcacag

SEQ ID NO: 3786759 - RNA, 14 nt, Human
aggcugagacagga

SEQ ID NO: 3786760 - RNA, 16 nt, Human
aggcugagacugcggg

SEQ ID NO: 3786761 - RNA, 14 nt, Human
aggcugaggaaagg

SEQ ID NO: 3786762 - RNA, 18 nt, Human
aggcugaggcaagagaau

SEQ ID NO: 3786763 - RNA, 14 nt, Human
aggcugaggcagaa

SEQ ID NO: 3786764 - RNA, 19 nt, Human
aggcugaggcaggagaaug

SEQ ID NO: 3786765 - RNA, 14 nt, Human
aggcugaggccugg

SEQ ID NO: 3786766 - RNA, 17 nt, Human
aggcugaggccuggacu

SEQ ID NO: 3786767 - RNA, 11 nt, Human
aggcugaggcg

SEQ ID NO: 3786768 - RNA, 21 nt, Human
aggcugaggcggguggaucac

SEQ ID NO: 3786769 - RNA, 18 nt, Human
aggcugaggcuggcacag

SEQ ID NO: 3786770 - RNA, 14 nt, Human
aggcugaggugucu

SEQ ID NO: 3786771 - RNA, 18 nt, Human
aggcugagugcaggccca

SEQ ID NO: 3786772 - RNA, 20 nt, Human
aggcugagugcaggcccacc

SEQ ID NO: 3786773 - RNA, 17 nt, Human
aggcugauaauuccagu

SEQ ID NO: 3786774 - RNA, 17 nt, Human
aggcugcagaaggccaa

SEQ ID NO: 3786775 - RNA, 19 nt, Human
aggcugcagcuggacagag

SEQ ID NO: 3786776 - RNA, 20 nt, Human
aggcugcagcuggacagagg

SEQ ID NO: 3786777 - RNA, 21 nt, Human
aggcugcagcuggacagaggg

SEQ ID NO: 3786778 - RNA, 22 nt, Human
aggcugcagcuggacagagggg

SEQ ID NO: 3786779 - RNA, 16 nt, Human
aggcugcauagaagga

SEQ ID NO: 3786780 - RNA, 14 nt, Human
aggcugccagugcc

SEQ ID NO: 3786781 - RNA, 16 nt, Human
aggcugccagugccug

SEQ ID NO: 3786782 - RNA, 17 nt, Human
aggcugccccucucacc

SEQ ID NO: 3786783 - RNA, 13 nt, Human
aggcugcccuccu

SEQ ID NO: 3786784 - RNA, 23 nt, Human
aggcugccugagcaccucccagc

SEQ ID NO: 3786785 - RNA, 19 nt, Human
aggcugcggccccuccccc

SEQ ID NO: 3786786 - RNA, 17 nt, Human
aggcugcgucuggaggg

SEQ ID NO: 3786787 - RNA, 15 nt, Human
aggcugcucagggcu

SEQ ID NO: 3786788 - RNA, 16 nt, Human
aggcugcucagggcug

SEQ ID NO: 3786789 - RNA, 20 nt, Human
aggcugcucggggugcacag

SEQ ID NO: 3786790 - RNA, 14 nt, Human
aggcugcuggagga

SEQ ID NO: 3786791 - RNA, 16 nt, Human
aggcugcuggaggaaa

SEQ ID NO: 3786792 - RNA, 22 nt, Human
aggcugcugggauggugggcuu

SEQ ID NO: 3786793 - RNA, 20 nt, Human
aggcugcuggggccucagac

SEQ ID NO: 3786794 - RNA, 13 nt, Human
auccccucaggac

SEQ ID NO: 3786795 - RNA, 12 nt, Human
auccccugagcc

SEQ ID NO: 3786796 - RNA, 13 nt, Human
auccccugccucc

SEQ ID NO: 3786797 - RNA, 12 nt, Human
auccccugcuac

SEQ ID NO: 3786798 - RNA, 13 nt, Human
auccccuucuccc

SEQ ID NO: 3786799 - RNA, 21 nt, Human
aucccgaagaauggagaggaa

SEQ ID NO: 3786800 - RNA, 17 nt, Human
aucccgagcaccuccac

SEQ ID NO: 3786801 - RNA, 15 nt, Human
aucccgagucuggga

SEQ ID NO: 3786802 - RNA, 20 nt, Human
aucccgauucacccugucca

SEQ ID NO: 3786803 - RNA, 22 nt, Human
aucccgccucuucuucuucaga

SEQ ID NO: 3786804 - RNA, 14 nt, Human
aucccggcugcccu

SEQ ID NO: 3786805 - RNA, 22 nt, Human
aucuucauggaauucacaaagu

SEQ ID NO: 3786806 - RNA, 14 nt, Human
aucuucauguaaau

SEQ ID NO: 3786807 - RNA, 18 nt, Human
aucuucauguaaauugac

SEQ ID NO: 3786808 - RNA, 17 nt, Human
aucuuccauauuuggaa

SEQ ID NO: 3786809 - RNA, 11 nt, Human
aucuucccagc

SEQ ID NO: 3786810 - RNA, 20 nt, Human
aucuucccagcagggccacu

SEQ ID NO: 3786811 - RNA, 21 nt, Human
aucuuccccaacgaaaagcac

SEQ ID NO: 3786812 - RNA, 21 nt, Human
aucuucccuagaggguuccug

SEQ ID NO: 3786813 - RNA, 14 nt, Human
aucuucccucuccc

SEQ ID NO: 3786814 - RNA, 14 nt, Human
aucuuccucugcua

SEQ ID NO: 3786815 - RNA, 18 nt, Human
aucuuccucugcuaaauu

SEQ ID NO: 3786816 - RNA, 16 nt, Human
aucuucgucuucacuc

SEQ ID NO: 3786817 - RNA, 18 nt, Human
aucuucguucuuguuagu

SEQ ID NO: 3786818 - RNA, 21 nt, Human
aucuucuaaacccaauccaaa

SEQ ID NO: 3786819 - RNA, 13 nt, Human
aucuucuaaaugg

SEQ ID NO: 3786820 - RNA, 23 nt, Human
aucuucuauauaauuccuguuuu

SEQ ID NO: 3786821 - RNA, 15 nt, Human
aucuucucaaguucu

SEQ ID NO: 3786822 - RNA, 14 nt, Human
aucuucucagcucc

SEQ ID NO: 3786823 - RNA, 21 nt, Human
aucuucucagcucccauuucu

SEQ ID NO: 3786824 - RNA, 22 nt, Human
aucuucucagcucccauuucua

SEQ ID NO: 3786825 - RNA, 13 nt, Human
aucuucuccagau

SEQ ID NO: 3786826 - RNA, 16 nt, Human
aucuucugccuucuca

SEQ ID NO: 3786827 - RNA, 17 nt, Human
aucuucuuaugcaauuu

SEQ ID NO: 3786828 - RNA, 14 nt, Human
aucuucuucaccau

SEQ ID NO: 3786829 - RNA, 21 nt, Human
aucuugaaauuaagaaggcaa

SEQ ID NO: 3786830 - RNA, 18 nt, Human
aucuugaaggaaaaauuc

SEQ ID NO: 3786831 - RNA, 20 nt, Human
aucuugaaggaaaaauucaa

SEQ ID NO: 3786832 - RNA, 22 nt, Human
aucuugaaggaaaaauucaaua

SEQ ID NO: 3786833 - RNA, 16 nt, Human
aucuugaagggcccag

SEQ ID NO: 3786834 - RNA, 18 nt, Human
aucuugaauacucugccc

SEQ ID NO: 3786835 - RNA, 19 nt, Human
aucuugaauacucugcccu

SEQ ID NO: 3786836 - RNA, 12 nt, Human
aucuugaaugug

SEQ ID NO: 3786837 - RNA, 13 nt, Human
aucuugaaugugg

SEQ ID NO: 3786838 - RNA, 21 nt, Human
aucuugaauguggucucagga

SEQ ID NO: 3786839 - RNA, 18 nt, Human
aucuugaauuguaaggaa

SEQ ID NO: 3786840 - RNA, 17 nt, Human
aucuugacauucaaggc

SEQ ID NO: 3786841 - RNA, 17 nt, Human
aucuugaccaagcagga

SEQ ID NO: 3786842 - RNA, 21 nt, Human
aucuugaccaagcaggaagcu

SEQ ID NO: 3786843 - RNA, 23 nt, Human
aucuugaccaagcaggaagcuca

SEQ ID NO: 3786844 - RNA, 17 nt, Human
aucuugacuacagucag

SEQ ID NO: 3786845 - RNA, 22 nt, Human
aucuugaggugguaguaaaaca

SEQ ID NO: 3786846 - RNA, 13 nt, Human
aucuugauacauu

SEQ ID NO: 3786847 - RNA, 16 nt, Human
aucuugauacauucaa

SEQ ID NO: 3786848 - RNA, 17 nt, Human
aucuugaugucuuuguu

SEQ ID NO: 3786849 - RNA, 22 nt, Human
aucuugcaguaucggcacugua

SEQ ID NO: 3786850 - RNA, 24 nt, Human
aucuugcaguaucggcacuguaca

SEQ ID NO: 3786851 - RNA, 19 nt, Human
aucuugcccgcucaggcug

SEQ ID NO: 3786852 - RNA, 17 nt, Human
aucuugccggucauuuu

SEQ ID NO: 3786853 - RNA, 14 nt, Human
aucuugccuccagg

SEQ ID NO: 3786854 - RNA, 22 nt, Human
aucuugcgaauccaagcucccu

SEQ ID NO: 3786855 - RNA, 14 nt, Human
aucuugcuaccagu

SEQ ID NO: 3786856 - RNA, 16 nt, Human
aucuugcuaccaguau

SEQ ID NO: 3786857 - RNA, 19 nt, Human
aucuugcuaccaguauuua

SEQ ID NO: 3786858 - RNA, 15 nt, Human
aucuugcucugcuga

SEQ ID NO: 3786859 - RNA, 16 nt, Human
aucuugcucugcugac

SEQ ID NO: 3786860 - RNA, 17 nt, Human
aucuugcucugcugaca

SEQ ID NO: 3786861 - RNA, 19 nt, Human
aucuugcucugcugacaga

SEQ ID NO: 3786862 - RNA, 14 nt, Human
aucuugcucuguaa

SEQ ID NO: 3786863 - RNA, 17 nt, Human
aucuugcucuguaaucu

SEQ ID NO: 3786864 - RNA, 22 nt, Human
aucuugcucuguaaucucguuu

SEQ ID NO: 3786865 - RNA, 12 nt, Human
aucuugcuggcu

SEQ ID NO: 3786866 - RNA, 12 nt, Human
aucuugcuugaa

SEQ ID NO: 3786867 - RNA, 23 nt, Human
aucuugcuuucuuuguuuggcug

SEQ ID NO: 3786868 - RNA, 22 nt, Human
aucuuggacaaaucacauauuu

SEQ ID NO: 3786869 - RNA, 21 nt, Human
aucuuggacucaugaggaggg

SEQ ID NO: 3786870 - RNA, 15 nt, Human
aucuuggagagcugg

SEQ ID NO: 3786871 - RNA, 23 nt, Human
aucuuggcacauuuaagagacag

SEQ ID NO: 3786872 - RNA, 20 nt, Human
aucuuggcagguaggaauau

SEQ ID NO: 3786873 - RNA, 17 nt, Human
aucuuggccuuacugua

SEQ ID NO: 3786874 - RNA, 13 nt, Human
aucuuggcuaugu

SEQ ID NO: 3786875 - RNA, 22 nt, Human
aucuuggcuauguaauucuugu

SEQ ID NO: 3786876 - RNA, 17 nt, Human
aucuuggggacaucucu

SEQ ID NO: 3786877 - RNA, 23 nt, Human
aucuugggggacagggcuggccc

SEQ ID NO: 3786878 - RNA, 20 nt, Human
aucuuggucagauuugaacu

SEQ ID NO: 3786879 - RNA, 19 nt, Human
aucuugguccaggaaaugu

SEQ ID NO: 3786880 - RNA, 23 nt, Human
aucuugguccaggaaaugugcac

SEQ ID NO: 3786881 - RNA, 15 nt, Human
aucuugguguguuaa

SEQ ID NO: 3786882 - RNA, 14 nt, Human
aucuugucaugugu

SEQ ID NO: 3786883 - RNA, 15 nt, Human
aucuugucucaaugc

SEQ ID NO: 3786884 - RNA, 20 nt, Human
aucuugucucaaugcucaua

SEQ ID NO: 3786885 - RNA, 14 nt, Human
aucuugucucuggg

SEQ ID NO: 3786886 - RNA, 11 nt, Human
aucuugugaaa

SEQ ID NO: 3786887 - RNA, 14 nt, Human
aucuugugaaaaua

SEQ ID NO: 3786888 - RNA, 22 nt, Human
aucuuguggcuuugcaaccauu

SEQ ID NO: 3786889 - RNA, 23 nt, Human
aucuugugugauuaacuuauuua

SEQ ID NO: 3786890 - RNA, 17 nt, Human
aucuuguguuguccuuu

SEQ ID NO: 3786891 - RNA, 22 nt, Human
aucuuguguuguccuuuugucu

SEQ ID NO: 3786892 - RNA, 17 nt, Human
aucuuguucaggaaaag

SEQ ID NO: 3786893 - RNA, 14 nt, Human
aucuuguuuccaaa

SEQ ID NO: 3786894 - RNA, 17 nt, Human
aucuuguuuugaaaaua

SEQ ID NO: 3786895 - RNA, 15 nt, Human
aucuuguuuuuccac

SEQ ID NO: 3786896 - RNA, 23 nt, Human
aucuuguuuuuccacuacugcua

SEQ ID NO: 3786897 - RNA, 21 nt, Human
aucuuuaaaagaugcuuuuaa

SEQ ID NO: 3786898 - RNA, 13 nt, Human
aucuuuauugaaa

SEQ ID NO: 3786899 - RNA, 17 nt, Human
aucuuuauugagaaaga

SEQ ID NO: 3786900 - RNA, 17 nt, Human
aucuuucaaaccagcuu

SEQ ID NO: 3786901 - RNA, 22 nt, Human
aucuuucacacuuccaccagcc

SEQ ID NO: 3786902 - RNA, 18 nt, Human
aucuuucacccacagaaa

SEQ ID NO: 3786903 - RNA, 14 nt, Human
aucuuucagaaaua

SEQ ID NO: 3786904 - RNA, 13 nt, Human
aucuuucccuccu

SEQ ID NO: 3786905 - RNA, 13 nt, Human
aucuuuccuuccu

SEQ ID NO: 3786906 - RNA, 17 nt, Human
aucuuucgauaaacaac

SEQ ID NO: 3786907 - RNA, 18 nt, Human
aucuuucgcacagcaguu

SEQ ID NO: 3786908 - RNA, 23 nt, Human
aucuuucgcacagcaguuccgga

SEQ ID NO: 3786909 - RNA, 16 nt, Human
aucuuucuaugcugcu

SEQ ID NO: 3786910 - RNA, 11 nt, Human
aucuuucuucu

SEQ ID NO: 3786911 - RNA, 20 nt, Human
aucuuucuuuaccugagacc

SEQ ID NO: 3786912 - RNA, 22 nt, Human
aucuuucuuuaccugagaccag

SEQ ID NO: 3786913 - RNA, 22 nt, Human
aucuuugaaagguuagagaaua

SEQ ID NO: 3786914 - RNA, 19 nt, Human
aucuuugaaauuauguaaa

SEQ ID NO: 3786915 - RNA, 14 nt, Human
aucuuugauguguu

SEQ ID NO: 3786916 - RNA, 17 nt, Human
aucuuugauguguuguu

SEQ ID NO: 3786917 - RNA, 19 nt, Human
aucuuugauguguuguucu

SEQ ID NO: 3786918 - RNA, 18 nt, Human
aucuuugauucuccuuca

SEQ ID NO: 3786919 - RNA, 20 nt, Human
aucuuugauucuccuucagc

SEQ ID NO: 3786920 - RNA, 16 nt, Human
aucuuugcacuccaau

SEQ ID NO: 3786921 - RNA, 17 nt, Human
aucuuugcagacaggca

SEQ ID NO: 3786922 - RNA, 16 nt, Human
aucuuugccacccuca

SEQ ID NO: 3786923 - RNA, 13 nt, Human
aucuuugccucuc

SEQ ID NO: 3786924 - RNA, 14 nt, Human
aucuuugccuuggg

SEQ ID NO: 3786925 - RNA, 22 nt, Human
aucuuugccuugggcugcuccu

SEQ ID NO: 3786926 - RNA, 22 nt, Human
aucuuuggacagaagcagcucu

SEQ ID NO: 3786927 - RNA, 17 nt, Human
aucuuuguaccaaaauu

SEQ ID NO: 3786928 - RNA, 21 nt, Human
aucuuuguaccaaaauuuuaa

SEQ ID NO: 3786929 - RNA, 19 nt, Human
aucuuuguggccaaggagc

SEQ ID NO: 3786930 - RNA, 18 nt, Human
aucuuuuaaaguguuacu

SEQ ID NO: 3786931 - RNA, 16 nt, Human
aucuuuuauguuugaa

SEQ ID NO: 3786932 - RNA, 20 nt, Human
aucuuuuauguuugaauaug

SEQ ID NO: 3786933 - RNA, 13 nt, Human
aucuuuuauucuu

SEQ ID NO: 3786934 - RNA, 14 nt, Human
aucuuuuauucuuu

SEQ ID NO: 3786935 - RNA, 14 nt, Human
aucuuuucacaaau

SEQ ID NO: 3786936 - RNA, 15 nt, Human
aucuuuucacaaaua

SEQ ID NO: 3786937 - RNA, 17 nt, Human
aucuuuucacaaauaaa

SEQ ID NO: 3786938 - RNA, 16 nt, Human
agggaagaaaagagcu

SEQ ID NO: 3786939 - RNA, 14 nt, Human
agggaagaacuauu

SEQ ID NO: 3786940 - RNA, 18 nt, Human
agggaagaaggaggaaug

SEQ ID NO: 3786941 - RNA, 15 nt, Human
agggaagagaaacag

SEQ ID NO: 3786942 - RNA, 19 nt, Human
agggaagagacagcccagg

SEQ ID NO: 3786943 - RNA, 17 nt, Human
agggaagauaaguugga

SEQ ID NO: 3786944 - RNA, 18 nt, Human
agggaagauaaguuggaa

SEQ ID NO: 3786945 - RNA, 20 nt, Human
agggaagauaaguuggaaac

SEQ ID NO: 3786946 - RNA, 19 nt, Human
agggaagcacugccucccu

SEQ ID NO: 3786947 - RNA, 14 nt, Human
agggaagcccagcu

SEQ ID NO: 3786948 - RNA, 18 nt, Human
agggaagcccagcuccag

SEQ ID NO: 3786949 - RNA, 23 nt, Human
agggaagcccagcuccagggcca

SEQ ID NO: 3786950 - RNA, 13 nt, Human
agggaagcuacag

SEQ ID NO: 3786951 - RNA, 19 nt, Human
agggaagcuacagguuaca

SEQ ID NO: 3786952 - RNA, 14 nt, Human
agggaagcucuugg

SEQ ID NO: 3786953 - RNA, 16 nt, Human
agggaagcuggccuga

SEQ ID NO: 3786954 - RNA, 23 nt, Human
agggaagcuggccugagagggga

SEQ ID NO: 3786955 - RNA, 18 nt, Human
agggaaggacagaaagga

SEQ ID NO: 3786956 - RNA, 22 nt, Human
agggaaggauacaaaagcaugu

SEQ ID NO: 3786957 - RNA, 16 nt, Human
agggaaggcaggcagg

SEQ ID NO: 3786958 - RNA, 12 nt, Human
agggaagggagc

SEQ ID NO: 3786959 - RNA, 15 nt, Human
aucccggcugcccuu

SEQ ID NO: 3786960 - RNA, 15 nt, Human
aucccguuuucccca

SEQ ID NO: 3786961 - RNA, 16 nt, Human
aucccguuuuccccau

SEQ ID NO: 3786962 - RNA, 13 nt, Human
aucccuacaugua

SEQ ID NO: 3786963 - RNA, 18 nt, Human
aucccuacauguauugca

SEQ ID NO: 3786964 - RNA, 21 nt, Human
aucccuacccccuaagagcca

SEQ ID NO: 3786965 - RNA, 17 nt, Human
aucccuaccgacccagg

SEQ ID NO: 3786966 - RNA, 19 nt, Human
aucccuaugcugccuaggc

SEQ ID NO: 3786967 - RNA, 21 nt, Human
aucccucacacauccagacau

SEQ ID NO: 3786968 - RNA, 12 nt, Human
aucccucaccca

SEQ ID NO: 3786969 - RNA, 17 nt, Human
aucccucaccuucugag

SEQ ID NO: 3786970 - RNA, 14 nt, Human
aucccucauccuca

SEQ ID NO: 3786971 - RNA, 23 nt, Human
aucccucauccucauacccaccc

SEQ ID NO: 3786972 - RNA, 13 nt, Human
aucccucaucugu

SEQ ID NO: 3786973 - RNA, 23 nt, Human
aucccucuaaugagacugaccau

SEQ ID NO: 3786974 - RNA, 20 nt, Human
aucccucuacagagcuuccc

SEQ ID NO: 3786975 - RNA, 22 nt, Human
aucccucuacagagcuucccug

SEQ ID NO: 3786976 - RNA, 11 nt, Human
aucccucucca

SEQ ID NO: 3786977 - RNA, 12 nt, Human
aucccucuccau

SEQ ID NO: 3786978 - RNA, 22 nt, Human
aucccucuccauaaccccaccc

SEQ ID NO: 3786979 - RNA, 16 nt, Human
aucccucucuggauug

SEQ ID NO: 3786980 - RNA, 17 nt, Human
aucccugaaggccccgc

SEQ ID NO: 3786981 - RNA, 15 nt, Human
aucccugccagcucu

SEQ ID NO: 3786982 - RNA, 14 nt, Human
aucccugccugguc

SEQ ID NO: 3786983 - RNA, 20 nt, Human
aucccugcucacugcagccu

SEQ ID NO: 3786984 - RNA, 10 nt, Human
aucccuggcc

SEQ ID NO: 3786985 - RNA, 19 nt, Human
aucccuggcugggauccac

SEQ ID NO: 3786986 - RNA, 17 nt, Human
aucccugggccugcugc

SEQ ID NO: 3786987 - RNA, 15 nt, Human
aucccugggccuugg

SEQ ID NO: 3786988 - RNA, 15 nt, Human
aucccuguguuaauu

SEQ ID NO: 3786989 - RNA, 18 nt, Human
aucccuguguugucucua

SEQ ID NO: 3786990 - RNA, 19 nt, Human
aucccuguuacccagagaa

SEQ ID NO: 3786991 - RNA, 14 nt, Human
aucccuguucauug

SEQ ID NO: 3786992 - RNA, 16 nt, Human
aucccuguuuaauauu

SEQ ID NO: 3786993 - RNA, 22 nt, Human
aucccuguuuaauauuuaaaca

SEQ ID NO: 3786994 - RNA, 16 nt, Human
aucccuucauacuuga

SEQ ID NO: 3786995 - RNA, 20 nt, Human
aucccuucauacuugaacgu

SEQ ID NO: 3786996 - RNA, 16 nt, Human
aucccuuccaccugcu

SEQ ID NO: 3786997 - RNA, 19 nt, Human
aucccuuccaccugcucug

SEQ ID NO: 3786998 - RNA, 13 nt, Human
aucccuucucaca

SEQ ID NO: 3786999 - RNA, 13 nt, Human
aucccuucucuuc

SEQ ID NO: 3787000 - RNA, 21 nt, Human
aucccuucucuuccaggcagc

SEQ ID NO: 3787001 - RNA, 14 nt, Human
aucccuugaccagg

SEQ ID NO: 3787002 - RNA, 18 nt, Human
aucccuugaccaggccug

SEQ ID NO: 3787003 - RNA, 19 nt, Human
aucccuuggacauuuuaug

SEQ ID NO: 3787004 - RNA, 21 nt, Human
aucccuuggacauuuuauguc

SEQ ID NO: 3787005 - RNA, 15 nt, Human
auccgaaaucagcag

SEQ ID NO: 3787006 - RNA, 16 nt, Human
auccgaaccuccucug

SEQ ID NO: 3787007 - RNA, 14 nt, Human
auccgaaucucuuu

SEQ ID NO: 3787008 - RNA, 17 nt, Human
auccgacugcuuuggac

SEQ ID NO: 3787009 - RNA, 23 nt, Human
auccgacuugaauuuucccacug

SEQ ID NO: 3787010 - RNA, 14 nt, Human
auccgccaauauua

SEQ ID NO: 3787011 - RNA, 14 nt, Human
auccgccuuuugua

SEQ ID NO: 3787012 - RNA, 18 nt, Human
auccgccuuuuguauaca

SEQ ID NO: 3787013 - RNA, 14 nt, Human
auccgcucucuucc

SEQ ID NO: 3787014 - RNA, 15 nt, Human
auccgcucucuuccu

SEQ ID NO: 3787015 - RNA, 22 nt, Human
auccggcaacaucaacccgagu

SEQ ID NO: 3787016 - RNA, 15 nt, Human
auccggcagccugga

SEQ ID NO: 3787017 - RNA, 17 nt, Human
auccgugccucuuuuua

SEQ ID NO: 3787018 - RNA, 14 nt, Human
auccuaaaacaaau

SEQ ID NO: 3787019 - RNA, 14 nt, Human
auccuaaacaucau

SEQ ID NO: 3787020 - RNA, 16 nt, Human
auccuaaagaacaaag

SEQ ID NO: 3787021 - RNA, 12 nt, Human
auccuaagaaau

SEQ ID NO: 3787022 - RNA, 15 nt, Human
auccuaagacacaaa

SEQ ID NO: 3787023 - RNA, 17 nt, Human
auccuaagcaucuaagu

SEQ ID NO: 3787024 - RNA, 19 nt, Human
auccuaagggucgaaagcu

SEQ ID NO: 3787025 - RNA, 23 nt, Human
auccuaagggucgaaagcucuag

SEQ ID NO: 3787026 - RNA, 12 nt, Human
auccuaauaaaa

SEQ ID NO: 3787027 - RNA, 14 nt, Human
auccuaauaaaaag

SEQ ID NO: 3787028 - RNA, 17 nt, Human
auccuaauaaaaaggug

SEQ ID NO: 3787029 - RNA, 13 nt, Human
auccuaaugaaug

SEQ ID NO: 3787030 - RNA, 19 nt, Human
auccuaaugaaugcauaaa

SEQ ID NO: 3787031 - RNA, 19 nt, Human
auccuacaagacacaguga

SEQ ID NO: 3787032 - RNA, 18 nt, Human
auccuaccaaugcaugca

SEQ ID NO: 3787033 - RNA, 21 nt, Human
auccuaccccaauuccuugua

SEQ ID NO: 3787034 - RNA, 22 nt, Human
auccuacccucgggcccaccug

SEQ ID NO: 3787035 - RNA, 15 nt, Human
auccuaccuugcuuu

SEQ ID NO: 3787036 - RNA, 22 nt, Human
auccuaccuugcuuuugcuucu

SEQ ID NO: 3787037 - RNA, 21 nt, Human
auccuacgaguaauugcauuu

SEQ ID NO: 3787038 - RNA, 18 nt, Human
auccuagauuauaucaaa

SEQ ID NO: 3787039 - RNA, 20 nt, Human
auccuagauuauaucaaagu

SEQ ID NO: 3787040 - RNA, 19 nt, Human
auccuagcacaugcuucaa

SEQ ID NO: 3787041 - RNA, 13 nt, Human
auccuagcugugu

SEQ ID NO: 3787042 - RNA, 16 nt, Human
auccuaggcauuugcu

SEQ ID NO: 3787043 - RNA, 21 nt, Human
auccuaggcauuugcugaaua

SEQ ID NO: 3787044 - RNA, 14 nt, Human
auccuaggcugaca

SEQ ID NO: 3787045 - RNA, 20 nt, Human
auccuagguaggguuuaauc

SEQ ID NO: 3787046 - RNA, 19 nt, Human
auccuaguuccaccaucaa

SEQ ID NO: 3787047 - RNA, 15 nt, Human
auccuauauagaaug

SEQ ID NO: 3787048 - RNA, 19 nt, Human
auccuaucaacaacaaggu

SEQ ID NO: 3787049 - RNA, 13 nt, Human
auccuaugcaugg

SEQ ID NO: 3787050 - RNA, 22 nt, Human
auccuaugcaugguuucagcac

SEQ ID NO: 3787051 - RNA, 23 nt, Human
auccuaugcaugguuucagcacu

SEQ ID NO: 3787052 - RNA, 21 nt, Human
auccuaugguuucuccaucca

SEQ ID NO: 3787053 - RNA, 12 nt, Human
auccuauguuuu

SEQ ID NO: 3787054 - RNA, 16 nt, Human
auccuauuguugaugg

SEQ ID NO: 3787055 - RNA, 17 nt, Human
auccucaaacacugcag

SEQ ID NO: 3787056 - RNA, 15 nt, Human
auccucaaagaaagu

SEQ ID NO: 3787057 - RNA, 18 nt, Human
auccucaaagaaagugua

SEQ ID NO: 3787058 - RNA, 20 nt, Human
auccucaaagaaaguguauu

SEQ ID NO: 3787059 - RNA, 12 nt, Human
auccucaaucca

SEQ ID NO: 3787060 - RNA, 16 nt, Human
auccucacagugaaca

SEQ ID NO: 3787061 - RNA, 15 nt, Human
auccucacugggugg

SEQ ID NO: 3787062 - RNA, 15 nt, Human
auccucaucuuuuuu

SEQ ID NO: 3787063 - RNA, 23 nt, Human
auccucauuugggguagcuagag

SEQ ID NO: 3787064 - RNA, 18 nt, Human
auccuccacuuguucagg

SEQ ID NO: 3787065 - RNA, 11 nt, Human
auccuccagca

SEQ ID NO: 3787066 - RNA, 15 nt, Human
auccuccagcaggga

SEQ ID NO: 3787067 - RNA, 13 nt, Human
auccuccagcuuc

SEQ ID NO: 3787068 - RNA, 19 nt, Human
auccuccaggugcacaagc

SEQ ID NO: 3787069 - RNA, 23 nt, Human
auccuccaggugcacaagcucca

SEQ ID NO: 3787070 - RNA, 12 nt, Human
auccuccagguu

SEQ ID NO: 3787071 - RNA, 17 nt, Human
auccuccagguuuuuca

SEQ ID NO: 3787072 - RNA, 19 nt, Human
auccuccagguuuuucaau

SEQ ID NO: 3787073 - RNA, 19 nt, Human
auccuccaguaccuugcuu

SEQ ID NO: 3787074 - RNA, 20 nt, Human
auccuccaguaccuugcuuc

SEQ ID NO: 3787075 - RNA, 19 nt, Human
auccucccaccucagccuc

SEQ ID NO: 3787076 - RNA, 16 nt, Human
auccuccccuggacuc

SEQ ID NO: 3787077 - RNA, 11 nt, Human
auccuccccuu

SEQ ID NO: 3787078 - RNA, 15 nt, Human
auccuccccuucccu

SEQ ID NO: 3787079 - RNA, 15 nt, Human
auccuccguccagcc

SEQ ID NO: 3787080 - RNA, 11 nt, Human
auccuccucau

SEQ ID NO: 3787081 - RNA, 13 nt, Human
auccuccuccagg

SEQ ID NO: 3787082 - RNA, 14 nt, Human
auccuccucccacc

SEQ ID NO: 3787083 - RNA, 17 nt, Human
auccuccuccuuccuag

SEQ ID NO: 3787084 - RNA, 17 nt, Human
augaagguuucugaaaa

SEQ ID NO: 3787085 - RNA, 23 nt, Human
augaaguaauaugcacacauuuu

SEQ ID NO: 3787086 - RNA, 13 nt, Human
augaaguacucau

SEQ ID NO: 3787087 - RNA, 19 nt, Human
augaaguguguuuccuuca

SEQ ID NO: 3787088 - RNA, 23 nt, Human
augaaguguguuuccuucagugc

SEQ ID NO: 3787089 - RNA, 14 nt, Human
augaaguugaaaau

SEQ ID NO: 3787090 - RNA, 15 nt, Human
augaaguuguaggua

SEQ ID NO: 3787091 - RNA, 22 nt, Human
augaaguuuaaaacaguauuua

SEQ ID NO: 3787092 - RNA, 23 nt, Human
augaaguuuccuuggcuggugca

SEQ ID NO: 3787093 - RNA, 19 nt, Human
augaaguuugaacuucaua

SEQ ID NO: 3787094 - RNA, 14 nt, Human
augaauaauggaaa

SEQ ID NO: 3787095 - RNA, 15 nt, Human
augaauacaaauuuu

SEQ ID NO: 3787096 - RNA, 13 nt, Human
augaauacagcag

SEQ ID NO: 3787097 - RNA, 15 nt, Human
augaauacagcagca

SEQ ID NO: 3787098 - RNA, 17 nt, Human
augaauacagcagcaag

SEQ ID NO: 3787099 - RNA, 14 nt, Human
augaauacauuucc

SEQ ID NO: 3787100 - RNA, 24 nt, Human
augaauaccuuagugcaguuauuu

SEQ ID NO: 3787101 - RNA, 21 nt, Human
augaauacuguauuuuguauu

SEQ ID NO: 3787102 - RNA, 13 nt, Human
augaauauauggc

SEQ ID NO: 3787103 - RNA, 17 nt, Human
augaauaucuauuaaua

SEQ ID NO: 3787104 - RNA, 19 nt, Human
augaauaucuauuaauaua

SEQ ID NO: 3787105 - RNA, 20 nt, Human
augaauaucuauuaauauau

SEQ ID NO: 3787106 - RNA, 16 nt, Human
augaauauuuaguguu

SEQ ID NO: 3787107 - RNA, 15 nt, Human
augaauauuuauaac

SEQ ID NO: 3787108 - RNA, 19 nt, Human
augaauauuuugauaauaa

SEQ ID NO: 3787109 - RNA, 21 nt, Human
augaaucacuguuuuuagaca

SEQ ID NO: 3787110 - RNA, 16 nt, Human
augaauccaacugcuu

SEQ ID NO: 3787111 - RNA, 18 nt, Human
augaaucccacccacaug

SEQ ID NO: 3787112 - RNA, 17 nt, Human
augaaucgcuucucuuu

SEQ ID NO: 3787113 - RNA, 14 nt, Human
augaaucuaugcca

SEQ ID NO: 3787114 - RNA, 16 nt, Human
augaaucuauuauacu

SEQ ID NO: 3787115 - RNA, 20 nt, Human
augaaucucccacuccagcg

SEQ ID NO: 3787116 - RNA, 13 nt, Human
auccugccauuua

SEQ ID NO: 3787117 - RNA, 16 nt, Human
auccugccauuuaaaa

SEQ ID NO: 3787118 - RNA, 23 nt, Human
auccugcccccugaaacuuauuu

SEQ ID NO: 3787119 - RNA, 13 nt, Human
auccugccccuga

SEQ ID NO: 3787120 - RNA, 21 nt, Human
auccugccuuagagccaggca

SEQ ID NO: 3787121 - RNA, 13 nt, Human
auccugcuaaguu

SEQ ID NO: 3787122 - RNA, 15 nt, Human
auccugcuguucuag

SEQ ID NO: 3787123 - RNA, 19 nt, Human
auccugcuucugauaugca

SEQ ID NO: 3787124 - RNA, 12 nt, Human
auccugcuugau

SEQ ID NO: 3787125 - RNA, 14 nt, Human
auccuggaggccca

SEQ ID NO: 3787126 - RNA, 17 nt, Human
auccuggaggcccaguu

SEQ ID NO: 3787127 - RNA, 12 nt, Human
auccuggcagcc

SEQ ID NO: 3787128 - RNA, 15 nt, Human
auccuggcagcccag

SEQ ID NO: 3787129 - RNA, 16 nt, Human
auccuggcagcccaga

SEQ ID NO: 3787130 - RNA, 21 nt, Human
auccuggcccagggcaucugg

SEQ ID NO: 3787131 - RNA, 19 nt, Human
auccuggcucuguggcuug

SEQ ID NO: 3787132 - RNA, 22 nt, Human
auccuggcucuguggcuugcua

SEQ ID NO: 3787133 - RNA, 24 nt, Human
auccuggcucuuuggagaucaagg

SEQ ID NO: 3787134 - RNA, 20 nt, Human
auccuggcugucgagaaaca

SEQ ID NO: 3787135 - RNA, 18 nt, Human
auccugggcauccuucuu

SEQ ID NO: 3787136 - RNA, 21 nt, Human
auccugggcuuuuguuuugcu

SEQ ID NO: 3787137 - RNA, 22 nt, Human
auccugggcuuuuguuuugcuu

SEQ ID NO: 3787138 - RNA, 20 nt, Human
auccuggggcauuaaaaaaa

SEQ ID NO: 3787139 - RNA, 22 nt, Human
auccuggguggucugcaggcag

SEQ ID NO: 3787140 - RNA, 23 nt, Human
auccugguuccuaggggaaugag

SEQ ID NO: 3787141 - RNA, 20 nt, Human
auccuguaggaagguacugu

SEQ ID NO: 3787142 - RNA, 16 nt, Human
auccuguauaagcacu

SEQ ID NO: 3787143 - RNA, 21 nt, Human
auccuguauucuucaaccagu

SEQ ID NO: 3787144 - RNA, 16 nt, Human
auccugucaucugaga

SEQ ID NO: 3787145 - RNA, 14 nt, Human
auccuguccucagc

SEQ ID NO: 3787146 - RNA, 18 nt, Human
auccuguccucagcuucu

SEQ ID NO: 3787147 - RNA, 17 nt, Human
auccugucuguucaugg

SEQ ID NO: 3787148 - RNA, 21 nt, Human
auccugucuuuaaggaaaaaa

SEQ ID NO: 3787149 - RNA, 16 nt, Human
auccugugacauguaa

SEQ ID NO: 3787150 - RNA, 13 nt, Human
auccuguggguga

SEQ ID NO: 3787151 - RNA, 12 nt, Human
auccuguugaaa

SEQ ID NO: 3787152 - RNA, 13 nt, Human
auccuguugaaaa

SEQ ID NO: 3787153 - RNA, 12 nt, Human
auccuuacaaau

SEQ ID NO: 3787154 - RNA, 16 nt, Human
auccuuacaaaugauu

SEQ ID NO: 3787155 - RNA, 18 nt, Human
auccuuacaaaugauugc

SEQ ID NO: 3787156 - RNA, 13 nt, Human
auccuuacaaguu

SEQ ID NO: 3787157 - RNA, 13 nt, Human
auccuuagagguc

SEQ ID NO: 3787158 - RNA, 19 nt, Human
auccuucaucuuuuaaaga

SEQ ID NO: 3787159 - RNA, 22 nt, Human
auccuuccaaagaauucuuaua

SEQ ID NO: 3787160 - RNA, 19 nt, Human
auccuucccugucugccag

SEQ ID NO: 3787161 - RNA, 17 nt, Human
auccuucccuuuggaga

SEQ ID NO: 3787162 - RNA, 14 nt, Human
auccuuccuuccca

SEQ ID NO: 3787163 - RNA, 20 nt, Human
auccuucgugaacauccccu

SEQ ID NO: 3787164 - RNA, 12 nt, Human
auccuugaagau

SEQ ID NO: 3787165 - RNA, 16 nt, Human
auccuugaagguauau

SEQ ID NO: 3787166 - RNA, 16 nt, Human
auccuugacuggaccu

SEQ ID NO: 3787167 - RNA, 15 nt, Human
auccuugacuuuuua

SEQ ID NO: 3787168 - RNA, 18 nt, Human
auccuugggggcucccag

SEQ ID NO: 3787169 - RNA, 22 nt, Human
auccuugggggcucccagggca

SEQ ID NO: 3787170 - RNA, 18 nt, Human
auccuuggucuuuguauc

SEQ ID NO: 3787171 - RNA, 14 nt, Human
auccuugucuuauu

SEQ ID NO: 3787172 - RNA, 19 nt, Human
auccuuguguuuaucagaa

SEQ ID NO: 3787173 - RNA, 12 nt, Human
auccuuguuuca

SEQ ID NO: 3787174 - RNA, 13 nt, Human
auccuuguuucaa

SEQ ID NO: 3787175 - RNA, 14 nt, Human
auccuuguuucaaa

SEQ ID NO: 3787176 - RNA, 14 nt, Human
auccuuuccagcau

SEQ ID NO: 3787177 - RNA, 17 nt, Human
auccuuuccagcaugag

SEQ ID NO: 3787178 - RNA, 13 nt, Human
auccuuucuaaca

SEQ ID NO: 3787179 - RNA, 17 nt, Human
auccuuucugccucuca

SEQ ID NO: 3787180 - RNA, 18 nt, Human
auccuuugccugccuggu

SEQ ID NO: 3787181 - RNA, 13 nt, Human
auccuuuuauguu

SEQ ID NO: 3787182 - RNA, 17 nt, Human
auccuuuuauguuauuu

SEQ ID NO: 3787183 - RNA, 19 nt, Human
auccuuuuauguuauuuau

SEQ ID NO: 3787184 - RNA, 16 nt, Human
auccuuuucuguguuu

SEQ ID NO: 3787185 - RNA, 18 nt, Human
auccuuuuguagaaugaa

SEQ ID NO: 3787186 - RNA, 22 nt, Human
auccuuuuuaaauucaguccua

SEQ ID NO: 3787187 - RNA, 18 nt, Human
auccuuuuucuuuauaaa

SEQ ID NO: 3787188 - RNA, 13 nt, Human
aucgaaaaaauaa

SEQ ID NO: 3787189 - RNA, 18 nt, Human
aucgaaauaacaauguua

SEQ ID NO: 3787190 - RNA, 15 nt, Human
aucgaaccguuuuga

SEQ ID NO: 3787191 - RNA, 18 nt, Human
aucgaaucuacuaauucc

SEQ ID NO: 3787192 - RNA, 13 nt, Human
aucgaaugaaauu

SEQ ID NO: 3787193 - RNA, 14 nt, Human
aucgaaugaaauua

SEQ ID NO: 3787194 - RNA, 21 nt, Human
aucgacuuguuuuugcacaug

SEQ ID NO: 3787195 - RNA, 23 nt, Human
aucgaugggggaugcuucaugug

SEQ ID NO: 3787196 - RNA, 11 nt, Human
aucgauuggcu

SEQ ID NO: 3787197 - RNA, 17 nt, Human
aucgcaccauucugacu

SEQ ID NO: 3787198 - RNA, 20 nt, Human
aucgcagaccuuuuuuagga

SEQ ID NO: 3787199 - RNA, 14 nt, Human
aucgccacaaacuc

SEQ ID NO: 3787200 - RNA, 13 nt, Human
aucgccuucccca

SEQ ID NO: 3787201 - RNA, 23 nt, Human
aucgcgccacuacacuccagccu

SEQ ID NO: 3787202 - RNA, 22 nt, Human
aucgcuccugcagccccagccc

SEQ ID NO: 3787203 - RNA, 12 nt, Human
aucgcuggcccc

SEQ ID NO: 3787204 - RNA, 23 nt, Human
aucgcuguguguuaguucccaac

SEQ ID NO: 3787205 - RNA, 17 nt, Human
aucgcuucauguaacua

SEQ ID NO: 3787206 - RNA, 18 nt, Human
aucggaggcuugucagag

SEQ ID NO: 3787207 - RNA, 20 nt, Human
aucggaggcuugucagagcu

SEQ ID NO: 3787208 - RNA, 22 nt, Human
aucggaggcuugucagagcugg

SEQ ID NO: 3787209 - RNA, 19 nt, Human
aucggcccacagcucccac

SEQ ID NO: 3787210 - RNA, 22 nt, Human
aucggccuagggcccccacagu

SEQ ID NO: 3787211 - RNA, 13 nt, Human
aucggccuccucu

SEQ ID NO: 3787212 - RNA, 17 nt, Human
aucgggagcagugucuu

SEQ ID NO: 3787213 - RNA, 15 nt, Human
aucgggggcuggggc

SEQ ID NO: 3787214 - RNA, 19 nt, Human
aucggucuugcccagagga

SEQ ID NO: 3787215 - RNA, 15 nt, Human
aucgguuaacaaaua

SEQ ID NO: 3787216 - RNA, 17 nt, Human
aucguaaaauuaagaaa

SEQ ID NO: 3787217 - RNA, 16 nt, Human
aucguauagcuguauu

SEQ ID NO: 3787218 - RNA, 18 nt, Human
aucgucacugcuuaacuu

SEQ ID NO: 3787219 - RNA, 17 nt, Human
aucgucaugcacaguau

SEQ ID NO: 3787220 - RNA, 23 nt, Human
aucguccagggagcauuuuccuc

SEQ ID NO: 3787221 - RNA, 23 nt, Human
aucgucucucccucccuuugaaa

SEQ ID NO: 3787222 - RNA, 20 nt, Human
aucgugacgcugaauaaaug

SEQ ID NO: 3787223 - RNA, 22 nt, Human
aucgugacgcugaauaaauguc

SEQ ID NO: 3787224 - RNA, 19 nt, Human
aucgugccguuacucucca

SEQ ID NO: 3787225 - RNA, 23 nt, Human
aucgugccguuacucuccaaccu

SEQ ID NO: 3787226 - RNA, 12 nt, Human
aucgugcuaaau

SEQ ID NO: 3787227 - RNA, 17 nt, Human
aucgugcuaaauuuuca

SEQ ID NO: 3787228 - RNA, 21 nt, Human
aucguguauugagauuucuua

SEQ ID NO: 3787229 - RNA, 18 nt, Human
agggcuuuguuuugcaca

SEQ ID NO: 3787230 - RNA, 13 nt, Human
agggcuuuucaaa

SEQ ID NO: 3787231 - RNA, 16 nt, Human
aggggaaaaaaauguu

SEQ ID NO: 3787232 - RNA, 13 nt, Human
aggggaaccugcc

SEQ ID NO: 3787233 - RNA, 15 nt, Human
aggggaaccugccau

SEQ ID NO: 3787234 - RNA, 13 nt, Human
aggggaagaauga

SEQ ID NO: 3787235 - RNA, 13 nt, Human
aggggaagagaag

SEQ ID NO: 3787236 - RNA, 15 nt, Human
aggggaagaggccug

SEQ ID NO: 3787237 - RNA, 16 nt, Human
aggggaagaguguacu

SEQ ID NO: 3787238 - RNA, 17 nt, Human
aggggaagcacucgugu

SEQ ID NO: 3787239 - RNA, 21 nt, Human
aggggaagcagaaauccaagc

SEQ ID NO: 3787240 - RNA, 17 nt, Human
aggggaaggagaaguaa

SEQ ID NO: 3787241 - RNA, 14 nt, Human
aggggaagggccag

SEQ ID NO: 3787242 - RNA, 14 nt, Human
aggggaagucccug

SEQ ID NO: 3787243 - RNA, 11 nt, Human
aggggaauauu

SEQ ID NO: 3787244 - RNA, 19 nt, Human
aggggaauauuuuauucaa

SEQ ID NO: 3787245 - RNA, 20 nt, Human
aggggaauguuugccucugc

SEQ ID NO: 3787246 - RNA, 13 nt, Human
aggggacaggccu

SEQ ID NO: 3787247 - RNA, 15 nt, Human
aggggacaggccuca

SEQ ID NO: 3787248 - RNA, 17 nt, Human
aggggacaggccucacc

SEQ ID NO: 3787249 - RNA, 13 nt, Human
aggggaccaggag

SEQ ID NO: 3787250 - RNA, 15 nt, Human
aggggaccaggagug

SEQ ID NO: 3787251 - RNA, 16 nt, Human
aggggaccaggagugg

SEQ ID NO: 3787252 - RNA, 15 nt, Human
aggggacccccgccc

SEQ ID NO: 3787253 - RNA, 22 nt, Human
aggggacccccgcccccugccc

SEQ ID NO: 3787254 - RNA, 19 nt, Human
aggggacccuccgcucugu

SEQ ID NO: 3787255 - RNA, 13 nt, Human
aggggaccuggaa

SEQ ID NO: 3787256 - RNA, 23 nt, Human
aggggaccuggaagggagguggg

SEQ ID NO: 3787257 - RNA, 19 nt, Human
aggggacuauuuaugaagg

SEQ ID NO: 3787258 - RNA, 17 nt, Human
aggggacugccaccucc

SEQ ID NO: 3787259 - RNA, 15 nt, Human
aggggagagccugcu

SEQ ID NO: 3787260 - RNA, 17 nt, Human
aggggagagccugcugg

SEQ ID NO: 3787261 - RNA, 13 nt, Human
aggggagcagagg

SEQ ID NO: 3787262 - RNA, 15 nt, Human
aggggagccaggagg

SEQ ID NO: 3787263 - RNA, 11 nt, Human
aggggagcccu

SEQ ID NO: 3787264 - RNA, 12 nt, Human
aggggagcccuc

SEQ ID NO: 3787265 - RNA, 16 nt, Human
aggggagcccuccacg

SEQ ID NO: 3787266 - RNA, 13 nt, Human
aggggaggagggc

SEQ ID NO: 3787267 - RNA, 19 nt, Human
aggggaggaucacuggagc

SEQ ID NO: 3787268 - RNA, 21 nt, Human
aggggaggcagccggcaccca

SEQ ID NO: 3787269 - RNA, 20 nt, Human
aggggaggccaucuggagag

SEQ ID NO: 3787270 - RNA, 18 nt, Human
aggggaggggcuccuuuc

SEQ ID NO: 3787271 - RNA, 18 nt, Human
aggggagggggauccgac

SEQ ID NO: 3787272 - RNA, 16 nt, Human
aggggaggggggcaca

SEQ ID NO: 3787273 - RNA, 19 nt, Human
aggggagggucagccaggg

SEQ ID NO: 3787274 - RNA, 15 nt, Human
aggggaggguggcag

SEQ ID NO: 3787275 - RNA, 16 nt, Human
aggggaggguggcagg

SEQ ID NO: 3787276 - RNA, 19 nt, Human
aggggaggguggcagguga

SEQ ID NO: 3787277 - RNA, 16 nt, Human
aggggaguugugucug

SEQ ID NO: 3787278 - RNA, 13 nt, Human
aggggauauuuaa

SEQ ID NO: 3787279 - RNA, 19 nt, Human
aggggcaaacaccugcuga

SEQ ID NO: 3787280 - RNA, 17 nt, Human
aggggcaaauucuuuug

SEQ ID NO: 3787281 - RNA, 20 nt, Human
aggggcaacgaagaaaaaaa

SEQ ID NO: 3787282 - RNA, 15 nt, Human
aggggcagagccagg

SEQ ID NO: 3787283 - RNA, 13 nt, Human
aggggcagaggcc

SEQ ID NO: 3787284 - RNA, 19 nt, Human
aggggcagauggaaaggag

SEQ ID NO: 3787285 - RNA, 13 nt, Human
aggggcagcccuu

SEQ ID NO: 3787286 - RNA, 13 nt, Human
aggggcagccugc

SEQ ID NO: 3787287 - RNA, 18 nt, Human
aggggcagccugccuugc

SEQ ID NO: 3787288 - RNA, 14 nt, Human
aggggcagcugacc

SEQ ID NO: 3787289 - RNA, 15 nt, Human
aggggcagcugacca

SEQ ID NO: 3787290 - RNA, 11 nt, Human
aggggcagcuu

SEQ ID NO: 3787291 - RNA, 14 nt, Human
aggggcaggagcuc

SEQ ID NO: 3787292 - RNA, 12 nt, Human
aggggcaggagg

SEQ ID NO: 3787293 - RNA, 17 nt, Human
aggggcaggcacagcac

SEQ ID NO: 3787294 - RNA, 15 nt, Human
aggggcaggcccugc

SEQ ID NO: 3787295 - RNA, 23 nt, Human
aggggcaggcccugcacuguccu

SEQ ID NO: 3787296 - RNA, 16 nt, Human
aggggcaucugccccu

SEQ ID NO: 3787297 - RNA, 21 nt, Human
aggggcaucugccccuccccc

SEQ ID NO: 3787298 - RNA, 18 nt, Human
aggggcauggccagcagc

SEQ ID NO: 3787299 - RNA, 23 nt, Human
aggggcauguauuggccuggagg

SEQ ID NO: 3787300 - RNA, 15 nt, Human
aggggcauugcugac

SEQ ID NO: 3787301 - RNA, 13 nt, Human
aggggccagaggc

SEQ ID NO: 3787302 - RNA, 14 nt, Human
aggggccagaggcu

SEQ ID NO: 3787303 - RNA, 15 nt, Human
aggggccagaggcuc

SEQ ID NO: 3787304 - RNA, 17 nt, Human
aggggccagaggcucgu

SEQ ID NO: 3787305 - RNA, 19 nt, Human
aggggcccacagggaaccc

SEQ ID NO: 3787306 - RNA, 19 nt, Human
aggggcccaguccuggccu

SEQ ID NO: 3787307 - RNA, 20 nt, Human
aggggccccccugcccugug

SEQ ID NO: 3787308 - RNA, 17 nt, Human
aggggccccguguccug

SEQ ID NO: 3787309 - RNA, 18 nt, Human
aggggccccguguccugc

SEQ ID NO: 3787310 - RNA, 13 nt, Human
aggggccccucuc

SEQ ID NO: 3787311 - RNA, 14 nt, Human
aggggccccucuca

SEQ ID NO: 3787312 - RNA, 16 nt, Human
aggggccccugcuucu

SEQ ID NO: 3787313 - RNA, 15 nt, Human
aggggcccgcuugcc

SEQ ID NO: 3787314 - RNA, 23 nt, Human
aucuguuagaugcuacuaagaaa

SEQ ID NO: 3787315 - RNA, 14 nt, Human
aucuguuagggccu

SEQ ID NO: 3787316 - RNA, 21 nt, Human
aucuguuuaaagcauauagag

SEQ ID NO: 3787317 - RNA, 12 nt, Human
aucuguuuacag

SEQ ID NO: 3787318 - RNA, 14 nt, Human
aucuguuucccagc

SEQ ID NO: 3787319 - RNA, 18 nt, Human
aucuguuuugaaggcaaa

SEQ ID NO: 3787320 - RNA, 22 nt, Human
aucuguuuugugguuuggaaua

SEQ ID NO: 3787321 - RNA, 14 nt, Human
aucuguuuuucuaa

SEQ ID NO: 3787322 - RNA, 12 nt, Human
aucuuaaaaagu

SEQ ID NO: 3787323 - RNA, 17 nt, Human
aucuuaaaaaguuguuc

SEQ ID NO: 3787324 - RNA, 19 nt, Human
aucuuaaaaaguuguucaa

SEQ ID NO: 3787325 - RNA, 19 nt, Human
aucuuaaagaaacagcuuu

SEQ ID NO: 3787326 - RNA, 20 nt, Human
aucuuaaagaaacagcuuuc

SEQ ID NO: 3787327 - RNA, 12 nt, Human
aucuuaacucuu

SEQ ID NO: 3787328 - RNA, 15 nt, Human
aucuuaacucuuugc

SEQ ID NO: 3787329 - RNA, 13 nt, Human
aucuuaagaaaua

SEQ ID NO: 3787330 - RNA, 16 nt, Human
aucuuaagaaauaaau

SEQ ID NO: 3787331 - RNA, 14 nt, Human
aucuuaauacuguu

SEQ ID NO: 3787332 - RNA, 22 nt, Human
aucuuaauacuguuauucuuug

SEQ ID NO: 3787333 - RNA, 12 nt, Human
aucuuaauauaa

SEQ ID NO: 3787334 - RNA, 13 nt, Human
aucuuaauauaaa

SEQ ID NO: 3787335 - RNA, 16 nt, Human
aucuuaauauauuuga

SEQ ID NO: 3787336 - RNA, 21 nt, Human
aucuuaauguuccucaaagcu

SEQ ID NO: 3787337 - RNA, 13 nt, Human
aucuuaauuuugg

SEQ ID NO: 3787338 - RNA, 21 nt, Human
aucuuacaacaggcuuaugaa

SEQ ID NO: 3787339 - RNA, 15 nt, Human
aucuuacugaaggua

SEQ ID NO: 3787340 - RNA, 13 nt, Human
aucuuacuuugua

SEQ ID NO: 3787341 - RNA, 16 nt, Human
aucuuacuuuguaaau

SEQ ID NO: 3787342 - RNA, 13 nt, Human
aucuuagauucuc

SEQ ID NO: 3787343 - RNA, 18 nt, Human
aucuuagauucucugugu

SEQ ID NO: 3787344 - RNA, 16 nt, Human
aucuuagcugccaagu

SEQ ID NO: 3787345 - RNA, 18 nt, Human
aucuuagugccugagagu

SEQ ID NO: 3787346 - RNA, 12 nt, Human
aucuuagugguu

SEQ ID NO: 3787347 - RNA, 15 nt, Human
aucuuauaauuuaaa

SEQ ID NO: 3787348 - RNA, 13 nt, Human
aucuuauacugua

SEQ ID NO: 3787349 - RNA, 15 nt, Human
aucuuauagcacuuu

SEQ ID NO: 3787350 - RNA, 18 nt, Human
aucuuauagcacuuugaa

SEQ ID NO: 3787351 - RNA, 17 nt, Human
aucuuauaguucuaggc

SEQ ID NO: 3787352 - RNA, 22 nt, Human
aucuuaucaagaguugugacaa

SEQ ID NO: 3787353 - RNA, 20 nt, Human
aucuuaucauggucucaguc

SEQ ID NO: 3787354 - RNA, 19 nt, Human
aucuuaucucagauauuug

SEQ ID NO: 3787355 - RNA, 14 nt, Human
aucuuauuaaaguu

SEQ ID NO: 3787356 - RNA, 23 nt, Human
aucuuauuaaaguuucaaaaauc

SEQ ID NO: 3787357 - RNA, 21 nt, Human
aucuuauuagggagaaaauuc

SEQ ID NO: 3787358 - RNA, 13 nt, Human
aucuuauucauuu

SEQ ID NO: 3787359 - RNA, 13 nt, Human
aucuuauuuagga

SEQ ID NO: 3787360 - RNA, 15 nt, Human
aucuuauuuuucuaa

SEQ ID NO: 3787361 - RNA, 21 nt, Human
aucuuauuuuucuaaacguaa

SEQ ID NO: 3787362 - RNA, 19 nt, Human
aucuucaaagcuugaagau

SEQ ID NO: 3787363 - RNA, 12 nt, Human
aucuucacauag

SEQ ID NO: 3787364 - RNA, 21 nt, Human
aucuucaccagaggaaucacu

SEQ ID NO: 3787365 - RNA, 17 nt, Human
aucuucacccaggccua

SEQ ID NO: 3787366 - RNA, 19 nt, Human
aucuucacccaggccuaug

SEQ ID NO: 3787367 - RNA, 14 nt, Human
aucuucagcuucuu

SEQ ID NO: 3787368 - RNA, 14 nt, Human
aucuucaguuuuau

SEQ ID NO: 3787369 - RNA, 22 nt, Human
aucuucauaucuaucagaguau

SEQ ID NO: 3787370 - RNA, 23 nt, Human
aucuucauggaauucacaaagua

SEQ ID NO: 3787371 - RNA, 19 nt, Human
aucuuccaacucaaacucu

SEQ ID NO: 3787372 - RNA, 18 nt, Human
aucuuccagaagugugau

SEQ ID NO: 3787373 - RNA, 14 nt, Human
aucuuccauauuug

SEQ ID NO: 3787374 - RNA, 15 nt, Human
aucuuccauauuugg

SEQ ID NO: 3787375 - RNA, 14 nt, Human
aucuucccaugcau

SEQ ID NO: 3787376 - RNA, 20 nt, Human
augaaaauccuaccaaccuc

SEQ ID NO: 3787377 - RNA, 18 nt, Human
augaaaaugaguugugaa

SEQ ID NO: 3787378 - RNA, 20 nt, Human
augaaaaugaguugugaaag

SEQ ID NO: 3787379 - RNA, 13 nt, Human
augaaaaugucag

SEQ ID NO: 3787380 - RNA, 14 nt, Human
augaaaaugucuug

SEQ ID NO: 3787381 - RNA, 15 nt, Human
augaaaaugucuugu

SEQ ID NO: 3787382 - RNA, 11 nt, Human
augaaaauugu

SEQ ID NO: 3787383 - RNA, 15 nt, Human
augaaaauuguauua

SEQ ID NO: 3787384 - RNA, 13 nt, Human
augaaaauuugag

SEQ ID NO: 3787385 - RNA, 19 nt, Human
augaaaauuugagacuauu

SEQ ID NO: 3787386 - RNA, 12 nt, Human
augaaacacagc

SEQ ID NO: 3787387 - RNA, 12 nt, Human
augaaacaccuu

SEQ ID NO: 3787388 - RNA, 17 nt, Human
augaaacaccuucucug

SEQ ID NO: 3787389 - RNA, 13 nt, Human
augaaacuaaagc

SEQ ID NO: 3787390 - RNA, 15 nt, Human
augaaacuaaagcaa

SEQ ID NO: 3787391 - RNA, 16 nt, Human
augaaacuaaagcaau

SEQ ID NO: 3787392 - RNA, 23 nt, Human
augaaacuaaagcaauagaaaca

SEQ ID NO: 3787393 - RNA, 14 nt, Human
augaaagaaaggcc

SEQ ID NO: 3787394 - RNA, 14 nt, Human
augaaagaauauau

SEQ ID NO: 3787395 - RNA, 18 nt, Human
augaaagaguaaaggaaa

SEQ ID NO: 3787396 - RNA, 12 nt, Human
augaaagaugau

SEQ ID NO: 3787397 - RNA, 19 nt, Human
augaaagauggcugugccu

SEQ ID NO: 3787398 - RNA, 20 nt, Human
augaaagauggcugugccuc

SEQ ID NO: 3787399 - RNA, 12 nt, Human
augaaagcaugu

SEQ ID NO: 3787400 - RNA, 18 nt, Human
augaaagcauguggcaug

SEQ ID NO: 3787401 - RNA, 23 nt, Human
augaaagcugauuacugucaaua

SEQ ID NO: 3787402 - RNA, 16 nt, Human
augaaagcuguuccuu

SEQ ID NO: 3787403 - RNA, 18 nt, Human
augaaagcuguuccuugg

SEQ ID NO: 3787404 - RNA, 12 nt, Human
augaaaggagag

SEQ ID NO: 3787405 - RNA, 15 nt, Human
augaaagguacuaua

SEQ ID NO: 3787406 - RNA, 17 nt, Human
augaaaggugccaugga

SEQ ID NO: 3787407 - RNA, 16 nt, Human
augaaagguuuacauu

SEQ ID NO: 3787408 - RNA, 16 nt, Human
augaaaguauuaaaau

SEQ ID NO: 3787409 - RNA, 16 nt, Human
augaaagucaguuuaa

SEQ ID NO: 3787410 - RNA, 20 nt, Human
augaaagucuagaaauaaaa

SEQ ID NO: 3787411 - RNA, 19 nt, Human
augaaagucuugugacuag

SEQ ID NO: 3787412 - RNA, 16 nt, Human
augaaauaaaauauau

SEQ ID NO: 3787413 - RNA, 14 nt, Human
augaaauaaagaaa

SEQ ID NO: 3787414 - RNA, 19 nt, Human
augaaauacacaaguaaac

SEQ ID NO: 3787415 - RNA, 20 nt, Human
augaaauacacaaguaaaca

SEQ ID NO: 3787416 - RNA, 17 nt, Human
augaaauacuauuuaaa

SEQ ID NO: 3787417 - RNA, 13 nt, Human
augaaauaugcau

SEQ ID NO: 3787418 - RNA, 15 nt, Human
augaaauaugcaucu

SEQ ID NO: 3787419 - RNA, 19 nt, Human
augaaauccuugacuggac

SEQ ID NO: 3787420 - RNA, 16 nt, Human
augaaauccuuuuccu

SEQ ID NO: 3787421 - RNA, 18 nt, Human
augaaaucuuacagcugg

SEQ ID NO: 3787422 - RNA, 16 nt, Human
augaaaugaacacaaa

SEQ ID NO: 3787423 - RNA, 22 nt, Human
augaaaugugaauuuuuauugu

SEQ ID NO: 3787424 - RNA, 23 nt, Human
augaaaugugaauuuuuauuguu

SEQ ID NO: 3787425 - RNA, 16 nt, Human
augaaauuacuuauca

SEQ ID NO: 3787426 - RNA, 23 nt, Human
augaaauuacuuaucauccacau

SEQ ID NO: 3787427 - RNA, 21 nt, Human
augaaauuauauaaguauucu

SEQ ID NO: 3787428 - RNA, 20 nt, Human
augaaauugucuagcagagc

SEQ ID NO: 3787429 - RNA, 14 nt, Human
augaaauuuaaaca

SEQ ID NO: 3787430 - RNA, 21 nt, Human
augaaauuuaaacauuaaaaa

SEQ ID NO: 3787431 - RNA, 17 nt, Human
augaaauuuaauauagc

SEQ ID NO: 3787432 - RNA, 15 nt, Human
augaaauuuuaccaa

SEQ ID NO: 3787433 - RNA, 20 nt, Human
augaaauuuuccaaugucug

SEQ ID NO: 3787434 - RNA, 14 nt, Human
augaaauuuuugua

SEQ ID NO: 3787435 - RNA, 17 nt, Human
augaacaaaauuauuug

SEQ ID NO: 3787436 - RNA, 12 nt, Human
augaacaaaugg

SEQ ID NO: 3787437 - RNA, 15 nt, Human
augaacaaauugaac

SEQ ID NO: 3787438 - RNA, 20 nt, Human
augaacacaaauuaugcuaa

SEQ ID NO: 3787439 - RNA, 13 nt, Human
augaacagugcac

SEQ ID NO: 3787440 - RNA, 20 nt, Human
augaacauuagaaaaauagc

SEQ ID NO: 3787441 - RNA, 10 nt, Human
augaacauuc

SEQ ID NO: 3787442 - RNA, 13 nt, Human
augaaccacaucu

SEQ ID NO: 3787443 - RNA, 22 nt, Human
augaacccaggacgcuucugaa

SEQ ID NO: 3787444 - RNA, 18 nt, Human
augaacccuuccugagcu

SEQ ID NO: 3787445 - RNA, 17 nt, Human
augaacccuuuguuucu

SEQ ID NO: 3787446 - RNA, 17 nt, Human
augaaccgcugaauaug

SEQ ID NO: 3787447 - RNA, 23 nt, Human
augaaccucaagcugcaucuaga

SEQ ID NO: 3787448 - RNA, 14 nt, Human
augaaccuucuggc

SEQ ID NO: 3787449 - RNA, 17 nt, Human
augaaccuucuggccuc

SEQ ID NO: 3787450 - RNA, 16 nt, Human
augaacggugagcauu

SEQ ID NO: 3787451 - RNA, 14 nt, Human
augaacucaacuuu

SEQ ID NO: 3787452 - RNA, 19 nt, Human
augaacugcauguauaaau

SEQ ID NO: 3787453 - RNA, 20 nt, Human
augaacugcauguauaaaug

SEQ ID NO: 3787454 - RNA, 19 nt, Human
augaacuggaggccaggaa

SEQ ID NO: 3787455 - RNA, 16 nt, Human
augaacuuaacaugcu

SEQ ID NO: 3787456 - RNA, 20 nt, Human
augaacuuagauuuuacaug

SEQ ID NO: 3787457 - RNA, 17 nt, Human
augaacuuauucuguag

SEQ ID NO: 3787458 - RNA, 20 nt, Human
augaacuucgcaucaaaaga

SEQ ID NO: 3787459 - RNA, 22 nt, Human
augaacuucgcaucaaaagaca

SEQ ID NO: 3787460 - RNA, 23 nt, Human
augaacuucgcaucaaaagacaa

SEQ ID NO: 3787461 - RNA, 22 nt, Human
augaagaaaagugggccagugu

SEQ ID NO: 3787462 - RNA, 22 nt, Human
augaagaaaauacuuaaauguu

SEQ ID NO: 3787463 - RNA, 23 nt, Human
augaagaaaauacuuaaauguua

SEQ ID NO: 3787464 - RNA, 15 nt, Human
augaagaacugagga

SEQ ID NO: 3787465 - RNA, 17 nt, Human
augaagaauagaaacaa

SEQ ID NO: 3787466 - RNA, 24 nt, Human
augaagaccuuuuucugcacuaua

SEQ ID NO: 3787467 - RNA, 19 nt, Human
augaagacucgcaauuuca

SEQ ID NO: 3787468 - RNA, 18 nt, Human
augaagagaagcaauuuu

SEQ ID NO: 3787469 - RNA, 13 nt, Human
augaagagcaaaa

SEQ ID NO: 3787470 - RNA, 18 nt, Human
augaagagugagagggca

SEQ ID NO: 3787471 - RNA, 21 nt, Human
augaagauaccaucagcaaag

SEQ ID NO: 3787472 - RNA, 22 nt, Human
augaagauauuuuuccauuuuu

SEQ ID NO: 3787473 - RNA, 18 nt, Human
augaagauguagaggaga

SEQ ID NO: 3787474 - RNA, 12 nt, Human
augaagauuauu

SEQ ID NO: 3787475 - RNA, 15 nt, Human
aggggcccuggagca

SEQ ID NO: 3787476 - RNA, 20 nt, Human
aggggcccuuggagcgugga

SEQ ID NO: 3787477 - RNA, 19 nt, Human
aggggccgaugcccagaga

SEQ ID NO: 3787478 - RNA, 16 nt, Human
aggggccgcugccacc

SEQ ID NO: 3787479 - RNA, 17 nt, Human
aggggccgggggcaguc

SEQ ID NO: 3787480 - RNA, 19 nt, Human
aggggccucuuaugggcug

SEQ ID NO: 3787481 - RNA, 12 nt, Human
aggggccugagc

SEQ ID NO: 3787482 - RNA, 17 nt, Human
aggggccugccaccugg

SEQ ID NO: 3787483 - RNA, 21 nt, Human
aggggccugccaccuggaccc

SEQ ID NO: 3787484 - RNA, 13 nt, Human
aggggccugccca

SEQ ID NO: 3787485 - RNA, 14 nt, Human
aggggccugcccag

SEQ ID NO: 3787486 - RNA, 21 nt, Human
aggggccuggagauccuccug

SEQ ID NO: 3787487 - RNA, 16 nt, Human
aggggcgcccaccucc

SEQ ID NO: 3787488 - RNA, 16 nt, Human
aggggcgcuggcccag

SEQ ID NO: 3787489 - RNA, 20 nt, Human
aggggcgcuggcccagccgg

SEQ ID NO: 3787490 - RNA, 23 nt, Human
aggggcgcuggcccagccggccu

SEQ ID NO: 3787491 - RNA, 17 nt, Human
aggggcggcaggaggga

SEQ ID NO: 3787492 - RNA, 20 nt, Human
aggggcggcaggagggaggu

SEQ ID NO: 3787493 - RNA, 21 nt, Human
aggggcgggaauauuguuucu

SEQ ID NO: 3787494 - RNA, 19 nt, Human
aggggcgucuguucccccu

SEQ ID NO: 3787495 - RNA, 20 nt, Human
aggggcgugggaguggccug

SEQ ID NO: 3787496 - RNA, 14 nt, Human
aggggcguguggcu

SEQ ID NO: 3787497 - RNA, 14 nt, Human
aggggcuaccagga

SEQ ID NO: 3787498 - RNA, 15 nt, Human
aggggcuaccaggaa

SEQ ID NO: 3787499 - RNA, 17 nt, Human
aggggcuaccaggaaag

SEQ ID NO: 3787500 - RNA, 20 nt, Human
aggggcuagaaccuagagaa

SEQ ID NO: 3787501 - RNA, 15 nt, Human
aggggcucaggaaaa

SEQ ID NO: 3787502 - RNA, 16 nt, Human
aggggcuccaugccag

SEQ ID NO: 3787503 - RNA, 23 nt, Human
aggggcuccuggaaaggcucagu

SEQ ID NO: 3787504 - RNA, 22 nt, Human
aggggcucucagcucagcgcca

SEQ ID NO: 3787505 - RNA, 15 nt, Human
aggggcucuggagag

SEQ ID NO: 3787506 - RNA, 15 nt, Human
aggggcugcccgcuc

SEQ ID NO: 3787507 - RNA, 20 nt, Human
aggggcugcccgcucccagu

SEQ ID NO: 3787508 - RNA, 20 nt, Human
aggggcugcuuccuccugga

SEQ ID NO: 3787509 - RNA, 21 nt, Human
aggggcugcuuccuccuggaa

SEQ ID NO: 3787510 - RNA, 15 nt, Human
aggggcuggacuggc

SEQ ID NO: 3787511 - RNA, 18 nt, Human
aggggcuggacuggcugu

SEQ ID NO: 3787512 - RNA, 23 nt, Human
aggggcuggccuuccugcccuac

SEQ ID NO: 3787513 - RNA, 17 nt, Human
aggggcuggcuucagga

SEQ ID NO: 3787514 - RNA, 19 nt, Human
aggggcuggcuucaggagg

SEQ ID NO: 3787515 - RNA, 21 nt, Human
aggggcuuaauuauugauguu

SEQ ID NO: 3787516 - RNA, 12 nt, Human
agggggagaaaa

SEQ ID NO: 3787517 - RNA, 21 nt, Human
agggggagaaaaggaaaagaa

SEQ ID NO: 3787518 - RNA, 21 nt, Human
agggggagccccuucugcuca

SEQ ID NO: 3787519 - RNA, 15 nt, Human
agggggaggggaagu

SEQ ID NO: 3787520 - RNA, 13 nt, Human
augaauaauggaa

SEQ ID NO: 3787521 - RNA, 14 nt, Human
augaauacaaauuu

SEQ ID NO: 3787522 - RNA, 16 nt, Human
augaauacagcagcaa

SEQ ID NO: 3787523 - RNA, 21 nt, Human
augaauacagggcaugcauuu

SEQ ID NO: 3787524 - RNA, 12 nt, Human
augaauauaaaa

SEQ ID NO: 3787525 - RNA, 23 nt, Human
augaauauauuuaagcaacaucu

SEQ ID NO: 3787526 - RNA, 18 nt, Human
augaauaucuauuaauau

SEQ ID NO: 3787527 - RNA, 14 nt, Human
augaauaugaugac

SEQ ID NO: 3787528 - RNA, 12 nt, Human
augaauauuuug

SEQ ID NO: 3787529 - RNA, 14 nt, Human
augaauauuuugau

SEQ ID NO: 3787530 - RNA, 22 nt, Human
augaauauuuugauaauaauau

SEQ ID NO: 3787531 - RNA, 14 nt, Human
augaaucaaagaca

SEQ ID NO: 3787532 - RNA, 13 nt, Human
augaaucacuguu

SEQ ID NO: 3787533 - RNA, 19 nt, Human
augaaucacuguuuuuaga

SEQ ID NO: 3787534 - RNA, 23 nt, Human
augaaucacuguuuuuagacacc

SEQ ID NO: 3787535 - RNA, 11 nt, Human
augaaucuaug

SEQ ID NO: 3787536 - RNA, 21 nt, Human
augaaucuaugccaaagauca

SEQ ID NO: 3787537 - RNA, 23 nt, Human
augaaucugucucccaguuauga

SEQ ID NO: 3787538 - RNA, 22 nt, Human
augaaugacuuccccaauaucu

SEQ ID NO: 3787539 - RNA, 23 nt, Human
augaaugacuuccccaauaucuu

SEQ ID NO: 3787540 - RNA, 21 nt, Human
augaaugcccagugagacugu

SEQ ID NO: 3787541 - RNA, 20 nt, Human
augaaugcccccagcuggcc

SEQ ID NO: 3787542 - RNA, 21 nt, Human
augaaugcccccagcuggccc

SEQ ID NO: 3787543 - RNA, 21 nt, Human
augaaugcuuaaagaauucaa

SEQ ID NO: 3787544 - RNA, 21 nt, Human
augaaugggcaaaacugaauu

SEQ ID NO: 3787545 - RNA, 19 nt, Human
augaauguaaauuuguacu

SEQ ID NO: 3787546 - RNA, 17 nt, Human
augaauguaugugcacu

SEQ ID NO: 3787547 - RNA, 15 nt, Human
augaauguauuuauu

SEQ ID NO: 3787548 - RNA, 17 nt, Human
augaauguauuuauuug

SEQ ID NO: 3787549 - RNA, 20 nt, Human
augaauguauuuauuuggga

SEQ ID NO: 3787550 - RNA, 19 nt, Human
augaaugucacuucuggau

SEQ ID NO: 3787551 - RNA, 14 nt, Human
augaaugugaagcc

SEQ ID NO: 3787552 - RNA, 16 nt, Human
augaaugugaagccuu

SEQ ID NO: 3787553 - RNA, 23 nt, Human
augaauguuccugccuccuugau

SEQ ID NO: 3787554 - RNA, 22 nt, Human
augaauguuuacacucuuugua

SEQ ID NO: 3787555 - RNA, 15 nt, Human
augaauuacauuugu

SEQ ID NO: 3787556 - RNA, 18 nt, Human
augaauuacauuuguaua

SEQ ID NO: 3787557 - RNA, 21 nt, Human
augaauugcguuggucucugc

SEQ ID NO: 3787558 - RNA, 22 nt, Human
augaauuguacagaauauuucu

SEQ ID NO: 3787559 - RNA, 21 nt, Human
augaauuuauugcacauuguu

SEQ ID NO: 3787560 - RNA, 15 nt, Human
augaauuuggagacu

SEQ ID NO: 3787561 - RNA, 14 nt, Human
augaauuuguaaug

SEQ ID NO: 3787562 - RNA, 19 nt, Human
augaauuuguaaugucuug

SEQ ID NO: 3787563 - RNA, 17 nt, Human
augaauuuuaaaaucug

SEQ ID NO: 3787564 - RNA, 15 nt, Human
augaauuuuaagggu

SEQ ID NO: 3787565 - RNA, 14 nt, Human
augaauuuuagcuu

SEQ ID NO: 3787566 - RNA, 16 nt, Human
augaauuuuagcuuuu

SEQ ID NO: 3787567 - RNA, 18 nt, Human
augaauuuucaaguaauu

SEQ ID NO: 3787568 - RNA, 22 nt, Human
augaauuuucaaguaauuguga

SEQ ID NO: 3787569 - RNA, 15 nt, Human
augacaaaaauucaa

SEQ ID NO: 3787570 - RNA, 19 nt, Human
augacaaaaauucaacuca

SEQ ID NO: 3787571 - RNA, 18 nt, Human
augacaacuggaauaguu

SEQ ID NO: 3787572 - RNA, 19 nt, Human
augacaacuggaauaguuu

SEQ ID NO: 3787573 - RNA, 19 nt, Human
augacaacuucuaauugcc

SEQ ID NO: 3787574 - RNA, 15 nt, Human
augacaagccccagg

SEQ ID NO: 3787575 - RNA, 15 nt, Human
augacaauaaagcuu

SEQ ID NO: 3787576 - RNA, 17 nt, Human
augacacauuuggcagu

SEQ ID NO: 3787577 - RNA, 15 nt, Human
augacaccaucuuuu

SEQ ID NO: 3787578 - RNA, 16 nt, Human
augacaccaucuuuua

SEQ ID NO: 3787579 - RNA, 17 nt, Human
augacacugaaaugccu

SEQ ID NO: 3787580 - RNA, 16 nt, Human
augacacugagaacag

SEQ ID NO: 3787581 - RNA, 20 nt, Human
augacagaaaauauguauua

SEQ ID NO: 3787582 - RNA, 16 nt, Human
augacagauguugaau

SEQ ID NO: 3787583 - RNA, 16 nt, Human
augacagccugcagca

SEQ ID NO: 3787584 - RNA, 15 nt, Human
augacaggccugucc

SEQ ID NO: 3787585 - RNA, 22 nt, Human
augacaguaauuguguuuacau

SEQ ID NO: 3787586 - RNA, 19 nt, Human
augacaguccgucaaaaca

SEQ ID NO: 3787587 - RNA, 20 nt, Human
augacaguccgucaaaacag

SEQ ID NO: 3787588 - RNA, 17 nt, Human
augacaguguuccccga

SEQ ID NO: 3787589 - RNA, 20 nt, Human
augacauaacagugcagggc

SEQ ID NO: 3787590 - RNA, 23 nt, Human
augacauacgcuuuuaaugaaaa

SEQ ID NO: 3787591 - RNA, 20 nt, Human
augacaucuuuuuaaagcuu

SEQ ID NO: 3787592 - RNA, 21 nt, Human
augacaucuuuuuaaagcuua

SEQ ID NO: 3787593 - RNA, 22 nt, Human
augacaugaggaaaauaaugua

SEQ ID NO: 3787594 - RNA, 16 nt, Human
augacaugcacugacc

SEQ ID NO: 3787595 - RNA, 17 nt, Human
augacaugcacugaccc

SEQ ID NO: 3787596 - RNA, 18 nt, Human
augacaugcacugacccu

SEQ ID NO: 3787597 - RNA, 19 nt, Human
augacaugcacugacccuu

SEQ ID NO: 3787598 - RNA, 22 nt, Human
augacaugcacugacccuucca

SEQ ID NO: 3787599 - RNA, 13 nt, Human
augacauguguca

SEQ ID NO: 3787600 - RNA, 15 nt, Human
augacauguuauaua

SEQ ID NO: 3787601 - RNA, 22 nt, Human
augacauuaaagaaggguugag

SEQ ID NO: 3787602 - RNA, 16 nt, Human
augacauucaugccug

SEQ ID NO: 3787603 - RNA, 18 nt, Human
augacauucaugccuggc

SEQ ID NO: 3787604 - RNA, 16 nt, Human
augacauugacuauuu

SEQ ID NO: 3787605 - RNA, 20 nt, Human
augacauuggauagaacaug

SEQ ID NO: 3787606 - RNA, 22 nt, Human
augacauuucuuugugcuuugg

SEQ ID NO: 3787607 - RNA, 20 nt, Human
augaccaauuuuaacuuaga

SEQ ID NO: 3787608 - RNA, 18 nt, Human
augaccacacuccagcug

SEQ ID NO: 3787609 - RNA, 13 nt, Human
augaccaguaaag

SEQ ID NO: 3787610 - RNA, 13 nt, Human
augacccaaagac

SEQ ID NO: 3787611 - RNA, 15 nt, Human
augacccaaagacca

SEQ ID NO: 3787612 - RNA, 16 nt, Human
augacccaaagaccaa

SEQ ID NO: 3787613 - RNA, 16 nt, Human
augacccaccccugug

SEQ ID NO: 3787614 - RNA, 15 nt, Human
augacccaggcuggg

SEQ ID NO: 3787615 - RNA, 22 nt, Human
augacccagugguuccuaaucc

SEQ ID NO: 3787616 - RNA, 16 nt, Human
augacccccccagcuu

SEQ ID NO: 3787617 - RNA, 18 nt, Human
augacccugccucuccca

SEQ ID NO: 3787618 - RNA, 23 nt, Human
augacccugccucucccaggcag

SEQ ID NO: 3787619 - RNA, 20 nt, Human
augaccucauuaaccgaugc

SEQ ID NO: 3787620 - RNA, 20 nt, Human
augaccucuguccucccucu

SEQ ID NO: 3787621 - RNA, 21 nt, Human
augaccuuauccuuccucucc

SEQ ID NO: 3787622 - RNA, 17 nt, Human
augaccuucuaggaagc

SEQ ID NO: 3787623 - RNA, 18 nt, Human
augaccuuguaauguaac

SEQ ID NO: 3787624 - RNA, 13 nt, Human
augaccuuucaau

SEQ ID NO: 3787625 - RNA, 15 nt, Human
augaccuuucaauag

SEQ ID NO: 3787626 - RNA, 22 nt, Human
augaccuuucaauaggaaaaac

SEQ ID NO: 3787627 - RNA, 21 nt, Human
augacgacaaagcugcuaaau

SEQ ID NO: 3787628 - RNA, 13 nt, Human
augccauaauaca

SEQ ID NO: 3787629 - RNA, 17 nt, Human
augccauaauacaaaag

SEQ ID NO: 3787630 - RNA, 16 nt, Human
augccaucaucuccug

SEQ ID NO: 3787631 - RNA, 18 nt, Human
augccauggacagaagaa

SEQ ID NO: 3787632 - RNA, 16 nt, Human
augccauuuguacuga

SEQ ID NO: 3787633 - RNA, 19 nt, Human
augcccacccccugcccug

SEQ ID NO: 3787634 - RNA, 17 nt, Human
augcccacguucuuucc

SEQ ID NO: 3787635 - RNA, 11 nt, Human
augcccagaga

SEQ ID NO: 3787636 - RNA, 16 nt, Human
augcccagagacccag

SEQ ID NO: 3787637 - RNA, 18 nt, Human
augcccagagacccagcg

SEQ ID NO: 3787638 - RNA, 11 nt, Human
augcccagccc

SEQ ID NO: 3787639 - RNA, 13 nt, Human
augcccagccccu

SEQ ID NO: 3787640 - RNA, 15 nt, Human
augcccagcguuuga

SEQ ID NO: 3787641 - RNA, 21 nt, Human
augcccagggccacucugccu

SEQ ID NO: 3787642 - RNA, 16 nt, Human
augcccagugagacug

SEQ ID NO: 3787643 - RNA, 17 nt, Human
augcccaguuucugccu

SEQ ID NO: 3787644 - RNA, 18 nt, Human
augcccaguuucugccuc

SEQ ID NO: 3787645 - RNA, 15 nt, Human
augccccggccaccu

SEQ ID NO: 3787646 - RNA, 17 nt, Human
augccccggccaccucu

SEQ ID NO: 3787647 - RNA, 18 nt, Human
augccccgucccccucug

SEQ ID NO: 3787648 - RNA, 16 nt, Human
augccccuggcuggga

SEQ ID NO: 3787649 - RNA, 13 nt, Human
augcccucccuuc

SEQ ID NO: 3787650 - RNA, 23 nt, Human
augcccuccucucccauuguccc

SEQ ID NO: 3787651 - RNA, 14 nt, Human
augcccuggaggug

SEQ ID NO: 3787652 - RNA, 14 nt, Human
augcccuggaucca

SEQ ID NO: 3787653 - RNA, 19 nt, Human
augcccuggauccaucagg

SEQ ID NO: 3787654 - RNA, 12 nt, Human
augcccugugca

SEQ ID NO: 3787655 - RNA, 19 nt, Human
augccgauauacucuagau

SEQ ID NO: 3787656 - RNA, 15 nt, Human
augccgauuucugua

SEQ ID NO: 3787657 - RNA, 18 nt, Human
augccgcgaugggucagg

SEQ ID NO: 3787658 - RNA, 14 nt, Human
augccggaugugcu

SEQ ID NO: 3787659 - RNA, 15 nt, Human
augccggaugugcuu

SEQ ID NO: 3787660 - RNA, 22 nt, Human
augccguggauugcacguggcc

SEQ ID NO: 3787661 - RNA, 20 nt, Human
augccguuacuuuucauauu

SEQ ID NO: 3787662 - RNA, 15 nt, Human
augccuaagaagaug

SEQ ID NO: 3787663 - RNA, 20 nt, Human
augccuaagaagaugacuuc

SEQ ID NO: 3787664 - RNA, 15 nt, Human
agggugggugcucag

SEQ ID NO: 3787665 - RNA, 16 nt, Human
agggugggugcucaga

SEQ ID NO: 3787666 - RNA, 23 nt, Human
aggguggugcugggacugagcca

SEQ ID NO: 3787667 - RNA, 17 nt, Human
agggugguggagccagu

SEQ ID NO: 3787668 - RNA, 20 nt, Human
agggugguucaacaaagaaa

SEQ ID NO: 3787669 - RNA, 15 nt, Human
agggugucugccccc

SEQ ID NO: 3787670 - RNA, 23 nt, Human
aggguguggggccaugccuccuc

SEQ ID NO: 3787671 - RNA, 17 nt, Human
aggguuaugauuaagua

SEQ ID NO: 3787672 - RNA, 18 nt, Human
aggguuauugcauuugga

SEQ ID NO: 3787673 - RNA, 22 nt, Human
aggguucaaaaugucuguagcu

SEQ ID NO: 3787674 - RNA, 18 nt, Human
aggguucagagacucagg

SEQ ID NO: 3787675 - RNA, 17 nt, Human
aggguucccgcggggcu

SEQ ID NO: 3787676 - RNA, 19 nt, Human
aggguucccgcggggcugu

SEQ ID NO: 3787677 - RNA, 23 nt, Human
aggguuccuguagaccuagggag

SEQ ID NO: 3787678 - RNA, 14 nt, Human
aggguucugccucu

SEQ ID NO: 3787679 - RNA, 19 nt, Human
aggguucugccucuccagg

SEQ ID NO: 3787680 - RNA, 18 nt, Human
aggguugaccccagagga

SEQ ID NO: 3787681 - RNA, 14 nt, Human
aggguugaucacac

SEQ ID NO: 3787682 - RNA, 16 nt, Human
aggguugcuggagccu

SEQ ID NO: 3787683 - RNA, 20 nt, Human
aggguuggcaccuucccccu

SEQ ID NO: 3787684 - RNA, 17 nt, Human
aggguuggccccugccc

SEQ ID NO: 3787685 - RNA, 14 nt, Human
aggguugugauuuu

SEQ ID NO: 3787686 - RNA, 14 nt, Human
aggguuuaaagaug

SEQ ID NO: 3787687 - RNA, 20 nt, Human
aggguuuauguuuaggaugu

SEQ ID NO: 3787688 - RNA, 19 nt, Human
aggguuucgagaagcugcu

SEQ ID NO: 3787689 - RNA, 20 nt, Human
aggguuuggcugugucuaaa

SEQ ID NO: 3787690 - RNA, 22 nt, Human
aggguuuggcugugucuaaacu

SEQ ID NO: 3787691 - RNA, 18 nt, Human
aggguuugugacagggcg

SEQ ID NO: 3787692 - RNA, 21 nt, Human
aggguuugugacagggcgggg

SEQ ID NO: 3787693 - RNA, 22 nt, Human
aggguuuugccauguuggccag

SEQ ID NO: 3787694 - RNA, 13 nt, Human
aggguuuuuaccu

SEQ ID NO: 3787695 - RNA, 22 nt, Human
aggguuuuuaccugucacauug

SEQ ID NO: 3787696 - RNA, 14 nt, Human
agguaaaacagggc

SEQ ID NO: 3787697 - RNA, 13 nt, Human
agguaaaaugcca

SEQ ID NO: 3787698 - RNA, 16 nt, Human
agguaaaaugccauga

SEQ ID NO: 3787699 - RNA, 14 nt, Human
agguaaaauguauu

SEQ ID NO: 3787700 - RNA, 16 nt, Human
agguaaaauguauuuu

SEQ ID NO: 3787701 - RNA, 14 nt, Human
agguaaaauucuaa

SEQ ID NO: 3787702 - RNA, 19 nt, Human
agguaaaauucuaaauaaa

SEQ ID NO: 3787703 - RNA, 14 nt, Human
agguaaacaguucu

SEQ ID NO: 3787704 - RNA, 14 nt, Human
agguaaauaaaaag

SEQ ID NO: 3787705 - RNA, 20 nt, Human
agguaaauaaaaagaaaggc

SEQ ID NO: 3787706 - RNA, 23 nt, Human
agguaaaucagacuaugaaguuu

SEQ ID NO: 3787707 - RNA, 13 nt, Human
agguaacagaaca

SEQ ID NO: 3787708 - RNA, 21 nt, Human
agguaacagaacagcuucagg

SEQ ID NO: 3787709 - RNA, 23 nt, Human
agguaacagaacagcuucagguu

SEQ ID NO: 3787710 - RNA, 19 nt, Human
agguaagggugacaaaugg

SEQ ID NO: 3787711 - RNA, 19 nt, Human
agguaaugaccaugaaaga

SEQ ID NO: 3787712 - RNA, 20 nt, Human
agguaaugaccaugaaagac

SEQ ID NO: 3787713 - RNA, 21 nt, Human
agguaauuuuuacccuaaugu

SEQ ID NO: 3787714 - RNA, 16 nt, Human
agguacaagaagcauu

SEQ ID NO: 3787715 - RNA, 14 nt, Human
agguacacuuguga

SEQ ID NO: 3787716 - RNA, 16 nt, Human
agguacacuugugaau

SEQ ID NO: 3787717 - RNA, 15 nt, Human
agguacagagaagga

SEQ ID NO: 3787718 - RNA, 18 nt, Human
agguacagagaccucccu

SEQ ID NO: 3787719 - RNA, 21 nt, Human
agguaccacugauuuggagau

SEQ ID NO: 3787720 - RNA, 22 nt, Human
agguaccagcaauauguaaaua

SEQ ID NO: 3787721 - RNA, 16 nt, Human
agguaccagcugcgcu

SEQ ID NO: 3787722 - RNA, 12 nt, Human
agguaccauccu

SEQ ID NO: 3787723 - RNA, 18 nt, Human
agguacccaauagcugcc

SEQ ID NO: 3787724 - RNA, 20 nt, Human
agguacccaauagcugccca

SEQ ID NO: 3787725 - RNA, 19 nt, Human
agguaccccagcucugcuu

SEQ ID NO: 3787726 - RNA, 21 nt, Human
agguaccccagcucugcuugc

SEQ ID NO: 3787727 - RNA, 17 nt, Human
agguaccccuuucuggc

SEQ ID NO: 3787728 - RNA, 22 nt, Human
agguaccuugaccuuuguacag

SEQ ID NO: 3787729 - RNA, 16 nt, Human
agguaccuuucacaua

SEQ ID NO: 3787730 - RNA, 13 nt, Human
agguacgcacaga

SEQ ID NO: 3787731 - RNA, 12 nt, Human
agguacuauuau

SEQ ID NO: 3787732 - RNA, 14 nt, Human
agguacuauucuga

SEQ ID NO: 3787733 - RNA, 11 nt, Human
agguacuguau

SEQ ID NO: 3787734 - RNA, 15 nt, Human
agguacuguaugauc

SEQ ID NO: 3787735 - RNA, 21 nt, Human
agguacuguaugaucaaaugu

SEQ ID NO: 3787736 - RNA, 23 nt, Human
agguagaaauaucugaaaaugua

SEQ ID NO: 3787737 - RNA, 15 nt, Human
agguagaaccucacc

SEQ ID NO: 3787738 - RNA, 18 nt, Human
agguagaacgccagggac

SEQ ID NO: 3787739 - RNA, 17 nt, Human
agguagaauguuuucaa

SEQ ID NO: 3787740 - RNA, 20 nt, Human
agguagaccaggauuucuaa

SEQ ID NO: 3787741 - RNA, 19 nt, Human
agguagacuuuuaugagaa

SEQ ID NO: 3787742 - RNA, 15 nt, Human
agguagagucugagg

SEQ ID NO: 3787743 - RNA, 19 nt, Human
agguagcugaaaggggaag

SEQ ID NO: 3787744 - RNA, 14 nt, Human
agguaggccaaggu

SEQ ID NO: 3787745 - RNA, 15 nt, Human
agguagggagauauu

SEQ ID NO: 3787746 - RNA, 17 nt, Human
agguaggggccccucuc

SEQ ID NO: 3787747 - RNA, 22 nt, Human
agguaggggccccucucagccc

SEQ ID NO: 3787748 - RNA, 20 nt, Human
agguagguggaucaccugag

SEQ ID NO: 3787749 - RNA, 15 nt, Human
agguagucucacugc

SEQ ID NO: 3787750 - RNA, 22 nt, Human
agguaguucaagaaaugaagag

SEQ ID NO: 3787751 - RNA, 23 nt, Human
agguaguucaagaaaugaagagc

SEQ ID NO: 3787752 - RNA, 12 nt, Human
agguauaauugu

SEQ ID NO: 3787753 - RNA, 14 nt, Human
agguauauacuuug

SEQ ID NO: 3787754 - RNA, 15 nt, Human
agguauaucauucua

SEQ ID NO: 3787755 - RNA, 18 nt, Human
agguauaucauucuaaag

SEQ ID NO: 3787756 - RNA, 20 nt, Human
agguauggaaggguuugugg

SEQ ID NO: 3787757 - RNA, 14 nt, Human
agguauguugccuu

SEQ ID NO: 3787758 - RNA, 20 nt, Human
agguauuaaaacuaaauuuc

SEQ ID NO: 3787759 - RNA, 16 nt, Human
agguauuauuaucuuu

SEQ ID NO: 3787760 - RNA, 17 nt, Human
agguauuuuguuucuuu

SEQ ID NO: 3787761 - RNA, 20 nt, Human
agguauuuuguuucuuuuaa

SEQ ID NO: 3787762 - RNA, 17 nt, Human
aggucaacagaaugaaa

SEQ ID NO: 3787763 - RNA, 22 nt, Human
aggucaacagaaugaaaaauga

SEQ ID NO: 3787764 - RNA, 18 nt, Human
aggucaagcccaggagga

SEQ ID NO: 3787765 - RNA, 20 nt, Human
aggucaaggccugucccugg

SEQ ID NO: 3787766 - RNA, 22 nt, Human
aggucaaguaagaagacaugaa

SEQ ID NO: 3787767 - RNA, 21 nt, Human
aggucaaugccagagacggaa

SEQ ID NO: 3787768 - RNA, 15 nt, Human
aggucacauaaaacu

SEQ ID NO: 3787769 - RNA, 20 nt, Human
aggucaccucacucagcacc

SEQ ID NO: 3787770 - RNA, 14 nt, Human
aggucacuccuggg

SEQ ID NO: 3787771 - RNA, 15 nt, Human
aggucacuccugggg

SEQ ID NO: 3787772 - RNA, 23 nt, Human
aggucacucuuccugcaaggacu

SEQ ID NO: 3787773 - RNA, 16 nt, Human
aggucacuggcucucc

SEQ ID NO: 3787774 - RNA, 21 nt, Human
aggucacuggcucuccaagug

SEQ ID NO: 3787775 - RNA, 16 nt, Human
aggucacuguuuccug

SEQ ID NO: 3787776 - RNA, 18 nt, Human
aggucacuguuuccuggg

SEQ ID NO: 3787777 - RNA, 19 nt, Human
aggucagacuaagaaauau

SEQ ID NO: 3787778 - RNA, 19 nt, Human
aggucagcgugcuuagccu

SEQ ID NO: 3787779 - RNA, 21 nt, Human
aggucaggagaucgagaccau

SEQ ID NO: 3787780 - RNA, 16 nt, Human
aggucaggaguuccua

SEQ ID NO: 3787781 - RNA, 13 nt, Human
aggucaggcccug

SEQ ID NO: 3787782 - RNA, 21 nt, Human
augacggaagaacauagaacu

SEQ ID NO: 3787783 - RNA, 16 nt, Human
augacgguauuaugcu

SEQ ID NO: 3787784 - RNA, 20 nt, Human
augacgguauuaugcuucuu

SEQ ID NO: 3787785 - RNA, 19 nt, Human
augacguacaaguaguucu

SEQ ID NO: 3787786 - RNA, 20 nt, Human
augacguacaaguaguucug

SEQ ID NO: 3787787 - RNA, 14 nt, Human
augacuaaagagag

SEQ ID NO: 3787788 - RNA, 15 nt, Human
augacuaaagagaga

SEQ ID NO: 3787789 - RNA, 17 nt, Human
augacuaaagagagaau

SEQ ID NO: 3787790 - RNA, 17 nt, Human
augacuaauucuugcau

SEQ ID NO: 3787791 - RNA, 20 nt, Human
augacuagaaagugaauaaa

SEQ ID NO: 3787792 - RNA, 22 nt, Human
augacuagaggcagggagggga

SEQ ID NO: 3787793 - RNA, 15 nt, Human
augacuauguaaacu

SEQ ID NO: 3787794 - RNA, 12 nt, Human
augacuccagaa

SEQ ID NO: 3787795 - RNA, 17 nt, Human
augacuccauagaccuu

SEQ ID NO: 3787796 - RNA, 15 nt, Human
augacucuuuauugu

SEQ ID NO: 3787797 - RNA, 13 nt, Human
augacugaauggg

SEQ ID NO: 3787798 - RNA, 13 nt, Human
augacugcacaug

SEQ ID NO: 3787799 - RNA, 21 nt, Human
augacugcuccccagcccugg

SEQ ID NO: 3787800 - RNA, 22 nt, Human
augacugcuccccagcccuggc

SEQ ID NO: 3787801 - RNA, 12 nt, Human
augacugcuugc

SEQ ID NO: 3787802 - RNA, 13 nt, Human
augacugcuugcc

SEQ ID NO: 3787803 - RNA, 21 nt, Human
augacugcuugcccuaagcag

SEQ ID NO: 3787804 - RNA, 15 nt, Human
augacuggaauuuuu

SEQ ID NO: 3787805 - RNA, 16 nt, Human
augacuggcauuuuau

SEQ ID NO: 3787806 - RNA, 18 nt, Human
augacuggggugggaggu

SEQ ID NO: 3787807 - RNA, 17 nt, Human
augacugugauuuucag

SEQ ID NO: 3787808 - RNA, 12 nt, Human
aaaaaucaucua

SEQ ID NO: 3787809 - RNA, 17 nt, Human
aaaaaucaucuauuuug

SEQ ID NO: 3787810 - RNA, 21 nt, Human
aaaaauccaaauauuguuaag

SEQ ID NO: 3787811 - RNA, 15 nt, Human
aaaaauccuucuaau

SEQ ID NO: 3787812 - RNA, 18 nt, Human
aaaaaucuaccuucugua

SEQ ID NO: 3787813 - RNA, 19 nt, Human
aaaaaucuaccuucuguag

SEQ ID NO: 3787814 - RNA, 14 nt, Human
aaaaaucuauauuu

SEQ ID NO: 3787815 - RNA, 18 nt, Human
aaaaaucugcuguuaacu

SEQ ID NO: 3787816 - RNA, 12 nt, Human
aaaaaucuguuu

SEQ ID NO: 3787817 - RNA, 19 nt, Human
aaaaaucuuaauacuguua

SEQ ID NO: 3787818 - RNA, 13 nt, Human
aaaaaucuugugc

SEQ ID NO: 3787819 - RNA, 14 nt, Human
aaaaaugacagacu

SEQ ID NO: 3787820 - RNA, 12 nt, Human
aaaaaugagaac

SEQ ID NO: 3787821 - RNA, 22 nt, Human
aaaaaugagcuugauuaaauca

SEQ ID NO: 3787822 - RNA, 20 nt, Human
aaaaaugcaaauccuaugug

SEQ ID NO: 3787823 - RNA, 23 nt, Human
aaaaaugcaaauccuaugugauu

SEQ ID NO: 3787824 - RNA, 17 nt, Human
aaaaaugccauaauaca

SEQ ID NO: 3787825 - RNA, 22 nt, Human
aaaaaugccauaauacaaaagg

SEQ ID NO: 3787826 - RNA, 12 nt, Human
aaaaaugccuuu

SEQ ID NO: 3787827 - RNA, 14 nt, Human
aaaaaugccuuuga

SEQ ID NO: 3787828 - RNA, 15 nt, Human
aaaaaugccuuugag

SEQ ID NO: 3787829 - RNA, 18 nt, Human
aaaaaugccuuugagaca

SEQ ID NO: 3787830 - RNA, 21 nt, Human
aaaaaugccuuugagacaguu

SEQ ID NO: 3787831 - RNA, 13 nt, Human
aaaaaugcuaaua

SEQ ID NO: 3787832 - RNA, 19 nt, Human
aaaaauggaaaaauaaaca

SEQ ID NO: 3787833 - RNA, 18 nt, Human
aaaaaugggacuucuuuu

SEQ ID NO: 3787834 - RNA, 16 nt, Human
aaaaaugguaaaauug

SEQ ID NO: 3787835 - RNA, 12 nt, Human
aaaaauguaaau

SEQ ID NO: 3787836 - RNA, 18 nt, Human
aaaaaugucaaaaguaga

SEQ ID NO: 3787837 - RNA, 12 nt, Human
aaaaaugucuua

SEQ ID NO: 3787838 - RNA, 18 nt, Human
aaaaaugugcaaaacagc

SEQ ID NO: 3787839 - RNA, 12 nt, Human
aaaaauguguaa

SEQ ID NO: 3787840 - RNA, 22 nt, Human
aaaaauguuaagcaucuaagga

SEQ ID NO: 3787841 - RNA, 20 nt, Human
aaaaauguuggauuuauaaa

SEQ ID NO: 3787842 - RNA, 22 nt, Human
aaaaauguuggauuuauaaaug

SEQ ID NO: 3787843 - RNA, 20 nt, Human
aaaaauguuuuuucaugugu

SEQ ID NO: 3787844 - RNA, 11 nt, Human
aaaaauuaaaa

SEQ ID NO: 3787845 - RNA, 17 nt, Human
aaaaauuaaaauggaug

SEQ ID NO: 3787846 - RNA, 13 nt, Human
aaaaauuacaguu

SEQ ID NO: 3787847 - RNA, 16 nt, Human
aaaaauuacuuaguau

SEQ ID NO: 3787848 - RNA, 19 nt, Human
aaaaauuaucuauagcuaa

SEQ ID NO: 3787849 - RNA, 18 nt, Human
aaaaauuaucuauuugua

SEQ ID NO: 3787850 - RNA, 22 nt, Human
aaaaauuaucuauuuguauaua

SEQ ID NO: 3787851 - RNA, 19 nt, Human
aaaaauuauugauugcuuu

SEQ ID NO: 3787852 - RNA, 15 nt, Human
aaaaauucaauagua

SEQ ID NO: 3787853 - RNA, 17 nt, Human
aaaaauucaauaguaau

SEQ ID NO: 3787854 - RNA, 14 nt, Human
aaaaauugaaaugu

SEQ ID NO: 3787855 - RNA, 13 nt, Human
aaaaauugaagag

SEQ ID NO: 3787856 - RNA, 17 nt, Human
aaaaauuggggauucuu

SEQ ID NO: 3787857 - RNA, 14 nt, Human
aaaaauugucuuca

SEQ ID NO: 3787858 - RNA, 14 nt, Human
aaaaauugugauca

SEQ ID NO: 3787859 - RNA, 11 nt, Human
aaaaauuguua

SEQ ID NO: 3787860 - RNA, 21 nt, Human
aaaaauuguuaauuuuuccua

SEQ ID NO: 3787861 - RNA, 23 nt, Human
aaaaauuguuucaaaauaaaaac

SEQ ID NO: 3787862 - RNA, 16 nt, Human
aaaaauuuaagcauug

SEQ ID NO: 3787863 - RNA, 22 nt, Human
aaaaauuuaagcauuguuugcu

SEQ ID NO: 3787864 - RNA, 18 nt, Human
aaaaauuuacuuuaaacu

SEQ ID NO: 3787865 - RNA, 23 nt, Human
aaaaauuuggaauucuguucauu

SEQ ID NO: 3787866 - RNA, 19 nt, Human
aaaaauuuuguaauuuucu

SEQ ID NO: 3787867 - RNA, 21 nt, Human
aaaaauuuugugacauuccuu

SEQ ID NO: 3787868 - RNA, 16 nt, Human
aaaacaaaaagaacaa

SEQ ID NO: 3787869 - RNA, 17 nt, Human
aaaacaaaaagaacaaa

SEQ ID NO: 3787870 - RNA, 13 nt, Human
aaaacaaaaccaa

SEQ ID NO: 3787871 - RNA, 20 nt, Human
aaaacaaaacuauacuugaa

SEQ ID NO: 3787872 - RNA, 12 nt, Human
aaaacaaaauuu

SEQ ID NO: 3787873 - RNA, 15 nt, Human
aaaacaaaauuuuau

SEQ ID NO: 3787874 - RNA, 13 nt, Human
aaaacaaauaaua

SEQ ID NO: 3787875 - RNA, 16 nt, Human
aaaacaaauaauaucu

SEQ ID NO: 3787876 - RNA, 22 nt, Human
aaaacaacuauggaucagaaua

SEQ ID NO: 3787877 - RNA, 12 nt, Human
aaaacaacuuua

SEQ ID NO: 3787878 - RNA, 14 nt, Human
aaaacaaggaugaa

SEQ ID NO: 3787879 - RNA, 16 nt, Human
aaaacaauaaaauuuu

SEQ ID NO: 3787880 - RNA, 17 nt, Human
aaaacaauauuguuucu

SEQ ID NO: 3787881 - RNA, 19 nt, Human
aaaacaauauuuauuguau

SEQ ID NO: 3787882 - RNA, 16 nt, Human
aaaacaaucacacuca

SEQ ID NO: 3787883 - RNA, 22 nt, Human
aaaacacacgcgcgcacacaca

SEQ ID NO: 3787884 - RNA, 23 nt, Human
aaaacacagacauucugccaggc

SEQ ID NO: 3787885 - RNA, 13 nt, Human
aaaacacagcaag

SEQ ID NO: 3787886 - RNA, 16 nt, Human
aaaacacauguuuuua

SEQ ID NO: 3787887 - RNA, 14 nt, Human
aaaacaccagcuuu

SEQ ID NO: 3787888 - RNA, 14 nt, Human
aaaacacuaguuuu

SEQ ID NO: 3787889 - RNA, 20 nt, Human
aaaacacugaaaaauuauac

SEQ ID NO: 3787890 - RNA, 18 nt, Human
aaaacacugccaucuuag

SEQ ID NO: 3787891 - RNA, 14 nt, Human
aaaacacuguggaa

SEQ ID NO: 3787892 - RNA, 19 nt, Human
aaaaaaggacaauuucaaa

SEQ ID NO: 3787893 - RNA, 11 nt, Human
aaaaaagucuc

SEQ ID NO: 3787894 - RNA, 18 nt, Human
aaaaaaguuauauagguu

SEQ ID NO: 3787895 - RNA, 12 nt, Human
aaaaaaguugua

SEQ ID NO: 3787896 - RNA, 20 nt, Human
aaaaaaguuuacaaguguau

SEQ ID NO: 3787897 - RNA, 20 nt, Human
aaaaaauacugccagaugcu

SEQ ID NO: 3787898 - RNA, 11 nt, Human
aaaaaauacuu

SEQ ID NO: 3787899 - RNA, 21 nt, Human
aaaaaauagaugucuuuuaua

SEQ ID NO: 3787900 - RNA, 12 nt, Human
aaaaaauaucua

SEQ ID NO: 3787901 - RNA, 22 nt, Human
aaaaaaugcugaacauugcaua

SEQ ID NO: 3787902 - RNA, 11 nt, Human
aaaaaauuaag

SEQ ID NO: 3787903 - RNA, 21 nt, Human
aaaaaauucagugaugugccu

SEQ ID NO: 3787904 - RNA, 11 nt, Human
aaaaaauuggu

SEQ ID NO: 3787905 - RNA, 12 nt, Human
aaaaaauuuguc

SEQ ID NO: 3787906 - RNA, 11 nt, Human
aaaaacaaaag

SEQ ID NO: 3787907 - RNA, 16 nt, Human
aaaaacaaagagcguu

SEQ ID NO: 3787908 - RNA, 12 nt, Human
aaaaacaacuuu

SEQ ID NO: 3787909 - RNA, 13 nt, Human
aaaaacacagcaa

SEQ ID NO: 3787910 - RNA, 18 nt, Human
aaaaacacagcaagggug

SEQ ID NO: 3787911 - RNA, 20 nt, Human
aaaaacagcauugcuuucug

SEQ ID NO: 3787912 - RNA, 21 nt, Human
aaaaacagcauugcuuucuga

SEQ ID NO: 3787913 - RNA, 19 nt, Human
aaaaacagguauauacuuu

SEQ ID NO: 3787914 - RNA, 16 nt, Human
aaaaacauagaaaaau

SEQ ID NO: 3787915 - RNA, 15 nt, Human
aaaaacauauucuug

SEQ ID NO: 3787916 - RNA, 13 nt, Human
aaaaacauguaug

SEQ ID NO: 3787917 - RNA, 14 nt, Human
aaaaaccaaaacug

SEQ ID NO: 3787918 - RNA, 18 nt, Human
aaaaaccaguauuguaca

SEQ ID NO: 3787919 - RNA, 19 nt, Human
aaaaaccaucuguaaaaga

SEQ ID NO: 3787920 - RNA, 19 nt, Human
aaaaacccagcaacagaaa

SEQ ID NO: 3787921 - RNA, 23 nt, Human
aaaaaccugagauuuauuaaaga

SEQ ID NO: 3787922 - RNA, 13 nt, Human
aaaaaccuugggu

SEQ ID NO: 3787923 - RNA, 14 nt, Human
aaaaacuaaaaacu

SEQ ID NO: 3787924 - RNA, 20 nt, Human
aaaaacuaaaucucuaauau

SEQ ID NO: 3787925 - RNA, 19 nt, Human
aaaaacucuuuaacuugua

SEQ ID NO: 3787926 - RNA, 12 nt, Human
aaaaacugaagu

SEQ ID NO: 3787927 - RNA, 13 nt, Human
aaaaacugauuuu

SEQ ID NO: 3787928 - RNA, 15 nt, Human
aaaaacugauuuuuu

SEQ ID NO: 3787929 - RNA, 12 nt, Human
aaaaacuguauu

SEQ ID NO: 3787930 - RNA, 20 nt, Human
aaaaacugucuuuaaaagag

SEQ ID NO: 3787931 - RNA, 15 nt, Human
aaaaacuugaaaaua

SEQ ID NO: 3787932 - RNA, 12 nt, Human
aaaaacuuguaa

SEQ ID NO: 3787933 - RNA, 18 nt, Human
aaaaacuuguaaaugcug

SEQ ID NO: 3787934 - RNA, 22 nt, Human
aaaaacuugugcuauaaagcua

SEQ ID NO: 3787935 - RNA, 13 nt, Human
aaaaagaaaaaag

SEQ ID NO: 3787936 - RNA, 14 nt, Human
aaaaagaaaagaua

SEQ ID NO: 3787937 - RNA, 12 nt, Human
aaaaagaaauga

SEQ ID NO: 3787938 - RNA, 20 nt, Human
aaaaagaacaugcaguuuga

SEQ ID NO: 3787939 - RNA, 11 nt, Human
aaaaagaagaa

SEQ ID NO: 3787940 - RNA, 14 nt, Human
aaaaagaagaaucu

SEQ ID NO: 3787941 - RNA, 14 nt, Human
aaaaagaaguaggg

SEQ ID NO: 3787942 - RNA, 17 nt, Human
aaaaagaaugaagccuc

SEQ ID NO: 3787943 - RNA, 17 nt, Human
aaaaagauaccuuaaaa

SEQ ID NO: 3787944 - RNA, 16 nt, Human
aaaaagaugacccauu

SEQ ID NO: 3787945 - RNA, 14 nt, Human
aaaaagauguacag

SEQ ID NO: 3787946 - RNA, 15 nt, Human
aaaaagauucuuuuu

SEQ ID NO: 3787947 - RNA, 13 nt, Human
aaaaagauuuguu

SEQ ID NO: 3787948 - RNA, 17 nt, Human
aaaaagcacuaguauaa

SEQ ID NO: 3787949 - RNA, 21 nt, Human
aaaaagcagcuaccagguguu

SEQ ID NO: 3787950 - RNA, 15 nt, Human
aaaaagcauguacag

SEQ ID NO: 3787951 - RNA, 18 nt, Human
aaaaagcauguacagugu

SEQ ID NO: 3787952 - RNA, 17 nt, Human
aaaaagccaguuugggu

SEQ ID NO: 3787953 - RNA, 17 nt, Human
aaaaagcuaauaccagu

SEQ ID NO: 3787954 - RNA, 19 nt, Human
aaaaagcuauaaauuauau

SEQ ID NO: 3787955 - RNA, 13 nt, Human
aaaaccuuuuacu

SEQ ID NO: 3787956 - RNA, 15 nt, Human
aaaaccuuuuacugg

SEQ ID NO: 3787957 - RNA, 14 nt, Human
aaaacgaaaacagu

SEQ ID NO: 3787958 - RNA, 16 nt, Human
aaaacgauuuaauuua

SEQ ID NO: 3787959 - RNA, 17 nt, Human
aaaacgauuuaauuuau

SEQ ID NO: 3787960 - RNA, 17 nt, Human
aaaacgcaaagggcuga

SEQ ID NO: 3787961 - RNA, 14 nt, Human
aaaacgcauggagu

SEQ ID NO: 3787962 - RNA, 17 nt, Human
aaaacgcauggagugug

SEQ ID NO: 3787963 - RNA, 18 nt, Human
aaaacgcauggagugugu

SEQ ID NO: 3787964 - RNA, 16 nt, Human
aaaacgcgcagaugug

SEQ ID NO: 3787965 - RNA, 17 nt, Human
aaaacguggcugcuuca

SEQ ID NO: 3787966 - RNA, 13 nt, Human
aaaacuaaaaacu

SEQ ID NO: 3787967 - RNA, 16 nt, Human
aaaacuaaaaacuaga

SEQ ID NO: 3787968 - RNA, 17 nt, Human
aaaacuacuuagcacuu

SEQ ID NO: 3787969 - RNA, 23 nt, Human
aaaacuagagcucuaagcccauu

SEQ ID NO: 3787970 - RNA, 18 nt, Human
aaaacuaggcauuuguaa

SEQ ID NO: 3787971 - RNA, 13 nt, Human
aaaacuauacaac

SEQ ID NO: 3787972 - RNA, 16 nt, Human
aaaacuauucaugcua

SEQ ID NO: 3787973 - RNA, 13 nt, Human
aaaacucauuuuu

SEQ ID NO: 3787974 - RNA, 19 nt, Human
aaaacuccgcccccagccu

SEQ ID NO: 3787975 - RNA, 22 nt, Human
aaaacucgaggacuguauuugu

SEQ ID NO: 3787976 - RNA, 19 nt, Human
aaaacucuacuuaauccaa

SEQ ID NO: 3787977 - RNA, 21 nt, Human
aaaacucuuuaacuuguaaua

SEQ ID NO: 3787978 - RNA, 13 nt, Human
aaaacugaaaaau

SEQ ID NO: 3787979 - RNA, 18 nt, Human
aaaacugaagucugaaau

SEQ ID NO: 3787980 - RNA, 18 nt, Human
aaaacugauugaaugaua

SEQ ID NO: 3787981 - RNA, 22 nt, Human
aaaacugauuuuuuuuuccuuc

SEQ ID NO: 3787982 - RNA, 22 nt, Human
aaaacugcacugucaagaugau

SEQ ID NO: 3787983 - RNA, 11 nt, Human
aaaacugcucc

SEQ ID NO: 3787984 - RNA, 12 nt, Human
aaaacugcuuuu

SEQ ID NO: 3787985 - RNA, 17 nt, Human
aaaacuguacauuuaaa

SEQ ID NO: 3787986 - RNA, 15 nt, Human
aaaacuguacuuuga

SEQ ID NO: 3787987 - RNA, 17 nt, Human
aaaacugugaccaagua

SEQ ID NO: 3787988 - RNA, 19 nt, Human
aaaacugugaccaaguaua

SEQ ID NO: 3787989 - RNA, 16 nt, Human
aaaacuguuaccuaaa

SEQ ID NO: 3787990 - RNA, 23 nt, Human
aaaacuguuuuggguagcugcca

SEQ ID NO: 3787991 - RNA, 21 nt, Human
aaaacuuaacuuccaaugaaa

SEQ ID NO: 3787992 - RNA, 21 nt, Human
aaaacuuaugcugauuuauuu

SEQ ID NO: 3787993 - RNA, 13 nt, Human
aaaacuucagaag

SEQ ID NO: 3787994 - RNA, 21 nt, Human
aaaacuucaguuucacagaaa

SEQ ID NO: 3787995 - RNA, 18 nt, Human
aaaacuucauucucguga

SEQ ID NO: 3787996 - RNA, 18 nt, Human
aaaacuucuuaaauaucu

SEQ ID NO: 3787997 - RNA, 18 nt, Human
aaaacuucuugucagaca

SEQ ID NO: 3787998 - RNA, 23 nt, Human
aaaacuucuugucagacauaaag

SEQ ID NO: 3787999 - RNA, 17 nt, Human
aaaacuuguaaaugcug

SEQ ID NO: 3788000 - RNA, 17 nt, Human
aaaacuugugcuauaaa

SEQ ID NO: 3788001 - RNA, 20 nt, Human
aaaacuuuacuaagaugaca

SEQ ID NO: 3788002 - RNA, 21 nt, Human
aaaacuuuaugcuaagugaaa

SEQ ID NO: 3788003 - RNA, 13 nt, Human
aaaacuuuauuuu

SEQ ID NO: 3788004 - RNA, 16 nt, Human
aaaacuuuauuuuaua

SEQ ID NO: 3788005 - RNA, 14 nt, Human
aaaacuuuccucgc

SEQ ID NO: 3788006 - RNA, 14 nt, Human
aaaacuuuuaaacu

SEQ ID NO: 3788007 - RNA, 15 nt, Human
aaaacuuuuauaaau

SEQ ID NO: 3788008 - RNA, 21 nt, Human
aaaacuuuuauaaauuaaaua

SEQ ID NO: 3788009 - RNA, 11 nt, Human
aaaagaaaaaa

SEQ ID NO: 3788010 - RNA, 21 nt, Human
aaaagaaaaaaaaaagaagaa

SEQ ID NO: 3788011 - RNA, 18 nt, Human
aaaagaaaaaaaaagaaa

SEQ ID NO: 3788012 - RNA, 19 nt, Human
aaaagaaaaaaaaagaaaa

SEQ ID NO: 3788013 - RNA, 22 nt, Human
aaaagaaaaaaaaagaaaaaag

SEQ ID NO: 3788014 - RNA, 13 nt, Human
aaaagaaaaacca

SEQ ID NO: 3788015 - RNA, 15 nt, Human
aaaagaaaaauaaua

SEQ ID NO: 3788016 - RNA, 15 nt, Human
aaaagaaaauaaaaa

SEQ ID NO: 3788017 - RNA, 22 nt, Human
aaaagaaaaugaaaaacaacca

SEQ ID NO: 3788018 - RNA, 11 nt, Human
aaaagaaagaa

SEQ ID NO: 3788019 - RNA, 17 nt, Human
aaaagaaagaaaaucag

SEQ ID NO: 3788020 - RNA, 20 nt, Human
aaaagaaagaaguuauuuuc

SEQ ID NO: 3788021 - RNA, 10 nt, Human
aaaagaaagc

SEQ ID NO: 3788022 - RNA, 21 nt, Human
aaaagaaaucaauaguugaau

SEQ ID NO: 3788023 - RNA, 22 nt, Human
aaaagaaaucuauagaaagugu

SEQ ID NO: 3788024 - RNA, 13 nt, Human
aaaagaaaugaug

SEQ ID NO: 3788025 - RNA, 17 nt, Human
aaaagaacaauauugac

SEQ ID NO: 3788026 - RNA, 22 nt, Human
aaaagaacaugcaguuugaaau

SEQ ID NO: 3788027 - RNA, 12 nt, Human
aaaagaacuucc

SEQ ID NO: 3788028 - RNA, 11 nt, Human
aaaagaagaag

SEQ ID NO: 3788029 - RNA, 12 nt, Human
aaaagaagaagu

SEQ ID NO: 3788030 - RNA, 14 nt, Human
aaaagaaggaaaga

SEQ ID NO: 3788031 - RNA, 11 nt, Human
aaaagaaguaa

SEQ ID NO: 3788032 - RNA, 16 nt, Human
aaaagaauacagaaag

SEQ ID NO: 3788033 - RNA, 12 nt, Human
aaaagaauauuu

SEQ ID NO: 3788034 - RNA, 11 nt, Human
aaaagaaugac

SEQ ID NO: 3788035 - RNA, 13 nt, Human
aaaagaauuguug

SEQ ID NO: 3788036 - RNA, 13 nt, Human
aaaagacaauucu

SEQ ID NO: 3788037 - RNA, 15 nt, Human
aaaagacacugcaga

SEQ ID NO: 3788038 - RNA, 13 nt, Human
aaaagacagggcu

SEQ ID NO: 3788039 - RNA, 19 nt, Human
aaaagacaguguauguaga

SEQ ID NO: 3788040 - RNA, 13 nt, Human
aaaagacauucag

SEQ ID NO: 3788041 - RNA, 13 nt, Human
aaaagacucuuuu

SEQ ID NO: 3788042 - RNA, 14 nt, Human
aaaagacuucccua

SEQ ID NO: 3788043 - RNA, 14 nt, Human
aaaagagaaaagaa

SEQ ID NO: 3788044 - RNA, 15 nt, Human
aaaagagaagaagaa

SEQ ID NO: 3788045 - RNA, 17 nt, Human
aaaagagaagaagaaaa

SEQ ID NO: 3788046 - RNA, 23 nt, Human
aaaagagaauuagauuauauugg

SEQ ID NO: 3788047 - RNA, 22 nt, Human
aaaagagaccacccauaucaug

SEQ ID NO: 3788048 - RNA, 21 nt, Human
aaaagagauauuuuaaaauga

SEQ ID NO: 3788049 - RNA, 16 nt, Human
aaaagagaugaugaaa

SEQ ID NO: 3788050 - RNA, 15 nt, Human
aaaagagauugagau

SEQ ID NO: 3788051 - RNA, 22 nt, Human
aaaagaggaaagaaugaaagag

SEQ ID NO: 3788052 - RNA, 17 nt, Human
aaaagagguuuuucuua

SEQ ID NO: 3788053 - RNA, 17 nt, Human
aaaagagucuuccaauu

SEQ ID NO: 3788054 - RNA, 13 nt, Human
aaaagauaaagau

SEQ ID NO: 3788055 - RNA, 22 nt, Human
aaaaauggaacauaaaauacaa

SEQ ID NO: 3788056 - RNA, 12 nt, Human
aaaaauggauau

SEQ ID NO: 3788057 - RNA, 15 nt, Human
aaaaauggauauuau

SEQ ID NO: 3788058 - RNA, 17 nt, Human
aaaaaugggacuucuuu

SEQ ID NO: 3788059 - RNA, 13 nt, Human
aaaaaugguaauu

SEQ ID NO: 3788060 - RNA, 20 nt, Human
aaaaaugguagcauuuuaaa

SEQ ID NO: 3788061 - RNA, 22 nt, Human
aaaaaugguauaaguaacuuua

SEQ ID NO: 3788062 - RNA, 18 nt, Human
aaaaaugguggcuucagc

SEQ ID NO: 3788063 - RNA, 20 nt, Human
aaaaaugguggcuucagcuc

SEQ ID NO: 3788064 - RNA, 18 nt, Human
aaaaauguaggagacugu

SEQ ID NO: 3788065 - RNA, 16 nt, Human
aaaaauguauaugcac

SEQ ID NO: 3788066 - RNA, 12 nt, Human
aaaaauguauuu

SEQ ID NO: 3788067 - RNA, 18 nt, Human
aaaaauguuaagcaucua

SEQ ID NO: 3788068 - RNA, 16 nt, Human
aaaaauguuggauuua

SEQ ID NO: 3788069 - RNA, 16 nt, Human
aaaaauguuuuuucau

SEQ ID NO: 3788070 - RNA, 12 nt, Human
aaaaauuaaaau

SEQ ID NO: 3788071 - RNA, 18 nt, Human
aaaaauuacuaauuuuac

SEQ ID NO: 3788072 - RNA, 13 nt, Human
aaaaauuagcuga

SEQ ID NO: 3788073 - RNA, 11 nt, Human
aaaaauuauua

SEQ ID NO: 3788074 - RNA, 18 nt, Human
aaaaauucaauaguaaua

SEQ ID NO: 3788075 - RNA, 19 nt, Human
aaaaauucaauaguaauau

SEQ ID NO: 3788076 - RNA, 13 nt, Human
aaaaauuccagaa

SEQ ID NO: 3788077 - RNA, 18 nt, Human
aaaaauuccuaagaauca

SEQ ID NO: 3788078 - RNA, 19 nt, Human
aaaaauuccuuuguguuuc

SEQ ID NO: 3788079 - RNA, 15 nt, Human
aaaaauuuaaaagua

SEQ ID NO: 3788080 - RNA, 21 nt, Human
aaaaauuuaaaggguguacuu

SEQ ID NO: 3788081 - RNA, 18 nt, Human
aaaaauuuaagcauuguu

SEQ ID NO: 3788082 - RNA, 20 nt, Human
aaaaauuuaagcauuguuug

SEQ ID NO: 3788083 - RNA, 21 nt, Human
aaaaauuuacuacaauaugua

SEQ ID NO: 3788084 - RNA, 19 nt, Human
aaaaauuuacuuuaaacua

SEQ ID NO: 3788085 - RNA, 12 nt, Human
aaaaauuugaac

SEQ ID NO: 3788086 - RNA, 17 nt, Human
aaaaauuugaacacugg

SEQ ID NO: 3788087 - RNA, 14 nt, Human
aaaaauuuguuuaa

SEQ ID NO: 3788088 - RNA, 16 nt, Human
aaaaauuuguuuaaag

SEQ ID NO: 3788089 - RNA, 23 nt, Human
aaaaauuuugugacauuccuucu

SEQ ID NO: 3788090 - RNA, 22 nt, Human
aaaaauuuuuggauugacagua

SEQ ID NO: 3788091 - RNA, 12 nt, Human
aaaacaaaaaac

SEQ ID NO: 3788092 - RNA, 14 nt, Human
aaaacaaaaaacaa

SEQ ID NO: 3788093 - RNA, 11 nt, Human
aaaacaaaaag

SEQ ID NO: 3788094 - RNA, 23 nt, Human
aaaacaaaaauucacaagcugcc

SEQ ID NO: 3788095 - RNA, 10 nt, Human
aaaacaaaac

SEQ ID NO: 3788096 - RNA, 16 nt, Human
aaaacaaaacaaaacu

SEQ ID NO: 3788097 - RNA, 14 nt, Human
aaaacaaaacuaua

SEQ ID NO: 3788098 - RNA, 15 nt, Human
aaaacaaaacugcau

SEQ ID NO: 3788099 - RNA, 10 nt, Human
aaaacaaaau

SEQ ID NO: 3788100 - RNA, 22 nt, Human
aaaacaacuuaauaaaaacuua

SEQ ID NO: 3788101 - RNA, 17 nt, Human
aaaacaagaaaguuucc

SEQ ID NO: 3788102 - RNA, 23 nt, Human
aaaagccuuguguauauuuguau

SEQ ID NO: 3788103 - RNA, 19 nt, Human
aaaagcgugagcuuaaaau

SEQ ID NO: 3788104 - RNA, 23 nt, Human
aaaagcgugagcuuaaaauacaa

SEQ ID NO: 3788105 - RNA, 14 nt, Human
aaaagcuaagagaa

SEQ ID NO: 3788106 - RNA, 20 nt, Human
aaaagcuacaguuuugugaa

SEQ ID NO: 3788107 - RNA, 17 nt, Human
aaaagcuauaaagcagu

SEQ ID NO: 3788108 - RNA, 21 nt, Human
aaaagcuauaaagcaguauuu

SEQ ID NO: 3788109 - RNA, 16 nt, Human
aaaagcuauaaauuau

SEQ ID NO: 3788110 - RNA, 19 nt, Human
aaaagcuaucuucauguaa

SEQ ID NO: 3788111 - RNA, 15 nt, Human
aaaagcuauuagcca

SEQ ID NO: 3788112 - RNA, 21 nt, Human
aaaagcuauuagccaggauca

SEQ ID NO: 3788113 - RNA, 20 nt, Human
aaaagcuauuuaaagcaucu

SEQ ID NO: 3788114 - RNA, 14 nt, Human
aaaagcucauauuu

SEQ ID NO: 3788115 - RNA, 15 nt, Human
aaaagcucauuucau

SEQ ID NO: 3788116 - RNA, 22 nt, Human
aaaagcuccaugugccucuuug

SEQ ID NO: 3788117 - RNA, 22 nt, Human
aaaagcuccauuuuuagugaaa

SEQ ID NO: 3788118 - RNA, 13 nt, Human
aaaagcucuuuua

SEQ ID NO: 3788119 - RNA, 18 nt, Human
aaaagcugaacacauuuc

SEQ ID NO: 3788120 - RNA, 10 nt, Human
aaaagcugau

SEQ ID NO: 3788121 - RNA, 23 nt, Human
aaaagcugaucauaagugaauuu

SEQ ID NO: 3788122 - RNA, 17 nt, Human
aaaagcuggauuuucuu

SEQ ID NO: 3788123 - RNA, 14 nt, Human
aaaagcuuccauga

SEQ ID NO: 3788124 - RNA, 20 nt, Human
aaaagcuucuuaauuaauuu

SEQ ID NO: 3788125 - RNA, 21 nt, Human
aaaagcuucuuaauuaauuug

SEQ ID NO: 3788126 - RNA, 17 nt, Human
aaaagcuuuaugauuuu

SEQ ID NO: 3788127 - RNA, 20 nt, Human
aaaagcuuuaugauuuucau

SEQ ID NO: 3788128 - RNA, 13 nt, Human
aaaagcuuuuguc

SEQ ID NO: 3788129 - RNA, 11 nt, Human
aaaaggaaaaa

SEQ ID NO: 3788130 - RNA, 21 nt, Human
aaaaggaaaaaaagacucuuu

SEQ ID NO: 3788131 - RNA, 15 nt, Human
aaaaggaaaagaaaa

SEQ ID NO: 3788132 - RNA, 21 nt, Human
aaaaggacaggcagaaagagu

SEQ ID NO: 3788133 - RNA, 22 nt, Human
aaaaggagagacucccaugaag

SEQ ID NO: 3788134 - RNA, 22 nt, Human
aaaaggagccaauuuaaagaaa

SEQ ID NO: 3788135 - RNA, 14 nt, Human
aaaaggaguauaca

SEQ ID NO: 3788136 - RNA, 15 nt, Human
aaaaggauaguauuu

SEQ ID NO: 3788137 - RNA, 16 nt, Human
aaaaggauaguauuuu

SEQ ID NO: 3788138 - RNA, 19 nt, Human
aaaaggaucuuuguggcca

SEQ ID NO: 3788139 - RNA, 13 nt, Human
aaaaggaugcaca

SEQ ID NO: 3788140 - RNA, 22 nt, Human
aaaaggaugcacagaguuguua

SEQ ID NO: 3788141 - RNA, 11 nt, Human
aaaaggcagga

SEQ ID NO: 3788142 - RNA, 13 nt, Human
aaaaggcaguuac

SEQ ID NO: 3788143 - RNA, 22 nt, Human
aaaaggccaaaccucuguucag

SEQ ID NO: 3788144 - RNA, 20 nt, Human
aaaaggcgguacuaguucag

SEQ ID NO: 3788145 - RNA, 19 nt, Human
aaaaggcugugcugcccug

SEQ ID NO: 3788146 - RNA, 12 nt, Human
aaaagggaagua

SEQ ID NO: 3788147 - RNA, 14 nt, Human
aaaagggaagucua

SEQ ID NO: 3788148 - RNA, 20 nt, Human
aaaagggaaguugugccuuu

SEQ ID NO: 3788149 - RNA, 19 nt, Human
aaaagggacugagaaauuu

SEQ ID NO: 3788150 - RNA, 22 nt, Human
aaaagggccaaagaaccaaaga

SEQ ID NO: 3788151 - RNA, 13 nt, Human
aaaaggggcuccu

SEQ ID NO: 3788152 - RNA, 19 nt, Human
aaaagggucuugggaaaua

SEQ ID NO: 3788153 - RNA, 21 nt, Human
aaaagggucuugggaaauaug

SEQ ID NO: 3788154 - RNA, 19 nt, Human
aaaagguaugcaaucaaau

SEQ ID NO: 3788155 - RNA, 15 nt, Human
aaaagguauuaaauu

SEQ ID NO: 3788156 - RNA, 14 nt, Human
aaaagguauuauac

SEQ ID NO: 3788157 - RNA, 18 nt, Human
aaaagguauuuugaauac

SEQ ID NO: 3788158 - RNA, 19 nt, Human
aaaagguauuuugaauacc

SEQ ID NO: 3788159 - RNA, 21 nt, Human
aaaagguauuuugaauaccau

SEQ ID NO: 3788160 - RNA, 19 nt, Human
aaaagguucacuaaagcag

SEQ ID NO: 3788161 - RNA, 19 nt, Human
aaaagguuuaugaaaaaga

SEQ ID NO: 3788162 - RNA, 22 nt, Human
aaaaguaaguaccacucaggcc

SEQ ID NO: 3788163 - RNA, 13 nt, Human
aaaaguaauaaaa

SEQ ID NO: 3788164 - RNA, 13 nt, Human
aaaaguaauauuu

SEQ ID NO: 3788165 - RNA, 13 nt, Human
aaaaguaaugccu

SEQ ID NO: 3788166 - RNA, 18 nt, Human
aaaaguagaacuuuguau

SEQ ID NO: 3788167 - RNA, 13 nt, Human
aaaaguagcaauu

SEQ ID NO: 3788168 - RNA, 20 nt, Human
aaaaguagguuuacauucau

SEQ ID NO: 3788169 - RNA, 15 nt, Human
aaaaguauauguuag

SEQ ID NO: 3788170 - RNA, 23 nt, Human
aaaaguauguucuaaccuuuaca

SEQ ID NO: 3788171 - RNA, 20 nt, Human
aaaaguauuauuuuccaaaa

SEQ ID NO: 3788172 - RNA, 14 nt, Human
aaaaguauugccaa

SEQ ID NO: 3788173 - RNA, 16 nt, Human
aaaaguauugccaaac

SEQ ID NO: 3788174 - RNA, 14 nt, Human
aaaaguauuuuccu

SEQ ID NO: 3788175 - RNA, 15 nt, Human
aaaaguauuuugaag

SEQ ID NO: 3788176 - RNA, 18 nt, Human
aaaaguauuuugaaguuu

SEQ ID NO: 3788177 - RNA, 20 nt, Human
aaaaguauuuugaaguuuac

SEQ ID NO: 3788178 - RNA, 22 nt, Human
aaaaguauuuugaaguuuacau

SEQ ID NO: 3788179 - RNA, 15 nt, Human
aaaagucaaaaggug

SEQ ID NO: 3788180 - RNA, 15 nt, Human
aaaagucacuuacua

SEQ ID NO: 3788181 - RNA, 19 nt, Human
aaaagucagacugcuggga

SEQ ID NO: 3788182 - RNA, 16 nt, Human
aaaagucagagacaga

SEQ ID NO: 3788183 - RNA, 19 nt, Human
aaaagucucuauuuaaauu

SEQ ID NO: 3788184 - RNA, 14 nt, Human
aaaagucugcauua

SEQ ID NO: 3788185 - RNA, 18 nt, Human
aaaagucugucuuuccug

SEQ ID NO: 3788186 - RNA, 19 nt, Human
aaaagucuucacucucuga

SEQ ID NO: 3788187 - RNA, 14 nt, Human
aaaagucuuuuaaa

SEQ ID NO: 3788188 - RNA, 18 nt, Human
aaaagucuuuuaaaaagu

SEQ ID NO: 3788189 - RNA, 15 nt, Human
aaaagugaagacaga

SEQ ID NO: 3788190 - RNA, 13 nt, Human
aaaagugacacag

SEQ ID NO: 3788191 - RNA, 14 nt, Human
aaaagugacacagc

SEQ ID NO: 3788192 - RNA, 20 nt, Human
aaaagugaucaauaaaaugu

SEQ ID NO: 3788193 - RNA, 17 nt, Human
aaaagugauuguuggca

SEQ ID NO: 3788194 - RNA, 18 nt, Human
aaaagugccucaagagga

SEQ ID NO: 3788195 - RNA, 22 nt, Human
aaaagugcugcagggcuuuaaa

SEQ ID NO: 3788196 - RNA, 21 nt, Human
aaaaguguguauauauuuugu

SEQ ID NO: 3788197 - RNA, 18 nt, Human
aaaaguuaaaaaaaauaa

SEQ ID NO: 3788198 - RNA, 18 nt, Human
aaaaguuacauguuugca

SEQ ID NO: 3788199 - RNA, 19 nt, Human
aaaaguuacauguuugcac

SEQ ID NO: 3788200 - RNA, 14 nt, Human
aaaaguuagcugag

SEQ ID NO: 3788201 - RNA, 12 nt, Human
aaaaguuauaac

SEQ ID NO: 3788202 - RNA, 12 nt, Human
aaaaguuauuaa

SEQ ID NO: 3788203 - RNA, 17 nt, Human
aaaaguuauuaaaauug

SEQ ID NO: 3788204 - RNA, 13 nt, Human
aaaaguuccaaga

SEQ ID NO: 3788205 - RNA, 15 nt, Human
aaaaguuccaagagu

SEQ ID NO: 3788206 - RNA, 22 nt, Human
aaaaguuccaagagucuaaaga

SEQ ID NO: 3788207 - RNA, 13 nt, Human
aaaaguugaauuu

SEQ ID NO: 3788208 - RNA, 14 nt, Human
aaaaguugcagcug

SEQ ID NO: 3788209 - RNA, 18 nt, Human
aaaaguugcagcuguuuu

SEQ ID NO: 3788210 - RNA, 17 nt, Human
aaaaguugcauuuuaac

SEQ ID NO: 3788211 - RNA, 17 nt, Human
aaaauaguuuguuuaau

SEQ ID NO: 3788212 - RNA, 24 nt, Human
aaaauauaauuuuuuagagagcug

SEQ ID NO: 3788213 - RNA, 14 nt, Human
aaaauauacauguu

SEQ ID NO: 3788214 - RNA, 15 nt, Human
aaaauauacuguaaa

SEQ ID NO: 3788215 - RNA, 18 nt, Human
aaaauauauaccccccca

SEQ ID NO: 3788216 - RNA, 23 nt, Human
aaaauauauauagaaauauauac

SEQ ID NO: 3788217 - RNA, 18 nt, Human
aaaauauauaucaaauau

SEQ ID NO: 3788218 - RNA, 13 nt, Human
aaaauauauguau

SEQ ID NO: 3788219 - RNA, 15 nt, Human
aaaauauauuuaaug

SEQ ID NO: 3788220 - RNA, 13 nt, Human
aaaauaucaaauu

SEQ ID NO: 3788221 - RNA, 13 nt, Human
aaaauaucauuca

SEQ ID NO: 3788222 - RNA, 22 nt, Human
aaaauaucuacauuaauauacu

SEQ ID NO: 3788223 - RNA, 14 nt, Human
aaaauaucuuuuga

SEQ ID NO: 3788224 - RNA, 22 nt, Human
aaaauaugaccacacuccagcu

SEQ ID NO: 3788225 - RNA, 14 nt, Human
aaaauaugcacuaa

SEQ ID NO: 3788226 - RNA, 16 nt, Human
aaaauauggaacuucu

SEQ ID NO: 3788227 - RNA, 20 nt, Human
aaaauauggaacuucuaaua

SEQ ID NO: 3788228 - RNA, 21 nt, Human
aaaauauggaacuucuaauau

SEQ ID NO: 3788229 - RNA, 20 nt, Human
aaaauauggguugcauuugg

SEQ ID NO: 3788230 - RNA, 13 nt, Human
aaaauaugucucg

SEQ ID NO: 3788231 - RNA, 14 nt, Human
aaaauauguucuuu

SEQ ID NO: 3788232 - RNA, 21 nt, Human
aaaauauuaucuuuguaauua

SEQ ID NO: 3788233 - RNA, 20 nt, Human
aaaauauucaauaagagauu

SEQ ID NO: 3788234 - RNA, 15 nt, Human
aaaauauuccugcau

SEQ ID NO: 3788235 - RNA, 14 nt, Human
aaaauauuguuucu

SEQ ID NO: 3788236 - RNA, 15 nt, Human
aaaauauuguuucug

SEQ ID NO: 3788237 - RNA, 14 nt, Human
aaaauauuuaaugu

SEQ ID NO: 3788238 - RNA, 13 nt, Human
aaaauauuuauaa

SEQ ID NO: 3788239 - RNA, 21 nt, Human
aaaauauuuauaaaacuucuc

SEQ ID NO: 3788240 - RNA, 15 nt, Human
aaaauauuuaugaag

SEQ ID NO: 3788241 - RNA, 20 nt, Human
aaaauauuuaugaagaaaau

SEQ ID NO: 3788242 - RNA, 13 nt, Human
aaaauauuuuaua

SEQ ID NO: 3788243 - RNA, 17 nt, Human
aaaauauuuuauaauuu

SEQ ID NO: 3788244 - RNA, 18 nt, Human
aaaauauuuuaugaucca

SEQ ID NO: 3788245 - RNA, 12 nt, Human
aaaauauuuuca

SEQ ID NO: 3788246 - RNA, 16 nt, Human
aaaauauuuuccugcc

SEQ ID NO: 3788247 - RNA, 18 nt, Human
aaaccuacccucagugag

SEQ ID NO: 3788248 - RNA, 17 nt, Human
aaaccuagagaagauaa

SEQ ID NO: 3788249 - RNA, 17 nt, Human
aaaccucaaaaugucua

SEQ ID NO: 3788250 - RNA, 18 nt, Human
aaaccucuaauuuauuuu

SEQ ID NO: 3788251 - RNA, 11 nt, Human
aaaccucuccu

SEQ ID NO: 3788252 - RNA, 15 nt, Human
aaaccucugugagca

SEQ ID NO: 3788253 - RNA, 11 nt, Human
aaaccucuguu

SEQ ID NO: 3788254 - RNA, 21 nt, Human
aaaccucuguucaguguaaau

SEQ ID NO: 3788255 - RNA, 15 nt, Human
aaaccugaagacuga

SEQ ID NO: 3788256 - RNA, 16 nt, Human
aaaccugagauuuauu

SEQ ID NO: 3788257 - RNA, 21 nt, Human
aaaccugagauuuauuaaaga

SEQ ID NO: 3788258 - RNA, 22 nt, Human
aaaccugagauuuauuaaagaa

SEQ ID NO: 3788259 - RNA, 23 nt, Human
aaaccugagauuuauuaaagaaa

SEQ ID NO: 3788260 - RNA, 12 nt, Human
aaaccugcccug

SEQ ID NO: 3788261 - RNA, 16 nt, Human
aaaccugcccugccug

SEQ ID NO: 3788262 - RNA, 16 nt, Human
aaaccugccuggguuu

SEQ ID NO: 3788263 - RNA, 15 nt, Human
aaaccugcuuuucaa

SEQ ID NO: 3788264 - RNA, 12 nt, Human
aaaccuggagau

SEQ ID NO: 3788265 - RNA, 17 nt, Human
aaaccuguaucuuucua

SEQ ID NO: 3788266 - RNA, 22 nt, Human
aaaccugugucucugagaguag

SEQ ID NO: 3788267 - RNA, 12 nt, Human
aaaccuguucua

SEQ ID NO: 3788268 - RNA, 20 nt, Human
aaaccuguuuuuuuuucauu

SEQ ID NO: 3788269 - RNA, 19 nt, Human
aaaccuuaauauuucuuca

SEQ ID NO: 3788270 - RNA, 23 nt, Human
aaaccuuaauauuucuucaaaua

SEQ ID NO: 3788271 - RNA, 16 nt, Human
aaaccuuauuguaccu

SEQ ID NO: 3788272 - RNA, 17 nt, Human
aaaccuuauuguaccuc

SEQ ID NO: 3788273 - RNA, 19 nt, Human
aaaccuuauuuuuucccaa

SEQ ID NO: 3788274 - RNA, 14 nt, Human
aaaccuugguguag

SEQ ID NO: 3788275 - RNA, 17 nt, Human
aaaccuuuagggcagcu

SEQ ID NO: 3788276 - RNA, 17 nt, Human
aaaccuuucaaauuuca

SEQ ID NO: 3788277 - RNA, 19 nt, Human
aaaccuuuggcuacacaau

SEQ ID NO: 3788278 - RNA, 15 nt, Human
aaaccuuuuauuaua

SEQ ID NO: 3788279 - RNA, 15 nt, Human
aaaccuuuuuuaaga

SEQ ID NO: 3788280 - RNA, 16 nt, Human
aaaccuuuuuuaagau

SEQ ID NO: 3788281 - RNA, 20 nt, Human
aaaccuuuuuuaagauuuuu

SEQ ID NO: 3788282 - RNA, 22 nt, Human
aaaccuuuuuuaagauuuuucu

SEQ ID NO: 3788283 - RNA, 18 nt, Human
aaacgaagccaucuuucu

SEQ ID NO: 3788284 - RNA, 19 nt, Human
aaacgaagccaucuuucuu

SEQ ID NO: 3788285 - RNA, 21 nt, Human
aaacgauuuaauucucuugaa

SEQ ID NO: 3788286 - RNA, 20 nt, Human
aaacgauuuuuaaaauguac

SEQ ID NO: 3788287 - RNA, 20 nt, Human
aaacgcauggaguguguauu

SEQ ID NO: 3788288 - RNA, 13 nt, Human
aaacgcuaccucu

SEQ ID NO: 3788289 - RNA, 18 nt, Human
aaacgcuaccucucuguc

SEQ ID NO: 3788290 - RNA, 12 nt, Human
aaacgcugccug

SEQ ID NO: 3788291 - RNA, 16 nt, Human
aaacggaugauuucua

SEQ ID NO: 3788292 - RNA, 20 nt, Human
aaacggauuauuuuuucaga

SEQ ID NO: 3788293 - RNA, 17 nt, Human
aaacgggaacaugcccc

SEQ ID NO: 3788294 - RNA, 15 nt, Human
aaacgggcucagcaa

SEQ ID NO: 3788295 - RNA, 15 nt, Human
aaacgucuuaaauau

SEQ ID NO: 3788296 - RNA, 14 nt, Human
aaacgugcccucug

SEQ ID NO: 3788297 - RNA, 14 nt, Human
aaacguuucaguaa

SEQ ID NO: 3788298 - RNA, 21 nt, Human
aaacguuuuauuguguuuuua

SEQ ID NO: 3788299 - RNA, 14 nt, Human
aaacuaaaaacuag

SEQ ID NO: 3788300 - RNA, 17 nt, Human
aaacuaaaucucuaaua

SEQ ID NO: 3788301 - RNA, 20 nt, Human
aaacuaaauuguaaacuccu

SEQ ID NO: 3788302 - RNA, 13 nt, Human
aaacuaaauuuca

SEQ ID NO: 3788303 - RNA, 20 nt, Human
aaacuaacagauaagcaaga

SEQ ID NO: 3788304 - RNA, 15 nt, Human
aaacuaagauucuuu

SEQ ID NO: 3788305 - RNA, 16 nt, Human
aaacuaagauucuuuu

SEQ ID NO: 3788306 - RNA, 16 nt, Human
aaacuaaggugcuaaa

SEQ ID NO: 3788307 - RNA, 13 nt, Human
aaacuaauaaaau

SEQ ID NO: 3788308 - RNA, 12 nt, Human
aaacuaaugagu

SEQ ID NO: 3788309 - RNA, 17 nt, Human
aaacuacaaaaauuaac

SEQ ID NO: 3788310 - RNA, 22 nt, Human
aaacuacacaucccuaaugugu

SEQ ID NO: 3788311 - RNA, 15 nt, Human
aaacuacauauugua

SEQ ID NO: 3788312 - RNA, 20 nt, Human
aaacuacauuagguugugaa

SEQ ID NO: 3788313 - RNA, 21 nt, Human
aaacuacauuagguugugaau

SEQ ID NO: 3788314 - RNA, 18 nt, Human
aaacuacauugacagauu

SEQ ID NO: 3788315 - RNA, 14 nt, Human
aaacuacauuuuaa

SEQ ID NO: 3788316 - RNA, 18 nt, Human
aaacuacauuuuaacaug

SEQ ID NO: 3788317 - RNA, 20 nt, Human
aaacuaccuaacauuauuua

SEQ ID NO: 3788318 - RNA, 13 nt, Human
aaacuacucuuug

SEQ ID NO: 3788319 - RNA, 14 nt, Human
aaacuacucuuuga

SEQ ID NO: 3788320 - RNA, 20 nt, Human
aaacuacugaaugaagcagu

SEQ ID NO: 3788321 - RNA, 20 nt, Human
aaacuacuuugcugcuaaua

SEQ ID NO: 3788322 - RNA, 21 nt, Human
aaacuagacuugaggaaacca

SEQ ID NO: 3788323 - RNA, 23 nt, Human
aaacuagcucgugauuggcauau

SEQ ID NO: 3788324 - RNA, 19 nt, Human
aaacuagcuuacaugagaa

SEQ ID NO: 3788325 - RNA, 23 nt, Human
aaacuagcuuacaugagaacaga

SEQ ID NO: 3788326 - RNA, 15 nt, Human
aaacuaggaaaauug

SEQ ID NO: 3788327 - RNA, 17 nt, Human
aaacuaggaaauuuuuu

SEQ ID NO: 3788328 - RNA, 14 nt, Human
aaacuaguaguucu

SEQ ID NO: 3788329 - RNA, 17 nt, Human
aaacuaguaguucucuu

SEQ ID NO: 3788330 - RNA, 15 nt, Human
aaacuaguuuuuccu

SEQ ID NO: 3788331 - RNA, 16 nt, Human
aaacuaguuuuuccua

SEQ ID NO: 3788332 - RNA, 22 nt, Human
aaacuauaagcaagaaggcaaa

SEQ ID NO: 3788333 - RNA, 13 nt, Human
aaacuauacuuga

SEQ ID NO: 3788334 - RNA, 22 nt, Human
aaacuauacuugaacaaaaggg

SEQ ID NO: 3788335 - RNA, 21 nt, Human
aaacuauuaaggauguagcuu

SEQ ID NO: 3788336 - RNA, 19 nt, Human
aaacuauucaugcuaccca

SEQ ID NO: 3788337 - RNA, 13 nt, Human
aaacuauuuaucu

SEQ ID NO: 3788338 - RNA, 20 nt, Human
aaacuauuugucuuucagga

SEQ ID NO: 3788339 - RNA, 21 nt, Human
aaacucaaaauauuuguacau

SEQ ID NO: 3788340 - RNA, 14 nt, Human
aaacucaagcuucu

SEQ ID NO: 3788341 - RNA, 16 nt, Human
aaacucaccugcuggc

SEQ ID NO: 3788342 - RNA, 18 nt, Human
aaacucaccugcuggccc

SEQ ID NO: 3788343 - RNA, 20 nt, Human
aaacucacugcucaagaaga

SEQ ID NO: 3788344 - RNA, 13 nt, Human
aaacucacuguga

SEQ ID NO: 3788345 - RNA, 21 nt, Human
aaacucagccugggacaguuu

SEQ ID NO: 3788346 - RNA, 23 nt, Human
aaacucaggauggucaucuugga

SEQ ID NO: 3788347 - RNA, 17 nt, Human
aaacucaggcaaagaaa

SEQ ID NO: 3788348 - RNA, 18 nt, Human
aaacucagggacagagcc

SEQ ID NO: 3788349 - RNA, 17 nt, Human
aaacucauauuacaaaa

SEQ ID NO: 3788350 - RNA, 16 nt, Human
aaacucaucugaaaug

SEQ ID NO: 3788351 - RNA, 13 nt, Human
aaacucaucugga

SEQ ID NO: 3788352 - RNA, 16 nt, Human
aaacucauuucuagca

SEQ ID NO: 3788353 - RNA, 12 nt, Human
aaacucauuuuu

SEQ ID NO: 3788354 - RNA, 16 nt, Human
aaacuccacaucugcc

SEQ ID NO: 3788355 - RNA, 11 nt, Human
aaacuccugac

SEQ ID NO: 3788356 - RNA, 14 nt, Human
aaacuccugugacc

SEQ ID NO: 3788357 - RNA, 20 nt, Human
aaacuccuuccuggccugag

SEQ ID NO: 3788358 - RNA, 20 nt, Human
aaacucgaggacuguauuug

SEQ ID NO: 3788359 - RNA, 21 nt, Human
aaacucuaaacauuaaucaau

SEQ ID NO: 3788360 - RNA, 17 nt, Human
aaacucuauggucuuau

SEQ ID NO: 3788361 - RNA, 18 nt, Human
aaacucuccucugcugcu

SEQ ID NO: 3788362 - RNA, 17 nt, Human
aaacucugaauuuaucu

SEQ ID NO: 3788363 - RNA, 18 nt, Human
aaacucugaauuuaucuu

SEQ ID NO: 3788364 - RNA, 15 nt, Human
aaacucugagugcaa

SEQ ID NO: 3788365 - RNA, 17 nt, Human
aaacucugcauccagag

SEQ ID NO: 3788366 - RNA, 11 nt, Human
aaacucugcug

SEQ ID NO: 3788367 - RNA, 12 nt, Human
aaacucugcugu

SEQ ID NO: 3788368 - RNA, 19 nt, Human
aaacucuguugcaagugca

SEQ ID NO: 3788369 - RNA, 13 nt, Human
aaacucuuaucuc

SEQ ID NO: 3788370 - RNA, 16 nt, Human
aaacucuuaucucagu

SEQ ID NO: 3788371 - RNA, 22 nt, Human
aaacucuuaucucagucaugca

SEQ ID NO: 3788372 - RNA, 20 nt, Human
aaacucuuuggucguuuuuu

SEQ ID NO: 3788373 - RNA, 13 nt, Human
aaacucuuuuccc

SEQ ID NO: 3788374 - RNA, 14 nt, Human
aaacugaaaaucua

SEQ ID NO: 3788375 - RNA, 21 nt, Human
aaacugaagcagccucucccc

SEQ ID NO: 3788376 - RNA, 22 nt, Human
aaacugaagcagccucucccca

SEQ ID NO: 3788377 - RNA, 17 nt, Human
aaacugaagucugaaau

SEQ ID NO: 3788378 - RNA, 19 nt, Human
aaacugaagucugaaauuu

SEQ ID NO: 3788379 - RNA, 22 nt, Human
aaacugacaugcccucccuucu

SEQ ID NO: 3788380 - RNA, 13 nt, Human
aaacugacuauca

SEQ ID NO: 3788381 - RNA, 11 nt, Human
aaacugagcau

SEQ ID NO: 3788382 - RNA, 14 nt, Human
aaacugaggaauuu

SEQ ID NO: 3788383 - RNA, 19 nt, Human
aaacugaggaauuucaccu

SEQ ID NO: 3788384 - RNA, 18 nt, Human
aaacugaggaauuuucuu

SEQ ID NO: 3788385 - RNA, 15 nt, Human
aaacugaugugaaac

SEQ ID NO: 3788386 - RNA, 12 nt, Human
aaacugcaauag

SEQ ID NO: 3788387 - RNA, 21 nt, Human
aaacugcaauagagacuguag

SEQ ID NO: 3788388 - RNA, 22 nt, Human
aaacugcaauagagacuguaga

SEQ ID NO: 3788389 - RNA, 18 nt, Human
aaacugcacaugauuuca

SEQ ID NO: 3788390 - RNA, 15 nt, Human
aaacugcacugucaa

SEQ ID NO: 3788391 - RNA, 23 nt, Human
aaacugcauaagugaaaaucuua

SEQ ID NO: 3788392 - RNA, 14 nt, Human
aaaauuuuauagcu

SEQ ID NO: 3788393 - RNA, 22 nt, Human
aaaauuuugcuccccagugaag

SEQ ID NO: 3788394 - RNA, 16 nt, Human
aaaauuuugcuuuuaa

SEQ ID NO: 3788395 - RNA, 13 nt, Human
aaaauuuuguaau

SEQ ID NO: 3788396 - RNA, 19 nt, Human
aaaauuuuguaauuuucuu

SEQ ID NO: 3788397 - RNA, 18 nt, Human
aaaauuuuguauguuaaa

SEQ ID NO: 3788398 - RNA, 19 nt, Human
aaaauuuugugacauuccu

SEQ ID NO: 3788399 - RNA, 20 nt, Human
aaaauuuugugacauuccuu

SEQ ID NO: 3788400 - RNA, 16 nt, Human
aaaauuuuguuuauaa

SEQ ID NO: 3788401 - RNA, 19 nt, Human
aaaauuuuuaaucuuuaau

SEQ ID NO: 3788402 - RNA, 23 nt, Human
aaaauuuuuggauugacaguaac

SEQ ID NO: 3788403 - RNA, 19 nt, Human
aaaauuuuuucucuaggaa

SEQ ID NO: 3788404 - RNA, 21 nt, Human
aaaauuuuuuuggucuuuuug

SEQ ID NO: 3788405 - RNA, 16 nt, Human
aaacaaaaagaugucu

SEQ ID NO: 3788406 - RNA, 23 nt, Human
aaacaaaaauucacaagcugccu

SEQ ID NO: 3788407 - RNA, 20 nt, Human
aaacaaaacuauacuugaac

SEQ ID NO: 3788408 - RNA, 19 nt, Human
aaacaaaagcugaacacau

SEQ ID NO: 3788409 - RNA, 23 nt, Human
aaacaaaagcugaacacauuucu

SEQ ID NO: 3788410 - RNA, 13 nt, Human
aaacaaaaugaag

SEQ ID NO: 3788411 - RNA, 17 nt, Human
aaacaaaauggcuucag

SEQ ID NO: 3788412 - RNA, 14 nt, Human
aaacaaaauuucua

SEQ ID NO: 3788413 - RNA, 13 nt, Human
aaacaaaauuuga

SEQ ID NO: 3788414 - RNA, 17 nt, Human
aaacaaaauuugacuaa

SEQ ID NO: 3788415 - RNA, 22 nt, Human
aaacaaacauuguguugacauu

SEQ ID NO: 3788416 - RNA, 13 nt, Human
aaacaaaccagaa

SEQ ID NO: 3788417 - RNA, 12 nt, Human
aaacaaagaugu

SEQ ID NO: 3788418 - RNA, 15 nt, Human
aaacaaauaaucaca

SEQ ID NO: 3788419 - RNA, 17 nt, Human
aaacaaauaaucacauu

SEQ ID NO: 3788420 - RNA, 13 nt, Human
aaacaaauaugca

SEQ ID NO: 3788421 - RNA, 17 nt, Human
aaacaaauaugcaaaag

SEQ ID NO: 3788422 - RNA, 19 nt, Human
aaacaaauucauauucugu

SEQ ID NO: 3788423 - RNA, 14 nt, Human
aaacaacaaaaaau

SEQ ID NO: 3788424 - RNA, 12 nt, Human
aaacaacacugu

SEQ ID NO: 3788425 - RNA, 22 nt, Human
aaacaacagcucgauccaaauu

SEQ ID NO: 3788426 - RNA, 12 nt, Human
aaacaacauuua

SEQ ID NO: 3788427 - RNA, 17 nt, Human
aaacaacauuuauaugu

SEQ ID NO: 3788428 - RNA, 17 nt, Human
aaacaacucuuugagaa

SEQ ID NO: 3788429 - RNA, 19 nt, Human
aaacaagaaaaauaaagaa

SEQ ID NO: 3788430 - RNA, 16 nt, Human
aaacaagaaaguuucc

SEQ ID NO: 3788431 - RNA, 22 nt, Human
aaacuguugccagagauggagg

SEQ ID NO: 3788432 - RNA, 18 nt, Human
aaacuguuucuuuaaaau

SEQ ID NO: 3788433 - RNA, 20 nt, Human
aaacuguuuuagaccuauaa

SEQ ID NO: 3788434 - RNA, 20 nt, Human
aaacuguuuuggguagcugc

SEQ ID NO: 3788435 - RNA, 17 nt, Human
aaacuuaaauguuauua

SEQ ID NO: 3788436 - RNA, 23 nt, Human
aaacuuaacuuuaacugaacaau

SEQ ID NO: 3788437 - RNA, 17 nt, Human
aaacuuaauuuaauauu

SEQ ID NO: 3788438 - RNA, 17 nt, Human
aaacuuagaauaaaauu

SEQ ID NO: 3788439 - RNA, 15 nt, Human
aaacuuauaaaucau

SEQ ID NO: 3788440 - RNA, 20 nt, Human
aaacuuaucuuacaaagugu

SEQ ID NO: 3788441 - RNA, 17 nt, Human
aaacuuaugaauguuuc

SEQ ID NO: 3788442 - RNA, 20 nt, Human
aaacuuaugcugauuuauuu

SEQ ID NO: 3788443 - RNA, 10 nt, Human
aaacuuauuu

SEQ ID NO: 3788444 - RNA, 12 nt, Human
aaacuuauuuga

SEQ ID NO: 3788445 - RNA, 18 nt, Human
aaacuuauuuuauauuuu

SEQ ID NO: 3788446 - RNA, 19 nt, Human
aaacuuauuuuuuucugau

SEQ ID NO: 3788447 - RNA, 22 nt, Human
aaacuuauuuuuuucugauugu

SEQ ID NO: 3788448 - RNA, 19 nt, Human
aaacuucagacauagaauu

SEQ ID NO: 3788449 - RNA, 13 nt, Human
aaacuucagcacc

SEQ ID NO: 3788450 - RNA, 20 nt, Human
aaacuucauguaauuuuauu

SEQ ID NO: 3788451 - RNA, 21 nt, Human
aaacuucauguaauuuuauuu

SEQ ID NO: 3788452 - RNA, 18 nt, Human
aaacuuccaaagaaaguu

SEQ ID NO: 3788453 - RNA, 21 nt, Human
aaacuuccagugcaacacuga

SEQ ID NO: 3788454 - RNA, 23 nt, Human
aaacuuccagugcaacacugaag

SEQ ID NO: 3788455 - RNA, 23 nt, Human
aaacuucccgucccauauccugc

SEQ ID NO: 3788456 - RNA, 21 nt, Human
aaacuucccuuucugcuugug

SEQ ID NO: 3788457 - RNA, 17 nt, Human
aaacuucuggcucccuc

SEQ ID NO: 3788458 - RNA, 17 nt, Human
aaacuucuuaaauaucu

SEQ ID NO: 3788459 - RNA, 19 nt, Human
aaacuucuuaaauaucuuu

SEQ ID NO: 3788460 - RNA, 15 nt, Human
aaacuucuugucaga

SEQ ID NO: 3788461 - RNA, 23 nt, Human
aaacuucuugucagacauaaagc

SEQ ID NO: 3788462 - RNA, 19 nt, Human
aaacuugacuccauuucau

SEQ ID NO: 3788463 - RNA, 22 nt, Human
aaacuugauguguuaucucuua

SEQ ID NO: 3788464 - RNA, 19 nt, Human
aaacuuggauacuuggauu

SEQ ID NO: 3788465 - RNA, 20 nt, Human
aaacuuggauacuuggauuu

SEQ ID NO: 3788466 - RNA, 24 nt, Human
aaacuuggcucgaaucucugugcc

SEQ ID NO: 3788467 - RNA, 11 nt, Human
aaacuuguaaa

SEQ ID NO: 3788468 - RNA, 16 nt, Human
aaacuuguaauuuuuu

SEQ ID NO: 3788469 - RNA, 20 nt, Human
aaacuuguaauuuuuuuaau

SEQ ID NO: 3788470 - RNA, 16 nt, Human
aaacuugucacuugca

SEQ ID NO: 3788471 - RNA, 17 nt, Human
aaacuugucacuugcau

SEQ ID NO: 3788472 - RNA, 19 nt, Human
aaacuugucacuugcaugu

SEQ ID NO: 3788473 - RNA, 20 nt, Human
aaacuugucacuugcauguc

SEQ ID NO: 3788474 - RNA, 13 nt, Human
aaacuugugaaug

SEQ ID NO: 3788475 - RNA, 18 nt, Human
aaacuuguuacuaaagaa

SEQ ID NO: 3788476 - RNA, 17 nt, Human
aaacuuguuauugugaa

SEQ ID NO: 3788477 - RNA, 12 nt, Human
aaacuuuaaaaa

SEQ ID NO: 3788478 - RNA, 22 nt, Human
aaacuuuaaaaaauauuuauua

SEQ ID NO: 3788479 - RNA, 14 nt, Human
aaacuuuaaaccug

SEQ ID NO: 3788480 - RNA, 22 nt, Human
aaacuuuaaaccuguagaauca

SEQ ID NO: 3788481 - RNA, 14 nt, Human
aaacuuuaauaugu

SEQ ID NO: 3788482 - RNA, 12 nt, Human
aaacuuuaugcu

SEQ ID NO: 3788483 - RNA, 19 nt, Human
aaacuuuauuuuauauaau

SEQ ID NO: 3788484 - RNA, 18 nt, Human
aaacuuuccucgccugac

SEQ ID NO: 3788485 - RNA, 21 nt, Human
aaacuuucuacucauuuuaau

SEQ ID NO: 3788486 - RNA, 16 nt, Human
aaacuuugaaguuagc

SEQ ID NO: 3788487 - RNA, 14 nt, Human
aaacuuugcuaaau

SEQ ID NO: 3788488 - RNA, 19 nt, Human
aaacuuuggaaccagacuc

SEQ ID NO: 3788489 - RNA, 20 nt, Human
aaacuuugggaaaacauguu

SEQ ID NO: 3788490 - RNA, 14 nt, Human
aaacuuuuauaaau

SEQ ID NO: 3788491 - RNA, 21 nt, Human
aaacuuuuauaaauuaaauau

SEQ ID NO: 3788492 - RNA, 18 nt, Human
aaacuuuucaaggcuuau

SEQ ID NO: 3788493 - RNA, 17 nt, Human
aaacuuuuuuuugagaa

SEQ ID NO: 3788494 - RNA, 10 nt, Human
aaagaaaaaa

SEQ ID NO: 3788495 - RNA, 22 nt, Human
aaagaaaaaaaaaaagaaagaa

SEQ ID NO: 3788496 - RNA, 21 nt, Human
aaagaaaaaaaaaagaagaag

SEQ ID NO: 3788497 - RNA, 22 nt, Human
aaagaaaaaaaaaagaagaaga

SEQ ID NO: 3788498 - RNA, 23 nt, Human
aaagaaaaaaaaccaucaaguug

SEQ ID NO: 3788499 - RNA, 15 nt, Human
aaagaaaaaaauuga

SEQ ID NO: 3788500 - RNA, 18 nt, Human
aaagaaaaaaauugaaau

SEQ ID NO: 3788501 - RNA, 19 nt, Human
aaagaaaaaaauugaaaug

SEQ ID NO: 3788502 - RNA, 21 nt, Human
aaagaaaaaaauugaaaugua

SEQ ID NO: 3788503 - RNA, 22 nt, Human
aaagaaaaaaauugaaauguaa

SEQ ID NO: 3788504 - RNA, 18 nt, Human
aaagaaaaaagagaaaag

SEQ ID NO: 3788505 - RNA, 18 nt, Human
aaagaaaaauauuuaaug

SEQ ID NO: 3788506 - RNA, 16 nt, Human
aaagaaaacccacccc

SEQ ID NO: 3788507 - RNA, 13 nt, Human
aaagaaaaccuuu

SEQ ID NO: 3788508 - RNA, 14 nt, Human
aaagaaaagauaaa

SEQ ID NO: 3788509 - RNA, 15 nt, Human
aaagaaaagaugcac

SEQ ID NO: 3788510 - RNA, 20 nt, Human
aaagaaaagaugcacuuugc

SEQ ID NO: 3788511 - RNA, 13 nt, Human
aaagaaaauaugc

SEQ ID NO: 3788512 - RNA, 16 nt, Human
aaagaaaauuccuaua

SEQ ID NO: 3788513 - RNA, 12 nt, Human
aaagaaaauuuu

SEQ ID NO: 3788514 - RNA, 19 nt, Human
aaagaaaauuuuuguagua

SEQ ID NO: 3788515 - RNA, 13 nt, Human
aaagaaacagcuu

SEQ ID NO: 3788516 - RNA, 12 nt, Human
aaagaaacaugg

SEQ ID NO: 3788517 - RNA, 13 nt, Human
aaagaaacauuug

SEQ ID NO: 3788518 - RNA, 10 nt, Human
aaagaaagaa

SEQ ID NO: 3788519 - RNA, 13 nt, Human
aaagaaagagaga

SEQ ID NO: 3788520 - RNA, 15 nt, Human
aaagaaagagagaaa

SEQ ID NO: 3788521 - RNA, 17 nt, Human
aaagaaagccucagaga

SEQ ID NO: 3788522 - RNA, 18 nt, Human
aaagaaagccucagagaa

SEQ ID NO: 3788523 - RNA, 12 nt, Human
aaagaaaguggu

SEQ ID NO: 3788524 - RNA, 23 nt, Human
aaagaaaguggucuuaagaaaug

SEQ ID NO: 3788525 - RNA, 16 nt, Human
aaagaaaguguauuug

SEQ ID NO: 3788526 - RNA, 23 nt, Human
aaagaaaguugcacggcugcuga

SEQ ID NO: 3788527 - RNA, 15 nt, Human
aaagaaauaauaaua

SEQ ID NO: 3788528 - RNA, 17 nt, Human
aaagaaauauaccuaaa

SEQ ID NO: 3788529 - RNA, 13 nt, Human
aaagaaauaucug

SEQ ID NO: 3788530 - RNA, 13 nt, Human
aaagaaaucaugu

SEQ ID NO: 3788531 - RNA, 15 nt, Human
aaagaaaucuauaga

SEQ ID NO: 3788532 - RNA, 23 nt, Human
aaagaaaucuauagaaaguguuc

SEQ ID NO: 3788533 - RNA, 17 nt, Human
aaagaaaugcacaaugu

SEQ ID NO: 3788534 - RNA, 15 nt, Human
aaagaaauguaaggg

SEQ ID NO: 3788535 - RNA, 19 nt, Human
aaagaaaugucuauuaagg

SEQ ID NO: 3788536 - RNA, 20 nt, Human
aaacucuguugcaagugcaa

SEQ ID NO: 3788537 - RNA, 16 nt, Human
aaacucuuuaacuucu

SEQ ID NO: 3788538 - RNA, 23 nt, Human
aaacucuuuaacuuguaauaaac

SEQ ID NO: 3788539 - RNA, 13 nt, Human
aaacucuuuauuu

SEQ ID NO: 3788540 - RNA, 13 nt, Human
aaacugaaaaucu

SEQ ID NO: 3788541 - RNA, 17 nt, Human
aaacugaauuuguacuu

SEQ ID NO: 3788542 - RNA, 19 nt, Human
aaacugacaugcccucccu

SEQ ID NO: 3788543 - RNA, 20 nt, Human
aaacugacaugcccucccuu

SEQ ID NO: 3788544 - RNA, 12 nt, Human
aaacugacuuua

SEQ ID NO: 3788545 - RNA, 21 nt, Human
aaacugagacucagacaggaa

SEQ ID NO: 3788546 - RNA, 23 nt, Human
aaacugagacucagacaggaaag

SEQ ID NO: 3788547 - RNA, 21 nt, Human
aaacugagaugugaacacauc

SEQ ID NO: 3788548 - RNA, 23 nt, Human
aaacugagaugugaacacaucag

SEQ ID NO: 3788549 - RNA, 13 nt, Human
aaacugauuuuuu

SEQ ID NO: 3788550 - RNA, 19 nt, Human
aaacugauuuuuuuuuccu

SEQ ID NO: 3788551 - RNA, 23 nt, Human
aaacugauuuuuuuuuccuucag

SEQ ID NO: 3788552 - RNA, 12 nt, Human
aaacugcacaug

SEQ ID NO: 3788553 - RNA, 22 nt, Human
aaacugcacaugauuucacaaa

SEQ ID NO: 3788554 - RNA, 16 nt, Human
aaacugcaugcccaga

SEQ ID NO: 3788555 - RNA, 14 nt, Human
aaacugcauuagaa

SEQ ID NO: 3788556 - RNA, 12 nt, Human
aaacugcauuug

SEQ ID NO: 3788557 - RNA, 17 nt, Human
aaacugcguuaaaggcu

SEQ ID NO: 3788558 - RNA, 13 nt, Human
aaacugcuuguuu

SEQ ID NO: 3788559 - RNA, 17 nt, Human
aaacugcuuguuuccua

SEQ ID NO: 3788560 - RNA, 22 nt, Human
aaacugcuuguuuccuagcaca

SEQ ID NO: 3788561 - RNA, 21 nt, Human
aaacugcuuuuuuuuuuccag

SEQ ID NO: 3788562 - RNA, 23 nt, Human
aaacugcuuuuuuuuuuccagca

SEQ ID NO: 3788563 - RNA, 14 nt, Human
aaacuggaaugagc

SEQ ID NO: 3788564 - RNA, 10 nt, Human
aaacuggaga

SEQ ID NO: 3788565 - RNA, 21 nt, Human
aaacuggagacugugugugcc

SEQ ID NO: 3788566 - RNA, 11 nt, Human
aaacuggaguc

SEQ ID NO: 3788567 - RNA, 20 nt, Human
aaacuggcaaacuucagacu

SEQ ID NO: 3788568 - RNA, 16 nt, Human
aaacuggcaaagcaga

SEQ ID NO: 3788569 - RNA, 18 nt, Human
aaacuggccauggccugc

SEQ ID NO: 3788570 - RNA, 15 nt, Human
aaacuggccugacuu

SEQ ID NO: 3788571 - RNA, 19 nt, Human
aaacugggaugaaacuaaa

SEQ ID NO: 3788572 - RNA, 20 nt, Human
aaacugggcuggaagauauu

SEQ ID NO: 3788573 - RNA, 17 nt, Human
aaacuggggccuccaga

SEQ ID NO: 3788574 - RNA, 16 nt, Human
aaacuguacagugucu

SEQ ID NO: 3788575 - RNA, 15 nt, Human
aaacuguacauuuaa

SEQ ID NO: 3788576 - RNA, 20 nt, Human
aaacuguacuuugauucaca

SEQ ID NO: 3788577 - RNA, 22 nt, Human
aaacuguacuuugauucacaug

SEQ ID NO: 3788578 - RNA, 15 nt, Human
aaacuguaugcucac

SEQ ID NO: 3788579 - RNA, 22 nt, Human
aaacuguauugaugacaguagu

SEQ ID NO: 3788580 - RNA, 17 nt, Human
aaacugucaaagaauca

SEQ ID NO: 3788581 - RNA, 14 nt, Human
aaacugucacuguu

SEQ ID NO: 3788582 - RNA, 20 nt, Human
aaacuguccucuuucagaaa

SEQ ID NO: 3788583 - RNA, 19 nt, Human
aaacuguguauuccaagac

SEQ ID NO: 3788584 - RNA, 20 nt, Human
aaacuguguggacugugaug

SEQ ID NO: 3788585 - RNA, 14 nt, Human
aaacuguguugcca

SEQ ID NO: 3788586 - RNA, 16 nt, Human
aaacuguguugccaca

SEQ ID NO: 3788587 - RNA, 19 nt, Human
aaacuguuaauaguucagg

SEQ ID NO: 3788588 - RNA, 22 nt, Human
aaacuguucaagaaauaauaaa

SEQ ID NO: 3788589 - RNA, 20 nt, Human
aaacuguucccaccugcugg

SEQ ID NO: 3788590 - RNA, 16 nt, Human
aaacuguugccagaga

SEQ ID NO: 3788591 - RNA, 16 nt, Human
aaacuguuucuuuaaa

SEQ ID NO: 3788592 - RNA, 23 nt, Human
aaacuguuugaaaacuucagaag

SEQ ID NO: 3788593 - RNA, 23 nt, Human
aaacuguuuuggguagcugccac

SEQ ID NO: 3788594 - RNA, 18 nt, Human
aaacuuaaccgcaucaga

SEQ ID NO: 3788595 - RNA, 16 nt, Human
aaacuuaaucuaaaug

SEQ ID NO: 3788596 - RNA, 18 nt, Human
aaacuuaaucuaaaugga

SEQ ID NO: 3788597 - RNA, 23 nt, Human
aaacuuaccuaagugacauuugu

SEQ ID NO: 3788598 - RNA, 22 nt, Human
aaacuuagaauaaaauuguaaa

SEQ ID NO: 3788599 - RNA, 20 nt, Human
aaacuuagcaucuaauuuca

SEQ ID NO: 3788600 - RNA, 21 nt, Human
aaacuuagugcggacaaguuu

SEQ ID NO: 3788601 - RNA, 15 nt, Human
aaacuuaguuuguga

SEQ ID NO: 3788602 - RNA, 20 nt, Human
aaacuuauaaaucauauuga

SEQ ID NO: 3788603 - RNA, 13 nt, Human
aaacuuaugaaug

SEQ ID NO: 3788604 - RNA, 16 nt, Human
aaacuuaugaauguuu

SEQ ID NO: 3788605 - RNA, 14 nt, Human
aaacuuauuugagu

SEQ ID NO: 3788606 - RNA, 22 nt, Human
aaacuuauuuuauauuuucccu

SEQ ID NO: 3788607 - RNA, 20 nt, Human
aaacuuauuuuuuucugauu

SEQ ID NO: 3788608 - RNA, 16 nt, Human
aaacuucaagcaccag

SEQ ID NO: 3788609 - RNA, 20 nt, Human
aaacuucagaagcaaacaau

SEQ ID NO: 3788610 - RNA, 23 nt, Human
aaacuucagcgguuuauauaagc

SEQ ID NO: 3788611 - RNA, 20 nt, Human
aaacuucaguuucacagaaa

SEQ ID NO: 3788612 - RNA, 16 nt, Human
aaacuuccaagaccug

SEQ ID NO: 3788613 - RNA, 14 nt, Human
aaacuucguuuaau

SEQ ID NO: 3788614 - RNA, 18 nt, Human
aaacuucucugaagggag

SEQ ID NO: 3788615 - RNA, 16 nt, Human
aaacuucuuaaauauc

SEQ ID NO: 3788616 - RNA, 20 nt, Human
aaacuucuuaaauaucuuuu

SEQ ID NO: 3788617 - RNA, 17 nt, Human
aaacuucuugucagaca

SEQ ID NO: 3788618 - RNA, 13 nt, Human
aaacuuggauacu

SEQ ID NO: 3788619 - RNA, 15 nt, Human
aaacuuggauucucu

SEQ ID NO: 3788620 - RNA, 18 nt, Human
aaacuuggauucucuaac

SEQ ID NO: 3788621 - RNA, 20 nt, Human
aaacuuggugcuuauugaua

SEQ ID NO: 3788622 - RNA, 12 nt, Human
aaacuuguaaau

SEQ ID NO: 3788623 - RNA, 19 nt, Human
aaacuuguaaauaaaggaa

SEQ ID NO: 3788624 - RNA, 18 nt, Human
aaacuugucacuugcaug

SEQ ID NO: 3788625 - RNA, 15 nt, Human
aaacuugugaaugcu

SEQ ID NO: 3788626 - RNA, 15 nt, Human
aaacuuguguaaaua

SEQ ID NO: 3788627 - RNA, 16 nt, Human
aaacuuguuucacuga

SEQ ID NO: 3788628 - RNA, 17 nt, Human
aaacuuguuucacugaa

SEQ ID NO: 3788629 - RNA, 20 nt, Human
aaaggugaguuugagcugcc

SEQ ID NO: 3788630 - RNA, 22 nt, Human
aaaggugaguuugagcugccuu

SEQ ID NO: 3788631 - RNA, 15 nt, Human
aaaggugauugucac

SEQ ID NO: 3788632 - RNA, 13 nt, Human
aaaggugccaugg

SEQ ID NO: 3788633 - RNA, 19 nt, Human
aaagguggauuuuguuuaa

SEQ ID NO: 3788634 - RNA, 22 nt, Human
aaaggugguauguguguguaug

SEQ ID NO: 3788635 - RNA, 14 nt, Human
aaagguguauuuaa

SEQ ID NO: 3788636 - RNA, 20 nt, Human
aaagguucuagguuucaaag

SEQ ID NO: 3788637 - RNA, 19 nt, Human
aaagguugaauaauauaug

SEQ ID NO: 3788638 - RNA, 16 nt, Human
aaagguuuacagaauu

SEQ ID NO: 3788639 - RNA, 16 nt, Human
aaagguuuaugaaaaa

SEQ ID NO: 3788640 - RNA, 19 nt, Human
aaagguuugcauucucaca

SEQ ID NO: 3788641 - RNA, 18 nt, Human
aaagguuuuauuuuguaa

SEQ ID NO: 3788642 - RNA, 14 nt, Human
aaagguuuuccucu

SEQ ID NO: 3788643 - RNA, 23 nt, Human
aaagguuuuggaucuugaaugug

SEQ ID NO: 3788644 - RNA, 20 nt, Human
aaaguaaaaagggaauuaug

SEQ ID NO: 3788645 - RNA, 13 nt, Human
aaaguaaagcuaa

SEQ ID NO: 3788646 - RNA, 18 nt, Human
aaaguaaauacaugcaua

SEQ ID NO: 3788647 - RNA, 22 nt, Human
aaaguaacucauuuguuaaaau

SEQ ID NO: 3788648 - RNA, 15 nt, Human
aaaguaauauuuauu

SEQ ID NO: 3788649 - RNA, 18 nt, Human
aaaguaauauuuauuaaa

SEQ ID NO: 3788650 - RNA, 12 nt, Human
aaaguaauguaa

SEQ ID NO: 3788651 - RNA, 13 nt, Human
aaaguaauguaaa

SEQ ID NO: 3788652 - RNA, 17 nt, Human
aaaguacaauguguuuu

SEQ ID NO: 3788653 - RNA, 19 nt, Human
aaaguacacuguuucaaac

SEQ ID NO: 3788654 - RNA, 21 nt, Human
aaaguacagaauuugaauuau

SEQ ID NO: 3788655 - RNA, 14 nt, Human
aaaguacagguacu

SEQ ID NO: 3788656 - RNA, 20 nt, Human
aaaguacagguacuuugucu

SEQ ID NO: 3788657 - RNA, 22 nt, Human
aaaguacagguacuuugucuaa

SEQ ID NO: 3788658 - RNA, 14 nt, Human
aaaguacauuuaau

SEQ ID NO: 3788659 - RNA, 15 nt, Human
aaaguacauuuuuug

SEQ ID NO: 3788660 - RNA, 18 nt, Human
aaaguacauuuuuugaaa

SEQ ID NO: 3788661 - RNA, 19 nt, Human
aaaguacauuuuuugaaau

SEQ ID NO: 3788662 - RNA, 12 nt, Human
aaaguacuguaa

SEQ ID NO: 3788663 - RNA, 14 nt, Human
aaaguacuuguagu

SEQ ID NO: 3788664 - RNA, 15 nt, Human
aaaguacuuguaguu

SEQ ID NO: 3788665 - RNA, 15 nt, Human
aaaguagaacuuugu

SEQ ID NO: 3788666 - RNA, 20 nt, Human
aaaguagaagucuuagaugu

SEQ ID NO: 3788667 - RNA, 11 nt, Human
aaaguagaggu

SEQ ID NO: 3788668 - RNA, 12 nt, Human
aaaguagggggc

SEQ ID NO: 3788669 - RNA, 19 nt, Human
aaaguaguacuucuucugu

SEQ ID NO: 3788670 - RNA, 18 nt, Human
aaaguauaaauuugugua

SEQ ID NO: 3788671 - RNA, 14 nt, Human
aaaguauaauguuu

SEQ ID NO: 3788672 - RNA, 17 nt, Human
aaaguauagagagaagu

SEQ ID NO: 3788673 - RNA, 17 nt, Human
aaaguauauauagaauc

SEQ ID NO: 3788674 - RNA, 18 nt, Human
aaaguauauauagaaucu

SEQ ID NO: 3788675 - RNA, 19 nt, Human
aaaguaucgggggcugggg

SEQ ID NO: 3788676 - RNA, 14 nt, Human
aaaguaugcauuau

SEQ ID NO: 3788677 - RNA, 19 nt, Human
aaaguauguauuauuuaca

SEQ ID NO: 3788678 - RNA, 13 nt, Human
aaaguauuaagca

SEQ ID NO: 3788679 - RNA, 17 nt, Human
aaaguauuauuuuccaa

SEQ ID NO: 3788680 - RNA, 16 nt, Human
aaaguauuccaccuua

SEQ ID NO: 3788681 - RNA, 22 nt, Human
aaaguauucuucucuuccuuuu

SEQ ID NO: 3788682 - RNA, 14 nt, Human
aaaguauugccaaa

SEQ ID NO: 3788683 - RNA, 15 nt, Human
aaaguauugccaaac

SEQ ID NO: 3788684 - RNA, 18 nt, Human
aaaguauugccaaacauu

SEQ ID NO: 3788685 - RNA, 19 nt, Human
aaaguauugccaaacauua

SEQ ID NO: 3788686 - RNA, 14 nt, Human
aaaguauuguaaau

SEQ ID NO: 3788687 - RNA, 15 nt, Human
aaaguauuguaaauu

SEQ ID NO: 3788688 - RNA, 16 nt, Human
aaaguauuguaaauua

SEQ ID NO: 3788689 - RNA, 20 nt, Human
aaaguauuguaaugagugaa

SEQ ID NO: 3788690 - RNA, 18 nt, Human
aaaguauuuaauuagugc

SEQ ID NO: 3788691 - RNA, 23 nt, Human
aaaguauuuaauuagugcuaagu

SEQ ID NO: 3788692 - RNA, 14 nt, Human
aaaguauuuuccug

SEQ ID NO: 3788693 - RNA, 21 nt, Human
aaaguauuuuccuguaaaaaa

SEQ ID NO: 3788694 - RNA, 12 nt, Human
aaaguauuuucu

SEQ ID NO: 3788695 - RNA, 15 nt, Human
aaaguauuuugaagu

SEQ ID NO: 3788696 - RNA, 17 nt, Human
aaaguauuuugaaguuu

SEQ ID NO: 3788697 - RNA, 23 nt, Human
aaaguauuuugaaguuuacauuu

SEQ ID NO: 3788698 - RNA, 18 nt, Human
aaagucaauguuuucagu

SEQ ID NO: 3788699 - RNA, 18 nt, Human
aaagucacaauguucuuu

SEQ ID NO: 3788700 - RNA, 20 nt, Human
aaagucacaauguucuuuau

SEQ ID NO: 3788701 - RNA, 17 nt, Human
aaagucaccaaauagug

SEQ ID NO: 3788702 - RNA, 13 nt, Human
aaagucagaaguu

SEQ ID NO: 3788703 - RNA, 18 nt, Human
aaagucagagacagauac

SEQ ID NO: 3788704 - RNA, 18 nt, Human
aaagucagauucuugcau

SEQ ID NO: 3788705 - RNA, 16 nt, Human
aaagucagguccaauu

SEQ ID NO: 3788706 - RNA, 16 nt, Human
aaagucaugauguuuu

SEQ ID NO: 3788707 - RNA, 17 nt, Human
aaagucaugauguuuuu

SEQ ID NO: 3788708 - RNA, 18 nt, Human
aaagucaugauguuuuua

SEQ ID NO: 3788709 - RNA, 20 nt, Human
aaagucaugcaaaggcuggg

SEQ ID NO: 3788710 - RNA, 21 nt, Human
aaagucaugcaaaggcuggga

SEQ ID NO: 3788711 - RNA, 19 nt, Human
aaaguccaauuuuaauuua

SEQ ID NO: 3788712 - RNA, 14 nt, Human
aaaguccuuuucuu

SEQ ID NO: 3788713 - RNA, 22 nt, Human
aaaguccuuuuuuuccaucuuu

SEQ ID NO: 3788714 - RNA, 12 nt, Human
aaagucuaaagu

SEQ ID NO: 3788715 - RNA, 19 nt, Human
aaagucuaaaguuuacagu

SEQ ID NO: 3788716 - RNA, 14 nt, Human
aaagucucuauuua

SEQ ID NO: 3788717 - RNA, 15 nt, Human
aaagucucuauuuaa

SEQ ID NO: 3788718 - RNA, 12 nt, Human
aaagucucuugu

SEQ ID NO: 3788719 - RNA, 19 nt, Human
aaagucugcauuacauucc

SEQ ID NO: 3788720 - RNA, 22 nt, Human
aaagucuguccuugaaggacua

SEQ ID NO: 3788721 - RNA, 22 nt, Human
aaagucugugugaugaacuuuc

SEQ ID NO: 3788722 - RNA, 18 nt, Human
aaagucuguugauuaaag

SEQ ID NO: 3788723 - RNA, 20 nt, Human
aaagucuucacucucugaag

SEQ ID NO: 3788724 - RNA, 19 nt, Human
aaagucuugugacuagugc

SEQ ID NO: 3788725 - RNA, 22 nt, Human
aaagucuugugacuagugcuga

SEQ ID NO: 3788726 - RNA, 21 nt, Human
aaagucuuuuaaaaaguauug

SEQ ID NO: 3788727 - RNA, 20 nt, Human
aaagugaaaguccagaaacu

SEQ ID NO: 3788728 - RNA, 13 nt, Human
aaagugaagcaaa

SEQ ID NO: 3788729 - RNA, 22 nt, Human
aaagugaaugaaagauuaaaca

SEQ ID NO: 3788730 - RNA, 12 nt, Human
aaagugaauuug

SEQ ID NO: 3788731 - RNA, 21 nt, Human
aaagugaauuugaaugaaaaa

SEQ ID NO: 3788732 - RNA, 13 nt, Human
aaagugacacagc

SEQ ID NO: 3788733 - RNA, 20 nt, Human
aaagugaggccacugaagag

SEQ ID NO: 3788734 - RNA, 23 nt, Human
aaagugaucaauaaaaugugauu

SEQ ID NO: 3788735 - RNA, 15 nt, Human
aaagugaugaacugg

SEQ ID NO: 3788736 - RNA, 15 nt, Human
aaagugaugacauau

SEQ ID NO: 3788737 - RNA, 16 nt, Human
aaagugaugacauauu

SEQ ID NO: 3788738 - RNA, 15 nt, Human
aaagugauuaaacgu

SEQ ID NO: 3788739 - RNA, 13 nt, Human
aaagugccaaaga

SEQ ID NO: 3788740 - RNA, 14 nt, Human
aaagugccaaagaa

SEQ ID NO: 3788741 - RNA, 15 nt, Human
aaagugccaguauuu

SEQ ID NO: 3788742 - RNA, 20 nt, Human
aaagugccugacacacuaac

SEQ ID NO: 3788743 - RNA, 15 nt, Human
aaagugccuuucagg

SEQ ID NO: 3788744 - RNA, 12 nt, Human
aaagugccuuug

SEQ ID NO: 3788745 - RNA, 13 nt, Human
aaagugcuaaggu

SEQ ID NO: 3788746 - RNA, 21 nt, Human
aaagugcuaagguucuaaggc

SEQ ID NO: 3788747 - RNA, 21 nt, Human
aaagugcugcagggcuuuaaa

SEQ ID NO: 3788748 - RNA, 12 nt, Human
aaagugcuggga

SEQ ID NO: 3788749 - RNA, 13 nt, Human
aaagugcuugugu

SEQ ID NO: 3788750 - RNA, 20 nt, Human
aaaguggaaaacaaggaagu

SEQ ID NO: 3788751 - RNA, 20 nt, Human
aaaguggaacgaaaaugaaa

SEQ ID NO: 3788752 - RNA, 13 nt, Human
aaaguggaaggaa

SEQ ID NO: 3788753 - RNA, 16 nt, Human
aaaguggaaggaaaga

SEQ ID NO: 3788754 - RNA, 22 nt, Human
aaaguggcaccugucugcucca

SEQ ID NO: 3788755 - RNA, 17 nt, Human
aaaguggccaugccacc

SEQ ID NO: 3788756 - RNA, 22 nt, Human
aaaguggguuuuuuaguugaau

SEQ ID NO: 3788757 - RNA, 23 nt, Human
aaagugguacuugaucauuuuua

SEQ ID NO: 3788758 - RNA, 21 nt, Human
aaaguggugcucaguuguaga

SEQ ID NO: 3788759 - RNA, 18 nt, Human
aaaguguaaagcauucca

SEQ ID NO: 3788760 - RNA, 17 nt, Human
aaaguguaacauaugca

SEQ ID NO: 3788761 - RNA, 14 nt, Human
aaaguguauuugga

SEQ ID NO: 3788762 - RNA, 22 nt, Human
aaaguguauuuggaaauaaagu

SEQ ID NO: 3788763 - RNA, 16 nt, Human
aaaguguauuuuauaa

SEQ ID NO: 3788764 - RNA, 21 nt, Human
aaaguguauuuuuuuacuaau

SEQ ID NO: 3788765 - RNA, 18 nt, Human
aaagugucaccuuuucuu

SEQ ID NO: 3788766 - RNA, 20 nt, Human
aaagugucaccuuuucuugc

SEQ ID NO: 3788767 - RNA, 21 nt, Human
aaagugugaaauaaauuuuuu

SEQ ID NO: 3788768 - RNA, 14 nt, Human
aaagugugagcagu

SEQ ID NO: 3788769 - RNA, 22 nt, Human
aaagugugagcagugaguuaca

SEQ ID NO: 3788770 - RNA, 14 nt, Human
aaagugugcuuuau

SEQ ID NO: 3788771 - RNA, 19 nt, Human
aaaguguggucccaacagg

SEQ ID NO: 3788772 - RNA, 16 nt, Human
aaaguguguauauauu

SEQ ID NO: 3788773 - RNA, 12 nt, Human
aaaguguguauu

SEQ ID NO: 3788774 - RNA, 14 nt, Human
aaaguguguauuaa

SEQ ID NO: 3788775 - RNA, 14 nt, Human
aaaguguguuguug

SEQ ID NO: 3788776 - RNA, 14 nt, Human
aaaguguuacuuuu

SEQ ID NO: 3788777 - RNA, 12 nt, Human
aaaguguuucag

SEQ ID NO: 3788778 - RNA, 13 nt, Human
aaaguguuucagc

SEQ ID NO: 3788779 - RNA, 18 nt, Human
aaacuuguuucacugaaa

SEQ ID NO: 3788780 - RNA, 20 nt, Human
aaacuuguuugcugugaaca

SEQ ID NO: 3788781 - RNA, 13 nt, Human
aaacuuuaauaua

SEQ ID NO: 3788782 - RNA, 21 nt, Human
aaacuuuagaguagcaugaga

SEQ ID NO: 3788783 - RNA, 18 nt, Human
aaacuuuaggguaaaaau

SEQ ID NO: 3788784 - RNA, 16 nt, Human
aaacuuuagguuuuuu

SEQ ID NO: 3788785 - RNA, 13 nt, Human
aaacuuuauacau

SEQ ID NO: 3788786 - RNA, 14 nt, Human
aaacuuuauuuuau

SEQ ID NO: 3788787 - RNA, 23 nt, Human
aaacuuuauuuuauauaauaaag

SEQ ID NO: 3788788 - RNA, 20 nt, Human
aaacuuucauuccuucagau

SEQ ID NO: 3788789 - RNA, 20 nt, Human
aaacuuuccucuuccugccu

SEQ ID NO: 3788790 - RNA, 15 nt, Human
aaacuuucuuaauau

SEQ ID NO: 3788791 - RNA, 12 nt, Human
aaacuuugaaau

SEQ ID NO: 3788792 - RNA, 15 nt, Human
aaacuuugauucuuu

SEQ ID NO: 3788793 - RNA, 13 nt, Human
aaacuuugggaaa

SEQ ID NO: 3788794 - RNA, 17 nt, Human
aaacuuugggaaaacau

SEQ ID NO: 3788795 - RNA, 15 nt, Human
aaacuuuuagaaacu

SEQ ID NO: 3788796 - RNA, 13 nt, Human
aaacuuuuauaaa

SEQ ID NO: 3788797 - RNA, 18 nt, Human
aaacuuuuauaaauuaaa

SEQ ID NO: 3788798 - RNA, 12 nt, Human
aaacuuuucuag

SEQ ID NO: 3788799 - RNA, 14 nt, Human
aaacuuuucucaga

SEQ ID NO: 3788800 - RNA, 12 nt, Human
aaacuuuucuga

SEQ ID NO: 3788801 - RNA, 16 nt, Human
aaacuuuucugauaga

SEQ ID NO: 3788802 - RNA, 17 nt, Human
aaacuuuucugauagag

SEQ ID NO: 3788803 - RNA, 24 nt, Human
aaacuuuuguaaagaaauuuacua

SEQ ID NO: 3788804 - RNA, 19 nt, Human
aaacuuuuuuauuuaaaaa

SEQ ID NO: 3788805 - RNA, 24 nt, Human
aaacuuuuuugaaauaauaaaucu

SEQ ID NO: 3788806 - RNA, 14 nt, Human
aaacuuuuuuucaa

SEQ ID NO: 3788807 - RNA, 17 nt, Human
aaacuuuuuuucaaugu

SEQ ID NO: 3788808 - RNA, 22 nt, Human
aaacuuuuuuucuguaccaguu

SEQ ID NO: 3788809 - RNA, 11 nt, Human
aaagaaaaaaa

SEQ ID NO: 3788810 - RNA, 21 nt, Human
aaagaaaaaaaaaaaagccag

SEQ ID NO: 3788811 - RNA, 22 nt, Human
aaagaaaaaaaaaaaagccagc

SEQ ID NO: 3788812 - RNA, 20 nt, Human
aaagaaaaaaaaaagaagaa

SEQ ID NO: 3788813 - RNA, 16 nt, Human
aaagaaaaaaaaagaa

SEQ ID NO: 3788814 - RNA, 18 nt, Human
aaagaaaaaaaagaaagc

SEQ ID NO: 3788815 - RNA, 18 nt, Human
aaagaaaaaaauguauuu

SEQ ID NO: 3788816 - RNA, 15 nt, Human
aaagaaaaaaauguc

SEQ ID NO: 3788817 - RNA, 19 nt, Human
aaagaaaaaaaugucaaaa

SEQ ID NO: 3788818 - RNA, 16 nt, Human
aaagaaaaaaauugaa

SEQ ID NO: 3788819 - RNA, 13 nt, Human
aaagaaaaacaaa

SEQ ID NO: 3788820 - RNA, 13 nt, Human
aaagaaaaauauu

SEQ ID NO: 3788821 - RNA, 21 nt, Human
aaagaaaaauuauuaaaggaa

SEQ ID NO: 3788822 - RNA, 19 nt, Human
aaagaaaacaaaaaacgaa

SEQ ID NO: 3788823 - RNA, 14 nt, Human
aaagaaaacaaaac

SEQ ID NO: 3788824 - RNA, 12 nt, Human
aaagaaaacuug

SEQ ID NO: 3788825 - RNA, 22 nt, Human
aaaguuuaauauuaaagccaug

SEQ ID NO: 3788826 - RNA, 15 nt, Human
aaaguuuaaucagag

SEQ ID NO: 3788827 - RNA, 19 nt, Human
aaaguuuacaaguguauau

SEQ ID NO: 3788828 - RNA, 22 nt, Human
aaaguuuacaguaaauaaauug

SEQ ID NO: 3788829 - RNA, 18 nt, Human
aaaguuucaaaaaucuga

SEQ ID NO: 3788830 - RNA, 20 nt, Human
aaaguuucaaaaaucugaag

SEQ ID NO: 3788831 - RNA, 19 nt, Human
aaaguuucaauuuguuucc

SEQ ID NO: 3788832 - RNA, 11 nt, Human
aaaguuucaug

SEQ ID NO: 3788833 - RNA, 20 nt, Human
aaaguuuccuaaucagaaau

SEQ ID NO: 3788834 - RNA, 16 nt, Human
aaaguuuguugaaaca

SEQ ID NO: 3788835 - RNA, 15 nt, Human
aaaguuuuacaaagg

SEQ ID NO: 3788836 - RNA, 15 nt, Human
aaaguuuucccuuga

SEQ ID NO: 3788837 - RNA, 15 nt, Human
aaaguuuuccugaga

SEQ ID NO: 3788838 - RNA, 13 nt, Human
aaaguuuugaaaa

SEQ ID NO: 3788839 - RNA, 21 nt, Human
aaaguuuugaguagauauuac

SEQ ID NO: 3788840 - RNA, 18 nt, Human
aaaguuuuguaaaagaaa

SEQ ID NO: 3788841 - RNA, 14 nt, Human
aaaguuuuguugua

SEQ ID NO: 3788842 - RNA, 14 nt, Human
aaaguuuuuguuug

SEQ ID NO: 3788843 - RNA, 19 nt, Human
aaauaaaaaaaaaaaagag

SEQ ID NO: 3788844 - RNA, 13 nt, Human
aaauaaaaaaaag

SEQ ID NO: 3788845 - RNA, 15 nt, Human
aaauaaaaaaaagaa

SEQ ID NO: 3788846 - RNA, 20 nt, Human
aaauaaaaaaaagaaaaaag

SEQ ID NO: 3788847 - RNA, 18 nt, Human
aaauaaaaaaagaaaaaa

SEQ ID NO: 3788848 - RNA, 15 nt, Human
aaauaaaaaacacug

SEQ ID NO: 3788849 - RNA, 21 nt, Human
aaauaaaaaagcucuuuuaau

SEQ ID NO: 3788850 - RNA, 13 nt, Human
aaauaaaaaaguc

SEQ ID NO: 3788851 - RNA, 14 nt, Human
aaauaaaaaauaua

SEQ ID NO: 3788852 - RNA, 18 nt, Human
aaauaaaaacaaacguuu

SEQ ID NO: 3788853 - RNA, 20 nt, Human
aaauaaaaagaaaggcuguu

SEQ ID NO: 3788854 - RNA, 19 nt, Human
aaauaaaaagugacacagc

SEQ ID NO: 3788855 - RNA, 16 nt, Human
aaauaaaaagugcuuu

SEQ ID NO: 3788856 - RNA, 18 nt, Human
aaauaaaacauuuucaca

SEQ ID NO: 3788857 - RNA, 14 nt, Human
aaauaaaaccagcu

SEQ ID NO: 3788858 - RNA, 21 nt, Human
aaauaaaacccguugauuacu

SEQ ID NO: 3788859 - RNA, 11 nt, Human
aaauaaaaccu

SEQ ID NO: 3788860 - RNA, 12 nt, Human
aaauaaaaccuu

SEQ ID NO: 3788861 - RNA, 16 nt, Human
aaauaaaacuuuuuaa

SEQ ID NO: 3788862 - RNA, 11 nt, Human
aaauaaaagca

SEQ ID NO: 3788863 - RNA, 13 nt, Human
aaauaaaagcagc

SEQ ID NO: 3788864 - RNA, 18 nt, Human
aaauaaaaggaagccaaa

SEQ ID NO: 3788865 - RNA, 17 nt, Human
aaauaaaaguuuuacaa

SEQ ID NO: 3788866 - RNA, 13 nt, Human
aaauaaaauacuu

SEQ ID NO: 3788867 - RNA, 19 nt, Human
aaauaaaaugaaaauugua

SEQ ID NO: 3788868 - RNA, 23 nt, Human
aaauaaaaugaaaauuguauuau

SEQ ID NO: 3788869 - RNA, 14 nt, Human
aaauaaaaugacca

SEQ ID NO: 3788870 - RNA, 16 nt, Human
aaauaaaaugaccagu

SEQ ID NO: 3788871 - RNA, 13 nt, Human
aaauaaaaugcua

SEQ ID NO: 3788872 - RNA, 14 nt, Human
aaauaaaaugcuag

SEQ ID NO: 3788873 - RNA, 15 nt, Human
aaauaaaauggauuu

SEQ ID NO: 3788874 - RNA, 13 nt, Human
aaauaaaauuaug

SEQ ID NO: 3788875 - RNA, 16 nt, Human
aaauaaaauuuguugc

SEQ ID NO: 3788876 - RNA, 17 nt, Human
aaauaaaauuuguugca

SEQ ID NO: 3788877 - RNA, 18 nt, Human
aaauaaaauuuguugcau

SEQ ID NO: 3788878 - RNA, 13 nt, Human
aaauaaacacugu

SEQ ID NO: 3788879 - RNA, 22 nt, Human
aaauaaaccaaaggacauuaug

SEQ ID NO: 3788880 - RNA, 13 nt, Human
aaauaaaccacug

SEQ ID NO: 3788881 - RNA, 19 nt, Human
aaauaaaccucaaaauguc

SEQ ID NO: 3788882 - RNA, 15 nt, Human
aaauaaacgucuuaa

SEQ ID NO: 3788883 - RNA, 14 nt, Human
aaauaaacuguugc

SEQ ID NO: 3788884 - RNA, 13 nt, Human
aaauaaacuuuuu

SEQ ID NO: 3788885 - RNA, 20 nt, Human
aaauaaacuuuuuuucaaug

SEQ ID NO: 3788886 - RNA, 19 nt, Human
aaauaaagacaaccauauu

SEQ ID NO: 3788887 - RNA, 13 nt, Human
aaauaaaggaacc

SEQ ID NO: 3788888 - RNA, 20 nt, Human
aaauaaaguauauauagaau

SEQ ID NO: 3788889 - RNA, 19 nt, Human
aaauaaaguaucaugcauu

SEQ ID NO: 3788890 - RNA, 15 nt, Human
aaauaaaguuacauu

SEQ ID NO: 3788891 - RNA, 18 nt, Human
aaauaaaguuggugacag

SEQ ID NO: 3788892 - RNA, 14 nt, Human
aaauaaauaaaagc

SEQ ID NO: 3788893 - RNA, 16 nt, Human
aaauaaauaaaagccu

SEQ ID NO: 3788894 - RNA, 11 nt, Human
aaauaaauaau

SEQ ID NO: 3788895 - RNA, 14 nt, Human
aaauaaauaauuuu

SEQ ID NO: 3788896 - RNA, 20 nt, Human
aaauaaauagcuauauccau

SEQ ID NO: 3788897 - RNA, 13 nt, Human
aaauaaauauacc

SEQ ID NO: 3788898 - RNA, 15 nt, Human
aaauaaauguaucau

SEQ ID NO: 3788899 - RNA, 21 nt, Human
aaauaaauguaucauagaaau

SEQ ID NO: 3788900 - RNA, 14 nt, Human
aaauaaauuugacu

SEQ ID NO: 3788901 - RNA, 19 nt, Human
aaauaaauuugguucuaau

SEQ ID NO: 3788902 - RNA, 17 nt, Human
aaauaacaaugugcucu

SEQ ID NO: 3788903 - RNA, 14 nt, Human
aaauaacaauguua

SEQ ID NO: 3788904 - RNA, 17 nt, Human
aaauaacaauguuaagg

SEQ ID NO: 3788905 - RNA, 16 nt, Human
aaauaacagaagaaaa

SEQ ID NO: 3788906 - RNA, 12 nt, Human
aaauaacaguau

SEQ ID NO: 3788907 - RNA, 21 nt, Human
aaauaaccaacccuucccuga

SEQ ID NO: 3788908 - RNA, 15 nt, Human
aaauaacccauaauu

SEQ ID NO: 3788909 - RNA, 23 nt, Human
aaauaacccuucaacguuucuuc

SEQ ID NO: 3788910 - RNA, 14 nt, Human
aaauaacugaauuu

SEQ ID NO: 3788911 - RNA, 13 nt, Human
aaauaacuggaaa

SEQ ID NO: 3788912 - RNA, 20 nt, Human
aaauaacuggaaaacagaac

SEQ ID NO: 3788913 - RNA, 21 nt, Human
aaauaacuggaggaauuuucu

SEQ ID NO: 3788914 - RNA, 15 nt, Human
aaauaacuucaagca

SEQ ID NO: 3788915 - RNA, 16 nt, Human
aaauaacuucaagcaa

SEQ ID NO: 3788916 - RNA, 16 nt, Human
aaauaacuucaguccu

SEQ ID NO: 3788917 - RNA, 13 nt, Human
aaauaagaaaaga

SEQ ID NO: 3788918 - RNA, 22 nt, Human
aaauaagaaaagauguagauuu

SEQ ID NO: 3788919 - RNA, 14 nt, Human
aaauaagaaauaau

SEQ ID NO: 3788920 - RNA, 20 nt, Human
aaauaagaacgaggauuuua

SEQ ID NO: 3788921 - RNA, 14 nt, Human
aaauaagaagaaug

SEQ ID NO: 3788922 - RNA, 22 nt, Human
aaauaaggaaugauauaagguu

SEQ ID NO: 3788923 - RNA, 22 nt, Human
aaauaaggauuuuucucuuauu

SEQ ID NO: 3788924 - RNA, 14 nt, Human
aaauaagguguauu

SEQ ID NO: 3788925 - RNA, 14 nt, Human
aaauaaguauuuau

SEQ ID NO: 3788926 - RNA, 21 nt, Human
aaauaagucaacaguaaacca

SEQ ID NO: 3788927 - RNA, 19 nt, Human
aaauaagugcccucuccca

SEQ ID NO: 3788928 - RNA, 20 nt, Human
aaauaagugguuauuucuca

SEQ ID NO: 3788929 - RNA, 17 nt, Human
aaauaauaaagaugcuc

SEQ ID NO: 3788930 - RNA, 19 nt, Human
aaauaauaaagaugcucuu

SEQ ID NO: 3788931 - RNA, 14 nt, Human
aaauaaucaaaagc

SEQ ID NO: 3788932 - RNA, 15 nt, Human
aaauaaucaaaagcu

SEQ ID NO: 3788933 - RNA, 20 nt, Human
aaauaaugcuacaauuuuaa

SEQ ID NO: 3788934 - RNA, 13 nt, Human
aaauaaugcugca

SEQ ID NO: 3788935 - RNA, 17 nt, Human
aaauaaugcuucagaua

SEQ ID NO: 3788936 - RNA, 21 nt, Human
aaauaaugcuucagauauuau

SEQ ID NO: 3788937 - RNA, 13 nt, Human
aaauaaugcuuug

SEQ ID NO: 3788938 - RNA, 16 nt, Human
aaauaaugcuuugaaa

SEQ ID NO: 3788939 - RNA, 16 nt, Human
aaauaaugucuuguua

SEQ ID NO: 3788940 - RNA, 22 nt, Human
aaauaaugugaaacuggauuaa

SEQ ID NO: 3788941 - RNA, 20 nt, Human
aaauaauguguaguucaugu

SEQ ID NO: 3788942 - RNA, 23 nt, Human
aaauaauuauauaacuguauuug

SEQ ID NO: 3788943 - RNA, 15 nt, Human
aaauaauucuaaagg

SEQ ID NO: 3788944 - RNA, 15 nt, Human
aaauaauuguuguuc

SEQ ID NO: 3788945 - RNA, 13 nt, Human
aaauaauuuccua

SEQ ID NO: 3788946 - RNA, 18 nt, Human
aaauaauuuuaaaaaugg

SEQ ID NO: 3788947 - RNA, 20 nt, Human
aaauaauuuuaaaaauggug

SEQ ID NO: 3788948 - RNA, 12 nt, Human
aaauaauuuuau

SEQ ID NO: 3788949 - RNA, 18 nt, Human
aaauaauuuuauuccaga

SEQ ID NO: 3788950 - RNA, 22 nt, Human
aaauaauuuuuauauuugaaau

SEQ ID NO: 3788951 - RNA, 15 nt, Human
aaauacaaaaauacu

SEQ ID NO: 3788952 - RNA, 16 nt, Human
aaauacaaguucuauu

SEQ ID NO: 3788953 - RNA, 14 nt, Human
aaauacaauaaacu

SEQ ID NO: 3788954 - RNA, 15 nt, Human
aaauacaauaaacua

SEQ ID NO: 3788955 - RNA, 21 nt, Human
aaauacaauuuuguuucugua

SEQ ID NO: 3788956 - RNA, 19 nt, Human
aaauacacacucaaaucaa

SEQ ID NO: 3788957 - RNA, 22 nt, Human
aaauacaccaccucacuccugu

SEQ ID NO: 3788958 - RNA, 17 nt, Human
aaauacagauagauaua

SEQ ID NO: 3788959 - RNA, 15 nt, Human
aaauacagauuuuga

SEQ ID NO: 3788960 - RNA, 13 nt, Human
aaauacaggaaac

SEQ ID NO: 3788961 - RNA, 14 nt, Human
aaauacaggaaaca

SEQ ID NO: 3788962 - RNA, 13 nt, Human
aaauacaugacau

SEQ ID NO: 3788963 - RNA, 14 nt, Human
aaauacaugaugau

SEQ ID NO: 3788964 - RNA, 14 nt, Human
aaauacaugcaucu

SEQ ID NO: 3788965 - RNA, 19 nt, Human
aaauacaugccacaucaaa

SEQ ID NO: 3788966 - RNA, 23 nt, Human
aaauacaugccacaucaaaccuu

SEQ ID NO: 3788967 - RNA, 18 nt, Human
aaauacauuuaaaacuua

SEQ ID NO: 3788968 - RNA, 18 nt, Human
aaauaccagccaguaaau

SEQ ID NO: 3788969 - RNA, 21 nt, Human
aaauaccagccaguaaauggg

SEQ ID NO: 3788970 - RNA, 15 nt, Human
aaauaccauuauuau

SEQ ID NO: 3788971 - RNA, 14 nt, Human
aaagugccuuugca

SEQ ID NO: 3788972 - RNA, 16 nt, Human
aaagugcuaagguucu

SEQ ID NO: 3788973 - RNA, 13 nt, Human
aaagugcugagau

SEQ ID NO: 3788974 - RNA, 11 nt, Human
aaagugcuggg

SEQ ID NO: 3788975 - RNA, 17 nt, Human
aaagugcuuguguaauu

SEQ ID NO: 3788976 - RNA, 23 nt, Human
aaagugcuuguguaauuuaugug

SEQ ID NO: 3788977 - RNA, 15 nt, Human
aaaguggaaguaugu

SEQ ID NO: 3788978 - RNA, 15 nt, Human
aaaguggaauuucuu

SEQ ID NO: 3788979 - RNA, 17 nt, Human
aaaguggcaagaccaaa

SEQ ID NO: 3788980 - RNA, 19 nt, Human
aaaguggccaagaagcagu

SEQ ID NO: 3788981 - RNA, 14 nt, Human
aaaguggccucuuu

SEQ ID NO: 3788982 - RNA, 21 nt, Human
aaaguggcgugggagccagcc

SEQ ID NO: 3788983 - RNA, 17 nt, Human
aaagugggcuugauucu

SEQ ID NO: 3788984 - RNA, 21 nt, Human
aaaguggguuauucuggaguu

SEQ ID NO: 3788985 - RNA, 17 nt, Human
aaaguggguuuuuuagu

SEQ ID NO: 3788986 - RNA, 21 nt, Human
aaaguggguuuuuuaguugaa

SEQ ID NO: 3788987 - RNA, 14 nt, Human
aaagugguacuuga

SEQ ID NO: 3788988 - RNA, 20 nt, Human
aaagugguacuugaucauuu

SEQ ID NO: 3788989 - RNA, 23 nt, Human
aaagugguagguacuuuuuguga

SEQ ID NO: 3788990 - RNA, 16 nt, Human
aaagugguauagaaau

SEQ ID NO: 3788991 - RNA, 20 nt, Human
aaagugguauagaaaugcug

SEQ ID NO: 3788992 - RNA, 23 nt, Human
aaauguuuuucugccagggagcu

SEQ ID NO: 3788993 - RNA, 23 nt, Human
aaauguuuuuggucuuuuauaau

SEQ ID NO: 3788994 - RNA, 21 nt, Human
aaauguuuuuuuuuaaagacu

SEQ ID NO: 3788995 - RNA, 17 nt, Human
aaauuaaaaagauucuu

SEQ ID NO: 3788996 - RNA, 13 nt, Human
aaauuaaacaauu

SEQ ID NO: 3788997 - RNA, 19 nt, Human
aaauuaaacuuauuuacaa

SEQ ID NO: 3788998 - RNA, 14 nt, Human
aaauuaaagaaaau

SEQ ID NO: 3788999 - RNA, 21 nt, Human
aaauuaaagccuuuaguauca

SEQ ID NO: 3789000 - RNA, 22 nt, Human
aaauuaaagccuuuaguaucag

SEQ ID NO: 3789001 - RNA, 16 nt, Human
aaauuaaaguuugcuu

SEQ ID NO: 3789002 - RNA, 15 nt, Human
aaauuaaauaaaaua

SEQ ID NO: 3789003 - RNA, 16 nt, Human
aaauuaaauauaugua

SEQ ID NO: 3789004 - RNA, 23 nt, Human
aaauuaaauauauguauguaaaa

SEQ ID NO: 3789005 - RNA, 21 nt, Human
aaauuaacuggguaaugaaac

SEQ ID NO: 3789006 - RNA, 13 nt, Human
aaauuaacuuuua

SEQ ID NO: 3789007 - RNA, 23 nt, Human
aaauuaacuuuuauaaacuuuac

SEQ ID NO: 3789008 - RNA, 14 nt, Human
aaauuaagaagaaa

SEQ ID NO: 3789009 - RNA, 14 nt, Human
aaauuaagaauguu

SEQ ID NO: 3789010 - RNA, 22 nt, Human
aaauuaaggcaacugaacaaaa

SEQ ID NO: 3789011 - RNA, 12 nt, Human
aaauuaaggugu

SEQ ID NO: 3789012 - RNA, 17 nt, Human
aaauuaagguguuugaa

SEQ ID NO: 3789013 - RNA, 23 nt, Human
aaauuaagguguuugaaaauagu

SEQ ID NO: 3789014 - RNA, 12 nt, Human
aaauuaauaucu

SEQ ID NO: 3789015 - RNA, 13 nt, Human
aaauuaaucacaa

SEQ ID NO: 3789016 - RNA, 14 nt, Human
aaauuaaucugggc

SEQ ID NO: 3789017 - RNA, 16 nt, Human
aaauuacaauuuuauc

SEQ ID NO: 3789018 - RNA, 16 nt, Human
aaauuacacccaaaga

SEQ ID NO: 3789019 - RNA, 14 nt, Human
aaauuacauauacu

SEQ ID NO: 3789020 - RNA, 18 nt, Human
aaauuacauuuguaauuu

SEQ ID NO: 3789021 - RNA, 19 nt, Human
aaauuaccagaguuguucu

SEQ ID NO: 3789022 - RNA, 15 nt, Human
aaauuaccuguggau

SEQ ID NO: 3789023 - RNA, 19 nt, Human
aaauuacuauagcaaagua

SEQ ID NO: 3789024 - RNA, 14 nt, Human
aaauuacuuuguga

SEQ ID NO: 3789025 - RNA, 11 nt, Human
aaauuagaaaa

SEQ ID NO: 3789026 - RNA, 17 nt, Human
aaauuagaaaauauucu

SEQ ID NO: 3789027 - RNA, 20 nt, Human
aaauuagaaaauguuauuua

SEQ ID NO: 3789028 - RNA, 16 nt, Human
aaauuagagaaauaua

SEQ ID NO: 3789029 - RNA, 20 nt, Human
aaauuagccaguaauccugu

SEQ ID NO: 3789030 - RNA, 21 nt, Human
aaauuagccaguaauccugua

SEQ ID NO: 3789031 - RNA, 15 nt, Human
aaauuagccgggcgu

SEQ ID NO: 3789032 - RNA, 21 nt, Human
aaauuagccuaagauauacuu

SEQ ID NO: 3789033 - RNA, 17 nt, Human
aaauuagcugugugaaa

SEQ ID NO: 3789034 - RNA, 15 nt, Human
aaauuaggaauaaau

SEQ ID NO: 3789035 - RNA, 18 nt, Human
aaauuaggaauaaauaaa

SEQ ID NO: 3789036 - RNA, 21 nt, Human
aaauuaggauguaaaucugcu

SEQ ID NO: 3789037 - RNA, 18 nt, Human
aaauuaggauuucaugau

SEQ ID NO: 3789038 - RNA, 17 nt, Human
aaauuagguuuuguaca

SEQ ID NO: 3789039 - RNA, 19 nt, Human
aaauuagguuuuguacaau

SEQ ID NO: 3789040 - RNA, 15 nt, Human
aaauuaguucccauu

SEQ ID NO: 3789041 - RNA, 15 nt, Human
aaauuauaaagauaa

SEQ ID NO: 3789042 - RNA, 23 nt, Human
aaauuauaaggacugcaugguaa

SEQ ID NO: 3789043 - RNA, 23 nt, Human
aaauuauaauguauucauauuug

SEQ ID NO: 3789044 - RNA, 17 nt, Human
aaauuauagaugggaau

SEQ ID NO: 3789045 - RNA, 21 nt, Human
aaauuauagcucuaauguuug

SEQ ID NO: 3789046 - RNA, 12 nt, Human
aaauuauauucc

SEQ ID NO: 3789047 - RNA, 18 nt, Human
aaauuauauuugugcuau

SEQ ID NO: 3789048 - RNA, 17 nt, Human
aaauuaucaagcuaaua

SEQ ID NO: 3789049 - RNA, 20 nt, Human
aaauuaucuugauacauuca

SEQ ID NO: 3789050 - RNA, 21 nt, Human
aaauuaucuugauacauucaa

SEQ ID NO: 3789051 - RNA, 17 nt, Human
aaauuaugcuaagaauu

SEQ ID NO: 3789052 - RNA, 14 nt, Human
aaauuaugguaaaa

SEQ ID NO: 3789053 - RNA, 15 nt, Human
aaauuauguaaauua

SEQ ID NO: 3789054 - RNA, 23 nt, Human
aaauuaugugccagauuuaugca

SEQ ID NO: 3789055 - RNA, 20 nt, Human
aaauuauguuacaucuguuu

SEQ ID NO: 3789056 - RNA, 14 nt, Human
aaauuauguuuuua

SEQ ID NO: 3789057 - RNA, 14 nt, Human
aaauuauuaaugaa

SEQ ID NO: 3789058 - RNA, 23 nt, Human
aaauuauuaguuuacaucauuuu

SEQ ID NO: 3789059 - RNA, 19 nt, Human
aaauuauuauaagcauuga

SEQ ID NO: 3789060 - RNA, 21 nt, Human
aaauuauucaguuaagaaaaa

SEQ ID NO: 3789061 - RNA, 20 nt, Human
aaauuauuguuuuucuuuuu

SEQ ID NO: 3789062 - RNA, 15 nt, Human
aaauuauuuaauaaa

SEQ ID NO: 3789063 - RNA, 16 nt, Human
aaauuauuuguguaau

SEQ ID NO: 3789064 - RNA, 17 nt, Human
aaauuauuuuaaacaaa

SEQ ID NO: 3789065 - RNA, 20 nt, Human
aaauuauuuuaaauuauaag

SEQ ID NO: 3789066 - RNA, 17 nt, Human
aaauuauuuuguucaua

SEQ ID NO: 3789067 - RNA, 21 nt, Human
aaauucaaaaaguguuuauuu

SEQ ID NO: 3789068 - RNA, 21 nt, Human
aaauucaacguuaauaauucu

SEQ ID NO: 3789069 - RNA, 16 nt, Human
aaauucaacuuuguaa

SEQ ID NO: 3789070 - RNA, 18 nt, Human
aaauucacaaacuuuuau

SEQ ID NO: 3789071 - RNA, 16 nt, Human
aaauucacaauagaaa

SEQ ID NO: 3789072 - RNA, 21 nt, Human
aaauucacaugaugcacuuca

SEQ ID NO: 3789073 - RNA, 12 nt, Human
aaauucagcaaa

SEQ ID NO: 3789074 - RNA, 21 nt, Human
aaauucagcaaaccauuuuua

SEQ ID NO: 3789075 - RNA, 13 nt, Human
aaauucagcauuu

SEQ ID NO: 3789076 - RNA, 15 nt, Human
aaauucagcauuuga

SEQ ID NO: 3789077 - RNA, 20 nt, Human
aaauucaggcuacugcuuca

SEQ ID NO: 3789078 - RNA, 14 nt, Human
aaauucaguuucau

SEQ ID NO: 3789079 - RNA, 17 nt, Human
aaauucauauucuuuua

SEQ ID NO: 3789080 - RNA, 14 nt, Human
aaauucaugcugcu

SEQ ID NO: 3789081 - RNA, 12 nt, Human
aaauucauuucu

SEQ ID NO: 3789082 - RNA, 13 nt, Human
aaauucauuuuuu

SEQ ID NO: 3789083 - RNA, 17 nt, Human
aaauuccaaagucucua

SEQ ID NO: 3789084 - RNA, 18 nt, Human
aaauuccaaagucucuaa

SEQ ID NO: 3789085 - RNA, 22 nt, Human
aaauuccaaagucucuaauucu

SEQ ID NO: 3789086 - RNA, 13 nt, Human
aaauuccacugga

SEQ ID NO: 3789087 - RNA, 20 nt, Human
aaauucccaacaaacauuga

SEQ ID NO: 3789088 - RNA, 18 nt, Human
aaauucccuggccuuuca

SEQ ID NO: 3789089 - RNA, 18 nt, Human
aaauucccuucaucugga

SEQ ID NO: 3789090 - RNA, 17 nt, Human
aaauuccuauugugauu

SEQ ID NO: 3789091 - RNA, 22 nt, Human
aaauuccuauugugauuugacu

SEQ ID NO: 3789092 - RNA, 14 nt, Human
aaauuccuguagca

SEQ ID NO: 3789093 - RNA, 23 nt, Human
aaauuccuuagcuuagaccucag

SEQ ID NO: 3789094 - RNA, 18 nt, Human
aaauucgaccugauuuac

SEQ ID NO: 3789095 - RNA, 21 nt, Human
aaauucgcugcaaccuguuga

SEQ ID NO: 3789096 - RNA, 15 nt, Human
aaauucuacaacaca

SEQ ID NO: 3789097 - RNA, 19 nt, Human
aaauucuauaggaacauau

SEQ ID NO: 3789098 - RNA, 19 nt, Human
aaauucuauuacaguaugu

SEQ ID NO: 3789099 - RNA, 13 nt, Human
aaauucuccugga

SEQ ID NO: 3789100 - RNA, 14 nt, Human
aaauucuccuggag

SEQ ID NO: 3789101 - RNA, 16 nt, Human
aaauucuccuggaggu

SEQ ID NO: 3789102 - RNA, 16 nt, Human
aaauucugaauauuuu

SEQ ID NO: 3789103 - RNA, 12 nt, Human
aaauucugaauu

SEQ ID NO: 3789104 - RNA, 21 nt, Human
aaauucugaauuugcaaagua

SEQ ID NO: 3789105 - RNA, 14 nt, Human
aaauucugauuucu

SEQ ID NO: 3789106 - RNA, 16 nt, Human
aaauucugauuucuuu

SEQ ID NO: 3789107 - RNA, 20 nt, Human
aaauucugauuucuuuucac

SEQ ID NO: 3789108 - RNA, 16 nt, Human
aaauucugucucugga

SEQ ID NO: 3789109 - RNA, 11 nt, Human
aaauucugugg

SEQ ID NO: 3789110 - RNA, 10 nt, Human
aaauucuguu

SEQ ID NO: 3789111 - RNA, 15 nt, Human
aaauucuguuuuuaa

SEQ ID NO: 3789112 - RNA, 23 nt, Human
aaauucuucuccacuuucuagcc

SEQ ID NO: 3789113 - RNA, 18 nt, Human
aaauucuugcaaaguauc

SEQ ID NO: 3789114 - RNA, 21 nt, Human
aaauucuugcaaaguaucccu

SEQ ID NO: 3789115 - RNA, 17 nt, Human
aaauucuuuauuucugu

SEQ ID NO: 3789116 - RNA, 13 nt, Human
aaauaaaacuuuu

SEQ ID NO: 3789117 - RNA, 22 nt, Human
aaauaaaagugaaugaaagauu

SEQ ID NO: 3789118 - RNA, 14 nt, Human
aaauaaaauaaagc

SEQ ID NO: 3789119 - RNA, 14 nt, Human
aaauaaaauauauc

SEQ ID NO: 3789120 - RNA, 15 nt, Human
aaauaaaaugaccag

SEQ ID NO: 3789121 - RNA, 22 nt, Human
aaauaaaauuaaagcugaaaac

SEQ ID NO: 3789122 - RNA, 12 nt, Human
aaauaaaauucc

SEQ ID NO: 3789123 - RNA, 18 nt, Human
aaauaaacaaauaacaau

SEQ ID NO: 3789124 - RNA, 22 nt, Human
aaauaaaccaaaggaaaauguc

SEQ ID NO: 3789125 - RNA, 17 nt, Human
aaauaaacgucuuaaau

SEQ ID NO: 3789126 - RNA, 14 nt, Human
aaauaaacucuaaa

SEQ ID NO: 3789127 - RNA, 17 nt, Human
aaauaaacuuuuuuuca

SEQ ID NO: 3789128 - RNA, 18 nt, Human
aaauaaacuuuuuuucaa

SEQ ID NO: 3789129 - RNA, 13 nt, Human
aaauaaagaaaua

SEQ ID NO: 3789130 - RNA, 13 nt, Human
aaauaaagaagua

SEQ ID NO: 3789131 - RNA, 13 nt, Human
aaauaaaguauau

SEQ ID NO: 3789132 - RNA, 15 nt, Human
aaauaaaguauauau

SEQ ID NO: 3789133 - RNA, 15 nt, Human
aaauaaaguaucaug

SEQ ID NO: 3789134 - RNA, 19 nt, Human
aaauaaaguuggucuuuug

SEQ ID NO: 3789135 - RNA, 15 nt, Human
aaauaaauagaaaag

SEQ ID NO: 3789136 - RNA, 13 nt, Human
aaauaaauagcuu

SEQ ID NO: 3789137 - RNA, 11 nt, Human
aaauaaauaua

SEQ ID NO: 3789138 - RNA, 13 nt, Human
aaauaaauauaua

SEQ ID NO: 3789139 - RNA, 17 nt, Human
aaauaaaucuacuguuu

SEQ ID NO: 3789140 - RNA, 20 nt, Human
aaauaaaugagcuauguauu

SEQ ID NO: 3789141 - RNA, 14 nt, Human
aaauaaauggaaau

SEQ ID NO: 3789142 - RNA, 16 nt, Human
aaauaaauguaucaua

SEQ ID NO: 3789143 - RNA, 12 nt, Human
aaauaaauuagu

SEQ ID NO: 3789144 - RNA, 11 nt, Human
aaauaaauuau

SEQ ID NO: 3789145 - RNA, 16 nt, Human
aaauaaauugaaauau

SEQ ID NO: 3789146 - RNA, 14 nt, Human
aaauaaauuguaua

SEQ ID NO: 3789147 - RNA, 15 nt, Human
aaauaaauuguauau

SEQ ID NO: 3789148 - RNA, 15 nt, Human
aaauaaauuguuuga

SEQ ID NO: 3789149 - RNA, 14 nt, Human
aaauaaauuuauau

SEQ ID NO: 3789150 - RNA, 23 nt, Human
aaauaacaaaucucaagcaaaca

SEQ ID NO: 3789151 - RNA, 20 nt, Human
aaauaacaaaugccaaauua

SEQ ID NO: 3789152 - RNA, 21 nt, Human
aaauaacaagucgaugaacua

SEQ ID NO: 3789153 - RNA, 14 nt, Human
aaauaacaaugugc

SEQ ID NO: 3789154 - RNA, 13 nt, Human
aaauaacacacau

SEQ ID NO: 3789155 - RNA, 19 nt, Human
aaauaaccaauccuggaca

SEQ ID NO: 3789156 - RNA, 18 nt, Human
aaauaaccccauucuuug

SEQ ID NO: 3789157 - RNA, 14 nt, Human
aaauaacuaaaaug

SEQ ID NO: 3789158 - RNA, 15 nt, Human
aaauaacuaaaaugu

SEQ ID NO: 3789159 - RNA, 15 nt, Human
aaauuacuauagcaa

SEQ ID NO: 3789160 - RNA, 14 nt, Human
aaauuacucuuucu

SEQ ID NO: 3789161 - RNA, 14 nt, Human
aaauuacuguguua

SEQ ID NO: 3789162 - RNA, 18 nt, Human
aaauuacuuaguauugca

SEQ ID NO: 3789163 - RNA, 17 nt, Human
aaauuacuuugugaaua

SEQ ID NO: 3789164 - RNA, 12 nt, Human
aaauuagaaaau

SEQ ID NO: 3789165 - RNA, 13 nt, Human
aaauuagaaaaua

SEQ ID NO: 3789166 - RNA, 20 nt, Human
aaauuagacugugauucaga

SEQ ID NO: 3789167 - RNA, 20 nt, Human
aaauuagauccuaagaugug

SEQ ID NO: 3789168 - RNA, 22 nt, Human
aaauuagccuaagauauacuug

SEQ ID NO: 3789169 - RNA, 18 nt, Human
aaauuagcugugugaaau

SEQ ID NO: 3789170 - RNA, 16 nt, Human
aaauuaggaauaaaua

SEQ ID NO: 3789171 - RNA, 19 nt, Human
aaauuagggcucuaauuuc

SEQ ID NO: 3789172 - RNA, 20 nt, Human
aaauuagggcucuaauuucc

SEQ ID NO: 3789173 - RNA, 18 nt, Human
aaauuagguauuuugucc

SEQ ID NO: 3789174 - RNA, 16 nt, Human
aaauuagguugaaaca

SEQ ID NO: 3789175 - RNA, 17 nt, Human
aaauuagguugaaacau

SEQ ID NO: 3789176 - RNA, 18 nt, Human
aaauuagguugaaacaua

SEQ ID NO: 3789177 - RNA, 19 nt, Human
aaauuagguugaaacauau

SEQ ID NO: 3789178 - RNA, 22 nt, Human
aaauuaguaggcucauuuacug

SEQ ID NO: 3789179 - RNA, 13 nt, Human
aaauuaguuauau

SEQ ID NO: 3789180 - RNA, 17 nt, Human
aaauuauaacuuaaaau

SEQ ID NO: 3789181 - RNA, 19 nt, Human
aaauuauaacuuaaaauau

SEQ ID NO: 3789182 - RNA, 15 nt, Human
aaauuauaaggacug

SEQ ID NO: 3789183 - RNA, 16 nt, Human
aaauuauaaggacugc

SEQ ID NO: 3789184 - RNA, 17 nt, Human
aaauuauaaggacugca

SEQ ID NO: 3789185 - RNA, 15 nt, Human
aaauuauagcucuaa

SEQ ID NO: 3789186 - RNA, 18 nt, Human
aaauuauaggagacuugu

SEQ ID NO: 3789187 - RNA, 18 nt, Human
aaauuauauaaguauucu

SEQ ID NO: 3789188 - RNA, 22 nt, Human
aaauuauauuugugcuauagua

SEQ ID NO: 3789189 - RNA, 15 nt, Human
aaauuaucaagcuaa

SEQ ID NO: 3789190 - RNA, 18 nt, Human
aaauuaucaagcuaauaa

SEQ ID NO: 3789191 - RNA, 20 nt, Human
aaauuaucaagcuaauaaaa

SEQ ID NO: 3789192 - RNA, 22 nt, Human
aaauuaucaggcaaauuugcau

SEQ ID NO: 3789193 - RNA, 23 nt, Human
aaauuaucaggcaaauuugcauu

SEQ ID NO: 3789194 - RNA, 16 nt, Human
aaauuaucuauagcua

SEQ ID NO: 3789195 - RNA, 16 nt, Human
aaauuaucuauuugua

SEQ ID NO: 3789196 - RNA, 22 nt, Human
aaauuaucuugauacauucaaa

SEQ ID NO: 3789197 - RNA, 22 nt, Human
aaauuauguaaauuaucaggca

SEQ ID NO: 3789198 - RNA, 17 nt, Human
aaauuauguauguuuac

SEQ ID NO: 3789199 - RNA, 23 nt, Human
aaauuauguuuauauaaaugcuu

SEQ ID NO: 3789200 - RNA, 24 nt, Human
aaauuauguuuauauaaaugcuuu

SEQ ID NO: 3789201 - RNA, 16 nt, Human
aaauuauguuuuuauu

SEQ ID NO: 3789202 - RNA, 19 nt, Human
aaauuauuaguuuacauca

SEQ ID NO: 3789203 - RNA, 14 nt, Human
aaauuauucaguua

SEQ ID NO: 3789204 - RNA, 15 nt, Human
aaauuauuuauuauu

SEQ ID NO: 3789205 - RNA, 17 nt, Human
aaauuauuugauuauuu

SEQ ID NO: 3789206 - RNA, 13 nt, Human
aaauuauuugcau

SEQ ID NO: 3789207 - RNA, 16 nt, Human
aaauuauuuguaagau

SEQ ID NO: 3789208 - RNA, 16 nt, Human
aaauuauuuuaaacaa

SEQ ID NO: 3789209 - RNA, 16 nt, Human
aaauuauuuuaaauua

SEQ ID NO: 3789210 - RNA, 22 nt, Human
aaauuauuuuaaauuauaagga

SEQ ID NO: 3789211 - RNA, 16 nt, Human
aaauuauuuuggauuu

SEQ ID NO: 3789212 - RNA, 19 nt, Human
aaauuauuuuguucauaca

SEQ ID NO: 3789213 - RNA, 22 nt, Human
aaauuauuuuguucauacauau

SEQ ID NO: 3789214 - RNA, 14 nt, Human
aaauucaaagcaug

SEQ ID NO: 3789215 - RNA, 20 nt, Human
aaauucaacuuuguaaaaau

SEQ ID NO: 3789216 - RNA, 19 nt, Human
aaauucaauuguaaauuga

SEQ ID NO: 3789217 - RNA, 23 nt, Human
aaauucaauuguaaauugaauca

SEQ ID NO: 3789218 - RNA, 14 nt, Human
aaauucacaaacuu

SEQ ID NO: 3789219 - RNA, 15 nt, Human
aaauucacaaacuuu

SEQ ID NO: 3789220 - RNA, 17 nt, Human
aaauucacaaacuuuua

SEQ ID NO: 3789221 - RNA, 22 nt, Human
aaauucacccccuuuccuggac

SEQ ID NO: 3789222 - RNA, 14 nt, Human
aaauucacuuucau

SEQ ID NO: 3789223 - RNA, 20 nt, Human
aaauucagauauauuuuuca

SEQ ID NO: 3789224 - RNA, 22 nt, Human
aaauucaggugaaaauguucau

SEQ ID NO: 3789225 - RNA, 17 nt, Human
aaauucaguccuaagaa

SEQ ID NO: 3789226 - RNA, 20 nt, Human
aaauucaguuuuuuuccagu

SEQ ID NO: 3789227 - RNA, 18 nt, Human
aaauucauggcaugcuua

SEQ ID NO: 3789228 - RNA, 14 nt, Human
aaauucauuucaca

SEQ ID NO: 3789229 - RNA, 19 nt, Human
aaauucauuucacauuaau

SEQ ID NO: 3789230 - RNA, 16 nt, Human
aaauucauuucuaauu

SEQ ID NO: 3789231 - RNA, 22 nt, Human
aaauucauuuuuuucacuggag

SEQ ID NO: 3789232 - RNA, 14 nt, Human
aaauuccaaagucu

SEQ ID NO: 3789233 - RNA, 17 nt, Human
aaauuccagaaaggaua

SEQ ID NO: 3789234 - RNA, 15 nt, Human
aaauucccuaaagcc

SEQ ID NO: 3789235 - RNA, 24 nt, Human
aaauuccuaagaaucagaguagaa

SEQ ID NO: 3789236 - RNA, 16 nt, Human
aaauuccuauugugau

SEQ ID NO: 3789237 - RNA, 19 nt, Human
aaauuccucaacaguguuu

SEQ ID NO: 3789238 - RNA, 14 nt, Human
aaauuccucuuugc

SEQ ID NO: 3789239 - RNA, 22 nt, Human
aaauuccuuagcuuagaccuca

SEQ ID NO: 3789240 - RNA, 17 nt, Human
aaauucgaccugauuua

SEQ ID NO: 3789241 - RNA, 23 nt, Human
aaauucgaccugauuuacaguuu

SEQ ID NO: 3789242 - RNA, 23 nt, Human
aaauucuauaggaacauaugaaa

SEQ ID NO: 3789243 - RNA, 16 nt, Human
aaauucugaauuugca

SEQ ID NO: 3789244 - RNA, 18 nt, Human
aaauucugaauuugcaaa

SEQ ID NO: 3789245 - RNA, 20 nt, Human
aaauucugaauuugcaaagu

SEQ ID NO: 3789246 - RNA, 17 nt, Human
aaauucuguuaaaaucu

SEQ ID NO: 3789247 - RNA, 13 nt, Human
aaauucuguuucu

SEQ ID NO: 3789248 - RNA, 17 nt, Human
aaauucuguuuuuaaaa

SEQ ID NO: 3789249 - RNA, 22 nt, Human
aaauucuguuuuuaaaaauuag

SEQ ID NO: 3789250 - RNA, 21 nt, Human
aaauucuucuaauugcugugu

SEQ ID NO: 3789251 - RNA, 23 nt, Human
aaauucuucugaacucaaacuga

SEQ ID NO: 3789252 - RNA, 14 nt, Human
aaauugaaaaguua

SEQ ID NO: 3789253 - RNA, 20 nt, Human
aaauugaaauguaaggcugu

SEQ ID NO: 3789254 - RNA, 12 nt, Human
aaauugaaccuu

SEQ ID NO: 3789255 - RNA, 17 nt, Human
aaauugaagagagauau

SEQ ID NO: 3789256 - RNA, 23 nt, Human
aaauugaauaaugguaccagaua

SEQ ID NO: 3789257 - RNA, 18 nt, Human
aaauugaauacuuugaau

SEQ ID NO: 3789258 - RNA, 21 nt, Human
aaauugaauacuuugaaugug

SEQ ID NO: 3789259 - RNA, 15 nt, Human
aaauugaauuuaaca

SEQ ID NO: 3789260 - RNA, 17 nt, Human
aaauugaauuuaacaau

SEQ ID NO: 3789261 - RNA, 14 nt, Human
aaauagaaauaagu

SEQ ID NO: 3789262 - RNA, 21 nt, Human
aaauagaauguaaaugucuca

SEQ ID NO: 3789263 - RNA, 19 nt, Human
aaauagacaguauauuuau

SEQ ID NO: 3789264 - RNA, 11 nt, Human
aaauagagcaa

SEQ ID NO: 3789265 - RNA, 19 nt, Human
aaauagaguauaugcacuu

SEQ ID NO: 3789266 - RNA, 18 nt, Human
aaauagaguguaguuuac

SEQ ID NO: 3789267 - RNA, 15 nt, Human
aaauagauaauuaaa

SEQ ID NO: 3789268 - RNA, 15 nt, Human
aaauagauauaaauu

SEQ ID NO: 3789269 - RNA, 15 nt, Human
aaauagaugcugugu

SEQ ID NO: 3789270 - RNA, 22 nt, Human
aaauagaugcuguguauauggu

SEQ ID NO: 3789271 - RNA, 21 nt, Human
aaauagauuuuauaagaugac

SEQ ID NO: 3789272 - RNA, 12 nt, Human
aaauagcaaaga

SEQ ID NO: 3789273 - RNA, 18 nt, Human
aaauagcaacaugcuuca

SEQ ID NO: 3789274 - RNA, 14 nt, Human
aaauagcauguauu

SEQ ID NO: 3789275 - RNA, 15 nt, Human
aaauagcauguauug

SEQ ID NO: 3789276 - RNA, 13 nt, Human
aaauagcauuugu

SEQ ID NO: 3789277 - RNA, 21 nt, Human
aaauagccacuuaccuucaau

SEQ ID NO: 3789278 - RNA, 21 nt, Human
aaauagccgggcaugguggcg

SEQ ID NO: 3789279 - RNA, 15 nt, Human
aaauagcguucuugu

SEQ ID NO: 3789280 - RNA, 19 nt, Human
aaauagcguucuuguaauu

SEQ ID NO: 3789281 - RNA, 18 nt, Human
aaauagcuaauaauguua

SEQ ID NO: 3789282 - RNA, 19 nt, Human
aaauagcuauauccaugua

SEQ ID NO: 3789283 - RNA, 13 nt, Human
aaauagcucuuuc

SEQ ID NO: 3789284 - RNA, 15 nt, Human
aaauagcuucuguuu

SEQ ID NO: 3789285 - RNA, 23 nt, Human
aaauagcuuggguagcgcacucu

SEQ ID NO: 3789286 - RNA, 13 nt, Human
aaauaggaaacaa

SEQ ID NO: 3789287 - RNA, 14 nt, Human
aaauaggaaacaag

SEQ ID NO: 3789288 - RNA, 19 nt, Human
aaauaggaaucauucagaa

SEQ ID NO: 3789289 - RNA, 20 nt, Human
aaauaggaaucauucagaaa

SEQ ID NO: 3789290 - RNA, 24 nt, Human
aaauaggagaggaugagagcccag

SEQ ID NO: 3789291 - RNA, 14 nt, Human
aaauaggauuuuua

SEQ ID NO: 3789292 - RNA, 19 nt, Human
aaauaggcuauuaaaaaag

SEQ ID NO: 3789293 - RNA, 17 nt, Human
aaauaggggauauuuaa

SEQ ID NO: 3789294 - RNA, 15 nt, Human
aaauaggguauauuu

SEQ ID NO: 3789295 - RNA, 13 nt, Human
aaauaguaaaaau

SEQ ID NO: 3789296 - RNA, 19 nt, Human
aaauaguaugaaaauggaa

SEQ ID NO: 3789297 - RNA, 12 nt, Human
aaauaguauuuc

SEQ ID NO: 3789298 - RNA, 21 nt, Human
aaauagucuagacuaaaagau

SEQ ID NO: 3789299 - RNA, 23 nt, Human
aaauagucucuuuaaaaggaaag

SEQ ID NO: 3789300 - RNA, 15 nt, Human
aaauagugaauuaua

SEQ ID NO: 3789301 - RNA, 19 nt, Human
aaauagugguucuuggaaa

SEQ ID NO: 3789302 - RNA, 13 nt, Human
aaauagugugaaa

SEQ ID NO: 3789303 - RNA, 15 nt, Human
aaauagugugaaaua

SEQ ID NO: 3789304 - RNA, 18 nt, Human
aaauagugugaaauauau

SEQ ID NO: 3789305 - RNA, 14 nt, Human
aaauaguuaauaua

SEQ ID NO: 3789306 - RNA, 17 nt, Human
aaauaguuaauauaguc

SEQ ID NO: 3789307 - RNA, 23 nt, Human
aaauaguugagccagcagacauu

SEQ ID NO: 3789308 - RNA, 12 nt, Human
aaauaguuuauu

SEQ ID NO: 3789309 - RNA, 20 nt, Human
aaauaguuuauuuuaaaaca

SEQ ID NO: 3789310 - RNA, 21 nt, Human
aaauaguuuggauauguaaaa

SEQ ID NO: 3789311 - RNA, 16 nt, Human
aaauauaaaacaaaua

SEQ ID NO: 3789312 - RNA, 22 nt, Human
aaauauaaacaaagauucauga

SEQ ID NO: 3789313 - RNA, 12 nt, Human
aaauauaaacau

SEQ ID NO: 3789314 - RNA, 12 nt, Human
aaauauaaagac

SEQ ID NO: 3789315 - RNA, 20 nt, Human
aaauauaaagcaucuaaacu

SEQ ID NO: 3789316 - RNA, 13 nt, Human
aaauauaaaucuu

SEQ ID NO: 3789317 - RNA, 14 nt, Human
aaauauaacacauu

SEQ ID NO: 3789318 - RNA, 14 nt, Human
aaauauaagauuuu

SEQ ID NO: 3789319 - RNA, 17 nt, Human
aaauuuaaaaguaaaau

SEQ ID NO: 3789320 - RNA, 19 nt, Human
aaauuuaaaaguaaaaugu

SEQ ID NO: 3789321 - RNA, 15 nt, Human
aaauuuaaagauauu

SEQ ID NO: 3789322 - RNA, 18 nt, Human
aaauuuaaagcagguucu

SEQ ID NO: 3789323 - RNA, 15 nt, Human
aaauuuaagcauugu

SEQ ID NO: 3789324 - RNA, 15 nt, Human
aaauuuaaguaucuu

SEQ ID NO: 3789325 - RNA, 21 nt, Human
aaauuuaagugcguguguaga

SEQ ID NO: 3789326 - RNA, 17 nt, Human
aaauuuacaucauuucu

SEQ ID NO: 3789327 - RNA, 12 nt, Human
aaauuuacuaua

SEQ ID NO: 3789328 - RNA, 14 nt, Human
aaauuuacuuuaca

SEQ ID NO: 3789329 - RNA, 16 nt, Human
aaauuuacuuuacaca

SEQ ID NO: 3789330 - RNA, 21 nt, Human
aaauuuagcauuguagugcuu

SEQ ID NO: 3789331 - RNA, 22 nt, Human
aaauuuagcauuguagugcuuu

SEQ ID NO: 3789332 - RNA, 14 nt, Human
aaauuuauaauuuu

SEQ ID NO: 3789333 - RNA, 13 nt, Human
aaauuuauaugua

SEQ ID NO: 3789334 - RNA, 14 nt, Human
aaauuuauuaaaua

SEQ ID NO: 3789335 - RNA, 21 nt, Human
aaauuuauuagcccugcauuu

SEQ ID NO: 3789336 - RNA, 13 nt, Human
aaauuuauuuccu

SEQ ID NO: 3789337 - RNA, 18 nt, Human
aaauuuauuuuauaagaa

SEQ ID NO: 3789338 - RNA, 19 nt, Human
aaauuuauuuuauaagaaa

SEQ ID NO: 3789339 - RNA, 19 nt, Human
aaauuucaaaagacauguu

SEQ ID NO: 3789340 - RNA, 18 nt, Human
aaauuucacuacuagauu

SEQ ID NO: 3789341 - RNA, 18 nt, Human
aaauuucagguuguuggu

SEQ ID NO: 3789342 - RNA, 16 nt, Human
aaauuuccaguaccuu

SEQ ID NO: 3789343 - RNA, 18 nt, Human
aaauuuccccaacagugu

SEQ ID NO: 3789344 - RNA, 23 nt, Human
aaauuuccccaacagugugaagu

SEQ ID NO: 3789345 - RNA, 20 nt, Human
aaauuucuuaugugacauua

SEQ ID NO: 3789346 - RNA, 16 nt, Human
aaauuugaaacauugc

SEQ ID NO: 3789347 - RNA, 20 nt, Human
aaauuugaauggguccauuu

SEQ ID NO: 3789348 - RNA, 12 nt, Human
aaauuugaauuu

SEQ ID NO: 3789349 - RNA, 22 nt, Human
aaauuugaauuuuguguuagag

SEQ ID NO: 3789350 - RNA, 18 nt, Human
aaauuugacuaauuuuac

SEQ ID NO: 3789351 - RNA, 18 nt, Human
aaauuugacuuuucugua

SEQ ID NO: 3789352 - RNA, 14 nt, Human
aaauuugagacuau

SEQ ID NO: 3789353 - RNA, 16 nt, Human
aaauuugauacuuaua

SEQ ID NO: 3789354 - RNA, 14 nt, Human
aaauuugauuucua

SEQ ID NO: 3789355 - RNA, 14 nt, Human
aaauuugcuagcag

SEQ ID NO: 3789356 - RNA, 12 nt, Human
aaauuuggaauu

SEQ ID NO: 3789357 - RNA, 21 nt, Human
aaauuuggggacagauucagu

SEQ ID NO: 3789358 - RNA, 15 nt, Human
aaauuugguucuaau

SEQ ID NO: 3789359 - RNA, 16 nt, Human
aaauuugguucuaaua

SEQ ID NO: 3789360 - RNA, 13 nt, Human
aaauuuguaaguu

SEQ ID NO: 3789361 - RNA, 16 nt, Human
aaauuugucugaaaca

SEQ ID NO: 3789362 - RNA, 18 nt, Human
aaauuugucugaaacauu

SEQ ID NO: 3789363 - RNA, 21 nt, Human
aaauuugucugguuaaaaaau

SEQ ID NO: 3789364 - RNA, 12 nt, Human
aaauuuguggaa

SEQ ID NO: 3789365 - RNA, 18 nt, Human
aaauuuguggguuuuuuu

SEQ ID NO: 3789366 - RNA, 20 nt, Human
aaauuuguuacuuaaauaua

SEQ ID NO: 3789367 - RNA, 15 nt, Human
aaauuuguucuugua

SEQ ID NO: 3789368 - RNA, 13 nt, Human
aaauuuguugcau

SEQ ID NO: 3789369 - RNA, 22 nt, Human
aaauuuguuuugacggaugauu

SEQ ID NO: 3789370 - RNA, 16 nt, Human
aaauuuuaagcuagga

SEQ ID NO: 3789371 - RNA, 23 nt, Human
aaauuuuagcgugcucacugacc

SEQ ID NO: 3789372 - RNA, 22 nt, Human
aaauuuuaggcaaguuuucccu

SEQ ID NO: 3789373 - RNA, 12 nt, Human
aaauuuuauucc

SEQ ID NO: 3789374 - RNA, 16 nt, Human
aaauuuuauuuugugc

SEQ ID NO: 3789375 - RNA, 14 nt, Human
aaauuuucuagacu

SEQ ID NO: 3789376 - RNA, 18 nt, Human
aaauuuucuagacuuucu

SEQ ID NO: 3789377 - RNA, 20 nt, Human
aaauuuucuagacuuucugu

SEQ ID NO: 3789378 - RNA, 17 nt, Human
aaauuuugaaaaguaau

SEQ ID NO: 3789379 - RNA, 18 nt, Human
aaauuuugaaaaguaaua

SEQ ID NO: 3789380 - RNA, 14 nt, Human
aaauuuugcaaaua

SEQ ID NO: 3789381 - RNA, 17 nt, Human
aaauuuugccuaauaca

SEQ ID NO: 3789382 - RNA, 21 nt, Human
aaauuuugcuaucaacaauaa

SEQ ID NO: 3789383 - RNA, 22 nt, Human
aaauuuugcuuuuaauuaaaua

SEQ ID NO: 3789384 - RNA, 18 nt, Human
aaauuuuguaaugaauuc

SEQ ID NO: 3789385 - RNA, 21 nt, Human
aaauuuuguaauuuucuugau

SEQ ID NO: 3789386 - RNA, 18 nt, Human
aaauuuuucagaugcuuc

SEQ ID NO: 3789387 - RNA, 16 nt, Human
aaauuuuucauauuuu

SEQ ID NO: 3789388 - RNA, 19 nt, Human
aaauuuuucauauuuuaau

SEQ ID NO: 3789389 - RNA, 19 nt, Human
aaauuuuuggauugacagu

SEQ ID NO: 3789390 - RNA, 12 nt, Human
aaauuuuuguaa

SEQ ID NO: 3789391 - RNA, 13 nt, Human
aaauuuuuuggca

SEQ ID NO: 3789392 - RNA, 23 nt, Human
aaauuuuuuuucauguuuuaaca

SEQ ID NO: 3789393 - RNA, 15 nt, Human
aacaaaaaacaauau

SEQ ID NO: 3789394 - RNA, 19 nt, Human
aacaaaaacacuaaaaaua

SEQ ID NO: 3789395 - RNA, 11 nt, Human
aacaaaaagaa

SEQ ID NO: 3789396 - RNA, 13 nt, Human
aacaaaaauuagg

SEQ ID NO: 3789397 - RNA, 11 nt, Human
aacaaaaauuu

SEQ ID NO: 3789398 - RNA, 15 nt, Human
aacaaaagcaagacu

SEQ ID NO: 3789399 - RNA, 13 nt, Human
aacaaaaggguca

SEQ ID NO: 3789400 - RNA, 15 nt, Human
aacaaaaguguuuaa

SEQ ID NO: 3789401 - RNA, 13 nt, Human
aacaaaaguuccc

SEQ ID NO: 3789402 - RNA, 20 nt, Human
aacaaaaucuccucuuuuag

SEQ ID NO: 3789403 - RNA, 14 nt, Human
aacaaaauguaugu

SEQ ID NO: 3789404 - RNA, 19 nt, Human
aacaaaauuuguuugaaau

SEQ ID NO: 3789405 - RNA, 14 nt, Human
aacaaacaaacaaa

SEQ ID NO: 3789406 - RNA, 15 nt, Human
aacaaacaauaccug

SEQ ID NO: 3789407 - RNA, 22 nt, Human
aacccuuaaacaguugcacagc

SEQ ID NO: 3789408 - RNA, 19 nt, Human
aacccuucaucuuccugug

SEQ ID NO: 3789409 - RNA, 20 nt, Human
aacccuuccccacugcacac

SEQ ID NO: 3789410 - RNA, 23 nt, Human
aacccuucuccucuuguaaauaa

SEQ ID NO: 3789411 - RNA, 16 nt, Human
aacccuucuucauguu

SEQ ID NO: 3789412 - RNA, 13 nt, Human
aacccuucuuuua

SEQ ID NO: 3789413 - RNA, 14 nt, Human
aacccuugaaaaga

SEQ ID NO: 3789414 - RNA, 21 nt, Human
aacccuugucagugacaguau

SEQ ID NO: 3789415 - RNA, 16 nt, Human
aacccuuugugugcuc

SEQ ID NO: 3789416 - RNA, 17 nt, Human
aaccgacaggcccuggc

SEQ ID NO: 3789417 - RNA, 21 nt, Human
aaccgagggggcugcucccac

SEQ ID NO: 3789418 - RNA, 13 nt, Human
aaccgaugcucca

SEQ ID NO: 3789419 - RNA, 15 nt, Human
aaccgaugcuccagc

SEQ ID NO: 3789420 - RNA, 21 nt, Human
aaccgaugcuccagccaaccc

SEQ ID NO: 3789421 - RNA, 14 nt, Human
aaccgaugcuuuac

SEQ ID NO: 3789422 - RNA, 17 nt, Human
aaccgaugcuuuaccaa

SEQ ID NO: 3789423 - RNA, 13 nt, Human
aaccgcaggaagc

SEQ ID NO: 3789424 - RNA, 15 nt, Human
aaccgccagcucugu

SEQ ID NO: 3789425 - RNA, 16 nt, Human
aaccgcuaaaagaaac

SEQ ID NO: 3789426 - RNA, 19 nt, Human
aaccgcucaccuagagcca

SEQ ID NO: 3789427 - RNA, 16 nt, Human
aaccgcuuuggccuga

SEQ ID NO: 3789428 - RNA, 17 nt, Human
aaccguagaugauuuca

SEQ ID NO: 3789429 - RNA, 17 nt, Human
aaccguggcccuuccug

SEQ ID NO: 3789430 - RNA, 16 nt, Human
aaccgugguaugucug

SEQ ID NO: 3789431 - RNA, 19 nt, Human
aaccguguuugucucuucu

SEQ ID NO: 3789432 - RNA, 21 nt, Human
aaccguguuugucucuucugg

SEQ ID NO: 3789433 - RNA, 18 nt, Human
aaccguuuugaagcuacu

SEQ ID NO: 3789434 - RNA, 17 nt, Human
aaccuaaaacucuuucg

SEQ ID NO: 3789435 - RNA, 15 nt, Human
aaccuaaccccuuuc

SEQ ID NO: 3789436 - RNA, 11 nt, Human
aaccuaaccug

SEQ ID NO: 3789437 - RNA, 15 nt, Human
aaccuaaccuguguc

SEQ ID NO: 3789438 - RNA, 18 nt, Human
aaccuaacuugcgcagaa

SEQ ID NO: 3789439 - RNA, 13 nt, Human
aaccuaagcaaaa

SEQ ID NO: 3789440 - RNA, 18 nt, Human
aaccuaauuaauauauua

SEQ ID NO: 3789441 - RNA, 18 nt, Human
aaccuacacacugucaug

SEQ ID NO: 3789442 - RNA, 23 nt, Human
aaccuacagagaugcuaagagaa

SEQ ID NO: 3789443 - RNA, 20 nt, Human
aaccuacaguuuuaacugug

SEQ ID NO: 3789444 - RNA, 18 nt, Human
aaccuaccuguaacuuuu

SEQ ID NO: 3789445 - RNA, 23 nt, Human
aaccuaccuucauuucaggaggg

SEQ ID NO: 3789446 - RNA, 15 nt, Human
aaccuagagaagaua

SEQ ID NO: 3789447 - RNA, 11 nt, Human
aaccuagagau

SEQ ID NO: 3789448 - RNA, 12 nt, Human
aaccuagccccu

SEQ ID NO: 3789449 - RNA, 20 nt, Human
aaccuagggugauauuaacc

SEQ ID NO: 3789450 - RNA, 20 nt, Human
aaccuaguuaaagaaaggaa

SEQ ID NO: 3789451 - RNA, 22 nt, Human
aaccuaguuaaagaaaggaaaa

SEQ ID NO: 3789452 - RNA, 16 nt, Human
aaccuauuuugaaaaa

SEQ ID NO: 3789453 - RNA, 21 nt, Human
aaccuauuuugaaaaauuccu

SEQ ID NO: 3789454 - RNA, 18 nt, Human
aaccucaacugccuacuc

SEQ ID NO: 3789455 - RNA, 17 nt, Human
aaccucaccaacuccua

SEQ ID NO: 3789456 - RNA, 20 nt, Human
aaccucaccccgaggcccug

SEQ ID NO: 3789457 - RNA, 23 nt, Human
aaccucaccccgaggcccugcau

SEQ ID NO: 3789458 - RNA, 22 nt, Human
aaccucacgcaccucccauccu

SEQ ID NO: 3789459 - RNA, 11 nt, Human
aaccucagccu

SEQ ID NO: 3789460 - RNA, 14 nt, Human
aaccucaguaauuu

SEQ ID NO: 3789461 - RNA, 13 nt, Human
aaccucaguguca

SEQ ID NO: 3789462 - RNA, 18 nt, Human
aaccucccagagguccag

SEQ ID NO: 3789463 - RNA, 20 nt, Human
aaccucccagagguccagcc

SEQ ID NO: 3789464 - RNA, 21 nt, Human
aaccucccagagguccagccc

SEQ ID NO: 3789465 - RNA, 23 nt, Human
aaccucccagagguccagcccau

SEQ ID NO: 3789466 - RNA, 23 nt, Human
aaccuccccagccugcgccugcu

SEQ ID NO: 3789467 - RNA, 13 nt, Human
aaccucccucuug

SEQ ID NO: 3789468 - RNA, 16 nt, Human
aaccucccucuuguuu

SEQ ID NO: 3789469 - RNA, 20 nt, Human
aaccuccgccaaugcacggc

SEQ ID NO: 3789470 - RNA, 12 nt, Human
aaccuccucugu

SEQ ID NO: 3789471 - RNA, 22 nt, Human
aaccuccuguggaacccagcag

SEQ ID NO: 3789472 - RNA, 21 nt, Human
aaccuccuguuagcuguuauu

SEQ ID NO: 3789473 - RNA, 19 nt, Human
aaccuccuuucucuucucu

SEQ ID NO: 3789474 - RNA, 22 nt, Human
aaccucgagguuucucaaagaa

SEQ ID NO: 3789475 - RNA, 17 nt, Human
aaccucgaguacugugg

SEQ ID NO: 3789476 - RNA, 19 nt, Human
aaccucgcgcuugcuggcc

SEQ ID NO: 3789477 - RNA, 24 nt, Human
aaccucuaaauucuuucauuuuag

SEQ ID NO: 3789478 - RNA, 19 nt, Human
aaccucuaauuuauuuugu

SEQ ID NO: 3789479 - RNA, 23 nt, Human
aaccucuacuaaaaagaaggaaa

SEQ ID NO: 3789480 - RNA, 13 nt, Human
aaccucucacucc

SEQ ID NO: 3789481 - RNA, 18 nt, Human
aaccucucacuucacccu

SEQ ID NO: 3789482 - RNA, 20 nt, Human
aaccucugauuuauuuugua

SEQ ID NO: 3789483 - RNA, 16 nt, Human
aaccucugcuucccag

SEQ ID NO: 3789484 - RNA, 20 nt, Human
aaccucugcuucccagguuc

SEQ ID NO: 3789485 - RNA, 13 nt, Human
aaccucuguucag

SEQ ID NO: 3789486 - RNA, 18 nt, Human
aaccucuguucaguguaa

SEQ ID NO: 3789487 - RNA, 11 nt, Human
aaccucuuccc

SEQ ID NO: 3789488 - RNA, 17 nt, Human
aaccucuucuggcucaa

SEQ ID NO: 3789489 - RNA, 16 nt, Human
aaccucuuuucugcau

SEQ ID NO: 3789490 - RNA, 11 nt, Human
aaccugaaaaa

SEQ ID NO: 3789491 - RNA, 22 nt, Human
aaccugaaaagauguugugucu

SEQ ID NO: 3789492 - RNA, 23 nt, Human
aaccugacagaugucagccgagc

SEQ ID NO: 3789493 - RNA, 20 nt, Human
aaccugagccccaaaaggua

SEQ ID NO: 3789494 - RNA, 20 nt, Human
aaccugagucguacagaaag

SEQ ID NO: 3789495 - RNA, 21 nt, Human
aaccugaugaaaauaaagaau

SEQ ID NO: 3789496 - RNA, 17 nt, Human
aaccugaugcagucacg

SEQ ID NO: 3789497 - RNA, 16 nt, Human
aaccugauuguaaacu

SEQ ID NO: 3789498 - RNA, 16 nt, Human
aaccugcaaaaucugu

SEQ ID NO: 3789499 - RNA, 13 nt, Human
aaccugcccugcc

SEQ ID NO: 3789500 - RNA, 11 nt, Human
aaccugcucuc

SEQ ID NO: 3789501 - RNA, 20 nt, Human
aaccugcucuccucuugcca

SEQ ID NO: 3789502 - RNA, 13 nt, Human
aaccugcuuuuca

SEQ ID NO: 3789503 - RNA, 19 nt, Human
aaccuggagagcuagaacc

SEQ ID NO: 3789504 - RNA, 22 nt, Human
aaccuggagggcuggaaucugg

SEQ ID NO: 3789505 - RNA, 11 nt, Human
aaccuggccuu

SEQ ID NO: 3789506 - RNA, 17 nt, Human
aaccugggauucaggaa

SEQ ID NO: 3789507 - RNA, 21 nt, Human
aaccugggauucaggaaugug

SEQ ID NO: 3789508 - RNA, 18 nt, Human
aaccuggguccaaauaaa

SEQ ID NO: 3789509 - RNA, 17 nt, Human
aaccuggguugcagaca

SEQ ID NO: 3789510 - RNA, 19 nt, Human
aaccuggguugcagacagg

SEQ ID NO: 3789511 - RNA, 23 nt, Human
aaccuggucacaggacucugccu

SEQ ID NO: 3789512 - RNA, 14 nt, Human
aaccuggugcugga

SEQ ID NO: 3789513 - RNA, 20 nt, Human
aaccuguaaauuauuuuaaa

SEQ ID NO: 3789514 - RNA, 13 nt, Human
aaccuguaauaaa

SEQ ID NO: 3789515 - RNA, 15 nt, Human
aaccuguacuucaag

SEQ ID NO: 3789516 - RNA, 15 nt, Human
aaccuguccuaagga

SEQ ID NO: 3789517 - RNA, 15 nt, Human
aaccuguccuugcac

SEQ ID NO: 3789518 - RNA, 18 nt, Human
aaccugucuccacugugc

SEQ ID NO: 3789519 - RNA, 18 nt, Human
aaccugugagcugcacca

SEQ ID NO: 3789520 - RNA, 16 nt, Human
aaccugugaguaaaua

SEQ ID NO: 3789521 - RNA, 18 nt, Human
aaccugugaguaaauauu

SEQ ID NO: 3789522 - RNA, 19 nt, Human
aaccuguuuuuuuuucauu

SEQ ID NO: 3789523 - RNA, 12 nt, Human
aaccuuaauauu

SEQ ID NO: 3789524 - RNA, 17 nt, Human
aaccuuaauuuauuauu

SEQ ID NO: 3789525 - RNA, 23 nt, Human
aaccuuagauguucuaagucuuu

SEQ ID NO: 3789526 - RNA, 16 nt, Human
aaccuuagcucccucc

SEQ ID NO: 3789527 - RNA, 16 nt, Human
aaccuuauuguaccuc

SEQ ID NO: 3789528 - RNA, 13 nt, Human
aaccuucucuaug

SEQ ID NO: 3789529 - RNA, 12 nt, Human
aaccuucuggcc

SEQ ID NO: 3789530 - RNA, 20 nt, Human
aaccuugaaaaaaaacagug

SEQ ID NO: 3789531 - RNA, 18 nt, Human
aaccuugaaaacuuuaug

SEQ ID NO: 3789532 - RNA, 14 nt, Human
aaccuugaaugcug

SEQ ID NO: 3789533 - RNA, 20 nt, Human
aaccuugaaugcugccagug

SEQ ID NO: 3789534 - RNA, 16 nt, Human
aaccuugccugguaca

SEQ ID NO: 3789535 - RNA, 18 nt, Human
aaccuugccugguacagu

SEQ ID NO: 3789536 - RNA, 10 nt, Human
aaauguauuu

SEQ ID NO: 3789537 - RNA, 16 nt, Human
aaauguauuuuauguu

SEQ ID NO: 3789538 - RNA, 18 nt, Human
aaauguauuuuauguuau

SEQ ID NO: 3789539 - RNA, 23 nt, Human
aaaugucaaaaguagaacuuugu

SEQ ID NO: 3789540 - RNA, 15 nt, Human
aaaugucaaauguga

SEQ ID NO: 3789541 - RNA, 17 nt, Human
aaaugucacagaagcag

SEQ ID NO: 3789542 - RNA, 22 nt, Human
aaaugucacuuuuugaggcaaa

SEQ ID NO: 3789543 - RNA, 22 nt, Human
aaaugucagauacaauguauuu

SEQ ID NO: 3789544 - RNA, 15 nt, Human
aaaugucaguucuga

SEQ ID NO: 3789545 - RNA, 16 nt, Human
aaaugucaguucugau

SEQ ID NO: 3789546 - RNA, 21 nt, Human
aaauguccaguaagaucacug

SEQ ID NO: 3789547 - RNA, 22 nt, Human
aaauguccaguaagaucacugu

SEQ ID NO: 3789548 - RNA, 22 nt, Human
aaauguccuugugaugugcacg

SEQ ID NO: 3789549 - RNA, 11 nt, Human
aaaugucuaau

SEQ ID NO: 3789550 - RNA, 18 nt, Human
aaaugucuaauguauuuu

SEQ ID NO: 3789551 - RNA, 24 nt, Human
aacacucaguggcccauggcauuu

SEQ ID NO: 3789552 - RNA, 16 nt, Human
aacacucaugcugaaa

SEQ ID NO: 3789553 - RNA, 21 nt, Human
aacacucauugaccugaggcc

SEQ ID NO: 3789554 - RNA, 12 nt, Human
aacacuccuuca

SEQ ID NO: 3789555 - RNA, 16 nt, Human
aacacuccuugcauca

SEQ ID NO: 3789556 - RNA, 13 nt, Human
aacacucuauauu

SEQ ID NO: 3789557 - RNA, 14 nt, Human
aacacucugagacu

SEQ ID NO: 3789558 - RNA, 19 nt, Human
aacacucuuuugcuuuauu

SEQ ID NO: 3789559 - RNA, 15 nt, Human
aacacugagcuguca

SEQ ID NO: 3789560 - RNA, 15 nt, Human
aacacugauuucccc

SEQ ID NO: 3789561 - RNA, 12 nt, Human
aacacugcccuc

SEQ ID NO: 3789562 - RNA, 14 nt, Human
aacacugcuugugu

SEQ ID NO: 3789563 - RNA, 13 nt, Human
aacacuggccccu

SEQ ID NO: 3789564 - RNA, 21 nt, Human
aacacugggagaaaugaaaaa

SEQ ID NO: 3789565 - RNA, 23 nt, Human
aacacuggggacuuggccucucu

SEQ ID NO: 3789566 - RNA, 15 nt, Human
aacacuggggcuggc

SEQ ID NO: 3789567 - RNA, 18 nt, Human
aacacuggggcuggcaca

SEQ ID NO: 3789568 - RNA, 16 nt, Human
aacacugggggagggg

SEQ ID NO: 3789569 - RNA, 21 nt, Human
aacacugggggcaccuuaaga

SEQ ID NO: 3789570 - RNA, 22 nt, Human
aacacuggucugcuguuccagu

SEQ ID NO: 3789571 - RNA, 22 nt, Human
aacacuggugugaccugagggc

SEQ ID NO: 3789572 - RNA, 18 nt, Human
aacacugguuuuaaauau

SEQ ID NO: 3789573 - RNA, 16 nt, Human
aacacugucuugaaga

SEQ ID NO: 3789574 - RNA, 12 nt, Human
aacacugugaaa

SEQ ID NO: 3789575 - RNA, 21 nt, Human
aacacugugcccugguggaga

SEQ ID NO: 3789576 - RNA, 20 nt, Human
aacacuguggaacuaauaaa

SEQ ID NO: 3789577 - RNA, 18 nt, Human
aacacuguggguguguga

SEQ ID NO: 3789578 - RNA, 18 nt, Human
aacacuguuaucauuuuu

SEQ ID NO: 3789579 - RNA, 21 nt, Human
aacacuguuaucauuuuuucc

SEQ ID NO: 3789580 - RNA, 21 nt, Human
aacacuguucucugcccucca

SEQ ID NO: 3789581 - RNA, 14 nt, Human
aacacuucuguccu

SEQ ID NO: 3789582 - RNA, 20 nt, Human
aacacuuggugcugggaacc

SEQ ID NO: 3789583 - RNA, 21 nt, Human
aacacuugugacuuuugcuuu

SEQ ID NO: 3789584 - RNA, 18 nt, Human
aacacuuuacaauguuca

SEQ ID NO: 3789585 - RNA, 18 nt, Human
aacacuuuuuugggggua

SEQ ID NO: 3789586 - RNA, 23 nt, Human
aacagaaaaauauguaccaagaa

SEQ ID NO: 3789587 - RNA, 14 nt, Human
aacagaaaacauuc

SEQ ID NO: 3789588 - RNA, 13 nt, Human
aacagaaacaaaa

SEQ ID NO: 3789589 - RNA, 18 nt, Human
aacagaaagggcaacaau

SEQ ID NO: 3789590 - RNA, 13 nt, Human
aacagaaauguac

SEQ ID NO: 3789591 - RNA, 14 nt, Human
aacagaaauuggua

SEQ ID NO: 3789592 - RNA, 18 nt, Human
aacuuacaaaaacacuuc

SEQ ID NO: 3789593 - RNA, 21 nt, Human
aacuuacaaagauucucuaug

SEQ ID NO: 3789594 - RNA, 12 nt, Human
aacuuacacaca

SEQ ID NO: 3789595 - RNA, 20 nt, Human
aacuuacauauuuauuuuua

SEQ ID NO: 3789596 - RNA, 16 nt, Human
aacuuagaauaaaauu

SEQ ID NO: 3789597 - RNA, 18 nt, Human
aacuuagaauaaaauugu

SEQ ID NO: 3789598 - RNA, 15 nt, Human
aacuuagagcuuuuu

SEQ ID NO: 3789599 - RNA, 23 nt, Human
aacuuagcauuuucugcaucucc

SEQ ID NO: 3789600 - RNA, 22 nt, Human
aacuuagccauuuuucaaagca

SEQ ID NO: 3789601 - RNA, 20 nt, Human
aacuuagugacaaaauagac

SEQ ID NO: 3789602 - RNA, 15 nt, Human
aacuuaguuugugaa

SEQ ID NO: 3789603 - RNA, 20 nt, Human
aacuuauauacuauuucccu

SEQ ID NO: 3789604 - RNA, 23 nt, Human
aacuuauauuaauaguaauuugu

SEQ ID NO: 3789605 - RNA, 12 nt, Human
aacuuaugaaug

SEQ ID NO: 3789606 - RNA, 14 nt, Human
aacuuaugaauguu

SEQ ID NO: 3789607 - RNA, 17 nt, Human
aacuuauguagauauuu

SEQ ID NO: 3789608 - RNA, 18 nt, Human
aacuuauguagauauuug

SEQ ID NO: 3789609 - RNA, 12 nt, Human
aacuuauguuuu

SEQ ID NO: 3789610 - RNA, 13 nt, Human
aacuuauuuagag

SEQ ID NO: 3789611 - RNA, 17 nt, Human
aacuuauuuuaaaauau

SEQ ID NO: 3789612 - RNA, 17 nt, Human
aacuuauuuuauuucca

SEQ ID NO: 3789613 - RNA, 16 nt, Human
aacuuauuuuuuucug

SEQ ID NO: 3789614 - RNA, 14 nt, Human
aacuucacauauug

SEQ ID NO: 3789615 - RNA, 22 nt, Human
aacuucacauauugauuuccgu

SEQ ID NO: 3789616 - RNA, 16 nt, Human
aacuucacauuaaaaa

SEQ ID NO: 3789617 - RNA, 21 nt, Human
aacuucagaugggaggaaaga

SEQ ID NO: 3789618 - RNA, 18 nt, Human
aacuucagcaguaccuau

SEQ ID NO: 3789619 - RNA, 12 nt, Human
aacuucaggaaa

SEQ ID NO: 3789620 - RNA, 15 nt, Human
aacuucaguccuggg

SEQ ID NO: 3789621 - RNA, 17 nt, Human
aacuucauauguaaucu

SEQ ID NO: 3789622 - RNA, 15 nt, Human
aacuucauggaucag

SEQ ID NO: 3789623 - RNA, 20 nt, Human
aacuucaugucaacuucugg

SEQ ID NO: 3789624 - RNA, 12 nt, Human
aacuucauucuc

SEQ ID NO: 3789625 - RNA, 16 nt, Human
aacuuccaaauaaaua

SEQ ID NO: 3789626 - RNA, 20 nt, Human
aacuuccaagaccugacuca

SEQ ID NO: 3789627 - RNA, 13 nt, Human
aacuuccaauuua

SEQ ID NO: 3789628 - RNA, 19 nt, Human
aacuuccagguguuacugu

SEQ ID NO: 3789629 - RNA, 23 nt, Human
aacuuccuuggacucauuuuaaa

SEQ ID NO: 3789630 - RNA, 20 nt, Human
aacuucgaaagcaucauuau

SEQ ID NO: 3789631 - RNA, 19 nt, Human
aacuucgcaucaaaagaca

SEQ ID NO: 3789632 - RNA, 15 nt, Human
aacuucuaaaacugu

SEQ ID NO: 3789633 - RNA, 15 nt, Human
aacuucuaauugcca

SEQ ID NO: 3789634 - RNA, 17 nt, Human
aacuucuuauggaauug

SEQ ID NO: 3789635 - RNA, 19 nt, Human
aacuucuucagagcugaca

SEQ ID NO: 3789636 - RNA, 19 nt, Human
aacuucuugcuucuuucua

SEQ ID NO: 3789637 - RNA, 22 nt, Human
aacuucuugcuucuuucuagaa

SEQ ID NO: 3789638 - RNA, 13 nt, Human
aacuucuugucag

SEQ ID NO: 3789639 - RNA, 20 nt, Human
aacuucuugucagacauaaa

SEQ ID NO: 3789640 - RNA, 21 nt, Human
aacuucuugucagacauaaag

SEQ ID NO: 3789641 - RNA, 13 nt, Human
aacuucuuucacu

SEQ ID NO: 3789642 - RNA, 22 nt, Human
aacuugaaaauauaugauggcu

SEQ ID NO: 3789643 - RNA, 12 nt, Human
aacuugaaauuu

SEQ ID NO: 3789644 - RNA, 18 nt, Human
aacuugagaacuuuauuu

SEQ ID NO: 3789645 - RNA, 22 nt, Human
aacuugagaacuuuauuuccaa

SEQ ID NO: 3789646 - RNA, 15 nt, Human
aacuugagcauguua

SEQ ID NO: 3789647 - RNA, 12 nt, Human
aacuugaggaca

SEQ ID NO: 3789648 - RNA, 14 nt, Human
aacuugaggacaca

SEQ ID NO: 3789649 - RNA, 15 nt, Human
aacuugaggacacau

SEQ ID NO: 3789650 - RNA, 16 nt, Human
aacuugaggacacaug

SEQ ID NO: 3789651 - RNA, 19 nt, Human
aacuugaggacacaugucc

SEQ ID NO: 3789652 - RNA, 16 nt, Human
aacuugaggguaauaa

SEQ ID NO: 3789653 - RNA, 19 nt, Human
aacuugaggguaauaaacu

SEQ ID NO: 3789654 - RNA, 17 nt, Human
aacuugauccauuucua

SEQ ID NO: 3789655 - RNA, 14 nt, Human
aacuugcaaaauca

SEQ ID NO: 3789656 - RNA, 17 nt, Human
aacuugcaaaaucaguu

SEQ ID NO: 3789657 - RNA, 19 nt, Human
aacuugcaaaaucaguuuu

SEQ ID NO: 3789658 - RNA, 23 nt, Human
aacuugcaagggcggccuuuccc

SEQ ID NO: 3789659 - RNA, 14 nt, Human
aacuugcaucacuu

SEQ ID NO: 3789660 - RNA, 11 nt, Human
aacuugccuuu

SEQ ID NO: 3789661 - RNA, 22 nt, Human
aacuugcugcaguaugaaaaua

SEQ ID NO: 3789662 - RNA, 14 nt, Human
aacuugcugcuguc

SEQ ID NO: 3789663 - RNA, 15 nt, Human
aacuugcuuaaaugu

SEQ ID NO: 3789664 - RNA, 18 nt, Human
aacuugcuuaucaacuuc

SEQ ID NO: 3789665 - RNA, 16 nt, Human
aacuuggaugaguuuu

SEQ ID NO: 3789666 - RNA, 17 nt, Human
aacuuggaugaguuuug

SEQ ID NO: 3789667 - RNA, 11 nt, Human
aacuuggcuca

SEQ ID NO: 3789668 - RNA, 18 nt, Human
aacuuggcugcaggaauc

SEQ ID NO: 3789669 - RNA, 11 nt, Human
aacuugggagu

SEQ ID NO: 3789670 - RNA, 17 nt, Human
aacuuggugcuuauuga

SEQ ID NO: 3789671 - RNA, 17 nt, Human
aacuugguucugcuuca

SEQ ID NO: 3789672 - RNA, 15 nt, Human
aacuuguaaaugcug

SEQ ID NO: 3789673 - RNA, 20 nt, Human
aacuuguaauuuuuuuaauu

SEQ ID NO: 3789674 - RNA, 23 nt, Human
aacuuguagcuguaaaacgcugu

SEQ ID NO: 3789675 - RNA, 15 nt, Human
aacuuguauuaugug

SEQ ID NO: 3789676 - RNA, 20 nt, Human
aacuugucaaaaaacaaaaa

SEQ ID NO: 3789677 - RNA, 12 nt, Human
aacuugugaaug

SEQ ID NO: 3789678 - RNA, 17 nt, Human
aacuugugaaugcuucu

SEQ ID NO: 3789679 - RNA, 14 nt, Human
aacuuguguaaaua

SEQ ID NO: 3789680 - RNA, 19 nt, Human
aacuugugucccuaaugug

SEQ ID NO: 3789681 - RNA, 18 nt, Human
aacuuguuauugugaaug

SEQ ID NO: 3789682 - RNA, 20 nt, Human
aacuuguuauugugaaugau

SEQ ID NO: 3789683 - RNA, 20 nt, Human
aacuuguucuuccaaagcag

SEQ ID NO: 3789684 - RNA, 16 nt, Human
aacuuguuuaauaaag

SEQ ID NO: 3789685 - RNA, 15 nt, Human
aacuuuaaaaaauau

SEQ ID NO: 3789686 - RNA, 17 nt, Human
aacuuuaaaaaauauuu

SEQ ID NO: 3789687 - RNA, 19 nt, Human
aacuuuaaagcguuugcac

SEQ ID NO: 3789688 - RNA, 13 nt, Human
aacuuuaaauuau

SEQ ID NO: 3789689 - RNA, 20 nt, Human
aacuuuaacuucuguuuuac

SEQ ID NO: 3789690 - RNA, 13 nt, Human
aacuuuaagagga

SEQ ID NO: 3789691 - RNA, 15 nt, Human
aacuuuaagaggaca

SEQ ID NO: 3789692 - RNA, 18 nt, Human
aacuuuaagcagcucuug

SEQ ID NO: 3789693 - RNA, 19 nt, Human
aacuuuaauauguauuuua

SEQ ID NO: 3789694 - RNA, 16 nt, Human
aacuuuaaucaaguug

SEQ ID NO: 3789695 - RNA, 20 nt, Human
aacuuuaauucucuuucaaa

SEQ ID NO: 3789696 - RNA, 16 nt, Human
aacagcuucagguuau

SEQ ID NO: 3789697 - RNA, 22 nt, Human
aacagcuucauguucccaaaau

SEQ ID NO: 3789698 - RNA, 22 nt, Human
aacagcuuuggggugucuuuuu

SEQ ID NO: 3789699 - RNA, 15 nt, Human
aacaggaaaaaaacu

SEQ ID NO: 3789700 - RNA, 16 nt, Human
aacaggaaaaaaacuu

SEQ ID NO: 3789701 - RNA, 22 nt, Human
aacaggaaaaaaacuuuuauaa

SEQ ID NO: 3789702 - RNA, 11 nt, Human
aacaggaaaag

SEQ ID NO: 3789703 - RNA, 22 nt, Human
aacaggaagaucuuaaauuuug

SEQ ID NO: 3789704 - RNA, 19 nt, Human
aacaggacuuaaaaugaca

SEQ ID NO: 3789705 - RNA, 21 nt, Human
aacaggagcugggauccuaag

SEQ ID NO: 3789706 - RNA, 14 nt, Human
aacaggaggacaau

SEQ ID NO: 3789707 - RNA, 16 nt, Human
aacaggaggacaauuc

SEQ ID NO: 3789708 - RNA, 14 nt, Human
aacaggcaagugaa

SEQ ID NO: 3789709 - RNA, 16 nt, Human
aacaggcacugcccug

SEQ ID NO: 3789710 - RNA, 18 nt, Human
aacaggcacuuggcagcc

SEQ ID NO: 3789711 - RNA, 14 nt, Human
aacaggcagauaca

SEQ ID NO: 3789712 - RNA, 17 nt, Human
aacaggccauugugaac

SEQ ID NO: 3789713 - RNA, 13 nt, Human
aacaggcccagca

SEQ ID NO: 3789714 - RNA, 18 nt, Human
aacaggcuacucuccucg

SEQ ID NO: 3789715 - RNA, 22 nt, Human
aacaggcugggcuucaguggca

SEQ ID NO: 3789716 - RNA, 21 nt, Human
aacaggcuguucugcacugaa

SEQ ID NO: 3789717 - RNA, 23 nt, Human
aacaggcuguucugcacugaaaa

SEQ ID NO: 3789718 - RNA, 13 nt, Human
aacagggaaggca

SEQ ID NO: 3789719 - RNA, 19 nt, Human
aacagggauugauuuuaaa

SEQ ID NO: 3789720 - RNA, 18 nt, Human
aacagggcaucuccagga

SEQ ID NO: 3789721 - RNA, 16 nt, Human
aacagggccacauaga

SEQ ID NO: 3789722 - RNA, 15 nt, Human
aacagggccuugcua

SEQ ID NO: 3789723 - RNA, 14 nt, Human
aacagggcugccuu

SEQ ID NO: 3789724 - RNA, 18 nt, Human
aacagggucucuagugcu

SEQ ID NO: 3789725 - RNA, 23 nt, Human
aacagggucucuagugcugugaa

SEQ ID NO: 3789726 - RNA, 13 nt, Human
aacaggucuccuc

SEQ ID NO: 3789727 - RNA, 15 nt, Human
aacaggucuccucuu

SEQ ID NO: 3789728 - RNA, 16 nt, Human
aacagguggcaggacc

SEQ ID NO: 3789729 - RNA, 22 nt, Human
aacagguuauuuuaguuucugu

SEQ ID NO: 3789730 - RNA, 17 nt, Human
aacagguugggauggga

SEQ ID NO: 3789731 - RNA, 19 nt, Human
aacaguaaaccacugaaaa

SEQ ID NO: 3789732 - RNA, 14 nt, Human
aacaguaaaugugc

SEQ ID NO: 3789733 - RNA, 15 nt, Human
aacaguaacauagcu

SEQ ID NO: 3789734 - RNA, 22 nt, Human
aacaguagugauaguuguaccg

SEQ ID NO: 3789735 - RNA, 20 nt, Human
aacaguaugugggauauuga

SEQ ID NO: 3789736 - RNA, 11 nt, Human
aacaguauuua

SEQ ID NO: 3789737 - RNA, 12 nt, Human
aacaguauuuau

SEQ ID NO: 3789738 - RNA, 16 nt, Human
aacaguauuuauuuug

SEQ ID NO: 3789739 - RNA, 18 nt, Human
aacaguauuuauuuugua

SEQ ID NO: 3789740 - RNA, 17 nt, Human
aacagucaaaacagaga

SEQ ID NO: 3789741 - RNA, 21 nt, Human
aacagucauguuuuaaaugua

SEQ ID NO: 3789742 - RNA, 18 nt, Human
aacaguccauugaaaggg

SEQ ID NO: 3789743 - RNA, 14 nt, Human
aacagucucaggaa

SEQ ID NO: 3789744 - RNA, 23 nt, Human
aacagugcaccugggacagggag

SEQ ID NO: 3789745 - RNA, 20 nt, Human
aacagugcagggcaaaauau

SEQ ID NO: 3789746 - RNA, 18 nt, Human
aacagugccauugucuuu

SEQ ID NO: 3789747 - RNA, 20 nt, Human
aacagugccauugucuuuau

SEQ ID NO: 3789748 - RNA, 12 nt, Human
aacagugccugc

SEQ ID NO: 3789749 - RNA, 13 nt, Human
aacagugccugcu

SEQ ID NO: 3789750 - RNA, 14 nt, Human
aacagugugaaguu

SEQ ID NO: 3789751 - RNA, 15 nt, Human
aacagugugaaguua

SEQ ID NO: 3789752 - RNA, 16 nt, Human
aacagugugaaguuag

SEQ ID NO: 3789753 - RNA, 17 nt, Human
aacagugugaaguuaga

SEQ ID NO: 3789754 - RNA, 23 nt, Human
aacaguguguaaacaaaaugaag

SEQ ID NO: 3789755 - RNA, 13 nt, Human
aacaguguuuccc

SEQ ID NO: 3789756 - RNA, 19 nt, Human
aacaguguuucccauaauu

SEQ ID NO: 3789757 - RNA, 17 nt, Human
aacaguuaacuuucaga

SEQ ID NO: 3789758 - RNA, 17 nt, Human
aagaaggaugauucaac

SEQ ID NO: 3789759 - RNA, 19 nt, Human
aagaaggcaaaaauaguuu

SEQ ID NO: 3789760 - RNA, 14 nt, Human
aagaaggcaauauu

SEQ ID NO: 3789761 - RNA, 12 nt, Human
aagaaggcuggg

SEQ ID NO: 3789762 - RNA, 16 nt, Human
aagaagggacugagag

SEQ ID NO: 3789763 - RNA, 14 nt, Human
aagaagggagaaga

SEQ ID NO: 3789764 - RNA, 15 nt, Human
aagaagggagaagaa

SEQ ID NO: 3789765 - RNA, 16 nt, Human
aagaagggcugcauga

SEQ ID NO: 3789766 - RNA, 20 nt, Human
aagaagggcugcaugauguu

SEQ ID NO: 3789767 - RNA, 21 nt, Human
aagaagguuaccaagaagccu

SEQ ID NO: 3789768 - RNA, 15 nt, Human
aagaaguaggcauga

SEQ ID NO: 3789769 - RNA, 22 nt, Human
aagaagugaccaaggaggaguu

SEQ ID NO: 3789770 - RNA, 16 nt, Human
aagaagugaguguuuc

SEQ ID NO: 3789771 - RNA, 19 nt, Human
aagaaguggggcagcagca

SEQ ID NO: 3789772 - RNA, 20 nt, Human
aagaaguucuuugauucugu

SEQ ID NO: 3789773 - RNA, 17 nt, Human
aagaaguuuaaggaaua

SEQ ID NO: 3789774 - RNA, 13 nt, Human
aagaaguuuuaaa

SEQ ID NO: 3789775 - RNA, 18 nt, Human
aagaaguuuuaaaaagcc

SEQ ID NO: 3789776 - RNA, 23 nt, Human
aagaaguuuuaaaaagccaguuu

SEQ ID NO: 3789777 - RNA, 15 nt, Human
aagaauaaaauguug

SEQ ID NO: 3789778 - RNA, 18 nt, Human
aagaauaaaauguugaaa

SEQ ID NO: 3789779 - RNA, 16 nt, Human
aagaauaaucacgcuu

SEQ ID NO: 3789780 - RNA, 22 nt, Human
aagaauacaaacauauuuguua

SEQ ID NO: 3789781 - RNA, 15 nt, Human
aagaauacagcuuuc

SEQ ID NO: 3789782 - RNA, 13 nt, Human
aagaauacaguua

SEQ ID NO: 3789783 - RNA, 12 nt, Human
aagaauacuuga

SEQ ID NO: 3789784 - RNA, 13 nt, Human
aagaauacuugaa

SEQ ID NO: 3789785 - RNA, 14 nt, Human
aagaauacuugaac

SEQ ID NO: 3789786 - RNA, 13 nt, Human
aagaauagaaaca

SEQ ID NO: 3789787 - RNA, 15 nt, Human
aagaauagaaacaag

SEQ ID NO: 3789788 - RNA, 21 nt, Human
aagaauauguuuccuuguuua

SEQ ID NO: 3789789 - RNA, 12 nt, Human
aagaauauugca

SEQ ID NO: 3789790 - RNA, 14 nt, Human
aagaauauugcaaa

SEQ ID NO: 3789791 - RNA, 11 nt, Human
aagaauauugu

SEQ ID NO: 3789792 - RNA, 12 nt, Human
aagaauauugua

SEQ ID NO: 3789793 - RNA, 22 nt, Human
aagaauauuguuccuaaguucu

SEQ ID NO: 3789794 - RNA, 12 nt, Human
aagaaucagaga

SEQ ID NO: 3789795 - RNA, 16 nt, Human
aagaaucagaguagaa

SEQ ID NO: 3789796 - RNA, 22 nt, Human
aagaaucauuguaaacauuagu

SEQ ID NO: 3789797 - RNA, 23 nt, Human
aagaaucccuagacuuuaggcuu

SEQ ID NO: 3789798 - RNA, 21 nt, Human
aagaaucccuguucauuguaa

SEQ ID NO: 3789799 - RNA, 21 nt, Human
aagaaucuugguuugccuucc

SEQ ID NO: 3789800 - RNA, 14 nt, Human
aagaaugaaagagu

SEQ ID NO: 3789801 - RNA, 19 nt, Human
aagaaugaacaaauugaac

SEQ ID NO: 3789802 - RNA, 21 nt, Human
aagaaugaagguuuuuguaaa

SEQ ID NO: 3789803 - RNA, 18 nt, Human
aagaaugauuaugaauua

SEQ ID NO: 3789804 - RNA, 20 nt, Human
aagaaugcacaagaauggau

SEQ ID NO: 3789805 - RNA, 19 nt, Human
aagaaugcugguuuuccua

SEQ ID NO: 3789806 - RNA, 17 nt, Human
aagaaugcuuaaucaga

SEQ ID NO: 3789807 - RNA, 16 nt, Human
aagaauggagcaguac

SEQ ID NO: 3789808 - RNA, 19 nt, Human
aagaaugguccgugcuaag

SEQ ID NO: 3789809 - RNA, 16 nt, Human
aagaauguacguccag

SEQ ID NO: 3789810 - RNA, 15 nt, Human
aagaaugucagaaaa

SEQ ID NO: 3789811 - RNA, 18 nt, Human
aagaaugucgauuaaaau

SEQ ID NO: 3789812 - RNA, 13 nt, Human
aagaauguguuuc

SEQ ID NO: 3789813 - RNA, 16 nt, Human
aagaauguguuucaaa

SEQ ID NO: 3789814 - RNA, 18 nt, Human
aagaauguuaagacuuga

SEQ ID NO: 3789815 - RNA, 20 nt, Human
aagaauguuacugccuuaau

SEQ ID NO: 3789816 - RNA, 16 nt, Human
aagaauguuagagcac

SEQ ID NO: 3789817 - RNA, 16 nt, Human
aagaauguuagaguaa

SEQ ID NO: 3789818 - RNA, 14 nt, Human
aagaauguugguuu

SEQ ID NO: 3789819 - RNA, 18 nt, Human
aagaauguugguuuacuu

SEQ ID NO: 3789820 - RNA, 21 nt, Human
aagaauguugguuuacuuuca

SEQ ID NO: 3789821 - RNA, 18 nt, Human
aagaauuaagauacaaau

SEQ ID NO: 3789822 - RNA, 12 nt, Human
aagaauucaaau

SEQ ID NO: 3789823 - RNA, 21 nt, Human
aagaauucaaauuuuaucugc

SEQ ID NO: 3789824 - RNA, 20 nt, Human
aagaauucuccaaaacaauu

SEQ ID NO: 3789825 - RNA, 15 nt, Human
aagaauugaaaaguu

SEQ ID NO: 3789826 - RNA, 18 nt, Human
aagaauugaaaaguuuuu

SEQ ID NO: 3789827 - RNA, 20 nt, Human
aagaauugaaaaguuuuugu

SEQ ID NO: 3789828 - RNA, 16 nt, Human
aagaauugaacccagg

SEQ ID NO: 3789829 - RNA, 16 nt, Human
aagaauugaagcagga

SEQ ID NO: 3789830 - RNA, 21 nt, Human
aagaauugaccaucugcuuuu

SEQ ID NO: 3789831 - RNA, 23 nt, Human
aagaauugauugggcacaucauu

SEQ ID NO: 3789832 - RNA, 21 nt, Human
aagaauuguuggggguuuuuu

SEQ ID NO: 3789833 - RNA, 22 nt, Human
aagaauuguuggggguuuuuuu

SEQ ID NO: 3789834 - RNA, 14 nt, Human
aagaauuugcauac

SEQ ID NO: 3789835 - RNA, 14 nt, Human
aagaauuuuaaaaa

SEQ ID NO: 3789836 - RNA, 20 nt, Human
aagaauuuuaaaaaugaauc

SEQ ID NO: 3789837 - RNA, 22 nt, Human
aagaauuuucagaccccagcgg

SEQ ID NO: 3789838 - RNA, 22 nt, Human
aagaauuuuccugagacaaauu

SEQ ID NO: 3789839 - RNA, 14 nt, Human
aagaauuuuuuauu

SEQ ID NO: 3789840 - RNA, 18 nt, Human
aagacaaaaauacucuaa

SEQ ID NO: 3789841 - RNA, 17 nt, Human
aagccagcuuucccugc

SEQ ID NO: 3789842 - RNA, 18 nt, Human
aagccaggagcaaauguu

SEQ ID NO: 3789843 - RNA, 21 nt, Human
aagccaggcagguagccaggg

SEQ ID NO: 3789844 - RNA, 18 nt, Human
aagccaggcucacucaca

SEQ ID NO: 3789845 - RNA, 20 nt, Human
aagccagggcccgggaagca

SEQ ID NO: 3789846 - RNA, 16 nt, Human
aagccagggcuggaga

SEQ ID NO: 3789847 - RNA, 12 nt, Human
aagccagggucu

SEQ ID NO: 3789848 - RNA, 20 nt, Human
aagccagggucucucccuca

SEQ ID NO: 3789849 - RNA, 13 nt, Human
aagccaggucccu

SEQ ID NO: 3789850 - RNA, 21 nt, Human
aagccagguuccacagaggac

SEQ ID NO: 3789851 - RNA, 23 nt, Human
aagccagguuccacagaggacac

SEQ ID NO: 3789852 - RNA, 17 nt, Human
aagccagugacuccagg

SEQ ID NO: 3789853 - RNA, 23 nt, Human
aagccaguguugccuaaguauua

SEQ ID NO: 3789854 - RNA, 20 nt, Human
aagccaguuuggguaaaaua

SEQ ID NO: 3789855 - RNA, 14 nt, Human
aagccaugagaaug

SEQ ID NO: 3789856 - RNA, 16 nt, Human
aagccaugagaauguu

SEQ ID NO: 3789857 - RNA, 22 nt, Human
aagccaugaguuccagaaagua

SEQ ID NO: 3789858 - RNA, 23 nt, Human
aagccaugaguuccagaaaguaa

SEQ ID NO: 3789859 - RNA, 21 nt, Human
aagccauggguagccugggug

SEQ ID NO: 3789860 - RNA, 18 nt, Human
aagccauguauaaaugug

SEQ ID NO: 3789861 - RNA, 20 nt, Human
aagccauguauaaaugugau

SEQ ID NO: 3789862 - RNA, 17 nt, Human
aagccauguuuaagauu

SEQ ID NO: 3789863 - RNA, 16 nt, Human
aagccauguuuauuac

SEQ ID NO: 3789864 - RNA, 21 nt, Human
aagccauguuuauuacaguau

SEQ ID NO: 3789865 - RNA, 23 nt, Human
aagccauguuuauuacaguauaa

SEQ ID NO: 3789866 - RNA, 18 nt, Human
aagccauuaaaugaauau

SEQ ID NO: 3789867 - RNA, 20 nt, Human
aagccauucuaaggaaauua

SEQ ID NO: 3789868 - RNA, 13 nt, Human
aagccauugucuu

SEQ ID NO: 3789869 - RNA, 18 nt, Human
aagcccaauauuauaauu

SEQ ID NO: 3789870 - RNA, 16 nt, Human
aagcccaccauuuggc

SEQ ID NO: 3789871 - RNA, 18 nt, Human
aagcccagaaaaggacag

SEQ ID NO: 3789872 - RNA, 16 nt, Human
aagcccagagggucug

SEQ ID NO: 3789873 - RNA, 18 nt, Human
aagcccagcccauggaga

SEQ ID NO: 3789874 - RNA, 22 nt, Human
aagcccaggaaaggcuccagga

SEQ ID NO: 3789875 - RNA, 15 nt, Human
aagcccaggagccca

SEQ ID NO: 3789876 - RNA, 16 nt, Human
aagcccaggagcccau

SEQ ID NO: 3789877 - RNA, 15 nt, Human
aagcccaggggccgg

SEQ ID NO: 3789878 - RNA, 17 nt, Human
aagcccagugcacugaa

SEQ ID NO: 3789879 - RNA, 16 nt, Human
aagcccauucauucca

SEQ ID NO: 3789880 - RNA, 23 nt, Human
aagcccauucauuccauucugga

SEQ ID NO: 3789881 - RNA, 16 nt, Human
aagccccacccaggcc

SEQ ID NO: 3789882 - RNA, 14 nt, Human
aagccccaggcagg

SEQ ID NO: 3789883 - RNA, 21 nt, Human
aagccccaggcaggcugugcg

SEQ ID NO: 3789884 - RNA, 21 nt, Human
aagccccaugcuggagccugu

SEQ ID NO: 3789885 - RNA, 15 nt, Human
aagcccccagagccc

SEQ ID NO: 3789886 - RNA, 16 nt, Human
aagcccccagagccca

SEQ ID NO: 3789887 - RNA, 18 nt, Human
aagcccccagagcccagg

SEQ ID NO: 3789888 - RNA, 19 nt, Human
aagcccccagagcccaggc

SEQ ID NO: 3789889 - RNA, 17 nt, Human
aagccccugcccaucug

SEQ ID NO: 3789890 - RNA, 18 nt, Human
aagccccugccccuccuc

SEQ ID NO: 3789891 - RNA, 21 nt, Human
aagccccuugcucuccccugc

SEQ ID NO: 3789892 - RNA, 19 nt, Human
aagcccgccugacagaaac

SEQ ID NO: 3789893 - RNA, 15 nt, Human
aagcccggcuccugg

SEQ ID NO: 3789894 - RNA, 18 nt, Human
aagcccggcuccugguca

SEQ ID NO: 3789895 - RNA, 22 nt, Human
aagcccggcuccuggucaccua

SEQ ID NO: 3789896 - RNA, 17 nt, Human
aagcccuaacucagcca

SEQ ID NO: 3789897 - RNA, 16 nt, Human
aagcccuacagagcug

SEQ ID NO: 3789898 - RNA, 17 nt, Human
aagcccuacagagcugu

SEQ ID NO: 3789899 - RNA, 20 nt, Human
aagcccucccagguguuaac

SEQ ID NO: 3789900 - RNA, 11 nt, Human
aagcccuccuu

SEQ ID NO: 3789901 - RNA, 13 nt, Human
aagcccuccuucc

SEQ ID NO: 3789902 - RNA, 13 nt, Human
aagcccucuucca

SEQ ID NO: 3789903 - RNA, 14 nt, Human
aagcccucuuccau

SEQ ID NO: 3789904 - RNA, 19 nt, Human
aagcccugagcuuucugcu

SEQ ID NO: 3789905 - RNA, 19 nt, Human
aagcccugucgagacacuu

SEQ ID NO: 3789906 - RNA, 22 nt, Human
aagcccuguugugccacagagu

SEQ ID NO: 3789907 - RNA, 14 nt, Human
aagccgacucuggc

SEQ ID NO: 3789908 - RNA, 19 nt, Human
aagccgacucuggcccugg

SEQ ID NO: 3789909 - RNA, 21 nt, Human
aagccgacucuggcccuggcc

SEQ ID NO: 3789910 - RNA, 17 nt, Human
aagccgagagccuuuug

SEQ ID NO: 3789911 - RNA, 15 nt, Human
aagccgccaggaccg

SEQ ID NO: 3789912 - RNA, 14 nt, Human
aagccgugcccugc

SEQ ID NO: 3789913 - RNA, 13 nt, Human
aagccguggcuuc

SEQ ID NO: 3789914 - RNA, 16 nt, Human
aagccuaaaugccuua

SEQ ID NO: 3789915 - RNA, 17 nt, Human
aagccuaagggauccug

SEQ ID NO: 3789916 - RNA, 16 nt, Human
aagccuaccugcucuc

SEQ ID NO: 3789917 - RNA, 19 nt, Human
aagccuaccugcucuccaa

SEQ ID NO: 3789918 - RNA, 18 nt, Human
aagccuagauguuuuaua

SEQ ID NO: 3789919 - RNA, 18 nt, Human
aagccuauuguaaauaca

SEQ ID NO: 3789920 - RNA, 22 nt, Human
aagccucaaagagagaaaguuu

SEQ ID NO: 3789921 - RNA, 21 nt, Human
aagccucaagguuuuagguuc

SEQ ID NO: 3789922 - RNA, 19 nt, Human
aagccucagauuccuuccc

SEQ ID NO: 3789923 - RNA, 21 nt, Human
aagccucagauuccuucccau

SEQ ID NO: 3789924 - RNA, 21 nt, Human
aagccucaucaucagagccuu

SEQ ID NO: 3789925 - RNA, 15 nt, Human
aagccuccacagcga

SEQ ID NO: 3789926 - RNA, 20 nt, Human
aagccuccauuuaguucuuu

SEQ ID NO: 3789927 - RNA, 22 nt, Human
aagccuccauuuaguucuuugu

SEQ ID NO: 3789928 - RNA, 15 nt, Human
aagccucgacacaga

SEQ ID NO: 3789929 - RNA, 18 nt, Human
aagccucgaggugccuuc

SEQ ID NO: 3789930 - RNA, 15 nt, Human
aagccucugcccagg

SEQ ID NO: 3789931 - RNA, 12 nt, Human
aagccucuggcu

SEQ ID NO: 3789932 - RNA, 18 nt, Human
aagccucugugucacugg

SEQ ID NO: 3789933 - RNA, 20 nt, Human
aagccucugugucacuggcu

SEQ ID NO: 3789934 - RNA, 21 nt, Human
aagccucugugucacuggcug

SEQ ID NO: 3789935 - RNA, 15 nt, Human
aagccugaggcuggg

SEQ ID NO: 3789936 - RNA, 16 nt, Human
aagccugagggaaagg

SEQ ID NO: 3789937 - RNA, 22 nt, Human
aagccugaguacuccacacugc

SEQ ID NO: 3789938 - RNA, 15 nt, Human
aagccugaugcugac

SEQ ID NO: 3789939 - RNA, 12 nt, Human
aagccugcaacu

SEQ ID NO: 3789940 - RNA, 21 nt, Human
aagccugcacaauaaaaaugu

SEQ ID NO: 3789941 - RNA, 17 nt, Human
aagccugcccuugucug

SEQ ID NO: 3789942 - RNA, 20 nt, Human
aagccugcccuugucugaga

SEQ ID NO: 3789943 - RNA, 23 nt, Human
aagccugccuaggaauucccagc

SEQ ID NO: 3789944 - RNA, 21 nt, Human
aagccugcguugguccagagc

SEQ ID NO: 3789945 - RNA, 22 nt, Human
aagccugcguugguccagagcg

SEQ ID NO: 3789946 - RNA, 12 nt, Human
aagccugcuccu

SEQ ID NO: 3789947 - RNA, 21 nt, Human
aagccuggccuacaugguuga

SEQ ID NO: 3789948 - RNA, 17 nt, Human
aagccugggauugacag

SEQ ID NO: 3789949 - RNA, 20 nt, Human
aagccugggggccuggcugg

SEQ ID NO: 3789950 - RNA, 21 nt, Human
aagccugggggccuggcuggc

SEQ ID NO: 3789951 - RNA, 23 nt, Human
aagccugggggccuggcuggcug

SEQ ID NO: 3789952 - RNA, 15 nt, Human
aagccuggucagccc

SEQ ID NO: 3789953 - RNA, 21 nt, Human
aagccuguaacacuccucugc

SEQ ID NO: 3789954 - RNA, 17 nt, Human
aagccuguaaucccagc

SEQ ID NO: 3789955 - RNA, 21 nt, Human
aagccuguauucucaaacaca

SEQ ID NO: 3789956 - RNA, 15 nt, Human
aagccuguggcugug

SEQ ID NO: 3789957 - RNA, 17 nt, Human
aagccuguucauggcag

SEQ ID NO: 3789958 - RNA, 18 nt, Human
aagccuguuccccucacu

SEQ ID NO: 3789959 - RNA, 15 nt, Human
aagccuguuguuuaa

SEQ ID NO: 3789960 - RNA, 18 nt, Human
aagccuguuguuuaagug

SEQ ID NO: 3789961 - RNA, 15 nt, Human
aagccuguuuaagag

SEQ ID NO: 3789962 - RNA, 18 nt, Human
aagccuguuuaagagaca

SEQ ID NO: 3789963 - RNA, 17 nt, Human
aagccuuaagcugcagg

SEQ ID NO: 3789964 - RNA, 16 nt, Human
aagccuuaucaagugu

SEQ ID NO: 3789965 - RNA, 14 nt, Human
aagccuucaagcuc

SEQ ID NO: 3789966 - RNA, 16 nt, Human
aagccuuccacacuca

SEQ ID NO: 3789967 - RNA, 23 nt, Human
aagccuugauugguguugccagu

SEQ ID NO: 3789968 - RNA, 13 nt, Human
aagccuuguguau

SEQ ID NO: 3789969 - RNA, 19 nt, Human
aagccuuguguauauuugu

SEQ ID NO: 3789970 - RNA, 17 nt, Human
aagccuuuacugacccu

SEQ ID NO: 3789971 - RNA, 16 nt, Human
aagccuuuuuccccaa

SEQ ID NO: 3789972 - RNA, 21 nt, Human
aagcgauauacagaugaaaau

SEQ ID NO: 3789973 - RNA, 20 nt, Human
aagcgauucucuugccucaa

SEQ ID NO: 3789974 - RNA, 14 nt, Human
aagcgcccuggccc

SEQ ID NO: 3789975 - RNA, 21 nt, Human
aagcgcccuggcccccacaug

SEQ ID NO: 3789976 - RNA, 16 nt, Human
aagcgccuccaacccu

SEQ ID NO: 3789977 - RNA, 20 nt, Human
aagcggcccuaagggagugu

SEQ ID NO: 3789978 - RNA, 14 nt, Human
aagcggcuggcagc

SEQ ID NO: 3789979 - RNA, 14 nt, Human
aagcggggggaggg

SEQ ID NO: 3789980 - RNA, 23 nt, Human
aagcgugaaggccgagaagcaag

SEQ ID NO: 3789981 - RNA, 15 nt, Human
aagcgugagccacug

SEQ ID NO: 3789982 - RNA, 21 nt, Human
aagcgugagccacugcaccgg

SEQ ID NO: 3789983 - RNA, 15 nt, Human
aagcuaaaauaaaga

SEQ ID NO: 3789984 - RNA, 15 nt, Human
aacucuuauaaauuu

SEQ ID NO: 3789985 - RNA, 14 nt, Human
aacucuuaucucag

SEQ ID NO: 3789986 - RNA, 16 nt, Human
aacucuucaaggucug

SEQ ID NO: 3789987 - RNA, 23 nt, Human
aacucuucccccucucccaguug

SEQ ID NO: 3789988 - RNA, 21 nt, Human
aacucuugacagcuauaauua

SEQ ID NO: 3789989 - RNA, 19 nt, Human
aagccaauccccuccuugg

SEQ ID NO: 3789990 - RNA, 20 nt, Human
aagccaauuuuucugcacug

SEQ ID NO: 3789991 - RNA, 22 nt, Human
aagccaauuuuucugcacugag

SEQ ID NO: 3789992 - RNA, 15 nt, Human
aagccacaggccuga

SEQ ID NO: 3789993 - RNA, 17 nt, Human
aagccacaggccugaga

SEQ ID NO: 3789994 - RNA, 19 nt, Human
aagccacaggccugagauu

SEQ ID NO: 3789995 - RNA, 13 nt, Human
aagccacauagag

SEQ ID NO: 3789996 - RNA, 18 nt, Human
aagccacauuauuucuag

SEQ ID NO: 3789997 - RNA, 14 nt, Human
aagccaccagaugu

SEQ ID NO: 3789998 - RNA, 11 nt, Human
aagccacccuc

SEQ ID NO: 3789999 - RNA, 15 nt, Human
aagccacccucccag

SEQ ID NO: 3790000 - RNA, 19 nt, Human
aagccacccucccagcucu

SEQ ID NO: 3790001 - RNA, 15 nt, Human
aagccacuagacucu

SEQ ID NO: 3790002 - RNA, 19 nt, Human
aagccacucugucccuucc

SEQ ID NO: 3790003 - RNA, 18 nt, Human
aagccacuuaaaauguuc

SEQ ID NO: 3790004 - RNA, 13 nt, Human
aagccacuugaaa

SEQ ID NO: 3790005 - RNA, 20 nt, Human
aagccagaagcugagcacca

SEQ ID NO: 3790006 - RNA, 18 nt, Human
aagccagcaggcucucag

SEQ ID NO: 3790007 - RNA, 20 nt, Human
aagccagcaggcucucaggc

SEQ ID NO: 3790008 - RNA, 11 nt, Human
aagccagccuu

SEQ ID NO: 3790009 - RNA, 21 nt, Human
aagccagcugcagcugggcug

SEQ ID NO: 3790010 - RNA, 19 nt, Human
aagccagcugcccccagag

SEQ ID NO: 3790011 - RNA, 22 nt, Human
aagccagcugcccccagagcca

SEQ ID NO: 3790012 - RNA, 12 nt, Human
aagccagcuugu

SEQ ID NO: 3790013 - RNA, 21 nt, Human
aagccagcuuguuuacaugcu

SEQ ID NO: 3790014 - RNA, 12 nt, Human
aagccagcuuuc

SEQ ID NO: 3790015 - RNA, 21 nt, Human
aagccaggaauuucccaggac

SEQ ID NO: 3790016 - RNA, 21 nt, Human
aagccaggagcaaauguuucu

SEQ ID NO: 3790017 - RNA, 19 nt, Human
aagccaggcucacucacag

SEQ ID NO: 3790018 - RNA, 22 nt, Human
aagccaggcucacucacagagu

SEQ ID NO: 3790019 - RNA, 22 nt, Human
aagccagggauggggccacagc

SEQ ID NO: 3790020 - RNA, 14 nt, Human
aagccagggcugga

SEQ ID NO: 3790021 - RNA, 23 nt, Human
aagccagggucucucccucaggu

SEQ ID NO: 3790022 - RNA, 15 nt, Human
aagccaggucccucu

SEQ ID NO: 3790023 - RNA, 17 nt, Human
aagccaggucccucuca

SEQ ID NO: 3790024 - RNA, 22 nt, Human
aagccagugacuccaggagagg

SEQ ID NO: 3790025 - RNA, 17 nt, Human
aagccagugcggcaggu

SEQ ID NO: 3790026 - RNA, 23 nt, Human
aagccaguuuggguaaaauacuu

SEQ ID NO: 3790027 - RNA, 18 nt, Human
aagccauaauuguucuua

SEQ ID NO: 3790028 - RNA, 23 nt, Human
aagccaucaccucagauggcagc

SEQ ID NO: 3790029 - RNA, 20 nt, Human
aagccaucuugaguggucau

SEQ ID NO: 3790030 - RNA, 15 nt, Human
aagccaucuugguaa

SEQ ID NO: 3790031 - RNA, 14 nt, Human
aagccauguuuaag

SEQ ID NO: 3790032 - RNA, 19 nt, Human
aagccauguuuaagauuua

SEQ ID NO: 3790033 - RNA, 22 nt, Human
aagccauguuuaagauuuaauu

SEQ ID NO: 3790034 - RNA, 14 nt, Human
aagccauugucuuc

SEQ ID NO: 3790035 - RNA, 17 nt, Human
aagccauuuuuacaucu

SEQ ID NO: 3790036 - RNA, 19 nt, Human
aagcccagccccuacugcu

SEQ ID NO: 3790037 - RNA, 12 nt, Human
aagcccagcucc

SEQ ID NO: 3790038 - RNA, 13 nt, Human
aagcccagcucca

SEQ ID NO: 3790039 - RNA, 21 nt, Human
aagcccagcuccagggccaga

SEQ ID NO: 3790040 - RNA, 14 nt, Human
aagcccaggagccc

SEQ ID NO: 3790041 - RNA, 22 nt, Human
aagcccagugcacugaaaguca

SEQ ID NO: 3790042 - RNA, 18 nt, Human
aagcccaguucagcuugg

SEQ ID NO: 3790043 - RNA, 22 nt, Human
aagcccauaugcuaccaccagc

SEQ ID NO: 3790044 - RNA, 22 nt, Human
aagcccaucaauuauagaaagc

SEQ ID NO: 3790045 - RNA, 15 nt, Human
aagcccauccugacc

SEQ ID NO: 3790046 - RNA, 16 nt, Human
aagcccauccugacca

SEQ ID NO: 3790047 - RNA, 18 nt, Human
aagcccauccugaccagc

SEQ ID NO: 3790048 - RNA, 19 nt, Human
aagcccaugaguccuugaa

SEQ ID NO: 3790049 - RNA, 22 nt, Human
aagcccaugaguccuugaaaau

SEQ ID NO: 3790050 - RNA, 12 nt, Human
aagccccaggca

SEQ ID NO: 3790051 - RNA, 17 nt, Human
aagccccaggcaggcug

SEQ ID NO: 3790052 - RNA, 12 nt, Human
aagccccauccu

SEQ ID NO: 3790053 - RNA, 19 nt, Human
aagccccaugcuggagccu

SEQ ID NO: 3790054 - RNA, 20 nt, Human
aagccccaugcuggagccug

SEQ ID NO: 3790055 - RNA, 20 nt, Human
aagcccccaccgugggcagg

SEQ ID NO: 3790056 - RNA, 12 nt, Human
aagcccccagag

SEQ ID NO: 3790057 - RNA, 13 nt, Human
aagcccccagagc

SEQ ID NO: 3790058 - RNA, 17 nt, Human
aagcccccagagcccag

SEQ ID NO: 3790059 - RNA, 21 nt, Human
aagcccccagcuaagaaccug

SEQ ID NO: 3790060 - RNA, 23 nt, Human
aagcccccccuuauaguuugggc

SEQ ID NO: 3790061 - RNA, 15 nt, Human
aagcccgacuugcug

SEQ ID NO: 3790062 - RNA, 9 nt, Human
aagcccucc

SEQ ID NO: 3790063 - RNA, 15 nt, Human
aagcccuccuuccac

SEQ ID NO: 3790064 - RNA, 16 nt, Human
aagcccucuuccauca

SEQ ID NO: 3790065 - RNA, 18 nt, Human
aagcccucuuccaucaug

SEQ ID NO: 3790066 - RNA, 12 nt, Human
aagcccugaggg

SEQ ID NO: 3790067 - RNA, 19 nt, Human
aagcccuggagccaacugc

SEQ ID NO: 3790068 - RNA, 20 nt, Human
aagcccugucgagacacuug

SEQ ID NO: 3790069 - RNA, 16 nt, Human
aagcccuuaaaaauau

SEQ ID NO: 3790070 - RNA, 20 nt, Human
aagcccuuccaugucgccuc

SEQ ID NO: 3790071 - RNA, 23 nt, Human
aagcccuuccaugucgccucugc

SEQ ID NO: 3790072 - RNA, 16 nt, Human
aagccgacucuggccc

SEQ ID NO: 3790073 - RNA, 13 nt, Human
aagccgcugcugg

SEQ ID NO: 3790074 - RNA, 20 nt, Human
aagccgcuggggccaguugg

SEQ ID NO: 3790075 - RNA, 14 nt, Human
aagccggcggccca

SEQ ID NO: 3790076 - RNA, 14 nt, Human
aagccgggaacaga

SEQ ID NO: 3790077 - RNA, 22 nt, Human
aagccguuguuuacuuaaagau

SEQ ID NO: 3790078 - RNA, 12 nt, Human
aagccuaaagau

SEQ ID NO: 3790079 - RNA, 18 nt, Human
aagccucaaaacaaaggc

SEQ ID NO: 3790080 - RNA, 13 nt, Human
aagccuccacagc

SEQ ID NO: 3790081 - RNA, 19 nt, Human
aagccuccauuuaguucuu

SEQ ID NO: 3790082 - RNA, 14 nt, Human
aagccuccccagcu

SEQ ID NO: 3790083 - RNA, 19 nt, Human
aagccuccuccagccgcca

SEQ ID NO: 3790084 - RNA, 23 nt, Human
aagccucuggcuagaggccagcc

SEQ ID NO: 3790085 - RNA, 23 nt, Human
aagccucugugucacuggcugcc

SEQ ID NO: 3790086 - RNA, 24 nt, Human
aagccucugugucacuggcugccu

SEQ ID NO: 3790087 - RNA, 20 nt, Human
aagccugaguuugcuuucaa

SEQ ID NO: 3790088 - RNA, 14 nt, Human
aagccugcaggagu

SEQ ID NO: 3790089 - RNA, 10 nt, Human
aagccugccc

SEQ ID NO: 3790090 - RNA, 15 nt, Human
aagccugcccuuguc

SEQ ID NO: 3790091 - RNA, 21 nt, Human
aagccugccuaggaauuccca

SEQ ID NO: 3790092 - RNA, 16 nt, Human
aagccugcuccuuccc

SEQ ID NO: 3790093 - RNA, 17 nt, Human
aagccugcuccuucccu

SEQ ID NO: 3790094 - RNA, 15 nt, Human
aagccugcugucuug

SEQ ID NO: 3790095 - RNA, 14 nt, Human
aagccuggaaaaaa

SEQ ID NO: 3790096 - RNA, 22 nt, Human
aagccuggguuugguguauggu

SEQ ID NO: 3790097 - RNA, 16 nt, Human
aagccugugcaaaaaa

SEQ ID NO: 3790098 - RNA, 17 nt, Human
aagccuguggaugauca

SEQ ID NO: 3790099 - RNA, 19 nt, Human
aagccuguuuuguuggaag

SEQ ID NO: 3790100 - RNA, 22 nt, Human
aagccuuaucaagugucuucca

SEQ ID NO: 3790101 - RNA, 13 nt, Human
aagccuucaaaac

SEQ ID NO: 3790102 - RNA, 22 nt, Human
aagccuucaaaacuauagcuug

SEQ ID NO: 3790103 - RNA, 15 nt, Human
aagccuucagcucca

SEQ ID NO: 3790104 - RNA, 16 nt, Human
aagccuucagcuccag

SEQ ID NO: 3790105 - RNA, 17 nt, Human
aagccuucagcuccagg

SEQ ID NO: 3790106 - RNA, 19 nt, Human
aagccuucagcuccaggga

SEQ ID NO: 3790107 - RNA, 16 nt, Human
aagccuucauugccuu

SEQ ID NO: 3790108 - RNA, 20 nt, Human
aagccuuccccuuauccucc

SEQ ID NO: 3790109 - RNA, 22 nt, Human
aagccuuccccuuauccucccu

SEQ ID NO: 3790110 - RNA, 20 nt, Human
aagccuugauugguguugcc

SEQ ID NO: 3790111 - RNA, 21 nt, Human
aagccuuguguauauuuguau

SEQ ID NO: 3790112 - RNA, 23 nt, Human
aagccuuuacugacccuggggcu

SEQ ID NO: 3790113 - RNA, 19 nt, Human
aagccuuuaguaucagugu

SEQ ID NO: 3790114 - RNA, 15 nt, Human
aagcgaaaaaaucag

SEQ ID NO: 3790115 - RNA, 16 nt, Human
aagcgauauacagaug

SEQ ID NO: 3790116 - RNA, 14 nt, Human
aagcgauucuccug

SEQ ID NO: 3790117 - RNA, 14 nt, Human
aagcgauucuucug

SEQ ID NO: 3790118 - RNA, 15 nt, Human
aagcgauucuucugc

SEQ ID NO: 3790119 - RNA, 23 nt, Human
aagcgcauccaaucucaaggaau

SEQ ID NO: 3790120 - RNA, 20 nt, Human
aagcgccuccaacccuagca

SEQ ID NO: 3790121 - RNA, 21 nt, Human
aagcggcccuaagggaguguc

SEQ ID NO: 3790122 - RNA, 13 nt, Human
aagcggggggagg

SEQ ID NO: 3790123 - RNA, 14 nt, Human
aagcggugucucuc

SEQ ID NO: 3790124 - RNA, 15 nt, Human
aagcguauggcuuua

SEQ ID NO: 3790125 - RNA, 12 nt, Human
aagcguggugga

SEQ ID NO: 3790126 - RNA, 13 nt, Human
aagcuaaaauaaa

SEQ ID NO: 3790127 - RNA, 16 nt, Human
aagcuaaaauaaagaa

SEQ ID NO: 3790128 - RNA, 11 nt, Human
aaggcucuaga

SEQ ID NO: 3790129 - RNA, 12 nt, Human
aaggcucuagau

SEQ ID NO: 3790130 - RNA, 18 nt, Human
aaggcucugaaagccagc

SEQ ID NO: 3790131 - RNA, 21 nt, Human
aaggcucugagagucuagauu

SEQ ID NO: 3790132 - RNA, 14 nt, Human
aaggcucuuuugua

SEQ ID NO: 3790133 - RNA, 16 nt, Human
aaggcugaccaagaga

SEQ ID NO: 3790134 - RNA, 19 nt, Human
aaggcugaccaagagagaa

SEQ ID NO: 3790135 - RNA, 17 nt, Human
aaggcugaggaaaggcc

SEQ ID NO: 3790136 - RNA, 23 nt, Human
aaggcugaggaaaggccagcugg

SEQ ID NO: 3790137 - RNA, 15 nt, Human
aaggcugcuuagaau

SEQ ID NO: 3790138 - RNA, 17 nt, Human
aaggcugugcugcccug

SEQ ID NO: 3790139 - RNA, 21 nt, Human
aaggcugugcugcccugaaga

SEQ ID NO: 3790140 - RNA, 13 nt, Human
aaggcuguguaag

SEQ ID NO: 3790141 - RNA, 21 nt, Human
aaggcuguguaagauuuguuu

SEQ ID NO: 3790142 - RNA, 19 nt, Human
aaggcuguguacacugaca

SEQ ID NO: 3790143 - RNA, 20 nt, Human
aaggcuguuaaauacaggaa

SEQ ID NO: 3790144 - RNA, 22 nt, Human
aaggcuguuaaauacaggaaac

SEQ ID NO: 3790145 - RNA, 13 nt, Human
aaggcuguugcau

SEQ ID NO: 3790146 - RNA, 23 nt, Human
aaggcuguugcaugggcuaauga

SEQ ID NO: 3790147 - RNA, 15 nt, Human
aaggcuuauaaaaca

SEQ ID NO: 3790148 - RNA, 16 nt, Human
aaggcuuauaaaacag

SEQ ID NO: 3790149 - RNA, 13 nt, Human
aaggcuucagucu

SEQ ID NO: 3790150 - RNA, 14 nt, Human
aaggcuugaagcug

SEQ ID NO: 3790151 - RNA, 16 nt, Human
aaggcuugaagcugug

SEQ ID NO: 3790152 - RNA, 14 nt, Human
aaggcuuucucuac

SEQ ID NO: 3790153 - RNA, 23 nt, Human
aaggcuuugauuaguuuucuugu

SEQ ID NO: 3790154 - RNA, 11 nt, Human
aaggcuuugug

SEQ ID NO: 3790155 - RNA, 22 nt, Human
aaggcuuuucaaccacaaaacu

SEQ ID NO: 3790156 - RNA, 16 nt, Human
aaggcuuuuuauaaac

SEQ ID NO: 3790157 - RNA, 13 nt, Human
aagggaaaaauca

SEQ ID NO: 3790158 - RNA, 22 nt, Human
aagggaaagcuucauucuccuu

SEQ ID NO: 3790159 - RNA, 13 nt, Human
aagggaaauauca

SEQ ID NO: 3790160 - RNA, 15 nt, Human
aagggaaauaucauu

SEQ ID NO: 3790161 - RNA, 23 nt, Human
aagggaacagugaggugcccagc

SEQ ID NO: 3790162 - RNA, 14 nt, Human
aagggaagaaacug

SEQ ID NO: 3790163 - RNA, 14 nt, Human
aagggaagacauuu

SEQ ID NO: 3790164 - RNA, 16 nt, Human
aagggaagacauuucu

SEQ ID NO: 3790165 - RNA, 18 nt, Human
aagggaaggaacucuggc

SEQ ID NO: 3790166 - RNA, 19 nt, Human
aagggaagugguucuuaga

SEQ ID NO: 3790167 - RNA, 12 nt, Human
aagggacaugaa

SEQ ID NO: 3790168 - RNA, 19 nt, Human
aagggacauguuuugauaa

SEQ ID NO: 3790169 - RNA, 20 nt, Human
aagggacauguuuugauaaa

SEQ ID NO: 3790170 - RNA, 15 nt, Human
aagggacugagaaau

SEQ ID NO: 3790171 - RNA, 13 nt, Human
aagggagaaaaaa

SEQ ID NO: 3790172 - RNA, 9 nt, Human
aagggagcc

SEQ ID NO: 3790173 - RNA, 18 nt, Human
aagggagcuggcuccagc

SEQ ID NO: 3790174 - RNA, 16 nt, Human
aagggaggcccagcgc

SEQ ID NO: 3790175 - RNA, 18 nt, Human
aagggagggcagagcugg

SEQ ID NO: 3790176 - RNA, 19 nt, Human
aagggagggcagagcuggu

SEQ ID NO: 3790177 - RNA, 20 nt, Human
aagggagggcagagcuggug

SEQ ID NO: 3790178 - RNA, 14 nt, Human
aagggagggcucug

SEQ ID NO: 3790179 - RNA, 17 nt, Human
aagggagggcucugagg

SEQ ID NO: 3790180 - RNA, 18 nt, Human
aagggagggcucugaggc

SEQ ID NO: 3790181 - RNA, 17 nt, Human
aagggaggugggccgug

SEQ ID NO: 3790182 - RNA, 18 nt, Human
aagggaguuuaaaaaugg

SEQ ID NO: 3790183 - RNA, 13 nt, Human
aagggauaaagaa

SEQ ID NO: 3790184 - RNA, 15 nt, Human
aagggaucugguccu

SEQ ID NO: 3790185 - RNA, 17 nt, Human
aagggauggcaagaugu

SEQ ID NO: 3790186 - RNA, 21 nt, Human
aagggauuuucagcccucaga

SEQ ID NO: 3790187 - RNA, 15 nt, Human
aagggcaaauaauga

SEQ ID NO: 3790188 - RNA, 14 nt, Human
aagggcaaaucugc

SEQ ID NO: 3790189 - RNA, 21 nt, Human
aagggcaauaccguguugguu

SEQ ID NO: 3790190 - RNA, 11 nt, Human
aacuuucauuu

SEQ ID NO: 3790191 - RNA, 11 nt, Human
aacuuucugua

SEQ ID NO: 3790192 - RNA, 21 nt, Human
aacuuucuuaauauuuuuaca

SEQ ID NO: 3790193 - RNA, 20 nt, Human
aacuuugaauaaagaauacu

SEQ ID NO: 3790194 - RNA, 18 nt, Human
aacuuuggaguccccuca

SEQ ID NO: 3790195 - RNA, 12 nt, Human
aacuuugggaaa

SEQ ID NO: 3790196 - RNA, 22 nt, Human
aacuuugggaaaacauguuaau

SEQ ID NO: 3790197 - RNA, 13 nt, Human
aacuuuguauagu

SEQ ID NO: 3790198 - RNA, 14 nt, Human
aacuuuguauaguu

SEQ ID NO: 3790199 - RNA, 21 nt, Human
aacuuuguauaguuauguaaa

SEQ ID NO: 3790200 - RNA, 19 nt, Human
aacuuuguggaugucuucc

SEQ ID NO: 3790201 - RNA, 20 nt, Human
aacuuuguuaggccaaagac

SEQ ID NO: 3790202 - RNA, 15 nt, Human
aacuuuuaaacuaca

SEQ ID NO: 3790203 - RNA, 12 nt, Human
aacuuuuauaaa

SEQ ID NO: 3790204 - RNA, 15 nt, Human
aacuuuuauaaacuu

SEQ ID NO: 3790205 - RNA, 16 nt, Human
aacuuuuauaaacuuu

SEQ ID NO: 3790206 - RNA, 17 nt, Human
aacuuuuauaaauuaaa

SEQ ID NO: 3790207 - RNA, 22 nt, Human
aacuuuuauaaauuaaauauau

SEQ ID NO: 3790208 - RNA, 15 nt, Human
aacuuuuccccuguc

SEQ ID NO: 3790209 - RNA, 19 nt, Human
aacuuuucuaacagaaagc

SEQ ID NO: 3790210 - RNA, 12 nt, Human
aacuuuucuaga

SEQ ID NO: 3790211 - RNA, 11 nt, Human
aacuuuuguaa

SEQ ID NO: 3790212 - RNA, 18 nt, Human
aacuuuuguaaagaaauu

SEQ ID NO: 3790213 - RNA, 14 nt, Human
aacuuuuguaaaua

SEQ ID NO: 3790214 - RNA, 14 nt, Human
aacuuuuguacuga

SEQ ID NO: 3790215 - RNA, 13 nt, Human
aacuuuugugaau

SEQ ID NO: 3790216 - RNA, 19 nt, Human
aacuuuugugaauuaggcu

SEQ ID NO: 3790217 - RNA, 23 nt, Human
aacuuuuuauugccuucucacca

SEQ ID NO: 3790218 - RNA, 23 nt, Human
aacuuuuuguucugguccuuuuu

SEQ ID NO: 3790219 - RNA, 15 nt, Human
aacuuuuuuaaauaa

SEQ ID NO: 3790220 - RNA, 21 nt, Human
aacuuuuuuaaauaaacuuuu

SEQ ID NO: 3790221 - RNA, 22 nt, Human
aacuuuuuuaaauaaacuuuuu

SEQ ID NO: 3790222 - RNA, 23 nt, Human
aacuuuuuuauuuaaaaaacuaa

SEQ ID NO: 3790223 - RNA, 13 nt, Human
aacuuuuuuccac

SEQ ID NO: 3790224 - RNA, 19 nt, Human
aacuuuuuugaaauaauaa

SEQ ID NO: 3790225 - RNA, 12 nt, Human
aacuuuuuuggu

SEQ ID NO: 3790226 - RNA, 15 nt, Human
aacuuuuuuucaaug

SEQ ID NO: 3790227 - RNA, 21 nt, Human
aacuuuuuuucuguaccaguu

SEQ ID NO: 3790228 - RNA, 15 nt, Human
aagaaaaaaaaaaga

SEQ ID NO: 3790229 - RNA, 18 nt, Human
aagaaaaaaaaagaaaaa

SEQ ID NO: 3790230 - RNA, 14 nt, Human
aagaaaaaaaaaug

SEQ ID NO: 3790231 - RNA, 19 nt, Human
aagaaaaaaacgaaaacag

SEQ ID NO: 3790232 - RNA, 23 nt, Human
aagaaaaaaauaauuuuaugaac

SEQ ID NO: 3790233 - RNA, 17 nt, Human
aagaaaaaaauguauuu

SEQ ID NO: 3790234 - RNA, 22 nt, Human
aagaaaaaaauguauuuuaugu

SEQ ID NO: 3790235 - RNA, 20 nt, Human
aagaaaaaaaugucaaaagu

SEQ ID NO: 3790236 - RNA, 19 nt, Human
aagaaaaaaauugaaaugu

SEQ ID NO: 3790237 - RNA, 12 nt, Human
aagaaaaaauac

SEQ ID NO: 3790238 - RNA, 16 nt, Human
aagaaaaaauacauuu

SEQ ID NO: 3790239 - RNA, 14 nt, Human
aagaaaaacuguuu

SEQ ID NO: 3790240 - RNA, 11 nt, Human
aagaaaaacuu

SEQ ID NO: 3790241 - RNA, 18 nt, Human
aagaaaaagaaaaagaaa

SEQ ID NO: 3790242 - RNA, 15 nt, Human
aagaaaaagaagaac

SEQ ID NO: 3790243 - RNA, 12 nt, Human
aagaaaaagauu

SEQ ID NO: 3790244 - RNA, 17 nt, Human
aagaaaaaggaugcaca

SEQ ID NO: 3790245 - RNA, 13 nt, Human
aagaaaaauauuu

SEQ ID NO: 3790246 - RNA, 22 nt, Human
aagaaaaaucauguuugcucuc

SEQ ID NO: 3790247 - RNA, 14 nt, Human
aagaaaacaacuuc

SEQ ID NO: 3790248 - RNA, 15 nt, Human
aagaaaacacuguua

SEQ ID NO: 3790249 - RNA, 15 nt, Human
aagaaaagagaagaa

SEQ ID NO: 3790250 - RNA, 16 nt, Human
aagaaaagagaagaag

SEQ ID NO: 3790251 - RNA, 23 nt, Human
aagaaaagagauauuuuaaaaug

SEQ ID NO: 3790252 - RNA, 11 nt, Human
aagaaaagaug

SEQ ID NO: 3790253 - RNA, 14 nt, Human
aagaaaagaugaaa

SEQ ID NO: 3790254 - RNA, 12 nt, Human
aagaaaagauuu

SEQ ID NO: 3790255 - RNA, 22 nt, Human
aagaaaaguagguuuacauuca

SEQ ID NO: 3790256 - RNA, 14 nt, Human
aagaaaaguauuuu

SEQ ID NO: 3790257 - RNA, 21 nt, Human
aagaaaaguauuuugaaguuu

SEQ ID NO: 3790258 - RNA, 20 nt, Human
aagaaaagugcauauuuauc

SEQ ID NO: 3790259 - RNA, 16 nt, Human
aagaaaaguuuaccau

SEQ ID NO: 3790260 - RNA, 15 nt, Human
aagaaaaguuuugua

SEQ ID NO: 3790261 - RNA, 22 nt, Human
aagaaaaguuuuguaaauuucu

SEQ ID NO: 3790262 - RNA, 18 nt, Human
aagaaaauaaaaaaaaga

SEQ ID NO: 3790263 - RNA, 20 nt, Human
aagaaaauaagagcucagga

SEQ ID NO: 3790264 - RNA, 19 nt, Human
aagaaaauacauaagacca

SEQ ID NO: 3790265 - RNA, 16 nt, Human
aagaaaauaccaagga

SEQ ID NO: 3790266 - RNA, 22 nt, Human
aagaaaauagagaugagcuuuc

SEQ ID NO: 3790267 - RNA, 15 nt, Human
aagaaaauaguggug

SEQ ID NO: 3790268 - RNA, 22 nt, Human
aagaaaauaguggugugauuug

SEQ ID NO: 3790269 - RNA, 13 nt, Human
aagaaaauaucac

SEQ ID NO: 3790270 - RNA, 17 nt, Human
aagaaaaucauauugcu

SEQ ID NO: 3790271 - RNA, 16 nt, Human
aagaaaaugaaaugca

SEQ ID NO: 3790272 - RNA, 19 nt, Human
aagaaacaacucuuugaga

SEQ ID NO: 3790273 - RNA, 19 nt, Human
aagaaacagaucuccuggc

SEQ ID NO: 3790274 - RNA, 16 nt, Human
aaggguucccucaaga

SEQ ID NO: 3790275 - RNA, 19 nt, Human
aaggguuuuccacccugga

SEQ ID NO: 3790276 - RNA, 14 nt, Human
aagguaaaauucua

SEQ ID NO: 3790277 - RNA, 17 nt, Human
aagguaaaauucuaaau

SEQ ID NO: 3790278 - RNA, 12 nt, Human
aagguaaaauug

SEQ ID NO: 3790279 - RNA, 16 nt, Human
aagguaaaauugaaag

SEQ ID NO: 3790280 - RNA, 16 nt, Human
aagguaaauaaaaaga

SEQ ID NO: 3790281 - RNA, 18 nt, Human
aagguacaagaagcauuu

SEQ ID NO: 3790282 - RNA, 17 nt, Human
aagguacuguaugauca

SEQ ID NO: 3790283 - RNA, 20 nt, Human
aagguacuguaugaucaaau

SEQ ID NO: 3790284 - RNA, 20 nt, Human
aagguagaaauaucugaaaa

SEQ ID NO: 3790285 - RNA, 14 nt, Human
aagguagacuuuua

SEQ ID NO: 3790286 - RNA, 22 nt, Human
aagguaguucaagaaaugaaga

SEQ ID NO: 3790287 - RNA, 12 nt, Human
aagguaguuuuu

SEQ ID NO: 3790288 - RNA, 15 nt, Human
aagguauaauaaaau

SEQ ID NO: 3790289 - RNA, 23 nt, Human
aagguauaucauucuaaagauag

SEQ ID NO: 3790290 - RNA, 22 nt, Human
aagguauaucuagguuuaugac

SEQ ID NO: 3790291 - RNA, 23 nt, Human
aagguauaucuagguuuaugaca

SEQ ID NO: 3790292 - RNA, 18 nt, Human
aagguauuaaauugaugu

SEQ ID NO: 3790293 - RNA, 22 nt, Human
aagguauuaaauugauguugcu

SEQ ID NO: 3790294 - RNA, 22 nt, Human
aagguauuauacaugugauaca

SEQ ID NO: 3790295 - RNA, 18 nt, Human
aagguauuccuuuugugu

SEQ ID NO: 3790296 - RNA, 19 nt, Human
aagguauuuaaaguauuuu

SEQ ID NO: 3790297 - RNA, 18 nt, Human
aagguauuuaauagguuu

SEQ ID NO: 3790298 - RNA, 14 nt, Human
aaggucaaauuuau

SEQ ID NO: 3790299 - RNA, 19 nt, Human
aaggucaccagcaccaaca

SEQ ID NO: 3790300 - RNA, 14 nt, Human
aaggucaccucacu

SEQ ID NO: 3790301 - RNA, 17 nt, Human
aaggucaccucacucag

SEQ ID NO: 3790302 - RNA, 19 nt, Human
aaggucaccucacucagca

SEQ ID NO: 3790303 - RNA, 14 nt, Human
aaggucacuguuuc

SEQ ID NO: 3790304 - RNA, 18 nt, Human
aaggucacuguuuccugg

SEQ ID NO: 3790305 - RNA, 13 nt, Human
aaggucaucaucg

SEQ ID NO: 3790306 - RNA, 18 nt, Human
aaggucauuuuuuuuaag

SEQ ID NO: 3790307 - RNA, 19 nt, Human
aaggucauuuuuuuuaaga

SEQ ID NO: 3790308 - RNA, 19 nt, Human
aagguccacaggucuagac

SEQ ID NO: 3790309 - RNA, 19 nt, Human
aagguccgguguucuaaga

SEQ ID NO: 3790310 - RNA, 21 nt, Human
aagguccgguguucuaagaug

SEQ ID NO: 3790311 - RNA, 22 nt, Human
aaggucggaggcuugggaccgc

SEQ ID NO: 3790312 - RNA, 18 nt, Human
aaggucguuuuuuucauu

SEQ ID NO: 3790313 - RNA, 19 nt, Human
aaggucuagguggaggugg

SEQ ID NO: 3790314 - RNA, 15 nt, Human
aaggucucauucuuc

SEQ ID NO: 3790315 - RNA, 17 nt, Human
aaggucuguuugcuguu

SEQ ID NO: 3790316 - RNA, 19 nt, Human
aaggucuguuuuguguacu

SEQ ID NO: 3790317 - RNA, 20 nt, Human
aaggucuguuuuguguacuu

SEQ ID NO: 3790318 - RNA, 19 nt, Human
aaggucuuugguucagcua

SEQ ID NO: 3790319 - RNA, 19 nt, Human
aaggugaaacauuuucucc

SEQ ID NO: 3790320 - RNA, 15 nt, Human
aaggugaaggaauau

SEQ ID NO: 3790321 - RNA, 17 nt, Human
aaggugagcauaaauca

SEQ ID NO: 3790322 - RNA, 18 nt, Human
aaggugaggccugucugu

SEQ ID NO: 3790323 - RNA, 21 nt, Human
aaggugaguuugagcugccuu

SEQ ID NO: 3790324 - RNA, 22 nt, Human
aaggugaguuugagcugccuuc

SEQ ID NO: 3790325 - RNA, 22 nt, Human
aaggugauaaaaucauaaguau

SEQ ID NO: 3790326 - RNA, 14 nt, Human
aaggugcaguuccc

SEQ ID NO: 3790327 - RNA, 23 nt, Human
aaggugcaguucccccaaccuca

SEQ ID NO: 3790328 - RNA, 12 nt, Human
aaggugcaucug

SEQ ID NO: 3790329 - RNA, 15 nt, Human
aaggugcuaaaucug

SEQ ID NO: 3790330 - RNA, 15 nt, Human
aaggugcuggaggug

SEQ ID NO: 3790331 - RNA, 20 nt, Human
aaggugcuggaggugggagc

SEQ ID NO: 3790332 - RNA, 20 nt, Human
aaggugcuguugucauugcu

SEQ ID NO: 3790333 - RNA, 22 nt, Human
aaggugcuguugucauugcuuu

SEQ ID NO: 3790334 - RNA, 23 nt, Human
aagguggaccuuuuaaaguguuu

SEQ ID NO: 3790335 - RNA, 14 nt, Human
aagguggauuuugu

SEQ ID NO: 3790336 - RNA, 17 nt, Human
aaggugggccuugcuac

SEQ ID NO: 3790337 - RNA, 22 nt, Human
aaggugggccuugcuaccucaa

SEQ ID NO: 3790338 - RNA, 20 nt, Human
aaggugggcugagcccuggc

SEQ ID NO: 3790339 - RNA, 22 nt, Human
aagguggggguuggcuggguac

SEQ ID NO: 3790340 - RNA, 16 nt, Human
aaggugguaugugugu

SEQ ID NO: 3790341 - RNA, 20 nt, Human
aagguggugggggugcagau

SEQ ID NO: 3790342 - RNA, 15 nt, Human
aaggugguguuucug

SEQ ID NO: 3790343 - RNA, 17 nt, Human
aagguguaacucuaauu

SEQ ID NO: 3790344 - RNA, 20 nt, Human
aagguguagccacaccagga

SEQ ID NO: 3790345 - RNA, 18 nt, Human
aagguguccuacagaaaa

SEQ ID NO: 3790346 - RNA, 15 nt, Human
aaggugucuuccucc

SEQ ID NO: 3790347 - RNA, 22 nt, Human
aagguguucauucacuugcauu

SEQ ID NO: 3790348 - RNA, 15 nt, Human
aagguuauaauuuuu

SEQ ID NO: 3790349 - RNA, 15 nt, Human
aagguuaucagugcu

SEQ ID NO: 3790350 - RNA, 23 nt, Human
aagaacugcauggaccuaacauu

SEQ ID NO: 3790351 - RNA, 13 nt, Human
aagaacuggaaac

SEQ ID NO: 3790352 - RNA, 19 nt, Human
aagaacugucauguaaaca

SEQ ID NO: 3790353 - RNA, 20 nt, Human
aagaacuguguuucaaguuc

SEQ ID NO: 3790354 - RNA, 19 nt, Human
aagaacuuccccauacaaa

SEQ ID NO: 3790355 - RNA, 14 nt, Human
aagaacuuguuuaa

SEQ ID NO: 3790356 - RNA, 18 nt, Human
aagaacuuguuuaauaaa

SEQ ID NO: 3790357 - RNA, 18 nt, Human
aagaacuuuuucuuuucc

SEQ ID NO: 3790358 - RNA, 19 nt, Human
aagaacuuuuucuuuuccc

SEQ ID NO: 3790359 - RNA, 13 nt, Human
aagaagaaaagag

SEQ ID NO: 3790360 - RNA, 14 nt, Human
aagaagaaaagaga

SEQ ID NO: 3790361 - RNA, 18 nt, Human
aagaagaaauaguucugu

SEQ ID NO: 3790362 - RNA, 19 nt, Human
aagaagacaaacuuugcau

SEQ ID NO: 3790363 - RNA, 17 nt, Human
aagaagacauggagacu

SEQ ID NO: 3790364 - RNA, 17 nt, Human
aagaagacauguuuuag

SEQ ID NO: 3790365 - RNA, 14 nt, Human
aagaagagaagcug

SEQ ID NO: 3790366 - RNA, 10 nt, Human
aagaagagac

SEQ ID NO: 3790367 - RNA, 14 nt, Human
aagaagagacagga

SEQ ID NO: 3790368 - RNA, 15 nt, Human
aagaagagcuaucag

SEQ ID NO: 3790369 - RNA, 22 nt, Human
aagaagaggagaaaaaaacuuc

SEQ ID NO: 3790370 - RNA, 14 nt, Human
aagaagauguuuaa

SEQ ID NO: 3790371 - RNA, 21 nt, Human
aagaagcaaccucaguaauuu

SEQ ID NO: 3790372 - RNA, 12 nt, Human
aagaagcaggcu

SEQ ID NO: 3790373 - RNA, 19 nt, Human
aagaagccacagaccuagg

SEQ ID NO: 3790374 - RNA, 14 nt, Human
aagaagcuguugua

SEQ ID NO: 3790375 - RNA, 22 nt, Human
aagaagcuucuaauaaauuaua

SEQ ID NO: 3790376 - RNA, 18 nt, Human
aagaaggaaagaugguua

SEQ ID NO: 3790377 - RNA, 19 nt, Human
aagaaggaaaugaauuucu

SEQ ID NO: 3790378 - RNA, 16 nt, Human
aagaaggaagacuuua

SEQ ID NO: 3790379 - RNA, 11 nt, Human
aagaaggaagu

SEQ ID NO: 3790380 - RNA, 14 nt, Human
aagaaggcaaaaau

SEQ ID NO: 3790381 - RNA, 16 nt, Human
aagaaggcaaaaaugu

SEQ ID NO: 3790382 - RNA, 15 nt, Human
aagaaggcaauauua

SEQ ID NO: 3790383 - RNA, 19 nt, Human
aagaaggcagcagguggca

SEQ ID NO: 3790384 - RNA, 17 nt, Human
aagaagggacugagaga

SEQ ID NO: 3790385 - RNA, 17 nt, Human
aagaagggagaagaaag

SEQ ID NO: 3790386 - RNA, 13 nt, Human
aagaagggaugga

SEQ ID NO: 3790387 - RNA, 22 nt, Human
aagaagggcuagaaccuggagg

SEQ ID NO: 3790388 - RNA, 21 nt, Human
aagaaggguccuucccucucc

SEQ ID NO: 3790389 - RNA, 18 nt, Human
aagaagguggaccuuuua

SEQ ID NO: 3790390 - RNA, 22 nt, Human
aagaagguggaccuuuuaaagu

SEQ ID NO: 3790391 - RNA, 18 nt, Human
aagaagguuuguguuuuu

SEQ ID NO: 3790392 - RNA, 22 nt, Human
aagaaguaaaagcaaaaaagaa

SEQ ID NO: 3790393 - RNA, 23 nt, Human
aagaagucuucucugccuguaag

SEQ ID NO: 3790394 - RNA, 16 nt, Human
aagaagugaaaaucua

SEQ ID NO: 3790395 - RNA, 18 nt, Human
aagaaguggggcagcagc

SEQ ID NO: 3790396 - RNA, 18 nt, Human
aagaaguguccgagaacu

SEQ ID NO: 3790397 - RNA, 14 nt, Human
aagaaguuuaagga

SEQ ID NO: 3790398 - RNA, 19 nt, Human
aagaaguuuauucucauuu

SEQ ID NO: 3790399 - RNA, 20 nt, Human
aagaauaaaauguugaaaag

SEQ ID NO: 3790400 - RNA, 14 nt, Human
aagaauaaacauuu

SEQ ID NO: 3790401 - RNA, 13 nt, Human
aagaauaauaaaa

SEQ ID NO: 3790402 - RNA, 22 nt, Human
aagaauaaucacgcuuuccuga

SEQ ID NO: 3790403 - RNA, 21 nt, Human
aagaauaauucaauuuuaaag

SEQ ID NO: 3790404 - RNA, 22 nt, Human
aagaauaauucaauuuuaaaga

SEQ ID NO: 3790405 - RNA, 13 nt, Human
aagaauaauuuau

SEQ ID NO: 3790406 - RNA, 16 nt, Human
aagaauacaaacauau

SEQ ID NO: 3790407 - RNA, 16 nt, Human
aagaauacuucucauu

SEQ ID NO: 3790408 - RNA, 15 nt, Human
aagaauacuugaacu

SEQ ID NO: 3790409 - RNA, 16 nt, Human
aagaauacuugaacuu

SEQ ID NO: 3790410 - RNA, 16 nt, Human
aagaauagcaucugua

SEQ ID NO: 3790411 - RNA, 17 nt, Human
aagaauagcauuguaaa

SEQ ID NO: 3790412 - RNA, 18 nt, Human
aagaauagcauuguaaaa

SEQ ID NO: 3790413 - RNA, 22 nt, Human
aagaauaggacuuguuuuuguu

SEQ ID NO: 3790414 - RNA, 12 nt, Human
aagaauauauau

SEQ ID NO: 3790415 - RNA, 19 nt, Human
aagaauauccuuuaaaauu

SEQ ID NO: 3790416 - RNA, 18 nt, Human
aagaauauguuuccuugu

SEQ ID NO: 3790417 - RNA, 16 nt, Human
aagaauauucagagaa

SEQ ID NO: 3790418 - RNA, 20 nt, Human
aagauggaauuuaucaaacc

SEQ ID NO: 3790419 - RNA, 16 nt, Human
aagauggaguuucuaa

SEQ ID NO: 3790420 - RNA, 17 nt, Human
aagauggaguuucuaag

SEQ ID NO: 3790421 - RNA, 16 nt, Human
aagauggauucucaga

SEQ ID NO: 3790422 - RNA, 21 nt, Human
aagauggcccagcuccccaag

SEQ ID NO: 3790423 - RNA, 22 nt, Human
aagauggcccagcuccccaaga

SEQ ID NO: 3790424 - RNA, 15 nt, Human
aagauggcccauccu

SEQ ID NO: 3790425 - RNA, 17 nt, Human
aagauggcugacuuugc

SEQ ID NO: 3790426 - RNA, 16 nt, Human
aagauggcugugccuc

SEQ ID NO: 3790427 - RNA, 18 nt, Human
aagauggcugugccucug

SEQ ID NO: 3790428 - RNA, 18 nt, Human
aagaugggggcagggcug

SEQ ID NO: 3790429 - RNA, 15 nt, Human
aagauggggucugua

SEQ ID NO: 3790430 - RNA, 21 nt, Human
aagauggggucuguaaaaucu

SEQ ID NO: 3790431 - RNA, 22 nt, Human
aagauggguccaggauuccucu

SEQ ID NO: 3790432 - RNA, 14 nt, Human
aagaugggugggga

SEQ ID NO: 3790433 - RNA, 22 nt, Human
aagauguagaggagaaacugga

SEQ ID NO: 3790434 - RNA, 20 nt, Human
aagauguccuccuuguucua

SEQ ID NO: 3790435 - RNA, 18 nt, Human
aagaugucuguuugcuga

SEQ ID NO: 3790436 - RNA, 13 nt, Human
aagaugugaauua

SEQ ID NO: 3790437 - RNA, 16 nt, Human
aagaugugaauuauug

SEQ ID NO: 3790438 - RNA, 18 nt, Human
aagaugugacauguuuua

SEQ ID NO: 3790439 - RNA, 14 nt, Human
aagaugugauauuc

SEQ ID NO: 3790440 - RNA, 19 nt, Human
aagaugugauauucuaaga

SEQ ID NO: 3790441 - RNA, 20 nt, Human
aagaugugcagcauuucacu

SEQ ID NO: 3790442 - RNA, 19 nt, Human
aagaugugucuucaauuug

SEQ ID NO: 3790443 - RNA, 15 nt, Human
aagauguguucuuau

SEQ ID NO: 3790444 - RNA, 16 nt, Human
aagauguguucuuauu

SEQ ID NO: 3790445 - RNA, 15 nt, Human
aagauguuauacaac

SEQ ID NO: 3790446 - RNA, 22 nt, Human
aagauguuauauuuuucuuaaa

SEQ ID NO: 3790447 - RNA, 20 nt, Human
aagauguuaugguguuuaga

SEQ ID NO: 3790448 - RNA, 21 nt, Human
aagauguugaagaauacaguu

SEQ ID NO: 3790449 - RNA, 16 nt, Human
aagauguugauuuuua

SEQ ID NO: 3790450 - RNA, 22 nt, Human
aagauguugauuuuuacugugu

SEQ ID NO: 3790451 - RNA, 15 nt, Human
aagauguugugucuu

SEQ ID NO: 3790452 - RNA, 18 nt, Human
aagauguugugucuugug

SEQ ID NO: 3790453 - RNA, 14 nt, Human
aagauguuuaacuu

SEQ ID NO: 3790454 - RNA, 17 nt, Human
aagauuaaacagaugau

SEQ ID NO: 3790455 - RNA, 19 nt, Human
aagauuaauagcauucgaa

SEQ ID NO: 3790456 - RNA, 21 nt, Human
aagauuacaaaucagaaguca

SEQ ID NO: 3790457 - RNA, 14 nt, Human
aagauuauaauugu

SEQ ID NO: 3790458 - RNA, 20 nt, Human
aagauuauagauucuaaaga

SEQ ID NO: 3790459 - RNA, 21 nt, Human
aagauuauagauucuaaagau

SEQ ID NO: 3790460 - RNA, 18 nt, Human
aagauuauuuuuuaugag

SEQ ID NO: 3790461 - RNA, 21 nt, Human
aagauucaaugccccugaauu

SEQ ID NO: 3790462 - RNA, 19 nt, Human
aagauucacaccugacucu

SEQ ID NO: 3790463 - RNA, 13 nt, Human
aagauucagcuag

SEQ ID NO: 3790464 - RNA, 20 nt, Human
aagauucauuuuuaaucaug

SEQ ID NO: 3790465 - RNA, 18 nt, Human
aagauucccagagacagg

SEQ ID NO: 3790466 - RNA, 12 nt, Human
aagauucuagau

SEQ ID NO: 3790467 - RNA, 13 nt, Human
aagauucuagaug

SEQ ID NO: 3790468 - RNA, 15 nt, Human
aagauucuagaugau

SEQ ID NO: 3790469 - RNA, 20 nt, Human
aagauucuauaguucuagac

SEQ ID NO: 3790470 - RNA, 19 nt, Human
aagauucuauguuaauauu

SEQ ID NO: 3790471 - RNA, 19 nt, Human
aagauucucuauguaucaa

SEQ ID NO: 3790472 - RNA, 19 nt, Human
aagauucuucccauucucc

SEQ ID NO: 3790473 - RNA, 21 nt, Human
aagauucuucccauucuccau

SEQ ID NO: 3790474 - RNA, 23 nt, Human
aagauucuucccauucuccauuu

SEQ ID NO: 3790475 - RNA, 16 nt, Human
aagauucuuuuaaauu

SEQ ID NO: 3790476 - RNA, 17 nt, Human
aagauucuuuuaaauua

SEQ ID NO: 3790477 - RNA, 20 nt, Human
aagauucuuuuaaauuagaa

SEQ ID NO: 3790478 - RNA, 16 nt, Human
aagauucuuuuucuga

SEQ ID NO: 3790479 - RNA, 21 nt, Human
aagauugaaaaggaagaucag

SEQ ID NO: 3790480 - RNA, 22 nt, Human
aagauugagaaguuacuuucca

SEQ ID NO: 3790481 - RNA, 16 nt, Human
aagauugauaucuaua

SEQ ID NO: 3790482 - RNA, 16 nt, Human
aagauugcugaaauuu

SEQ ID NO: 3790483 - RNA, 19 nt, Human
aagauugcuuaauaaauug

SEQ ID NO: 3790484 - RNA, 21 nt, Human
aagauugguguuuuuuucuau

SEQ ID NO: 3790485 - RNA, 21 nt, Human
aagauuguaauuaaaaugaua

SEQ ID NO: 3790486 - RNA, 14 nt, Human
aagauuguauugcu

SEQ ID NO: 3790487 - RNA, 17 nt, Human
aagauugucauuaguga

SEQ ID NO: 3790488 - RNA, 20 nt, Human
aagauugugggggaaaaaua

SEQ ID NO: 3790489 - RNA, 20 nt, Human
aagauuguuauuaaauguag

SEQ ID NO: 3790490 - RNA, 15 nt, Human
aagauuguuccugcu

SEQ ID NO: 3790491 - RNA, 13 nt, Human
aagauuguuuauc

SEQ ID NO: 3790492 - RNA, 15 nt, Human
aagauuguuuaucua

SEQ ID NO: 3790493 - RNA, 20 nt, Human
aagauuguuuaucuagaugu

SEQ ID NO: 3790494 - RNA, 12 nt, Human
aagauuuaagca

SEQ ID NO: 3790495 - RNA, 13 nt, Human
aagauuuaauauu

SEQ ID NO: 3790496 - RNA, 18 nt, Human
aagauuuaauuugccaaa

SEQ ID NO: 3790497 - RNA, 21 nt, Human
aagauuuagaaaaaaguuuac

SEQ ID NO: 3790498 - RNA, 18 nt, Human
aagauuuaucaaaucagu

SEQ ID NO: 3790499 - RNA, 12 nt, Human
aagauuuauguu

SEQ ID NO: 3790500 - RNA, 14 nt, Human
aagauuuauuuugu

SEQ ID NO: 3790501 - RNA, 23 nt, Human
aagauuuauuuuguuaaaaucuc

SEQ ID NO: 3790502 - RNA, 16 nt, Human
aagauuuccauauaaa

SEQ ID NO: 3790503 - RNA, 16 nt, Human
aagauuuccuugugca

SEQ ID NO: 3790504 - RNA, 17 nt, Human
aagauuucuaaauaaaa

SEQ ID NO: 3790505 - RNA, 18 nt, Human
aagauuucuaaauaaaag

SEQ ID NO: 3790506 - RNA, 17 nt, Human
aagauuuggaagcucuu

SEQ ID NO: 3790507 - RNA, 17 nt, Human
aagauuuguuuuuaaac

SEQ ID NO: 3790508 - RNA, 23 nt, Human
aagauuuguuuuuaaacuguaca

SEQ ID NO: 3790509 - RNA, 17 nt, Human
aagauuuuaaucaaguu

SEQ ID NO: 3790510 - RNA, 13 nt, Human
aagauuuucagaa

SEQ ID NO: 3790511 - RNA, 16 nt, Human
aagauuuuccucuugu

SEQ ID NO: 3790512 - RNA, 21 nt, Human
aagauuuuccuuuuuuauaca

SEQ ID NO: 3790513 - RNA, 23 nt, Human
aagauuuugaaaacuacauuuua

SEQ ID NO: 3790514 - RNA, 14 nt, Human
aagauuuuuuaaua

SEQ ID NO: 3790515 - RNA, 17 nt, Human
aagauuuuuuaauaauu

SEQ ID NO: 3790516 - RNA, 20 nt, Human
aagauuuuuuaauuguuuaa

SEQ ID NO: 3790517 - RNA, 14 nt, Human
aagauuuuuucauu

SEQ ID NO: 3790518 - RNA, 23 nt, Human
aagauuuuuuuuuuuucucucaa

SEQ ID NO: 3790519 - RNA, 15 nt, Human
aagcaaaaaagaaaa

SEQ ID NO: 3790520 - RNA, 20 nt, Human
aagcaaaaacgaaagcuggg

SEQ ID NO: 3790521 - RNA, 12 nt, Human
aagcaaaaaugc

SEQ ID NO: 3790522 - RNA, 17 nt, Human
aagcaaaaaugcuaaua

SEQ ID NO: 3790523 - RNA, 11 nt, Human
aagcaaaagaa

SEQ ID NO: 3790524 - RNA, 13 nt, Human
aagcaaaagaaaa

SEQ ID NO: 3790525 - RNA, 14 nt, Human
aagcaaaagaaaaa

SEQ ID NO: 3790526 - RNA, 15 nt, Human
aagcaaaagaaaaag

SEQ ID NO: 3790527 - RNA, 12 nt, Human
aagcaaaaggca

SEQ ID NO: 3790528 - RNA, 17 nt, Human
aagcaaaaucauggaau

SEQ ID NO: 3790529 - RNA, 13 nt, Human
aagcaaaauccug

SEQ ID NO: 3790530 - RNA, 22 nt, Human
aagcaaaauuauagaaguuuag

SEQ ID NO: 3790531 - RNA, 12 nt, Human
aagcaaacacau

SEQ ID NO: 3790532 - RNA, 13 nt, Human
aagcaaacacauu

SEQ ID NO: 3790533 - RNA, 13 nt, Human
aagcaaacccaga

SEQ ID NO: 3790534 - RNA, 22 nt, Human
aagcaaacugguuauuuaaaau

SEQ ID NO: 3790535 - RNA, 22 nt, Human
aagcaaagacuuuccucuuagu

SEQ ID NO: 3790536 - RNA, 17 nt, Human
aagcaaagcacagagag

SEQ ID NO: 3790537 - RNA, 14 nt, Human
aagcaaauaaauau

SEQ ID NO: 3790538 - RNA, 23 nt, Human
aagcaaauacuuagcaaaaagug

SEQ ID NO: 3790539 - RNA, 17 nt, Human
aagcaaaucgaaugaaa

SEQ ID NO: 3790540 - RNA, 18 nt, Human
aagcaaaucgaaugaaau

SEQ ID NO: 3790541 - RNA, 17 nt, Human
aagcaacaauuuucaga

SEQ ID NO: 3790542 - RNA, 22 nt, Human
aagcaaccucaguaauuuagaa

SEQ ID NO: 3790543 - RNA, 16 nt, Human
aagcaacugucuauuu

SEQ ID NO: 3790544 - RNA, 15 nt, Human
aagcaagagagaugu

SEQ ID NO: 3790545 - RNA, 18 nt, Human
aagcaagagagauguuuu

SEQ ID NO: 3790546 - RNA, 15 nt, Human
aagcaagauuucaga

SEQ ID NO: 3790547 - RNA, 16 nt, Human
aagcaagauuucagau

SEQ ID NO: 3790548 - RNA, 16 nt, Human
aagcaagcaacacaga

SEQ ID NO: 3790549 - RNA, 14 nt, Human
aagcaaggcggugg

SEQ ID NO: 3790550 - RNA, 19 nt, Human
aagcaaguaaaaaggcuaa

SEQ ID NO: 3790551 - RNA, 20 nt, Human
aagcaaguaaaaaggcuaaa

SEQ ID NO: 3790552 - RNA, 19 nt, Human
aagcaaguucgucuguugu

SEQ ID NO: 3790553 - RNA, 19 nt, Human
aagcaauaaaauuuuuuug

SEQ ID NO: 3790554 - RNA, 21 nt, Human
aagcaauaauggucccaucca

SEQ ID NO: 3790555 - RNA, 13 nt, Human
aagcaauagaaac

SEQ ID NO: 3790556 - RNA, 22 nt, Human
aauaucaguuacucagcccugg

SEQ ID NO: 3790557 - RNA, 13 nt, Human
aauaucauucagc

SEQ ID NO: 3790558 - RNA, 20 nt, Human
aauauccaauugcugcuugu

SEQ ID NO: 3790559 - RNA, 14 nt, Human
aauauccauauuaa

SEQ ID NO: 3790560 - RNA, 17 nt, Human
aauaucccggggguggg

SEQ ID NO: 3790561 - RNA, 16 nt, Human
aauaucccuacaugua

SEQ ID NO: 3790562 - RNA, 15 nt, Human
aauaaaaaauuauga

SEQ ID NO: 3790563 - RNA, 18 nt, Human
aauaaaaacccacaaaaa

SEQ ID NO: 3790564 - RNA, 19 nt, Human
aauaaaaacugacuccuua

SEQ ID NO: 3790565 - RNA, 15 nt, Human
aauaaaaagaaaggc

SEQ ID NO: 3790566 - RNA, 15 nt, Human
aauauuuauugcuuu

SEQ ID NO: 3790567 - RNA, 21 nt, Human
aauauuuauugcuuuauaaau

SEQ ID NO: 3790568 - RNA, 11 nt, Human
aauauuuauuu

SEQ ID NO: 3790569 - RNA, 15 nt, Human
aauauuuauuuuaau

SEQ ID NO: 3790570 - RNA, 18 nt, Human
aauauuuauuuuaauaau

SEQ ID NO: 3790571 - RNA, 14 nt, Human
aauauuucaagaca

SEQ ID NO: 3790572 - RNA, 16 nt, Human
aauauuucaagacauu

SEQ ID NO: 3790573 - RNA, 15 nt, Human
aauauuucagauaau

SEQ ID NO: 3790574 - RNA, 16 nt, Human
aauauuuccauaugga

SEQ ID NO: 3790575 - RNA, 19 nt, Human
aauauuuccuuaaacugug

SEQ ID NO: 3790576 - RNA, 13 nt, Human
aauauuucuauug

SEQ ID NO: 3790577 - RNA, 11 nt, Human
aauauuugaau

SEQ ID NO: 3790578 - RNA, 13 nt, Human
aauauuugaaucu

SEQ ID NO: 3790579 - RNA, 18 nt, Human
aauauuugguuuuccugu

SEQ ID NO: 3790580 - RNA, 11 nt, Human
aauauuuuaaa

SEQ ID NO: 3790581 - RNA, 16 nt, Human
aauauuuuaaagaauu

SEQ ID NO: 3790582 - RNA, 14 nt, Human
aauauuuuaagcau

SEQ ID NO: 3790583 - RNA, 21 nt, Human
aauauuuuaauuuuuaaaugc

SEQ ID NO: 3790584 - RNA, 21 nt, Human
aauauuuuagguguaaaauaa

SEQ ID NO: 3790585 - RNA, 18 nt, Human
aauauuuuaugauccagc

SEQ ID NO: 3790586 - RNA, 12 nt, Human
aauauuuuaugg

SEQ ID NO: 3790587 - RNA, 14 nt, Human
aauauuuuauucaa

SEQ ID NO: 3790588 - RNA, 13 nt, Human
aauauuuucagua

SEQ ID NO: 3790589 - RNA, 17 nt, Human
aauauuuucauuauaca

SEQ ID NO: 3790590 - RNA, 13 nt, Human
aauauuuucugug

SEQ ID NO: 3790591 - RNA, 15 nt, Human
aauauuuucugugug

SEQ ID NO: 3790592 - RNA, 16 nt, Human
aauauuuucugugugu

SEQ ID NO: 3790593 - RNA, 22 nt, Human
aauauuuucuguguguuccugg

SEQ ID NO: 3790594 - RNA, 23 nt, Human
aauauuuucuguguguuccuggc

SEQ ID NO: 3790595 - RNA, 13 nt, Human
aauauuuugaauc

SEQ ID NO: 3790596 - RNA, 16 nt, Human
aauauuuugauaauaa

SEQ ID NO: 3790597 - RNA, 21 nt, Human
aauauuuuguauuauugcugu

SEQ ID NO: 3790598 - RNA, 13 nt, Human
aauauuuugucua

SEQ ID NO: 3790599 - RNA, 15 nt, Human
aauauuuugucuaaa

SEQ ID NO: 3790600 - RNA, 16 nt, Human
aauauuuugucuaaaa

SEQ ID NO: 3790601 - RNA, 16 nt, Human
aauauuuuuauauaca

SEQ ID NO: 3790602 - RNA, 18 nt, Human
aauauuuuuauauacaga

SEQ ID NO: 3790603 - RNA, 19 nt, Human
aauauuuuuauauuuccuu

SEQ ID NO: 3790604 - RNA, 19 nt, Human
aauauuuuuuauauauaca

SEQ ID NO: 3790605 - RNA, 21 nt, Human
aauauuuuuuauauauacagu

SEQ ID NO: 3790606 - RNA, 17 nt, Human
aauauuuuuuuguagau

SEQ ID NO: 3790607 - RNA, 14 nt, Human
aaucaaaaauugaa

SEQ ID NO: 3790608 - RNA, 20 nt, Human
aaucaaaauaacgccccaga

SEQ ID NO: 3790609 - RNA, 16 nt, Human
aaucaaaaucucucca

SEQ ID NO: 3790610 - RNA, 19 nt, Human
aaucaaaaucucuccacuu

SEQ ID NO: 3790611 - RNA, 13 nt, Human
aaucaaacauuuu

SEQ ID NO: 3790612 - RNA, 22 nt, Human
aaucaaagcaaugcauuuugga

SEQ ID NO: 3790613 - RNA, 16 nt, Human
aaucaaauaaguauuu

SEQ ID NO: 3790614 - RNA, 18 nt, Human
aaucaaauaaguauuuau

SEQ ID NO: 3790615 - RNA, 16 nt, Human
aaucaaauaauaccuu

SEQ ID NO: 3790616 - RNA, 15 nt, Human
aaucaaauaugcaaa

SEQ ID NO: 3790617 - RNA, 22 nt, Human
aaucaaauaugcaaagcacuga

SEQ ID NO: 3790618 - RNA, 17 nt, Human
aaucaacaccuuaauau

SEQ ID NO: 3790619 - RNA, 13 nt, Human
aaucaacagaagc

SEQ ID NO: 3790620 - RNA, 20 nt, Human
aaucaaccaccuauuuuuga

SEQ ID NO: 3790621 - RNA, 16 nt, Human
aaucaacugaaagugu

SEQ ID NO: 3790622 - RNA, 13 nt, Human
aaucaacuuuuua

SEQ ID NO: 3790623 - RNA, 22 nt, Human
aaucaagagccuuaaaacauca

SEQ ID NO: 3790624 - RNA, 13 nt, Human
aaucaagagcugc

SEQ ID NO: 3790625 - RNA, 14 nt, Human
aaucaagagcugcc

SEQ ID NO: 3790626 - RNA, 12 nt, Human
aaucaagauaaa

SEQ ID NO: 3790627 - RNA, 15 nt, Human
aaucaagauaaagga

SEQ ID NO: 3790628 - RNA, 16 nt, Human
aaucaagcaagccucu

SEQ ID NO: 3790629 - RNA, 16 nt, Human
aaucaagcagguuaga

SEQ ID NO: 3790630 - RNA, 15 nt, Human
aaucaagcuucaguu

SEQ ID NO: 3790631 - RNA, 18 nt, Human
aaucaagggucaggccuu

SEQ ID NO: 3790632 - RNA, 17 nt, Human
aaucaagucuguuuacu

SEQ ID NO: 3790633 - RNA, 19 nt, Human
aaucaaguuuccaagcaaa

SEQ ID NO: 3790634 - RNA, 13 nt, Human
aaucaauaaacga

SEQ ID NO: 3790635 - RNA, 15 nt, Human
aaucaauaaagaaaa

SEQ ID NO: 3790636 - RNA, 14 nt, Human
aaucaauacacuag

SEQ ID NO: 3790637 - RNA, 12 nt, Human
aaucaauaguug

SEQ ID NO: 3790638 - RNA, 13 nt, Human
aaucaaugaauau

SEQ ID NO: 3790639 - RNA, 14 nt, Human
aaucaaugaauauu

SEQ ID NO: 3790640 - RNA, 22 nt, Human
aaucaaugcaagagugauugca

SEQ ID NO: 3790641 - RNA, 22 nt, Human
aaucaauuaauuuuuuuauugu

SEQ ID NO: 3790642 - RNA, 15 nt, Human
aaucaauucuaguca

SEQ ID NO: 3790643 - RNA, 20 nt, Human
aaucaauuuaaacccauuuu

SEQ ID NO: 3790644 - RNA, 12 nt, Human
aaucaauuuaag

SEQ ID NO: 3790645 - RNA, 13 nt, Human
aaucacauccugg

SEQ ID NO: 3790646 - RNA, 15 nt, Human
aaucaccaaaggcuc

SEQ ID NO: 3790647 - RNA, 13 nt, Human
aaucaccauguaa

SEQ ID NO: 3790648 - RNA, 15 nt, Human
aaucaccgaaaacgu

SEQ ID NO: 3790649 - RNA, 21 nt, Human
aaucaccgaaaacguggcugc

SEQ ID NO: 3790650 - RNA, 19 nt, Human
aaucaccgaugcaaacauu

SEQ ID NO: 3790651 - RNA, 16 nt, Human
aaucacgcuuuuugaa

SEQ ID NO: 3790652 - RNA, 16 nt, Human
aaucacuaacauuaua

SEQ ID NO: 3790653 - RNA, 22 nt, Human
aaucacuaacauuauauugcaa

SEQ ID NO: 3790654 - RNA, 22 nt, Human
aaucacucuuguggauguuuua

SEQ ID NO: 3790655 - RNA, 13 nt, Human
aaucacuguguau

SEQ ID NO: 3790656 - RNA, 16 nt, Human
aaucacuguguauauu

SEQ ID NO: 3790657 - RNA, 19 nt, Human
aaucacuguguauauuuga

SEQ ID NO: 3790658 - RNA, 14 nt, Human
aaucacuguuuuua

SEQ ID NO: 3790659 - RNA, 19 nt, Human
aaucacuuaacauuccuaa

SEQ ID NO: 3790660 - RNA, 14 nt, Human
aaucacuuccauag

SEQ ID NO: 3790661 - RNA, 16 nt, Human
aaucacuugauucaua

SEQ ID NO: 3790662 - RNA, 21 nt, Human
aaucacuugauucauaaagau

SEQ ID NO: 3790663 - RNA, 13 nt, Human
aaucacuuugucu

SEQ ID NO: 3790664 - RNA, 16 nt, Human
aaucacuuugucuaac

SEQ ID NO: 3790665 - RNA, 14 nt, Human
aaucagaaauuuuu

SEQ ID NO: 3790666 - RNA, 13 nt, Human
aaucagaauuaga

SEQ ID NO: 3790667 - RNA, 13 nt, Human
aaucagacaaagu

SEQ ID NO: 3790668 - RNA, 17 nt, Human
aaucagacuaugaaguu

SEQ ID NO: 3790669 - RNA, 16 nt, Human
aaucagagaaggaaca

SEQ ID NO: 3790670 - RNA, 18 nt, Human
aaucagagaccaggcccu

SEQ ID NO: 3790671 - RNA, 15 nt, Human
aaucagaguagaaau

SEQ ID NO: 3790672 - RNA, 17 nt, Human
aaucagaguagaaauaa

SEQ ID NO: 3790673 - RNA, 14 nt, Human
aaucagauuuuccu

SEQ ID NO: 3790674 - RNA, 12 nt, Human
aaucagcacuga

SEQ ID NO: 3790675 - RNA, 18 nt, Human
aaucagcauucucacucc

SEQ ID NO: 3790676 - RNA, 14 nt, Human
aaucagcauuuagu

SEQ ID NO: 3790677 - RNA, 18 nt, Human
aaucagccaaguuuuaua

SEQ ID NO: 3790678 - RNA, 19 nt, Human
aaucagccaauuauguuaa

SEQ ID NO: 3790679 - RNA, 21 nt, Human
aaucagccaauuauguuaaac

SEQ ID NO: 3790680 - RNA, 17 nt, Human
aaucagccuacaggccu

SEQ ID NO: 3790681 - RNA, 16 nt, Human
aaucagccucuuaaag

SEQ ID NO: 3790682 - RNA, 16 nt, Human
aaucagcuauuuugug

SEQ ID NO: 3790683 - RNA, 12 nt, Human
aaucagcugcuu

SEQ ID NO: 3790684 - RNA, 17 nt, Human
aaucagcugcuuuguua

SEQ ID NO: 3790685 - RNA, 18 nt, Human
aaucaggaauauuuucca

SEQ ID NO: 3790686 - RNA, 21 nt, Human
aaucaggguuaguauugucca

SEQ ID NO: 3790687 - RNA, 16 nt, Human
aaucagguggcuuuug

SEQ ID NO: 3790688 - RNA, 21 nt, Human
aaucagguuuucuuuuaagaa

SEQ ID NO: 3790689 - RNA, 14 nt, Human
aaucaguaagaggu

SEQ ID NO: 3790690 - RNA, 11 nt, Human
aaucaguauau

SEQ ID NO: 3790691 - RNA, 19 nt, Human
aaucagucagugcaaaugu

SEQ ID NO: 3790692 - RNA, 21 nt, Human
aaucagucagugcaaauguca

SEQ ID NO: 3790693 - RNA, 22 nt, Human
aaucagucauguguaauaugca

SEQ ID NO: 3790694 - RNA, 18 nt, Human
aaucagugggcaggauaa

SEQ ID NO: 3790695 - RNA, 24 nt, Human
aaucagugggcaggauaaacugaa

SEQ ID NO: 3790696 - RNA, 17 nt, Human
aaucaguguagccccaa

SEQ ID NO: 3790697 - RNA, 14 nt, Human
aaucagugugucua

SEQ ID NO: 3790698 - RNA, 15 nt, Human
aaucaguuaguuuuu

SEQ ID NO: 3790699 - RNA, 22 nt, Human
aaucaguuauacaguuauaaaa

SEQ ID NO: 3790700 - RNA, 18 nt, Human
aaucauaaacugugugca

SEQ ID NO: 3790701 - RNA, 16 nt, Human
aaucauaaguauuugg

SEQ ID NO: 3790702 - RNA, 23 nt, Human
aaucauaggcaccuuuuacugug

SEQ ID NO: 3790703 - RNA, 15 nt, Human
aaucauaguuacugu

SEQ ID NO: 3790704 - RNA, 19 nt, Human
aaucauaguuacuguguaa

SEQ ID NO: 3790705 - RNA, 18 nt, Human
aaucauauaaauagaaug

SEQ ID NO: 3790706 - RNA, 19 nt, Human
aaucauauugaugaaaaga

SEQ ID NO: 3790707 - RNA, 18 nt, Human
aaucaucaagaagggcug

SEQ ID NO: 3790708 - RNA, 22 nt, Human
aaucaucagaaaggaaaaacaa

SEQ ID NO: 3790709 - RNA, 18 nt, Human
aauaacccauaauugaag

SEQ ID NO: 3790710 - RNA, 16 nt, Human
aauaaccccaaaauga

SEQ ID NO: 3790711 - RNA, 17 nt, Human
aauaaccccaaaaugaa

SEQ ID NO: 3790712 - RNA, 18 nt, Human
aauaacccuuugguuuuu

SEQ ID NO: 3790713 - RNA, 19 nt, Human
aauaaccuuccauacauuu

SEQ ID NO: 3790714 - RNA, 15 nt, Human
aauaacgauaaaaga

SEQ ID NO: 3790715 - RNA, 22 nt, Human
aauaacguuuaagccaaaacaa

SEQ ID NO: 3790716 - RNA, 15 nt, Human
aauaacuaaaaggua

SEQ ID NO: 3790717 - RNA, 13 nt, Human
aauaacuaaaaug

SEQ ID NO: 3790718 - RNA, 19 nt, Human
aauaacuacuguguuccug

SEQ ID NO: 3790719 - RNA, 14 nt, Human
aauaacuccuucuu

SEQ ID NO: 3790720 - RNA, 19 nt, Human
aauaacucuguggcauuau

SEQ ID NO: 3790721 - RNA, 15 nt, Human
aauaacugaauuugg

SEQ ID NO: 3790722 - RNA, 21 nt, Human
aauaacuggaaaacagaacac

SEQ ID NO: 3790723 - RNA, 21 nt, Human
aauaacuggaacaaauuauuu

SEQ ID NO: 3790724 - RNA, 16 nt, Human
aauaacuguguacugu

SEQ ID NO: 3790725 - RNA, 15 nt, Human
aauaacuucaguccu

SEQ ID NO: 3790726 - RNA, 15 nt, Human
aauaacuucugaccu

SEQ ID NO: 3790727 - RNA, 13 nt, Human
aauaagaaacuuu

SEQ ID NO: 3790728 - RNA, 15 nt, Human
aauaagaaaguuuca

SEQ ID NO: 3790729 - RNA, 21 nt, Human
aaucauggaaugguuauaaaa

SEQ ID NO: 3790730 - RNA, 21 nt, Human
aaucauggcuaagcuuaaaaa

SEQ ID NO: 3790731 - RNA, 17 nt, Human
aaucauggugcucagag

SEQ ID NO: 3790732 - RNA, 15 nt, Human
aaucaugguuuuucu

SEQ ID NO: 3790733 - RNA, 14 nt, Human
aaucauguacauuu

SEQ ID NO: 3790734 - RNA, 19 nt, Human
aaucauguacauuucugaa

SEQ ID NO: 3790735 - RNA, 23 nt, Human
aaucaugucagucugcuuagaaa

SEQ ID NO: 3790736 - RNA, 22 nt, Human
aaucauguccauacacuuuguu

SEQ ID NO: 3790737 - RNA, 15 nt, Human
aaucauguguguuaa

SEQ ID NO: 3790738 - RNA, 16 nt, Human
aaucauguuucuuuga

SEQ ID NO: 3790739 - RNA, 16 nt, Human
aaucauucagaaaugu

SEQ ID NO: 3790740 - RNA, 20 nt, Human
aaucauuguaaacauuaguu

SEQ ID NO: 3790741 - RNA, 16 nt, Human
aaucauuguacaguuu

SEQ ID NO: 3790742 - RNA, 18 nt, Human
aaucauuguacaguuugu

SEQ ID NO: 3790743 - RNA, 14 nt, Human
aaucauuguuuuga

SEQ ID NO: 3790744 - RNA, 16 nt, Human
aaucauuguuuugaau

SEQ ID NO: 3790745 - RNA, 19 nt, Human
aaucauuguuuugaauauu

SEQ ID NO: 3790746 - RNA, 20 nt, Human
aaucauuuccccauaacuca

SEQ ID NO: 3790747 - RNA, 13 nt, Human
aaucauuucucac

SEQ ID NO: 3790748 - RNA, 22 nt, Human
aaucauuucugcaucagcugcu

SEQ ID NO: 3790749 - RNA, 11 nt, Human
aaucauuuguu

SEQ ID NO: 3790750 - RNA, 14 nt, Human
aaucauuuguuuac

SEQ ID NO: 3790751 - RNA, 17 nt, Human
aaucauuuuaauuauua

SEQ ID NO: 3790752 - RNA, 20 nt, Human
aaucauuuuacccuuggcuc

SEQ ID NO: 3790753 - RNA, 17 nt, Human
aaucauuuuaggaaagg

SEQ ID NO: 3790754 - RNA, 23 nt, Human
aaucauuuuauaugucaaagcag

SEQ ID NO: 3790755 - RNA, 18 nt, Human
aaucauuuucauuccuaa

SEQ ID NO: 3790756 - RNA, 16 nt, Human
aaucauuuuccuuuuu

SEQ ID NO: 3790757 - RNA, 13 nt, Human
aaucauuuugcaa

SEQ ID NO: 3790758 - RNA, 19 nt, Human
aaucauuuuuuauauauau

SEQ ID NO: 3790759 - RNA, 21 nt, Human
aaucauuuuuuauauauaugc

SEQ ID NO: 3790760 - RNA, 23 nt, Human
aaucauuuuuuauauauaugcau

SEQ ID NO: 3790761 - RNA, 16 nt, Human
aauccaaaagaaaaac

SEQ ID NO: 3790762 - RNA, 21 nt, Human
aauccaaacuuggauuuuuga

SEQ ID NO: 3790763 - RNA, 14 nt, Human
aauccaaauauugu

SEQ ID NO: 3790764 - RNA, 23 nt, Human
aauccaagcgaggucaacagaga

SEQ ID NO: 3790765 - RNA, 13 nt, Human
aauccacacauca

SEQ ID NO: 3790766 - RNA, 17 nt, Human
aauccacucccaggcag

SEQ ID NO: 3790767 - RNA, 18 nt, Human
aauccacucccaggcagc

SEQ ID NO: 3790768 - RNA, 20 nt, Human
aauccagaaacuuguucuuc

SEQ ID NO: 3790769 - RNA, 19 nt, Human
aauccaggacccugccagg

SEQ ID NO: 3790770 - RNA, 17 nt, Human
aauccaggcagauccag

SEQ ID NO: 3790771 - RNA, 22 nt, Human
aauccaggcagauccaggacua

SEQ ID NO: 3790772 - RNA, 13 nt, Human
aauccauacauuu

SEQ ID NO: 3790773 - RNA, 14 nt, Human
aauccauacauuug

SEQ ID NO: 3790774 - RNA, 17 nt, Human
aauccauacauuugugu

SEQ ID NO: 3790775 - RNA, 19 nt, Human
aauccaucagugccaaacu

SEQ ID NO: 3790776 - RNA, 21 nt, Human
aauccaucuaaauaccugccc

SEQ ID NO: 3790777 - RNA, 15 nt, Human
aauccaugcuugggu

SEQ ID NO: 3790778 - RNA, 22 nt, Human
aauccauguuaguuuuuacuuu

SEQ ID NO: 3790779 - RNA, 22 nt, Human
aauccauuuggaaaucuuuaaa

SEQ ID NO: 3790780 - RNA, 14 nt, Human
aaucccaaaaguca

SEQ ID NO: 3790781 - RNA, 16 nt, Human
aaucccaaauuugauu

SEQ ID NO: 3790782 - RNA, 18 nt, Human
aaucccauucauaacuuu

SEQ ID NO: 3790783 - RNA, 20 nt, Human
aaucccauucauaacuuuca

SEQ ID NO: 3790784 - RNA, 15 nt, Human
aauccccaguaaaau

SEQ ID NO: 3790785 - RNA, 21 nt, Human
aauccccaguaaaauugccau

SEQ ID NO: 3790786 - RNA, 14 nt, Human
aaucccccaggaga

SEQ ID NO: 3790787 - RNA, 19 nt, Human
aauccccucauucaggaaa

SEQ ID NO: 3790788 - RNA, 21 nt, Human
aauccccucccugucaaagcu

SEQ ID NO: 3790789 - RNA, 17 nt, Human
aauccccuccuugggca

SEQ ID NO: 3790790 - RNA, 17 nt, Human
aauccccuucuccccug

SEQ ID NO: 3790791 - RNA, 20 nt, Human
aauccccuucuccccugcac

SEQ ID NO: 3790792 - RNA, 23 nt, Human
aauccccuucuccccugcacugu

SEQ ID NO: 3790793 - RNA, 17 nt, Human
aaucccgccaccuaucu

SEQ ID NO: 3790794 - RNA, 18 nt, Human
aaucccugcucacugcag

SEQ ID NO: 3790795 - RNA, 17 nt, Human
aaucccugggcauugcu

SEQ ID NO: 3790796 - RNA, 14 nt, Human
aaucccuguucauu

SEQ ID NO: 3790797 - RNA, 17 nt, Human
aaucccuguucauugua

SEQ ID NO: 3790798 - RNA, 14 nt, Human
aaucccuguuuaau

SEQ ID NO: 3790799 - RNA, 11 nt, Human
aaucccuucau

SEQ ID NO: 3790800 - RNA, 20 nt, Human
aauccgaaccuccucuguga

SEQ ID NO: 3790801 - RNA, 12 nt, Human
aauccgcccauc

SEQ ID NO: 3790802 - RNA, 13 nt, Human
aauccgcucucuu

SEQ ID NO: 3790803 - RNA, 15 nt, Human
aauccuaagacacaa

SEQ ID NO: 3790804 - RNA, 17 nt, Human
aauccuaaguuaccuuu

SEQ ID NO: 3790805 - RNA, 19 nt, Human
aauccuaauuucuccuccc

SEQ ID NO: 3790806 - RNA, 24 nt, Human
aauccuaauuucuccucccuuccu

SEQ ID NO: 3790807 - RNA, 15 nt, Human
aauccuaccucaaaa

SEQ ID NO: 3790808 - RNA, 14 nt, Human
aauccuaccuugcu

SEQ ID NO: 3790809 - RNA, 21 nt, Human
aauccuaccuugcuuuugcuu

SEQ ID NO: 3790810 - RNA, 15 nt, Human
aauccuaugcauggu

SEQ ID NO: 3790811 - RNA, 18 nt, Human
aauccuaugcaugguuuc

SEQ ID NO: 3790812 - RNA, 21 nt, Human
aauccuaugcaugguuucagc

SEQ ID NO: 3790813 - RNA, 14 nt, Human
aauccuaugugauu

SEQ ID NO: 3790814 - RNA, 15 nt, Human
aauccucacugggug

SEQ ID NO: 3790815 - RNA, 20 nt, Human
aauccucucaccucagccuc

SEQ ID NO: 3790816 - RNA, 17 nt, Human
aauccugauuccucucu

SEQ ID NO: 3790817 - RNA, 17 nt, Human
aauccugcaaugaaagg

SEQ ID NO: 3790818 - RNA, 12 nt, Human
aauccugccccc

SEQ ID NO: 3790819 - RNA, 18 nt, Human
aauccuguaggaagguac

SEQ ID NO: 3790820 - RNA, 19 nt, Human
aauccugucgauuagacug

SEQ ID NO: 3790821 - RNA, 21 nt, Human
aauccugucgauuagacugga

SEQ ID NO: 3790822 - RNA, 19 nt, Human
aauccuuacaaaugauugc

SEQ ID NO: 3790823 - RNA, 19 nt, Human
aauccuuagaucuggcaug

SEQ ID NO: 3790824 - RNA, 20 nt, Human
aauccuuccaaaaauuauua

SEQ ID NO: 3790825 - RNA, 21 nt, Human
aauccuuccauuccacacaga

SEQ ID NO: 3790826 - RNA, 13 nt, Human
aauccuucuaguu

SEQ ID NO: 3790827 - RNA, 14 nt, Human
aauccuucuaguuu

SEQ ID NO: 3790828 - RNA, 16 nt, Human
aauccuucuaguuucc

SEQ ID NO: 3790829 - RNA, 20 nt, Human
aauccuucuaguuucccaca

SEQ ID NO: 3790830 - RNA, 21 nt, Human
aauccuucuaguuucccacaa

SEQ ID NO: 3790831 - RNA, 18 nt, Human
aauccuuuauuauuauuu

SEQ ID NO: 3790832 - RNA, 22 nt, Human
aauccuuuguuuucugacuaau

SEQ ID NO: 3790833 - RNA, 23 nt, Human
aauccuuuguuuucugacuaauu

SEQ ID NO: 3790834 - RNA, 18 nt, Human
aaucgaggaaccagagcc

SEQ ID NO: 3790835 - RNA, 19 nt, Human
aaucgagugagacaaaauu

SEQ ID NO: 3790836 - RNA, 21 nt, Human
aaucgagugccgcaucucaca

SEQ ID NO: 3790837 - RNA, 14 nt, Human
aaucgcuuaaagau

SEQ ID NO: 3790838 - RNA, 12 nt, Human
aaucgcuucucu

SEQ ID NO: 3790839 - RNA, 21 nt, Human
aaucggaucuggggcucuggg

SEQ ID NO: 3790840 - RNA, 22 nt, Human
aaucggaucuggggcucuggga

SEQ ID NO: 3790841 - RNA, 22 nt, Human
aaucggcccacagcucccaccc

SEQ ID NO: 3790842 - RNA, 15 nt, Human
aaucguuaugugugu

SEQ ID NO: 3790843 - RNA, 14 nt, Human
aaucuaacaaugga

SEQ ID NO: 3790844 - RNA, 14 nt, Human
aaucuaacauuauu

SEQ ID NO: 3790845 - RNA, 20 nt, Human
aaucuaaccacaucaauauu

SEQ ID NO: 3790846 - RNA, 13 nt, Human
aaucuaagggaaa

SEQ ID NO: 3790847 - RNA, 16 nt, Human
aaucuaauauuaaaaa

SEQ ID NO: 3790848 - RNA, 17 nt, Human
aaucuaauauuaaaaau

SEQ ID NO: 3790849 - RNA, 13 nt, Human
aaucuaaugacau

SEQ ID NO: 3790850 - RNA, 20 nt, Human
aaucuacaaucucuuuuugu

SEQ ID NO: 3790851 - RNA, 17 nt, Human
aaucuacccaaaggaua

SEQ ID NO: 3790852 - RNA, 13 nt, Human
aaucuacugcauu

SEQ ID NO: 3790853 - RNA, 18 nt, Human
aaggaugaucuaggaaga

SEQ ID NO: 3790854 - RNA, 23 nt, Human
aaggaugaucuaggaagacuuug

SEQ ID NO: 3790855 - RNA, 19 nt, Human
aaggaugaugucuuuuuau

SEQ ID NO: 3790856 - RNA, 19 nt, Human
aaggaugccccgucccccu

SEQ ID NO: 3790857 - RNA, 17 nt, Human
aaggauguaaacagugc

SEQ ID NO: 3790858 - RNA, 20 nt, Human
aaggauguaaacagugccug

SEQ ID NO: 3790859 - RNA, 16 nt, Human
aaggauguacauuucc

SEQ ID NO: 3790860 - RNA, 14 nt, Human
aaggaugucacagg

SEQ ID NO: 3790861 - RNA, 15 nt, Human
aaggaugucacaggg

SEQ ID NO: 3790862 - RNA, 22 nt, Human
aaggaugugauuguggaaugga

SEQ ID NO: 3790863 - RNA, 16 nt, Human
aaggaugugggggaag

SEQ ID NO: 3790864 - RNA, 16 nt, Human
aaggauuauggaaaaa

SEQ ID NO: 3790865 - RNA, 19 nt, Human
aaggauuauggaaaaauaa

SEQ ID NO: 3790866 - RNA, 20 nt, Human
aaggauucugcuggccucug

SEQ ID NO: 3790867 - RNA, 14 nt, Human
aaggauugugauau

SEQ ID NO: 3790868 - RNA, 14 nt, Human
aaggcaaaaacaaa

SEQ ID NO: 3790869 - RNA, 13 nt, Human
aaggcaaaaauag

SEQ ID NO: 3790870 - RNA, 15 nt, Human
aaggcaaaaauguaa

SEQ ID NO: 3790871 - RNA, 12 nt, Human
aaggcaaaauug

SEQ ID NO: 3790872 - RNA, 15 nt, Human
aaggcaaaauugcaa

SEQ ID NO: 3790873 - RNA, 15 nt, Human
aaggcaaacccauca

SEQ ID NO: 3790874 - RNA, 20 nt, Human
aaggcaaacccaucaacaaa

SEQ ID NO: 3790875 - RNA, 16 nt, Human
aaggcaaaugcccaag

SEQ ID NO: 3790876 - RNA, 21 nt, Human
aaggcaacaaaagaagcccgg

SEQ ID NO: 3790877 - RNA, 20 nt, Human
aaggcaacugaacaaaaaaa

SEQ ID NO: 3790878 - RNA, 12 nt, Human
aaggcaacuggg

SEQ ID NO: 3790879 - RNA, 13 nt, Human
aaggcaagagggg

SEQ ID NO: 3790880 - RNA, 16 nt, Human
aaggcaagccaggcuc

SEQ ID NO: 3790881 - RNA, 13 nt, Human
aaggcaaggcugu

SEQ ID NO: 3790882 - RNA, 15 nt, Human
aaggcaaggcuguca

SEQ ID NO: 3790883 - RNA, 17 nt, Human
aaggcaauauuaaccua

SEQ ID NO: 3790884 - RNA, 19 nt, Human
aaggcacccccgucaagag

SEQ ID NO: 3790885 - RNA, 12 nt, Human
aaggcacugccu

SEQ ID NO: 3790886 - RNA, 13 nt, Human
aaggcacugccug

SEQ ID NO: 3790887 - RNA, 14 nt, Human
aaggcacugccuga

SEQ ID NO: 3790888 - RNA, 19 nt, Human
aaggcagaaagcaaaauua

SEQ ID NO: 3790889 - RNA, 16 nt, Human
aaggcagaggccuggg

SEQ ID NO: 3790890 - RNA, 17 nt, Human
aaggcagaggccugggc

SEQ ID NO: 3790891 - RNA, 20 nt, Human
aaggcagauuuuacagagcg

SEQ ID NO: 3790892 - RNA, 19 nt, Human
aaggcagcaaggcccgagc

SEQ ID NO: 3790893 - RNA, 20 nt, Human
aaggcagcucuaaaugucaa

SEQ ID NO: 3790894 - RNA, 22 nt, Human
aaggcagcuguugucucuucuc

SEQ ID NO: 3790895 - RNA, 13 nt, Human
aaggcaggaagag

SEQ ID NO: 3790896 - RNA, 14 nt, Human
aaggcaggcagggc

SEQ ID NO: 3790897 - RNA, 16 nt, Human
aaggcaggcagggcuc

SEQ ID NO: 3790898 - RNA, 17 nt, Human
aaggcaggcagggcucu

SEQ ID NO: 3790899 - RNA, 21 nt, Human
aaggcaggcagggcucuccug

SEQ ID NO: 3790900 - RNA, 16 nt, Human
aaggcaggugccucca

SEQ ID NO: 3790901 - RNA, 20 nt, Human
aaggcaggugccuccaggug

SEQ ID NO: 3790902 - RNA, 23 nt, Human
aaggcaguagaacuccaggcccu

SEQ ID NO: 3790903 - RNA, 23 nt, Human
aaggcaguuaccauuaaaccauc

SEQ ID NO: 3790904 - RNA, 19 nt, Human
aaggcauaucagucucuga

SEQ ID NO: 3790905 - RNA, 20 nt, Human
aaggcauaucaugcuuugaa

SEQ ID NO: 3790906 - RNA, 18 nt, Human
aaggcaucuaucugugcu

SEQ ID NO: 3790907 - RNA, 21 nt, Human
aaggcaugauguuaaccagaa

SEQ ID NO: 3790908 - RNA, 21 nt, Human
aaggcaugccuggacaaaccc

SEQ ID NO: 3790909 - RNA, 17 nt, Human
aaggcauggcggccccc

SEQ ID NO: 3790910 - RNA, 16 nt, Human
aaggcauguuccucug

SEQ ID NO: 3790911 - RNA, 12 nt, Human
aaggcauucucu

SEQ ID NO: 3790912 - RNA, 15 nt, Human
aaggcauuguuugag

SEQ ID NO: 3790913 - RNA, 16 nt, Human
aaggccaaaccucugu

SEQ ID NO: 3790914 - RNA, 14 nt, Human
aaggccaccucuuc

SEQ ID NO: 3790915 - RNA, 12 nt, Human
aaggccaccugc

SEQ ID NO: 3790916 - RNA, 14 nt, Human
aaggccaccugcag

SEQ ID NO: 3790917 - RNA, 19 nt, Human
aaggccagaguggccuggc

SEQ ID NO: 3790918 - RNA, 20 nt, Human
aaggccagaguggccuggcc

SEQ ID NO: 3790919 - RNA, 14 nt, Human
aaggccagcuggca

SEQ ID NO: 3790920 - RNA, 21 nt, Human
aaggccaguggaaauucaggu

SEQ ID NO: 3790921 - RNA, 18 nt, Human
aaggccauaaaacaggua

SEQ ID NO: 3790922 - RNA, 18 nt, Human
aaggccauggagagcugg

SEQ ID NO: 3790923 - RNA, 14 nt, Human
aaggcccagccccu

SEQ ID NO: 3790924 - RNA, 21 nt, Human
aaggcccccucucaggagcca

SEQ ID NO: 3790925 - RNA, 19 nt, Human
aaggccccgcccaggcuua

SEQ ID NO: 3790926 - RNA, 18 nt, Human
aaggcccgagcagcugag

SEQ ID NO: 3790927 - RNA, 23 nt, Human
aaggcccuguuagugcacugauu

SEQ ID NO: 3790928 - RNA, 20 nt, Human
aaggccgaagcucuggcuga

SEQ ID NO: 3790929 - RNA, 15 nt, Human
aaggccuaggauucu

SEQ ID NO: 3790930 - RNA, 14 nt, Human
aaggccucccacag

SEQ ID NO: 3790931 - RNA, 12 nt, Human
aaggccucuugg

SEQ ID NO: 3790932 - RNA, 20 nt, Human
aaggccucuuggagaccuua

SEQ ID NO: 3790933 - RNA, 13 nt, Human
aaggccucuugua

SEQ ID NO: 3790934 - RNA, 11 nt, Human
aaggccugggg

SEQ ID NO: 3790935 - RNA, 12 nt, Human
aauauuaaaagu

SEQ ID NO: 3790936 - RNA, 14 nt, Human
aauauuaaagccau

SEQ ID NO: 3790937 - RNA, 19 nt, Human
aauauuaaagccauguuua

SEQ ID NO: 3790938 - RNA, 20 nt, Human
aauauuaaagccauguuuau

SEQ ID NO: 3790939 - RNA, 22 nt, Human
aauauuaaagccauguuuauua

SEQ ID NO: 3790940 - RNA, 14 nt, Human
aauauuaaauacag

SEQ ID NO: 3790941 - RNA, 16 nt, Human
aauauuaaauacagac

SEQ ID NO: 3790942 - RNA, 22 nt, Human
aauauuaaauacagacacuaag

SEQ ID NO: 3790943 - RNA, 21 nt, Human
aauauuaagcaugacagaaaa

SEQ ID NO: 3790944 - RNA, 22 nt, Human
aauauuaagcaugacagaaaau

SEQ ID NO: 3790945 - RNA, 22 nt, Human
aauauuaagguaguuauucaca

SEQ ID NO: 3790946 - RNA, 15 nt, Human
aauauuaaugccuuu

SEQ ID NO: 3790947 - RNA, 20 nt, Human
aauauuacagauaaaaugua

SEQ ID NO: 3790948 - RNA, 16 nt, Human
aauauuacuuuaacau

SEQ ID NO: 3790949 - RNA, 13 nt, Human
aauauuagaugug

SEQ ID NO: 3790950 - RNA, 18 nt, Human
aauauuagaugugauuua

SEQ ID NO: 3790951 - RNA, 19 nt, Human
aauauuagaugugauuuaa

SEQ ID NO: 3790952 - RNA, 23 nt, Human
aauauuaggcuuaaaaacugaaa

SEQ ID NO: 3790953 - RNA, 21 nt, Human
aauauuagugaccucagcuuu

SEQ ID NO: 3790954 - RNA, 16 nt, Human
aauauuauacuaagaa

SEQ ID NO: 3790955 - RNA, 19 nt, Human
aauauuauauuuggaugca

SEQ ID NO: 3790956 - RNA, 16 nt, Human
aauauuaugagaugcu

SEQ ID NO: 3790957 - RNA, 14 nt, Human
aauauuauguguuu

SEQ ID NO: 3790958 - RNA, 20 nt, Human
aauauuauuuguguuuccua

SEQ ID NO: 3790959 - RNA, 15 nt, Human
aauauucaauaaagc

SEQ ID NO: 3790960 - RNA, 16 nt, Human
aauauucaauaaagcu

SEQ ID NO: 3790961 - RNA, 17 nt, Human
aauauucacugggccaa

SEQ ID NO: 3790962 - RNA, 19 nt, Human
aauauucagacaaaaugga

SEQ ID NO: 3790963 - RNA, 20 nt, Human
aauauucaggguaaauagga

SEQ ID NO: 3790964 - RNA, 19 nt, Human
aauauucauaguagaacuu

SEQ ID NO: 3790965 - RNA, 23 nt, Human
aauauucauauuggaaaaaucac

SEQ ID NO: 3790966 - RNA, 14 nt, Human
aauauucuuucaau

SEQ ID NO: 3790967 - RNA, 15 nt, Human
aauauugaaaauuga

SEQ ID NO: 3790968 - RNA, 16 nt, Human
aauauugacauuugua

SEQ ID NO: 3790969 - RNA, 14 nt, Human
aauauugacuuugu

SEQ ID NO: 3790970 - RNA, 19 nt, Human
aauauugagcagaauucau

SEQ ID NO: 3790971 - RNA, 16 nt, Human
aauauugaggcuuugu

SEQ ID NO: 3790972 - RNA, 11 nt, Human
aauauugcuga

SEQ ID NO: 3790973 - RNA, 13 nt, Human
aauauugcugaug

SEQ ID NO: 3790974 - RNA, 18 nt, Human
aauauugcugauggugca

SEQ ID NO: 3790975 - RNA, 22 nt, Human
aauauugcugauggugcaauga

SEQ ID NO: 3790976 - RNA, 20 nt, Human
aauauugcuuuggucauaug

SEQ ID NO: 3790977 - RNA, 22 nt, Human
aauauuguauuguuagauguuu

SEQ ID NO: 3790978 - RNA, 16 nt, Human
aauauugucauuccug

SEQ ID NO: 3790979 - RNA, 9 nt, Human
aauauugug

SEQ ID NO: 3790980 - RNA, 14 nt, Human
aauauuguuccuaa

SEQ ID NO: 3790981 - RNA, 18 nt, Human
aauauuguuguauaauuu

SEQ ID NO: 3790982 - RNA, 13 nt, Human
aauauuguuucua

SEQ ID NO: 3790983 - RNA, 23 nt, Human
aauauuguuucugcauucauuuu

SEQ ID NO: 3790984 - RNA, 19 nt, Human
aauauuguuucuuuaucac

SEQ ID NO: 3790985 - RNA, 16 nt, Human
aauauuguuugguaaa

SEQ ID NO: 3790986 - RNA, 23 nt, Human
aauauuguuugguaaauguuucu

SEQ ID NO: 3790987 - RNA, 20 nt, Human
aauauuuaaaauuuauugcu

SEQ ID NO: 3790988 - RNA, 12 nt, Human
aauauuuaaaca

SEQ ID NO: 3790989 - RNA, 13 nt, Human
aauauuuaaacau

SEQ ID NO: 3790990 - RNA, 21 nt, Human
aauauuuaacauuauuuauau

SEQ ID NO: 3790991 - RNA, 16 nt, Human
aauauuuacaauguau

SEQ ID NO: 3790992 - RNA, 15 nt, Human
aauauuuacauauga

SEQ ID NO: 3790993 - RNA, 16 nt, Human
aauauuuauaaaacuu

SEQ ID NO: 3790994 - RNA, 19 nt, Human
aauauuuauaaaugagcaa

SEQ ID NO: 3790995 - RNA, 14 nt, Human
aauauuuauauauu

SEQ ID NO: 3790996 - RNA, 14 nt, Human
aauauuuauauuuc

SEQ ID NO: 3790997 - RNA, 13 nt, Human
aauauuuaugaag

SEQ ID NO: 3790998 - RNA, 19 nt, Human
aauguuuuguaaacauuua

SEQ ID NO: 3790999 - RNA, 18 nt, Human
aauguuuuguaaacuuug

SEQ ID NO: 3791000 - RNA, 15 nt, Human
aauguuuuuuuuuaa

SEQ ID NO: 3791001 - RNA, 20 nt, Human
aauuaaaaaaaaaaaacuuu

SEQ ID NO: 3791002 - RNA, 16 nt, Human
aauuaaaaaaaaauug

SEQ ID NO: 3791003 - RNA, 18 nt, Human
aauuaaaaaagauaaaca

SEQ ID NO: 3791004 - RNA, 17 nt, Human
aauuaaaaaauuuccag

SEQ ID NO: 3791005 - RNA, 12 nt, Human
aauuaaaaacua

SEQ ID NO: 3791006 - RNA, 15 nt, Human
aauuaaaaagauucu

SEQ ID NO: 3791007 - RNA, 11 nt, Human
aauuaaaacaa

SEQ ID NO: 3791008 - RNA, 16 nt, Human
aauuaaaacagcugca

SEQ ID NO: 3791009 - RNA, 14 nt, Human
aauuaaaacuucuu

SEQ ID NO: 3791010 - RNA, 15 nt, Human
aauuaaaacuucuua

SEQ ID NO: 3791011 - RNA, 20 nt, Human
aauuaaaaggauaguauuuu

SEQ ID NO: 3791012 - RNA, 22 nt, Human
aauuaaaaggauaguauuuuua

SEQ ID NO: 3791013 - RNA, 16 nt, Human
aauuaaaagucuuuuu

SEQ ID NO: 3791014 - RNA, 21 nt, Human
aauuaaaauugucccauuugc

SEQ ID NO: 3791015 - RNA, 14 nt, Human
aauuaaacaauuua

SEQ ID NO: 3791016 - RNA, 19 nt, Human
aauuaaacaauuuauuuua

SEQ ID NO: 3791017 - RNA, 13 nt, Human
aauuaaacggauu

SEQ ID NO: 3791018 - RNA, 23 nt, Human
aauuaaacggauuauuuuuucag

SEQ ID NO: 3791019 - RNA, 13 nt, Human
aauuaaagaaaau

SEQ ID NO: 3791020 - RNA, 13 nt, Human
aauuaaagaaaua

SEQ ID NO: 3791021 - RNA, 13 nt, Human
aauuaaagugucc

SEQ ID NO: 3791022 - RNA, 18 nt, Human
aauuaaaguguccauuga

SEQ ID NO: 3791023 - RNA, 17 nt, Human
aauuaaauaaaauaacc

SEQ ID NO: 3791024 - RNA, 16 nt, Human
aauuaaauauauguau

SEQ ID NO: 3791025 - RNA, 23 nt, Human
aauuaaauauauguauguaaaaa

SEQ ID NO: 3791026 - RNA, 12 nt, Human
aauuaaaucugu

SEQ ID NO: 3791027 - RNA, 18 nt, Human
aauuaaauuuugugucuc

SEQ ID NO: 3791028 - RNA, 17 nt, Human
aauuaacacuuaagguu

SEQ ID NO: 3791029 - RNA, 20 nt, Human
aauuaacauauaauauaugu

SEQ ID NO: 3791030 - RNA, 19 nt, Human
aauuaacaugaauauuuag

SEQ ID NO: 3791031 - RNA, 14 nt, Human
aauuaacauguuaa

SEQ ID NO: 3791032 - RNA, 14 nt, Human
aauuaaccuggugc

SEQ ID NO: 3791033 - RNA, 14 nt, Human
aauuaacugaaaca

SEQ ID NO: 3791034 - RNA, 18 nt, Human
aauuaacuggguaaugaa

SEQ ID NO: 3791035 - RNA, 21 nt, Human
aauuaacuggguaaugaaaca

SEQ ID NO: 3791036 - RNA, 17 nt, Human
aauuaacuugaguuuua

SEQ ID NO: 3791037 - RNA, 13 nt, Human
aauuaacuuuuau

SEQ ID NO: 3791038 - RNA, 15 nt, Human
aauuaacuuuuauaa

SEQ ID NO: 3791039 - RNA, 16 nt, Human
aauuaacuuuuauaaa

SEQ ID NO: 3791040 - RNA, 12 nt, Human
aauuaagaagaa

SEQ ID NO: 3791041 - RNA, 11 nt, Human
aauuaagaaug

SEQ ID NO: 3791042 - RNA, 16 nt, Human
aauuaagaauguucuc

SEQ ID NO: 3791043 - RNA, 22 nt, Human
aauuaagauacaaauuaauuuu

SEQ ID NO: 3791044 - RNA, 18 nt, Human
aauuaagcaaauguuaaa

SEQ ID NO: 3791045 - RNA, 22 nt, Human
aauuaaggcaacugaacaaaaa

SEQ ID NO: 3791046 - RNA, 18 nt, Human
aauuaagggccgauuuaa

SEQ ID NO: 3791047 - RNA, 16 nt, Human
aauuaagguguuugaa

SEQ ID NO: 3791048 - RNA, 20 nt, Human
aauuaagguguuugaaaaua

SEQ ID NO: 3791049 - RNA, 17 nt, Human
aauuaaugaaauaucug

SEQ ID NO: 3791050 - RNA, 12 nt, Human
aauuaauuguaa

SEQ ID NO: 3791051 - RNA, 14 nt, Human
aauuaauuugauua

SEQ ID NO: 3791052 - RNA, 15 nt, Human
aauuaauuugauuaa

SEQ ID NO: 3791053 - RNA, 18 nt, Human
aauuacaaaaaaaaauuu

SEQ ID NO: 3791054 - RNA, 16 nt, Human
aauuacaacuaaguga

SEQ ID NO: 3791055 - RNA, 16 nt, Human
aauuacaauauuucug

SEQ ID NO: 3791056 - RNA, 14 nt, Human
aauuacaauuuuau

SEQ ID NO: 3791057 - RNA, 19 nt, Human
aauuacaauuuuaucuguu

SEQ ID NO: 3791058 - RNA, 23 nt, Human
aauuacagugccuaaaauaagaa

SEQ ID NO: 3791059 - RNA, 13 nt, Human
aauuacauauacu

SEQ ID NO: 3791060 - RNA, 17 nt, Human
aauuacauguaaaacau

SEQ ID NO: 3791061 - RNA, 13 nt, Human
aauuacauuugua

SEQ ID NO: 3791062 - RNA, 18 nt, Human
aauuaccaguaaagugua

SEQ ID NO: 3791063 - RNA, 22 nt, Human
aauuaccaguaaaguguaacau

SEQ ID NO: 3791064 - RNA, 23 nt, Human
aauuaccauuuguuaauaucacu

SEQ ID NO: 3791065 - RNA, 17 nt, Human
aauuacccuuuugcagg

SEQ ID NO: 3791066 - RNA, 18 nt, Human
aauuaccuggauguucuu

SEQ ID NO: 3791067 - RNA, 14 nt, Human
aauuacuaacuucu

SEQ ID NO: 3791068 - RNA, 15 nt, Human
aauuacuaacuucua

SEQ ID NO: 3791069 - RNA, 17 nt, Human
aauuacuaacuucuaaa

SEQ ID NO: 3791070 - RNA, 20 nt, Human
aauuacuaacuucuaaaacu

SEQ ID NO: 3791071 - RNA, 21 nt, Human
aauuacuaacuucuaaaacug

SEQ ID NO: 3791072 - RNA, 19 nt, Human
aauuacucaggaagaacac

SEQ ID NO: 3791073 - RNA, 15 nt, Human
aauuacugccuugaa

SEQ ID NO: 3791074 - RNA, 23 nt, Human
aauuacuguuuauuaaaguacaa

SEQ ID NO: 3791075 - RNA, 12 nt, Human
aauuacuuaaaa

SEQ ID NO: 3791076 - RNA, 19 nt, Human
aauuacuuaucccugccca

SEQ ID NO: 3791077 - RNA, 11 nt, Human
aauuagaaaau

SEQ ID NO: 3791078 - RNA, 14 nt, Human
aauuagaaaauauu

SEQ ID NO: 3791079 - RNA, 18 nt, Human
aauuagaaaauauucucu

SEQ ID NO: 3791080 - RNA, 19 nt, Human
aauuagaaaauauucucua

SEQ ID NO: 3791081 - RNA, 22 nt, Human
aauuagaaaauguuauuuaaca

SEQ ID NO: 3791082 - RNA, 18 nt, Human
aauuagaaauuggcugga

SEQ ID NO: 3791083 - RNA, 15 nt, Human
aauuagaauaguguu

SEQ ID NO: 3791084 - RNA, 16 nt, Human
aauuagacacuuugga

SEQ ID NO: 3791085 - RNA, 21 nt, Human
aauuagacugugauucagaaa

SEQ ID NO: 3791086 - RNA, 12 nt, Human
aauuagagcaga

SEQ ID NO: 3791087 - RNA, 20 nt, Human
aauuagauccauuaauuuaa

SEQ ID NO: 3791088 - RNA, 17 nt, Human
aauuagaugcauguuga

SEQ ID NO: 3791089 - RNA, 14 nt, Human
aauuagccaguaau

SEQ ID NO: 3791090 - RNA, 19 nt, Human
aauuagccaguaauccugu

SEQ ID NO: 3791091 - RNA, 20 nt, Human
aauuagccaguaauccugua

SEQ ID NO: 3791092 - RNA, 19 nt, Human
aauuagccuaagauauacu

SEQ ID NO: 3791093 - RNA, 15 nt, Human
aauuagcugcuucua

SEQ ID NO: 3791094 - RNA, 17 nt, Human
aauuaggaaaaaaacua

SEQ ID NO: 3791095 - RNA, 20 nt, Human
aaucaauacacuaguuguuu

SEQ ID NO: 3791096 - RNA, 14 nt, Human
aaucaaucuugcau

SEQ ID NO: 3791097 - RNA, 16 nt, Human
aaucaaucuugcaugu

SEQ ID NO: 3791098 - RNA, 18 nt, Human
aaucaaucuugcauguaa

SEQ ID NO: 3791099 - RNA, 14 nt, Human
aaucaauuaaaagu

SEQ ID NO: 3791100 - RNA, 20 nt, Human
aaucaauuacugguccaaaa

SEQ ID NO: 3791101 - RNA, 16 nt, Human
aaucaauuuuuaggaa

SEQ ID NO: 3791102 - RNA, 13 nt, Human
aaucacaauacau

SEQ ID NO: 3791103 - RNA, 17 nt, Human
aaucacaauuuuuaaug

SEQ ID NO: 3791104 - RNA, 13 nt, Human
aaucacaggcugg

SEQ ID NO: 3791105 - RNA, 22 nt, Human
aaucacauauuuuaaaauuugu

SEQ ID NO: 3791106 - RNA, 18 nt, Human
aaucacaugaauuauuac

SEQ ID NO: 3791107 - RNA, 20 nt, Human
aaucaccagggccaaaagcu

SEQ ID NO: 3791108 - RNA, 15 nt, Human
aaucaccauguaagc

SEQ ID NO: 3791109 - RNA, 19 nt, Human
aaucaccauguaagcacuc

SEQ ID NO: 3791110 - RNA, 23 nt, Human
aaucaccauguaagcacucugga

SEQ ID NO: 3791111 - RNA, 14 nt, Human
aaucaccgaaaacg

SEQ ID NO: 3791112 - RNA, 23 nt, Human
aaucaccgaaaacguggcugcuu

SEQ ID NO: 3791113 - RNA, 19 nt, Human
aaucaccuaauuaauuuca

SEQ ID NO: 3791114 - RNA, 15 nt, Human
aaucacgcuuuuuga

SEQ ID NO: 3791115 - RNA, 20 nt, Human
aaucacgcuuuuugaaaaag

SEQ ID NO: 3791116 - RNA, 15 nt, Human
aaucacguaaagcua

SEQ ID NO: 3791117 - RNA, 20 nt, Human
aaucacguaaagcuagaaau

SEQ ID NO: 3791118 - RNA, 15 nt, Human
aaucacuaacauuau

SEQ ID NO: 3791119 - RNA, 12 nt, Human
aaucacucagag

SEQ ID NO: 3791120 - RNA, 18 nt, Human
aaucacucuaauuaauug

SEQ ID NO: 3791121 - RNA, 21 nt, Human
aaucacucuaauuaauuguaa

SEQ ID NO: 3791122 - RNA, 16 nt, Human
aaucacucuuguggau

SEQ ID NO: 3791123 - RNA, 18 nt, Human
aaucacucuuguggaugu

SEQ ID NO: 3791124 - RNA, 10 nt, Human
aaucacugug

SEQ ID NO: 3791125 - RNA, 18 nt, Human
aaucacuguguauauuug

SEQ ID NO: 3791126 - RNA, 19 nt, Human
aaucacuguuuagaacaca

SEQ ID NO: 3791127 - RNA, 21 nt, Human
aaucacuguuuagaacacaca

SEQ ID NO: 3791128 - RNA, 17 nt, Human
aaucacuuaacauuccu

SEQ ID NO: 3791129 - RNA, 16 nt, Human
aaucacuuaggaaaug

SEQ ID NO: 3791130 - RNA, 18 nt, Human
aaucacuugauucauaaa

SEQ ID NO: 3791131 - RNA, 13 nt, Human
aaucagaaauuuu

SEQ ID NO: 3791132 - RNA, 21 nt, Human
aaucagaagauagucuuggaa

SEQ ID NO: 3791133 - RNA, 24 nt, Human
aaucagaagucaucuugcuaccag

SEQ ID NO: 3791134 - RNA, 14 nt, Human
aaucagaauggaag

SEQ ID NO: 3791135 - RNA, 12 nt, Human
aaucagacugac

SEQ ID NO: 3791136 - RNA, 13 nt, Human
aaucagagacaaa

SEQ ID NO: 3791137 - RNA, 18 nt, Human
aaucagaguagaaauaaa

SEQ ID NO: 3791138 - RNA, 14 nt, Human
aaucagauagauau

SEQ ID NO: 3791139 - RNA, 15 nt, Human
aaucagaucuuuauu

SEQ ID NO: 3791140 - RNA, 13 nt, Human
aaucagcacugaa

SEQ ID NO: 3791141 - RNA, 14 nt, Human
aaucagcacugaaa

SEQ ID NO: 3791142 - RNA, 17 nt, Human
aaucagccaaguuuuau

SEQ ID NO: 3791143 - RNA, 18 nt, Human
aaucagccaauuauguua

SEQ ID NO: 3791144 - RNA, 13 nt, Human
accacacuggacu

SEQ ID NO: 3791145 - RNA, 22 nt, Human
accacacuggacuccggcccuc

SEQ ID NO: 3791146 - RNA, 13 nt, Human
accacagacacac

SEQ ID NO: 3791147 - RNA, 15 nt, Human
accacagacacacac

SEQ ID NO: 3791148 - RNA, 21 nt, Human
accacagcaaggcaccugcag

SEQ ID NO: 3791149 - RNA, 16 nt, Human
accacagcacagccaa

SEQ ID NO: 3791150 - RNA, 17 nt, Human
accacagccagcaccug

SEQ ID NO: 3791151 - RNA, 13 nt, Human
accacagcccugu

SEQ ID NO: 3791152 - RNA, 17 nt, Human
accacagcccugucagu

SEQ ID NO: 3791153 - RNA, 12 nt, Human
accacagcugcu

SEQ ID NO: 3791154 - RNA, 15 nt, Human
accacaggcucaggc

SEQ ID NO: 3791155 - RNA, 22 nt, Human
accacagguucaugccaccaug

SEQ ID NO: 3791156 - RNA, 12 nt, Human
accacagugucu

SEQ ID NO: 3791157 - RNA, 18 nt, Human
accacauacguaaaaauc

SEQ ID NO: 3791158 - RNA, 19 nt, Human
accacauagcaugaggcca

SEQ ID NO: 3791159 - RNA, 23 nt, Human
accacauccacacacgcaggaac

SEQ ID NO: 3791160 - RNA, 22 nt, Human
accacauccuccguccagccgc

SEQ ID NO: 3791161 - RNA, 17 nt, Human
accacaucuugcucugc

SEQ ID NO: 3791162 - RNA, 20 nt, Human
accacaucuugcucugcuga

SEQ ID NO: 3791163 - RNA, 18 nt, Human
accacaugugcacaugca

SEQ ID NO: 3791164 - RNA, 24 nt, Human
accacauuggagauguuuaguaau

SEQ ID NO: 3791165 - RNA, 16 nt, Human
accaccaagccaaggg

SEQ ID NO: 3791166 - RNA, 14 nt, Human
accaccaagccuug

SEQ ID NO: 3791167 - RNA, 15 nt, Human
accaccaagccuuga

SEQ ID NO: 3791168 - RNA, 14 nt, Human
accaccacuggcca

SEQ ID NO: 3791169 - RNA, 23 nt, Human
accaccacuuaugccccuagaag

SEQ ID NO: 3791170 - RNA, 15 nt, Human
accaccagcuguguc

SEQ ID NO: 3791171 - RNA, 20 nt, Human
accaccagggcaucucuggg

SEQ ID NO: 3791172 - RNA, 23 nt, Human
accaccaucaccagacaggugcg

SEQ ID NO: 3791173 - RNA, 23 nt, Human
accacccacucuccucugccuca

SEQ ID NO: 3791174 - RNA, 18 nt, Human
accaccccaacaaaccau

SEQ ID NO: 3791175 - RNA, 14 nt, Human
accaccccaucugc

SEQ ID NO: 3791176 - RNA, 18 nt, Human
accaccccaucugcauuc

SEQ ID NO: 3791177 - RNA, 14 nt, Human
accaccccccacuc

SEQ ID NO: 3791178 - RNA, 18 nt, Human
accaccccgccugcccuc

SEQ ID NO: 3791179 - RNA, 14 nt, Human
accaccccuaccac

SEQ ID NO: 3791180 - RNA, 19 nt, Human
accaccccugccuccaccc

SEQ ID NO: 3791181 - RNA, 13 nt, Human
accacccucacug

SEQ ID NO: 3791182 - RNA, 19 nt, Human
accacccucacuggcucuc

SEQ ID NO: 3791183 - RNA, 11 nt, Human
accacccuccc

SEQ ID NO: 3791184 - RNA, 14 nt, Human
accacccugcucau

SEQ ID NO: 3791185 - RNA, 15 nt, Human
accaccgcuccccag

SEQ ID NO: 3791186 - RNA, 18 nt, Human
accaccgcuccccagccc

SEQ ID NO: 3791187 - RNA, 18 nt, Human
accaccuaaucaggcuga

SEQ ID NO: 3791188 - RNA, 20 nt, Human
accaccuaggccacuccucc

SEQ ID NO: 3791189 - RNA, 17 nt, Human
accaccucaaauuuaaa

SEQ ID NO: 3791190 - RNA, 16 nt, Human
accaccucacuccugu

SEQ ID NO: 3791191 - RNA, 17 nt, Human
accaccucuccagaggc

SEQ ID NO: 3791192 - RNA, 15 nt, Human
accaccuucccagcu

SEQ ID NO: 3791193 - RNA, 22 nt, Human
accaccuucccagcucucccuc

SEQ ID NO: 3791194 - RNA, 20 nt, Human
accaccuuuguuucuccccc

SEQ ID NO: 3791195 - RNA, 21 nt, Human
accacgaaagcacacacaaaa

SEQ ID NO: 3791196 - RNA, 24 nt, Human
accacgacuggccagggccacgcu

SEQ ID NO: 3791197 - RNA, 21 nt, Human
accacgauguggcccuggccu

SEQ ID NO: 3791198 - RNA, 22 nt, Human
accacgauguggcccuggccug

SEQ ID NO: 3791199 - RNA, 13 nt, Human
accacgcccggcu

SEQ ID NO: 3791200 - RNA, 14 nt, Human
accacgcccggcua

SEQ ID NO: 3791201 - RNA, 13 nt, Human
accacgccuggcu

SEQ ID NO: 3791202 - RNA, 18 nt, Human
accacgcuggaccuugaa

SEQ ID NO: 3791203 - RNA, 14 nt, Human
accacggaaaagag

SEQ ID NO: 3791204 - RNA, 21 nt, Human
accacggacguuuccaucagg

SEQ ID NO: 3791205 - RNA, 14 nt, Human
accacggccacugg

SEQ ID NO: 3791206 - RNA, 22 nt, Human
accacgggacaucacagggugg

SEQ ID NO: 3791207 - RNA, 23 nt, Human
accacgugcuacccccaugcugg

SEQ ID NO: 3791208 - RNA, 13 nt, Human
accacguuucuaa

SEQ ID NO: 3791209 - RNA, 17 nt, Human
accacuacaugcagccc

SEQ ID NO: 3791210 - RNA, 14 nt, Human
accacuacauucug

SEQ ID NO: 3791211 - RNA, 15 nt, Human
accacuagccucagg

SEQ ID NO: 3791212 - RNA, 16 nt, Human
accacuagccucaggg

SEQ ID NO: 3791213 - RNA, 15 nt, Human
accacuauaaaaugu

SEQ ID NO: 3791214 - RNA, 20 nt, Human
accacucaaauuaaucuuuc

SEQ ID NO: 3791215 - RNA, 17 nt, Human
accacucgugcaucccu

SEQ ID NO: 3791216 - RNA, 12 nt, Human
acugugcagagu

SEQ ID NO: 3791217 - RNA, 21 nt, Human
acugugcaggugcuauuguua

SEQ ID NO: 3791218 - RNA, 16 nt, Human
acugugcauagugcug

SEQ ID NO: 3791219 - RNA, 12 nt, Human
acugugccacaa

SEQ ID NO: 3791220 - RNA, 17 nt, Human
acugugccaugugccag

SEQ ID NO: 3791221 - RNA, 18 nt, Human
acugugccaugugccagg

SEQ ID NO: 3791222 - RNA, 16 nt, Human
acugugccauguguuu

SEQ ID NO: 3791223 - RNA, 17 nt, Human
acugugcccugguggag

SEQ ID NO: 3791224 - RNA, 14 nt, Human
acugugccuuugca

SEQ ID NO: 3791225 - RNA, 19 nt, Human
acugugccuuugcaaauca

SEQ ID NO: 3791226 - RNA, 22 nt, Human
acugugccuuugcaaaucagug

SEQ ID NO: 3791227 - RNA, 22 nt, Human
acugugcgcauaggccugcuuu

SEQ ID NO: 3791228 - RNA, 15 nt, Human
acugugcuacugucu

SEQ ID NO: 3791229 - RNA, 23 nt, Human
acugugcuacugucuuuggaaaa

SEQ ID NO: 3791230 - RNA, 14 nt, Human
acugugcucagggc

SEQ ID NO: 3791231 - RNA, 20 nt, Human
acugugcuccagccugggca

SEQ ID NO: 3791232 - RNA, 13 nt, Human
acugugcuguugu

SEQ ID NO: 3791233 - RNA, 18 nt, Human
acugugcuguuguuauga

SEQ ID NO: 3791234 - RNA, 22 nt, Human
acugugcuguuguuaugaugug

SEQ ID NO: 3791235 - RNA, 23 nt, Human
acugugcuguuguuaugaugugc

SEQ ID NO: 3791236 - RNA, 21 nt, Human
acugugcuuucuauuguacag

SEQ ID NO: 3791237 - RNA, 14 nt, Human
acuguggaaaaaua

SEQ ID NO: 3791238 - RNA, 15 nt, Human
acuguggaaaaauau

SEQ ID NO: 3791239 - RNA, 22 nt, Human
acuguggagacugcuccugagc

SEQ ID NO: 3791240 - RNA, 18 nt, Human
acuguggaggaaggauug

SEQ ID NO: 3791241 - RNA, 23 nt, Human
acuguggaggaaggauuguaaaa

SEQ ID NO: 3791242 - RNA, 20 nt, Human
acuguggcacuugccugggu

SEQ ID NO: 3791243 - RNA, 22 nt, Human
acuguggcacuugccuggguca

SEQ ID NO: 3791244 - RNA, 20 nt, Human
acuguggccguuaucuggaa

SEQ ID NO: 3791245 - RNA, 12 nt, Human
acuguggccuug

SEQ ID NO: 3791246 - RNA, 22 nt, Human
acuguggccuuggucuaacuuu

SEQ ID NO: 3791247 - RNA, 17 nt, Human
acugugggcaauuuaga

SEQ ID NO: 3791248 - RNA, 19 nt, Human
acugugggcaauuuagaaa

SEQ ID NO: 3791249 - RNA, 20 nt, Human
acugugggcaauuuagaaaa

SEQ ID NO: 3791250 - RNA, 22 nt, Human
acuguggggaaccaauugcuuu

SEQ ID NO: 3791251 - RNA, 22 nt, Human
acuguggggugugcacaucucu

SEQ ID NO: 3791252 - RNA, 22 nt, Human
acuguggguuuguggggggagg

SEQ ID NO: 3791253 - RNA, 17 nt, Human
acugugguaaaugccac

SEQ ID NO: 3791254 - RNA, 14 nt, Human
acuguggugacuuu

SEQ ID NO: 3791255 - RNA, 15 nt, Human
acuguggugacuuug

SEQ ID NO: 3791256 - RNA, 19 nt, Human
acuguguaaaauguaaugc

SEQ ID NO: 3791257 - RNA, 12 nt, Human
acuguguaacug

SEQ ID NO: 3791258 - RNA, 17 nt, Human
acuguguaacugcccaa

SEQ ID NO: 3791259 - RNA, 17 nt, Human
acuguguacauaacuga

SEQ ID NO: 3791260 - RNA, 12 nt, Human
acuguguauaga

SEQ ID NO: 3791261 - RNA, 17 nt, Human
acuguguauauuugauu

SEQ ID NO: 3791262 - RNA, 18 nt, Human
acuguguauauuugauuu

SEQ ID NO: 3791263 - RNA, 16 nt, Human
acuguguauguacaua

SEQ ID NO: 3791264 - RNA, 21 nt, Human
acuguguauuccaagacaugu

SEQ ID NO: 3791265 - RNA, 18 nt, Human
acugugucccucucucug

SEQ ID NO: 3791266 - RNA, 13 nt, Human
acuguguccuggu

SEQ ID NO: 3791267 - RNA, 12 nt, Human
acugugugcuca

SEQ ID NO: 3791268 - RNA, 21 nt, Human
acugugugcucaggagcccug

SEQ ID NO: 3791269 - RNA, 17 nt, Human
acuguguggacugugau

SEQ ID NO: 3791270 - RNA, 19 nt, Human
acuguguggacugugaugc

SEQ ID NO: 3791271 - RNA, 16 nt, Human
acuguguguaauuguu

SEQ ID NO: 3791272 - RNA, 23 nt, Human
acugugugugcccucugggcucu

SEQ ID NO: 3791273 - RNA, 18 nt, Human
acugugugugugaaugaa

SEQ ID NO: 3791274 - RNA, 12 nt, Human
acuguguuccug

SEQ ID NO: 3791275 - RNA, 21 nt, Human
acuguguuguauuaacaaaag

SEQ ID NO: 3791276 - RNA, 15 nt, Human
acuguguuucaaguu

SEQ ID NO: 3791277 - RNA, 18 nt, Human
acuguuaaccauuuaagu

SEQ ID NO: 3791278 - RNA, 19 nt, Human
acuguuaagaaaucuguuu

SEQ ID NO: 3791279 - RNA, 12 nt, Human
acuguuacagua

SEQ ID NO: 3791280 - RNA, 16 nt, Human
acuguuacaguaaugu

SEQ ID NO: 3791281 - RNA, 13 nt, Human
acuguuaccauug

SEQ ID NO: 3791282 - RNA, 16 nt, Human
acuguuaccauuggaa

SEQ ID NO: 3791283 - RNA, 17 nt, Human
acuguuaccauuggaaa

SEQ ID NO: 3791284 - RNA, 18 nt, Human
acuguuaccauuggaaau

SEQ ID NO: 3791285 - RNA, 20 nt, Human
acuguuagaaaauggacacu

SEQ ID NO: 3791286 - RNA, 16 nt, Human
acuguuagaacacuau

SEQ ID NO: 3791287 - RNA, 17 nt, Human
acuguuagaacacuauu

SEQ ID NO: 3791288 - RNA, 17 nt, Human
acuuagcuuaucaauuu

SEQ ID NO: 3791289 - RNA, 14 nt, Human
acuuaggcuuugua

SEQ ID NO: 3791290 - RNA, 15 nt, Human
acuuagguguggggg

SEQ ID NO: 3791291 - RNA, 17 nt, Human
acuuaguagauuaaaaa

SEQ ID NO: 3791292 - RNA, 18 nt, Human
acuuauaaaguagaaaug

SEQ ID NO: 3791293 - RNA, 19 nt, Human
acuuauaaaucauauugau

SEQ ID NO: 3791294 - RNA, 23 nt, Human
acuuauaagguguuuucugugua

SEQ ID NO: 3791295 - RNA, 13 nt, Human
acuuauagccucu

SEQ ID NO: 3791296 - RNA, 22 nt, Human
acuuauaucaucagcauaccuu

SEQ ID NO: 3791297 - RNA, 12 nt, Human
acuuauauugaa

SEQ ID NO: 3791298 - RNA, 15 nt, Human
acuuauauuguaaga

SEQ ID NO: 3791299 - RNA, 22 nt, Human
acuuauauuuucguaugaaaau

SEQ ID NO: 3791300 - RNA, 20 nt, Human
acuuaucagcuacuuaagag

SEQ ID NO: 3791301 - RNA, 21 nt, Human
acuuaucaguuugcuaauguu

SEQ ID NO: 3791302 - RNA, 20 nt, Human
acuuaucauccacauuguuu

SEQ ID NO: 3791303 - RNA, 22 nt, Human
acuuaucauccacauuguuuua

SEQ ID NO: 3791304 - RNA, 16 nt, Human
acuuaucccugcccau

SEQ ID NO: 3791305 - RNA, 19 nt, Human
acuuauccuaaaacaaaua

SEQ ID NO: 3791306 - RNA, 17 nt, Human
acuuaucucucugugcu

SEQ ID NO: 3791307 - RNA, 22 nt, Human
acuuaucucucugugcugugga

SEQ ID NO: 3791308 - RNA, 22 nt, Human
acuuaugaaaugugcacuuuau

SEQ ID NO: 3791309 - RNA, 12 nt, Human
acuuaugaaugu

SEQ ID NO: 3791310 - RNA, 16 nt, Human
acuuaugauuucaugu

SEQ ID NO: 3791311 - RNA, 14 nt, Human
acuuaugcugauuu

SEQ ID NO: 3791312 - RNA, 14 nt, Human
acuuauguuuuuaa

SEQ ID NO: 3791313 - RNA, 16 nt, Human
acuuauguuuuuaaau

SEQ ID NO: 3791314 - RNA, 16 nt, Human
acuuauuacaauuugu

SEQ ID NO: 3791315 - RNA, 20 nt, Human
acuuauuacugcuaaguauu

SEQ ID NO: 3791316 - RNA, 15 nt, Human
acuuauucaaagaga

SEQ ID NO: 3791317 - RNA, 13 nt, Human
acuuauugaauau

SEQ ID NO: 3791318 - RNA, 18 nt, Human
acuuauugaauauaugau

SEQ ID NO: 3791319 - RNA, 18 nt, Human
acuuauugcuuugaaacu

SEQ ID NO: 3791320 - RNA, 21 nt, Human
acuuauuggaacucugcuuga

SEQ ID NO: 3791321 - RNA, 13 nt, Human
acuuauuguaaau

SEQ ID NO: 3791322 - RNA, 20 nt, Human
acuuauuguggauaacaaag

SEQ ID NO: 3791323 - RNA, 22 nt, Human
acuuauuguggauaacaaagau

SEQ ID NO: 3791324 - RNA, 18 nt, Human
acuuauuuaaauagauga

SEQ ID NO: 3791325 - RNA, 15 nt, Human
acuuauuuauauaaa

SEQ ID NO: 3791326 - RNA, 16 nt, Human
acuuauuucuucaaau

SEQ ID NO: 3791327 - RNA, 12 nt, Human
acuuauuugagu

SEQ ID NO: 3791328 - RNA, 13 nt, Human
acuuauuuggggu

SEQ ID NO: 3791329 - RNA, 16 nt, Human
acuuauuuuauuucca

SEQ ID NO: 3791330 - RNA, 19 nt, Human
acuuauuuuugacaguguu

SEQ ID NO: 3791331 - RNA, 22 nt, Human
acuuauuuuugacaguguugaa

SEQ ID NO: 3791332 - RNA, 19 nt, Human
acuuauuuuuuucugauug

SEQ ID NO: 3791333 - RNA, 19 nt, Human
acuucaaaacaaacagaug

SEQ ID NO: 3791334 - RNA, 18 nt, Human
acuucaaaaguauuuucc

SEQ ID NO: 3791335 - RNA, 15 nt, Human
acuucaaaauauuga

SEQ ID NO: 3791336 - RNA, 18 nt, Human
acuucaaacuacuuugcu

SEQ ID NO: 3791337 - RNA, 16 nt, Human
acuucaaagcaagcug

SEQ ID NO: 3791338 - RNA, 19 nt, Human
acuucaaauuuuuuaaaag

SEQ ID NO: 3791339 - RNA, 18 nt, Human
acuucaagcaccagggaa

SEQ ID NO: 3791340 - RNA, 16 nt, Human
acuucacacacaggca

SEQ ID NO: 3791341 - RNA, 16 nt, Human
acuucacacugcaaga

SEQ ID NO: 3791342 - RNA, 23 nt, Human
acuucacacugcaagagccuugg

SEQ ID NO: 3791343 - RNA, 12 nt, Human
acuucacagagu

SEQ ID NO: 3791344 - RNA, 19 nt, Human
acuucacagagugugcugg

SEQ ID NO: 3791345 - RNA, 19 nt, Human
acuucacgcuuucagcgaa

SEQ ID NO: 3791346 - RNA, 19 nt, Human
acuucacugucaggaagaa

SEQ ID NO: 3791347 - RNA, 14 nt, Human
acuucacugugcug

SEQ ID NO: 3791348 - RNA, 17 nt, Human
acuucagaagcaaacaa

SEQ ID NO: 3791349 - RNA, 18 nt, Human
acuucagaagcaaacaau

SEQ ID NO: 3791350 - RNA, 15 nt, Human
acuucagagagcugg

SEQ ID NO: 3791351 - RNA, 16 nt, Human
acuucagagagcuggu

SEQ ID NO: 3791352 - RNA, 17 nt, Human
acuucagagagcuggua

SEQ ID NO: 3791353 - RNA, 18 nt, Human
acuucagagagcugguag

SEQ ID NO: 3791354 - RNA, 14 nt, Human
acuucagcaagaga

SEQ ID NO: 3791355 - RNA, 10 nt, Human
acuucagcac

SEQ ID NO: 3791356 - RNA, 16 nt, Human
acuucagcuagagcuu

SEQ ID NO: 3791357 - RNA, 13 nt, Human
acuucagcucugu

SEQ ID NO: 3791358 - RNA, 11 nt, Human
acuucagcuga

SEQ ID NO: 3791359 - RNA, 20 nt, Human
acuucaggcucuucuccuuu

SEQ ID NO: 3791360 - RNA, 16 nt, Human
acuucagggcagauuu

SEQ ID NO: 3791361 - RNA, 23 nt, Human
acuucagggcagggcucugauau

SEQ ID NO: 3791362 - RNA, 21 nt, Human
acuucaggguucuccucuccc

SEQ ID NO: 3791363 - RNA, 23 nt, Human
acuucaggguucuccucuccccu

SEQ ID NO: 3791364 - RNA, 17 nt, Human
acuucaguauguuguca

SEQ ID NO: 3791365 - RNA, 15 nt, Human
acuucaguccugcuc

SEQ ID NO: 3791366 - RNA, 21 nt, Human
acuucaguuucacagaaaaua

SEQ ID NO: 3791367 - RNA, 22 nt, Human
acuucaguuucacagaaaauaa

SEQ ID NO: 3791368 - RNA, 15 nt, Human
acuucaucuggaagu

SEQ ID NO: 3791369 - RNA, 19 nt, Human
acuucaugacaagcauuuu

SEQ ID NO: 3791370 - RNA, 15 nt, Human
acuucauggaaugga

SEQ ID NO: 3791371 - RNA, 12 nt, Human
acuucauguaaa

SEQ ID NO: 3791372 - RNA, 23 nt, Human
acuucauguaauuuuauuuuaaa

SEQ ID NO: 3791373 - RNA, 14 nt, Human
acuucaugucaacu

SEQ ID NO: 3791374 - RNA, 17 nt, Human
acuucauuaauaauaaa

SEQ ID NO: 3791375 - RNA, 15 nt, Human
acuucauucuugaaa

SEQ ID NO: 3791376 - RNA, 13 nt, Human
acugcaggcccug

SEQ ID NO: 3791377 - RNA, 19 nt, Human
acugcaggcccuggccucc

SEQ ID NO: 3791378 - RNA, 10 nt, Human
acugcaggga

SEQ ID NO: 3791379 - RNA, 22 nt, Human
acugcagggacacgggcagccu

SEQ ID NO: 3791380 - RNA, 16 nt, Human
acugcagggacugcca

SEQ ID NO: 3791381 - RNA, 17 nt, Human
acugcagggacugccag

SEQ ID NO: 3791382 - RNA, 18 nt, Human
acugcagggacugccagu

SEQ ID NO: 3791383 - RNA, 22 nt, Human
acugcagggccaggacugagcc

SEQ ID NO: 3791384 - RNA, 17 nt, Human
acugcagguuggacccc

SEQ ID NO: 3791385 - RNA, 20 nt, Human
acugcagguuggaccccaga

SEQ ID NO: 3791386 - RNA, 21 nt, Human
acugcagguuggaccccagag

SEQ ID NO: 3791387 - RNA, 14 nt, Human
acugcauacaaucu

SEQ ID NO: 3791388 - RNA, 16 nt, Human
acugcauaccaaccug

SEQ ID NO: 3791389 - RNA, 16 nt, Human
acugcauaugaaagga

SEQ ID NO: 3791390 - RNA, 20 nt, Human
acugcaucaagaugugacau

SEQ ID NO: 3791391 - RNA, 22 nt, Human
acugcaucaagaugugacaugu

SEQ ID NO: 3791392 - RNA, 14 nt, Human
acugcauccagccu

SEQ ID NO: 3791393 - RNA, 23 nt, Human
acugcauccuccgccucccgggu

SEQ ID NO: 3791394 - RNA, 17 nt, Human
acugcaugcccagagac

SEQ ID NO: 3791395 - RNA, 13 nt, Human
acugcaugcugcu

SEQ ID NO: 3791396 - RNA, 16 nt, Human
acugcaugcugcugga

SEQ ID NO: 3791397 - RNA, 17 nt, Human
acugcaugcugcuggac

SEQ ID NO: 3791398 - RNA, 21 nt, Human
acugcauguaccauuugcaug

SEQ ID NO: 3791399 - RNA, 16 nt, Human
acugcauguuugugau

SEQ ID NO: 3791400 - RNA, 20 nt, Human
acugcauuaccgcguuguaa

SEQ ID NO: 3791401 - RNA, 21 nt, Human
acugcauuaccgcguuguaaa

SEQ ID NO: 3791402 - RNA, 16 nt, Human
acugcauuagaaauua

SEQ ID NO: 3791403 - RNA, 15 nt, Human
acugcauuauauuua

SEQ ID NO: 3791404 - RNA, 14 nt, Human
acugcauuauuuga

SEQ ID NO: 3791405 - RNA, 16 nt, Human
acugcauuuagggagu

SEQ ID NO: 3791406 - RNA, 12 nt, Human
acugcauuuuag

SEQ ID NO: 3791407 - RNA, 15 nt, Human
acugccaagccaugg

SEQ ID NO: 3791408 - RNA, 22 nt, Human
acugccacacgucugacccucu

SEQ ID NO: 3791409 - RNA, 13 nt, Human
acugccaccuccc

SEQ ID NO: 3791410 - RNA, 22 nt, Human
acugccacuuugcacauuuuga

SEQ ID NO: 3791411 - RNA, 13 nt, Human
acugccagcaacg

SEQ ID NO: 3791412 - RNA, 12 nt, Human
acugccaggagg

SEQ ID NO: 3791413 - RNA, 14 nt, Human
acugccaggaggga

SEQ ID NO: 3791414 - RNA, 14 nt, Human
acugccaggcucuc

SEQ ID NO: 3791415 - RNA, 17 nt, Human
acugccaggcucucuuu

SEQ ID NO: 3791416 - RNA, 19 nt, Human
acugccagucccccugccc

SEQ ID NO: 3791417 - RNA, 16 nt, Human
acugccagucucacug

SEQ ID NO: 3791418 - RNA, 13 nt, Human
acugccauaaaac

SEQ ID NO: 3791419 - RNA, 21 nt, Human
acugccauaaaacauuaagaa

SEQ ID NO: 3791420 - RNA, 22 nt, Human
acugccauaaaacauuaagaaa

SEQ ID NO: 3791421 - RNA, 13 nt, Human
acugccauaugau

SEQ ID NO: 3791422 - RNA, 14 nt, Human
acugccauccuggc

SEQ ID NO: 3791423 - RNA, 17 nt, Human
acugccauuauuuucug

SEQ ID NO: 3791424 - RNA, 23 nt, Human
acugccauuauuuucugucagau

SEQ ID NO: 3791425 - RNA, 19 nt, Human
acugcccaaagugcuucca

SEQ ID NO: 3791426 - RNA, 15 nt, Human
acugcccacccccuc

SEQ ID NO: 3791427 - RNA, 17 nt, Human
acugcccacccccucaa

SEQ ID NO: 3791428 - RNA, 16 nt, Human
acugcccagcggacag

SEQ ID NO: 3791429 - RNA, 17 nt, Human
acugcccaggcacugca

SEQ ID NO: 3791430 - RNA, 16 nt, Human
acugcccauggacagg

SEQ ID NO: 3791431 - RNA, 19 nt, Human
acugcccauggacaggcug

SEQ ID NO: 3791432 - RNA, 21 nt, Human
acugcccauggacaggcuggc

SEQ ID NO: 3791433 - RNA, 14 nt, Human
acccaugaaucaaa

SEQ ID NO: 3791434 - RNA, 17 nt, Human
acccaugaaucaaagac

SEQ ID NO: 3791435 - RNA, 18 nt, Human
acccaugcaagcagagga

SEQ ID NO: 3791436 - RNA, 22 nt, Human
acccaugcaagcagaggaccag

SEQ ID NO: 3791437 - RNA, 18 nt, Human
acccauggaaaaaugcca

SEQ ID NO: 3791438 - RNA, 16 nt, Human
acccaugggcucugac

SEQ ID NO: 3791439 - RNA, 22 nt, Human
acccauuaaggggaagaaugaa

SEQ ID NO: 3791440 - RNA, 21 nt, Human
acccauucagagacugucccu

SEQ ID NO: 3791441 - RNA, 17 nt, Human
acccauuccauuuaucu

SEQ ID NO: 3791442 - RNA, 17 nt, Human
acccauuccuauuucuu

SEQ ID NO: 3791443 - RNA, 15 nt, Human
acccauuccuuccca

SEQ ID NO: 3791444 - RNA, 16 nt, Human
acccauuccuucccag

SEQ ID NO: 3791445 - RNA, 13 nt, Human
acccauugcuguu

SEQ ID NO: 3791446 - RNA, 23 nt, Human
acccauuuaaauuuuuuuccuua

SEQ ID NO: 3791447 - RNA, 15 nt, Human
acccauuuguucaua

SEQ ID NO: 3791448 - RNA, 23 nt, Human
accccaaaauuagccaguaaucc

SEQ ID NO: 3791449 - RNA, 22 nt, Human
accccaacagcacccucuccag

SEQ ID NO: 3791450 - RNA, 14 nt, Human
accccaaccugcuc

SEQ ID NO: 3791451 - RNA, 20 nt, Human
accccaaccugcucuccucu

SEQ ID NO: 3791452 - RNA, 17 nt, Human
accccaacgcacaggaa

SEQ ID NO: 3791453 - RNA, 16 nt, Human
accccaagaggaaguu

SEQ ID NO: 3791454 - RNA, 21 nt, Human
accccaagccagcccggccgc

SEQ ID NO: 3791455 - RNA, 15 nt, Human
accccaagcgcccug

SEQ ID NO: 3791456 - RNA, 17 nt, Human
accccaaggagggagau

SEQ ID NO: 3791457 - RNA, 19 nt, Human
accccaccauaugaauugu

SEQ ID NO: 3791458 - RNA, 15 nt, Human
accccacccccaccc

SEQ ID NO: 3791459 - RNA, 12 nt, Human
accccacccccu

SEQ ID NO: 3791460 - RNA, 12 nt, Human
accccacccuca

SEQ ID NO: 3791461 - RNA, 18 nt, Human
accccacccucccuggag

SEQ ID NO: 3791462 - RNA, 19 nt, Human
accccacccuguuuggauu

SEQ ID NO: 3791463 - RNA, 13 nt, Human
accccacccuucc

SEQ ID NO: 3791464 - RNA, 16 nt, Human
accccacccuugccca

SEQ ID NO: 3791465 - RNA, 17 nt, Human
accccacccuugcccac

SEQ ID NO: 3791466 - RNA, 22 nt, Human
accccacccuugcccaccccac

SEQ ID NO: 3791467 - RNA, 11 nt, Human
accccaccugc

SEQ ID NO: 3791468 - RNA, 14 nt, Human
accccaccugcagg

SEQ ID NO: 3791469 - RNA, 12 nt, Human
accccaccugcg

SEQ ID NO: 3791470 - RNA, 16 nt, Human
accccacucacagaga

SEQ ID NO: 3791471 - RNA, 18 nt, Human
accccacucacagagaca

SEQ ID NO: 3791472 - RNA, 13 nt, Human
accccacucccac

SEQ ID NO: 3791473 - RNA, 22 nt, Human
accccacuuagccuuucuuuuc

SEQ ID NO: 3791474 - RNA, 19 nt, Human
accccagacuagauguagu

SEQ ID NO: 3791475 - RNA, 15 nt, Human
accccagagccacac

SEQ ID NO: 3791476 - RNA, 18 nt, Human
accccagagccacacaug

SEQ ID NO: 3791477 - RNA, 13 nt, Human
accccagagugug

SEQ ID NO: 3791478 - RNA, 13 nt, Human
accccagcauccu

SEQ ID NO: 3791479 - RNA, 12 nt, Human
accccagccuaa

SEQ ID NO: 3791480 - RNA, 21 nt, Human
accccagccucaaauccagga

SEQ ID NO: 3791481 - RNA, 22 nt, Human
accccagccuggccacgcagcc

SEQ ID NO: 3791482 - RNA, 14 nt, Human
accccagcucugcu

SEQ ID NO: 3791483 - RNA, 13 nt, Human
accccagcuggga

SEQ ID NO: 3791484 - RNA, 17 nt, Human
accccagcugggaggca

SEQ ID NO: 3791485 - RNA, 19 nt, Human
accccagcugugagccuug

SEQ ID NO: 3791486 - RNA, 21 nt, Human
accccagcugugagccuuggc

SEQ ID NO: 3791487 - RNA, 17 nt, Human
accccaggacgccacuc

SEQ ID NO: 3791488 - RNA, 19 nt, Human
accccaggcccacucaggg

SEQ ID NO: 3791489 - RNA, 12 nt, Human
accccaggcccc

SEQ ID NO: 3791490 - RNA, 15 nt, Human
accccaggccccgag

SEQ ID NO: 3791491 - RNA, 15 nt, Human
accccagggcagcca

SEQ ID NO: 3791492 - RNA, 17 nt, Human
accccagggcagccagg

SEQ ID NO: 3791493 - RNA, 21 nt, Human
accccagggcagccagggaga

SEQ ID NO: 3791494 - RNA, 11 nt, Human
accccagggcc

SEQ ID NO: 3791495 - RNA, 15 nt, Human
accccaguucugcuc

SEQ ID NO: 3791496 - RNA, 21 nt, Human
accccaguucugcuccucucc

SEQ ID NO: 3791497 - RNA, 18 nt, Human
accccaucccuccuuaag

SEQ ID NO: 3791498 - RNA, 17 nt, Human
accccaucccugucuuu

SEQ ID NO: 3791499 - RNA, 18 nt, Human
accccauccuccagggcu

SEQ ID NO: 3791500 - RNA, 17 nt, Human
accccaucugcauuccc

SEQ ID NO: 3791501 - RNA, 13 nt, Human
accccaucugccc

SEQ ID NO: 3791502 - RNA, 16 nt, Human
accccaugccaaagcu

SEQ ID NO: 3791503 - RNA, 17 nt, Human
accccaugcuguugauu

SEQ ID NO: 3791504 - RNA, 22 nt, Human
accccaugcuguugauugcuaa

SEQ ID NO: 3791505 - RNA, 21 nt, Human
accccauggugcuaggaagag

SEQ ID NO: 3791506 - RNA, 13 nt, Human
accccauucccgc

SEQ ID NO: 3791507 - RNA, 23 nt, Human
accccauucuuugcuugaacaca

SEQ ID NO: 3791508 - RNA, 14 nt, Human
accccauuucucuc

SEQ ID NO: 3791509 - RNA, 16 nt, Human
accccauuuucugugg

SEQ ID NO: 3791510 - RNA, 16 nt, Human
acccccaaggggcagu

SEQ ID NO: 3791511 - RNA, 12 nt, Human
acccccacacac

SEQ ID NO: 3791512 - RNA, 20 nt, Human
acccccacacacacacacau

SEQ ID NO: 3791513 - RNA, 15 nt, Human
acccccacaccucag

SEQ ID NO: 3791514 - RNA, 10 nt, Human
acccccacca

SEQ ID NO: 3791515 - RNA, 14 nt, Human
acccccaccccaca

SEQ ID NO: 3791516 - RNA, 16 nt, Human
acccccaccccacacu

SEQ ID NO: 3791517 - RNA, 16 nt, Human
acccccaccccuugcu

SEQ ID NO: 3791518 - RNA, 11 nt, Human
acccccacccu

SEQ ID NO: 3791519 - RNA, 18 nt, Human
acccccacucucauuccc

SEQ ID NO: 3791520 - RNA, 11 nt, Human
acccccagcaa

SEQ ID NO: 3791521 - RNA, 11 nt, Human
acccccagccc

SEQ ID NO: 3791522 - RNA, 20 nt, Human
acccccagccccgacuccag

SEQ ID NO: 3791523 - RNA, 21 nt, Human
acccccagccccgacuccagc

SEQ ID NO: 3791524 - RNA, 14 nt, Human
acccccagccuggg

SEQ ID NO: 3791525 - RNA, 15 nt, Human
acccccagccugggc

SEQ ID NO: 3791526 - RNA, 16 nt, Human
acccccagcuuugcua

SEQ ID NO: 3791527 - RNA, 15 nt, Human
acccccauucucauc

SEQ ID NO: 3791528 - RNA, 14 nt, Human
accccccaagcugu

SEQ ID NO: 3791529 - RNA, 22 nt, Human
accccccacacucacuccugag

SEQ ID NO: 3791530 - RNA, 12 nt, Human
accccccaccug

SEQ ID NO: 3791531 - RNA, 15 nt, Human
accccccagcacuga

SEQ ID NO: 3791532 - RNA, 14 nt, Human
accccccuguacac

SEQ ID NO: 3791533 - RNA, 19 nt, Human
accccccuguucuaagggg

SEQ ID NO: 3791534 - RNA, 20 nt, Human
accccccuuucacaggcagc

SEQ ID NO: 3791535 - RNA, 15 nt, Human
acccccgcccaggcu

SEQ ID NO: 3791536 - RNA, 20 nt, Human
acccccgcccaggcuggcca

SEQ ID NO: 3791537 - RNA, 14 nt, Human
acccccgcccccug

SEQ ID NO: 3791538 - RNA, 15 nt, Human
acccccgcccccugc

SEQ ID NO: 3791539 - RNA, 19 nt, Human
acccccgcccccugcccuc

SEQ ID NO: 3791540 - RNA, 20 nt, Human
acccccgcccccugcccucc

SEQ ID NO: 3791541 - RNA, 20 nt, Human
acccccguggggcagggagc

SEQ ID NO: 3791542 - RNA, 13 nt, Human
acccccucacccc

SEQ ID NO: 3791543 - RNA, 16 nt, Human
acccccucauuguuua

SEQ ID NO: 3791544 - RNA, 14 nt, Human
acccccucccaccc

SEQ ID NO: 3791545 - RNA, 16 nt, Human
acccccucccaccccc

SEQ ID NO: 3791546 - RNA, 17 nt, Human
acccccucccaccccca

SEQ ID NO: 3791547 - RNA, 13 nt, Human
acccccuccccag

SEQ ID NO: 3791548 - RNA, 15 nt, Human
acccccuccccgccc

SEQ ID NO: 3791549 - RNA, 14 nt, Human
acccccucccuggc

SEQ ID NO: 3791550 - RNA, 17 nt, Human
acccccucccuggccug

SEQ ID NO: 3791551 - RNA, 15 nt, Human
acccccuccucucug

SEQ ID NO: 3791552 - RNA, 15 nt, Human
acccccuccugcugc

SEQ ID NO: 3791553 - RNA, 19 nt, Human
acccccuccuucagacacc

SEQ ID NO: 3791554 - RNA, 15 nt, Human
acccccucucccugc

SEQ ID NO: 3791555 - RNA, 22 nt, Human
acccccucuucugagcacagau

SEQ ID NO: 3791556 - RNA, 11 nt, Human
acccccugaau

SEQ ID NO: 3791557 - RNA, 22 nt, Human
acccccugagauccccugagcc

SEQ ID NO: 3791558 - RNA, 14 nt, Human
acccccugcaaagc

SEQ ID NO: 3791559 - RNA, 13 nt, Human
acccccugcccug

SEQ ID NO: 3791560 - RNA, 18 nt, Human
acccccuucagugcccac

SEQ ID NO: 3791561 - RNA, 19 nt, Human
acccccuuccuacucccag

SEQ ID NO: 3791562 - RNA, 18 nt, Human
acccccuucuccauccac

SEQ ID NO: 3791563 - RNA, 19 nt, Human
acccccuucuccauccaca

SEQ ID NO: 3791564 - RNA, 16 nt, Human
acccccuucucugcuc

SEQ ID NO: 3791565 - RNA, 23 nt, Human
acccccuucucugcuccaccaca

SEQ ID NO: 3791566 - RNA, 14 nt, Human
acccccuucugggc

SEQ ID NO: 3791567 - RNA, 18 nt, Human
acccccuuugugcugugg

SEQ ID NO: 3791568 - RNA, 15 nt, Human
accccgacuuuuguu

SEQ ID NO: 3791569 - RNA, 15 nt, Human
accccgcagacaccu

SEQ ID NO: 3791570 - RNA, 17 nt, Human
accccgcagacaccuug

SEQ ID NO: 3791571 - RNA, 20 nt, Human
accccgcagacaccuuggac

SEQ ID NO: 3791572 - RNA, 21 nt, Human
accccgcucugcaugcggccc

SEQ ID NO: 3791573 - RNA, 14 nt, Human
accccggcaggccc

SEQ ID NO: 3791574 - RNA, 17 nt, Human
accccggcaggcccugc

SEQ ID NO: 3791575 - RNA, 18 nt, Human
accccggcaggcccugca

SEQ ID NO: 3791576 - RNA, 21 nt, Human
accccggcaggcccugcagug

SEQ ID NO: 3791577 - RNA, 15 nt, Human
accccggccaccugc

SEQ ID NO: 3791578 - RNA, 13 nt, Human
accccgggcgggu

SEQ ID NO: 3791579 - RNA, 13 nt, Human
accccgggcucuc

SEQ ID NO: 3791580 - RNA, 13 nt, Human
acccucccagacc

SEQ ID NO: 3791581 - RNA, 15 nt, Human
acccucccagaccug

SEQ ID NO: 3791582 - RNA, 16 nt, Human
acccucccauggcacc

SEQ ID NO: 3791583 - RNA, 17 nt, Human
acccucccauggcaccu

SEQ ID NO: 3791584 - RNA, 23 nt, Human
acccuccccgcaccccccaagcu

SEQ ID NO: 3791585 - RNA, 12 nt, Human
acccuccccucu

SEQ ID NO: 3791586 - RNA, 13 nt, Human
acccuccccucuc

SEQ ID NO: 3791587 - RNA, 15 nt, Human
acccuccccuuccca

SEQ ID NO: 3791588 - RNA, 14 nt, Human
acccucccucagcc

SEQ ID NO: 3791589 - RNA, 18 nt, Human
acccucccucagccccuc

SEQ ID NO: 3791590 - RNA, 20 nt, Human
acccucccugcuguccccuc

SEQ ID NO: 3791591 - RNA, 21 nt, Human
acccucccugcuguccccucu

SEQ ID NO: 3791592 - RNA, 13 nt, Human
acccucccuggag

SEQ ID NO: 3791593 - RNA, 14 nt, Human
acccucccuggagu

SEQ ID NO: 3791594 - RNA, 15 nt, Human
acccuccgccuucac

SEQ ID NO: 3791595 - RNA, 19 nt, Human
acccuccuccagaccauuc

SEQ ID NO: 3791596 - RNA, 11 nt, Human
acccuccuggc

SEQ ID NO: 3791597 - RNA, 15 nt, Human
acccuccuggccuca

SEQ ID NO: 3791598 - RNA, 13 nt, Human
acccuccuggcuc

SEQ ID NO: 3791599 - RNA, 20 nt, Human
acuuccauggcccucauuaa

SEQ ID NO: 3791600 - RNA, 22 nt, Human
acuucccaguucaggaguccca

SEQ ID NO: 3791601 - RNA, 23 nt, Human
acuucccaguucaggagucccaa

SEQ ID NO: 3791602 - RNA, 18 nt, Human
acuuccccaauaucuugc

SEQ ID NO: 3791603 - RNA, 20 nt, Human
acuuccccauggcccugagc

SEQ ID NO: 3791604 - RNA, 21 nt, Human
acuucccccaaauuuaaagaa

SEQ ID NO: 3791605 - RNA, 22 nt, Human
acuuccccgcauuccaggcucc

SEQ ID NO: 3791606 - RNA, 16 nt, Human
acuuccccuccuaccc

SEQ ID NO: 3791607 - RNA, 19 nt, Human
acuucccgggccagggcug

SEQ ID NO: 3791608 - RNA, 20 nt, Human
acuucccucuguuucucuuu

SEQ ID NO: 3791609 - RNA, 22 nt, Human
acuucccugacacugcggggcu

SEQ ID NO: 3791610 - RNA, 22 nt, Human
acuucccugauugaccugcucc

SEQ ID NO: 3791611 - RNA, 13 nt, Human
acuucccugggca

SEQ ID NO: 3791612 - RNA, 14 nt, Human
acuucccuuucugc

SEQ ID NO: 3791613 - RNA, 16 nt, Human
acuuccgucacauccc

SEQ ID NO: 3791614 - RNA, 20 nt, Human
acuuccuaaauauuaugaga

SEQ ID NO: 3791615 - RNA, 17 nt, Human
acuuccucgccucuccc

SEQ ID NO: 3791616 - RNA, 19 nt, Human
acuuccugccuggucuccu

SEQ ID NO: 3791617 - RNA, 17 nt, Human
acuuccuguccagagag

SEQ ID NO: 3791618 - RNA, 22 nt, Human
acuuccuguccagcuccaaccu

SEQ ID NO: 3791619 - RNA, 17 nt, Human
acuuccuguuugggccc

SEQ ID NO: 3791620 - RNA, 22 nt, Human
acuuccuuacuaagcauagcaa

SEQ ID NO: 3791621 - RNA, 15 nt, Human
acuuccuuacuuuua

SEQ ID NO: 3791622 - RNA, 18 nt, Human
acuuccuuaugcuucuuu

SEQ ID NO: 3791623 - RNA, 14 nt, Human
acuuccuugagaca

SEQ ID NO: 3791624 - RNA, 23 nt, Human
acuucgacacuguucuuagcuca

SEQ ID NO: 3791625 - RNA, 17 nt, Human
acuucgcaucaaaagac

SEQ ID NO: 3791626 - RNA, 15 nt, Human
acuucggccagagcu

SEQ ID NO: 3791627 - RNA, 19 nt, Human
acuucgggaaggugucugg

SEQ ID NO: 3791628 - RNA, 17 nt, Human
acuucggggcugggaag

SEQ ID NO: 3791629 - RNA, 19 nt, Human
acuucgucuucuaauuuca

SEQ ID NO: 3791630 - RNA, 22 nt, Human
acuucgugggaucugccccucc

SEQ ID NO: 3791631 - RNA, 20 nt, Human
acuucguuuaaugaaugcuu

SEQ ID NO: 3791632 - RNA, 16 nt, Human
acuucuaaaacuguac

SEQ ID NO: 3791633 - RNA, 17 nt, Human
acuucuaagaaaagccu

SEQ ID NO: 3791634 - RNA, 17 nt, Human
acuucuaauugccaugu

SEQ ID NO: 3791635 - RNA, 17 nt, Human
acuucucaggacacagg

SEQ ID NO: 3791636 - RNA, 21 nt, Human
acuucucaggacacaggccug

SEQ ID NO: 3791637 - RNA, 18 nt, Human
acuucucaucacacacau

SEQ ID NO: 3791638 - RNA, 20 nt, Human
acuucucauuuuuuaaaaaa

SEQ ID NO: 3791639 - RNA, 15 nt, Human
acuucuccacccugc

SEQ ID NO: 3791640 - RNA, 15 nt, Human
acuucuccagccuag

SEQ ID NO: 3791641 - RNA, 22 nt, Human
acuucuccauccuuucugccuc

SEQ ID NO: 3791642 - RNA, 14 nt, Human
acuucucugaaggg

SEQ ID NO: 3791643 - RNA, 23 nt, Human
acuucucugccuuugacauuuaa

SEQ ID NO: 3791644 - RNA, 20 nt, Human
acuucucuuaaacuugugaa

SEQ ID NO: 3791645 - RNA, 14 nt, Human
acuucucuuccuug

SEQ ID NO: 3791646 - RNA, 16 nt, Human
acuucucuugcuuucu

SEQ ID NO: 3791647 - RNA, 21 nt, Human
acuucucuuguuagguaauuu

SEQ ID NO: 3791648 - RNA, 17 nt, Human
acuucucuuugccucaa

SEQ ID NO: 3791649 - RNA, 19 nt, Human
acuucugcuuuccacaccu

SEQ ID NO: 3791650 - RNA, 22 nt, Human
acuucugcuuuccacaccuggc

SEQ ID NO: 3791651 - RNA, 21 nt, Human
acuucuguaauuguguggauu

SEQ ID NO: 3791652 - RNA, 23 nt, Human
acuucugugagacccccacaccu

SEQ ID NO: 3791653 - RNA, 23 nt, Human
acuucuguuuucaaucucguaua

SEQ ID NO: 3791654 - RNA, 17 nt, Human
acuucuuauacauuuga

SEQ ID NO: 3791655 - RNA, 23 nt, Human
acuucuuauggaauugauuugca

SEQ ID NO: 3791656 - RNA, 21 nt, Human
acuucuucagagcugacacag

SEQ ID NO: 3791657 - RNA, 18 nt, Human
acuucuucucuuagauuc

SEQ ID NO: 3791658 - RNA, 13 nt, Human
acuucuucuguaa

SEQ ID NO: 3791659 - RNA, 12 nt, Human
acuucuugaagg

SEQ ID NO: 3791660 - RNA, 13 nt, Human
acuucuugaaggu

SEQ ID NO: 3791661 - RNA, 21 nt, Human
acuucuugaauauaaaaaauc

SEQ ID NO: 3791662 - RNA, 23 nt, Human
acuucuugaauauaaaaaaucau

SEQ ID NO: 3791663 - RNA, 18 nt, Human
acuucuugcuucuuucua

SEQ ID NO: 3791664 - RNA, 20 nt, Human
acuucuugcuucuuucuaga

SEQ ID NO: 3791665 - RNA, 15 nt, Human
acuucuugucagaca

SEQ ID NO: 3791666 - RNA, 17 nt, Human
acuucuugucagacaua

SEQ ID NO: 3791667 - RNA, 21 nt, Human
acuucuugucagacauaaagc

SEQ ID NO: 3791668 - RNA, 22 nt, Human
acuucuugucagacauaaagcc

SEQ ID NO: 3791669 - RNA, 19 nt, Human
acuucuuguguguaugcac

SEQ ID NO: 3791670 - RNA, 15 nt, Human
acuucuuucagcaga

SEQ ID NO: 3791671 - RNA, 17 nt, Human
acuucuuucccuuccuc

SEQ ID NO: 3791672 - RNA, 15 nt, Human
acuucuuuuauaacu

SEQ ID NO: 3791673 - RNA, 20 nt, Human
acuucuuuugcucuuagcug

SEQ ID NO: 3791674 - RNA, 23 nt, Human
acuucuuuuuuuuuauuuuuaga

SEQ ID NO: 3791675 - RNA, 14 nt, Human
acuugaaaauuaac

SEQ ID NO: 3791676 - RNA, 17 nt, Human
acuugaaaauuaacaug

SEQ ID NO: 3791677 - RNA, 20 nt, Human
acuugaaagcauccaugugu

SEQ ID NO: 3791678 - RNA, 20 nt, Human
acuugaaauauccugcuuga

SEQ ID NO: 3791679 - RNA, 17 nt, Human
acuugaaauuauaucug

SEQ ID NO: 3791680 - RNA, 20 nt, Human
acuugaaauuugaauuuugu

SEQ ID NO: 3791681 - RNA, 15 nt, Human
acuugaacaaaaggg

SEQ ID NO: 3791682 - RNA, 17 nt, Human
acuugaacaaaaggguc

SEQ ID NO: 3791683 - RNA, 20 nt, Human
acuugaacaaaagggucaga

SEQ ID NO: 3791684 - RNA, 21 nt, Human
acuugaacaaaagggucagag

SEQ ID NO: 3791685 - RNA, 15 nt, Human
acuugaaccauaaaa

SEQ ID NO: 3791686 - RNA, 19 nt, Human
acuugaaccauaaaauguc

SEQ ID NO: 3791687 - RNA, 20 nt, Human
acuugaaccauaaaaugucc

SEQ ID NO: 3791688 - RNA, 19 nt, Human
acuugaaccauaguuacug

SEQ ID NO: 3791689 - RNA, 20 nt, Human
acuugaacguuuucuaauug

SEQ ID NO: 3791690 - RNA, 18 nt, Human
acuugaacuucaccugca

SEQ ID NO: 3791691 - RNA, 12 nt, Human
acuugaacuugu

SEQ ID NO: 3791692 - RNA, 21 nt, Human
acuugaagggccagagccagg

SEQ ID NO: 3791693 - RNA, 22 nt, Human
acuugaaguuguuacuaacuaa

SEQ ID NO: 3791694 - RNA, 19 nt, Human
acuugaauaaccaucugaa

SEQ ID NO: 3791695 - RNA, 16 nt, Human
acuugaaucaaagcag

SEQ ID NO: 3791696 - RNA, 20 nt, Human
acuugaaugaaaauguccau

SEQ ID NO: 3791697 - RNA, 24 nt, Human
acuugaaugcuaguuauacuuauu

SEQ ID NO: 3791698 - RNA, 19 nt, Human
acuugaauuuucccacugc

SEQ ID NO: 3791699 - RNA, 13 nt, Human
acuugacagugga

SEQ ID NO: 3791700 - RNA, 18 nt, Human
acuugacccugagcugac

SEQ ID NO: 3791701 - RNA, 17 nt, Human
acuugagaacuugacaa

SEQ ID NO: 3791702 - RNA, 19 nt, Human
acuugagaauuacccuuuu

SEQ ID NO: 3791703 - RNA, 14 nt, Human
acuugagaccuaau

SEQ ID NO: 3791704 - RNA, 19 nt, Human
acuugagaggaugaaugua

SEQ ID NO: 3791705 - RNA, 16 nt, Human
acuugagaugauuucc

SEQ ID NO: 3791706 - RNA, 21 nt, Human
acuugagauguaugaaggcuu

SEQ ID NO: 3791707 - RNA, 22 nt, Human
acuugagauguaugaaggcuuu

SEQ ID NO: 3791708 - RNA, 21 nt, Human
acuugagcgugaaucuguauc

SEQ ID NO: 3791709 - RNA, 13 nt, Human
acuugaggacaca

SEQ ID NO: 3791710 - RNA, 16 nt, Human
acuugaggacacaugu

SEQ ID NO: 3791711 - RNA, 15 nt, Human
acuugagggcccaga

SEQ ID NO: 3791712 - RNA, 16 nt, Human
acuugagggcccagag

SEQ ID NO: 3791713 - RNA, 19 nt, Human
acuugaggguaauaaacuu

SEQ ID NO: 3791714 - RNA, 18 nt, Human
acuugaguaaaauacucu

SEQ ID NO: 3791715 - RNA, 16 nt, Human
acuugaguguaauguu

SEQ ID NO: 3791716 - RNA, 21 nt, Human
acuugaguuacaccagaccug

SEQ ID NO: 3791717 - RNA, 15 nt, Human
acuugaguuuuauuu

SEQ ID NO: 3791718 - RNA, 23 nt, Human
acuugauaagggacugauguuug

SEQ ID NO: 3791719 - RNA, 22 nt, Human
acuugaugaguguaacaagaaa

SEQ ID NO: 3791720 - RNA, 14 nt, Human
acuugaugcaugug

SEQ ID NO: 3791721 - RNA, 19 nt, Human
acuugauggcuccgaacac

SEQ ID NO: 3791722 - RNA, 16 nt, Human
acuugauggucagaca

SEQ ID NO: 3791723 - RNA, 22 nt, Human
agaauaaauacuguuuuacugu

SEQ ID NO: 3791724 - RNA, 16 nt, Human
agaauaaggcaggcau

SEQ ID NO: 3791725 - RNA, 21 nt, Human
agaauaagucauguuccuuca

SEQ ID NO: 3791726 - RNA, 20 nt, Human
agaauaaucacgcuuuccug

SEQ ID NO: 3791727 - RNA, 16 nt, Human
agaauaaucuuugggu

SEQ ID NO: 3791728 - RNA, 14 nt, Human
agaauaauguucua

SEQ ID NO: 3791729 - RNA, 19 nt, Human
agaauaauguucuauugug

SEQ ID NO: 3791730 - RNA, 17 nt, Human
agaauaccacaucaaau

SEQ ID NO: 3791731 - RNA, 18 nt, Human
agaauaccacaucaaaua

SEQ ID NO: 3791732 - RNA, 15 nt, Human
agaauacuucucauu

SEQ ID NO: 3791733 - RNA, 14 nt, Human
agaauacuugaacu

SEQ ID NO: 3791734 - RNA, 15 nt, Human
agaauacuugaacuu

SEQ ID NO: 3791735 - RNA, 14 nt, Human
agaauacuuuucuc

SEQ ID NO: 3791736 - RNA, 14 nt, Human
agaauagaaagaaa

SEQ ID NO: 3791737 - RNA, 22 nt, Human
agaauagaaauaaaggauguga

SEQ ID NO: 3791738 - RNA, 14 nt, Human
agaauagaaggaaa

SEQ ID NO: 3791739 - RNA, 15 nt, Human
agaauagaaggaaac

SEQ ID NO: 3791740 - RNA, 16 nt, Human
agaauagaugcugacu

SEQ ID NO: 3791741 - RNA, 19 nt, Human
agaauagcaucuguacaaa

SEQ ID NO: 3791742 - RNA, 19 nt, Human
agaauagccacauuuggaa

SEQ ID NO: 3791743 - RNA, 21 nt, Human
agaauagccacauuuggaaua

SEQ ID NO: 3791744 - RNA, 15 nt, Human
agaauaggacuuguu

SEQ ID NO: 3791745 - RNA, 21 nt, Human
agaauaggacuuguuuuuguu

SEQ ID NO: 3791746 - RNA, 19 nt, Human
agaauaggcauuaacacaa

SEQ ID NO: 3791747 - RNA, 16 nt, Human
agaauauaaaaaacuu

SEQ ID NO: 3791748 - RNA, 15 nt, Human
agaauauaacaugaa

SEQ ID NO: 3791749 - RNA, 16 nt, Human
agaauauaacaugaaa

SEQ ID NO: 3791750 - RNA, 13 nt, Human
agaauauaauacu

SEQ ID NO: 3791751 - RNA, 17 nt, Human
agaauauaauuaucgga

SEQ ID NO: 3791752 - RNA, 15 nt, Human
agaauauauauauau

SEQ ID NO: 3791753 - RNA, 12 nt, Human
agaauauauuua

SEQ ID NO: 3791754 - RNA, 20 nt, Human
agaauauauuuauuuaaagc

SEQ ID NO: 3791755 - RNA, 23 nt, Human
agaauauauuuauuuaaagcauu

SEQ ID NO: 3791756 - RNA, 20 nt, Human
agaauaucaagaugauucug

SEQ ID NO: 3791757 - RNA, 16 nt, Human
agaauaucacagaaaa

SEQ ID NO: 3791758 - RNA, 19 nt, Human
agaauauccuacuucucca

SEQ ID NO: 3791759 - RNA, 12 nt, Human
agaauaugccuu

SEQ ID NO: 3791760 - RNA, 17 nt, Human
agaauauguuucaaacu

SEQ ID NO: 3791761 - RNA, 13 nt, Human
agaauauguuucc

SEQ ID NO: 3791762 - RNA, 15 nt, Human
agaauauguuuccuu

SEQ ID NO: 3791763 - RNA, 18 nt, Human
agaauauguuuccuuguu

SEQ ID NO: 3791764 - RNA, 19 nt, Human
agaauauuagcuuuacugu

SEQ ID NO: 3791765 - RNA, 20 nt, Human
agaauauuagcuuuacuguu

SEQ ID NO: 3791766 - RNA, 14 nt, Human
agaauauucagaca

SEQ ID NO: 3791767 - RNA, 15 nt, Human
agaauauugcaaaau

SEQ ID NO: 3791768 - RNA, 18 nt, Human
agaauauugcaaaauaca

SEQ ID NO: 3791769 - RNA, 15 nt, Human
agaauauuguuccua

SEQ ID NO: 3791770 - RNA, 16 nt, Human
agaauauuguuccuaa

SEQ ID NO: 3791771 - RNA, 16 nt, Human
agaauauuuauuaccu

SEQ ID NO: 3791772 - RNA, 17 nt, Human
agaauauuucuauugaa

SEQ ID NO: 3791773 - RNA, 19 nt, Human
agaauauuucuauugaauu

SEQ ID NO: 3791774 - RNA, 14 nt, Human
agaauauuuuaagu

SEQ ID NO: 3791775 - RNA, 14 nt, Human
agaaucaaacauuu

SEQ ID NO: 3791776 - RNA, 21 nt, Human
agaaucaacauuucucaauaa

SEQ ID NO: 3791777 - RNA, 14 nt, Human
agaaucaaucagua

SEQ ID NO: 3791778 - RNA, 16 nt, Human
agaaucacaggcuggg

SEQ ID NO: 3791779 - RNA, 17 nt, Human
agaaucagaagauaguc

SEQ ID NO: 3791780 - RNA, 17 nt, Human
agaaucagaguagaaau

SEQ ID NO: 3791781 - RNA, 18 nt, Human
agaaucagaguagaaaua

SEQ ID NO: 3791782 - RNA, 19 nt, Human
agaaucagucuauccacag

SEQ ID NO: 3791783 - RNA, 16 nt, Human
agaaucagugcaaaga

SEQ ID NO: 3791784 - RNA, 20 nt, Human
agaaucauaugauucugcuu

SEQ ID NO: 3791785 - RNA, 18 nt, Human
agaaucaugugaacccgg

SEQ ID NO: 3791786 - RNA, 21 nt, Human
agaaucaugugcgucagucca

SEQ ID NO: 3791787 - RNA, 16 nt, Human
agaaucauguuucuuu

SEQ ID NO: 3791788 - RNA, 19 nt, Human
agaaucauguuucuuugau

SEQ ID NO: 3791789 - RNA, 13 nt, Human
agaaucauuaccu

SEQ ID NO: 3791790 - RNA, 17 nt, Human
agaaucauuauuuauua

SEQ ID NO: 3791791 - RNA, 22 nt, Human
agaaucauuauuuauuaaauuu

SEQ ID NO: 3791792 - RNA, 13 nt, Human
agaaucauuguaa

SEQ ID NO: 3791793 - RNA, 15 nt, Human
agaaucauuuagcau

SEQ ID NO: 3791794 - RNA, 18 nt, Human
agaauccaagugaacacu

SEQ ID NO: 3791795 - RNA, 18 nt, Human
agaauccacauuucuaaa

SEQ ID NO: 3791796 - RNA, 22 nt, Human
agaauccacccauccuaccaau

SEQ ID NO: 3791797 - RNA, 15 nt, Human
agaaucccaaauuug

SEQ ID NO: 3791798 - RNA, 18 nt, Human
agaaucccaaauuugauu

SEQ ID NO: 3791799 - RNA, 12 nt, Human
agaaucccagcc

SEQ ID NO: 3791800 - RNA, 19 nt, Human
agaaucccuagacuuuagg

SEQ ID NO: 3791801 - RNA, 16 nt, Human
agaaucccucuacaug

SEQ ID NO: 3791802 - RNA, 14 nt, Human
agaaagugccuuuc

SEQ ID NO: 3791803 - RNA, 16 nt, Human
agaaagugccuuucag

SEQ ID NO: 3791804 - RNA, 21 nt, Human
agaaagugccuuucaggaucu

SEQ ID NO: 3791805 - RNA, 20 nt, Human
agaaagugggugagaugcug

SEQ ID NO: 3791806 - RNA, 14 nt, Human
agaaaguggugcuc

SEQ ID NO: 3791807 - RNA, 16 nt, Human
agaaaguguauuugga

SEQ ID NO: 3791808 - RNA, 16 nt, Human
agaaagugugcuuuau

SEQ ID NO: 3791809 - RNA, 14 nt, Human
agaaaguguucugu

SEQ ID NO: 3791810 - RNA, 20 nt, Human
agaaaguguucuguuacaaa

SEQ ID NO: 3791811 - RNA, 17 nt, Human
agaaaguugcacggcug

SEQ ID NO: 3791812 - RNA, 21 nt, Human
agaaaguugcacggcugcuga

SEQ ID NO: 3791813 - RNA, 12 nt, Human
agaaaguuuccc

SEQ ID NO: 3791814 - RNA, 14 nt, Human
agaaauaaaacugu

SEQ ID NO: 3791815 - RNA, 19 nt, Human
agaaauaaaaggaagccaa

SEQ ID NO: 3791816 - RNA, 20 nt, Human
agaaauaaaaggaagccaaa

SEQ ID NO: 3791817 - RNA, 13 nt, Human
agaaauaaaccaa

SEQ ID NO: 3791818 - RNA, 17 nt, Human
agaaauaaaccuuaaua

SEQ ID NO: 3791819 - RNA, 23 nt, Human
agaaauaaaccuuaauauuucuu

SEQ ID NO: 3791820 - RNA, 19 nt, Human
agaaauaaagagaagauau

SEQ ID NO: 3791821 - RNA, 15 nt, Human
agaaauaaaguuucu

SEQ ID NO: 3791822 - RNA, 19 nt, Human
agaaauaaauagcuauauc

SEQ ID NO: 3791823 - RNA, 22 nt, Human
agaaauaaauagcuauauccau

SEQ ID NO: 3791824 - RNA, 14 nt, Human
agaaauaaauauac

SEQ ID NO: 3791825 - RNA, 21 nt, Human
agaaauaaauccacccauguu

SEQ ID NO: 3791826 - RNA, 17 nt, Human
agaaauaaauuuauuuc

SEQ ID NO: 3791827 - RNA, 17 nt, Human
agaaauaagugguuauu

SEQ ID NO: 3791828 - RNA, 16 nt, Human
agaaauaaguuuuugu

SEQ ID NO: 3791829 - RNA, 23 nt, Human
agaaauaaguuuuuguuucacag

SEQ ID NO: 3791830 - RNA, 15 nt, Human
agaaauaauaugcau

SEQ ID NO: 3791831 - RNA, 23 nt, Human
agaaauacaaaaauacucagaua

SEQ ID NO: 3791832 - RNA, 16 nt, Human
agaaauacagacugga

SEQ ID NO: 3791833 - RNA, 17 nt, Human
agaaauacaguacuguu

SEQ ID NO: 3791834 - RNA, 14 nt, Human
agaaauacagucuu

SEQ ID NO: 3791835 - RNA, 19 nt, Human
agaaauacagucuuccaca

SEQ ID NO: 3791836 - RNA, 23 nt, Human
agaaauacuacuguguaagggcc

SEQ ID NO: 3791837 - RNA, 13 nt, Human
agaaauagacaaa

SEQ ID NO: 3791838 - RNA, 18 nt, Human
agaaauagacaaaaagua

SEQ ID NO: 3791839 - RNA, 22 nt, Human
agaaauagacaaaaaguauauu

SEQ ID NO: 3791840 - RNA, 20 nt, Human
agaaauagccugcgcuguuu

SEQ ID NO: 3791841 - RNA, 20 nt, Human
agaaauagcuuaugaaaaga

SEQ ID NO: 3791842 - RNA, 16 nt, Human
agaaauaguucuguga

SEQ ID NO: 3791843 - RNA, 23 nt, Human
agaaauaguuugagaaaugcaua

SEQ ID NO: 3791844 - RNA, 20 nt, Human
agaaauauaauaaaaugugu

SEQ ID NO: 3791845 - RNA, 12 nt, Human
agaaauaucugu

SEQ ID NO: 3791846 - RNA, 14 nt, Human
agaaauaucuguga

SEQ ID NO: 3791847 - RNA, 23 nt, Human
agaaauaucugugaaauaucauc

SEQ ID NO: 3791848 - RNA, 15 nt, Human
agaaauaugauuuua

SEQ ID NO: 3791849 - RNA, 14 nt, Human
agaaauauggacac

SEQ ID NO: 3791850 - RNA, 15 nt, Human
agaaauaugugguuu

SEQ ID NO: 3791851 - RNA, 15 nt, Human
agaaauauuuuaaaa

SEQ ID NO: 3791852 - RNA, 14 nt, Human
agaaauauuuuaau

SEQ ID NO: 3791853 - RNA, 15 nt, Human
agaaaucaauaguug

SEQ ID NO: 3791854 - RNA, 19 nt, Human
agaaaucaauaguugaauu

SEQ ID NO: 3791855 - RNA, 11 nt, Human
agaaaucaugu

SEQ ID NO: 3791856 - RNA, 17 nt, Human
agaaaucauguuaugau

SEQ ID NO: 3791857 - RNA, 21 nt, Human
agaaaucauguuaugauaaaa

SEQ ID NO: 3791858 - RNA, 16 nt, Human
agaaauccauaucuua

SEQ ID NO: 3791859 - RNA, 22 nt, Human
agaaaucccuguuuaauauuua

SEQ ID NO: 3791860 - RNA, 12 nt, Human
agaaaucuaaaa

SEQ ID NO: 3791861 - RNA, 19 nt, Human
agaaaucuauagaaagugu

SEQ ID NO: 3791862 - RNA, 13 nt, Human
agaaaucugaaaa

SEQ ID NO: 3791863 - RNA, 13 nt, Human
agaaaucuguuuu

SEQ ID NO: 3791864 - RNA, 14 nt, Human
agaaaugaaagcag

SEQ ID NO: 3791865 - RNA, 19 nt, Human
agaaaugaaauuuuaccaa

SEQ ID NO: 3791866 - RNA, 20 nt, Human
agaaaugaaauuuuaccaag

SEQ ID NO: 3791867 - RNA, 23 nt, Human
agaaaugaaauuuuaccaaguua

SEQ ID NO: 3791868 - RNA, 23 nt, Human
agaagcccccagcuaagaaccug

SEQ ID NO: 3791869 - RNA, 14 nt, Human
agaagcccggcucc

SEQ ID NO: 3791870 - RNA, 16 nt, Human
agaagcccggcuccug

SEQ ID NO: 3791871 - RNA, 13 nt, Human
agaagcccugaug

SEQ ID NO: 3791872 - RNA, 14 nt, Human
agaagccgggaaca

SEQ ID NO: 3791873 - RNA, 22 nt, Human
agaagccgggaacagacaacag

SEQ ID NO: 3791874 - RNA, 15 nt, Human
agaagccuauuguaa

SEQ ID NO: 3791875 - RNA, 15 nt, Human
agaagccuccccagc

SEQ ID NO: 3791876 - RNA, 13 nt, Human
agaagccucuggc

SEQ ID NO: 3791877 - RNA, 23 nt, Human
agaagccucugggucaguggucc

SEQ ID NO: 3791878 - RNA, 12 nt, Human
agaagccugagg

SEQ ID NO: 3791879 - RNA, 14 nt, Human
agaagccugaggcu

SEQ ID NO: 3791880 - RNA, 17 nt, Human
agaagccugaugcugac

SEQ ID NO: 3791881 - RNA, 14 nt, Human
agaagccugggggc

SEQ ID NO: 3791882 - RNA, 17 nt, Human
agaagccugggggccug

SEQ ID NO: 3791883 - RNA, 20 nt, Human
agaagccugggggccuggcu

SEQ ID NO: 3791884 - RNA, 16 nt, Human
agaagccuguuuuguu

SEQ ID NO: 3791885 - RNA, 17 nt, Human
agaagccuucaagcucu

SEQ ID NO: 3791886 - RNA, 14 nt, Human
agaagccuucagcu

SEQ ID NO: 3791887 - RNA, 19 nt, Human
agaagccuucagcuccagg

SEQ ID NO: 3791888 - RNA, 19 nt, Human
agaagcgauuuaaguuaca

SEQ ID NO: 3791889 - RNA, 19 nt, Human
agaagcgugagacgccacc

SEQ ID NO: 3791890 - RNA, 18 nt, Human
agaagcuaagguuuagau

SEQ ID NO: 3791891 - RNA, 21 nt, Human
agaagcuauaaauuccucuuu

SEQ ID NO: 3791892 - RNA, 15 nt, Human
agaagcucccaggaa

SEQ ID NO: 3791893 - RNA, 16 nt, Human
agaagcucccccagca

SEQ ID NO: 3791894 - RNA, 23 nt, Human
agaagcucccugaaguaagcaaa

SEQ ID NO: 3791895 - RNA, 19 nt, Human
agaagcucucgggcuagga

SEQ ID NO: 3791896 - RNA, 22 nt, Human
agaagcugccaggugagaaacu

SEQ ID NO: 3791897 - RNA, 13 nt, Human
agaagcugcucaa

SEQ ID NO: 3791898 - RNA, 23 nt, Human
agaagcugcucaacuugcaaaau

SEQ ID NO: 3791899 - RNA, 22 nt, Human
agaagcugcuccaggccugcag

SEQ ID NO: 3791900 - RNA, 17 nt, Human
agaagcugcucuggaau

SEQ ID NO: 3791901 - RNA, 13 nt, Human
agaagcuguagua

SEQ ID NO: 3791902 - RNA, 14 nt, Human
agaagcuguuguac

SEQ ID NO: 3791903 - RNA, 18 nt, Human
agaagcuguuguacauuu

SEQ ID NO: 3791904 - RNA, 13 nt, Human
agaagcuuaggca

SEQ ID NO: 3791905 - RNA, 16 nt, Human
agaagcuuaggcaggg

SEQ ID NO: 3791906 - RNA, 17 nt, Human
agaagcuucagaaguuu

SEQ ID NO: 3791907 - RNA, 18 nt, Human
agaagcuuccauuccaag

SEQ ID NO: 3791908 - RNA, 9 nt, Human
agaaggaag

SEQ ID NO: 3791909 - RNA, 20 nt, Human
agaaggaaggcagggaggag

SEQ ID NO: 3791910 - RNA, 13 nt, Human
agaaggaagggca

SEQ ID NO: 3791911 - RNA, 22 nt, Human
agaaggaauucuaggcauccca

SEQ ID NO: 3791912 - RNA, 15 nt, Human
agaaggagaaggaag

SEQ ID NO: 3791913 - RNA, 14 nt, Human
agaaggagacagag

SEQ ID NO: 3791914 - RNA, 20 nt, Human
agaaggagacagagcugguu

SEQ ID NO: 3791915 - RNA, 13 nt, Human
agaaggagagaaa

SEQ ID NO: 3791916 - RNA, 19 nt, Human
agaaggaggagagggaaaa

SEQ ID NO: 3791917 - RNA, 14 nt, Human
agaaggaugaauga

SEQ ID NO: 3791918 - RNA, 17 nt, Human
agaaggauguacauuuc

SEQ ID NO: 3791919 - RNA, 11 nt, Human
agaaggcaaaa

SEQ ID NO: 3791920 - RNA, 13 nt, Human
agaaggcaauauu

SEQ ID NO: 3791921 - RNA, 15 nt, Human
agaaggcagggaaag

SEQ ID NO: 3791922 - RNA, 19 nt, Human
agaaggcauggacuucugg

SEQ ID NO: 3791923 - RNA, 18 nt, Human
agaaggcauuugcagggu

SEQ ID NO: 3791924 - RNA, 13 nt, Human
agaaggccaagag

SEQ ID NO: 3791925 - RNA, 18 nt, Human
agaaggcucuucugacua

SEQ ID NO: 3791926 - RNA, 15 nt, Human
agaagggaaacaguc

SEQ ID NO: 3791927 - RNA, 18 nt, Human
agaagggaauccuccucc

SEQ ID NO: 3791928 - RNA, 11 nt, Human
agaagggaggc

SEQ ID NO: 3791929 - RNA, 16 nt, Human
agaagggagggcagag

SEQ ID NO: 3791930 - RNA, 21 nt, Human
agaagggcuagaaccuggaga

SEQ ID NO: 3791931 - RNA, 23 nt, Human
agaagggcuagaaccuggagagc

SEQ ID NO: 3791932 - RNA, 15 nt, Human
agaaggggaagcacu

SEQ ID NO: 3791933 - RNA, 15 nt, Human
agaaggggacugcca

SEQ ID NO: 3791934 - RNA, 16 nt, Human
agaaggggacugccac

SEQ ID NO: 3791935 - RNA, 21 nt, Human
agaaggggcgggaauauuguu

SEQ ID NO: 3791936 - RNA, 17 nt, Human
agaagggggccaugagg

SEQ ID NO: 3791937 - RNA, 20 nt, Human
agaagggggucaaagcaagg

SEQ ID NO: 3791938 - RNA, 15 nt, Human
agaaggguccuuccc

SEQ ID NO: 3791939 - RNA, 18 nt, Human
agaaggguccuucccucu

SEQ ID NO: 3791940 - RNA, 20 nt, Human
agaaggguccuucccucucc

SEQ ID NO: 3791941 - RNA, 23 nt, Human
agaaggguuuuccacccuggaau

SEQ ID NO: 3791942 - RNA, 13 nt, Human
agaaggucuguuu

SEQ ID NO: 3791943 - RNA, 22 nt, Human
agaagguggaccuuuuaaagug

SEQ ID NO: 3791944 - RNA, 24 nt, Human
agaagguggaccuuuuaaaguguu

SEQ ID NO: 3791945 - RNA, 22 nt, Human
agaagguggggguuggcugggu

SEQ ID NO: 3791946 - RNA, 18 nt, Human
agaagguuaccaagaagc

SEQ ID NO: 3791947 - RNA, 16 nt, Human
agaagguugcucuaga

SEQ ID NO: 3791948 - RNA, 20 nt, Human
agaagguugcucuagauuga

SEQ ID NO: 3791949 - RNA, 14 nt, Human
agaagguuuauugu

SEQ ID NO: 3791950 - RNA, 16 nt, Human
agaagguuuauuguua

SEQ ID NO: 3791951 - RNA, 17 nt, Human
agaagguuuauuguuaa

SEQ ID NO: 3791952 - RNA, 15 nt, Human
agaaguaaaagcaaa

SEQ ID NO: 3791953 - RNA, 20 nt, Human
agaaguaacaagagugauuc

SEQ ID NO: 3791954 - RNA, 21 nt, Human
agaaguaagaggcuaccucuu

SEQ ID NO: 3791955 - RNA, 20 nt, Human
agaaguagauuaagagccau

SEQ ID NO: 3791956 - RNA, 21 nt, Human
agaaguaggcaugagggauca

SEQ ID NO: 3791957 - RNA, 14 nt, Human
agaaguauuauaaa

SEQ ID NO: 3791958 - RNA, 19 nt, Human
agaaguauuauaaauuaug

SEQ ID NO: 3791959 - RNA, 15 nt, Human
agaaguauuuuuaga

SEQ ID NO: 3791960 - RNA, 19 nt, Human
agaaguauuuuuagaauaa

SEQ ID NO: 3791961 - RNA, 17 nt, Human
agaagucaaaguaaaac

SEQ ID NO: 3791962 - RNA, 17 nt, Human
agaagucaacagugaaa

SEQ ID NO: 3791963 - RNA, 17 nt, Human
agaagucaaggcuuaga

SEQ ID NO: 3791964 - RNA, 14 nt, Human
agaagucacacagu

SEQ ID NO: 3791965 - RNA, 18 nt, Human
agaagucacagggcagua

SEQ ID NO: 3791966 - RNA, 23 nt, Human
agaagucacagggcaguaccuga

SEQ ID NO: 3791967 - RNA, 23 nt, Human
accucgugccaccccgagggcug

SEQ ID NO: 3791968 - RNA, 21 nt, Human
accucuaaauucuuucauuuu

SEQ ID NO: 3791969 - RNA, 16 nt, Human
accucuaauaguauaa

SEQ ID NO: 3791970 - RNA, 18 nt, Human
accucuaauuuauuuugu

SEQ ID NO: 3791971 - RNA, 21 nt, Human
accucuacccaaacccuaggu

SEQ ID NO: 3791972 - RNA, 13 nt, Human
accucuagaauuu

SEQ ID NO: 3791973 - RNA, 19 nt, Human
accucuagaauuuuaagcc

SEQ ID NO: 3791974 - RNA, 19 nt, Human
accucuagguccccauacu

SEQ ID NO: 3791975 - RNA, 20 nt, Human
accucuauaauugccacuga

SEQ ID NO: 3791976 - RNA, 12 nt, Human
accucucaauau

SEQ ID NO: 3791977 - RNA, 19 nt, Human
accucucaauauucaauaa

SEQ ID NO: 3791978 - RNA, 23 nt, Human
accucucaauauucaauaaagcu

SEQ ID NO: 3791979 - RNA, 12 nt, Human
accucucacucc

SEQ ID NO: 3791980 - RNA, 18 nt, Human
accucucaucaguguccu

SEQ ID NO: 3791981 - RNA, 10 nt, Human
accucuccaa

SEQ ID NO: 3791982 - RNA, 13 nt, Human
accucuccaaggg

SEQ ID NO: 3791983 - RNA, 22 nt, Human
accucuccaagggcuucugcac

SEQ ID NO: 3791984 - RNA, 18 nt, Human
accucuccagccucagcu

SEQ ID NO: 3791985 - RNA, 20 nt, Human
accucuccagccucagcucu

SEQ ID NO: 3791986 - RNA, 15 nt, Human
accucuccaucuuca

SEQ ID NO: 3791987 - RNA, 20 nt, Human
accucuccaucuucagcuuc

SEQ ID NO: 3791988 - RNA, 12 nt, Human
accucucccuca

SEQ ID NO: 3791989 - RNA, 17 nt, Human
accucucccugacccug

SEQ ID NO: 3791990 - RNA, 22 nt, Human
accucucccugacccuguauau

SEQ ID NO: 3791991 - RNA, 13 nt, Human
accucucccuugg

SEQ ID NO: 3791992 - RNA, 14 nt, Human
accucucccuugga

SEQ ID NO: 3791993 - RNA, 14 nt, Human
accucucucacucc

SEQ ID NO: 3791994 - RNA, 14 nt, Human
accucucucucugg

SEQ ID NO: 3791995 - RNA, 14 nt, Human
accucucugucaug

SEQ ID NO: 3791996 - RNA, 16 nt, Human
accucucugucaugug

SEQ ID NO: 3791997 - RNA, 14 nt, Human
accucucugucccu

SEQ ID NO: 3791998 - RNA, 15 nt, Human
accucucugucccuu

SEQ ID NO: 3791999 - RNA, 14 nt, Human
accucugacagcag

SEQ ID NO: 3792000 - RNA, 21 nt, Human
accucugacagcagcaucucu

SEQ ID NO: 3792001 - RNA, 17 nt, Human
accucugauuuauuuug

SEQ ID NO: 3792002 - RNA, 18 nt, Human
accucugauuuauuuugu

SEQ ID NO: 3792003 - RNA, 12 nt, Human
accucugcacaa

SEQ ID NO: 3792004 - RNA, 16 nt, Human
accucugcacaagcug

SEQ ID NO: 3792005 - RNA, 20 nt, Human
accucugcagcaauaaagca

SEQ ID NO: 3792006 - RNA, 14 nt, Human
accucugccucaau

SEQ ID NO: 3792007 - RNA, 15 nt, Human
accucugccucaaug

SEQ ID NO: 3792008 - RNA, 20 nt, Human
accucugccugaagucacac

SEQ ID NO: 3792009 - RNA, 17 nt, Human
accucugcggaccccag

SEQ ID NO: 3792010 - RNA, 18 nt, Human
accucugcggaccccagc

SEQ ID NO: 3792011 - RNA, 20 nt, Human
accucugcggaccccagcug

SEQ ID NO: 3792012 - RNA, 12 nt, Human
accucugcucug

SEQ ID NO: 3792013 - RNA, 22 nt, Human
agaccuggagccccuggguggg

SEQ ID NO: 3792014 - RNA, 22 nt, Human
agaccuggcaaggacacagaug

SEQ ID NO: 3792015 - RNA, 14 nt, Human
agaccuggcagcuc

SEQ ID NO: 3792016 - RNA, 15 nt, Human
agaccuggcagcucu

SEQ ID NO: 3792017 - RNA, 15 nt, Human
agaccuguccuccug

SEQ ID NO: 3792018 - RNA, 16 nt, Human
agaccugucuccuggc

SEQ ID NO: 3792019 - RNA, 19 nt, Human
agaccuguuagcagacagg

SEQ ID NO: 3792020 - RNA, 22 nt, Human
agaccuuccauaaugcuacugu

SEQ ID NO: 3792021 - RNA, 16 nt, Human
agaccuucuccaaaug

SEQ ID NO: 3792022 - RNA, 21 nt, Human
agaccuuguuacuucugaggu

SEQ ID NO: 3792023 - RNA, 18 nt, Human
agacuggccugaggagca

SEQ ID NO: 3792024 - RNA, 22 nt, Human
agacugggaagauaggcucugc

SEQ ID NO: 3792025 - RNA, 21 nt, Human
agacugggaaggcuugggauu

SEQ ID NO: 3792026 - RNA, 22 nt, Human
agacugggaaggcuugggauuu

SEQ ID NO: 3792027 - RNA, 23 nt, Human
agacugggaaggcuugggauuug

SEQ ID NO: 3792028 - RNA, 12 nt, Human
agacugggcuga

SEQ ID NO: 3792029 - RNA, 14 nt, Human
agacugggcugagg

SEQ ID NO: 3792030 - RNA, 14 nt, Human
agacuggggccacu

SEQ ID NO: 3792031 - RNA, 15 nt, Human
agacugguccugugu

SEQ ID NO: 3792032 - RNA, 12 nt, Human
agacuggugacu

SEQ ID NO: 3792033 - RNA, 13 nt, Human
agacuggugacug

SEQ ID NO: 3792034 - RNA, 20 nt, Human
agacuggugacugauucuuc

SEQ ID NO: 3792035 - RNA, 20 nt, Human
agacugguuccauggccucu

SEQ ID NO: 3792036 - RNA, 16 nt, Human
agacugguuuucugcc

SEQ ID NO: 3792037 - RNA, 18 nt, Human
agacugguuuucugccaa

SEQ ID NO: 3792038 - RNA, 14 nt, Human
agacuguaaugaau

SEQ ID NO: 3792039 - RNA, 14 nt, Human
agacuguacaaagu

SEQ ID NO: 3792040 - RNA, 17 nt, Human
agacuguagauauguau

SEQ ID NO: 3792041 - RNA, 23 nt, Human
agacuguagauauguauucuuuu

SEQ ID NO: 3792042 - RNA, 18 nt, Human
agacugucuggccccccu

SEQ ID NO: 3792043 - RNA, 16 nt, Human
agacugugauucagaa

SEQ ID NO: 3792044 - RNA, 17 nt, Human
agacugugauucagaaa

SEQ ID NO: 3792045 - RNA, 19 nt, Human
agacugugcuguuguucuc

SEQ ID NO: 3792046 - RNA, 19 nt, Human
agacuguggagacugcucc

SEQ ID NO: 3792047 - RNA, 22 nt, Human
agacugugucucucugauaccu

SEQ ID NO: 3792048 - RNA, 16 nt, Human
agacugugugugcccu

SEQ ID NO: 3792049 - RNA, 17 nt, Human
agacugugugugcccuc

SEQ ID NO: 3792050 - RNA, 18 nt, Human
agacugugugugcccucu

SEQ ID NO: 3792051 - RNA, 17 nt, Human
agacuguuaaaugaaac

SEQ ID NO: 3792052 - RNA, 14 nt, Human
agacuguugcucaa

SEQ ID NO: 3792053 - RNA, 17 nt, Human
agacuguugucccugca

SEQ ID NO: 3792054 - RNA, 17 nt, Human
agacuuaauagaaacau

SEQ ID NO: 3792055 - RNA, 23 nt, Human
agacuuaauagaaacauugaaga

SEQ ID NO: 3792056 - RNA, 21 nt, Human
agacuuaaugagacuuuaaaa

SEQ ID NO: 3792057 - RNA, 20 nt, Human
agacuuacagcaaauccuuu

SEQ ID NO: 3792058 - RNA, 23 nt, Human
agacuuacagggauaaggccugu

SEQ ID NO: 3792059 - RNA, 15 nt, Human
agacuuaccaggaag

SEQ ID NO: 3792060 - RNA, 14 nt, Human
agacuuacucuaag

SEQ ID NO: 3792061 - RNA, 19 nt, Human
agacuuacuuuacucauuu

SEQ ID NO: 3792062 - RNA, 19 nt, Human
agacuuaguauauuuucuu

SEQ ID NO: 3792063 - RNA, 21 nt, Human
agacuucacacugcaagagcc

SEQ ID NO: 3792064 - RNA, 14 nt, Human
agacuucagggagu

SEQ ID NO: 3792065 - RNA, 13 nt, Human
agacuucaguaug

SEQ ID NO: 3792066 - RNA, 17 nt, Human
agacuucauuuuuccua

SEQ ID NO: 3792067 - RNA, 20 nt, Human
agacuuccaaaccugacaga

SEQ ID NO: 3792068 - RNA, 21 nt, Human
agacuuccaaaccugacagau

SEQ ID NO: 3792069 - RNA, 13 nt, Human
agacuuccaaaga

SEQ ID NO: 3792070 - RNA, 14 nt, Human
agacuucccagcuu

SEQ ID NO: 3792071 - RNA, 14 nt, Human
agacuuccuugaga

SEQ ID NO: 3792072 - RNA, 16 nt, Human
agacuucgacucagga

SEQ ID NO: 3792073 - RNA, 20 nt, Human
agacuucgacucaggaucca

SEQ ID NO: 3792074 - RNA, 17 nt, Human
agacuucucuuugccuc

SEQ ID NO: 3792075 - RNA, 13 nt, Human
agacuucuguuuu

SEQ ID NO: 3792076 - RNA, 17 nt, Human
agacuucuguuuucaau

SEQ ID NO: 3792077 - RNA, 18 nt, Human
agacuugaaaagagacag

SEQ ID NO: 3792078 - RNA, 22 nt, Human
agacuugaaaagagacaggcag

SEQ ID NO: 3792079 - RNA, 12 nt, Human
agacuugacagu

SEQ ID NO: 3792080 - RNA, 13 nt, Human
agacuugacagug

SEQ ID NO: 3792081 - RNA, 23 nt, Human
agacuugccaacaccacagaaau

SEQ ID NO: 3792082 - RNA, 15 nt, Human
agacuugccauguga

SEQ ID NO: 3792083 - RNA, 16 nt, Human
agacuugccuuccuaa

SEQ ID NO: 3792084 - RNA, 12 nt, Human
agacuugcugaa

SEQ ID NO: 3792085 - RNA, 18 nt, Human
agacuuggcaacagaagc

SEQ ID NO: 3792086 - RNA, 19 nt, Human
agacuuggcaacagaagca

SEQ ID NO: 3792087 - RNA, 15 nt, Human
agacuugggacauug

SEQ ID NO: 3792088 - RNA, 21 nt, Human
agacuuguauagcaugaaaua

SEQ ID NO: 3792089 - RNA, 21 nt, Human
agacuuguauauucuauuuua

SEQ ID NO: 3792090 - RNA, 17 nt, Human
agacuuuaacauaagcu

SEQ ID NO: 3792091 - RNA, 17 nt, Human
agacuuuagaaauaaau

SEQ ID NO: 3792092 - RNA, 20 nt, Human
agacuuuaggcuuucagcuu

SEQ ID NO: 3792093 - RNA, 16 nt, Human
agacuuuauguaguuu

SEQ ID NO: 3792094 - RNA, 17 nt, Human
agacuuuauguaguuuu

SEQ ID NO: 3792095 - RNA, 15 nt, Human
agacuuuccauuaca

SEQ ID NO: 3792096 - RNA, 22 nt, Human
agacuuuccauuacaaguauuu

SEQ ID NO: 3792097 - RNA, 21 nt, Human
agacuuucuuucuguaggugg

SEQ ID NO: 3792098 - RNA, 23 nt, Human
agacuuuggaaaaugcauuguau

SEQ ID NO: 3792099 - RNA, 23 nt, Human
agacuuugguuauuuuacuuuuu

SEQ ID NO: 3792100 - RNA, 18 nt, Human
agacuuuguuuuuaaaau

SEQ ID NO: 3792101 - RNA, 19 nt, Human
agacuuuguuuuuaaaaug

SEQ ID NO: 3792102 - RNA, 19 nt, Human
agacuuuucuuucagccaa

SEQ ID NO: 3792103 - RNA, 14 nt, Human
agacuuuuguacau

SEQ ID NO: 3792104 - RNA, 19 nt, Human
agacuuuuugguggaugua

SEQ ID NO: 3792105 - RNA, 20 nt, Human
agacuuuuugguggauguaa

SEQ ID NO: 3792106 - RNA, 13 nt, Human
agagaaaaaagaa

SEQ ID NO: 3792107 - RNA, 17 nt, Human
agagaaaaaagaagugu

SEQ ID NO: 3792108 - RNA, 16 nt, Human
agagaaaaagaaaugc

SEQ ID NO: 3792109 - RNA, 21 nt, Human
agagaaaaaugcuuugcuuug

SEQ ID NO: 3792110 - RNA, 23 nt, Human
agagaaaacaugcagaacaaaug

SEQ ID NO: 3792111 - RNA, 13 nt, Human
agagaaaauaaaa

SEQ ID NO: 3792112 - RNA, 15 nt, Human
agagaaaauauaugu

SEQ ID NO: 3792113 - RNA, 19 nt, Human
agagaaaauauauguauuu

SEQ ID NO: 3792114 - RNA, 23 nt, Human
agagaaaauauauguauuuuuau

SEQ ID NO: 3792115 - RNA, 14 nt, Human
agagaaaauugaau

SEQ ID NO: 3792116 - RNA, 16 nt, Human
agagaaaauugaauuu

SEQ ID NO: 3792117 - RNA, 21 nt, Human
agagaaaccagcuuccuucag

SEQ ID NO: 3792118 - RNA, 21 nt, Human
agagaaaccguccucuuuuuc

SEQ ID NO: 3792119 - RNA, 21 nt, Human
agagaaacucuauggguauca

SEQ ID NO: 3792120 - RNA, 16 nt, Human
agagaaagaaaaugaa

SEQ ID NO: 3792121 - RNA, 15 nt, Human
agagaaagaagagac

SEQ ID NO: 3792122 - RNA, 14 nt, Human
agagaaagccaggc

SEQ ID NO: 3792123 - RNA, 17 nt, Human
agagaaagccaggcagg

SEQ ID NO: 3792124 - RNA, 14 nt, Human
agagaaagcgcaga

SEQ ID NO: 3792125 - RNA, 18 nt, Human
agagaaaggccugcacac

SEQ ID NO: 3792126 - RNA, 12 nt, Human
agagaaagggga

SEQ ID NO: 3792127 - RNA, 18 nt, Human
agagaaagugauuucuag

SEQ ID NO: 3792128 - RNA, 24 nt, Human
agagaaagugggugagaugcugga

SEQ ID NO: 3792129 - RNA, 23 nt, Human
agagaaauauuuuaauuuuuaaa

SEQ ID NO: 3792130 - RNA, 14 nt, Human
agagaaaucugaaa

SEQ ID NO: 3792131 - RNA, 17 nt, Human
agagaaauucuguuaaa

SEQ ID NO: 3792132 - RNA, 13 nt, Human
agagaaccaggcu

SEQ ID NO: 3792133 - RNA, 17 nt, Human
agagaaccgagcaaaga

SEQ ID NO: 3792134 - RNA, 21 nt, Human
agagaaccgagcaaagaucaa

SEQ ID NO: 3792135 - RNA, 19 nt, Human
agagaaccuaacuguaucu

SEQ ID NO: 3792136 - RNA, 21 nt, Human
agagaaccuaacuguaucuug

SEQ ID NO: 3792137 - RNA, 23 nt, Human
agagaaccuaacuguaucuugag

SEQ ID NO: 3792138 - RNA, 22 nt, Human
agagaaccucacgcaccuccca

SEQ ID NO: 3792139 - RNA, 22 nt, Human
agagaacucgcgcucaguaaac

SEQ ID NO: 3792140 - RNA, 17 nt, Human
agagaagaaagaacgga

SEQ ID NO: 3792141 - RNA, 11 nt, Human
agagaagaaga

SEQ ID NO: 3792142 - RNA, 13 nt, Human
agagaagaagaaa

SEQ ID NO: 3792143 - RNA, 15 nt, Human
agagaagaaugagcc

SEQ ID NO: 3792144 - RNA, 13 nt, Human
agagaagauaauu

SEQ ID NO: 3792145 - RNA, 15 nt, Human
agagaagauaauugu

SEQ ID NO: 3792146 - RNA, 20 nt, Human
agagaagauaauuguugaaa

SEQ ID NO: 3792147 - RNA, 16 nt, Human
agagaagccagcuugu

SEQ ID NO: 3792148 - RNA, 17 nt, Human
agagaagccccuucccc

SEQ ID NO: 3792149 - RNA, 20 nt, Human
agagaagccccuuccccaug

SEQ ID NO: 3792150 - RNA, 23 nt, Human
agagaagccccuuccccauggga

SEQ ID NO: 3792151 - RNA, 14 nt, Human
agagaagccuucaa

SEQ ID NO: 3792152 - RNA, 18 nt, Human
agagaagcggauuuccag

SEQ ID NO: 3792153 - RNA, 12 nt, Human
agagaagcuggg

SEQ ID NO: 3792154 - RNA, 14 nt, Human
agagaaggcagcag

SEQ ID NO: 3792155 - RNA, 21 nt, Human
agagaagggcauaaaacagcu

SEQ ID NO: 3792156 - RNA, 15 nt, Human
agagaaggggaggag

SEQ ID NO: 3792157 - RNA, 19 nt, Human
agagaugaagagugagagg

SEQ ID NO: 3792158 - RNA, 23 nt, Human
agagaugccuccaccgcugccua

SEQ ID NO: 3792159 - RNA, 16 nt, Human
agagaugccucccuga

SEQ ID NO: 3792160 - RNA, 23 nt, Human
agagaugcuguaacuuaaaauag

SEQ ID NO: 3792161 - RNA, 12 nt, Human
agagauggagga

SEQ ID NO: 3792162 - RNA, 22 nt, Human
agagaugggacugggagggccc

SEQ ID NO: 3792163 - RNA, 23 nt, Human
agagaugggacugggagggccca

SEQ ID NO: 3792164 - RNA, 20 nt, Human
agagaugggagcuccucucc

SEQ ID NO: 3792165 - RNA, 16 nt, Human
agagaugucucuuaua

SEQ ID NO: 3792166 - RNA, 18 nt, Human
agagauguguaauuuuuc

SEQ ID NO: 3792167 - RNA, 19 nt, Human
agagauguguaauuuuucu

SEQ ID NO: 3792168 - RNA, 18 nt, Human
agagauguguguugauac

SEQ ID NO: 3792169 - RNA, 22 nt, Human
agagauguguguugauacuguu

SEQ ID NO: 3792170 - RNA, 23 nt, Human
agagauguguguugauacuguug

SEQ ID NO: 3792171 - RNA, 24 nt, Human
agagauguguguugauacuguugc

SEQ ID NO: 3792172 - RNA, 12 nt, Human
agagauguuuuu

SEQ ID NO: 3792173 - RNA, 20 nt, Human
agagauguuuuuaaaaguuu

SEQ ID NO: 3792174 - RNA, 20 nt, Human
agagauuaccuccugagaaa

SEQ ID NO: 3792175 - RNA, 13 nt, Human
agagauucauuuu

SEQ ID NO: 3792176 - RNA, 15 nt, Human
agagauucauuuucu

SEQ ID NO: 3792177 - RNA, 23 nt, Human
agagauucugaacuaaagugcug

SEQ ID NO: 3792178 - RNA, 19 nt, Human
agagauucugauuugccac

SEQ ID NO: 3792179 - RNA, 21 nt, Human
agagauuggaucaaguauuac

SEQ ID NO: 3792180 - RNA, 13 nt, Human
agagauuuaauua

SEQ ID NO: 3792181 - RNA, 23 nt, Human
agagauuuauauaaauguaaaaa

SEQ ID NO: 3792182 - RNA, 22 nt, Human
agaccuuguuacuucugaggua

SEQ ID NO: 3792183 - RNA, 22 nt, Human
agaccuuguucacacucucaca

SEQ ID NO: 3792184 - RNA, 16 nt, Human
agaccuuucaaagcca

SEQ ID NO: 3792185 - RNA, 17 nt, Human
agaccuuuucaacuugg

SEQ ID NO: 3792186 - RNA, 14 nt, Human
agaccuuuuucugc

SEQ ID NO: 3792187 - RNA, 13 nt, Human
agacgaggcccuc

SEQ ID NO: 3792188 - RNA, 16 nt, Human
agacgaugucuucaua

SEQ ID NO: 3792189 - RNA, 15 nt, Human
agacgccaccauucc

SEQ ID NO: 3792190 - RNA, 17 nt, Human
agacgccaccauuccug

SEQ ID NO: 3792191 - RNA, 14 nt, Human
agacgccuggcugc

SEQ ID NO: 3792192 - RNA, 15 nt, Human
agacgccuggcugcu

SEQ ID NO: 3792193 - RNA, 19 nt, Human
agacgcucauucagcaucu

SEQ ID NO: 3792194 - RNA, 20 nt, Human
agacgcugugcugcccugcc

SEQ ID NO: 3792195 - RNA, 16 nt, Human
agacggaggggaguag

SEQ ID NO: 3792196 - RNA, 20 nt, Human
agacggagucucgcucuguc

SEQ ID NO: 3792197 - RNA, 14 nt, Human
agacgggcccuggu

SEQ ID NO: 3792198 - RNA, 17 nt, Human
agacguaggggaggggu

SEQ ID NO: 3792199 - RNA, 21 nt, Human
agacguggaaccucugucuca

SEQ ID NO: 3792200 - RNA, 16 nt, Human
agacguuuuauaagca

SEQ ID NO: 3792201 - RNA, 13 nt, Human
agacuaagaaaua

SEQ ID NO: 3792202 - RNA, 14 nt, Human
agacuaagaaauau

SEQ ID NO: 3792203 - RNA, 21 nt, Human
agacuaagaucgguuaacaaa

SEQ ID NO: 3792204 - RNA, 13 nt, Human
agacuaagccagc

SEQ ID NO: 3792205 - RNA, 13 nt, Human
agacuaagcccug

SEQ ID NO: 3792206 - RNA, 14 nt, Human
agacuaagcccugu

SEQ ID NO: 3792207 - RNA, 15 nt, Human
agacuaauuuaaaaa

SEQ ID NO: 3792208 - RNA, 15 nt, Human
agacuacacaggaug

SEQ ID NO: 3792209 - RNA, 21 nt, Human
agacuacagcuggggugcagg

SEQ ID NO: 3792210 - RNA, 14 nt, Human
agacuacuaagagg

SEQ ID NO: 3792211 - RNA, 16 nt, Human
agacuacuauuuucuu

SEQ ID NO: 3792212 - RNA, 19 nt, Human
agacuacuauuuucuuuuu

SEQ ID NO: 3792213 - RNA, 14 nt, Human
agacuagaauucua

SEQ ID NO: 3792214 - RNA, 22 nt, Human
agacuagaauucuagugcugcu

SEQ ID NO: 3792215 - RNA, 19 nt, Human
agacuagauugccuuuguu

SEQ ID NO: 3792216 - RNA, 23 nt, Human
agacuagcaaucucuucauuauu

SEQ ID NO: 3792217 - RNA, 19 nt, Human
agacuauauacaugugugu

SEQ ID NO: 3792218 - RNA, 17 nt, Human
agacuauauuguacaca

SEQ ID NO: 3792219 - RNA, 17 nt, Human
agacuaucaaacagaaa

SEQ ID NO: 3792220 - RNA, 15 nt, Human
agacuaucagcccaa

SEQ ID NO: 3792221 - RNA, 17 nt, Human
agacuaucuaaauguug

SEQ ID NO: 3792222 - RNA, 17 nt, Human
agacuaucuuacuauuu

SEQ ID NO: 3792223 - RNA, 21 nt, Human
agacuauggagccuggcacag

SEQ ID NO: 3792224 - RNA, 20 nt, Human
agacuauucaaacagucuca

SEQ ID NO: 3792225 - RNA, 17 nt, Human
agacuauuuaaacuuau

SEQ ID NO: 3792226 - RNA, 22 nt, Human
agacuauuuaaacuuauaaauc

SEQ ID NO: 3792227 - RNA, 14 nt, Human
agacuauuuuuaga

SEQ ID NO: 3792228 - RNA, 15 nt, Human
agacucaaauguucu

SEQ ID NO: 3792229 - RNA, 22 nt, Human
agacucaagguucccagagaug

SEQ ID NO: 3792230 - RNA, 12 nt, Human
agacucaccucu

SEQ ID NO: 3792231 - RNA, 16 nt, Human
agacucaccucugccu

SEQ ID NO: 3792232 - RNA, 18 nt, Human
agacucagggccccagca

SEQ ID NO: 3792233 - RNA, 22 nt, Human
agacucagguuguaguaaagaa

SEQ ID NO: 3792234 - RNA, 18 nt, Human
agacucagugcagaugga

SEQ ID NO: 3792235 - RNA, 12 nt, Human
agacucaguguu

SEQ ID NO: 3792236 - RNA, 15 nt, Human
agacucaguuuguca

SEQ ID NO: 3792237 - RNA, 16 nt, Human
agacucaguuugucag

SEQ ID NO: 3792238 - RNA, 22 nt, Human
agacucauauuacugguaggaa

SEQ ID NO: 3792239 - RNA, 20 nt, Human
agacucauccugaacagcau

SEQ ID NO: 3792240 - RNA, 22 nt, Human
agacucauccugaacagcaugg

SEQ ID NO: 3792241 - RNA, 18 nt, Human
agacucaucuuacuguac

SEQ ID NO: 3792242 - RNA, 12 nt, Human
agacuccaaaga

SEQ ID NO: 3792243 - RNA, 14 nt, Human
agacuccaaagaaa

SEQ ID NO: 3792244 - RNA, 14 nt, Human
agacuccauaguuu

SEQ ID NO: 3792245 - RNA, 16 nt, Human
agacuccauaguuugg

SEQ ID NO: 3792246 - RNA, 22 nt, Human
agacuccaucucuauauaaaaa

SEQ ID NO: 3792247 - RNA, 15 nt, Human
agacucccaugaagc

SEQ ID NO: 3792248 - RNA, 16 nt, Human
agacucccaugaagcc

SEQ ID NO: 3792249 - RNA, 18 nt, Human
agacucccaugaagccuu

SEQ ID NO: 3792250 - RNA, 19 nt, Human
agacucccaugaagccuuu

SEQ ID NO: 3792251 - RNA, 21 nt, Human
agacucccaugaagccuuuug

SEQ ID NO: 3792252 - RNA, 23 nt, Human
agacucccaugaagccuuuugaa

SEQ ID NO: 3792253 - RNA, 19 nt, Human
agacucccauuccugaaga

SEQ ID NO: 3792254 - RNA, 23 nt, Human
agacucccauuccugaagaacca

SEQ ID NO: 3792255 - RNA, 17 nt, Human
agacuccuagcuguccu

SEQ ID NO: 3792256 - RNA, 11 nt, Human
agacuccuagg

SEQ ID NO: 3792257 - RNA, 14 nt, Human
agacuccuaggcag

SEQ ID NO: 3792258 - RNA, 22 nt, Human
agacuccuaggcaggacaugcu

SEQ ID NO: 3792259 - RNA, 13 nt, Human
agacuccugcagg

SEQ ID NO: 3792260 - RNA, 14 nt, Human
agacuccugcaggc

SEQ ID NO: 3792261 - RNA, 15 nt, Human
agacuccugcaggca

SEQ ID NO: 3792262 - RNA, 19 nt, Human
agacuccugcaggcagcca

SEQ ID NO: 3792263 - RNA, 20 nt, Human
agacuccugcaggcagccag

SEQ ID NO: 3792264 - RNA, 23 nt, Human
agacuccugcaggcagccaggcc

SEQ ID NO: 3792265 - RNA, 16 nt, Human
agacuccugcccuguu

SEQ ID NO: 3792266 - RNA, 17 nt, Human
agacuccuucaacaauu

SEQ ID NO: 3792267 - RNA, 20 nt, Human
agacuccuugagagaccagg

SEQ ID NO: 3792268 - RNA, 19 nt, Human
agacucgagaacuuucauu

SEQ ID NO: 3792269 - RNA, 19 nt, Human
agacucgcgacaaugcaaa

SEQ ID NO: 3792270 - RNA, 20 nt, Human
agacucgcgacaaugcaaac

SEQ ID NO: 3792271 - RNA, 21 nt, Human
agacucgcgacaaugcaaacc

SEQ ID NO: 3792272 - RNA, 17 nt, Human
agacucggggugcuucc

SEQ ID NO: 3792273 - RNA, 22 nt, Human
agacucggggugcuuccuugua

SEQ ID NO: 3792274 - RNA, 13 nt, Human
agacucuaccaga

SEQ ID NO: 3792275 - RNA, 21 nt, Human
agacucuaccagacuguguau

SEQ ID NO: 3792276 - RNA, 19 nt, Human
agacucuacccauauuaca

SEQ ID NO: 3792277 - RNA, 16 nt, Human
agacucuagaguccaa

SEQ ID NO: 3792278 - RNA, 13 nt, Human
agacucucucugg

SEQ ID NO: 3792279 - RNA, 17 nt, Human
agacucugucuaccugg

SEQ ID NO: 3792280 - RNA, 14 nt, Human
agacucuuuaugcu

SEQ ID NO: 3792281 - RNA, 21 nt, Human
agacucuuuuccuucccuuuu

SEQ ID NO: 3792282 - RNA, 23 nt, Human
agacucuuuuuguaccuggugac

SEQ ID NO: 3792283 - RNA, 15 nt, Human
agacugaacagccaa

SEQ ID NO: 3792284 - RNA, 12 nt, Human
agacugaccaau

SEQ ID NO: 3792285 - RNA, 17 nt, Human
agacugagcaccugcuu

SEQ ID NO: 3792286 - RNA, 16 nt, Human
agacugaggacaaagu

SEQ ID NO: 3792287 - RNA, 19 nt, Human
agacugaucaggaccucca

SEQ ID NO: 3792288 - RNA, 19 nt, Human
agacugcaagaggcuccug

SEQ ID NO: 3792289 - RNA, 21 nt, Human
agacugcaagaggcuccuguc

SEQ ID NO: 3792290 - RNA, 21 nt, Human
agacugcaaugugaucuaugu

SEQ ID NO: 3792291 - RNA, 16 nt, Human
agacugcacccaggag

SEQ ID NO: 3792292 - RNA, 17 nt, Human
agacugcacccaggagg

SEQ ID NO: 3792293 - RNA, 22 nt, Human
agacugccacaaggaagaaauu

SEQ ID NO: 3792294 - RNA, 13 nt, Human
agacugccagcuc

SEQ ID NO: 3792295 - RNA, 14 nt, Human
agacugccagcucu

SEQ ID NO: 3792296 - RNA, 21 nt, Human
agacugccauauuaaauuuuu

SEQ ID NO: 3792297 - RNA, 20 nt, Human
agacugcgggaugguccugg

SEQ ID NO: 3792298 - RNA, 22 nt, Human
agacugcgggaugguccugggg

SEQ ID NO: 3792299 - RNA, 16 nt, Human
agacugcuccugagcc

SEQ ID NO: 3792300 - RNA, 21 nt, Human
agacugcuguggccaggaggu

SEQ ID NO: 3792301 - RNA, 15 nt, Human
aauuggguucacagc

SEQ ID NO: 3792302 - RNA, 13 nt, Human
aauuggguucaug

SEQ ID NO: 3792303 - RNA, 15 nt, Human
aauuggguucaugau

SEQ ID NO: 3792304 - RNA, 19 nt, Human
aauuggguucaugaugcag

SEQ ID NO: 3792305 - RNA, 18 nt, Human
aauugguaucaagaaagu

SEQ ID NO: 3792306 - RNA, 19 nt, Human
aauugguguaauggggcag

SEQ ID NO: 3792307 - RNA, 17 nt, Human
aauuguaaaacugaggc

SEQ ID NO: 3792308 - RNA, 21 nt, Human
aauuguaaaguaaaagcuaua

SEQ ID NO: 3792309 - RNA, 14 nt, Human
aauuguaacuguuc

SEQ ID NO: 3792310 - RNA, 16 nt, Human
aauuguaacuguucuu

SEQ ID NO: 3792311 - RNA, 11 nt, Human
aauuguaauag

SEQ ID NO: 3792312 - RNA, 17 nt, Human
aauuguaauuaauaaua

SEQ ID NO: 3792313 - RNA, 15 nt, Human
aauuguaauuauauc

SEQ ID NO: 3792314 - RNA, 12 nt, Human
aauuguacaaaa

SEQ ID NO: 3792315 - RNA, 14 nt, Human
aauuguacagccgg

SEQ ID NO: 3792316 - RNA, 21 nt, Human
aauuguacauauuuguggaau

SEQ ID NO: 3792317 - RNA, 22 nt, Human
aauuguaccuuuuuuguuuuuu

SEQ ID NO: 3792318 - RNA, 16 nt, Human
aauuguauaacagguu

SEQ ID NO: 3792319 - RNA, 19 nt, Human
aauuguauaacagguuauu

SEQ ID NO: 3792320 - RNA, 15 nt, Human
aauuguauagagaua

SEQ ID NO: 3792321 - RNA, 14 nt, Human
aauuguauauucac

SEQ ID NO: 3792322 - RNA, 14 nt, Human
aauuguauauugua

SEQ ID NO: 3792323 - RNA, 20 nt, Human
aauuguaucagaggccuaua

SEQ ID NO: 3792324 - RNA, 19 nt, Human
aauuguaucguauagcugu

SEQ ID NO: 3792325 - RNA, 13 nt, Human
aauuguaucuagu

SEQ ID NO: 3792326 - RNA, 11 nt, Human
aauuguauuuu

SEQ ID NO: 3792327 - RNA, 12 nt, Human
aauuguauuuuu

SEQ ID NO: 3792328 - RNA, 17 nt, Human
aauuguccguguucaua

SEQ ID NO: 3792329 - RNA, 18 nt, Human
aauugucgaaaagagucu

SEQ ID NO: 3792330 - RNA, 13 nt, Human
aauugucuauuua

SEQ ID NO: 3792331 - RNA, 19 nt, Human
aauugucuuaauggaugaa

SEQ ID NO: 3792332 - RNA, 17 nt, Human
aauugucuucauguaca

SEQ ID NO: 3792333 - RNA, 15 nt, Human
aauugucuuuaaaaa

SEQ ID NO: 3792334 - RNA, 20 nt, Human
aauugucuuuugucaugugg

SEQ ID NO: 3792335 - RNA, 14 nt, Human
acauuaucuucugg

SEQ ID NO: 3792336 - RNA, 17 nt, Human
acauuaugcuccagaaa

SEQ ID NO: 3792337 - RNA, 22 nt, Human
acauuauuaaguaacuuauuua

SEQ ID NO: 3792338 - RNA, 12 nt, Human
acauuauuacuu

SEQ ID NO: 3792339 - RNA, 12 nt, Human
acauuauucugg

SEQ ID NO: 3792340 - RNA, 18 nt, Human
acauuauuuauaugggga

SEQ ID NO: 3792341 - RNA, 12 nt, Human
acauuauuucua

SEQ ID NO: 3792342 - RNA, 16 nt, Human
acauuauuucuagucc

SEQ ID NO: 3792343 - RNA, 14 nt, Human
acauuauuugcaug

SEQ ID NO: 3792344 - RNA, 24 nt, Human
acauucaaaauaggguauauuuuc

SEQ ID NO: 3792345 - RNA, 16 nt, Human
acauucaggaagauga

SEQ ID NO: 3792346 - RNA, 19 nt, Human
acauucaggaauucuugga

SEQ ID NO: 3792347 - RNA, 22 nt, Human
acauucauagucuuuggagaaa

SEQ ID NO: 3792348 - RNA, 13 nt, Human
acauuccaagaca

SEQ ID NO: 3792349 - RNA, 14 nt, Human
acauuccaagacag

SEQ ID NO: 3792350 - RNA, 16 nt, Human
acauuccaagacucua

SEQ ID NO: 3792351 - RNA, 18 nt, Human
acauucccaagguuacuu

SEQ ID NO: 3792352 - RNA, 23 nt, Human
acauuccguuuacauuuuagaca

SEQ ID NO: 3792353 - RNA, 19 nt, Human
acauuccuaaacuaucuuu

SEQ ID NO: 3792354 - RNA, 18 nt, Human
acauuccucaugaaugua

SEQ ID NO: 3792355 - RNA, 21 nt, Human
acauuccucaugaauguaaau

SEQ ID NO: 3792356 - RNA, 22 nt, Human
acauuccucaugaauguaaauu

SEQ ID NO: 3792357 - RNA, 17 nt, Human
acauuccuugccugcac

SEQ ID NO: 3792358 - RNA, 21 nt, Human
acauuccuugcugaaacgcau

SEQ ID NO: 3792359 - RNA, 14 nt, Human
acauucgaucucau

SEQ ID NO: 3792360 - RNA, 19 nt, Human
acauucgaucucauucagu

SEQ ID NO: 3792361 - RNA, 19 nt, Human
acauucucaguuuuucuua

SEQ ID NO: 3792362 - RNA, 19 nt, Human
acauucucgcuucccugaa

SEQ ID NO: 3792363 - RNA, 18 nt, Human
acauucucuaauaagaaa

SEQ ID NO: 3792364 - RNA, 19 nt, Human
acauucucuaauaagaaaa

SEQ ID NO: 3792365 - RNA, 16 nt, Human
acauucugaugagcaa

SEQ ID NO: 3792366 - RNA, 16 nt, Human
acauucugccaggccc

SEQ ID NO: 3792367 - RNA, 23 nt, Human
acauucuggggaaacaacauuua

SEQ ID NO: 3792368 - RNA, 12 nt, Human
acauucuguuaa

SEQ ID NO: 3792369 - RNA, 13 nt, Human
acauucuuaaaaa

SEQ ID NO: 3792370 - RNA, 17 nt, Human
acauucuuauaaauaug

SEQ ID NO: 3792371 - RNA, 20 nt, Human
acauucuuggcuuaaucauu

SEQ ID NO: 3792372 - RNA, 22 nt, Human
acauucuuggcuuaaucauuuu

SEQ ID NO: 3792373 - RNA, 18 nt, Human
acauucuuuuugcucuaa

SEQ ID NO: 3792374 - RNA, 12 nt, Human
acauugaagaau

SEQ ID NO: 3792375 - RNA, 15 nt, Human
acauugaaguaauga

SEQ ID NO: 3792376 - RNA, 19 nt, Human
acauugacgauuccuucuc

SEQ ID NO: 3792377 - RNA, 16 nt, Human
acauugagcugauaua

SEQ ID NO: 3792378 - RNA, 22 nt, Human
acauugaguagacacauuuaag

SEQ ID NO: 3792379 - RNA, 16 nt, Human
acauugauucagccug

SEQ ID NO: 3792380 - RNA, 16 nt, Human
acauugcagucugcuu

SEQ ID NO: 3792381 - RNA, 15 nt, Human
acauugcauucuauu

SEQ ID NO: 3792382 - RNA, 14 nt, Human
acauugccaaaaag

SEQ ID NO: 3792383 - RNA, 16 nt, Human
acauugccuuugaaug

SEQ ID NO: 3792384 - RNA, 22 nt, Human
acauugcggacagccacggcca

SEQ ID NO: 3792385 - RNA, 15 nt, Human
acauugcguuugacc

SEQ ID NO: 3792386 - RNA, 23 nt, Human
acauugcguuugaccuuuuaugu

SEQ ID NO: 3792387 - RNA, 18 nt, Human
acauugcuuuuaaaacua

SEQ ID NO: 3792388 - RNA, 16 nt, Human
acauuggaaacaaguc

SEQ ID NO: 3792389 - RNA, 15 nt, Human
acauuggaagcaggu

SEQ ID NO: 3792390 - RNA, 20 nt, Human
acauuggaagcagguuaaau

SEQ ID NO: 3792391 - RNA, 22 nt, Human
acauuggaagcagguuaaaugu

SEQ ID NO: 3792392 - RNA, 15 nt, Human
acauuggaauguucu

SEQ ID NO: 3792393 - RNA, 22 nt, Human
acauuggagaugccauccucuu

SEQ ID NO: 3792394 - RNA, 15 nt, Human
acauugggaagggga

SEQ ID NO: 3792395 - RNA, 19 nt, Human
acauugggaaggggacccc

SEQ ID NO: 3792396 - RNA, 23 nt, Human
acauugggaaggggacccccgcc

SEQ ID NO: 3792397 - RNA, 16 nt, Human
acauugggucuauucc

SEQ ID NO: 3792398 - RNA, 16 nt, Human
acauugguaagaauga

SEQ ID NO: 3792399 - RNA, 22 nt, Human
acauugguguuguacucaauuu

SEQ ID NO: 3792400 - RNA, 23 nt, Human
acauuguaagagagaugagcacu

SEQ ID NO: 3792401 - RNA, 12 nt, Human
acauugucaaua

SEQ ID NO: 3792402 - RNA, 22 nt, Human
acauugucuccuauauauuucu

SEQ ID NO: 3792403 - RNA, 12 nt, Human
acauugucugcg

SEQ ID NO: 3792404 - RNA, 11 nt, Human
acauugugcca

SEQ ID NO: 3792405 - RNA, 17 nt, Human
acauuguuauuuucagu

SEQ ID NO: 3792406 - RNA, 21 nt, Human
acauuguucaccuuuguagca

SEQ ID NO: 3792407 - RNA, 14 nt, Human
acauuguugagcua

SEQ ID NO: 3792408 - RNA, 21 nt, Human
acauuguugcucccugugaca

SEQ ID NO: 3792409 - RNA, 20 nt, Human
acauuguuguuuuuuuaaua

SEQ ID NO: 3792410 - RNA, 16 nt, Human
acauuguuuuaaaaag

SEQ ID NO: 3792411 - RNA, 12 nt, Human
acauuguuuugc

SEQ ID NO: 3792412 - RNA, 10 nt, Human
acauuuaaaa

SEQ ID NO: 3792413 - RNA, 14 nt, Human
acauuuaaaacauu

SEQ ID NO: 3792414 - RNA, 22 nt, Human
acauuuaaaacauuaaaauaua

SEQ ID NO: 3792415 - RNA, 14 nt, Human
acauuuaaaccuuu

SEQ ID NO: 3792416 - RNA, 14 nt, Human
acauuuaaagcauu

SEQ ID NO: 3792417 - RNA, 16 nt, Human
acauuuaauacagcag

SEQ ID NO: 3792418 - RNA, 12 nt, Human
acauuuaauuua

SEQ ID NO: 3792419 - RNA, 15 nt, Human
acauuuacaaacuga

SEQ ID NO: 3792420 - RNA, 14 nt, Human
acauuuacauguau

SEQ ID NO: 3792421 - RNA, 21 nt, Human
acauuuacuacaguuuuuaac

SEQ ID NO: 3792422 - RNA, 17 nt, Human
acauuuagaaaagugaa

SEQ ID NO: 3792423 - RNA, 20 nt, Human
acauuuagaaaagugaauug

SEQ ID NO: 3792424 - RNA, 12 nt, Human
acauuuauaauu

SEQ ID NO: 3792425 - RNA, 14 nt, Human
acauuuaugauuua

SEQ ID NO: 3792426 - RNA, 15 nt, Human
acauuuaugauuuaa

SEQ ID NO: 3792427 - RNA, 19 nt, Human
acauuuaugauuuaauaaa

SEQ ID NO: 3792428 - RNA, 14 nt, Human
acauuuauucugcu

SEQ ID NO: 3792429 - RNA, 23 nt, Human
acauuuauuuuuuuuaaagaaaa

SEQ ID NO: 3792430 - RNA, 16 nt, Human
acauuucacauuauuc

SEQ ID NO: 3792431 - RNA, 24 nt, Human
acauuucaccuacuuuguaaguga

SEQ ID NO: 3792432 - RNA, 23 nt, Human
acauuucauaauuuguuuccagc

SEQ ID NO: 3792433 - RNA, 17 nt, Human
acauuuccuaaauauau

SEQ ID NO: 3792434 - RNA, 12 nt, Human
acauuucuaacu

SEQ ID NO: 3792435 - RNA, 14 nt, Human
acauuucuaacucu

SEQ ID NO: 3792436 - RNA, 12 nt, Human
acauuucuauaa

SEQ ID NO: 3792437 - RNA, 18 nt, Human
acauuucuuuucuuuuua

SEQ ID NO: 3792438 - RNA, 16 nt, Human
acauuugagucccuuc

SEQ ID NO: 3792439 - RNA, 22 nt, Human
acauuugaugcaugucuuuuaa

SEQ ID NO: 3792440 - RNA, 16 nt, Human
acauuugccuugcaga

SEQ ID NO: 3792441 - RNA, 21 nt, Human
acauuugccuugcagaacugc

SEQ ID NO: 3792442 - RNA, 15 nt, Human
acauuugccuugcug

SEQ ID NO: 3792443 - RNA, 17 nt, Human
acauuugcuacuguugu

SEQ ID NO: 3792444 - RNA, 18 nt, Human
acauuugcucauggaauu

SEQ ID NO: 3792445 - RNA, 15 nt, Human
acauuugcugccauu

SEQ ID NO: 3792446 - RNA, 23 nt, Human
acauuugcuuuuugugauaugca

SEQ ID NO: 3792447 - RNA, 16 nt, Human
accaauauuuaaucuu

SEQ ID NO: 3792448 - RNA, 11 nt, Human
accaauauuug

SEQ ID NO: 3792449 - RNA, 16 nt, Human
accaauauuuguagaa

SEQ ID NO: 3792450 - RNA, 13 nt, Human
accaaucaugaau

SEQ ID NO: 3792451 - RNA, 15 nt, Human
accaaucaugaauua

SEQ ID NO: 3792452 - RNA, 13 nt, Human
accaauccuggac

SEQ ID NO: 3792453 - RNA, 20 nt, Human
accaaucuuacuuuguaaau

SEQ ID NO: 3792454 - RNA, 22 nt, Human
accaaugcaugcagccacugug

SEQ ID NO: 3792455 - RNA, 21 nt, Human
accaaugccaaaaaaagacag

SEQ ID NO: 3792456 - RNA, 13 nt, Human
accaaugucuuga

SEQ ID NO: 3792457 - RNA, 15 nt, Human
accaauguucucucu

SEQ ID NO: 3792458 - RNA, 23 nt, Human
accaauuauaagggcaaauugga

SEQ ID NO: 3792459 - RNA, 17 nt, Human
accaauuauugauauau

SEQ ID NO: 3792460 - RNA, 22 nt, Human
accaauugcugcuacuuauaua

SEQ ID NO: 3792461 - RNA, 16 nt, Human
accaauugguuaaucu

SEQ ID NO: 3792462 - RNA, 17 nt, Human
accaauugugcugccau

SEQ ID NO: 3792463 - RNA, 18 nt, Human
accaauuuacacugccau

SEQ ID NO: 3792464 - RNA, 14 nt, Human
accacaaaaaugaa

SEQ ID NO: 3792465 - RNA, 10 nt, Human
accacaaagg

SEQ ID NO: 3792466 - RNA, 14 nt, Human
accacaaaggccaa

SEQ ID NO: 3792467 - RNA, 18 nt, Human
accacaaaggccaaacug

SEQ ID NO: 3792468 - RNA, 13 nt, Human
accacaacaugag

SEQ ID NO: 3792469 - RNA, 15 nt, Human
accacaacugacaca

SEQ ID NO: 3792470 - RNA, 16 nt, Human
accacaagacugcaca

SEQ ID NO: 3792471 - RNA, 12 nt, Human
accacaagggcu

SEQ ID NO: 3792472 - RNA, 18 nt, Human
accacacaccucaccaga

SEQ ID NO: 3792473 - RNA, 14 nt, Human
accacacauuucac

SEQ ID NO: 3792474 - RNA, 21 nt, Human
accacacauuucacugucugu

SEQ ID NO: 3792475 - RNA, 17 nt, Human
accacaccaaaccucuc

SEQ ID NO: 3792476 - RNA, 16 nt, Human
accacacccagccuca

SEQ ID NO: 3792477 - RNA, 18 nt, Human
accacacccggcuaauuu

SEQ ID NO: 3792478 - RNA, 13 nt, Human
accacacccugua

SEQ ID NO: 3792479 - RNA, 16 nt, Human
accacaccgcagaagc

SEQ ID NO: 3792480 - RNA, 15 nt, Human
accacaccucccuga

SEQ ID NO: 3792481 - RNA, 22 nt, Human
accacaccucccugaaccaucc

SEQ ID NO: 3792482 - RNA, 13 nt, Human
accacaccuggcu

SEQ ID NO: 3792483 - RNA, 22 nt, Human
accacacguaaugaaacuugga

SEQ ID NO: 3792484 - RNA, 16 nt, Human
accacacuggacuccg

SEQ ID NO: 3792485 - RNA, 21 nt, Human
accacacuggacuccggcccu

SEQ ID NO: 3792486 - RNA, 16 nt, Human
accacacuuccugucc

SEQ ID NO: 3792487 - RNA, 21 nt, Human
accacacuuccuguccagaga

SEQ ID NO: 3792488 - RNA, 13 nt, Human
accacacuugaaa

SEQ ID NO: 3792489 - RNA, 12 nt, Human
accacagacaca

SEQ ID NO: 3792490 - RNA, 18 nt, Human
accacagacacacacacg

SEQ ID NO: 3792491 - RNA, 20 nt, Human
accacagacacacacacgca

SEQ ID NO: 3792492 - RNA, 16 nt, Human
accacagccagcaccu

SEQ ID NO: 3792493 - RNA, 14 nt, Human
accacagcccuguc

SEQ ID NO: 3792494 - RNA, 15 nt, Human
accacagcccuguca

SEQ ID NO: 3792495 - RNA, 12 nt, Human
aauugugaaaaa

SEQ ID NO: 3792496 - RNA, 15 nt, Human
aauugugaacucauu

SEQ ID NO: 3792497 - RNA, 16 nt, Human
aauugugaauugauaa

SEQ ID NO: 3792498 - RNA, 11 nt, Human
aauugugaugu

SEQ ID NO: 3792499 - RNA, 20 nt, Human
aauugugccgagaaaagcau

SEQ ID NO: 3792500 - RNA, 13 nt, Human
aauugugcugcca

SEQ ID NO: 3792501 - RNA, 12 nt, Human
aauugugcuucu

SEQ ID NO: 3792502 - RNA, 17 nt, Human
aauugugcuucucccca

SEQ ID NO: 3792503 - RNA, 21 nt, Human
aauuguggggaugaugaaaua

SEQ ID NO: 3792504 - RNA, 16 nt, Human
aauugugggucuauuu

SEQ ID NO: 3792505 - RNA, 21 nt, Human
aauugugggucuauuucuagu

SEQ ID NO: 3792506 - RNA, 19 nt, Human
aauugugugauauuucaga

SEQ ID NO: 3792507 - RNA, 23 nt, Human
aauugugugauauuucagaaaua

SEQ ID NO: 3792508 - RNA, 19 nt, Human
aauuguguggauucuuuaa

SEQ ID NO: 3792509 - RNA, 23 nt, Human
aauugugugugaugugaagccaa

SEQ ID NO: 3792510 - RNA, 20 nt, Human
aauuguguuuacauuuuaug

SEQ ID NO: 3792511 - RNA, 23 nt, Human
aauuguuccuuggagaaaugaaa

SEQ ID NO: 3792512 - RNA, 20 nt, Human
aauuguugaacagguguuuu

SEQ ID NO: 3792513 - RNA, 21 nt, Human
aauuguugaacagguguuuuu

SEQ ID NO: 3792514 - RNA, 17 nt, Human
aauuguugagauacuuu

SEQ ID NO: 3792515 - RNA, 12 nt, Human
aauuguuguucu

SEQ ID NO: 3792516 - RNA, 23 nt, Human
aauuguuguucuguuaacugaau

SEQ ID NO: 3792517 - RNA, 13 nt, Human
aauuguuguuucu

SEQ ID NO: 3792518 - RNA, 15 nt, Human
aauuguuguuucuuu

SEQ ID NO: 3792519 - RNA, 17 nt, Human
aauuguuguuucuuucu

SEQ ID NO: 3792520 - RNA, 20 nt, Human
aauuguuguuucuuucuagu

SEQ ID NO: 3792521 - RNA, 13 nt, Human
aauuguuguuugu

SEQ ID NO: 3792522 - RNA, 17 nt, Human
aauuguuguuuguaugu

SEQ ID NO: 3792523 - RNA, 13 nt, Human
aauuguuuaaaaa

SEQ ID NO: 3792524 - RNA, 20 nt, Human
aauuguuuaaguguuguaaa

SEQ ID NO: 3792525 - RNA, 12 nt, Human
aauuguuucaca

SEQ ID NO: 3792526 - RNA, 19 nt, Human
aauuguuuggcuuccuccu

SEQ ID NO: 3792527 - RNA, 20 nt, Human
aauuguuuguaagugaagug

SEQ ID NO: 3792528 - RNA, 15 nt, Human
aauuguuuguccuca

SEQ ID NO: 3792529 - RNA, 16 nt, Human
aauuguuugucuuuaa

SEQ ID NO: 3792530 - RNA, 14 nt, Human
aauuuaaaaaaaua

SEQ ID NO: 3792531 - RNA, 13 nt, Human
aauuuaaaaaaua

SEQ ID NO: 3792532 - RNA, 18 nt, Human
aauuuaaaaaauaaauaa

SEQ ID NO: 3792533 - RNA, 14 nt, Human
aauuuaaaaauaua

SEQ ID NO: 3792534 - RNA, 15 nt, Human
aauuuaaaaauauau

SEQ ID NO: 3792535 - RNA, 21 nt, Human
aauuuaaaaguaaaaugucuu

SEQ ID NO: 3792536 - RNA, 9 nt, Human
aauuuaaac

SEQ ID NO: 3792537 - RNA, 15 nt, Human
aauuuaaacaccucc

SEQ ID NO: 3792538 - RNA, 19 nt, Human
aauuuaaacaccuccucau

SEQ ID NO: 3792539 - RNA, 18 nt, Human
aauuuaaacaggcccagc

SEQ ID NO: 3792540 - RNA, 13 nt, Human
aauuuaaacauua

SEQ ID NO: 3792541 - RNA, 14 nt, Human
aauuuaaacauuaa

SEQ ID NO: 3792542 - RNA, 22 nt, Human
aauuuaaacauuaaaaauggaa

SEQ ID NO: 3792543 - RNA, 17 nt, Human
aauuuaaacccauuuua

SEQ ID NO: 3792544 - RNA, 20 nt, Human
aauuuaaagaaguaugggaa

SEQ ID NO: 3792545 - RNA, 17 nt, Human
aauuuaaagauauuguu

SEQ ID NO: 3792546 - RNA, 12 nt, Human
aauuuaaagcaa

SEQ ID NO: 3792547 - RNA, 15 nt, Human
aauuuaaagccacaa

SEQ ID NO: 3792548 - RNA, 18 nt, Human
aauuuaaaggguguacuu

SEQ ID NO: 3792549 - RNA, 22 nt, Human
aauuuaaaggguguacuuauau

SEQ ID NO: 3792550 - RNA, 22 nt, Human
aauuuaaaguuguuugugccuu

SEQ ID NO: 3792551 - RNA, 16 nt, Human
aauuuaaauagcuuuu

SEQ ID NO: 3792552 - RNA, 14 nt, Human
aauuuaaauauaau

SEQ ID NO: 3792553 - RNA, 23 nt, Human
aauuuaaauauaauucuguaaau

SEQ ID NO: 3792554 - RNA, 18 nt, Human
aauuuaaaugaaagaaaa

SEQ ID NO: 3792555 - RNA, 19 nt, Human
aauuuaaaugaaagaaaau

SEQ ID NO: 3792556 - RNA, 13 nt, Human
aauuuaaauguua

SEQ ID NO: 3792557 - RNA, 13 nt, Human
aauuuaagcauug

SEQ ID NO: 3792558 - RNA, 14 nt, Human
aauuuaagcauugu

SEQ ID NO: 3792559 - RNA, 15 nt, Human
aauuuaagcauuguu

SEQ ID NO: 3792560 - RNA, 23 nt, Human
aauuuaagcauuguuugcuuauu

SEQ ID NO: 3792561 - RNA, 15 nt, Human
aauuuaagcuuaagc

SEQ ID NO: 3792562 - RNA, 16 nt, Human
aauuuaaggucuguuu

SEQ ID NO: 3792563 - RNA, 14 nt, Human
aauuuaagugcgug

SEQ ID NO: 3792564 - RNA, 23 nt, Human
aauuuaagugcguguguagaguu

SEQ ID NO: 3792565 - RNA, 12 nt, Human
aauuuaaguuuu

SEQ ID NO: 3792566 - RNA, 20 nt, Human
aauuuaaguuuugacaagcu

SEQ ID NO: 3792567 - RNA, 24 nt, Human
aauuuaaguuuugacaagcuggcu

SEQ ID NO: 3792568 - RNA, 15 nt, Human
aauuuaauauuuacu

SEQ ID NO: 3792569 - RNA, 14 nt, Human
aauuuaaucuuuuu

SEQ ID NO: 3792570 - RNA, 16 nt, Human
aauuuacaaaaauaua

SEQ ID NO: 3792571 - RNA, 13 nt, Human
aauuuacaaagug

SEQ ID NO: 3792572 - RNA, 14 nt, Human
aauuuacaaagugu

SEQ ID NO: 3792573 - RNA, 15 nt, Human
aauuuacaaagugug

SEQ ID NO: 3792574 - RNA, 18 nt, Human
aauuuacagagacagaaa

SEQ ID NO: 3792575 - RNA, 15 nt, Human
aauuuacauacucug

SEQ ID NO: 3792576 - RNA, 13 nt, Human
aauuuaccuaaga

SEQ ID NO: 3792577 - RNA, 18 nt, Human
aauuuaccuaagauuaca

SEQ ID NO: 3792578 - RNA, 16 nt, Human
aauuuacuacaauaug

SEQ ID NO: 3792579 - RNA, 21 nt, Human
aauuuacuacaauauguacau

SEQ ID NO: 3792580 - RNA, 22 nt, Human
aauuuacuacaauauguacauu

SEQ ID NO: 3792581 - RNA, 13 nt, Human
aauuuacuauaua

SEQ ID NO: 3792582 - RNA, 16 nt, Human
aauuuacuauauauau

SEQ ID NO: 3792583 - RNA, 16 nt, Human
aauuuacuuguuuugg

SEQ ID NO: 3792584 - RNA, 16 nt, Human
aauuuacuuuaaacua

SEQ ID NO: 3792585 - RNA, 22 nt, Human
aauuuagaaaaagaacaugcag

SEQ ID NO: 3792586 - RNA, 17 nt, Human
aauuuagaaauauaauu

SEQ ID NO: 3792587 - RNA, 17 nt, Human
aauuuagaaaucauuuu

SEQ ID NO: 3792588 - RNA, 21 nt, Human
aauuuagaaaucauuuugcaa

SEQ ID NO: 3792589 - RNA, 16 nt, Human
aauuuagacuuggauu

SEQ ID NO: 3792590 - RNA, 16 nt, Human
aauuuagauuguaaac

SEQ ID NO: 3792591 - RNA, 16 nt, Human
aauuuaggguacuaaa

SEQ ID NO: 3792592 - RNA, 22 nt, Human
aauuuaggguacuaaauuuaaa

SEQ ID NO: 3792593 - RNA, 20 nt, Human
aauuugucauuuugaagcua

SEQ ID NO: 3792594 - RNA, 22 nt, Human
aauuugucauuuugaagcuaau

SEQ ID NO: 3792595 - RNA, 20 nt, Human
aauuuguguaauaaaguguu

SEQ ID NO: 3792596 - RNA, 17 nt, Human
aauuuguguaauauuac

SEQ ID NO: 3792597 - RNA, 14 nt, Human
aauuuguguguuuu

SEQ ID NO: 3792598 - RNA, 17 nt, Human
aauuuguguguuuuuag

SEQ ID NO: 3792599 - RNA, 16 nt, Human
aauuuguuauaaugaa

SEQ ID NO: 3792600 - RNA, 14 nt, Human
aauuuguucuugua

SEQ ID NO: 3792601 - RNA, 12 nt, Human
aauuuguugcau

SEQ ID NO: 3792602 - RNA, 13 nt, Human
aauuuguuugugc

SEQ ID NO: 3792603 - RNA, 15 nt, Human
aauuuuaaagccauu

SEQ ID NO: 3792604 - RNA, 16 nt, Human
aauuuuaaagugcaaa

SEQ ID NO: 3792605 - RNA, 17 nt, Human
aauuuuaaauaaaagug

SEQ ID NO: 3792606 - RNA, 18 nt, Human
aauuuuaaauaaaaguga

SEQ ID NO: 3792607 - RNA, 19 nt, Human
aauuuuaaccuaugauauu

SEQ ID NO: 3792608 - RNA, 16 nt, Human
aauuuuaagauuccuu

SEQ ID NO: 3792609 - RNA, 17 nt, Human
aauuuuaagauuccuuu

SEQ ID NO: 3792610 - RNA, 18 nt, Human
aauuuuaagauuccuuuu

SEQ ID NO: 3792611 - RNA, 18 nt, Human
aauuuuaagcuaggaaaa

SEQ ID NO: 3792612 - RNA, 13 nt, Human
aauuuuaaugcua

SEQ ID NO: 3792613 - RNA, 15 nt, Human
aauuuuaauuuauuu

SEQ ID NO: 3792614 - RNA, 23 nt, Human
aauuuuacaagggcauaaaguaa

SEQ ID NO: 3792615 - RNA, 20 nt, Human
aauuuuacauguuuauaaau

SEQ ID NO: 3792616 - RNA, 12 nt, Human
aauuuuacauuu

SEQ ID NO: 3792617 - RNA, 17 nt, Human
aauuuuaccaaguuaua

SEQ ID NO: 3792618 - RNA, 23 nt, Human
aauuuuaccaaguuauauaaaga

SEQ ID NO: 3792619 - RNA, 17 nt, Human
aauuuuacccuuuagac

SEQ ID NO: 3792620 - RNA, 12 nt, Human
aauuuuaggaac

SEQ ID NO: 3792621 - RNA, 13 nt, Human
aauuuuaguauuc

SEQ ID NO: 3792622 - RNA, 14 nt, Human
aauuuuaguauuca

SEQ ID NO: 3792623 - RNA, 19 nt, Human
aauuuuauagcucaguuua

SEQ ID NO: 3792624 - RNA, 16 nt, Human
aauuuuaucucuuauu

SEQ ID NO: 3792625 - RNA, 14 nt, Human
aauuuuaucuguuu

SEQ ID NO: 3792626 - RNA, 19 nt, Human
aauuuuaugaacugcaugu

SEQ ID NO: 3792627 - RNA, 20 nt, Human
aauuuuaugaacugcaugua

SEQ ID NO: 3792628 - RNA, 12 nt, Human
aauuuuaugaau

SEQ ID NO: 3792629 - RNA, 12 nt, Human
aauuuuauuccu

SEQ ID NO: 3792630 - RNA, 19 nt, Human
aauuuuauuuuaaaauuuc

SEQ ID NO: 3792631 - RNA, 19 nt, Human
aauuuucaaguaauuguga

SEQ ID NO: 3792632 - RNA, 13 nt, Human
aauuuucagauuu

SEQ ID NO: 3792633 - RNA, 14 nt, Human
aauuuucagauuug

SEQ ID NO: 3792634 - RNA, 18 nt, Human
aauuuucaucuaggauuu

SEQ ID NO: 3792635 - RNA, 12 nt, Human
aauuuucauuuu

SEQ ID NO: 3792636 - RNA, 13 nt, Human
aauuuucauuuua

SEQ ID NO: 3792637 - RNA, 15 nt, Human
aauuuucauuuuaca

SEQ ID NO: 3792638 - RNA, 19 nt, Human
aauuuucauuuuacaguua

SEQ ID NO: 3792639 - RNA, 19 nt, Human
aauuuucauuuugcacuga

SEQ ID NO: 3792640 - RNA, 16 nt, Human
aauuuuccuugaagcc

SEQ ID NO: 3792641 - RNA, 17 nt, Human
aauuuuccuugaagccg

SEQ ID NO: 3792642 - RNA, 11 nt, Human
aauuuuccuuu

SEQ ID NO: 3792643 - RNA, 15 nt, Human
aauuuucuaaaagcu

SEQ ID NO: 3792644 - RNA, 16 nt, Human
aauuuucuaaaagcuu

SEQ ID NO: 3792645 - RNA, 20 nt, Human
aauuuucuacaaauaauuuu

SEQ ID NO: 3792646 - RNA, 23 nt, Human
aauuuucucaaaagcauuuauca

SEQ ID NO: 3792647 - RNA, 21 nt, Human
aauuuucuguguucugaaguc

SEQ ID NO: 3792648 - RNA, 17 nt, Human
aauuuucuucaguuggu

SEQ ID NO: 3792649 - RNA, 14 nt, Human
aauuuucuucaugc

SEQ ID NO: 3792650 - RNA, 19 nt, Human
aauuuucuugaugacugga

SEQ ID NO: 3792651 - RNA, 12 nt, Human
aauuuucuuuca

SEQ ID NO: 3792652 - RNA, 13 nt, Human
aauuuugaaaaac

SEQ ID NO: 3792653 - RNA, 13 nt, Human
aauuuugaaaagu

SEQ ID NO: 3792654 - RNA, 16 nt, Human
aauuuugauaguggga

SEQ ID NO: 3792655 - RNA, 16 nt, Human
aauuuugaugaacaaa

SEQ ID NO: 3792656 - RNA, 21 nt, Human
aauuuugcaaauauaaacauc

SEQ ID NO: 3792657 - RNA, 22 nt, Human
aauuuugcuggaauuccuaacu

SEQ ID NO: 3792658 - RNA, 20 nt, Human
aauuuugguuguauucuuug

SEQ ID NO: 3792659 - RNA, 15 nt, Human
aauuuuguaacgaag

SEQ ID NO: 3792660 - RNA, 12 nt, Human
aauuuuguaauu

SEQ ID NO: 3792661 - RNA, 13 nt, Human
aauuuuguaauuu

SEQ ID NO: 3792662 - RNA, 13 nt, Human
accccaggcccac

SEQ ID NO: 3792663 - RNA, 15 nt, Human
accccaggcccacuc

SEQ ID NO: 3792664 - RNA, 13 nt, Human
accccaggccccg

SEQ ID NO: 3792665 - RNA, 10 nt, Human
accccagggc

SEQ ID NO: 3792666 - RNA, 16 nt, Human
accccagggcacagga

SEQ ID NO: 3792667 - RNA, 15 nt, Human
accccagggccugag

SEQ ID NO: 3792668 - RNA, 17 nt, Human
accccagggccugagcc

SEQ ID NO: 3792669 - RNA, 24 nt, Human
accccagggccugagccuggccag

SEQ ID NO: 3792670 - RNA, 13 nt, Human
accccagguuucu

SEQ ID NO: 3792671 - RNA, 17 nt, Human
accccaguggccacuca

SEQ ID NO: 3792672 - RNA, 19 nt, Human
accccaguggccacucagc

SEQ ID NO: 3792673 - RNA, 23 nt, Human
accccaguucugcuccucuccag

SEQ ID NO: 3792674 - RNA, 15 nt, Human
accccaguuuuuguu

SEQ ID NO: 3792675 - RNA, 19 nt, Human
accccauagugaccggcug

SEQ ID NO: 3792676 - RNA, 15 nt, Human
accccaucccacacc

SEQ ID NO: 3792677 - RNA, 16 nt, Human
accccaucugcauucc

SEQ ID NO: 3792678 - RNA, 14 nt, Human
accccaucugccca

SEQ ID NO: 3792679 - RNA, 17 nt, Human
accccaucugcccagga

SEQ ID NO: 3792680 - RNA, 15 nt, Human
accccaucugugaau

SEQ ID NO: 3792681 - RNA, 16 nt, Human
accccaucugugaaua

SEQ ID NO: 3792682 - RNA, 23 nt, Human
accccaugucaccggauccuggg

SEQ ID NO: 3792683 - RNA, 15 nt, Human
accccauucccgcag

SEQ ID NO: 3792684 - RNA, 13 nt, Human
accccauucuuug

SEQ ID NO: 3792685 - RNA, 19 nt, Human
accccauuucucuccucac

SEQ ID NO: 3792686 - RNA, 18 nt, Human
accccauuugcuuucuuu

SEQ ID NO: 3792687 - RNA, 14 nt, Human
acccccacacacac

SEQ ID NO: 3792688 - RNA, 21 nt, Human
acccccacacacacacacaug

SEQ ID NO: 3792689 - RNA, 17 nt, Human
acccccacaccucaguu

SEQ ID NO: 3792690 - RNA, 15 nt, Human
acccccaccaagggc

SEQ ID NO: 3792691 - RNA, 12 nt, Human
acccccacccca

SEQ ID NO: 3792692 - RNA, 15 nt, Human
acccccaccccacac

SEQ ID NO: 3792693 - RNA, 17 nt, Human
acccccaccccacacuu

SEQ ID NO: 3792694 - RNA, 15 nt, Human
acccccacccccagc

SEQ ID NO: 3792695 - RNA, 18 nt, Human
acccccacccccagcuca

SEQ ID NO: 3792696 - RNA, 14 nt, Human
acccccaccccuuc

SEQ ID NO: 3792697 - RNA, 20 nt, Human
acccccaccccuuccccacu

SEQ ID NO: 3792698 - RNA, 21 nt, Human
acccccacucucauuccccag

SEQ ID NO: 3792699 - RNA, 17 nt, Human
acccccacuggacugac

SEQ ID NO: 3792700 - RNA, 12 nt, Human
acccccagcccc

SEQ ID NO: 3792701 - RNA, 12 nt, Human
acccccagccug

SEQ ID NO: 3792702 - RNA, 14 nt, Human
acccccagccugcu

SEQ ID NO: 3792703 - RNA, 15 nt, Human
acccccagccugcua

SEQ ID NO: 3792704 - RNA, 13 nt, Human
acccccagccugg

SEQ ID NO: 3792705 - RNA, 16 nt, Human
acccccagccugggcc

SEQ ID NO: 3792706 - RNA, 12 nt, Human
acccccagcuca

SEQ ID NO: 3792707 - RNA, 20 nt, Human
acccccagcucaauggacug

SEQ ID NO: 3792708 - RNA, 21 nt, Human
acccccagcucaauggacugg

SEQ ID NO: 3792709 - RNA, 13 nt, Human
acccccagcuccc

SEQ ID NO: 3792710 - RNA, 14 nt, Human
acccccagcuuugc

SEQ ID NO: 3792711 - RNA, 15 nt, Human
acccccauucugucc

SEQ ID NO: 3792712 - RNA, 18 nt, Human
acccccauuucuauuuau

SEQ ID NO: 3792713 - RNA, 13 nt, Human
accccccaccugc

SEQ ID NO: 3792714 - RNA, 20 nt, Human
accccccagaaccuguccuu

SEQ ID NO: 3792715 - RNA, 12 nt, Human
acccccccagcu

SEQ ID NO: 3792716 - RNA, 14 nt, Human
accccccgugggcu

SEQ ID NO: 3792717 - RNA, 18 nt, Human
accccccuuucacaggca

SEQ ID NO: 3792718 - RNA, 22 nt, Human
acccccgaguuuggucccuggg

SEQ ID NO: 3792719 - RNA, 17 nt, Human
acccccucaccccucca

SEQ ID NO: 3792720 - RNA, 13 nt, Human
acccccucccacc

SEQ ID NO: 3792721 - RNA, 19 nt, Human
acccccucccacccccagc

SEQ ID NO: 3792722 - RNA, 14 nt, Human
acccccuccccagg

SEQ ID NO: 3792723 - RNA, 16 nt, Human
acccccuccccagggg

SEQ ID NO: 3792724 - RNA, 16 nt, Human
acccccucccuggccu

SEQ ID NO: 3792725 - RNA, 20 nt, Human
acccccucccuggccuguuc

SEQ ID NO: 3792726 - RNA, 13 nt, Human
acccccuccucuc

SEQ ID NO: 3792727 - RNA, 14 nt, Human
acccccuccugcug

SEQ ID NO: 3792728 - RNA, 16 nt, Human
acccccuccuucagac

SEQ ID NO: 3792729 - RNA, 21 nt, Human
acccccucgggucuccucacu

SEQ ID NO: 3792730 - RNA, 14 nt, Human
acccccucuagaaa

SEQ ID NO: 3792731 - RNA, 21 nt, Human
acccccucuucugagcacaga

SEQ ID NO: 3792732 - RNA, 20 nt, Human
acccccugagauccccugag

SEQ ID NO: 3792733 - RNA, 17 nt, Human
acccccugcaaagccca

SEQ ID NO: 3792734 - RNA, 20 nt, Human
acccccugcaaagcccagcu

SEQ ID NO: 3792735 - RNA, 12 nt, Human
acccccugcagc

SEQ ID NO: 3792736 - RNA, 13 nt, Human
acccccugcagcu

SEQ ID NO: 3792737 - RNA, 15 nt, Human
acccccugcccugca

SEQ ID NO: 3792738 - RNA, 13 nt, Human
acccccugugccu

SEQ ID NO: 3792739 - RNA, 17 nt, Human
acccccuuaaauuuaau

SEQ ID NO: 3792740 - RNA, 11 nt, Human
acccccuuccc

SEQ ID NO: 3792741 - RNA, 11 nt, Human
acaaucuauuu

SEQ ID NO: 3792742 - RNA, 17 nt, Human
acaaucucccuucacaa

SEQ ID NO: 3792743 - RNA, 12 nt, Human
acaaucucuuaa

SEQ ID NO: 3792744 - RNA, 18 nt, Human
acaaucuuaaggggcagc

SEQ ID NO: 3792745 - RNA, 19 nt, Human
acaaucuuaaggggcagcu

SEQ ID NO: 3792746 - RNA, 12 nt, Human
acaaucuucugu

SEQ ID NO: 3792747 - RNA, 24 nt, Human
acaaugaacaucccuuuuucaaug

SEQ ID NO: 3792748 - RNA, 16 nt, Human
acaaugacauuuauau

SEQ ID NO: 3792749 - RNA, 17 nt, Human
acaaugacuuacuguac

SEQ ID NO: 3792750 - RNA, 19 nt, Human
acaaugacuuacuguacau

SEQ ID NO: 3792751 - RNA, 22 nt, Human
acaaugacuuacuguacaugaa

SEQ ID NO: 3792752 - RNA, 21 nt, Human
acaaugaucaccgacugaaaa

SEQ ID NO: 3792753 - RNA, 20 nt, Human
acaaugauccuguauucaga

SEQ ID NO: 3792754 - RNA, 16 nt, Human
acaaugaugaugauaa

SEQ ID NO: 3792755 - RNA, 22 nt, Human
acaaugcaccuagcugugcaag

SEQ ID NO: 3792756 - RNA, 24 nt, Human
acaaugcaguacaggacauauauu

SEQ ID NO: 3792757 - RNA, 22 nt, Human
acaaugcaguucugagcaccgu

SEQ ID NO: 3792758 - RNA, 20 nt, Human
acaaugccuauuguaauaua

SEQ ID NO: 3792759 - RNA, 17 nt, Human
acaaugcuguauuuuaa

SEQ ID NO: 3792760 - RNA, 18 nt, Human
acaaugcuguauuuuaaa

SEQ ID NO: 3792761 - RNA, 22 nt, Human
acaaugcugugcccuaaagugu

SEQ ID NO: 3792762 - RNA, 16 nt, Human
acaauggaaacugaau

SEQ ID NO: 3792763 - RNA, 18 nt, Human
acaauggacccuuuuugu

SEQ ID NO: 3792764 - RNA, 19 nt, Human
acaauggauaggcacagga

SEQ ID NO: 3792765 - RNA, 18 nt, Human
acaauggcagaacaggug

SEQ ID NO: 3792766 - RNA, 14 nt, Human
acaaugguaacauu

SEQ ID NO: 3792767 - RNA, 22 nt, Human
acaaugguguuauuugaaacuu

SEQ ID NO: 3792768 - RNA, 15 nt, Human
acaauguaauuauuu

SEQ ID NO: 3792769 - RNA, 18 nt, Human
acaauguaauuauuuaug

SEQ ID NO: 3792770 - RNA, 23 nt, Human
acaauguauuuauuuaaaagauu

SEQ ID NO: 3792771 - RNA, 18 nt, Human
acaaugucaguauuucag

SEQ ID NO: 3792772 - RNA, 11 nt, Human
acaaugucugc

SEQ ID NO: 3792773 - RNA, 17 nt, Human
acaaugugaaaagaaaa

SEQ ID NO: 3792774 - RNA, 17 nt, Human
acaaugugaacuuuauu

SEQ ID NO: 3792775 - RNA, 17 nt, Human
acaaugugacuuugaaa

SEQ ID NO: 3792776 - RNA, 23 nt, Human
acaaugugucuuucuuuuuggac

SEQ ID NO: 3792777 - RNA, 19 nt, Human
acaauguguuuuucuccag

SEQ ID NO: 3792778 - RNA, 21 nt, Human
acaauguuaaggaaacucuua

SEQ ID NO: 3792779 - RNA, 15 nt, Human
acaauguucauccca

SEQ ID NO: 3792780 - RNA, 12 nt, Human
acaauguucuuu

SEQ ID NO: 3792781 - RNA, 22 nt, Human
acaauguuguagugucccccac

SEQ ID NO: 3792782 - RNA, 16 nt, Human
acaauuaaagcuguua

SEQ ID NO: 3792783 - RNA, 21 nt, Human
acaauuagauaaauguccauu

SEQ ID NO: 3792784 - RNA, 14 nt, Human
acaauuccaaagga

SEQ ID NO: 3792785 - RNA, 23 nt, Human
acaauuccuagauaaaaagaugg

SEQ ID NO: 3792786 - RNA, 23 nt, Human
acaauuccucuacuaacaaucag

SEQ ID NO: 3792787 - RNA, 24 nt, Human
acaauucuaaaaugauuguaguaa

SEQ ID NO: 3792788 - RNA, 21 nt, Human
acaauucuguuuuuaaugcua

SEQ ID NO: 3792789 - RNA, 17 nt, Human
acaauucuuuauacaac

SEQ ID NO: 3792790 - RNA, 12 nt, Human
acaauugaaaug

SEQ ID NO: 3792791 - RNA, 19 nt, Human
acaauugaaguaaacuuuu

SEQ ID NO: 3792792 - RNA, 17 nt, Human
acaauugaagucaauua

SEQ ID NO: 3792793 - RNA, 21 nt, Human
acaauugcuuacucauuaaaa

SEQ ID NO: 3792794 - RNA, 20 nt, Human
acaauugggagcugccaaga

SEQ ID NO: 3792795 - RNA, 22 nt, Human
acaauugguaaaacucacugug

SEQ ID NO: 3792796 - RNA, 22 nt, Human
acaauugugggcauaaacuguu

SEQ ID NO: 3792797 - RNA, 14 nt, Human
acaauuguguagcc

SEQ ID NO: 3792798 - RNA, 17 nt, Human
acaauuguguagccuuu

SEQ ID NO: 3792799 - RNA, 23 nt, Human
acaauuguguagccuuuuuguau

SEQ ID NO: 3792800 - RNA, 20 nt, Human
acaauuuaaagcaaaggagu

SEQ ID NO: 3792801 - RNA, 20 nt, Human
acaauuuacaaaguguguau

SEQ ID NO: 3792802 - RNA, 23 nt, Human
acaauuuacaaaguguguauuaa

SEQ ID NO: 3792803 - RNA, 23 nt, Human
acaauuuauaaaauagaaauaua

SEQ ID NO: 3792804 - RNA, 18 nt, Human
acaauuuaugaauugaau

SEQ ID NO: 3792805 - RNA, 13 nt, Human
acaauuuauuaug

SEQ ID NO: 3792806 - RNA, 15 nt, Human
acaauuuauuuuauu

SEQ ID NO: 3792807 - RNA, 20 nt, Human
acaauuuauuuuauuuuagc

SEQ ID NO: 3792808 - RNA, 20 nt, Human
acaauuucaaaaaaauaaaa

SEQ ID NO: 3792809 - RNA, 17 nt, Human
acaauuuccuuuauauu

SEQ ID NO: 3792810 - RNA, 16 nt, Human
acaauuucuuuugguu

SEQ ID NO: 3792811 - RNA, 13 nt, Human
acaauuugauaca

SEQ ID NO: 3792812 - RNA, 15 nt, Human
acaauuugauacaua

SEQ ID NO: 3792813 - RNA, 18 nt, Human
acaauuuggcaauuuugu

SEQ ID NO: 3792814 - RNA, 16 nt, Human
acaauuuucagauuug

SEQ ID NO: 3792815 - RNA, 12 nt, Human
acaauuuuguac

SEQ ID NO: 3792816 - RNA, 20 nt, Human
acaauuuuguuucuguacuu

SEQ ID NO: 3792817 - RNA, 21 nt, Human
acaauuuuuauuucuuuuacu

SEQ ID NO: 3792818 - RNA, 16 nt, Human
acaauuuuuuaucaug

SEQ ID NO: 3792819 - RNA, 17 nt, Human
acaauuuuuuuaauuuu

SEQ ID NO: 3792820 - RNA, 18 nt, Human
acaauuuuuuuaauuuug

SEQ ID NO: 3792821 - RNA, 17 nt, Human
acaauuuuuuuuauuag

SEQ ID NO: 3792822 - RNA, 18 nt, Human
acaauuuuuuuuauuagu

SEQ ID NO: 3792823 - RNA, 16 nt, Human
acacaaaacuccgccc

SEQ ID NO: 3792824 - RNA, 19 nt, Human
acacaaaaguuucucuuuu

SEQ ID NO: 3792825 - RNA, 22 nt, Human
acacaaacaaacaagcuaggug

SEQ ID NO: 3792826 - RNA, 16 nt, Human
acacaaaccugccugg

SEQ ID NO: 3792827 - RNA, 17 nt, Human
acacaaaccugccuggg

SEQ ID NO: 3792828 - RNA, 12 nt, Human
acacaaagagag

SEQ ID NO: 3792829 - RNA, 13 nt, Human
acacaaaggaagu

SEQ ID NO: 3792830 - RNA, 13 nt, Human
acacaaaggggau

SEQ ID NO: 3792831 - RNA, 13 nt, Human
acacaacaaaaau

SEQ ID NO: 3792832 - RNA, 15 nt, Human
acacaacaaaaauuu

SEQ ID NO: 3792833 - RNA, 13 nt, Human
acacaacacacac

SEQ ID NO: 3792834 - RNA, 17 nt, Human
acacaacggcagugaag

SEQ ID NO: 3792835 - RNA, 18 nt, Human
acacaagcccacagcaca

SEQ ID NO: 3792836 - RNA, 14 nt, Human
acacaaggggcccu

SEQ ID NO: 3792837 - RNA, 20 nt, Human
acacaaggucauggccacac

SEQ ID NO: 3792838 - RNA, 16 nt, Human
acacaaguaagagacu

SEQ ID NO: 3792839 - RNA, 15 nt, Human
acacaaguccuguga

SEQ ID NO: 3792840 - RNA, 22 nt, Human
acacaagugcaguagugcaguu

SEQ ID NO: 3792841 - RNA, 13 nt, Human
acacaauaagcaa

SEQ ID NO: 3792842 - RNA, 14 nt, Human
acacaauaugaaua

SEQ ID NO: 3792843 - RNA, 16 nt, Human
acacaauguuauucgu

SEQ ID NO: 3792844 - RNA, 17 nt, Human
acacaauuggaagucua

SEQ ID NO: 3792845 - RNA, 14 nt, Human
acacacaacaauua

SEQ ID NO: 3792846 - RNA, 14 nt, Human
acacacaaguaaga

SEQ ID NO: 3792847 - RNA, 10 nt, Human
acacacacaa

SEQ ID NO: 3792848 - RNA, 16 nt, Human
acacacacaaagagag

SEQ ID NO: 3792849 - RNA, 13 nt, Human
acacacacacaca

SEQ ID NO: 3792850 - RNA, 15 nt, Human
acacacacacagcca

SEQ ID NO: 3792851 - RNA, 13 nt, Human
acacacacacaug

SEQ ID NO: 3792852 - RNA, 13 nt, Human
acacacacacgca

SEQ ID NO: 3792853 - RNA, 14 nt, Human
acacacacacgcac

SEQ ID NO: 3792854 - RNA, 15 nt, Human
acacacacagaaaau

SEQ ID NO: 3792855 - RNA, 16 nt, Human
acacacacagaaaaua

SEQ ID NO: 3792856 - RNA, 14 nt, Human
acacacacagaugu

SEQ ID NO: 3792857 - RNA, 11 nt, Human
acacacacagc

SEQ ID NO: 3792858 - RNA, 11 nt, Human
acacacacaua

SEQ ID NO: 3792859 - RNA, 14 nt, Human
acacacacauacac

SEQ ID NO: 3792860 - RNA, 17 nt, Human
acacacacauacacgaa

SEQ ID NO: 3792861 - RNA, 14 nt, Human
acacacacauauac

SEQ ID NO: 3792862 - RNA, 17 nt, Human
acacacaccacacauac

SEQ ID NO: 3792863 - RNA, 12 nt, Human
acacacacgcac

SEQ ID NO: 3792864 - RNA, 15 nt, Human
acacacacgcacaua

SEQ ID NO: 3792865 - RNA, 21 nt, Human
acacacacgcacgcacacaca

SEQ ID NO: 3792866 - RNA, 23 nt, Human
accucagcucugggagaggauuu

SEQ ID NO: 3792867 - RNA, 12 nt, Human
accucaggaaag

SEQ ID NO: 3792868 - RNA, 17 nt, Human
accucaggaaagaauag

SEQ ID NO: 3792869 - RNA, 23 nt, Human
accucaggaaagaauagaaagaa

SEQ ID NO: 3792870 - RNA, 17 nt, Human
accucaggcacuagccu

SEQ ID NO: 3792871 - RNA, 12 nt, Human
accucaggcagg

SEQ ID NO: 3792872 - RNA, 15 nt, Human
accucaggcaggaag

SEQ ID NO: 3792873 - RNA, 21 nt, Human
accucaggccaggugcagugg

SEQ ID NO: 3792874 - RNA, 11 nt, Human
accucaggccu

SEQ ID NO: 3792875 - RNA, 18 nt, Human
accucaggcuuccuuggc

SEQ ID NO: 3792876 - RNA, 12 nt, Human
accucagggcuc

SEQ ID NO: 3792877 - RNA, 15 nt, Human
accucagggcuccca

SEQ ID NO: 3792878 - RNA, 20 nt, Human
accucagggcucccaggggu

SEQ ID NO: 3792879 - RNA, 15 nt, Human
accucaggugaucca

SEQ ID NO: 3792880 - RNA, 21 nt, Human
accucaggugauccacccacc

SEQ ID NO: 3792881 - RNA, 14 nt, Human
accucagguugcug

SEQ ID NO: 3792882 - RNA, 19 nt, Human
accucagguugcugguugc

SEQ ID NO: 3792883 - RNA, 15 nt, Human
accucaguaauuuag

SEQ ID NO: 3792884 - RNA, 17 nt, Human
accucagucaguauugu

SEQ ID NO: 3792885 - RNA, 18 nt, Human
accucagucaguauuguu

SEQ ID NO: 3792886 - RNA, 21 nt, Human
acacacagguggugucacugu

SEQ ID NO: 3792887 - RNA, 14 nt, Human
acacacaugcacac

SEQ ID NO: 3792888 - RNA, 14 nt, Human
acacacaugcauac

SEQ ID NO: 3792889 - RNA, 16 nt, Human
acacacaugcauacac

SEQ ID NO: 3792890 - RNA, 18 nt, Human
acacacaugcauacacac

SEQ ID NO: 3792891 - RNA, 14 nt, Human
acacaccagagccc

SEQ ID NO: 3792892 - RNA, 17 nt, Human
acacaccaggcgcuaau

SEQ ID NO: 3792893 - RNA, 16 nt, Human
acacaccaggcugugg

SEQ ID NO: 3792894 - RNA, 18 nt, Human
acacaccaggcugugggc

SEQ ID NO: 3792895 - RNA, 22 nt, Human
acacaccaggcugugggccuca

SEQ ID NO: 3792896 - RNA, 13 nt, Human
acacacccugagg

SEQ ID NO: 3792897 - RNA, 15 nt, Human
acacacgcacgcaca

SEQ ID NO: 3792898 - RNA, 17 nt, Human
acacacgcacgcacaca

SEQ ID NO: 3792899 - RNA, 14 nt, Human
acacacgcugccuu

SEQ ID NO: 3792900 - RNA, 23 nt, Human
acacacggugccuuuauuuccac

SEQ ID NO: 3792901 - RNA, 19 nt, Human
acacacuacaccacacaca

SEQ ID NO: 3792902 - RNA, 14 nt, Human
acacacugaaagcu

SEQ ID NO: 3792903 - RNA, 15 nt, Human
acacacugaggcagg

SEQ ID NO: 3792904 - RNA, 16 nt, Human
acacacugaggcaggg

SEQ ID NO: 3792905 - RNA, 13 nt, Human
acacacugaugcu

SEQ ID NO: 3792906 - RNA, 21 nt, Human
acacacugcauguuugugauu

SEQ ID NO: 3792907 - RNA, 16 nt, Human
acacacugguacuuag

SEQ ID NO: 3792908 - RNA, 19 nt, Human
acacacugugcuuucuauu

SEQ ID NO: 3792909 - RNA, 16 nt, Human
acacacuguguccugg

SEQ ID NO: 3792910 - RNA, 20 nt, Human
acacacuguguccuggugcu

SEQ ID NO: 3792911 - RNA, 14 nt, Human
acacacuuacuuuu

SEQ ID NO: 3792912 - RNA, 13 nt, Human
acacacuuuauuu

SEQ ID NO: 3792913 - RNA, 23 nt, Human
acacacuuuugguuaagucuguu

SEQ ID NO: 3792914 - RNA, 17 nt, Human
acacacuuuuuauuaga

SEQ ID NO: 3792915 - RNA, 23 nt, Human
acacagaaaauauacuguaaaga

SEQ ID NO: 3792916 - RNA, 20 nt, Human
acacagaaaauguugagaau

SEQ ID NO: 3792917 - RNA, 14 nt, Human
acacagaaacacug

SEQ ID NO: 3792918 - RNA, 14 nt, Human
acacagaaaccaau

SEQ ID NO: 3792919 - RNA, 16 nt, Human
acacagaaaugcugcu

SEQ ID NO: 3792920 - RNA, 20 nt, Human
acacagaaaugcugcuggcc

SEQ ID NO: 3792921 - RNA, 21 nt, Human
acacagaaaugcugcuggcca

SEQ ID NO: 3792922 - RNA, 23 nt, Human
acacagaaggggacugccaccuc

SEQ ID NO: 3792923 - RNA, 12 nt, Human
acacagaccacc

SEQ ID NO: 3792924 - RNA, 20 nt, Human
acacagacuauugacaucag

SEQ ID NO: 3792925 - RNA, 15 nt, Human
acacagacucauauu

SEQ ID NO: 3792926 - RNA, 23 nt, Human
acacagacucauccugaacagca

SEQ ID NO: 3792927 - RNA, 21 nt, Human
acacagacuguugucccugca

SEQ ID NO: 3792928 - RNA, 12 nt, Human
acacagaggaag

SEQ ID NO: 3792929 - RNA, 13 nt, Human
acacagaggaaga

SEQ ID NO: 3792930 - RNA, 17 nt, Human
acacagaggaagagcag

SEQ ID NO: 3792931 - RNA, 20 nt, Human
acacagaggaauuuauaccu

SEQ ID NO: 3792932 - RNA, 21 nt, Human
acacagaugaaacacaaacaa

SEQ ID NO: 3792933 - RNA, 11 nt, Human
acacagccaca

SEQ ID NO: 3792934 - RNA, 14 nt, Human
acacagccacacac

SEQ ID NO: 3792935 - RNA, 19 nt, Human
acacagccacacacacaga

SEQ ID NO: 3792936 - RNA, 20 nt, Human
acacagccacacacacagaa

SEQ ID NO: 3792937 - RNA, 20 nt, Human
acacagccaggugccuugga

SEQ ID NO: 3792938 - RNA, 14 nt, Human
acacagccugggcc

SEQ ID NO: 3792939 - RNA, 18 nt, Human
acacagcgucccuagcag

SEQ ID NO: 3792940 - RNA, 21 nt, Human
acacagcgucccuagcaguga

SEQ ID NO: 3792941 - RNA, 21 nt, Human
acacagcuaacacacagcucc

SEQ ID NO: 3792942 - RNA, 23 nt, Human
acacagcuaacacacagcuccca

SEQ ID NO: 3792943 - RNA, 15 nt, Human
acacagcuacagcuu

SEQ ID NO: 3792944 - RNA, 11 nt, Human
acacagcucug

SEQ ID NO: 3792945 - RNA, 13 nt, Human
acacagcucuucu

SEQ ID NO: 3792946 - RNA, 20 nt, Human
acacagcucuucuccaggcu

SEQ ID NO: 3792947 - RNA, 19 nt, Human
acacagcugcagagacaga

SEQ ID NO: 3792948 - RNA, 11 nt, Human
acacagcugcc

SEQ ID NO: 3792949 - RNA, 18 nt, Human
acacagcuguucuucugu

SEQ ID NO: 3792950 - RNA, 14 nt, Human
acacaggaggagaa

SEQ ID NO: 3792951 - RNA, 16 nt, Human
acacaggcaacugagg

SEQ ID NO: 3792952 - RNA, 19 nt, Human
acacaggcaacugaggcag

SEQ ID NO: 3792953 - RNA, 15 nt, Human
acacaggcagcuuuc

SEQ ID NO: 3792954 - RNA, 18 nt, Human
acacaggcauuuccuggg

SEQ ID NO: 3792955 - RNA, 19 nt, Human
acacaggccacccugugca

SEQ ID NO: 3792956 - RNA, 16 nt, Human
acacaggcccggcucc

SEQ ID NO: 3792957 - RNA, 18 nt, Human
acacaggcccggcuccag

SEQ ID NO: 3792958 - RNA, 21 nt, Human
acacaggcccggcuccaggcu

SEQ ID NO: 3792959 - RNA, 22 nt, Human
acacaggcccggcuccaggcuc

SEQ ID NO: 3792960 - RNA, 16 nt, Human
acacaggcccucccug

SEQ ID NO: 3792961 - RNA, 13 nt, Human
acacaggccugug

SEQ ID NO: 3792962 - RNA, 18 nt, Human
acacagggacuugaaguu

SEQ ID NO: 3792963 - RNA, 17 nt, Human
acacaggggaggugaua

SEQ ID NO: 3792964 - RNA, 21 nt, Human
acacagguggugucacugucc

SEQ ID NO: 3792965 - RNA, 23 nt, Human
acacagucucacccagacuccag

SEQ ID NO: 3792966 - RNA, 19 nt, Human
acacagucuuggcucacug

SEQ ID NO: 3792967 - RNA, 11 nt, Human
acacagugagu

SEQ ID NO: 3792968 - RNA, 19 nt, Human
acacagugccuucaauaaa

SEQ ID NO: 3792969 - RNA, 20 nt, Human
acacagugggaacucugaca

SEQ ID NO: 3792970 - RNA, 22 nt, Human
acacagugggaacucugacaag

SEQ ID NO: 3792971 - RNA, 12 nt, Human
acacauaaagga

SEQ ID NO: 3792972 - RNA, 14 nt, Human
acacauaaaggaua

SEQ ID NO: 3792973 - RNA, 15 nt, Human
acacauaauuaacac

SEQ ID NO: 3792974 - RNA, 22 nt, Human
acacauacaguuuuaugcucuu

SEQ ID NO: 3792975 - RNA, 15 nt, Human
acacauacccucuuc

SEQ ID NO: 3792976 - RNA, 17 nt, Human
acacauaccuuugguua

SEQ ID NO: 3792977 - RNA, 22 nt, Human
acacauacucauuuuucaugau

SEQ ID NO: 3792978 - RNA, 17 nt, Human
acacauagauucaccug

SEQ ID NO: 3792979 - RNA, 21 nt, Human
acacauauaccuauaaugugu

SEQ ID NO: 3792980 - RNA, 16 nt, Human
acacauauauauuaca

SEQ ID NO: 3792981 - RNA, 12 nt, Human
acacaucaguca

SEQ ID NO: 3792982 - RNA, 14 nt, Human
acacaucaucugua

SEQ ID NO: 3792983 - RNA, 15 nt, Human
acacaucaucuguaa

SEQ ID NO: 3792984 - RNA, 20 nt, Human
acacaucccuaaugugugcc

SEQ ID NO: 3792985 - RNA, 18 nt, Human
acacauccgccuuuugua

SEQ ID NO: 3792986 - RNA, 16 nt, Human
acacaucgcacugugg

SEQ ID NO: 3792987 - RNA, 14 nt, Human
acacaucuucccua

SEQ ID NO: 3792988 - RNA, 15 nt, Human
acacaucuucccuag

SEQ ID NO: 3792989 - RNA, 19 nt, Human
acacaugaagguaaauaaa

SEQ ID NO: 3792990 - RNA, 15 nt, Human
acacaugaaguccaa

SEQ ID NO: 3792991 - RNA, 18 nt, Human
acacaugauccugcaauu

SEQ ID NO: 3792992 - RNA, 14 nt, Human
acacaugcauacac

SEQ ID NO: 3792993 - RNA, 17 nt, Human
acacaugcauacacaca

SEQ ID NO: 3792994 - RNA, 18 nt, Human
acacaugcauacacacac

SEQ ID NO: 3792995 - RNA, 19 nt, Human
acacaugcauacacacaca

SEQ ID NO: 3792996 - RNA, 19 nt, Human
acacaugcuucccuuuccu

SEQ ID NO: 3792997 - RNA, 14 nt, Human
acacauggaaaccc

SEQ ID NO: 3792998 - RNA, 19 nt, Human
acacauggaaacccauagg

SEQ ID NO: 3792999 - RNA, 15 nt, Human
acacauguauuuggu

SEQ ID NO: 3793000 - RNA, 19 nt, Human
acacauguccaagaagccc

SEQ ID NO: 3793001 - RNA, 21 nt, Human
acacauguccaagaagcccag

SEQ ID NO: 3793002 - RNA, 18 nt, Human
acacauuacaaaguuaaa

SEQ ID NO: 3793003 - RNA, 20 nt, Human
acacauuaucgggagcagug

SEQ ID NO: 3793004 - RNA, 23 nt, Human
acacauuaucgggagcagugucu

SEQ ID NO: 3793005 - RNA, 18 nt, Human
acacauucggcucccugg

SEQ ID NO: 3793006 - RNA, 21 nt, Human
acacauugcugugaacaggaa

SEQ ID NO: 3793007 - RNA, 14 nt, Human
acacauuguuauuu

SEQ ID NO: 3793008 - RNA, 15 nt, Human
acacauuucaaauga

SEQ ID NO: 3793009 - RNA, 16 nt, Human
acacauuugcuacugu

SEQ ID NO: 3793010 - RNA, 14 nt, Human
acacauuugcuuuu

SEQ ID NO: 3793011 - RNA, 13 nt, Human
acacauuuguaca

SEQ ID NO: 3793012 - RNA, 22 nt, Human
acacauuuguugccagauuuca

SEQ ID NO: 3793013 - RNA, 20 nt, Human
acacauuuuauuuuauuaug

SEQ ID NO: 3793014 - RNA, 21 nt, Human
acacauuuugguucuucucaa

SEQ ID NO: 3793015 - RNA, 13 nt, Human
acacauuuuguau

SEQ ID NO: 3793016 - RNA, 19 nt, Human
acacauuuuuaaauuguua

SEQ ID NO: 3793017 - RNA, 14 nt, Human
acacauuuuucaga

SEQ ID NO: 3793018 - RNA, 14 nt, Human
acacauuuuuuaaa

SEQ ID NO: 3793019 - RNA, 15 nt, Human
acaccaaaaaauauc

SEQ ID NO: 3793020 - RNA, 18 nt, Human
acaccaacauaaaaauga

SEQ ID NO: 3793021 - RNA, 14 nt, Human
acaccaagcacagc

SEQ ID NO: 3793022 - RNA, 21 nt, Human
acaccaagcacagcagccugg

SEQ ID NO: 3793023 - RNA, 13 nt, Human
acaccacacacaa

SEQ ID NO: 3793024 - RNA, 17 nt, Human
acaccacacacaacagc

SEQ ID NO: 3793025 - RNA, 19 nt, Human
acaccacacacaacagcca

SEQ ID NO: 3793026 - RNA, 15 nt, Human
acaccacacccagcc

SEQ ID NO: 3793027 - RNA, 24 nt, Human
acccgaggcugcccacuaugguca

SEQ ID NO: 3793028 - RNA, 12 nt, Human
acccgaugcugc

SEQ ID NO: 3793029 - RNA, 13 nt, Human
acccgaugcugcu

SEQ ID NO: 3793030 - RNA, 23 nt, Human
acccgaugcugcuuuccccugug

SEQ ID NO: 3793031 - RNA, 18 nt, Human
accugcccuuuuuucugc

SEQ ID NO: 3793032 - RNA, 21 nt, Human
accugcccuuuuuucugccuc

SEQ ID NO: 3793033 - RNA, 22 nt, Human
accugcccuuuuuucugccucc

SEQ ID NO: 3793034 - RNA, 13 nt, Human
accugccgaccuc

SEQ ID NO: 3793035 - RNA, 17 nt, Human
accugccgaccucgucc

SEQ ID NO: 3793036 - RNA, 20 nt, Human
accugccgaccucguccucc

SEQ ID NO: 3793037 - RNA, 22 nt, Human
accugccucccuucaugcaugg

SEQ ID NO: 3793038 - RNA, 17 nt, Human
accugccuccugccugc

SEQ ID NO: 3793039 - RNA, 11 nt, Human
accugccucuc

SEQ ID NO: 3793040 - RNA, 19 nt, Human
accugccucucacacacau

SEQ ID NO: 3793041 - RNA, 23 nt, Human
accugccucucacacacauagau

SEQ ID NO: 3793042 - RNA, 11 nt, Human
accugccugcg

SEQ ID NO: 3793043 - RNA, 22 nt, Human
accugccugcgucuuccgcccc

SEQ ID NO: 3793044 - RNA, 19 nt, Human
accugcggugcuaucuccc

SEQ ID NO: 3793045 - RNA, 22 nt, Human
accugcggugcuaucuccccca

SEQ ID NO: 3793046 - RNA, 21 nt, Human
accugcgucucauacucaccu

SEQ ID NO: 3793047 - RNA, 21 nt, Human
accugcuaggccagagcccac

SEQ ID NO: 3793048 - RNA, 20 nt, Human
accugcucacgucaaaugca

SEQ ID NO: 3793049 - RNA, 16 nt, Human
accugcucagcccugc

SEQ ID NO: 3793050 - RNA, 17 nt, Human
accugcucccaggccag

SEQ ID NO: 3793051 - RNA, 15 nt, Human
accugcuccgcugcu

SEQ ID NO: 3793052 - RNA, 22 nt, Human
accugcuccgcugcuccuuggc

SEQ ID NO: 3793053 - RNA, 14 nt, Human
accugcucuccucu

SEQ ID NO: 3793054 - RNA, 17 nt, Human
accugcucuccucuucu

SEQ ID NO: 3793055 - RNA, 23 nt, Human
accugcucugugcccacccucca

SEQ ID NO: 3793056 - RNA, 16 nt, Human
accugcugaccugugc

SEQ ID NO: 3793057 - RNA, 17 nt, Human
accugcugaccugugca

SEQ ID NO: 3793058 - RNA, 18 nt, Human
accugcugaccugugcac

SEQ ID NO: 3793059 - RNA, 15 nt, Human
accugcugagcucug

SEQ ID NO: 3793060 - RNA, 21 nt, Human
accugcugagcucugagaggc

SEQ ID NO: 3793061 - RNA, 18 nt, Human
accugcugagggaccagc

SEQ ID NO: 3793062 - RNA, 19 nt, Human
accugcugagggaccagcc

SEQ ID NO: 3793063 - RNA, 11 nt, Human
accugcugcuu

SEQ ID NO: 3793064 - RNA, 19 nt, Human
accugcuucaugcucagcc

SEQ ID NO: 3793065 - RNA, 23 nt, Human
accugcuucaugcucagcccuga

SEQ ID NO: 3793066 - RNA, 15 nt, Human
accugcuucucugcc

SEQ ID NO: 3793067 - RNA, 18 nt, Human
accugcuuggguggagaa

SEQ ID NO: 3793068 - RNA, 20 nt, Human
accugcuuggguggagaagc

SEQ ID NO: 3793069 - RNA, 22 nt, Human
accugcuuggguggagaagcca

SEQ ID NO: 3793070 - RNA, 15 nt, Human
accugcuuucaagac

SEQ ID NO: 3793071 - RNA, 15 nt, Human
accugcuuugacuga

SEQ ID NO: 3793072 - RNA, 15 nt, Human
accugcuuuucaaug

SEQ ID NO: 3793073 - RNA, 19 nt, Human
accugcuuuucaauguguu

SEQ ID NO: 3793074 - RNA, 15 nt, Human
accugcuuuuugaaa

SEQ ID NO: 3793075 - RNA, 16 nt, Human
accugcuuuuugaaau

SEQ ID NO: 3793076 - RNA, 18 nt, Human
accugcuuuuugaaauga

SEQ ID NO: 3793077 - RNA, 23 nt, Human
accugcuuuuugaaaugaaauuu

SEQ ID NO: 3793078 - RNA, 20 nt, Human
acacuuuucaugugugauuu

SEQ ID NO: 3793079 - RNA, 21 nt, Human
acacuuuuucucuuuccauga

SEQ ID NO: 3793080 - RNA, 22 nt, Human
acacuuuuuuggggauaugcuu

SEQ ID NO: 3793081 - RNA, 14 nt, Human
acagaaaaaccuug

SEQ ID NO: 3793082 - RNA, 21 nt, Human
acagaaaaaccuuggguuaga

SEQ ID NO: 3793083 - RNA, 15 nt, Human
acagaaaaagacuuu

SEQ ID NO: 3793084 - RNA, 18 nt, Human
acagaaaacaacaaaaaa

SEQ ID NO: 3793085 - RNA, 19 nt, Human
acagaaaacaacaaaaaau

SEQ ID NO: 3793086 - RNA, 21 nt, Human
acagaaaacaacaaaaaauaa

SEQ ID NO: 3793087 - RNA, 12 nt, Human
acagaaaauaua

SEQ ID NO: 3793088 - RNA, 18 nt, Human
acagaaaauauacuguaa

SEQ ID NO: 3793089 - RNA, 13 nt, Human
acagaaaauaugu

SEQ ID NO: 3793090 - RNA, 15 nt, Human
acagaaaauauguau

SEQ ID NO: 3793091 - RNA, 15 nt, Human
acagaaacacugccu

SEQ ID NO: 3793092 - RNA, 18 nt, Human
acagaaaccucuacuaaa

SEQ ID NO: 3793093 - RNA, 15 nt, Human
acagaaaccuuuuua

SEQ ID NO: 3793094 - RNA, 20 nt, Human
acagaaagagacuccgucuc

SEQ ID NO: 3793095 - RNA, 17 nt, Human
acagaaagagagcacug

SEQ ID NO: 3793096 - RNA, 18 nt, Human
acagaaaguggugcucag

SEQ ID NO: 3793097 - RNA, 17 nt, Human
acagaaauauauauaca

SEQ ID NO: 3793098 - RNA, 20 nt, Human
acagaaauauauauacauau

SEQ ID NO: 3793099 - RNA, 20 nt, Human
acagaaauugguaccuugca

SEQ ID NO: 3793100 - RNA, 21 nt, Human
acagaaauugguaccuugcac

SEQ ID NO: 3793101 - RNA, 23 nt, Human
acagaaauugguaccuugcacac

SEQ ID NO: 3793102 - RNA, 14 nt, Human
acagaaauuguaua

SEQ ID NO: 3793103 - RNA, 16 nt, Human
acagaaauuguauauu

SEQ ID NO: 3793104 - RNA, 23 nt, Human
acagaaauuguauauuguaauuu

SEQ ID NO: 3793105 - RNA, 12 nt, Human
acagaaauuuaa

SEQ ID NO: 3793106 - RNA, 19 nt, Human
acagaacaaauguuuguuu

SEQ ID NO: 3793107 - RNA, 12 nt, Human
acagaacacugu

SEQ ID NO: 3793108 - RNA, 15 nt, Human
acagaacagcuucag

SEQ ID NO: 3793109 - RNA, 18 nt, Human
acagaacagcuucagguu

SEQ ID NO: 3793110 - RNA, 14 nt, Human
acagaacaggguca

SEQ ID NO: 3793111 - RNA, 16 nt, Human
acagaacauagacaga

SEQ ID NO: 3793112 - RNA, 17 nt, Human
acagaacaucauuagaa

SEQ ID NO: 3793113 - RNA, 21 nt, Human
acagaacaugcuguuauuuag

SEQ ID NO: 3793114 - RNA, 23 nt, Human
acagaaccuuguuauuucucaga

SEQ ID NO: 3793115 - RNA, 16 nt, Human
acagaacuaaauguuc

SEQ ID NO: 3793116 - RNA, 20 nt, Human
acagaacucgguguccccac

SEQ ID NO: 3793117 - RNA, 18 nt, Human
acagaacucuuucaaaac

SEQ ID NO: 3793118 - RNA, 14 nt, Human
acagaacuucagaa

SEQ ID NO: 3793119 - RNA, 17 nt, Human
acagaacuucagaaaga

SEQ ID NO: 3793120 - RNA, 20 nt, Human
acagaacuucagaaagacuu

SEQ ID NO: 3793121 - RNA, 18 nt, Human
acagaagaaaauagaauu

SEQ ID NO: 3793122 - RNA, 15 nt, Human
acagaagaaacuggg

SEQ ID NO: 3793123 - RNA, 20 nt, Human
acagaagaaggcagcaggug

SEQ ID NO: 3793124 - RNA, 13 nt, Human
acagaagcauuug

SEQ ID NO: 3793125 - RNA, 22 nt, Human
acagaagcauuuguauuuugug

SEQ ID NO: 3793126 - RNA, 15 nt, Human
acagaagccaggagc

SEQ ID NO: 3793127 - RNA, 18 nt, Human
acagaagccaggagcaaa

SEQ ID NO: 3793128 - RNA, 21 nt, Human
acagaagccucacugcaagca

SEQ ID NO: 3793129 - RNA, 19 nt, Human
acagaagcuucagaaguuu

SEQ ID NO: 3793130 - RNA, 19 nt, Human
acagaaggcuccugccccc

SEQ ID NO: 3793131 - RNA, 17 nt, Human
acagaagggagggcaga

SEQ ID NO: 3793132 - RNA, 22 nt, Human
acagaagggagggcagagcugg

SEQ ID NO: 3793133 - RNA, 13 nt, Human
acagaaguccugu

SEQ ID NO: 3793134 - RNA, 15 nt, Human
acagaaguccuguau

SEQ ID NO: 3793135 - RNA, 22 nt, Human
acagaaguccuguaugucuguc

SEQ ID NO: 3793136 - RNA, 15 nt, Human
acagaauaaugaaug

SEQ ID NO: 3793137 - RNA, 22 nt, Human
acagaauacuguuaaaggaaaa

SEQ ID NO: 3793138 - RNA, 15 nt, Human
acagaauauuuuuau

SEQ ID NO: 3793139 - RNA, 23 nt, Human
acagaaucauaugauucugcuuu

SEQ ID NO: 3793140 - RNA, 15 nt, Human
acagaaugaaaaaug

SEQ ID NO: 3793141 - RNA, 20 nt, Human
acagaauguaucugugaagu

SEQ ID NO: 3793142 - RNA, 20 nt, Human
acagaauguuuuacugugaa

SEQ ID NO: 3793143 - RNA, 19 nt, Human
acagacaaaaacagccuca

SEQ ID NO: 3793144 - RNA, 20 nt, Human
acagacaaaaacagccucac

SEQ ID NO: 3793145 - RNA, 14 nt, Human
acagacaacagaag

SEQ ID NO: 3793146 - RNA, 18 nt, Human
acagacacacacacgcac

SEQ ID NO: 3793147 - RNA, 11 nt, Human
acagacacagg

SEQ ID NO: 3793148 - RNA, 13 nt, Human
acagacacaggcc

SEQ ID NO: 3793149 - RNA, 14 nt, Human
acagacacaggccc

SEQ ID NO: 3793150 - RNA, 15 nt, Human
acagacacaggcccg

SEQ ID NO: 3793151 - RNA, 22 nt, Human
acagacacaggcccggcuccag

SEQ ID NO: 3793152 - RNA, 22 nt, Human
acagacacuaacgaaauaucaa

SEQ ID NO: 3793153 - RNA, 21 nt, Human
acagacacucccacuuggcau

SEQ ID NO: 3793154 - RNA, 14 nt, Human
acagacacuggcau

SEQ ID NO: 3793155 - RNA, 21 nt, Human
acagacagagaaggcagcagg

SEQ ID NO: 3793156 - RNA, 13 nt, Human
acagacagcccuc

SEQ ID NO: 3793157 - RNA, 13 nt, Human
acagacaggcucu

SEQ ID NO: 3793158 - RNA, 18 nt, Human
acagacauacuaaccagc

SEQ ID NO: 3793159 - RNA, 14 nt, Human
acagacauauuuaa

SEQ ID NO: 3793160 - RNA, 12 nt, Human
acagacauuguu

SEQ ID NO: 3793161 - RNA, 14 nt, Human
acagacccugcccu

SEQ ID NO: 3793162 - RNA, 18 nt, Human
acagaccgaacuguugua

SEQ ID NO: 3793163 - RNA, 22 nt, Human
acagaccuggagccccugggug

SEQ ID NO: 3793164 - RNA, 21 nt, Human
acagacggaaggguaaacaau

SEQ ID NO: 3793165 - RNA, 15 nt, Human
acagacguaugcuua

SEQ ID NO: 3793166 - RNA, 17 nt, Human
acagacuauuuaacuug

SEQ ID NO: 3793167 - RNA, 14 nt, Human
acagacuauuuuua

SEQ ID NO: 3793168 - RNA, 17 nt, Human
acagacuauuuuuagau

SEQ ID NO: 3793169 - RNA, 23 nt, Human
acagacuauuuuuagauuuucuu

SEQ ID NO: 3793170 - RNA, 20 nt, Human
acagacucaaaugcucagac

SEQ ID NO: 3793171 - RNA, 11 nt, Human
acagacugcaa

SEQ ID NO: 3793172 - RNA, 22 nt, Human
acagacuggaagcacagcuuca

SEQ ID NO: 3793173 - RNA, 12 nt, Human
acagacuuguau

SEQ ID NO: 3793174 - RNA, 14 nt, Human
acagacuuguauau

SEQ ID NO: 3793175 - RNA, 14 nt, Human
acgccuuguucuug

SEQ ID NO: 3793176 - RNA, 13 nt, Human
acgcgaaaccaau

SEQ ID NO: 3793177 - RNA, 21 nt, Human
acgcgcagaugugcagcagau

SEQ ID NO: 3793178 - RNA, 17 nt, Human
acgcgccccccucccag

SEQ ID NO: 3793179 - RNA, 20 nt, Human
acgcgccccccucccagagg

SEQ ID NO: 3793180 - RNA, 20 nt, Human
acgcgccuugucuccuacuc

SEQ ID NO: 3793181 - RNA, 18 nt, Human
acgcgcuucgacuuuucu

SEQ ID NO: 3793182 - RNA, 20 nt, Human
acgcgguuugguuugcagcg

SEQ ID NO: 3793183 - RNA, 20 nt, Human
acgcguaucuaggcuuuggu

SEQ ID NO: 3793184 - RNA, 23 nt, Human
acgcguguguacacgggacugac

SEQ ID NO: 3793185 - RNA, 13 nt, Human
acgcguugaaauu

SEQ ID NO: 3793186 - RNA, 13 nt, Human
acgcuacccggga

SEQ ID NO: 3793187 - RNA, 21 nt, Human
acgcuacccgggaagggggcu

SEQ ID NO: 3793188 - RNA, 18 nt, Human
acgcuacuauaaagagaa

SEQ ID NO: 3793189 - RNA, 14 nt, Human
acgcuauuccagcu

SEQ ID NO: 3793190 - RNA, 22 nt, Human
acgcuauuccagcugucccccc

SEQ ID NO: 3793191 - RNA, 17 nt, Human
acgcuccagcugccccg

SEQ ID NO: 3793192 - RNA, 19 nt, Human
acgcucccucccccugccc

SEQ ID NO: 3793193 - RNA, 20 nt, Human
acgcuccgcugccgugccgc

SEQ ID NO: 3793194 - RNA, 22 nt, Human
acgcuccucccucugaggcugu

SEQ ID NO: 3793195 - RNA, 14 nt, Human
acgcuccuuccucu

SEQ ID NO: 3793196 - RNA, 21 nt, Human
acgcuccuuuguguguguguc

SEQ ID NO: 3793197 - RNA, 22 nt, Human
acgcuccuuuguguguguguca

SEQ ID NO: 3793198 - RNA, 18 nt, Human
acgcucucuacucugcuu

SEQ ID NO: 3793199 - RNA, 11 nt, Human
acgcucucugg

SEQ ID NO: 3793200 - RNA, 15 nt, Human
acgcucucuggccuu

SEQ ID NO: 3793201 - RNA, 11 nt, Human
acgcucugcug

SEQ ID NO: 3793202 - RNA, 13 nt, Human
acgcugaauaaau

SEQ ID NO: 3793203 - RNA, 16 nt, Human
acgcugaauaaauguc

SEQ ID NO: 3793204 - RNA, 19 nt, Human
acgcugaauaaaugucuuu

SEQ ID NO: 3793205 - RNA, 17 nt, Human
acgcugacuacagggcc

SEQ ID NO: 3793206 - RNA, 15 nt, Human
acgcugagccaccug

SEQ ID NO: 3793207 - RNA, 22 nt, Human
acgcugagccaccugcccuuuu

SEQ ID NO: 3793208 - RNA, 16 nt, Human
acgcugauacauaacu

SEQ ID NO: 3793209 - RNA, 12 nt, Human
acgcugccugcc

SEQ ID NO: 3793210 - RNA, 14 nt, Human
acgcugccugcccg

SEQ ID NO: 3793211 - RNA, 18 nt, Human
acgcugccuucgguaccc

SEQ ID NO: 3793212 - RNA, 14 nt, Human
acgcugcucugccc

SEQ ID NO: 3793213 - RNA, 15 nt, Human
acgcugcucugcccc

SEQ ID NO: 3793214 - RNA, 16 nt, Human
acgcugcucugcccca

SEQ ID NO: 3793215 - RNA, 19 nt, Human
acgcugcucugccccagcu

SEQ ID NO: 3793216 - RNA, 20 nt, Human
acgcugcucugccccagcuu

SEQ ID NO: 3793217 - RNA, 12 nt, Human
acgcugcuguca

SEQ ID NO: 3793218 - RNA, 13 nt, Human
acgcuggaccuug

SEQ ID NO: 3793219 - RNA, 16 nt, Human
acgcuggagugcagug

SEQ ID NO: 3793220 - RNA, 19 nt, Human
acgcuggagugcagugagc

SEQ ID NO: 3793221 - RNA, 19 nt, Human
acgcugguagagauggagg

SEQ ID NO: 3793222 - RNA, 19 nt, Human
acgcugucuccagaccccc

SEQ ID NO: 3793223 - RNA, 21 nt, Human
acgcugucuccagacccccac

SEQ ID NO: 3793224 - RNA, 22 nt, Human
acgcugucuccagacccccacc

SEQ ID NO: 3793225 - RNA, 23 nt, Human
acgcugucuccagacccccaccc

SEQ ID NO: 3793226 - RNA, 15 nt, Human
acgcugugcugcccu

SEQ ID NO: 3793227 - RNA, 17 nt, Human
acgcugugcugcccugc

SEQ ID NO: 3793228 - RNA, 22 nt, Human
acgcugugcugcccugcccacc

SEQ ID NO: 3793229 - RNA, 14 nt, Human
acgcugugggcagg

SEQ ID NO: 3793230 - RNA, 15 nt, Human
acgcugugggcaggu

SEQ ID NO: 3793231 - RNA, 22 nt, Human
acgcuguucuaauggcacuuau

SEQ ID NO: 3793232 - RNA, 13 nt, Human
acgcuucacagug

SEQ ID NO: 3793233 - RNA, 13 nt, Human
acgcuucuccgga

SEQ ID NO: 3793234 - RNA, 18 nt, Human
acgcuugcguaugucugu

SEQ ID NO: 3793235 - RNA, 20 nt, Human
acgcuugcguaugucuguua

SEQ ID NO: 3793236 - RNA, 15 nt, Human
acgcuugcucauuuu

SEQ ID NO: 3793237 - RNA, 22 nt, Human
acagagggucacaguguuuaca

SEQ ID NO: 3793238 - RNA, 19 nt, Human
acagagguauuaaaacuaa

SEQ ID NO: 3793239 - RNA, 21 nt, Human
acagaguaaauagcauucucu

SEQ ID NO: 3793240 - RNA, 14 nt, Human
acagaguaagacau

SEQ ID NO: 3793241 - RNA, 23 nt, Human
acagaguacuuggcuguuagccc

SEQ ID NO: 3793242 - RNA, 23 nt, Human
acagaguaugaacaccugggcuu

SEQ ID NO: 3793243 - RNA, 15 nt, Human
acagagucaaggccu

SEQ ID NO: 3793244 - RNA, 17 nt, Human
acagagucucacuguug

SEQ ID NO: 3793245 - RNA, 23 nt, Human
acagagucucacuguugcccagg

SEQ ID NO: 3793246 - RNA, 19 nt, Human
acagagugauagccuuccg

SEQ ID NO: 3793247 - RNA, 18 nt, Human
acagaguggucuuucugg

SEQ ID NO: 3793248 - RNA, 19 nt, Human
acagaguggucuuucugga

SEQ ID NO: 3793249 - RNA, 16 nt, Human
acagaguuguuacauu

SEQ ID NO: 3793250 - RNA, 13 nt, Human
acagauaagcaag

SEQ ID NO: 3793251 - RNA, 15 nt, Human
acagauaagcaagag

SEQ ID NO: 3793252 - RNA, 21 nt, Human
acagauaauaauggguuucuu

SEQ ID NO: 3793253 - RNA, 14 nt, Human
acagauaaucagug

SEQ ID NO: 3793254 - RNA, 13 nt, Human
acagauaccucca

SEQ ID NO: 3793255 - RNA, 22 nt, Human
acagauacuggaaguuuugcau

SEQ ID NO: 3793256 - RNA, 21 nt, Human
acagauaguaucuagcaauca

SEQ ID NO: 3793257 - RNA, 15 nt, Human
acagauauacuuugu

SEQ ID NO: 3793258 - RNA, 20 nt, Human
acagaucauagauuucugau

SEQ ID NO: 3793259 - RNA, 21 nt, Human
acagaucauagauuucugauu

SEQ ID NO: 3793260 - RNA, 22 nt, Human
acagaucaucuuggaacugcau

SEQ ID NO: 3793261 - RNA, 17 nt, Human
acagaucuccaaagcuu

SEQ ID NO: 3793262 - RNA, 16 nt, Human
acagaucuggaaccuc

SEQ ID NO: 3793263 - RNA, 22 nt, Human
acagaucuggaaccucagccug

SEQ ID NO: 3793264 - RNA, 13 nt, Human
acagaugaaaauu

SEQ ID NO: 3793265 - RNA, 16 nt, Human
acagaugaaaauuuga

SEQ ID NO: 3793266 - RNA, 23 nt, Human
acagaugaaaauuugagacuauu

SEQ ID NO: 3793267 - RNA, 19 nt, Human
acagaugaaacacaaacaa

SEQ ID NO: 3793268 - RNA, 14 nt, Human
acagaugaauaaac

SEQ ID NO: 3793269 - RNA, 17 nt, Human
acagaugaauguauuua

SEQ ID NO: 3793270 - RNA, 20 nt, Human
acagaugaugagaauuucua

SEQ ID NO: 3793271 - RNA, 20 nt, Human
acagaugccauauaguguua

SEQ ID NO: 3793272 - RNA, 13 nt, Human
acagaugccccag

SEQ ID NO: 3793273 - RNA, 17 nt, Human
acagaugccccagagcu

SEQ ID NO: 3793274 - RNA, 21 nt, Human
acagaugccccagagcuguuu

SEQ ID NO: 3793275 - RNA, 13 nt, Human
acagaugccuccu

SEQ ID NO: 3793276 - RNA, 17 nt, Human
acagauggauuugccug

SEQ ID NO: 3793277 - RNA, 22 nt, Human
acagauggcacuuugaaggggc

SEQ ID NO: 3793278 - RNA, 14 nt, Human
acagauguccauca

SEQ ID NO: 3793279 - RNA, 22 nt, Human
acagauguccaucagaugacaa

SEQ ID NO: 3793280 - RNA, 22 nt, Human
acagaugugggcuuugauuucc

SEQ ID NO: 3793281 - RNA, 16 nt, Human
acagauucacacuguc

SEQ ID NO: 3793282 - RNA, 19 nt, Human
acagauugccuguuucuga

SEQ ID NO: 3793283 - RNA, 13 nt, Human
acagauugcugcu

SEQ ID NO: 3793284 - RNA, 24 nt, Human
acagauuggagagggcucugugcu

SEQ ID NO: 3793285 - RNA, 15 nt, Human
acagauuggauuuua

SEQ ID NO: 3793286 - RNA, 23 nt, Human
acagauuguuucuauacaaauau

SEQ ID NO: 3793287 - RNA, 17 nt, Human
acagauuucauaccuca

SEQ ID NO: 3793288 - RNA, 20 nt, Human
acagauuuccauccuaguca

SEQ ID NO: 3793289 - RNA, 14 nt, Human
acagauuugagcuc

SEQ ID NO: 3793290 - RNA, 14 nt, Human
acagauuuggaaag

SEQ ID NO: 3793291 - RNA, 20 nt, Human
acagauuuggugaauuugaa

SEQ ID NO: 3793292 - RNA, 13 nt, Human
acagauuugugaa

SEQ ID NO: 3793293 - RNA, 14 nt, Human
acagauuugugaac

SEQ ID NO: 3793294 - RNA, 21 nt, Human
acagauuugugaacucagcca

SEQ ID NO: 3793295 - RNA, 11 nt, Human
acagauuuuaa

SEQ ID NO: 3793296 - RNA, 17 nt, Human
acagauuuuaauuguca

SEQ ID NO: 3793297 - RNA, 19 nt, Human
acagauuuugauagcaaag

SEQ ID NO: 3793298 - RNA, 17 nt, Human
acagauuuuuacaaaug

SEQ ID NO: 3793299 - RNA, 15 nt, Human
acagcaaaaccauug

SEQ ID NO: 3793300 - RNA, 15 nt, Human
acagcaaacaggugc

SEQ ID NO: 3793301 - RNA, 19 nt, Human
acagcaaauuuauaauuuu

SEQ ID NO: 3793302 - RNA, 20 nt, Human
acagcaacacaaagcuuuug

SEQ ID NO: 3793303 - RNA, 22 nt, Human
acagcaacgaucacaaaugacu

SEQ ID NO: 3793304 - RNA, 16 nt, Human
acagcaaggagauuua

SEQ ID NO: 3793305 - RNA, 17 nt, Human
acagcaaggagauuuac

SEQ ID NO: 3793306 - RNA, 18 nt, Human
acagcaagggugauggga

SEQ ID NO: 3793307 - RNA, 19 nt, Human
acagcaauuccucaggcua

SEQ ID NO: 3793308 - RNA, 14 nt, Human
acagcaauuucuaa

SEQ ID NO: 3793309 - RNA, 13 nt, Human
acagcacagagaa

SEQ ID NO: 3793310 - RNA, 21 nt, Human
acagcacagagaagacaaaau

SEQ ID NO: 3793311 - RNA, 12 nt, Human
acagcacagcca

SEQ ID NO: 3793312 - RNA, 16 nt, Human
acagcacagcucccug

SEQ ID NO: 3793313 - RNA, 17 nt, Human
acagcacaugcuggcca

SEQ ID NO: 3793314 - RNA, 13 nt, Human
acagcaccaaauc

SEQ ID NO: 3793315 - RNA, 19 nt, Human
acagcacgggggccaagga

SEQ ID NO: 3793316 - RNA, 20 nt, Human
acagcacuacucugugccag

SEQ ID NO: 3793317 - RNA, 18 nt, Human
acagcacuacuggguguc

SEQ ID NO: 3793318 - RNA, 22 nt, Human
acagcacuacugggugucauuu

SEQ ID NO: 3793319 - RNA, 21 nt, Human
accuuucaccuuuguguauuu

SEQ ID NO: 3793320 - RNA, 16 nt, Human
accuuucagcugugaa

SEQ ID NO: 3793321 - RNA, 20 nt, Human
accuuucauaaucuuugcuu

SEQ ID NO: 3793322 - RNA, 13 nt, Human
accuuucccaucu

SEQ ID NO: 3793323 - RNA, 14 nt, Human
accuuucccucacc

SEQ ID NO: 3793324 - RNA, 15 nt, Human
accuuucuccuuugu

SEQ ID NO: 3793325 - RNA, 19 nt, Human
accuuucuccuuuguacuu

SEQ ID NO: 3793326 - RNA, 20 nt, Human
accuuucuccuuuguacuuu

SEQ ID NO: 3793327 - RNA, 23 nt, Human
accuuucuccuuuguacuuugug

SEQ ID NO: 3793328 - RNA, 17 nt, Human
accuuugacaaagguaa

SEQ ID NO: 3793329 - RNA, 22 nt, Human
accuuugacaaagguaaaucag

SEQ ID NO: 3793330 - RNA, 14 nt, Human
accuuugcaggcau

SEQ ID NO: 3793331 - RNA, 23 nt, Human
accuuuggguugcaaucugggga

SEQ ID NO: 3793332 - RNA, 19 nt, Human
accuuuguauucucuccug

SEQ ID NO: 3793333 - RNA, 13 nt, Human
accuuugucccca

SEQ ID NO: 3793334 - RNA, 14 nt, Human
accuuuguccccac

SEQ ID NO: 3793335 - RNA, 16 nt, Human
accuuuguccccaccg

SEQ ID NO: 3793336 - RNA, 23 nt, Human
accuuugugggguuuuuggagaa

SEQ ID NO: 3793337 - RNA, 15 nt, Human
accuuuguguauuuu

SEQ ID NO: 3793338 - RNA, 22 nt, Human
accuuuguuugcaucugaaaau

SEQ ID NO: 3793339 - RNA, 22 nt, Human
accuuuuaaauccuguugaaaa

SEQ ID NO: 3793340 - RNA, 14 nt, Human
accuuuuacuguga

SEQ ID NO: 3793341 - RNA, 16 nt, Human
accuuuuacugugaug

SEQ ID NO: 3793342 - RNA, 15 nt, Human
accuuuuauguagca

SEQ ID NO: 3793343 - RNA, 15 nt, Human
accuuuuauguagua

SEQ ID NO: 3793344 - RNA, 16 nt, Human
accuuuuauugacaca

SEQ ID NO: 3793345 - RNA, 13 nt, Human
accuuuucaggaa

SEQ ID NO: 3793346 - RNA, 19 nt, Human
accuuuugggaauguuuua

SEQ ID NO: 3793347 - RNA, 16 nt, Human
accuuuuuauuucaaa

SEQ ID NO: 3793348 - RNA, 15 nt, Human
accuuuuuccuuccu

SEQ ID NO: 3793349 - RNA, 16 nt, Human
accuuuuuuaagauuu

SEQ ID NO: 3793350 - RNA, 20 nt, Human
accuuuuuuaagauuuuucu

SEQ ID NO: 3793351 - RNA, 22 nt, Human
accuuuuuuaagauuuuucuca

SEQ ID NO: 3793352 - RNA, 14 nt, Human
accuuuuuuauaca

SEQ ID NO: 3793353 - RNA, 17 nt, Human
accuuuuuuauacauaa

SEQ ID NO: 3793354 - RNA, 19 nt, Human
accuuuuuuuuuuuuccaa

SEQ ID NO: 3793355 - RNA, 13 nt, Human
acgaaaaaauggu

SEQ ID NO: 3793356 - RNA, 13 nt, Human
acgaaacccacuc

SEQ ID NO: 3793357 - RNA, 14 nt, Human
acgaaagagagaga

SEQ ID NO: 3793358 - RNA, 23 nt, Human
acgaaagagagagaaacaaacuu

SEQ ID NO: 3793359 - RNA, 23 nt, Human
acgaaauaauuguuguucuguua

SEQ ID NO: 3793360 - RNA, 15 nt, Human
acgaacccaccugcu

SEQ ID NO: 3793361 - RNA, 16 nt, Human
acgaacccaccugcug

SEQ ID NO: 3793362 - RNA, 11 nt, Human
acgaagaaaaa

SEQ ID NO: 3793363 - RNA, 14 nt, Human
acgaaggagcccau

SEQ ID NO: 3793364 - RNA, 14 nt, Human
acgaaguguugcau

SEQ ID NO: 3793365 - RNA, 18 nt, Human
acgaauagacaucaaacu

SEQ ID NO: 3793366 - RNA, 14 nt, Human
acgaauauugcuga

SEQ ID NO: 3793367 - RNA, 15 nt, Human
acgaauauugcugau

SEQ ID NO: 3793368 - RNA, 21 nt, Human
acgaauauugcugauggugca

SEQ ID NO: 3793369 - RNA, 14 nt, Human
acgaauauuuucag

SEQ ID NO: 3793370 - RNA, 19 nt, Human
acgaauuucugugcccucc

SEQ ID NO: 3793371 - RNA, 21 nt, Human
acgaauuucugugcccuccug

SEQ ID NO: 3793372 - RNA, 22 nt, Human
acgacaaagccaaacucugcca

SEQ ID NO: 3793373 - RNA, 12 nt, Human
acgacaaagcug

SEQ ID NO: 3793374 - RNA, 15 nt, Human
acgacaaagcugcua

SEQ ID NO: 3793375 - RNA, 23 nt, Human
acgacaaagcugcuaaaucuccu

SEQ ID NO: 3793376 - RNA, 14 nt, Human
acgacaaggaaagg

SEQ ID NO: 3793377 - RNA, 21 nt, Human
acgacacggucggggcaucug

SEQ ID NO: 3793378 - RNA, 16 nt, Human
acgaccggggccagca

SEQ ID NO: 3793379 - RNA, 21 nt, Human
acgacucuuuuccaaacacag

SEQ ID NO: 3793380 - RNA, 12 nt, Human
acgacugucucc

SEQ ID NO: 3793381 - RNA, 16 nt, Human
acgagacguuuccuac

SEQ ID NO: 3793382 - RNA, 17 nt, Human
acgagagcagaggucuc

SEQ ID NO: 3793383 - RNA, 21 nt, Human
acgagaggggaagaguguacu

SEQ ID NO: 3793384 - RNA, 19 nt, Human
acgagcuguuuacuaggga

SEQ ID NO: 3793385 - RNA, 15 nt, Human
acgaggaaccgaaaa

SEQ ID NO: 3793386 - RNA, 16 nt, Human
acgaggcccucgggcc

SEQ ID NO: 3793387 - RNA, 19 nt, Human
acgaggcccucgggcccag

SEQ ID NO: 3793388 - RNA, 17 nt, Human
acgaggcugggccaagc

SEQ ID NO: 3793389 - RNA, 14 nt, Human
acgagggugccgug

SEQ ID NO: 3793390 - RNA, 14 nt, Human
acgagguaugaggu

SEQ ID NO: 3793391 - RNA, 17 nt, Human
acgagucaauccccuca

SEQ ID NO: 3793392 - RNA, 13 nt, Human
acgagugcuaagu

SEQ ID NO: 3793393 - RNA, 23 nt, Human
acgauaaggaagaaacagaagag

SEQ ID NO: 3793394 - RNA, 23 nt, Human
acgauacgcuacuauaaagagaa

SEQ ID NO: 3793395 - RNA, 16 nt, Human
acgaucacaaaugacu

SEQ ID NO: 3793396 - RNA, 21 nt, Human
acagcccucccgccccuuccc

SEQ ID NO: 3793397 - RNA, 20 nt, Human
acagcccugucagugcagcc

SEQ ID NO: 3793398 - RNA, 21 nt, Human
acagcccugucagugcagccc

SEQ ID NO: 3793399 - RNA, 23 nt, Human
acagcccuuaugcgguuaauuuu

SEQ ID NO: 3793400 - RNA, 15 nt, Human
acagcccuuuugucu

SEQ ID NO: 3793401 - RNA, 22 nt, Human
acagccgcagccucccucugac

SEQ ID NO: 3793402 - RNA, 23 nt, Human
acagccgcuccugucugccagcc

SEQ ID NO: 3793403 - RNA, 18 nt, Human
acagccggggccugccua

SEQ ID NO: 3793404 - RNA, 17 nt, Human
acagccgucagccaaau

SEQ ID NO: 3793405 - RNA, 14 nt, Human
acagccucacagaa

SEQ ID NO: 3793406 - RNA, 17 nt, Human
acagccucacagaagaa

SEQ ID NO: 3793407 - RNA, 12 nt, Human
acagccucacuu

SEQ ID NO: 3793408 - RNA, 18 nt, Human
acagccucacuugaaugu

SEQ ID NO: 3793409 - RNA, 15 nt, Human
acagccucccacccc

SEQ ID NO: 3793410 - RNA, 17 nt, Human
acagccuccccugccag

SEQ ID NO: 3793411 - RNA, 12 nt, Human
acagccuccucu

SEQ ID NO: 3793412 - RNA, 17 nt, Human
acagccuccucugucug

SEQ ID NO: 3793413 - RNA, 11 nt, Human
acagccuggca

SEQ ID NO: 3793414 - RNA, 12 nt, Human
acagccuggcac

SEQ ID NO: 3793415 - RNA, 18 nt, Human
acagccugggccccagcu

SEQ ID NO: 3793416 - RNA, 20 nt, Human
acagccuguggcggugccug

SEQ ID NO: 3793417 - RNA, 22 nt, Human
acagccuguggcggugccuggg

SEQ ID NO: 3793418 - RNA, 23 nt, Human
acagccugugucuuuaaaugcug

SEQ ID NO: 3793419 - RNA, 20 nt, Human
acagcgacauagcccauccc

SEQ ID NO: 3793420 - RNA, 17 nt, Human
acagcgagacuccgucu

SEQ ID NO: 3793421 - RNA, 22 nt, Human
acagcgagaggcagagaaagaa

SEQ ID NO: 3793422 - RNA, 17 nt, Human
acagcgagggcagcugc

SEQ ID NO: 3793423 - RNA, 23 nt, Human
acagcgagggcagcugcuauuua

SEQ ID NO: 3793424 - RNA, 18 nt, Human
acagcgccagccucagac

SEQ ID NO: 3793425 - RNA, 18 nt, Human
acagcggagucuguccug

SEQ ID NO: 3793426 - RNA, 18 nt, Human
acagcggcuggacuugga

SEQ ID NO: 3793427 - RNA, 14 nt, Human
acagcgucccuggc

SEQ ID NO: 3793428 - RNA, 15 nt, Human
acagcgucccuggcg

SEQ ID NO: 3793429 - RNA, 17 nt, Human
acagcgucccuggcgca

SEQ ID NO: 3793430 - RNA, 19 nt, Human
acagcgugcuaaaauaaca

SEQ ID NO: 3793431 - RNA, 16 nt, Human
acagcguuaugugucu

SEQ ID NO: 3793432 - RNA, 16 nt, Human
acagcguuuaagacug

SEQ ID NO: 3793433 - RNA, 14 nt, Human
acagcuaacaugga

SEQ ID NO: 3793434 - RNA, 16 nt, Human
acagcuaaugggacac

SEQ ID NO: 3793435 - RNA, 17 nt, Human
acagcuaaugggacacu

SEQ ID NO: 3793436 - RNA, 16 nt, Human
acagcuacaacagccu

SEQ ID NO: 3793437 - RNA, 22 nt, Human
acagcuaucgaacuucacaacu

SEQ ID NO: 3793438 - RNA, 21 nt, Human
acagcuaugcaaaaagcuagu

SEQ ID NO: 3793439 - RNA, 17 nt, Human
acagcuaugggagcccc

SEQ ID NO: 3793440 - RNA, 20 nt, Human
acagcucaagucuucccuga

SEQ ID NO: 3793441 - RNA, 23 nt, Human
acagcucaagucuucccugauca

SEQ ID NO: 3793442 - RNA, 18 nt, Human
acagcucagaaguuucuu

SEQ ID NO: 3793443 - RNA, 23 nt, Human
acagcucaguucuagucucucug

SEQ ID NO: 3793444 - RNA, 22 nt, Human
acagcucccaccccacccccuu

SEQ ID NO: 3793445 - RNA, 14 nt, Human
acagcuccuucugu

SEQ ID NO: 3793446 - RNA, 18 nt, Human
acagcuccuucuguccua

SEQ ID NO: 3793447 - RNA, 20 nt, Human
acagcuccuugggaggaagc

SEQ ID NO: 3793448 - RNA, 22 nt, Human
acagcuccuugggaggaagcag

SEQ ID NO: 3793449 - RNA, 15 nt, Human
acagcucgauccaaa

SEQ ID NO: 3793450 - RNA, 12 nt, Human
acagcucuggcc

SEQ ID NO: 3793451 - RNA, 14 nt, Human
acagcucuguccug

SEQ ID NO: 3793452 - RNA, 18 nt, Human
acagcucuucuccaggcu

SEQ ID NO: 3793453 - RNA, 19 nt, Human
acagcucuucuccaggcug

SEQ ID NO: 3793454 - RNA, 20 nt, Human
acagcucuucuccaggcugu

SEQ ID NO: 3793455 - RNA, 19 nt, Human
acagcucuuuuugugaagu

SEQ ID NO: 3793456 - RNA, 16 nt, Human
acagcugaauuaucua

SEQ ID NO: 3793457 - RNA, 16 nt, Human
acagcugaggucucuu

SEQ ID NO: 3793458 - RNA, 16 nt, Human
acagcugauacuucau

SEQ ID NO: 3793459 - RNA, 18 nt, Human
acagcugcaauucccugg

SEQ ID NO: 3793460 - RNA, 16 nt, Human
acagcugcauuagaaa

SEQ ID NO: 3793461 - RNA, 14 nt, Human
acagcugccucuuc

SEQ ID NO: 3793462 - RNA, 15 nt, Human
acagcugccucuucc

SEQ ID NO: 3793463 - RNA, 19 nt, Human
acuagcaccugccagggag

SEQ ID NO: 3793464 - RNA, 13 nt, Human
acuagcauaucug

SEQ ID NO: 3793465 - RNA, 15 nt, Human
acuagcauaucugcc

SEQ ID NO: 3793466 - RNA, 23 nt, Human
acuagccaacggccccagcuucu

SEQ ID NO: 3793467 - RNA, 22 nt, Human
acuagccagacacucugcucug

SEQ ID NO: 3793468 - RNA, 19 nt, Human
acuagccuuuggcucugga

SEQ ID NO: 3793469 - RNA, 20 nt, Human
acuagccuuuggcucuggag

SEQ ID NO: 3793470 - RNA, 22 nt, Human
acuagccuuuggcucuggagac

SEQ ID NO: 3793471 - RNA, 14 nt, Human
acuagcuuacauga

SEQ ID NO: 3793472 - RNA, 18 nt, Human
acuaggaaauccauucac

SEQ ID NO: 3793473 - RNA, 16 nt, Human
acuaggacucugaggc

SEQ ID NO: 3793474 - RNA, 17 nt, Human
acuaggacucugaggcu

SEQ ID NO: 3793475 - RNA, 15 nt, Human
acuaggauacugcug

SEQ ID NO: 3793476 - RNA, 16 nt, Human
acuaggcauuuguaaa

SEQ ID NO: 3793477 - RNA, 23 nt, Human
acuaggcauuuguaaauauuaaa

SEQ ID NO: 3793478 - RNA, 18 nt, Human
acuaggcccccacuugcc

SEQ ID NO: 3793479 - RNA, 22 nt, Human
acuaggccuugcggcuccucag

SEQ ID NO: 3793480 - RNA, 23 nt, Human
acuaggcugagcaaucugacccu

SEQ ID NO: 3793481 - RNA, 19 nt, Human
acuaggcugggugcccaca

SEQ ID NO: 3793482 - RNA, 22 nt, Human
acuaggcugggugcccacagcc

SEQ ID NO: 3793483 - RNA, 23 nt, Human
acuaggcugggugcccacagccc

SEQ ID NO: 3793484 - RNA, 14 nt, Human
acuagggaccuggg

SEQ ID NO: 3793485 - RNA, 16 nt, Human
acuagggaccugggga

SEQ ID NO: 3793486 - RNA, 18 nt, Human
acuagggagccauguuuc

SEQ ID NO: 3793487 - RNA, 22 nt, Human
acuagggagccauguuucacaa

SEQ ID NO: 3793488 - RNA, 16 nt, Human
acuagggaucccucau

SEQ ID NO: 3793489 - RNA, 22 nt, Human
acuaggggauauaggagaggaa

SEQ ID NO: 3793490 - RNA, 15 nt, Human
acuagguaacuucau

SEQ ID NO: 3793491 - RNA, 16 nt, Human
acuagguaacuucaua

SEQ ID NO: 3793492 - RNA, 22 nt, Human
acuaggugcccagaaugaggcu

SEQ ID NO: 3793493 - RNA, 16 nt, Human
acuagguucaauuccc

SEQ ID NO: 3793494 - RNA, 19 nt, Human
acuaguaaguaauuaugca

SEQ ID NO: 3793495 - RNA, 13 nt, Human
acuaguacaaauu

SEQ ID NO: 3793496 - RNA, 20 nt, Human
acuaguacaaauuauaaaaa

SEQ ID NO: 3793497 - RNA, 19 nt, Human
acuaguaguuccugcuaca

SEQ ID NO: 3793498 - RNA, 18 nt, Human
acuaguauuucuaugaaa

SEQ ID NO: 3793499 - RNA, 20 nt, Human
acuaguauuucuaugaaaua

SEQ ID NO: 3793500 - RNA, 16 nt, Human
acuaguauuuguugag

SEQ ID NO: 3793501 - RNA, 13 nt, Human
acuagucacccca

SEQ ID NO: 3793502 - RNA, 16 nt, Human
acuagugaggaaagau

SEQ ID NO: 3793503 - RNA, 16 nt, Human
acuagugcaaaucaua

SEQ ID NO: 3793504 - RNA, 15 nt, Human
acuagugcugaagcu

SEQ ID NO: 3793505 - RNA, 19 nt, Human
acuagugcugaagcuuauu

SEQ ID NO: 3793506 - RNA, 18 nt, Human
acuaguuacacaucuuca

SEQ ID NO: 3793507 - RNA, 15 nt, Human
acuauaaaacaaaaa

SEQ ID NO: 3793508 - RNA, 13 nt, Human
acuauaaaagcuu

SEQ ID NO: 3793509 - RNA, 19 nt, Human
acuauaaaaugucuucaag

SEQ ID NO: 3793510 - RNA, 20 nt, Human
acuauaaagaaguaacaaaa

SEQ ID NO: 3793511 - RNA, 13 nt, Human
acuauaaagagaa

SEQ ID NO: 3793512 - RNA, 14 nt, Human
acuauaaagagaag

SEQ ID NO: 3793513 - RNA, 14 nt, Human
acuauaagaacuuu

SEQ ID NO: 3793514 - RNA, 18 nt, Human
acuauaagaacuuugagc

SEQ ID NO: 3793515 - RNA, 23 nt, Human
acuauacuugaacaaaaggguca

SEQ ID NO: 3793516 - RNA, 20 nt, Human
acuauagcaaaguaguacuu

SEQ ID NO: 3793517 - RNA, 20 nt, Human
acuauagcccagguccucug

SEQ ID NO: 3793518 - RNA, 20 nt, Human
acuauagcuugcagaacugu

SEQ ID NO: 3793519 - RNA, 15 nt, Human
acuauagguccagaa

SEQ ID NO: 3793520 - RNA, 19 nt, Human
acuauauaauuuauuucca

SEQ ID NO: 3793521 - RNA, 22 nt, Human
acuauauacaucacguuaaagu

SEQ ID NO: 3793522 - RNA, 14 nt, Human
acuauauacaugug

SEQ ID NO: 3793523 - RNA, 16 nt, Human
acuauauagagauguu

SEQ ID NO: 3793524 - RNA, 17 nt, Human
acuauauagagauguuu

SEQ ID NO: 3793525 - RNA, 16 nt, Human
acuauauauauaaaug

SEQ ID NO: 3793526 - RNA, 18 nt, Human
acuauaugcaaacagggu

SEQ ID NO: 3793527 - RNA, 19 nt, Human
acuauauuaguauguaugu

SEQ ID NO: 3793528 - RNA, 19 nt, Human
acuaucaaacugaagccag

SEQ ID NO: 3793529 - RNA, 22 nt, Human
acuaucaguuuguccuguagag

SEQ ID NO: 3793530 - RNA, 14 nt, Human
acuaucauaaaauc

SEQ ID NO: 3793531 - RNA, 17 nt, Human
acuaucaucuuauucag

SEQ ID NO: 3793532 - RNA, 17 nt, Human
acuaucauuuaauaaua

SEQ ID NO: 3793533 - RNA, 17 nt, Human
acuaucccggcugcccu

SEQ ID NO: 3793534 - RNA, 16 nt, Human
acuaucuacucuccuc

SEQ ID NO: 3793535 - RNA, 20 nt, Human
acuaucucuacugaauguca

SEQ ID NO: 3793536 - RNA, 14 nt, Human
acuaucugucuggu

SEQ ID NO: 3793537 - RNA, 22 nt, Human
acuaucugugcguagaaguucu

SEQ ID NO: 3793538 - RNA, 11 nt, Human
acuaucuugug

SEQ ID NO: 3793539 - RNA, 22 nt, Human
acuaucuuuuugcuuacaguuu

SEQ ID NO: 3793540 - RNA, 16 nt, Human
acuaugaaaaugcugg

SEQ ID NO: 3793541 - RNA, 18 nt, Human
acuaugaacuucucucag

SEQ ID NO: 3793542 - RNA, 19 nt, Human
acuaugaacuucucucaga

SEQ ID NO: 3793543 - RNA, 21 nt, Human
acuaugaacuucucucagacu

SEQ ID NO: 3793544 - RNA, 16 nt, Human
acuaugccugugucuu

SEQ ID NO: 3793545 - RNA, 18 nt, Human
acuaugccugugucuucu

SEQ ID NO: 3793546 - RNA, 23 nt, Human
acuaugcguggcuggaaccacau

SEQ ID NO: 3793547 - RNA, 14 nt, Human
acuaugcguuuuua

SEQ ID NO: 3793548 - RNA, 14 nt, Human
acuauggaaaauca

SEQ ID NO: 3793549 - RNA, 17 nt, Human
acuauggaaaaucagcu

SEQ ID NO: 3793550 - RNA, 22 nt, Human
acuauggaaaaucagcugcuca

SEQ ID NO: 3793551 - RNA, 22 nt, Human
acuauggagugcaccaaagaga

SEQ ID NO: 3793552 - RNA, 21 nt, Human
acuauggauaaacuaaacacg

SEQ ID NO: 3793553 - RNA, 16 nt, Human
acuauggcugaguucu

SEQ ID NO: 3793554 - RNA, 15 nt, Human
acuaugggaugagaa

SEQ ID NO: 3793555 - RNA, 16 nt, Human
acuaugguauuugagu

SEQ ID NO: 3793556 - RNA, 14 nt, Human
acuauguaaacuac

SEQ ID NO: 3793557 - RNA, 16 nt, Human
acuauguaaacuacuu

SEQ ID NO: 3793558 - RNA, 19 nt, Human
acuauguacaauauuuuaa

SEQ ID NO: 3793559 - RNA, 21 nt, Human
acuauguacaauauuuuaagc

SEQ ID NO: 3793560 - RNA, 14 nt, Human
acuauguggaugug

SEQ ID NO: 3793561 - RNA, 15 nt, Human
acuauguugcccagg

SEQ ID NO: 3793562 - RNA, 16 nt, Human
acuauguugcccaggc

SEQ ID NO: 3793563 - RNA, 20 nt, Human
acuauguugcccaggcaggu

SEQ ID NO: 3793564 - RNA, 14 nt, Human
acuauuaagcagua

SEQ ID NO: 3793565 - RNA, 20 nt, Human
acuauuaaggauguagcuuu

SEQ ID NO: 3793566 - RNA, 20 nt, Human
acuauuauguuguuagagaa

SEQ ID NO: 3793567 - RNA, 18 nt, Human
acuauucaaacagucuca

SEQ ID NO: 3793568 - RNA, 23 nt, Human
acuauucugauuacacaaaacaa

SEQ ID NO: 3793569 - RNA, 17 nt, Human
acuauucuugauguaaa

SEQ ID NO: 3793570 - RNA, 23 nt, Human
acuauucuugauguaaaaucuug

SEQ ID NO: 3793571 - RNA, 12 nt, Human
acuauugacauc

SEQ ID NO: 3793572 - RNA, 13 nt, Human
acuauugcccagg

SEQ ID NO: 3793573 - RNA, 16 nt, Human
acuauuggaaaguacu

SEQ ID NO: 3793574 - RNA, 23 nt, Human
acuauugugcucagagacacugu

SEQ ID NO: 3793575 - RNA, 14 nt, Human
acuauuguuacauu

SEQ ID NO: 3793576 - RNA, 18 nt, Human
acuauuuaaacuuauaaa

SEQ ID NO: 3793577 - RNA, 21 nt, Human
acuauuuaaacuuauaaauca

SEQ ID NO: 3793578 - RNA, 20 nt, Human
acuauuuaaagccuccucau

SEQ ID NO: 3793579 - RNA, 17 nt, Human
acuauuuaacugacuau

SEQ ID NO: 3793580 - RNA, 18 nt, Human
acuauuuaacuugagggu

SEQ ID NO: 3793581 - RNA, 16 nt, Human
acuauuuaagauguga

SEQ ID NO: 3793582 - RNA, 20 nt, Human
acuauuuaguuuuuguaauu

SEQ ID NO: 3793583 - RNA, 12 nt, Human
acuauuuaucug

SEQ ID NO: 3793584 - RNA, 19 nt, Human
acuauuuauugacucuggg

SEQ ID NO: 3793585 - RNA, 17 nt, Human
acuauuuauuuacaaau

SEQ ID NO: 3793586 - RNA, 16 nt, Human
acuauuuccuuuauaa

SEQ ID NO: 3793587 - RNA, 14 nt, Human
acuauuucggccuu

SEQ ID NO: 3793588 - RNA, 19 nt, Human
acuauuugcuuauuuaaua

SEQ ID NO: 3793589 - RNA, 23 nt, Human
acuauuugcuuauuuaauaaaga

SEQ ID NO: 3793590 - RNA, 16 nt, Human
acuauuugucuuucag

SEQ ID NO: 3793591 - RNA, 15 nt, Human
acuauuuuauucuaa

SEQ ID NO: 3793592 - RNA, 17 nt, Human
acuauuuuauuuucuaa

SEQ ID NO: 3793593 - RNA, 22 nt, Human
acuauuuucagaugugaaccau

SEQ ID NO: 3793594 - RNA, 15 nt, Human
acaguucacacccug

SEQ ID NO: 3793595 - RNA, 18 nt, Human
acaguucacacccugcaa

SEQ ID NO: 3793596 - RNA, 19 nt, Human
acaguucacacccugcaag

SEQ ID NO: 3793597 - RNA, 12 nt, Human
acaguucaguuc

SEQ ID NO: 3793598 - RNA, 20 nt, Human
acaguuccccuauguggaag

SEQ ID NO: 3793599 - RNA, 19 nt, Human
acaguucggugagcuacaa

SEQ ID NO: 3793600 - RNA, 22 nt, Human
acaguucggugagcuacaaaug

SEQ ID NO: 3793601 - RNA, 13 nt, Human
acaguucugaaga

SEQ ID NO: 3793602 - RNA, 15 nt, Human
acaguucuucgggaa

SEQ ID NO: 3793603 - RNA, 21 nt, Human
acaguucuucgggaagagagg

SEQ ID NO: 3793604 - RNA, 24 nt, Human
acaguucuucgggaagagaggagu

SEQ ID NO: 3793605 - RNA, 17 nt, Human
acaguucuugugugguu

SEQ ID NO: 3793606 - RNA, 22 nt, Human
acauagcuacccaaaagagaaa

SEQ ID NO: 3793607 - RNA, 17 nt, Human
acauaguaaguucagca

SEQ ID NO: 3793608 - RNA, 20 nt, Human
acauaguaaguucagcacuu

SEQ ID NO: 3793609 - RNA, 22 nt, Human
acauaguaaguucagcacuugu

SEQ ID NO: 3793610 - RNA, 14 nt, Human
acauagucuggcug

SEQ ID NO: 3793611 - RNA, 15 nt, Human
acauagucuggcugu

SEQ ID NO: 3793612 - RNA, 16 nt, Human
acauagugaugguucc

SEQ ID NO: 3793613 - RNA, 20 nt, Human
acauagugggacccugucuc

SEQ ID NO: 3793614 - RNA, 17 nt, Human
acauaguucuccaguug

SEQ ID NO: 3793615 - RNA, 15 nt, Human
acauaguuuuucagu

SEQ ID NO: 3793616 - RNA, 16 nt, Human
acauauaaauugucuu

SEQ ID NO: 3793617 - RNA, 17 nt, Human
acauauaaauugucuua

SEQ ID NO: 3793618 - RNA, 15 nt, Human
acauauacacacaca

SEQ ID NO: 3793619 - RNA, 20 nt, Human
acauauacacgaauagacau

SEQ ID NO: 3793620 - RNA, 16 nt, Human
acauauaccuauaaug

SEQ ID NO: 3793621 - RNA, 20 nt, Human
acauauaccuauaaugugug

SEQ ID NO: 3793622 - RNA, 23 nt, Human
acauauaccuauaauguguguau

SEQ ID NO: 3793623 - RNA, 15 nt, Human
acauauauauauaua

SEQ ID NO: 3793624 - RNA, 21 nt, Human
acauauauuuuuaaaaaauga

SEQ ID NO: 3793625 - RNA, 19 nt, Human
acauauauuuuuuaaaaua

SEQ ID NO: 3793626 - RNA, 20 nt, Human
acauauauuuuuuaaaauaa

SEQ ID NO: 3793627 - RNA, 23 nt, Human
acauaucuacacuucgcaccgga

SEQ ID NO: 3793628 - RNA, 20 nt, Human
acauaucuaguaugaaauua

SEQ ID NO: 3793629 - RNA, 15 nt, Human
acauaucuuuauuaa

SEQ ID NO: 3793630 - RNA, 18 nt, Human
acauaucuuuauuaauca

SEQ ID NO: 3793631 - RNA, 14 nt, Human
acauaugaaaauac

SEQ ID NO: 3793632 - RNA, 15 nt, Human
acauaugaaauuuaa

SEQ ID NO: 3793633 - RNA, 14 nt, Human
acauaugacuugau

SEQ ID NO: 3793634 - RNA, 19 nt, Human
acauaugaguguggaagcc

SEQ ID NO: 3793635 - RNA, 21 nt, Human
acauaugaguguggaagccgg

SEQ ID NO: 3793636 - RNA, 16 nt, Human
acauaugcaccuugug

SEQ ID NO: 3793637 - RNA, 18 nt, Human
acauaugcaccuuguguc

SEQ ID NO: 3793638 - RNA, 13 nt, Human
acauauggaauuu

SEQ ID NO: 3793639 - RNA, 17 nt, Human
acauauggaauuuugca

SEQ ID NO: 3793640 - RNA, 13 nt, Human
acauauggauguu

SEQ ID NO: 3793641 - RNA, 15 nt, Human
acauauggauguuac

SEQ ID NO: 3793642 - RNA, 13 nt, Human
acauauguaaaau

SEQ ID NO: 3793643 - RNA, 14 nt, Human
acauauguaaaaua

SEQ ID NO: 3793644 - RNA, 16 nt, Human
acauauguacauaaau

SEQ ID NO: 3793645 - RNA, 18 nt, Human
acauauuaggaaaauaug

SEQ ID NO: 3793646 - RNA, 20 nt, Human
acauauucauuuggaaauaa

SEQ ID NO: 3793647 - RNA, 22 nt, Human
acauauuccauguuuggaagac

SEQ ID NO: 3793648 - RNA, 16 nt, Human
acauauugauuuccgu

SEQ ID NO: 3793649 - RNA, 18 nt, Human
acauauugauuuccguua

SEQ ID NO: 3793650 - RNA, 15 nt, Human
acauauuuaauguuu

SEQ ID NO: 3793651 - RNA, 16 nt, Human
acauauuuuauagaac

SEQ ID NO: 3793652 - RNA, 18 nt, Human
acauauuuuauagaacuu

SEQ ID NO: 3793653 - RNA, 22 nt, Human
acauauuuuuuauaucuggaau

SEQ ID NO: 3793654 - RNA, 23 nt, Human
acaucaaauaauugaagagacaa

SEQ ID NO: 3793655 - RNA, 16 nt, Human
acaucaacaucuuggu

SEQ ID NO: 3793656 - RNA, 14 nt, Human
acaucacagcccag

SEQ ID NO: 3793657 - RNA, 13 nt, Human
acaucacaggaca

SEQ ID NO: 3793658 - RNA, 23 nt, Human
acaucaccgacgcgucuccuguu

SEQ ID NO: 3793659 - RNA, 22 nt, Human
acaucacuauccaugcaccaaa

SEQ ID NO: 3793660 - RNA, 22 nt, Human
acaucacugcuugaugaagcaa

SEQ ID NO: 3793661 - RNA, 17 nt, Human
acaucacuguucaugcu

SEQ ID NO: 3793662 - RNA, 15 nt, Human
acaucagaaaggaau

SEQ ID NO: 3793663 - RNA, 12 nt, Human
acaucagauaag

SEQ ID NO: 3793664 - RNA, 11 nt, Human
acaucagccag

SEQ ID NO: 3793665 - RNA, 14 nt, Human
acaucagccagcug

SEQ ID NO: 3793666 - RNA, 20 nt, Human
acaucaguggcauggcucca

SEQ ID NO: 3793667 - RNA, 22 nt, Human
acaucaguggcauggcuccagu

SEQ ID NO: 3793668 - RNA, 20 nt, Human
acaucaucaaggcacugccu

SEQ ID NO: 3793669 - RNA, 14 nt, Human
acaucaucuguaag

SEQ ID NO: 3793670 - RNA, 20 nt, Human
acaucaucuguaagcuguuu

SEQ ID NO: 3793671 - RNA, 18 nt, Human
acaucauuacuauaagaa

SEQ ID NO: 3793672 - RNA, 15 nt, Human
acaucauucauuuuu

SEQ ID NO: 3793673 - RNA, 13 nt, Human
acaucauuucuuu

SEQ ID NO: 3793674 - RNA, 22 nt, Human
acaucauuucuuuuugggagag

SEQ ID NO: 3793675 - RNA, 16 nt, Human
acauccaaagcagaca

SEQ ID NO: 3793676 - RNA, 19 nt, Human
acauccaacuccagcaacu

SEQ ID NO: 3793677 - RNA, 14 nt, Human
acauccaaggagaa

SEQ ID NO: 3793678 - RNA, 21 nt, Human
acauccacaugauaccucuga

SEQ ID NO: 3793679 - RNA, 21 nt, Human
acauccagagcuuugucguau

SEQ ID NO: 3793680 - RNA, 13 nt, Human
acauccauguccu

SEQ ID NO: 3793681 - RNA, 21 nt, Human
acaucccaccccauccuccag

SEQ ID NO: 3793682 - RNA, 14 nt, Human
acaucccacugcca

SEQ ID NO: 3793683 - RNA, 16 nt, Human
acaucccauguaacag

SEQ ID NO: 3793684 - RNA, 17 nt, Human
acaucccauugcccugg

SEQ ID NO: 3793685 - RNA, 18 nt, Human
acauccccccgccaaaag

SEQ ID NO: 3793686 - RNA, 12 nt, Human
acaucccugggc

SEQ ID NO: 3793687 - RNA, 13 nt, Human
acaucccugggcc

SEQ ID NO: 3793688 - RNA, 20 nt, Human
acaucccuuaccugggaaag

SEQ ID NO: 3793689 - RNA, 18 nt, Human
acauccgccuuuuguaua

SEQ ID NO: 3793690 - RNA, 16 nt, Human
acauccgcgugugccu

SEQ ID NO: 3793691 - RNA, 17 nt, Human
acauccgcgugugccug

SEQ ID NO: 3793692 - RNA, 13 nt, Human
acauccuccuccc

SEQ ID NO: 3793693 - RNA, 13 nt, Human
acauccucuucug

SEQ ID NO: 3793694 - RNA, 12 nt, Human
acauccugggua

SEQ ID NO: 3793695 - RNA, 19 nt, Human
acauccuguauaagcacug

SEQ ID NO: 3793696 - RNA, 22 nt, Human
acauccugucaucugagaauga

SEQ ID NO: 3793697 - RNA, 14 nt, Human
acauccuguguuuc

SEQ ID NO: 3793698 - RNA, 12 nt, Human
acauccuugugg

SEQ ID NO: 3793699 - RNA, 17 nt, Human
acauccuuucuaaacaa

SEQ ID NO: 3793700 - RNA, 18 nt, Human
acauccuuugcagggcag

SEQ ID NO: 3793701 - RNA, 23 nt, Human
acauccuuugcagggcagcccca

SEQ ID NO: 3793702 - RNA, 14 nt, Human
acaucgaaugugua

SEQ ID NO: 3793703 - RNA, 14 nt, Human
acaucgcccuccac

SEQ ID NO: 3793704 - RNA, 16 nt, Human
acaucgcgaugggaac

SEQ ID NO: 3793705 - RNA, 21 nt, Human
acaucuaagccugaaggggcg

SEQ ID NO: 3793706 - RNA, 20 nt, Human
acaucuaguaguuguucuga

SEQ ID NO: 3793707 - RNA, 20 nt, Human
acaucucaacaggccucagg

SEQ ID NO: 3793708 - RNA, 21 nt, Human
acaucucaacaggccucaggg

SEQ ID NO: 3793709 - RNA, 12 nt, Human
acaucucagaga

SEQ ID NO: 3793710 - RNA, 11 nt, Human
acaucuccuua

SEQ ID NO: 3793711 - RNA, 15 nt, Human
acaucucugaaagca

SEQ ID NO: 3793712 - RNA, 15 nt, Human
acaucucugacuuuc

SEQ ID NO: 3793713 - RNA, 22 nt, Human
acaucucugcacccuggggccu

SEQ ID NO: 3793714 - RNA, 15 nt, Human
acaucucugcuugag

SEQ ID NO: 3793715 - RNA, 14 nt, Human
acaucuggaaaaua

SEQ ID NO: 3793716 - RNA, 13 nt, Human
acaucuggcuuau

SEQ ID NO: 3793717 - RNA, 17 nt, Human
acaucuguguuucaagu

SEQ ID NO: 3793718 - RNA, 16 nt, Human
acaucuguuuuaaauu

SEQ ID NO: 3793719 - RNA, 17 nt, Human
acaucuguuuuaaauuu

SEQ ID NO: 3793720 - RNA, 18 nt, Human
acaucuuaguauuugcau

SEQ ID NO: 3793721 - RNA, 11 nt, Human
acaucuuccac

SEQ ID NO: 3793722 - RNA, 14 nt, Human
acaucuugaucugc

SEQ ID NO: 3793723 - RNA, 21 nt, Human
acaucuugaucugcucagccc

SEQ ID NO: 3793724 - RNA, 15 nt, Human
acaucuugcucugcu

SEQ ID NO: 3793725 - RNA, 17 nt, Human
acaucuugcucugcuga

SEQ ID NO: 3793726 - RNA, 24 nt, Human
acaucuuggcacauuuaagagaca

SEQ ID NO: 3793727 - RNA, 16 nt, Human
acaucuuuauugaaau

SEQ ID NO: 3793728 - RNA, 22 nt, Human
acaucuuuauugaaauucuauu

SEQ ID NO: 3793729 - RNA, 16 nt, Human
acaucuuuuaagacaa

SEQ ID NO: 3793730 - RNA, 16 nt, Human
acaucuuuuuaaagcu

SEQ ID NO: 3793731 - RNA, 15 nt, Human
acaucuuuuuucaca

SEQ ID NO: 3793732 - RNA, 14 nt, Human
acaugaaaauuuua

SEQ ID NO: 3793733 - RNA, 16 nt, Human
acaugaaaauuuuaaa

SEQ ID NO: 3793734 - RNA, 23 nt, Human
acaugaaaauuuuaaaaauacau

SEQ ID NO: 3793735 - RNA, 17 nt, Human
acaugaaauuuuuguaa

SEQ ID NO: 3793736 - RNA, 14 nt, Human
acaugaacuuagau

SEQ ID NO: 3793737 - RNA, 22 nt, Human
acaugaacuuagauuuuacaug

SEQ ID NO: 3793738 - RNA, 16 nt, Human
acaugaagaagcuaaa

SEQ ID NO: 3793739 - RNA, 14 nt, Human
acaugaagaccuuu

SEQ ID NO: 3793740 - RNA, 18 nt, Human
acaugaagauucuuuccc

SEQ ID NO: 3793741 - RNA, 20 nt, Human
acaugaagcuucaugcacuu

SEQ ID NO: 3793742 - RNA, 13 nt, Human
acaugaagguaaa

SEQ ID NO: 3793743 - RNA, 23 nt, Human
acaugaagguaaauaaaaagaaa

SEQ ID NO: 3793744 - RNA, 14 nt, Human
acaugaaguauuuu

SEQ ID NO: 3793745 - RNA, 19 nt, Human
acaugaaguguguuuccuu

SEQ ID NO: 3793746 - RNA, 13 nt, Human
acaugaauaugau

SEQ ID NO: 3793747 - RNA, 21 nt, Human
acaugaaucccacccacaugu

SEQ ID NO: 3793748 - RNA, 15 nt, Human
acaugaauuuuagcu

SEQ ID NO: 3793749 - RNA, 17 nt, Human
acaugaauuuuagcuuu

SEQ ID NO: 3793750 - RNA, 22 nt, Human
acaugaauuuuagcuuuugugg

SEQ ID NO: 3793751 - RNA, 18 nt, Human
aaugacauuuauaucaca

SEQ ID NO: 3793752 - RNA, 19 nt, Human
aaugaccaguaauugugaa

SEQ ID NO: 3793753 - RNA, 22 nt, Human
aaugaccuucauucugagacca

SEQ ID NO: 3793754 - RNA, 18 nt, Human
aaugaccuuguaauguaa

SEQ ID NO: 3793755 - RNA, 21 nt, Human
aaugaccuuguaauguaacug

SEQ ID NO: 3793756 - RNA, 13 nt, Human
aaugaccuuucaa

SEQ ID NO: 3793757 - RNA, 17 nt, Human
aaugaccuuucaauagg

SEQ ID NO: 3793758 - RNA, 20 nt, Human
aaugaccuuucaauaggaaa

SEQ ID NO: 3793759 - RNA, 14 nt, Human
aaugacguuuacau

SEQ ID NO: 3793760 - RNA, 17 nt, Human
aaugacuaaaaaacaaa

SEQ ID NO: 3793761 - RNA, 12 nt, Human
aaugacuacuua

SEQ ID NO: 3793762 - RNA, 14 nt, Human
aaugacuacuuagc

SEQ ID NO: 3793763 - RNA, 23 nt, Human
aaugacuauauaauuuauuucca

SEQ ID NO: 3793764 - RNA, 20 nt, Human
aaugacucagaauauugcuu

SEQ ID NO: 3793765 - RNA, 20 nt, Human
aaugacucaggacauccccc

SEQ ID NO: 3793766 - RNA, 17 nt, Human
aaugacuuacuguacau

SEQ ID NO: 3793767 - RNA, 14 nt, Human
aaugacuuauugug

SEQ ID NO: 3793768 - RNA, 13 nt, Human
aaugacuuuauua

SEQ ID NO: 3793769 - RNA, 14 nt, Human
aaugacuuuauuau

SEQ ID NO: 3793770 - RNA, 20 nt, Human
aaugagaaaaugucuuuauu

SEQ ID NO: 3793771 - RNA, 12 nt, Human
aaugagaaaucu

SEQ ID NO: 3793772 - RNA, 13 nt, Human
aaugagaaaugga

SEQ ID NO: 3793773 - RNA, 13 nt, Human
aaugagaaucuac

SEQ ID NO: 3793774 - RNA, 13 nt, Human
aaugagacagcag

SEQ ID NO: 3793775 - RNA, 15 nt, Human
aaugagacauccagc

SEQ ID NO: 3793776 - RNA, 14 nt, Human
aaugagacuaugcg

SEQ ID NO: 3793777 - RNA, 19 nt, Human
aaugagacucuagggucca

SEQ ID NO: 3793778 - RNA, 17 nt, Human
aaugagaucccgccucu

SEQ ID NO: 3793779 - RNA, 13 nt, Human
aaugagcccagag

SEQ ID NO: 3793780 - RNA, 14 nt, Human
aaugagcccagaga

SEQ ID NO: 3793781 - RNA, 21 nt, Human
aaugagccuacgcugaagaug

SEQ ID NO: 3793782 - RNA, 12 nt, Human
aaugagccuggc

SEQ ID NO: 3793783 - RNA, 16 nt, Human
aaugagcuauguauua

SEQ ID NO: 3793784 - RNA, 19 nt, Human
aaugagcuauuaaaacuca

SEQ ID NO: 3793785 - RNA, 23 nt, Human
aaugagcuauuaaaacucagccu

SEQ ID NO: 3793786 - RNA, 17 nt, Human
aaugagcuugauuaaau

SEQ ID NO: 3793787 - RNA, 18 nt, Human
aaugagcuugauuaaauc

SEQ ID NO: 3793788 - RNA, 14 nt, Human
aaugagcuuucuga

SEQ ID NO: 3793789 - RNA, 15 nt, Human
aaugagcuuucugaa

SEQ ID NO: 3793790 - RNA, 14 nt, Human
aaugaggacauguu

SEQ ID NO: 3793791 - RNA, 16 nt, Human
aaugaggacauguuuu

SEQ ID NO: 3793792 - RNA, 14 nt, Human
aaugaggagacaca

SEQ ID NO: 3793793 - RNA, 19 nt, Human
aaugaggagagaaaauaua

SEQ ID NO: 3793794 - RNA, 12 nt, Human
aaugaggaggaa

SEQ ID NO: 3793795 - RNA, 18 nt, Human
aaugaggaggaaggagag

SEQ ID NO: 3793796 - RNA, 15 nt, Human
aaugaggauuauuga

SEQ ID NO: 3793797 - RNA, 22 nt, Human
aaugaggccauggacucugucc

SEQ ID NO: 3793798 - RNA, 18 nt, Human
aaugaggcuugcugagag

SEQ ID NO: 3793799 - RNA, 14 nt, Human
aaugagggccaaga

SEQ ID NO: 3793800 - RNA, 18 nt, Human
aaugagggccaagaaaga

SEQ ID NO: 3793801 - RNA, 19 nt, Human
aaugaggucagcaugucua

SEQ ID NO: 3793802 - RNA, 16 nt, Human
aaugaggucccaggca

SEQ ID NO: 3793803 - RNA, 14 nt, Human
aaugaggucuguuu

SEQ ID NO: 3793804 - RNA, 16 nt, Human
aaugaggucuguuuaa

SEQ ID NO: 3793805 - RNA, 14 nt, Human
aaugagucuguugu

SEQ ID NO: 3793806 - RNA, 16 nt, Human
aaugagugaauugaau

SEQ ID NO: 3793807 - RNA, 14 nt, Human
aaugagugugaagg

SEQ ID NO: 3793808 - RNA, 19 nt, Human
aaugaguuaccuacauuuu

SEQ ID NO: 3793809 - RNA, 17 nt, Human
aaugaguuuaaaaauca

SEQ ID NO: 3793810 - RNA, 21 nt, Human
aaugaguuucacagugugauu

SEQ ID NO: 3793811 - RNA, 14 nt, Human
aaugaguuucuuag

SEQ ID NO: 3793812 - RNA, 19 nt, Human
aaugaguuucuuagacuuu

SEQ ID NO: 3793813 - RNA, 21 nt, Human
aaugaguuuuuauggggcuga

SEQ ID NO: 3793814 - RNA, 21 nt, Human
aaugauaaguaaaugcuaggu

SEQ ID NO: 3793815 - RNA, 20 nt, Human
aaugauaauauuguggugcc

SEQ ID NO: 3793816 - RNA, 18 nt, Human
aaugauacccugaauuug

SEQ ID NO: 3793817 - RNA, 16 nt, Human
aaugauacugauggug

SEQ ID NO: 3793818 - RNA, 14 nt, Human
aaugauagauuuga

SEQ ID NO: 3793819 - RNA, 18 nt, Human
aaugauagauuugaccuc

SEQ ID NO: 3793820 - RNA, 15 nt, Human
aaugauagcuacugu

SEQ ID NO: 3793821 - RNA, 13 nt, Human
aaugauaugcauu

SEQ ID NO: 3793822 - RNA, 15 nt, Human
aaugauaugcuugua

SEQ ID NO: 3793823 - RNA, 18 nt, Human
aaugauaugcuuguaacu

SEQ ID NO: 3793824 - RNA, 14 nt, Human
aaugauauugcuga

SEQ ID NO: 3793825 - RNA, 22 nt, Human
aaugauauugcugaagaaucua

SEQ ID NO: 3793826 - RNA, 16 nt, Human
aaugaucagcaucugu

SEQ ID NO: 3793827 - RNA, 16 nt, Human
aaugauccccagcugu

SEQ ID NO: 3793828 - RNA, 23 nt, Human
aaugauccuguauucagacagau

SEQ ID NO: 3793829 - RNA, 17 nt, Human
aaugaucgaaaaaauaa

SEQ ID NO: 3793830 - RNA, 18 nt, Human
aaugaucgaaaaaauaau

SEQ ID NO: 3793831 - RNA, 21 nt, Human
aaugaucgaaaaaauaauuau

SEQ ID NO: 3793832 - RNA, 13 nt, Human
aaugaucuagguu

SEQ ID NO: 3793833 - RNA, 14 nt, Human
aaugaucuagguuu

SEQ ID NO: 3793834 - RNA, 18 nt, Human
aaugaucuagguuuaacu

SEQ ID NO: 3793835 - RNA, 22 nt, Human
aaugaucuagguuuaacucaga

SEQ ID NO: 3793836 - RNA, 23 nt, Human
aaugaucuagguuuaacucagau

SEQ ID NO: 3793837 - RNA, 15 nt, Human
aaugaugaguauuag

SEQ ID NO: 3793838 - RNA, 17 nt, Human
aaugaugaugauaauga

SEQ ID NO: 3793839 - RNA, 21 nt, Human
aaugaugauguggaagaacuu

SEQ ID NO: 3793840 - RNA, 12 nt, Human
aaugaugcacau

SEQ ID NO: 3793841 - RNA, 20 nt, Human
aaugaugccaugaggaacaa

SEQ ID NO: 3793842 - RNA, 15 nt, Human
aaugauggacccaau

SEQ ID NO: 3793843 - RNA, 18 nt, Human
aaugauggcaauuuugua

SEQ ID NO: 3793844 - RNA, 21 nt, Human
aaugauggcccauucuacuug

SEQ ID NO: 3793845 - RNA, 22 nt, Human
aaugaugguaggaagaagcucu

SEQ ID NO: 3793846 - RNA, 14 nt, Human
aaugauguccagaa

SEQ ID NO: 3793847 - RNA, 17 nt, Human
aaugaugugcaaaaccu

SEQ ID NO: 3793848 - RNA, 14 nt, Human
aaugauguugaaua

SEQ ID NO: 3793849 - RNA, 16 nt, Human
aaugauuaauuaaaac

SEQ ID NO: 3793850 - RNA, 15 nt, Human
aaugauuaugaauua

SEQ ID NO: 3793851 - RNA, 21 nt, Human
aaugauuaugaauuacauuug

SEQ ID NO: 3793852 - RNA, 23 nt, Human
aaugauuaugaauuacauuugua

SEQ ID NO: 3793853 - RNA, 15 nt, Human
aaugauuauuuucau

SEQ ID NO: 3793854 - RNA, 13 nt, Human
aaugauucagugu

SEQ ID NO: 3793855 - RNA, 14 nt, Human
aaugauucauguua

SEQ ID NO: 3793856 - RNA, 19 nt, Human
aaugauugcuuuuaaaauu

SEQ ID NO: 3793857 - RNA, 15 nt, Human
aaugauuguaguaau

SEQ ID NO: 3793858 - RNA, 11 nt, Human
aaugauuucag

SEQ ID NO: 3793859 - RNA, 18 nt, Human
aaugauuuccaaagagaa

SEQ ID NO: 3793860 - RNA, 19 nt, Human
aaugauuuuaucugugaau

SEQ ID NO: 3793861 - RNA, 13 nt, Human
aaugcaaaaaucu

SEQ ID NO: 3793862 - RNA, 20 nt, Human
aaugcaaacacacaaaggua

SEQ ID NO: 3793863 - RNA, 23 nt, Human
aaugcaaaccaucauugaaaucu

SEQ ID NO: 3793864 - RNA, 13 nt, Human
aaugcaaacuggg

SEQ ID NO: 3793865 - RNA, 13 nt, Human
aaugcaaagaauc

SEQ ID NO: 3793866 - RNA, 14 nt, Human
aaugcaaauaacaa

SEQ ID NO: 3793867 - RNA, 17 nt, Human
aaugcaaauaacaaaug

SEQ ID NO: 3793868 - RNA, 17 nt, Human
aaugcaaccauuugaaa

SEQ ID NO: 3793869 - RNA, 20 nt, Human
aaugcaacuacccaaaacaa

SEQ ID NO: 3793870 - RNA, 21 nt, Human
aaugcaagauuuuccacaaga

SEQ ID NO: 3793871 - RNA, 16 nt, Human
aaugcaauagaagugc

SEQ ID NO: 3793872 - RNA, 17 nt, Human
aaugcaauagaagugcu

SEQ ID NO: 3793873 - RNA, 16 nt, Human
aaugcaauauuaaugc

SEQ ID NO: 3793874 - RNA, 18 nt, Human
aaugcacaaacagaggcc

SEQ ID NO: 3793875 - RNA, 15 nt, Human
aaugcacacaaaaca

SEQ ID NO: 3793876 - RNA, 13 nt, Human
aaugcacacuagc

SEQ ID NO: 3793877 - RNA, 16 nt, Human
aaugcacauccauucc

SEQ ID NO: 3793878 - RNA, 13 nt, Human
aaugcaccuggaa

SEQ ID NO: 3793879 - RNA, 19 nt, Human
aaugcacuuuguucuggcu

SEQ ID NO: 3793880 - RNA, 18 nt, Human
aaugcagcccauuucucc

SEQ ID NO: 3793881 - RNA, 23 nt, Human
aaugcagggauugcugccacuuu

SEQ ID NO: 3793882 - RNA, 15 nt, Human
aaugcaguauauuuc

SEQ ID NO: 3793883 - RNA, 15 nt, Human
aaugcaguaugguac

SEQ ID NO: 3793884 - RNA, 16 nt, Human
aaugcaguaugguaca

SEQ ID NO: 3793885 - RNA, 17 nt, Human
aaugcaguuacaaauua

SEQ ID NO: 3793886 - RNA, 20 nt, Human
aaugcaguuacaaauuauaa

SEQ ID NO: 3793887 - RNA, 19 nt, Human
aaugcauauccugagccau

SEQ ID NO: 3793888 - RNA, 14 nt, Human
aaugcauauuugca

SEQ ID NO: 3793889 - RNA, 18 nt, Human
aaugcauauuugcaaagu

SEQ ID NO: 3793890 - RNA, 21 nt, Human
aaugcauccagcaguacaaua

SEQ ID NO: 3793891 - RNA, 19 nt, Human
aaugcauccauuccucagg

SEQ ID NO: 3793892 - RNA, 23 nt, Human
aaugcauccauuccucagggaca

SEQ ID NO: 3793893 - RNA, 19 nt, Human
aaugcaucuagauuaugga

SEQ ID NO: 3793894 - RNA, 20 nt, Human
aaugcaucuuugauguguug

SEQ ID NO: 3793895 - RNA, 21 nt, Human
aaugcaugaacaaguuuuaau

SEQ ID NO: 3793896 - RNA, 19 nt, Human
aaugcaugauuuuguaacc

SEQ ID NO: 3793897 - RNA, 15 nt, Human
aauuuuccuugaagc

SEQ ID NO: 3793898 - RNA, 20 nt, Human
aauuuuccuuuaauaugaaa

SEQ ID NO: 3793899 - RNA, 23 nt, Human
aauuuuccuuuaauaugaaauuu

SEQ ID NO: 3793900 - RNA, 17 nt, Human
aauuuucucauuuucuu

SEQ ID NO: 3793901 - RNA, 21 nt, Human
aauuuucuugaugacuggaau

SEQ ID NO: 3793902 - RNA, 22 nt, Human
aauuuugaaaaguaauauuuau

SEQ ID NO: 3793903 - RNA, 19 nt, Human
aauuuugaagugcuguuua

SEQ ID NO: 3793904 - RNA, 20 nt, Human
aauuuugaagugcuguuuau

SEQ ID NO: 3793905 - RNA, 17 nt, Human
aaugcauuauuuugaau

SEQ ID NO: 3793906 - RNA, 14 nt, Human
aaugcauucuucuc

SEQ ID NO: 3793907 - RNA, 16 nt, Human
aaugcauugauauugu

SEQ ID NO: 3793908 - RNA, 21 nt, Human
aaugcauugauauugugaaca

SEQ ID NO: 3793909 - RNA, 12 nt, Human
aaugcauuguau

SEQ ID NO: 3793910 - RNA, 13 nt, Human
aaugccaagauaa

SEQ ID NO: 3793911 - RNA, 13 nt, Human
aaugccaaucucu

SEQ ID NO: 3793912 - RNA, 16 nt, Human
aaugccacagcccugu

SEQ ID NO: 3793913 - RNA, 23 nt, Human
aaugccacagcccugucagcaug

SEQ ID NO: 3793914 - RNA, 12 nt, Human
aaugccagggcc

SEQ ID NO: 3793915 - RNA, 21 nt, Human
aaugccaguaacgcgucuucc

SEQ ID NO: 3793916 - RNA, 18 nt, Human
aaugccauaauacaaaag

SEQ ID NO: 3793917 - RNA, 23 nt, Human
aaugccauagucaaagagaguuu

SEQ ID NO: 3793918 - RNA, 23 nt, Human
aaugccaucaauaaaaaauuaug

SEQ ID NO: 3793919 - RNA, 13 nt, Human
aaugccauucucu

SEQ ID NO: 3793920 - RNA, 20 nt, Human
aaugccauuuauuuauugau

SEQ ID NO: 3793921 - RNA, 20 nt, Human
aaugccauuuuaaggaaaac

SEQ ID NO: 3793922 - RNA, 11 nt, Human
aaugcccagac

SEQ ID NO: 3793923 - RNA, 11 nt, Human
aaugcccagcc

SEQ ID NO: 3793924 - RNA, 14 nt, Human
aaugcccagccccu

SEQ ID NO: 3793925 - RNA, 20 nt, Human
aaugcccagccccuucugac

SEQ ID NO: 3793926 - RNA, 21 nt, Human
aaugccccugaauuuaaauag

SEQ ID NO: 3793927 - RNA, 18 nt, Human
aaugcccguaaugcuuag

SEQ ID NO: 3793928 - RNA, 22 nt, Human
aaugcccucaggggacuugaau

SEQ ID NO: 3793929 - RNA, 11 nt, Human
aaugcccucuu

SEQ ID NO: 3793930 - RNA, 22 nt, Human
aaugcccuuacacuuacuguug

SEQ ID NO: 3793931 - RNA, 14 nt, Human
aaugcccuucacug

SEQ ID NO: 3793932 - RNA, 17 nt, Human
aaugcccuucacuguca

SEQ ID NO: 3793933 - RNA, 15 nt, Human
aaugccuaauaaaca

SEQ ID NO: 3793934 - RNA, 20 nt, Human
aaugccucaguguauuugua

SEQ ID NO: 3793935 - RNA, 21 nt, Human
aaugccucaguguauuuguau

SEQ ID NO: 3793936 - RNA, 14 nt, Human
aaugccuccucccu

SEQ ID NO: 3793937 - RNA, 17 nt, Human
aaugccuccugugggga

SEQ ID NO: 3793938 - RNA, 22 nt, Human
aaugccucuccuuaaaugcuuc

SEQ ID NO: 3793939 - RNA, 20 nt, Human
aaugccuuaaaauggaauug

SEQ ID NO: 3793940 - RNA, 15 nt, Human
aaugccuuacuuugu

SEQ ID NO: 3793941 - RNA, 21 nt, Human
aaugccuuacuuuguaugaua

SEQ ID NO: 3793942 - RNA, 22 nt, Human
aaugccuuagaaauguaaacug

SEQ ID NO: 3793943 - RNA, 19 nt, Human
aaugccuuugagacaguuu

SEQ ID NO: 3793944 - RNA, 22 nt, Human
aaugccuuugagacaguuucuu

SEQ ID NO: 3793945 - RNA, 23 nt, Human
aaugccuuugagacaguuucuua

SEQ ID NO: 3793946 - RNA, 15 nt, Human
aaugccuuuucccaa

SEQ ID NO: 3793947 - RNA, 14 nt, Human
aaugcgauuuuauu

SEQ ID NO: 3793948 - RNA, 20 nt, Human
aaugcgcaggcuggcccugc

SEQ ID NO: 3793949 - RNA, 20 nt, Human
aaugcggccgcauucccuga

SEQ ID NO: 3793950 - RNA, 22 nt, Human
aaugcgguuauaaaaaaugguu

SEQ ID NO: 3793951 - RNA, 23 nt, Human
aaugcgguuauaaaaaaugguuc

SEQ ID NO: 3793952 - RNA, 19 nt, Human
aaugcuaauuuaaagagac

SEQ ID NO: 3793953 - RNA, 17 nt, Human
aaugcuacgugugauuu

SEQ ID NO: 3793954 - RNA, 15 nt, Human
aaugcuagaaaaauu

SEQ ID NO: 3793955 - RNA, 14 nt, Human
aaugcuagaagaaa

SEQ ID NO: 3793956 - RNA, 18 nt, Human
aaugcuagcucugagcca

SEQ ID NO: 3793957 - RNA, 17 nt, Human
aaugcuaggucucggac

SEQ ID NO: 3793958 - RNA, 18 nt, Human
aaugcuagguuaauucca

SEQ ID NO: 3793959 - RNA, 16 nt, Human
aaugcuaugucauuuc

SEQ ID NO: 3793960 - RNA, 18 nt, Human
aaugcuauuuuuguuuuu

SEQ ID NO: 3793961 - RNA, 20 nt, Human
aaugcuauuuuuguuuuuag

SEQ ID NO: 3793962 - RNA, 20 nt, Human
aaugcuccccacagcguccc

SEQ ID NO: 3793963 - RNA, 11 nt, Human
aaugcuccccc

SEQ ID NO: 3793964 - RNA, 14 nt, Human
aaugcucccccauc

SEQ ID NO: 3793965 - RNA, 20 nt, Human
aaugcucccccauccucccc

SEQ ID NO: 3793966 - RNA, 19 nt, Human
aaugcuccuuguuccuaga

SEQ ID NO: 3793967 - RNA, 18 nt, Human
aaugcugaacauugcaua

SEQ ID NO: 3793968 - RNA, 13 nt, Human
aaugcugcacuaa

SEQ ID NO: 3793969 - RNA, 12 nt, Human
aaugcugcacuu

SEQ ID NO: 3793970 - RNA, 13 nt, Human
aaugcugcacuuc

SEQ ID NO: 3793971 - RNA, 17 nt, Human
aaugcugcacuuccugu

SEQ ID NO: 3793972 - RNA, 12 nt, Human
aaugcugcagau

SEQ ID NO: 3793973 - RNA, 14 nt, Human
aaugcugcauuuua

SEQ ID NO: 3793974 - RNA, 22 nt, Human
aaugcugccuucccaugaaucu

SEQ ID NO: 3793975 - RNA, 17 nt, Human
aaugcugcuggccaaau

SEQ ID NO: 3793976 - RNA, 22 nt, Human
aaugcuggacuggaggccccug

SEQ ID NO: 3793977 - RNA, 22 nt, Human
aaugcuggagaaaaauaucugu

SEQ ID NO: 3793978 - RNA, 23 nt, Human
aaugcuggcuauagaugucuuuu

SEQ ID NO: 3793979 - RNA, 19 nt, Human
aaugcugguuuuccuaaau

SEQ ID NO: 3793980 - RNA, 22 nt, Human
aaugcuguauuagucacagaga

SEQ ID NO: 3793981 - RNA, 16 nt, Human
aaugcuguauuuuaaa

SEQ ID NO: 3793982 - RNA, 21 nt, Human
aaugcuguauuuuaaaagaau

SEQ ID NO: 3793983 - RNA, 22 nt, Human
aaugcuguauuuuaaaagaaug

SEQ ID NO: 3793984 - RNA, 19 nt, Human
aaugcugucuuucuugcuc

SEQ ID NO: 3793985 - RNA, 20 nt, Human
aaugcugugcccuaaagugu

SEQ ID NO: 3793986 - RNA, 16 nt, Human
aaugcuuaauuucuaa

SEQ ID NO: 3793987 - RNA, 20 nt, Human
aaugcuuaauuucuaaagau

SEQ ID NO: 3793988 - RNA, 22 nt, Human
aaugcuucauucaauauugaca

SEQ ID NO: 3793989 - RNA, 14 nt, Human
aaugcuucuaagua

SEQ ID NO: 3793990 - RNA, 21 nt, Human
aaugcuucuaaguaaauacaa

SEQ ID NO: 3793991 - RNA, 22 nt, Human
aaugcuucuaaguaaauacaau

SEQ ID NO: 3793992 - RNA, 20 nt, Human
aaugcuugcugcugauuuaa

SEQ ID NO: 3793993 - RNA, 17 nt, Human
aaugcuuggcuucucau

SEQ ID NO: 3793994 - RNA, 11 nt, Human
aaugcuuuuug

SEQ ID NO: 3793995 - RNA, 18 nt, Human
aauggaaaaaaaaaaaag

SEQ ID NO: 3793996 - RNA, 14 nt, Human
aauggaaaaugauu

SEQ ID NO: 3793997 - RNA, 17 nt, Human
aauggaaacagaggacc

SEQ ID NO: 3793998 - RNA, 13 nt, Human
aauggaaaggaga

SEQ ID NO: 3793999 - RNA, 16 nt, Human
aauggaaauuuugcua

SEQ ID NO: 3794000 - RNA, 14 nt, Human
aauggaaccacucu

SEQ ID NO: 3794001 - RNA, 14 nt, Human
aauggaaccaggcu

SEQ ID NO: 3794002 - RNA, 18 nt, Human
aauggaaccccaccacug

SEQ ID NO: 3794003 - RNA, 16 nt, Human
aauggaagagaaaucu

SEQ ID NO: 3794004 - RNA, 16 nt, Human
aauggaagagagaaag

SEQ ID NO: 3794005 - RNA, 22 nt, Human
aauggaauaaaaggcuugaagc

SEQ ID NO: 3794006 - RNA, 14 nt, Human
aauggaauacugaa

SEQ ID NO: 3794007 - RNA, 18 nt, Human
aauggacaaaauccauga

SEQ ID NO: 3794008 - RNA, 19 nt, Human
aauggacauaggacucaaa

SEQ ID NO: 3794009 - RNA, 14 nt, Human
aauggacauuucua

SEQ ID NO: 3794010 - RNA, 22 nt, Human
aauggacccuuuuuguuaugau

SEQ ID NO: 3794011 - RNA, 21 nt, Human
aauggaccggagagugggggu

SEQ ID NO: 3794012 - RNA, 23 nt, Human
aauggacguguuaugacuccaga

SEQ ID NO: 3794013 - RNA, 14 nt, Human
aauggacucaaacu

SEQ ID NO: 3794014 - RNA, 23 nt, Human
aauggacuggaaggggaagggac

SEQ ID NO: 3794015 - RNA, 16 nt, Human
aauggacuguggugac

SEQ ID NO: 3794016 - RNA, 18 nt, Human
aauggacuuugcacacuu

SEQ ID NO: 3794017 - RNA, 13 nt, Human
aauggagaggaac

SEQ ID NO: 3794018 - RNA, 20 nt, Human
aauggaggccauauuuccau

SEQ ID NO: 3794019 - RNA, 17 nt, Human
aauggaggccauugugu

SEQ ID NO: 3794020 - RNA, 21 nt, Human
aauggaguagaccccuggcug

SEQ ID NO: 3794021 - RNA, 22 nt, Human
aauggagucauuugagucucuu

SEQ ID NO: 3794022 - RNA, 19 nt, Human
aauggauacuacaucuuua

SEQ ID NO: 3794023 - RNA, 16 nt, Human
aauggaucacaagaug

SEQ ID NO: 3794024 - RNA, 22 nt, Human
aauggauccccagugaaaacua

SEQ ID NO: 3794025 - RNA, 13 nt, Human
aauggauuuuucu

SEQ ID NO: 3794026 - RNA, 20 nt, Human
aauggcaacaaacugcacau

SEQ ID NO: 3794027 - RNA, 21 nt, Human
aauggcaaggcagcccugucu

SEQ ID NO: 3794028 - RNA, 17 nt, Human
aauggcaaguuuuccau

SEQ ID NO: 3794029 - RNA, 20 nt, Human
aauggcacagcccaaagaag

SEQ ID NO: 3794030 - RNA, 19 nt, Human
aauggcacuguugcaaacu

SEQ ID NO: 3794031 - RNA, 18 nt, Human
aauggcagcagaaaacuu

SEQ ID NO: 3794032 - RNA, 21 nt, Human
aauggcccugggucccaggac

SEQ ID NO: 3794033 - RNA, 22 nt, Human
aauggccugccuugaagccacu

SEQ ID NO: 3794034 - RNA, 13 nt, Human
aauggccuuuauu

SEQ ID NO: 3794035 - RNA, 23 nt, Human
aauggcguccguggguugcuaac

SEQ ID NO: 3794036 - RNA, 20 nt, Human
aauggcgucuggaaguccaa

SEQ ID NO: 3794037 - RNA, 16 nt, Human
aauggcuaauucccag

SEQ ID NO: 3794038 - RNA, 13 nt, Human
aauggcuccuuca

SEQ ID NO: 3794039 - RNA, 15 nt, Human
aauggcugauaauuu

SEQ ID NO: 3794040 - RNA, 21 nt, Human
acaaaaugacauuuugccaaa

SEQ ID NO: 3794041 - RNA, 15 nt, Human
acaaaauggaauacu

SEQ ID NO: 3794042 - RNA, 19 nt, Human
acaaaauggaauacucuua

SEQ ID NO: 3794043 - RNA, 12 nt, Human
acaaaauguaac

SEQ ID NO: 3794044 - RNA, 17 nt, Human
acaaaauguaacuguua

SEQ ID NO: 3794045 - RNA, 20 nt, Human
acaaaauguaacuguuacca

SEQ ID NO: 3794046 - RNA, 20 nt, Human
acaaaauguaggguuauaau

SEQ ID NO: 3794047 - RNA, 22 nt, Human
acaaaauguaggguuauaauaa

SEQ ID NO: 3794048 - RNA, 17 nt, Human
acaaaauguuauuuccc

SEQ ID NO: 3794049 - RNA, 20 nt, Human
acaaaauuaagcaaauguua

SEQ ID NO: 3794050 - RNA, 14 nt, Human
acaaaauuucuauu

SEQ ID NO: 3794051 - RNA, 13 nt, Human
acaaaauuugacu

SEQ ID NO: 3794052 - RNA, 20 nt, Human
acaaaauuugacuaauuuua

SEQ ID NO: 3794053 - RNA, 22 nt, Human
acaaaauuuuauuuugugcuca

SEQ ID NO: 3794054 - RNA, 13 nt, Human
acaaacaaaagca

SEQ ID NO: 3794055 - RNA, 16 nt, Human
acaaacaaaauuucua

SEQ ID NO: 3794056 - RNA, 19 nt, Human
acaaacaaaauuucuauua

SEQ ID NO: 3794057 - RNA, 14 nt, Human
acaaacaagcauau

SEQ ID NO: 3794058 - RNA, 14 nt, Human
acaaacaauaccug

SEQ ID NO: 3794059 - RNA, 18 nt, Human
acaaacaauggaaacuga

SEQ ID NO: 3794060 - RNA, 20 nt, Human
acaaacaauggaaacugaau

SEQ ID NO: 3794061 - RNA, 15 nt, Human
acaaacacauuguua

SEQ ID NO: 3794062 - RNA, 14 nt, Human
acaaacagaugcuc

SEQ ID NO: 3794063 - RNA, 14 nt, Human
acaaacauaagugc

SEQ ID NO: 3794064 - RNA, 22 nt, Human
acaaacauauuuguuaaauauu

SEQ ID NO: 3794065 - RNA, 14 nt, Human
aagugguuuuaaua

SEQ ID NO: 3794066 - RNA, 18 nt, Human
aaguguaaagcauuccaa

SEQ ID NO: 3794067 - RNA, 17 nt, Human
aaguguaacagcugagg

SEQ ID NO: 3794068 - RNA, 12 nt, Human
aaguguaacugg

SEQ ID NO: 3794069 - RNA, 19 nt, Human
aaguguaagaaacacacug

SEQ ID NO: 3794070 - RNA, 15 nt, Human
aaguguaauaauaug

SEQ ID NO: 3794071 - RNA, 13 nt, Human
aaguguaggcaga

SEQ ID NO: 3794072 - RNA, 14 nt, Human
aaguguaggcagac

SEQ ID NO: 3794073 - RNA, 19 nt, Human
aaguguaggcagacacagg

SEQ ID NO: 3794074 - RNA, 19 nt, Human
aaguguauaauauaaaaaa

SEQ ID NO: 3794075 - RNA, 23 nt, Human
aaguguauaucagaaaagggaag

SEQ ID NO: 3794076 - RNA, 17 nt, Human
aaguguauuauaacagu

SEQ ID NO: 3794077 - RNA, 13 nt, Human
aaguguauuugga

SEQ ID NO: 3794078 - RNA, 15 nt, Human
aaguguauuuggaaa

SEQ ID NO: 3794079 - RNA, 21 nt, Human
aaguguauuuuauaaaauuaa

SEQ ID NO: 3794080 - RNA, 15 nt, Human
aaguguauuuuucaa

SEQ ID NO: 3794081 - RNA, 22 nt, Human
aaguguauuuuucaauaaagca

SEQ ID NO: 3794082 - RNA, 18 nt, Human
aaguguauuuuuuuacua

SEQ ID NO: 3794083 - RNA, 22 nt, Human
aagugucauauguaggugucug

SEQ ID NO: 3794084 - RNA, 24 nt, Human
aagugucauauguaggugucugca

SEQ ID NO: 3794085 - RNA, 12 nt, Human
aagugucauguu

SEQ ID NO: 3794086 - RNA, 19 nt, Human
aaguguccauugacaugua

SEQ ID NO: 3794087 - RNA, 15 nt, Human
aaguguccgagaacu

SEQ ID NO: 3794088 - RNA, 17 nt, Human
aagugucucugccuuga

SEQ ID NO: 3794089 - RNA, 19 nt, Human
aagugugaguaagagcugg

SEQ ID NO: 3794090 - RNA, 11 nt, Human
aagugugauug

SEQ ID NO: 3794091 - RNA, 20 nt, Human
aagugugcacguugcuucag

SEQ ID NO: 3794092 - RNA, 21 nt, Human
aagugugcauauuguacacuu

SEQ ID NO: 3794093 - RNA, 18 nt, Human
aagugugggucugugugu

SEQ ID NO: 3794094 - RNA, 20 nt, Human
aagugugggucugugugugu

SEQ ID NO: 3794095 - RNA, 15 nt, Human
aaguguguauauauu

SEQ ID NO: 3794096 - RNA, 21 nt, Human
aaguguguauauauuuugugu

SEQ ID NO: 3794097 - RNA, 20 nt, Human
aagugugucaaaucaauaaa

SEQ ID NO: 3794098 - RNA, 11 nt, Human
aagugugugug

SEQ ID NO: 3794099 - RNA, 17 nt, Human
aaguguguguggcagca

SEQ ID NO: 3794100 - RNA, 21 nt, Human
aaguguguguuuuucauaaag

SEQ ID NO: 3794101 - RNA, 22 nt, Human
aaguguucuguuacaaaaugua

SEQ ID NO: 3794102 - RNA, 14 nt, Human
aaguguuggaaaaa

SEQ ID NO: 3794103 - RNA, 20 nt, Human
aaguguuggaaaaaauuugu

SEQ ID NO: 3794104 - RNA, 15 nt, Human
aaguguuuauguugu

SEQ ID NO: 3794105 - RNA, 15 nt, Human
aaguguuucagcuaa

SEQ ID NO: 3794106 - RNA, 21 nt, Human
aaguguuuccuucauuucuga

SEQ ID NO: 3794107 - RNA, 14 nt, Human
aaguguuuucucug

SEQ ID NO: 3794108 - RNA, 23 nt, Human
aaguguuuuguucuuucuggagu

SEQ ID NO: 3794109 - RNA, 18 nt, Human
aaguuaaaaaaaauaaua

SEQ ID NO: 3794110 - RNA, 20 nt, Human
aaguuaaaaaaaauaauaaa

SEQ ID NO: 3794111 - RNA, 11 nt, Human
aaguuaaaggg

SEQ ID NO: 3794112 - RNA, 12 nt, Human
aaguuaaauaaa

SEQ ID NO: 3794113 - RNA, 13 nt, Human
aaguuaacagaga

SEQ ID NO: 3794114 - RNA, 21 nt, Human
aaguuaagagaaacuuuauac

SEQ ID NO: 3794115 - RNA, 22 nt, Human
aaguuaauguauauaaaaaugg

SEQ ID NO: 3794116 - RNA, 12 nt, Human
aaguuaauuuaa

SEQ ID NO: 3794117 - RNA, 20 nt, Human
aaguuacaaauugcuugaaa

SEQ ID NO: 3794118 - RNA, 15 nt, Human
aaguuacaauguuuu

SEQ ID NO: 3794119 - RNA, 19 nt, Human
aaguuacacagaaaugcug

SEQ ID NO: 3794120 - RNA, 21 nt, Human
aaguuacacagaaaugcugcu

SEQ ID NO: 3794121 - RNA, 22 nt, Human
aaguuacacagaaaugcugcug

SEQ ID NO: 3794122 - RNA, 14 nt, Human
aaguuacacauuuu

SEQ ID NO: 3794123 - RNA, 16 nt, Human
aaguuacauguuugca

SEQ ID NO: 3794124 - RNA, 19 nt, Human
aaguuacauguuugcaccu

SEQ ID NO: 3794125 - RNA, 23 nt, Human
aaguuacauugcuggucuuguaa

SEQ ID NO: 3794126 - RNA, 19 nt, Human
aaguuacuagguaacuuca

SEQ ID NO: 3794127 - RNA, 14 nt, Human
aaguuacugaaugc

SEQ ID NO: 3794128 - RNA, 16 nt, Human
aaguuacuuauucuag

SEQ ID NO: 3794129 - RNA, 13 nt, Human
aaguuacuuucuu

SEQ ID NO: 3794130 - RNA, 19 nt, Human
aaguuacuuugucagaggc

SEQ ID NO: 3794131 - RNA, 14 nt, Human
aaguuagaaucuau

SEQ ID NO: 3794132 - RNA, 19 nt, Human
aaguuagaaucuauuuucu

SEQ ID NO: 3794133 - RNA, 15 nt, Human
aaguuagaauuccuu

SEQ ID NO: 3794134 - RNA, 19 nt, Human
aaguuaguaggauaugccu

SEQ ID NO: 3794135 - RNA, 20 nt, Human
aaguuaguaucuuuugauau

SEQ ID NO: 3794136 - RNA, 18 nt, Human
aaguuaguuccacugaga

SEQ ID NO: 3794137 - RNA, 19 nt, Human
aaguuaguuccacugagac

SEQ ID NO: 3794138 - RNA, 14 nt, Human
aaguuaguuucagu

SEQ ID NO: 3794139 - RNA, 22 nt, Human
aaguuaguuuguauauauuauu

SEQ ID NO: 3794140 - RNA, 14 nt, Human
aaguuauaagacuc

SEQ ID NO: 3794141 - RNA, 17 nt, Human
aaguuauaguauaucug

SEQ ID NO: 3794142 - RNA, 15 nt, Human
aaguuauagugaaua

SEQ ID NO: 3794143 - RNA, 13 nt, Human
aaguuauauuuca

SEQ ID NO: 3794144 - RNA, 23 nt, Human
aaguuauauuuccuauaccauuu

SEQ ID NO: 3794145 - RNA, 15 nt, Human
aaguuauguguaugu

SEQ ID NO: 3794146 - RNA, 14 nt, Human
aaguuauuaaaauu

SEQ ID NO: 3794147 - RNA, 17 nt, Human
aaguuauuaaaauuguu

SEQ ID NO: 3794148 - RNA, 22 nt, Human
aaguuauuaagagguaagacuu

SEQ ID NO: 3794149 - RNA, 14 nt, Human
aaguuauuaauauu

SEQ ID NO: 3794150 - RNA, 17 nt, Human
aaguuauuagugguuua

SEQ ID NO: 3794151 - RNA, 19 nt, Human
aaguuauugauaaguucau

SEQ ID NO: 3794152 - RNA, 22 nt, Human
aaguuauugauaaguucauaca

SEQ ID NO: 3794153 - RNA, 23 nt, Human
aaguuauugauaaguucauacau

SEQ ID NO: 3794154 - RNA, 12 nt, Human
aaguuauuguac

SEQ ID NO: 3794155 - RNA, 19 nt, Human
aaguuauuuuuguacaugu

SEQ ID NO: 3794156 - RNA, 11 nt, Human
aaguucaaacu

SEQ ID NO: 3794157 - RNA, 16 nt, Human
aaguucaacauguuau

SEQ ID NO: 3794158 - RNA, 22 nt, Human
aaguucaauauaagcuuuucuu

SEQ ID NO: 3794159 - RNA, 17 nt, Human
aaguucacaaaauggug

SEQ ID NO: 3794160 - RNA, 21 nt, Human
aaguucaccagacucuauaaa

SEQ ID NO: 3794161 - RNA, 13 nt, Human
aaguucauacauu

SEQ ID NO: 3794162 - RNA, 19 nt, Human
aaguucauaccuaaguacu

SEQ ID NO: 3794163 - RNA, 23 nt, Human
aaguucauauuccauauuuauuc

SEQ ID NO: 3794164 - RNA, 20 nt, Human
aaguucauugcaauuaaacu

SEQ ID NO: 3794165 - RNA, 15 nt, Human
aaguuccaagagucu

SEQ ID NO: 3794166 - RNA, 19 nt, Human
aaguuccaaguugcuaaua

SEQ ID NO: 3794167 - RNA, 19 nt, Human
aaguuccaugggauacaac

SEQ ID NO: 3794168 - RNA, 19 nt, Human
aaguucccaguuggagcuc

SEQ ID NO: 3794169 - RNA, 17 nt, Human
aaguucccuacuuccug

SEQ ID NO: 3794170 - RNA, 20 nt, Human
aaguuccuuggccaugcaga

SEQ ID NO: 3794171 - RNA, 12 nt, Human
aaguucuaagau

SEQ ID NO: 3794172 - RNA, 20 nt, Human
aaguucuaagauucuaauga

SEQ ID NO: 3794173 - RNA, 21 nt, Human
aaguucuaauaauuucuaaug

SEQ ID NO: 3794174 - RNA, 18 nt, Human
aaguucuagagaagaggc

SEQ ID NO: 3794175 - RNA, 21 nt, Human
aaguucuagagaagaggcugg

SEQ ID NO: 3794176 - RNA, 15 nt, Human
aaguucuauuuaagu

SEQ ID NO: 3794177 - RNA, 16 nt, Human
aaguucugcuuucucc

SEQ ID NO: 3794178 - RNA, 19 nt, Human
aaguucuggaugcauuucu

SEQ ID NO: 3794179 - RNA, 17 nt, Human
aaguucuguguauuuaa

SEQ ID NO: 3794180 - RNA, 23 nt, Human
aaguucuguguuuaauuucuuca

SEQ ID NO: 3794181 - RNA, 13 nt, Human
aaguucuuagaua

SEQ ID NO: 3794182 - RNA, 23 nt, Human
aaguucuuagauaucuuuuuauu

SEQ ID NO: 3794183 - RNA, 20 nt, Human
aaguugaaagaguccuauuu

SEQ ID NO: 3794184 - RNA, 17 nt, Human
acacacugaugcuuaga

SEQ ID NO: 3794185 - RNA, 17 nt, Human
acacacugguacuuaga

SEQ ID NO: 3794186 - RNA, 20 nt, Human
acacacuguacacauaagcc

SEQ ID NO: 3794187 - RNA, 19 nt, Human
acacacugucaugcuucau

SEQ ID NO: 3794188 - RNA, 11 nt, Human
acacacugugc

SEQ ID NO: 3794189 - RNA, 23 nt, Human
acacacugugcuuucuauuguac

SEQ ID NO: 3794190 - RNA, 11 nt, Human
acacagaaaau

SEQ ID NO: 3794191 - RNA, 12 nt, Human
acacagaaaaua

SEQ ID NO: 3794192 - RNA, 13 nt, Human
acacagaaaauau

SEQ ID NO: 3794193 - RNA, 14 nt, Human
acacagaaaauaua

SEQ ID NO: 3794194 - RNA, 18 nt, Human
acacagaaaauguugaga

SEQ ID NO: 3794195 - RNA, 13 nt, Human
acacagaaacacu

SEQ ID NO: 3794196 - RNA, 21 nt, Human
acacagaaacacugccuuuuu

SEQ ID NO: 3794197 - RNA, 13 nt, Human
acacagaaaccuu

SEQ ID NO: 3794198 - RNA, 18 nt, Human
acacagaaaccuuuuuaa

SEQ ID NO: 3794199 - RNA, 21 nt, Human
acacagaaaccuuuuuaaaaa

SEQ ID NO: 3794200 - RNA, 17 nt, Human
acacagaaagccuauca

SEQ ID NO: 3794201 - RNA, 12 nt, Human
acacagaaauau

SEQ ID NO: 3794202 - RNA, 16 nt, Human
acacagaaauauauau

SEQ ID NO: 3794203 - RNA, 21 nt, Human
acacagaaauauauauacaua

SEQ ID NO: 3794204 - RNA, 19 nt, Human
acacagaggcugccucucc

SEQ ID NO: 3794205 - RNA, 21 nt, Human
acacagaguggucuuucugga

SEQ ID NO: 3794206 - RNA, 16 nt, Human
acacagauacacacac

SEQ ID NO: 3794207 - RNA, 17 nt, Human
acacagauacacacaca

SEQ ID NO: 3794208 - RNA, 16 nt, Human
acacagauagaccuuu

SEQ ID NO: 3794209 - RNA, 11 nt, Human
acacagauguu

SEQ ID NO: 3794210 - RNA, 22 nt, Human
acacagcagaggcccagauauu

SEQ ID NO: 3794211 - RNA, 17 nt, Human
acacagcauuguauaug

SEQ ID NO: 3794212 - RNA, 15 nt, Human
acacagccacacaca

SEQ ID NO: 3794213 - RNA, 19 nt, Human
acacagccugggccccagc

SEQ ID NO: 3794214 - RNA, 17 nt, Human
acacagcuacucucccc

SEQ ID NO: 3794215 - RNA, 12 nt, Human
acacagcucugu

SEQ ID NO: 3794216 - RNA, 11 nt, Human
acacagcucuu

SEQ ID NO: 3794217 - RNA, 16 nt, Human
acacagcucuucucca

SEQ ID NO: 3794218 - RNA, 18 nt, Human
acacagcucuucuccagg

SEQ ID NO: 3794219 - RNA, 19 nt, Human
acacagcucuucuccaggc

SEQ ID NO: 3794220 - RNA, 13 nt, Human
acacagcugcuuu

SEQ ID NO: 3794221 - RNA, 15 nt, Human
acacagcugggcugu

SEQ ID NO: 3794222 - RNA, 20 nt, Human
acacagcuuuaucaccagag

SEQ ID NO: 3794223 - RNA, 18 nt, Human
acacaggacagggguucc

SEQ ID NO: 3794224 - RNA, 16 nt, Human
acacaggauagauaac

SEQ ID NO: 3794225 - RNA, 24 nt, Human
acacaggauccuauucucaccagg

SEQ ID NO: 3794226 - RNA, 15 nt, Human
acacaggcaacugag

SEQ ID NO: 3794227 - RNA, 17 nt, Human
acacaggcccggcucca

SEQ ID NO: 3794228 - RNA, 19 nt, Human
acacaggcccggcuccagg

SEQ ID NO: 3794229 - RNA, 20 nt, Human
acacaggcccggcuccaggc

SEQ ID NO: 3794230 - RNA, 16 nt, Human
acacaggccuguguag

SEQ ID NO: 3794231 - RNA, 22 nt, Human
acacaggccuguguagcuguga

SEQ ID NO: 3794232 - RNA, 11 nt, Human
acacagggcag

SEQ ID NO: 3794233 - RNA, 16 nt, Human
acacaggggcuugacu

SEQ ID NO: 3794234 - RNA, 20 nt, Human
acacagggugacggugacaa

SEQ ID NO: 3794235 - RNA, 15 nt, Human
acacaggucuuuccu

SEQ ID NO: 3794236 - RNA, 18 nt, Human
acacagguggugucacug

SEQ ID NO: 3794237 - RNA, 22 nt, Human
acacagguggugucacuguccc

SEQ ID NO: 3794238 - RNA, 16 nt, Human
acacagguucacgugc

SEQ ID NO: 3794239 - RNA, 19 nt, Human
acacaguauuacuucugcu

SEQ ID NO: 3794240 - RNA, 13 nt, Human
acacaguauuuuc

SEQ ID NO: 3794241 - RNA, 18 nt, Human
acacagucaaaauaauuc

SEQ ID NO: 3794242 - RNA, 15 nt, Human
acacagucugcaaga

SEQ ID NO: 3794243 - RNA, 17 nt, Human
acacagugaccauacua

SEQ ID NO: 3794244 - RNA, 20 nt, Human
acacagugccuucaauaaau

SEQ ID NO: 3794245 - RNA, 21 nt, Human
acacaguguuuuuguaaagug

SEQ ID NO: 3794246 - RNA, 16 nt, Human
acacaguuccugggaa

SEQ ID NO: 3794247 - RNA, 18 nt, Human
acacaguuccugggaaca

SEQ ID NO: 3794248 - RNA, 19 nt, Human
acacauaagccaaaacuga

SEQ ID NO: 3794249 - RNA, 13 nt, Human
acacauaauuaaa

SEQ ID NO: 3794250 - RNA, 16 nt, Human
acacauaauuaaagug

SEQ ID NO: 3794251 - RNA, 18 nt, Human
acacauaauuaaaguguc

SEQ ID NO: 3794252 - RNA, 21 nt, Human
acacauaauuaaaguguccau

SEQ ID NO: 3794253 - RNA, 17 nt, Human
acacauacaguuuuaug

SEQ ID NO: 3794254 - RNA, 18 nt, Human
acacauagauuaauggca

SEQ ID NO: 3794255 - RNA, 21 nt, Human
acacauagauuaauggcacug

SEQ ID NO: 3794256 - RNA, 13 nt, Human
acacauagauuca

SEQ ID NO: 3794257 - RNA, 19 nt, Human
acacauagauucaccugua

SEQ ID NO: 3794258 - RNA, 14 nt, Human
acacauauaaacau

SEQ ID NO: 3794259 - RNA, 17 nt, Human
acacauaugagggggaa

SEQ ID NO: 3794260 - RNA, 16 nt, Human
acacauaugucauaua

SEQ ID NO: 3794261 - RNA, 18 nt, Human
acacaucacccuuaccau

SEQ ID NO: 3794262 - RNA, 20 nt, Human
acacaucagccaucaacuaa

SEQ ID NO: 3794263 - RNA, 22 nt, Human
acacaucagcuugcccuguuaa

SEQ ID NO: 3794264 - RNA, 16 nt, Human
acacaucccagcccaa

SEQ ID NO: 3794265 - RNA, 19 nt, Human
acacaucccuaaugugugc

SEQ ID NO: 3794266 - RNA, 21 nt, Human
acacauccgccuuuuguauac

SEQ ID NO: 3794267 - RNA, 13 nt, Human
aauuccgucacca

SEQ ID NO: 3794268 - RNA, 14 nt, Human
aauuccuacagcac

SEQ ID NO: 3794269 - RNA, 15 nt, Human
aauuccuacagcacu

SEQ ID NO: 3794270 - RNA, 20 nt, Human
aauuccuagauaaaaagaug

SEQ ID NO: 3794271 - RNA, 12 nt, Human
aauuccuauaag

SEQ ID NO: 3794272 - RNA, 22 nt, Human
aauuccuauacgcagcgugcuu

SEQ ID NO: 3794273 - RNA, 18 nt, Human
aauuccuauugugauuug

SEQ ID NO: 3794274 - RNA, 21 nt, Human
aauuccucauccucagaugcu

SEQ ID NO: 3794275 - RNA, 21 nt, Human
aauucgcccgagcuguuuaug

SEQ ID NO: 3794276 - RNA, 23 nt, Human
aauucgcccgagcuguuuauguu

SEQ ID NO: 3794277 - RNA, 15 nt, Human
aauucggugugcacc

SEQ ID NO: 3794278 - RNA, 22 nt, Human
aauucuaaauaaaauauaauug

SEQ ID NO: 3794279 - RNA, 13 nt, Human
aauucuaaaugaa

SEQ ID NO: 3794280 - RNA, 22 nt, Human
aauucuaaucuaacaauggaag

SEQ ID NO: 3794281 - RNA, 15 nt, Human
aauucuacauuguca

SEQ ID NO: 3794282 - RNA, 22 nt, Human
aauucuauaaggccauaaaaca

SEQ ID NO: 3794283 - RNA, 13 nt, Human
aauucuaugccug

SEQ ID NO: 3794284 - RNA, 15 nt, Human
aauucuaugccuguc

SEQ ID NO: 3794285 - RNA, 23 nt, Human
aauucuauuaaagugcuaagguu

SEQ ID NO: 3794286 - RNA, 14 nt, Human
aauucuauuugcug

SEQ ID NO: 3794287 - RNA, 17 nt, Human
aauucucaaccuaccac

SEQ ID NO: 3794288 - RNA, 19 nt, Human
aauucucaugugauccuuu

SEQ ID NO: 3794289 - RNA, 20 nt, Human
aauucucaugugauccuuuu

SEQ ID NO: 3794290 - RNA, 21 nt, Human
aauucucaugugauccuuuua

SEQ ID NO: 3794291 - RNA, 21 nt, Human
aauucucauuugucacacacu

SEQ ID NO: 3794292 - RNA, 15 nt, Human
aauucuccacugugc

SEQ ID NO: 3794293 - RNA, 15 nt, Human
aauucuccugccuuu

SEQ ID NO: 3794294 - RNA, 18 nt, Human
aauucuccugccuuugcc

SEQ ID NO: 3794295 - RNA, 15 nt, Human
aauucucuaguuuga

SEQ ID NO: 3794296 - RNA, 17 nt, Human
aauucucuaguuugauu

SEQ ID NO: 3794297 - RNA, 15 nt, Human
aauucugaaguuaua

SEQ ID NO: 3794298 - RNA, 17 nt, Human
aauucugaauuugcaaa

SEQ ID NO: 3794299 - RNA, 19 nt, Human
aauucugaauuugcaaagu

SEQ ID NO: 3794300 - RNA, 20 nt, Human
aauucugaauuugcaaagua

SEQ ID NO: 3794301 - RNA, 23 nt, Human
aauucugaguuuuguguuuguug

SEQ ID NO: 3794302 - RNA, 19 nt, Human
aauucugcaauguuuuccu

SEQ ID NO: 3794303 - RNA, 19 nt, Human
aauucugcuaccucacugg

SEQ ID NO: 3794304 - RNA, 20 nt, Human
aauucuguacauagccuaua

SEQ ID NO: 3794305 - RNA, 14 nt, Human
aauucuguauagau

SEQ ID NO: 3794306 - RNA, 23 nt, Human
aauucuguggguccgauaauauc

SEQ ID NO: 3794307 - RNA, 17 nt, Human
aauucuguucauuuguu

SEQ ID NO: 3794308 - RNA, 13 nt, Human
aauucuguuucuu

SEQ ID NO: 3794309 - RNA, 18 nt, Human
aauucuguuuuuaaaaau

SEQ ID NO: 3794310 - RNA, 14 nt, Human
aauucuguuuuucu

SEQ ID NO: 3794311 - RNA, 14 nt, Human
aauucuuaaaauau

SEQ ID NO: 3794312 - RNA, 22 nt, Human
aauucuuacacugccuguauac

SEQ ID NO: 3794313 - RNA, 23 nt, Human
aauucuuacacugccuguauacu

SEQ ID NO: 3794314 - RNA, 18 nt, Human
aauucuuacccuguacau

SEQ ID NO: 3794315 - RNA, 23 nt, Human
aauucuuauuccauauuagaaaa

SEQ ID NO: 3794316 - RNA, 15 nt, Human
aauucuuauucuuuc

SEQ ID NO: 3794317 - RNA, 23 nt, Human
aauucuucaccuaagucucugug

SEQ ID NO: 3794318 - RNA, 19 nt, Human
aauucuucagcguaaaaug

SEQ ID NO: 3794319 - RNA, 15 nt, Human
aauucuucugaacuc

SEQ ID NO: 3794320 - RNA, 15 nt, Human
aauucuucuguccug

SEQ ID NO: 3794321 - RNA, 17 nt, Human
aauucuugcauauuuug

SEQ ID NO: 3794322 - RNA, 15 nt, Human
aauucuuggaauacu

SEQ ID NO: 3794323 - RNA, 15 nt, Human
aauucuuguauauua

SEQ ID NO: 3794324 - RNA, 17 nt, Human
aauucuuuaaaauuaca

SEQ ID NO: 3794325 - RNA, 14 nt, Human
aauucuuuauacaa

SEQ ID NO: 3794326 - RNA, 19 nt, Human
aauucuuuauacaacagug

SEQ ID NO: 3794327 - RNA, 22 nt, Human
aauucuuuauacaacagugcua

SEQ ID NO: 3794328 - RNA, 18 nt, Human
acaccagagcccaccuug

SEQ ID NO: 3794329 - RNA, 20 nt, Human
acaccagccuuucucccagg

SEQ ID NO: 3794330 - RNA, 14 nt, Human
acaccagggccagc

SEQ ID NO: 3794331 - RNA, 18 nt, Human
acaccagggccagccucu

SEQ ID NO: 3794332 - RNA, 15 nt, Human
acaccaugauuccuu

SEQ ID NO: 3794333 - RNA, 16 nt, Human
acaccaugauuccuuu

SEQ ID NO: 3794334 - RNA, 18 nt, Human
acaccaugauuccuuuaa

SEQ ID NO: 3794335 - RNA, 22 nt, Human
acaccauuggaccccacccagc

SEQ ID NO: 3794336 - RNA, 19 nt, Human
acacccaaagagguauuua

SEQ ID NO: 3794337 - RNA, 20 nt, Human
acacccaaagcauggacuaa

SEQ ID NO: 3794338 - RNA, 14 nt, Human
acacccaaagcuga

SEQ ID NO: 3794339 - RNA, 15 nt, Human
acacccacacucaga

SEQ ID NO: 3794340 - RNA, 22 nt, Human
acacccaccguccgcccugcuc

SEQ ID NO: 3794341 - RNA, 13 nt, Human
acacccagcaaua

SEQ ID NO: 3794342 - RNA, 13 nt, Human
acacccagcccac

SEQ ID NO: 3794343 - RNA, 21 nt, Human
acacccagcccacuucugcca

SEQ ID NO: 3794344 - RNA, 14 nt, Human
acacccagccucag

SEQ ID NO: 3794345 - RNA, 20 nt, Human
acacccagccucaguccucc

SEQ ID NO: 3794346 - RNA, 23 nt, Human
acacccagccucaguccuccccu

SEQ ID NO: 3794347 - RNA, 12 nt, Human
acaccccaccug

SEQ ID NO: 3794348 - RNA, 20 nt, Human
acaccccauugguggacuac

SEQ ID NO: 3794349 - RNA, 17 nt, Human
acaccccgacuuuuguu

SEQ ID NO: 3794350 - RNA, 16 nt, Human
acaccccuccccugcc

SEQ ID NO: 3794351 - RNA, 23 nt, Human
acaccccuccccugcccuagagc

SEQ ID NO: 3794352 - RNA, 18 nt, Human
acaccccuuauccaggac

SEQ ID NO: 3794353 - RNA, 19 nt, Human
acaccccuuauccaggacu

SEQ ID NO: 3794354 - RNA, 17 nt, Human
acacccgacuccucaaa

SEQ ID NO: 3794355 - RNA, 18 nt, Human
acacccgugagcgccugu

SEQ ID NO: 3794356 - RNA, 20 nt, Human
acacccucacucugccaggg

SEQ ID NO: 3794357 - RNA, 22 nt, Human
acacccucgaagcgcgccacuc

SEQ ID NO: 3794358 - RNA, 12 nt, Human
acacccucuccc

SEQ ID NO: 3794359 - RNA, 13 nt, Human
acacccugcaagg

SEQ ID NO: 3794360 - RNA, 12 nt, Human
acacccugcccu

SEQ ID NO: 3794361 - RNA, 22 nt, Human
acacccuucucccacucuccua

SEQ ID NO: 3794362 - RNA, 13 nt, Human
acaccgacuagcc

SEQ ID NO: 3794363 - RNA, 20 nt, Human
acaccggcuggcagggcugg

SEQ ID NO: 3794364 - RNA, 16 nt, Human
acaccgggccuggaga

SEQ ID NO: 3794365 - RNA, 19 nt, Human
acaccgggguggugggaac

SEQ ID NO: 3794366 - RNA, 15 nt, Human
acaccuaacucaccu

SEQ ID NO: 3794367 - RNA, 18 nt, Human
acaccuaagggacauguu

SEQ ID NO: 3794368 - RNA, 22 nt, Human
acaccuaagggacauguuuuga

SEQ ID NO: 3794369 - RNA, 21 nt, Human
acaccuagcuuuauucuucag

SEQ ID NO: 3794370 - RNA, 23 nt, Human
acaccuaggcuaggguggggaga

SEQ ID NO: 3794371 - RNA, 20 nt, Human
acaccuaugucauuucauuu

SEQ ID NO: 3794372 - RNA, 20 nt, Human
acaccucacucugcuaccuu

SEQ ID NO: 3794373 - RNA, 18 nt, Human
acaccucaguucccuugg

SEQ ID NO: 3794374 - RNA, 21 nt, Human
acaccucaguucccuuggccu

SEQ ID NO: 3794375 - RNA, 22 nt, Human
acaccucaguucccuuggccuc

SEQ ID NO: 3794376 - RNA, 13 nt, Human
acaccucccugaa

SEQ ID NO: 3794377 - RNA, 15 nt, Human
acaccuccucucacu

SEQ ID NO: 3794378 - RNA, 11 nt, Human
acaccuccuuc

SEQ ID NO: 3794379 - RNA, 22 nt, Human
acaccuccuucccucucuggag

SEQ ID NO: 3794380 - RNA, 12 nt, Human
acaccucgcccc

SEQ ID NO: 3794381 - RNA, 22 nt, Human
acaccucguuagggaagagaaa

SEQ ID NO: 3794382 - RNA, 18 nt, Human
acaccucugcacaagcug

SEQ ID NO: 3794383 - RNA, 13 nt, Human
acaccucugccag

SEQ ID NO: 3794384 - RNA, 15 nt, Human
acaccucugcuuucu

SEQ ID NO: 3794385 - RNA, 21 nt, Human
acaccucugcuuucugauguu

SEQ ID NO: 3794386 - RNA, 16 nt, Human
acaccugacucugaaa

SEQ ID NO: 3794387 - RNA, 21 nt, Human
acaccugacucugaaaucuga

SEQ ID NO: 3794388 - RNA, 12 nt, Human
acaccugcaccu

SEQ ID NO: 3794389 - RNA, 16 nt, Human
acaccugcaccucccc

SEQ ID NO: 3794390 - RNA, 18 nt, Human
acaccugcaccucccccc

SEQ ID NO: 3794391 - RNA, 19 nt, Human
acaccugcagccucccucc

SEQ ID NO: 3794392 - RNA, 15 nt, Human
acaccugcccugccc

SEQ ID NO: 3794393 - RNA, 17 nt, Human
acaccugcccugcccug

SEQ ID NO: 3794394 - RNA, 17 nt, Human
acaccuggcccuggggc

SEQ ID NO: 3794395 - RNA, 23 nt, Human
acaccuggcugagguuccucugc

SEQ ID NO: 3794396 - RNA, 21 nt, Human
acaccuuagccugcccuccuu

SEQ ID NO: 3794397 - RNA, 23 nt, Human
acaccuuagccugcccuccuuuc

SEQ ID NO: 3794398 - RNA, 15 nt, Human
acaccuuauauuuac

SEQ ID NO: 3794399 - RNA, 21 nt, Human
acaccuucuuauuauauauau

SEQ ID NO: 3794400 - RNA, 15 nt, Human
acaccuugacagggc

SEQ ID NO: 3794401 - RNA, 15 nt, Human
acaccuuuagguucu

SEQ ID NO: 3794402 - RNA, 17 nt, Human
acaccuuucuccuuugu

SEQ ID NO: 3794403 - RNA, 17 nt, Human
acaccuuuuaacucacc

SEQ ID NO: 3794404 - RNA, 13 nt, Human
acacgaaacuugu

SEQ ID NO: 3794405 - RNA, 23 nt, Human
acacgaaacuuguuauugugaau

SEQ ID NO: 3794406 - RNA, 14 nt, Human
acacgaaagagaga

SEQ ID NO: 3794407 - RNA, 18 nt, Human
acacgaacuuuagcugca

SEQ ID NO: 3794408 - RNA, 14 nt, Human
acacgaauauugcu

SEQ ID NO: 3794409 - RNA, 18 nt, Human
acacgaauauugcugaug

SEQ ID NO: 3794410 - RNA, 21 nt, Human
acacgaauauugcugauggug

SEQ ID NO: 3794411 - RNA, 22 nt, Human
acacgaccggggccagcaccac

SEQ ID NO: 3794412 - RNA, 13 nt, Human
acacgcacacaca

SEQ ID NO: 3794413 - RNA, 23 nt, Human
acacgcacacacacacacaggag

SEQ ID NO: 3794414 - RNA, 13 nt, Human
acacgcacgcaca

SEQ ID NO: 3794415 - RNA, 20 nt, Human
acacgcacgcacacacacaa

SEQ ID NO: 3794416 - RNA, 15 nt, Human
acacgcaggagcaca

SEQ ID NO: 3794417 - RNA, 20 nt, Human
acacgccccaauuuucaggu

SEQ ID NO: 3794418 - RNA, 23 nt, Human
acacgcgccccccucccagaggc

SEQ ID NO: 3794419 - RNA, 12 nt, Human
acacgcuccuuc

SEQ ID NO: 3794420 - RNA, 16 nt, Human
acacgcuccuuccucu

SEQ ID NO: 3794421 - RNA, 12 nt, Human
acacgcugccuu

SEQ ID NO: 3794422 - RNA, 17 nt, Human
acacgcugcucugcccc

SEQ ID NO: 3794423 - RNA, 18 nt, Human
acacggagcccagcccuc

SEQ ID NO: 3794424 - RNA, 14 nt, Human
acacggaggcaucu

SEQ ID NO: 3794425 - RNA, 17 nt, Human
acacggaggcaucugca

SEQ ID NO: 3794426 - RNA, 14 nt, Human
acacggccacauca

SEQ ID NO: 3794427 - RNA, 16 nt, Human
acacgggcagccuggc

SEQ ID NO: 3794428 - RNA, 15 nt, Human
acacgggccugucca

SEQ ID NO: 3794429 - RNA, 16 nt, Human
acacgggggcagcuga

SEQ ID NO: 3794430 - RNA, 16 nt, Human
acacgggguauuuuag

SEQ ID NO: 3794431 - RNA, 22 nt, Human
acacgguuugaagccuggaaca

SEQ ID NO: 3794432 - RNA, 23 nt, Human
aauagaguguaguuuacagaaaa

SEQ ID NO: 3794433 - RNA, 19 nt, Human
aauagauaugaaagcugau

SEQ ID NO: 3794434 - RNA, 21 nt, Human
aauagaugacauugacuauuu

SEQ ID NO: 3794435 - RNA, 19 nt, Human
aauagauguuugauagauu

SEQ ID NO: 3794436 - RNA, 22 nt, Human
aauagauguuugauagauuuuc

SEQ ID NO: 3794437 - RNA, 15 nt, Human
aauagauuauaguug

SEQ ID NO: 3794438 - RNA, 22 nt, Human
aauagauugcucaaaucagguu

SEQ ID NO: 3794439 - RNA, 15 nt, Human
aauagcaaagaauug

SEQ ID NO: 3794440 - RNA, 18 nt, Human
aauagcaaagaauugacu

SEQ ID NO: 3794441 - RNA, 17 nt, Human
aauagcaacaugcuuca

SEQ ID NO: 3794442 - RNA, 15 nt, Human
aauagcaaccuuuuu

SEQ ID NO: 3794443 - RNA, 15 nt, Human
aauagcaacuuuugu

SEQ ID NO: 3794444 - RNA, 21 nt, Human
aauagcaaggcugugcaucua

SEQ ID NO: 3794445 - RNA, 15 nt, Human
aauagcaauauucuu

SEQ ID NO: 3794446 - RNA, 20 nt, Human
aauagcacuuucauugccag

SEQ ID NO: 3794447 - RNA, 23 nt, Human
aauagcagcccucaauugugaaa

SEQ ID NO: 3794448 - RNA, 19 nt, Human
aauagcauguauugugucu

SEQ ID NO: 3794449 - RNA, 12 nt, Human
aauagcauguca

SEQ ID NO: 3794450 - RNA, 15 nt, Human
aauagcaugucacua

SEQ ID NO: 3794451 - RNA, 20 nt, Human
aauagcaugucacuaaagca

SEQ ID NO: 3794452 - RNA, 20 nt, Human
aauagcauguccuaaugcuu

SEQ ID NO: 3794453 - RNA, 17 nt, Human
aauagcauguuguagau

SEQ ID NO: 3794454 - RNA, 18 nt, Human
aauagcauguuguagaua

SEQ ID NO: 3794455 - RNA, 21 nt, Human
aauagccaacacccaucuguu

SEQ ID NO: 3794456 - RNA, 20 nt, Human
aauagccacuaaccuugccu

SEQ ID NO: 3794457 - RNA, 23 nt, Human
aauagccacugcauaccaaccug

SEQ ID NO: 3794458 - RNA, 20 nt, Human
aauagccacuuaccuucaau

SEQ ID NO: 3794459 - RNA, 22 nt, Human
aauagccauauuuguaaaauga

SEQ ID NO: 3794460 - RNA, 16 nt, Human
aauagcguucuuguaa

SEQ ID NO: 3794461 - RNA, 21 nt, Human
aauagcuaaauaccucaauca

SEQ ID NO: 3794462 - RNA, 16 nt, Human
aauagcuacagugcau

SEQ ID NO: 3794463 - RNA, 21 nt, Human
aauagcuagacuggugacuga

SEQ ID NO: 3794464 - RNA, 20 nt, Human
aauagcuauauccauguacu

SEQ ID NO: 3794465 - RNA, 21 nt, Human
aauagcuauauccauguacug

SEQ ID NO: 3794466 - RNA, 20 nt, Human
aauagcucccagauuucagu

SEQ ID NO: 3794467 - RNA, 14 nt, Human
aauagcugggacua

SEQ ID NO: 3794468 - RNA, 18 nt, Human
aauagcuguaaacuucca

SEQ ID NO: 3794469 - RNA, 17 nt, Human
aauagcuuaugaaaaga

SEQ ID NO: 3794470 - RNA, 14 nt, Human
aauagcuuguauag

SEQ ID NO: 3794471 - RNA, 19 nt, Human
aauagcuuguauaguguaa

SEQ ID NO: 3794472 - RNA, 21 nt, Human
aaucuuaauacuguuauucuu

SEQ ID NO: 3794473 - RNA, 14 nt, Human
aaucuuaauguucc

SEQ ID NO: 3794474 - RNA, 18 nt, Human
aaucuuacagcugggugg

SEQ ID NO: 3794475 - RNA, 14 nt, Human
aaucuuacucuaga

SEQ ID NO: 3794476 - RNA, 19 nt, Human
aaucuuaggggagagcuuu

SEQ ID NO: 3794477 - RNA, 16 nt, Human
aaucuuauaauuuaaa

SEQ ID NO: 3794478 - RNA, 19 nt, Human
aaucuuauaauuuaaaaua

SEQ ID NO: 3794479 - RNA, 19 nt, Human
aaucuuauaguucuaggca

SEQ ID NO: 3794480 - RNA, 21 nt, Human
aaucuuaucauggucucaguc

SEQ ID NO: 3794481 - RNA, 17 nt, Human
aaucuuauuaaaguuuc

SEQ ID NO: 3794482 - RNA, 20 nt, Human
aaucuuauuaaaguuucaaa

SEQ ID NO: 3794483 - RNA, 14 nt, Human
aaucuucaauaguu

SEQ ID NO: 3794484 - RNA, 15 nt, Human
aaucuuccaauuuag

SEQ ID NO: 3794485 - RNA, 17 nt, Human
aaucuucccaugcauuc

SEQ ID NO: 3794486 - RNA, 14 nt, Human
aaucuuccuguuua

SEQ ID NO: 3794487 - RNA, 16 nt, Human
aaucuucuccagauuu

SEQ ID NO: 3794488 - RNA, 18 nt, Human
acagagaacuaacacuau

SEQ ID NO: 3794489 - RNA, 19 nt, Human
acagagaacuaacacuauu

SEQ ID NO: 3794490 - RNA, 23 nt, Human
acagagaacuagugguggcucug

SEQ ID NO: 3794491 - RNA, 9 nt, Human
acagagaag

SEQ ID NO: 3794492 - RNA, 15 nt, Human
acagagaagccagcu

SEQ ID NO: 3794493 - RNA, 19 nt, Human
acagagaagccagcuuguu

SEQ ID NO: 3794494 - RNA, 13 nt, Human
acagagaagccau

SEQ ID NO: 3794495 - RNA, 12 nt, Human
acagagaagccu

SEQ ID NO: 3794496 - RNA, 14 nt, Human
acagagaagccuuc

SEQ ID NO: 3794497 - RNA, 16 nt, Human
acagagaagccuucaa

SEQ ID NO: 3794498 - RNA, 23 nt, Human
acagagaagccuucaagcucuga

SEQ ID NO: 3794499 - RNA, 19 nt, Human
acagagaaggaaugucuuu

SEQ ID NO: 3794500 - RNA, 22 nt, Human
acagagaaggaaugucuuuggu

SEQ ID NO: 3794501 - RNA, 14 nt, Human
acagagaaggcagg

SEQ ID NO: 3794502 - RNA, 12 nt, Human
acagagaaguca

SEQ ID NO: 3794503 - RNA, 14 nt, Human
acagagaagucaca

SEQ ID NO: 3794504 - RNA, 16 nt, Human
acagagaagucacagg

SEQ ID NO: 3794505 - RNA, 16 nt, Human
acagagacaccugcac

SEQ ID NO: 3794506 - RNA, 17 nt, Human
acagagacaccugcacc

SEQ ID NO: 3794507 - RNA, 19 nt, Human
acagagacauuccuccgag

SEQ ID NO: 3794508 - RNA, 19 nt, Human
acagagaccucccuguuca

SEQ ID NO: 3794509 - RNA, 20 nt, Human
acagagaggagaaacacauc

SEQ ID NO: 3794510 - RNA, 24 nt, Human
acagagagggagagcagagaaaga

SEQ ID NO: 3794511 - RNA, 21 nt, Human
acagagagggcaccaucacaa

SEQ ID NO: 3794512 - RNA, 19 nt, Human
acagagaugcuaagagaaa

SEQ ID NO: 3794513 - RNA, 16 nt, Human
acagagcaguugagag

SEQ ID NO: 3794514 - RNA, 20 nt, Human
acagagccaggagaagcuca

SEQ ID NO: 3794515 - RNA, 22 nt, Human
acagagccaggagaagcucagc

SEQ ID NO: 3794516 - RNA, 18 nt, Human
acagagcccacgccccca

SEQ ID NO: 3794517 - RNA, 17 nt, Human
acagagccguaaaaacu

SEQ ID NO: 3794518 - RNA, 23 nt, Human
acagagccuucugaggacauucc

SEQ ID NO: 3794519 - RNA, 16 nt, Human
acagagcgacagagca

SEQ ID NO: 3794520 - RNA, 15 nt, Human
acagagcucuccagc

SEQ ID NO: 3794521 - RNA, 15 nt, Human
acagagcuucccuga

SEQ ID NO: 3794522 - RNA, 14 nt, Human
acagaggaagagca

SEQ ID NO: 3794523 - RNA, 19 nt, Human
acagaggcagccccauucu

SEQ ID NO: 3794524 - RNA, 15 nt, Human
acagaggcccucaag

SEQ ID NO: 3794525 - RNA, 12 nt, Human
acagaggccugc

SEQ ID NO: 3794526 - RNA, 13 nt, Human
acagaggccugcc

SEQ ID NO: 3794527 - RNA, 14 nt, Human
acagaggccugccc

SEQ ID NO: 3794528 - RNA, 16 nt, Human
acagagggaagaaaag

SEQ ID NO: 3794529 - RNA, 18 nt, Human
acagaggggguggccucc

SEQ ID NO: 3794530 - RNA, 19 nt, Human
acagaggggguggccuccc

SEQ ID NO: 3794531 - RNA, 21 nt, Human
acagaggggguggccucccaa

SEQ ID NO: 3794532 - RNA, 22 nt, Human
acagagguauuaaaacuaaauu

SEQ ID NO: 3794533 - RNA, 15 nt, Human
acagaguaagacauu

SEQ ID NO: 3794534 - RNA, 16 nt, Human
acagaguaagacauug

SEQ ID NO: 3794535 - RNA, 19 nt, Human
acagagucucacuguugcc

SEQ ID NO: 3794536 - RNA, 13 nt, Human
acagagucugggu

SEQ ID NO: 3794537 - RNA, 19 nt, Human
acagagugagacucugucu

SEQ ID NO: 3794538 - RNA, 21 nt, Human
acagaguggaauaagacagag

SEQ ID NO: 3794539 - RNA, 21 nt, Human
acagaguggucuuucuggaga

SEQ ID NO: 3794540 - RNA, 16 nt, Human
acagaguugauuuuuu

SEQ ID NO: 3794541 - RNA, 17 nt, Human
acagaguuguuacauuu

SEQ ID NO: 3794542 - RNA, 18 nt, Human
acagaguuguuacauuuu

SEQ ID NO: 3794543 - RNA, 21 nt, Human
acagaguuguuacauuuuuaa

SEQ ID NO: 3794544 - RNA, 22 nt, Human
acagauaaaaaguggaauuucu

SEQ ID NO: 3794545 - RNA, 16 nt, Human
acagauaaaauguaaa

SEQ ID NO: 3794546 - RNA, 17 nt, Human
acagauaaagauugugu

SEQ ID NO: 3794547 - RNA, 20 nt, Human
acagauaagcaagagagaug

SEQ ID NO: 3794548 - RNA, 16 nt, Human
acagauaccuccaacc

SEQ ID NO: 3794549 - RNA, 19 nt, Human
acagauaccuccaacccug

SEQ ID NO: 3794550 - RNA, 21 nt, Human
acagauaccuccaacccugcc

SEQ ID NO: 3794551 - RNA, 22 nt, Human
acagauaccuccaacccugccg

SEQ ID NO: 3794552 - RNA, 20 nt, Human
acagauacuccuccaagguu

SEQ ID NO: 3794553 - RNA, 21 nt, Human
acagauacuggaaguuuugca

SEQ ID NO: 3794554 - RNA, 16 nt, Human
acagauaggccuucuu

SEQ ID NO: 3794555 - RNA, 23 nt, Human
acagauagucaaaccauaaacuu

SEQ ID NO: 3794556 - RNA, 14 nt, Human
acagauauaaaugg

SEQ ID NO: 3794557 - RNA, 18 nt, Human
acagauccccaagccugg

SEQ ID NO: 3794558 - RNA, 18 nt, Human
acagaugccacacaagga

SEQ ID NO: 3794559 - RNA, 14 nt, Human
acagaugccccaga

SEQ ID NO: 3794560 - RNA, 18 nt, Human
acagaugccuccuuccuc

SEQ ID NO: 3794561 - RNA, 19 nt, Human
acagauggaaaaacugagg

SEQ ID NO: 3794562 - RNA, 14 nt, Human
acagauggccagcc

SEQ ID NO: 3794563 - RNA, 20 nt, Human
acagauguaaaagacuuuuu

SEQ ID NO: 3794564 - RNA, 20 nt, Human
acagaugucagccgagccgg

SEQ ID NO: 3794565 - RNA, 21 nt, Human
acagauguccaucagaugaca

SEQ ID NO: 3794566 - RNA, 17 nt, Human
acagaugugcugacaag

SEQ ID NO: 3794567 - RNA, 13 nt, Human
acagauucagucu

SEQ ID NO: 3794568 - RNA, 14 nt, Human
acagauucagucuu

SEQ ID NO: 3794569 - RNA, 17 nt, Human
acagauucagucuugcc

SEQ ID NO: 3794570 - RNA, 15 nt, Human
acagauucuuucagu

SEQ ID NO: 3794571 - RNA, 19 nt, Human
acagauucuuucaguucuu

SEQ ID NO: 3794572 - RNA, 20 nt, Human
acagauucuuucaguucuuu

SEQ ID NO: 3794573 - RNA, 18 nt, Human
acagauugaauuugccua

SEQ ID NO: 3794574 - RNA, 13 nt, Human
acagauuggauuu

SEQ ID NO: 3794575 - RNA, 22 nt, Human
acagauuggauuuuauguugac

SEQ ID NO: 3794576 - RNA, 23 nt, Human
acagauuggauuuuauguugaca

SEQ ID NO: 3794577 - RNA, 15 nt, Human
acagauuguuucuau

SEQ ID NO: 3794578 - RNA, 16 nt, Human
acagauuguuucuaua

SEQ ID NO: 3794579 - RNA, 18 nt, Human
acagauuguuucuauaca

SEQ ID NO: 3794580 - RNA, 15 nt, Human
acagauuguuugcaa

SEQ ID NO: 3794581 - RNA, 20 nt, Human
acagauuuauuccuuuguua

SEQ ID NO: 3794582 - RNA, 15 nt, Human
acagauuugagcuca

SEQ ID NO: 3794583 - RNA, 15 nt, Human
acagauuuggaaaga

SEQ ID NO: 3794584 - RNA, 12 nt, Human
acagauuuguga

SEQ ID NO: 3794585 - RNA, 22 nt, Human
acagauuugugaacucagccaa

SEQ ID NO: 3794586 - RNA, 18 nt, Human
acagauuuuaauugucau

SEQ ID NO: 3794587 - RNA, 20 nt, Human
acagauuuuaauugucaugg

SEQ ID NO: 3794588 - RNA, 17 nt, Human
acagauuuugauagcaa

SEQ ID NO: 3794589 - RNA, 20 nt, Human
acagauuuugauagcaaagc

SEQ ID NO: 3794590 - RNA, 20 nt, Human
acagauuuugggguuguguu

SEQ ID NO: 3794591 - RNA, 20 nt, Human
acagcaaaaccauugcuuca

SEQ ID NO: 3794592 - RNA, 10 nt, Human
acagcaaauu

SEQ ID NO: 3794593 - RNA, 20 nt, Human
acagcaaauuuauaauuuua

SEQ ID NO: 3794594 - RNA, 22 nt, Human
acagcaaauuuauaauuuuaag

SEQ ID NO: 3794595 - RNA, 17 nt, Human
acagcaacaauuuauga

SEQ ID NO: 3794596 - RNA, 20 nt, Human
acagcaacaauuuaugaauu

SEQ ID NO: 3794597 - RNA, 17 nt, Human
acagcaacacaaagcuu

SEQ ID NO: 3794598 - RNA, 20 nt, Human
acagcaacgaucacaaauga

SEQ ID NO: 3794599 - RNA, 20 nt, Human
acagcaaggaggcuggcugg

SEQ ID NO: 3794600 - RNA, 23 nt, Human
acagcaaggaggcuggcuggggc

SEQ ID NO: 3794601 - RNA, 16 nt, Human
acagcaaggcaccugc

SEQ ID NO: 3794602 - RNA, 18 nt, Human
acagcaaggcaccugcag

SEQ ID NO: 3794603 - RNA, 15 nt, Human
acagcaaguagauaa

SEQ ID NO: 3794604 - RNA, 12 nt, Human
acagcaagucag

SEQ ID NO: 3794605 - RNA, 17 nt, Human
acagcaauuccucaggc

SEQ ID NO: 3794606 - RNA, 17 nt, Human
acagcacagcucccugc

SEQ ID NO: 3794607 - RNA, 18 nt, Human
acagcacagcucccugcc

SEQ ID NO: 3794608 - RNA, 12 nt, Human
acagcacaugcu

SEQ ID NO: 3794609 - RNA, 12 nt, Human
acagcacuacuc

SEQ ID NO: 3794610 - RNA, 15 nt, Human
acagcacuacucugu

SEQ ID NO: 3794611 - RNA, 14 nt, Human
acagcacuggggag

SEQ ID NO: 3794612 - RNA, 23 nt, Human
acagcagacucagcucugacauu

SEQ ID NO: 3794613 - RNA, 15 nt, Human
acagcagagguucuu

SEQ ID NO: 3794614 - RNA, 21 nt, Human
acagcagauaacaaugcagca

SEQ ID NO: 3794615 - RNA, 16 nt, Human
acagcagcaagaaaaa

SEQ ID NO: 3794616 - RNA, 19 nt, Human
aaugaauaaugccuuugua

SEQ ID NO: 3794617 - RNA, 20 nt, Human
aaugaauaaugccuuuguaa

SEQ ID NO: 3794618 - RNA, 17 nt, Human
aaugaauaauggaaaau

SEQ ID NO: 3794619 - RNA, 17 nt, Human
aaugaauaguuuuucau

SEQ ID NO: 3794620 - RNA, 19 nt, Human
aaugaauaucuauuaauau

SEQ ID NO: 3794621 - RNA, 19 nt, Human
aaugaauauugaaguuuca

SEQ ID NO: 3794622 - RNA, 18 nt, Human
aaugaauauuuugauaau

SEQ ID NO: 3794623 - RNA, 20 nt, Human
aaugaaucguaaugaaguug

SEQ ID NO: 3794624 - RNA, 13 nt, Human
aaugaaugaaacu

SEQ ID NO: 3794625 - RNA, 14 nt, Human
aaugaaugcuuaaa

SEQ ID NO: 3794626 - RNA, 14 nt, Human
aaugaaugucagug

SEQ ID NO: 3794627 - RNA, 15 nt, Human
aaugaaugucagugu

SEQ ID NO: 3794628 - RNA, 22 nt, Human
aaugaaugucagugugacugau

SEQ ID NO: 3794629 - RNA, 20 nt, Human
aaugaaugugugugguuuuu

SEQ ID NO: 3794630 - RNA, 17 nt, Human
aaugaauuaaauaaacc

SEQ ID NO: 3794631 - RNA, 23 nt, Human
aaugaauuuagugagcauaggug

SEQ ID NO: 3794632 - RNA, 14 nt, Human
aaugacaacagaag

SEQ ID NO: 3794633 - RNA, 16 nt, Human
aaugacaacagaagcu

SEQ ID NO: 3794634 - RNA, 19 nt, Human
aaugacagcaaacagauca

SEQ ID NO: 3794635 - RNA, 22 nt, Human
aaugacaucucaggggccagag

SEQ ID NO: 3794636 - RNA, 13 nt, Human
aaugacaucuuca

SEQ ID NO: 3794637 - RNA, 13 nt, Human
aaugacaugaauu

SEQ ID NO: 3794638 - RNA, 14 nt, Human
aaugacauguguca

SEQ ID NO: 3794639 - RNA, 16 nt, Human
aaugacccaaagacca

SEQ ID NO: 3794640 - RNA, 20 nt, Human
aaugaccuuguaauguaacu

SEQ ID NO: 3794641 - RNA, 15 nt, Human
aaugaccuuucaaua

SEQ ID NO: 3794642 - RNA, 16 nt, Human
aaugaccuuucaauag

SEQ ID NO: 3794643 - RNA, 18 nt, Human
aaugaccuuucaauagga

SEQ ID NO: 3794644 - RNA, 24 nt, Human
aaugacuaaaaauauuauaacuua

SEQ ID NO: 3794645 - RNA, 13 nt, Human
aaugacucuuccc

SEQ ID NO: 3794646 - RNA, 18 nt, Human
aaugacuuacuguacaug

SEQ ID NO: 3794647 - RNA, 19 nt, Human
aaugacuuauuguggauaa

SEQ ID NO: 3794648 - RNA, 22 nt, Human
aaugacuuauuguggauaacaa

SEQ ID NO: 3794649 - RNA, 23 nt, Human
aaugacuuauuguggauaacaaa

SEQ ID NO: 3794650 - RNA, 24 nt, Human
aaugacuuauuguggauaacaaag

SEQ ID NO: 3794651 - RNA, 17 nt, Human
aaugacuuuauuauuua

SEQ ID NO: 3794652 - RNA, 13 nt, Human
acagcaucagggu

SEQ ID NO: 3794653 - RNA, 20 nt, Human
acagcaucauuuugcauuca

SEQ ID NO: 3794654 - RNA, 20 nt, Human
acagcaucuccaagcagcuu

SEQ ID NO: 3794655 - RNA, 17 nt, Human
acagcauggugcaugcc

SEQ ID NO: 3794656 - RNA, 21 nt, Human
acagcauguacggauuuucag

SEQ ID NO: 3794657 - RNA, 15 nt, Human
acagcaugugcccuc

SEQ ID NO: 3794658 - RNA, 16 nt, Human
acagcaugugcccucc

SEQ ID NO: 3794659 - RNA, 23 nt, Human
acagcauucuugucacaauaaau

SEQ ID NO: 3794660 - RNA, 23 nt, Human
acagcauuuguguguuacaaugu

SEQ ID NO: 3794661 - RNA, 17 nt, Human
acagccaacuauggccu

SEQ ID NO: 3794662 - RNA, 19 nt, Human
acagccacacacacagaaa

SEQ ID NO: 3794663 - RNA, 15 nt, Human
acagccacggccagg

SEQ ID NO: 3794664 - RNA, 17 nt, Human
acagccacggccaggcc

SEQ ID NO: 3794665 - RNA, 12 nt, Human
acagccacucag

SEQ ID NO: 3794666 - RNA, 20 nt, Human
acagccacuccccuccacuc

SEQ ID NO: 3794667 - RNA, 15 nt, Human
acagccagacuggca

SEQ ID NO: 3794668 - RNA, 14 nt, Human
acagccagcaagag

SEQ ID NO: 3794669 - RNA, 19 nt, Human
acagccaggugccuuggag

SEQ ID NO: 3794670 - RNA, 18 nt, Human
acagccaucccagccuug

SEQ ID NO: 3794671 - RNA, 15 nt, Human
acagccaugauucuu

SEQ ID NO: 3794672 - RNA, 18 nt, Human
acagcccaaagaaggaaa

SEQ ID NO: 3794673 - RNA, 15 nt, Human
acagcccacugagaa

SEQ ID NO: 3794674 - RNA, 10 nt, Human
acagcccaga

SEQ ID NO: 3794675 - RNA, 16 nt, Human
acagcccagccacgga

SEQ ID NO: 3794676 - RNA, 15 nt, Human
acagcccaggauacu

SEQ ID NO: 3794677 - RNA, 20 nt, Human
acagcccgcaugcagcagcu

SEQ ID NO: 3794678 - RNA, 19 nt, Human
acagcccgggcucugccuc

SEQ ID NO: 3794679 - RNA, 22 nt, Human
acagcccgggcucugccuccca

SEQ ID NO: 3794680 - RNA, 19 nt, Human
acagcccuucuuuccacag

SEQ ID NO: 3794681 - RNA, 21 nt, Human
acagcccuucuuuccacagaa

SEQ ID NO: 3794682 - RNA, 16 nt, Human
acagcccuuuugucuc

SEQ ID NO: 3794683 - RNA, 19 nt, Human
acagccgauucaccugagc

SEQ ID NO: 3794684 - RNA, 13 nt, Human
acagccgcagccu

SEQ ID NO: 3794685 - RNA, 20 nt, Human
acagccgcagccucccucug

SEQ ID NO: 3794686 - RNA, 23 nt, Human
acagccgcagccucccucugacc

SEQ ID NO: 3794687 - RNA, 13 nt, Human
acagccgcuccag

SEQ ID NO: 3794688 - RNA, 15 nt, Human
acagccgcuccagag

SEQ ID NO: 3794689 - RNA, 16 nt, Human
acagccucccaccccc

SEQ ID NO: 3794690 - RNA, 19 nt, Human
acagccuccccugccaggg

SEQ ID NO: 3794691 - RNA, 13 nt, Human
acagccuccucug

SEQ ID NO: 3794692 - RNA, 22 nt, Human
acagccuccucugucugcccuu

SEQ ID NO: 3794693 - RNA, 18 nt, Human
acagccucugaccccucc

SEQ ID NO: 3794694 - RNA, 21 nt, Human
acagccucugaccccuccuca

SEQ ID NO: 3794695 - RNA, 22 nt, Human
acagccucugaccccuccucac

SEQ ID NO: 3794696 - RNA, 13 nt, Human
acagccucuuuuu

SEQ ID NO: 3794697 - RNA, 20 nt, Human
acagccugacaacauuucua

SEQ ID NO: 3794698 - RNA, 15 nt, Human
acagccugcaaguca

SEQ ID NO: 3794699 - RNA, 15 nt, Human
acagccuggcacagg

SEQ ID NO: 3794700 - RNA, 12 nt, Human
acagccugggcc

SEQ ID NO: 3794701 - RNA, 20 nt, Human
acagccuggucgccuuccac

SEQ ID NO: 3794702 - RNA, 21 nt, Human
acagccuguggcggugccugg

SEQ ID NO: 3794703 - RNA, 19 nt, Human
acagcgaaguagcuugcuc

SEQ ID NO: 3794704 - RNA, 18 nt, Human
acagcgagacuccgucuc

SEQ ID NO: 3794705 - RNA, 19 nt, Human
acagcgagaggcagagaaa

SEQ ID NO: 3794706 - RNA, 15 nt, Human
acagcgagggcagcu

SEQ ID NO: 3794707 - RNA, 18 nt, Human
acagcgagggcagcugcu

SEQ ID NO: 3794708 - RNA, 19 nt, Human
acagcgagggcagcugcua

SEQ ID NO: 3794709 - RNA, 12 nt, Human
acagcgcugggu

SEQ ID NO: 3794710 - RNA, 15 nt, Human
acagcggccccugca

SEQ ID NO: 3794711 - RNA, 16 nt, Human
acagcggccccugcau

SEQ ID NO: 3794712 - RNA, 18 nt, Human
acagcuaacacacagcuc

SEQ ID NO: 3794713 - RNA, 20 nt, Human
acagcuaaucagcauucuca

SEQ ID NO: 3794714 - RNA, 15 nt, Human
acagcuaaugggaca

SEQ ID NO: 3794715 - RNA, 19 nt, Human
acagcuaaugggacacuaa

SEQ ID NO: 3794716 - RNA, 18 nt, Human
acagcuacaacagccuca

SEQ ID NO: 3794717 - RNA, 21 nt, Human
acagcuacaacagccucacuu

SEQ ID NO: 3794718 - RNA, 22 nt, Human
acagcuacucuccccacgaggg

SEQ ID NO: 3794719 - RNA, 23 nt, Human
acagcuacucuccccacgagggc

SEQ ID NO: 3794720 - RNA, 14 nt, Human
acagcuaugcaaaa

SEQ ID NO: 3794721 - RNA, 21 nt, Human
acagcuaugggagccccaggg

SEQ ID NO: 3794722 - RNA, 14 nt, Human
acagcucaggaggc

SEQ ID NO: 3794723 - RNA, 21 nt, Human
acagcucaggaucucuuagca

SEQ ID NO: 3794724 - RNA, 16 nt, Human
acagcucauuaaacuu

SEQ ID NO: 3794725 - RNA, 13 nt, Human
acagcucccaccc

SEQ ID NO: 3794726 - RNA, 18 nt, Human
acagcucccaccccaccc

SEQ ID NO: 3794727 - RNA, 12 nt, Human
acagcuccccca

SEQ ID NO: 3794728 - RNA, 16 nt, Human
acagcucccucugccu

SEQ ID NO: 3794729 - RNA, 17 nt, Human
acagcucccucugccug

SEQ ID NO: 3794730 - RNA, 14 nt, Human
acagcucccugcca

SEQ ID NO: 3794731 - RNA, 14 nt, Human
acagcuccucccac

SEQ ID NO: 3794732 - RNA, 13 nt, Human
acagcuccuuggg

SEQ ID NO: 3794733 - RNA, 23 nt, Human
acagcuccuugggaggaagcaga

SEQ ID NO: 3794734 - RNA, 20 nt, Human
acagcuccuuuuccagagca

SEQ ID NO: 3794735 - RNA, 21 nt, Human
acagcuccuuuuccagagcau

SEQ ID NO: 3794736 - RNA, 17 nt, Human
acagcucuguccuggga

SEQ ID NO: 3794737 - RNA, 17 nt, Human
acagcucuguguugcca

SEQ ID NO: 3794738 - RNA, 19 nt, Human
acagcucuguguugccaug

SEQ ID NO: 3794739 - RNA, 16 nt, Human
acagcucuucuccagg

SEQ ID NO: 3794740 - RNA, 18 nt, Human
acagcugagcacauucug

SEQ ID NO: 3794741 - RNA, 23 nt, Human
acagcugagcacccagcucuguc

SEQ ID NO: 3794742 - RNA, 15 nt, Human
acagcugcagagaca

SEQ ID NO: 3794743 - RNA, 17 nt, Human
acagcugcagagacaga

SEQ ID NO: 3794744 - RNA, 21 nt, Human
acagcugcagagacagagagg

SEQ ID NO: 3794745 - RNA, 12 nt, Human
acagcugccugc

SEQ ID NO: 3794746 - RNA, 14 nt, Human
acagcugccuggga

SEQ ID NO: 3794747 - RNA, 15 nt, Human
acagcugccuuagcu

SEQ ID NO: 3794748 - RNA, 19 nt, Human
acagcugccuuagcuucag

SEQ ID NO: 3794749 - RNA, 23 nt, Human
acagcugcuuucuguugucauug

SEQ ID NO: 3794750 - RNA, 14 nt, Human
acagcuggacccug

SEQ ID NO: 3794751 - RNA, 13 nt, Human
acagcuggcucua

SEQ ID NO: 3794752 - RNA, 20 nt, Human
acagcuggcucuacuucccc

SEQ ID NO: 3794753 - RNA, 23 nt, Human
acagcuggggugcagggaugugg

SEQ ID NO: 3794754 - RNA, 19 nt, Human
acagcuggguggcacugcc

SEQ ID NO: 3794755 - RNA, 20 nt, Human
acagcuggugcccugcuuuc

SEQ ID NO: 3794756 - RNA, 11 nt, Human
acagcuggugu

SEQ ID NO: 3794757 - RNA, 22 nt, Human
acagcugguguagcuacagaga

SEQ ID NO: 3794758 - RNA, 23 nt, Human
acagcugguguagcuacagagaa

SEQ ID NO: 3794759 - RNA, 22 nt, Human
acagcuguauagcugcuuccag

SEQ ID NO: 3794760 - RNA, 21 nt, Human
acagauuguuucuauacaaau

SEQ ID NO: 3794761 - RNA, 14 nt, Human
acagauuguuugca

SEQ ID NO: 3794762 - RNA, 20 nt, Human
acagauuuaauacaguuuau

SEQ ID NO: 3794763 - RNA, 15 nt, Human
acagauuugugaacu

SEQ ID NO: 3794764 - RNA, 14 nt, Human
acagauuuuaauug

SEQ ID NO: 3794765 - RNA, 22 nt, Human
acagcaaaaccauugcuucacu

SEQ ID NO: 3794766 - RNA, 18 nt, Human
acagcaaaacuccaucuc

SEQ ID NO: 3794767 - RNA, 13 nt, Human
acagcaaaccaag

SEQ ID NO: 3794768 - RNA, 14 nt, Human
acagcaaaccaaga

SEQ ID NO: 3794769 - RNA, 17 nt, Human
acagcaaaccaagagau

SEQ ID NO: 3794770 - RNA, 21 nt, Human
acagcaaaccaagagauugcu

SEQ ID NO: 3794771 - RNA, 18 nt, Human
acagcaaauuuauaauuu

SEQ ID NO: 3794772 - RNA, 14 nt, Human
acagcaaccccagg

SEQ ID NO: 3794773 - RNA, 21 nt, Human
acagcaacgaucacaaaugac

SEQ ID NO: 3794774 - RNA, 21 nt, Human
acagcaaggagauuuacaacu

SEQ ID NO: 3794775 - RNA, 16 nt, Human
acagcaaggaggcugg

SEQ ID NO: 3794776 - RNA, 21 nt, Human
acagcaaggaggcuggcuggg

SEQ ID NO: 3794777 - RNA, 19 nt, Human
acagcaagucacuggccag

SEQ ID NO: 3794778 - RNA, 15 nt, Human
acagcaagugugaau

SEQ ID NO: 3794779 - RNA, 14 nt, Human
acagcacagagaag

SEQ ID NO: 3794780 - RNA, 22 nt, Human
acagcacagagaagacaaaauu

SEQ ID NO: 3794781 - RNA, 20 nt, Human
acagcacagcucccugccaa

SEQ ID NO: 3794782 - RNA, 15 nt, Human
acagcacaugcuggc

SEQ ID NO: 3794783 - RNA, 18 nt, Human
acagcacaugcuggccag

SEQ ID NO: 3794784 - RNA, 21 nt, Human
acagcacaugcuggccagccu

SEQ ID NO: 3794785 - RNA, 19 nt, Human
acagcacuacuggguguca

SEQ ID NO: 3794786 - RNA, 20 nt, Human
acagcacuacugggugucau

SEQ ID NO: 3794787 - RNA, 21 nt, Human
acagcacuacugggugucauu

SEQ ID NO: 3794788 - RNA, 22 nt, Human
acagcacuggcucucuccagga

SEQ ID NO: 3794789 - RNA, 14 nt, Human
acagcagcaagaaa

SEQ ID NO: 3794790 - RNA, 21 nt, Human
acagcagcaagaaaaaaaaau

SEQ ID NO: 3794791 - RNA, 22 nt, Human
acagcagcauuuuuauuucaga

SEQ ID NO: 3794792 - RNA, 13 nt, Human
acagcagccugcu

SEQ ID NO: 3794793 - RNA, 17 nt, Human
acagcagcucaggcaca

SEQ ID NO: 3794794 - RNA, 16 nt, Human
acagcagcuucaccag

SEQ ID NO: 3794795 - RNA, 12 nt, Human
acagcaggcagc

SEQ ID NO: 3794796 - RNA, 16 nt, Human
acagcaggcagcgcca

SEQ ID NO: 3794797 - RNA, 14 nt, Human
acagcaggcugcca

SEQ ID NO: 3794798 - RNA, 20 nt, Human
acagcaggcugccagugccu

SEQ ID NO: 3794799 - RNA, 11 nt, Human
acagcaggugu

SEQ ID NO: 3794800 - RNA, 14 nt, Human
acagcagugagacu

SEQ ID NO: 3794801 - RNA, 16 nt, Human
acagcagugucaucag

SEQ ID NO: 3794802 - RNA, 15 nt, Human
acagcaguugaaaag

SEQ ID NO: 3794803 - RNA, 21 nt, Human
acagcaguugaaaagacucca

SEQ ID NO: 3794804 - RNA, 21 nt, Human
acagcaucauuuugcauucaa

SEQ ID NO: 3794805 - RNA, 21 nt, Human
acagcauccccaaaacaaagu

SEQ ID NO: 3794806 - RNA, 14 nt, Human
acagcaucuccaag

SEQ ID NO: 3794807 - RNA, 14 nt, Human
acagcaucuguagu

SEQ ID NO: 3794808 - RNA, 23 nt, Human
acagcauggcacucccuccagca

SEQ ID NO: 3794809 - RNA, 18 nt, Human
acagcaugugcccuccug

SEQ ID NO: 3794810 - RNA, 13 nt, Human
acagcauguguau

SEQ ID NO: 3794811 - RNA, 14 nt, Human
acagcauguguuaa

SEQ ID NO: 3794812 - RNA, 19 nt, Human
acagcauucuugucacaau

SEQ ID NO: 3794813 - RNA, 12 nt, Human
acagcauugcuu

SEQ ID NO: 3794814 - RNA, 13 nt, Human
acagcauugcuuu

SEQ ID NO: 3794815 - RNA, 17 nt, Human
acagcauuuguguguua

SEQ ID NO: 3794816 - RNA, 23 nt, Human
acagccaaaugcauggugcaguu

SEQ ID NO: 3794817 - RNA, 20 nt, Human
acagccaacacgcaccugcc

SEQ ID NO: 3794818 - RNA, 21 nt, Human
acagccaacacgcaccugccu

SEQ ID NO: 3794819 - RNA, 21 nt, Human
acagccaacagcuacaacagc

SEQ ID NO: 3794820 - RNA, 23 nt, Human
acagccaacagcuacaacagccu

SEQ ID NO: 3794821 - RNA, 21 nt, Human
acagccaacuagccccugggg

SEQ ID NO: 3794822 - RNA, 19 nt, Human
acagccaacuauggccugu

SEQ ID NO: 3794823 - RNA, 10 nt, Human
acagccacac

SEQ ID NO: 3794824 - RNA, 14 nt, Human
acagccacacacac

SEQ ID NO: 3794825 - RNA, 17 nt, Human
acagccacacacacaga

SEQ ID NO: 3794826 - RNA, 22 nt, Human
acagccacacacacagaaaaua

SEQ ID NO: 3794827 - RNA, 16 nt, Human
acagccacggccaggc

SEQ ID NO: 3794828 - RNA, 16 nt, Human
acagccacuccccggc

SEQ ID NO: 3794829 - RNA, 20 nt, Human
acagccagaacucugugucc

SEQ ID NO: 3794830 - RNA, 13 nt, Human
acagccagacugg

SEQ ID NO: 3794831 - RNA, 13 nt, Human
acagccagcaccu

SEQ ID NO: 3794832 - RNA, 14 nt, Human
acagccagggggau

SEQ ID NO: 3794833 - RNA, 16 nt, Human
acagccaggugccuug

SEQ ID NO: 3794834 - RNA, 17 nt, Human
acagccaggugccuugg

SEQ ID NO: 3794835 - RNA, 20 nt, Human
acagccauaggcccuuucag

SEQ ID NO: 3794836 - RNA, 19 nt, Human
acagcccaaagaaggaaaa

SEQ ID NO: 3794837 - RNA, 20 nt, Human
acagcccaggauacuggcac

SEQ ID NO: 3794838 - RNA, 21 nt, Human
acagcccaggauacuggcaca

SEQ ID NO: 3794839 - RNA, 13 nt, Human
acagcccaggccu

SEQ ID NO: 3794840 - RNA, 16 nt, Human
acagccccagagcagg

SEQ ID NO: 3794841 - RNA, 17 nt, Human
acagccccagagcaggg

SEQ ID NO: 3794842 - RNA, 16 nt, Human
acagccccucccuccu

SEQ ID NO: 3794843 - RNA, 19 nt, Human
acagccccucccuccucug

SEQ ID NO: 3794844 - RNA, 16 nt, Human
acagcccgauccuccc

SEQ ID NO: 3794845 - RNA, 21 nt, Human
acagcccgauccuccccugga

SEQ ID NO: 3794846 - RNA, 23 nt, Human
acagcccgauccuccccuggacu

SEQ ID NO: 3794847 - RNA, 15 nt, Human
acagcccgcaugcag

SEQ ID NO: 3794848 - RNA, 15 nt, Human
acagcccgggcucug

SEQ ID NO: 3794849 - RNA, 16 nt, Human
acagcccgggcucugc

SEQ ID NO: 3794850 - RNA, 17 nt, Human
acagcccgggcucugcc

SEQ ID NO: 3794851 - RNA, 20 nt, Human
acagcccgggcucugccucc

SEQ ID NO: 3794852 - RNA, 17 nt, Human
acagcccuauuucuuga

SEQ ID NO: 3794853 - RNA, 18 nt, Human
acagcccuauuucuugau

SEQ ID NO: 3794854 - RNA, 14 nt, Human
acagcccuccaucu

SEQ ID NO: 3794855 - RNA, 14 nt, Human
acagcccucccgcc

SEQ ID NO: 3794856 - RNA, 12 nt, Human
acagcccuguca

SEQ ID NO: 3794857 - RNA, 20 nt, Human
acagcccuucuuuccacaga

SEQ ID NO: 3794858 - RNA, 22 nt, Human
acagccgaguggauagaugccc

SEQ ID NO: 3794859 - RNA, 18 nt, Human
acagccgcuccugucugc

SEQ ID NO: 3794860 - RNA, 15 nt, Human
acaugcaacccgaag

SEQ ID NO: 3794861 - RNA, 20 nt, Human
acaugcaaggcacuguacua

SEQ ID NO: 3794862 - RNA, 17 nt, Human
acaugcaaggucauuuu

SEQ ID NO: 3794863 - RNA, 21 nt, Human
acaugcaauuuauuaaaauga

SEQ ID NO: 3794864 - RNA, 18 nt, Human
acaugcacaccucccccu

SEQ ID NO: 3794865 - RNA, 15 nt, Human
acaugcacacucaug

SEQ ID NO: 3794866 - RNA, 23 nt, Human
acaugcacagcuaacauggaagu

SEQ ID NO: 3794867 - RNA, 20 nt, Human
acaugcagcccaugcccacc

SEQ ID NO: 3794868 - RNA, 13 nt, Human
acaugcaguuuga

SEQ ID NO: 3794869 - RNA, 19 nt, Human
acaugcaguuugaaauucu

SEQ ID NO: 3794870 - RNA, 14 nt, Human
acaugcauacacac

SEQ ID NO: 3794871 - RNA, 16 nt, Human
acaugcauacacacac

SEQ ID NO: 3794872 - RNA, 24 nt, Human
acaugcauacacacacacacacag

SEQ ID NO: 3794873 - RNA, 16 nt, Human
acaugcauacuucaaa

SEQ ID NO: 3794874 - RNA, 21 nt, Human
acaugcauacuucaaaaguau

SEQ ID NO: 3794875 - RNA, 18 nt, Human
acaugccaagcacugugc

SEQ ID NO: 3794876 - RNA, 14 nt, Human
acaugccacaagga

SEQ ID NO: 3794877 - RNA, 22 nt, Human
acaugccacaucaaaccuuuga

SEQ ID NO: 3794878 - RNA, 18 nt, Human
acaugccauuuguacuga

SEQ ID NO: 3794879 - RNA, 21 nt, Human
acaugccauuuguacugaccc

SEQ ID NO: 3794880 - RNA, 13 nt, Human
acaugcccucccu

SEQ ID NO: 3794881 - RNA, 21 nt, Human
acaugcccucccuucucccug

SEQ ID NO: 3794882 - RNA, 19 nt, Human
acaugccuaccaauauuua

SEQ ID NO: 3794883 - RNA, 17 nt, Human
acaugccucucucaggc

SEQ ID NO: 3794884 - RNA, 21 nt, Human
acaugccugccccaaacaaau

SEQ ID NO: 3794885 - RNA, 14 nt, Human
acaugcgaccccga

SEQ ID NO: 3794886 - RNA, 23 nt, Human
acaugcggagaacaaaugugaag

SEQ ID NO: 3794887 - RNA, 17 nt, Human
acaugcgggcugggcag

SEQ ID NO: 3794888 - RNA, 19 nt, Human
acaugcuaagagaaguaga

SEQ ID NO: 3794889 - RNA, 22 nt, Human
acaugcuacacacugcauguuu

SEQ ID NO: 3794890 - RNA, 21 nt, Human
acaugcuaccugaucccacuc

SEQ ID NO: 3794891 - RNA, 18 nt, Human
acaugcuggacaggucug

SEQ ID NO: 3794892 - RNA, 21 nt, Human
acaugcuggugaauauuuuca

SEQ ID NO: 3794893 - RNA, 19 nt, Human
acaugcuguacauacuuuu

SEQ ID NO: 3794894 - RNA, 19 nt, Human
acaugcuguguaagcugug

SEQ ID NO: 3794895 - RNA, 21 nt, Human
acaugcuguguaagcuguguc

SEQ ID NO: 3794896 - RNA, 13 nt, Human
acaugcuguuauu

SEQ ID NO: 3794897 - RNA, 21 nt, Human
acaugcuuauuccaugacugc

SEQ ID NO: 3794898 - RNA, 21 nt, Human
acaugcuucaugaaaauccua

SEQ ID NO: 3794899 - RNA, 18 nt, Human
acaugcuucccuuuccug

SEQ ID NO: 3794900 - RNA, 19 nt, Human
acaugcuucccuuuccuga

SEQ ID NO: 3794901 - RNA, 14 nt, Human
acauggacuuguau

SEQ ID NO: 3794902 - RNA, 17 nt, Human
acauggagacuccugcc

SEQ ID NO: 3794903 - RNA, 22 nt, Human
acauggagacuccugcccuguu

SEQ ID NO: 3794904 - RNA, 13 nt, Human
aauguguaagaac

SEQ ID NO: 3794905 - RNA, 15 nt, Human
aauguguaauuuugu

SEQ ID NO: 3794906 - RNA, 16 nt, Human
aauguguaauuuuguu

SEQ ID NO: 3794907 - RNA, 19 nt, Human
aauguguaauuuuguucua

SEQ ID NO: 3794908 - RNA, 16 nt, Human
aauguguaguucaugu

SEQ ID NO: 3794909 - RNA, 14 nt, Human
aauguguauaaaca

SEQ ID NO: 3794910 - RNA, 15 nt, Human
aauguguauaaacaa

SEQ ID NO: 3794911 - RNA, 16 nt, Human
aauguguauaaauugu

SEQ ID NO: 3794912 - RNA, 19 nt, Human
aauguguaucggaugcuuu

SEQ ID NO: 3794913 - RNA, 22 nt, Human
aauguguauuacaaauauuuug

SEQ ID NO: 3794914 - RNA, 12 nt, Human
aaugugucuuua

SEQ ID NO: 3794915 - RNA, 13 nt, Human
aaugugugaaaaa

SEQ ID NO: 3794916 - RNA, 18 nt, Human
aaugugugagugcaugua

SEQ ID NO: 3794917 - RNA, 21 nt, Human
aaugugugagugcauguacua

SEQ ID NO: 3794918 - RNA, 19 nt, Human
aaugugugccauagaguuu

SEQ ID NO: 3794919 - RNA, 23 nt, Human
aauguguggauugccucugaaaa

SEQ ID NO: 3794920 - RNA, 15 nt, Human
aauguguguauaugg

SEQ ID NO: 3794921 - RNA, 12 nt, Human
aauguguguaug

SEQ ID NO: 3794922 - RNA, 16 nt, Human
aauguguguaugugug

SEQ ID NO: 3794923 - RNA, 23 nt, Human
aaugugugugaugugacauuugu

SEQ ID NO: 3794924 - RNA, 11 nt, Human
aaugugugugu

SEQ ID NO: 3794925 - RNA, 22 nt, Human
aauguguucucggaguguguau

SEQ ID NO: 3794926 - RNA, 13 nt, Human
aauguguuucaaa

SEQ ID NO: 3794927 - RNA, 14 nt, Human
aauguuaaagaugu

SEQ ID NO: 3794928 - RNA, 15 nt, Human
aauguuaaagaugua

SEQ ID NO: 3794929 - RNA, 18 nt, Human
aauguuaaagggauauuu

SEQ ID NO: 3794930 - RNA, 15 nt, Human
aauguuaaagucagu

SEQ ID NO: 3794931 - RNA, 12 nt, Human
aauguuaaauuu

SEQ ID NO: 3794932 - RNA, 13 nt, Human
aauguuaaauuug

SEQ ID NO: 3794933 - RNA, 18 nt, Human
aauguuaaauuuguaagu

SEQ ID NO: 3794934 - RNA, 19 nt, Human
aauguuaagacuugacagu

SEQ ID NO: 3794935 - RNA, 15 nt, Human
aauguuacagaaucu

SEQ ID NO: 3794936 - RNA, 16 nt, Human
aauguuaccucugaau

SEQ ID NO: 3794937 - RNA, 13 nt, Human
aauguuacugauc

SEQ ID NO: 3794938 - RNA, 18 nt, Human
aauguuacugaucaugca

SEQ ID NO: 3794939 - RNA, 19 nt, Human
aauguuacugaucaugcau

SEQ ID NO: 3794940 - RNA, 15 nt, Human
aauguuacugccuua

SEQ ID NO: 3794941 - RNA, 16 nt, Human
aauguuagagcacagu

SEQ ID NO: 3794942 - RNA, 15 nt, Human
aauguuagauaguua

SEQ ID NO: 3794943 - RNA, 17 nt, Human
aauguuagccucaauuu

SEQ ID NO: 3794944 - RNA, 16 nt, Human
aauguuagucauuguu

SEQ ID NO: 3794945 - RNA, 13 nt, Human
aauguuauaaagu

SEQ ID NO: 3794946 - RNA, 23 nt, Human
aauguuaucuuauacuguacaau

SEQ ID NO: 3794947 - RNA, 22 nt, Human
aauguuauguuguguucuaaua

SEQ ID NO: 3794948 - RNA, 14 nt, Human
aauguuauuuaaca

SEQ ID NO: 3794949 - RNA, 12 nt, Human
aauguuauuucu

SEQ ID NO: 3794950 - RNA, 19 nt, Human
aauguuauuucugcaaaca

SEQ ID NO: 3794951 - RNA, 18 nt, Human
aauguuauuuucuucuaa

SEQ ID NO: 3794952 - RNA, 20 nt, Human
aauguuauuuucuucuaagu

SEQ ID NO: 3794953 - RNA, 18 nt, Human
aauguucacaauauauuu

SEQ ID NO: 3794954 - RNA, 22 nt, Human
aauguucacugguacucugcca

SEQ ID NO: 3794955 - RNA, 19 nt, Human
aauguucauacugaugugu

SEQ ID NO: 3794956 - RNA, 13 nt, Human
aauguucaucaau

SEQ ID NO: 3794957 - RNA, 22 nt, Human
aauguucaucccaugauguagu

SEQ ID NO: 3794958 - RNA, 21 nt, Human
aauguucauuguaauguuacu

SEQ ID NO: 3794959 - RNA, 12 nt, Human
aauguuccagac

SEQ ID NO: 3794960 - RNA, 17 nt, Human
aauguuccagacauucu

SEQ ID NO: 3794961 - RNA, 16 nt, Human
aauguucuaaguuucu

SEQ ID NO: 3794962 - RNA, 17 nt, Human
aauguucuaaguuucua

SEQ ID NO: 3794963 - RNA, 19 nt, Human
aauguucuaaguuucuaag

SEQ ID NO: 3794964 - RNA, 21 nt, Human
aauguucuaaguuucuaagau

SEQ ID NO: 3794965 - RNA, 22 nt, Human
aauguucuaaguuucuaagauu

SEQ ID NO: 3794966 - RNA, 17 nt, Human
aauguucugacauuaac

SEQ ID NO: 3794967 - RNA, 19 nt, Human
aauguucugcuaaauuuca

SEQ ID NO: 3794968 - RNA, 12 nt, Human
aauguucuucca

SEQ ID NO: 3794969 - RNA, 11 nt, Human
aauguucuuug

SEQ ID NO: 3794970 - RNA, 21 nt, Human
aauguucuuuggaaaguacac

SEQ ID NO: 3794971 - RNA, 12 nt, Human
aauguugaaaag

SEQ ID NO: 3794972 - RNA, 22 nt, Human
aauguugaacaaaauaaauugg

SEQ ID NO: 3794973 - RNA, 18 nt, Human
aauguugacaugggacau

SEQ ID NO: 3794974 - RNA, 21 nt, Human
aauguugauuucuaguuauuu

SEQ ID NO: 3794975 - RNA, 23 nt, Human
aauguugauuucuaguuauuuau

SEQ ID NO: 3794976 - RNA, 17 nt, Human
aauguugcugaaaaaug

SEQ ID NO: 3794977 - RNA, 13 nt, Human
aauguugcuggau

SEQ ID NO: 3794978 - RNA, 22 nt, Human
aauguuggauuuauaaaugcua

SEQ ID NO: 3794979 - RNA, 13 nt, Human
aauguugggacug

SEQ ID NO: 3794980 - RNA, 13 nt, Human
aauguugguuuac

SEQ ID NO: 3794981 - RNA, 12 nt, Human
aauguugugaau

SEQ ID NO: 3794982 - RNA, 13 nt, Human
aauguugugaaua

SEQ ID NO: 3794983 - RNA, 18 nt, Human
aauguuguuaugcuauua

SEQ ID NO: 3794984 - RNA, 21 nt, Human
aauguuguucauuauuggagg

SEQ ID NO: 3794985 - RNA, 12 nt, Human
aauguuguuucc

SEQ ID NO: 3794986 - RNA, 22 nt, Human
aauguuguuuccuaauaucaaa

SEQ ID NO: 3794987 - RNA, 23 nt, Human
aauguuguuuccuaauaucaaau

SEQ ID NO: 3794988 - RNA, 17 nt, Human
aauguuuaaaaaaguuu

SEQ ID NO: 3794989 - RNA, 19 nt, Human
aauguuuaaaaaaguuuaa

SEQ ID NO: 3794990 - RNA, 13 nt, Human
aauguuuaaaaca

SEQ ID NO: 3794991 - RNA, 15 nt, Human
aauguuuaaacauuu

SEQ ID NO: 3794992 - RNA, 15 nt, Human
aauguuuaaaccuuu

SEQ ID NO: 3794993 - RNA, 21 nt, Human
aauguuuaagcagaauuggaa

SEQ ID NO: 3794994 - RNA, 20 nt, Human
aauguuuaaucauauaaaua

SEQ ID NO: 3794995 - RNA, 12 nt, Human
aauguuuacaaa

SEQ ID NO: 3794996 - RNA, 20 nt, Human
aauguuuacacucuuuguaa

SEQ ID NO: 3794997 - RNA, 21 nt, Human
aauguuuacagggagccuccu

SEQ ID NO: 3794998 - RNA, 20 nt, Human
aauguuuagcaaauacauau

SEQ ID NO: 3794999 - RNA, 16 nt, Human
aauguuuaugagccag

SEQ ID NO: 3795000 - RNA, 22 nt, Human
aauguuuaugagccagacaaau

SEQ ID NO: 3795001 - RNA, 21 nt, Human
aauguuuaugcaaggaaggaa

SEQ ID NO: 3795002 - RNA, 16 nt, Human
aauguuuauuaaaugc

SEQ ID NO: 3795003 - RNA, 23 nt, Human
aauguuucaaacauauauaacaa

SEQ ID NO: 3795004 - RNA, 20 nt, Human
aauguuuccaaccuggagua

SEQ ID NO: 3795005 - RNA, 13 nt, Human
aauguuuccuuua

SEQ ID NO: 3795006 - RNA, 15 nt, Human
aauguuugccucugc

SEQ ID NO: 3795007 - RNA, 20 nt, Human
aauguuuggcauguaaaugu

SEQ ID NO: 3795008 - RNA, 18 nt, Human
aauguuugucucauccca

SEQ ID NO: 3795009 - RNA, 19 nt, Human
aauguuuuaaauguacaga

SEQ ID NO: 3795010 - RNA, 15 nt, Human
aauguuuuaaauucu

SEQ ID NO: 3795011 - RNA, 16 nt, Human
aauguuuuaacaagaa

SEQ ID NO: 3795012 - RNA, 16 nt, Human
aauguuuucaaaaggu

SEQ ID NO: 3795013 - RNA, 12 nt, Human
aauguuuugaca

SEQ ID NO: 3795014 - RNA, 14 nt, Human
aauguuuuguaaac

SEQ ID NO: 3795015 - RNA, 15 nt, Human
aauguuuuguaaacu

SEQ ID NO: 3795016 - RNA, 17 nt, Human
aauguuuuguaaacuuu

SEQ ID NO: 3795017 - RNA, 19 nt, Human
aauguuuuguaaacuuuga

SEQ ID NO: 3795018 - RNA, 23 nt, Human
aauguuuuguaaacuuugaaaua

SEQ ID NO: 3795019 - RNA, 20 nt, Human
acauuaguaaaugucuuugu

SEQ ID NO: 3795020 - RNA, 22 nt, Human
acauuaguaaaugucuuuguaa

SEQ ID NO: 3795021 - RNA, 22 nt, Human
acauuaguacuuuauagaagaa

SEQ ID NO: 3795022 - RNA, 14 nt, Human
acauuagucucagu

SEQ ID NO: 3795023 - RNA, 15 nt, Human
acauuauaaacgcuu

SEQ ID NO: 3795024 - RNA, 14 nt, Human
acauuauauugcaa

SEQ ID NO: 3795025 - RNA, 15 nt, Human
acauuauauugcaau

SEQ ID NO: 3795026 - RNA, 17 nt, Human
acauuauauugcaauga

SEQ ID NO: 3795027 - RNA, 19 nt, Human
acauuauauugcaaugaag

SEQ ID NO: 3795028 - RNA, 20 nt, Human
acauuauauuucuauuuuau

SEQ ID NO: 3795029 - RNA, 19 nt, Human
acauuaucgggagcagugu

SEQ ID NO: 3795030 - RNA, 21 nt, Human
acauuaucgggagcagugucu

SEQ ID NO: 3795031 - RNA, 20 nt, Human
acauuaucuaacugugcuca

SEQ ID NO: 3795032 - RNA, 22 nt, Human
acauuaugugguuuuagauuuu

SEQ ID NO: 3795033 - RNA, 13 nt, Human
acauuaugugugc

SEQ ID NO: 3795034 - RNA, 15 nt, Human
acauuaugugugcau

SEQ ID NO: 3795035 - RNA, 20 nt, Human
acauuaugugugcaugugug

SEQ ID NO: 3795036 - RNA, 21 nt, Human
acauuaugugugcaugugugu

SEQ ID NO: 3795037 - RNA, 13 nt, Human
acauuauuucuag

SEQ ID NO: 3795038 - RNA, 13 nt, Human
acauuauuugcau

SEQ ID NO: 3795039 - RNA, 19 nt, Human
acauucaaauuugucuggu

SEQ ID NO: 3795040 - RNA, 18 nt, Human
acauucaacagagacuga

SEQ ID NO: 3795041 - RNA, 18 nt, Human
acauucaacccuggagag

SEQ ID NO: 3795042 - RNA, 13 nt, Human
acauucaaggcau

SEQ ID NO: 3795043 - RNA, 15 nt, Human
acauucaauaagcau

SEQ ID NO: 3795044 - RNA, 12 nt, Human
acauucaauguu

SEQ ID NO: 3795045 - RNA, 14 nt, Human
acauucaccugccc

SEQ ID NO: 3795046 - RNA, 16 nt, Human
acauucagaacaccaa

SEQ ID NO: 3795047 - RNA, 15 nt, Human
acauucagcugaggu

SEQ ID NO: 3795048 - RNA, 21 nt, Human
acauucagcugagguucauua

SEQ ID NO: 3795049 - RNA, 17 nt, Human
augaaagacuguacaaa

SEQ ID NO: 3795050 - RNA, 19 nt, Human
augaaagacuguacaaagu

SEQ ID NO: 3795051 - RNA, 18 nt, Human
augaaagauuaaacagau

SEQ ID NO: 3795052 - RNA, 12 nt, Human
augaaagauuca

SEQ ID NO: 3795053 - RNA, 13 nt, Human
augaaagcaacaa

SEQ ID NO: 3795054 - RNA, 20 nt, Human
augaaagcagggaauuucua

SEQ ID NO: 3795055 - RNA, 21 nt, Human
augaaagcagggaauuucuau

SEQ ID NO: 3795056 - RNA, 21 nt, Human
augaaagcugauuacugucaa

SEQ ID NO: 3795057 - RNA, 18 nt, Human
augaaagggcccagagag

SEQ ID NO: 3795058 - RNA, 19 nt, Human
augaaagggcccagagagg

SEQ ID NO: 3795059 - RNA, 15 nt, Human
augaaagguauguag

SEQ ID NO: 3795060 - RNA, 21 nt, Human
augaaagguuuacauugucaa

SEQ ID NO: 3795061 - RNA, 20 nt, Human
augaaagucuugugacuagu

SEQ ID NO: 3795062 - RNA, 20 nt, Human
augaaagugaugacauauuu

SEQ ID NO: 3795063 - RNA, 18 nt, Human
augaaauaacacagcagu

SEQ ID NO: 3795064 - RNA, 20 nt, Human
augaaauaacuccuucuugu

SEQ ID NO: 3795065 - RNA, 22 nt, Human
augaaauaacuccuucuuguag

SEQ ID NO: 3795066 - RNA, 22 nt, Human
augaaauacuguuugagguuuu

SEQ ID NO: 3795067 - RNA, 18 nt, Human
augaaauauauuuaaaau

SEQ ID NO: 3795068 - RNA, 13 nt, Human
augaaauauuaug

SEQ ID NO: 3795069 - RNA, 17 nt, Human
augaaauauuauguuaa

SEQ ID NO: 3795070 - RNA, 18 nt, Human
augaaauauuauguuaaa

SEQ ID NO: 3795071 - RNA, 20 nt, Human
augaaauauuauguuaaaac

SEQ ID NO: 3795072 - RNA, 21 nt, Human
augaaauauuauguuaaaacu

SEQ ID NO: 3795073 - RNA, 13 nt, Human
augaaauauugcu

SEQ ID NO: 3795074 - RNA, 17 nt, Human
augaaauauugcuguau

SEQ ID NO: 3795075 - RNA, 23 nt, Human
augaaaugcuaugucauuucaug

SEQ ID NO: 3795076 - RNA, 12 nt, Human
augaaauguuuu

SEQ ID NO: 3795077 - RNA, 19 nt, Human
augaaauuauauaaguauu

SEQ ID NO: 3795078 - RNA, 13 nt, Human
augaaauuccauu

SEQ ID NO: 3795079 - RNA, 23 nt, Human
augaaauugucuagcagagcagg

SEQ ID NO: 3795080 - RNA, 12 nt, Human
augaaauuuaaa

SEQ ID NO: 3795081 - RNA, 21 nt, Human
augaaauuuaauauagcuauu

SEQ ID NO: 3795082 - RNA, 21 nt, Human
augaaauuuuaccaaguuaua

SEQ ID NO: 3795083 - RNA, 19 nt, Human
augaaauuuucuagacuuu

SEQ ID NO: 3795084 - RNA, 14 nt, Human
augaacaaaauuau

SEQ ID NO: 3795085 - RNA, 15 nt, Human
augaacaaaauuauu

SEQ ID NO: 3795086 - RNA, 21 nt, Human
augaacaaguuuuaauguaua

SEQ ID NO: 3795087 - RNA, 14 nt, Human
augaacacaaauua

SEQ ID NO: 3795088 - RNA, 15 nt, Human
augaacacaaauuau

SEQ ID NO: 3795089 - RNA, 15 nt, Human
augaacacacugugu

SEQ ID NO: 3795090 - RNA, 20 nt, Human
augaacaccauaccuuugcu

SEQ ID NO: 3795091 - RNA, 13 nt, Human
augaacacuuaua

SEQ ID NO: 3795092 - RNA, 16 nt, Human
augaacauacaaaugc

SEQ ID NO: 3795093 - RNA, 21 nt, Human
augaacauagacuagagaaac

SEQ ID NO: 3795094 - RNA, 21 nt, Human
augaacauauuguugaaaggu

SEQ ID NO: 3795095 - RNA, 13 nt, Human
augaacauuccaa

SEQ ID NO: 3795096 - RNA, 22 nt, Human
augaaccacaucuugcucugcu

SEQ ID NO: 3795097 - RNA, 20 nt, Human
augaaccagccggggccuua

SEQ ID NO: 3795098 - RNA, 18 nt, Human
augaacccgaggcugaga

SEQ ID NO: 3795099 - RNA, 13 nt, Human
augaacccuuccu

SEQ ID NO: 3795100 - RNA, 22 nt, Human
augaacccuuccugagcuuuau

SEQ ID NO: 3795101 - RNA, 13 nt, Human
augaaccuggagg

SEQ ID NO: 3795102 - RNA, 24 nt, Human
augaaccuucuggccucccacaga

SEQ ID NO: 3795103 - RNA, 15 nt, Human
augaacggccuugcu

SEQ ID NO: 3795104 - RNA, 15 nt, Human
augaacggugagcau

SEQ ID NO: 3795105 - RNA, 13 nt, Human
augaacuauuccc

SEQ ID NO: 3795106 - RNA, 12 nt, Human
augaacucugaa

SEQ ID NO: 3795107 - RNA, 16 nt, Human
augaacugaaguuuca

SEQ ID NO: 3795108 - RNA, 13 nt, Human
augaacugcaugu

SEQ ID NO: 3795109 - RNA, 12 nt, Human
augaacuuagau

SEQ ID NO: 3795110 - RNA, 19 nt, Human
augaacuuagauuuuacau

SEQ ID NO: 3795111 - RNA, 18 nt, Human
augaacuuauucuguaga

SEQ ID NO: 3795112 - RNA, 15 nt, Human
augaacuugaggaca

SEQ ID NO: 3795113 - RNA, 17 nt, Human
augaacuugaggacaca

SEQ ID NO: 3795114 - RNA, 20 nt, Human
augaacuugaggacacaugu

SEQ ID NO: 3795115 - RNA, 18 nt, Human
augaacuuguaaaggaau

SEQ ID NO: 3795116 - RNA, 17 nt, Human
augaagaaaaaauacau

SEQ ID NO: 3795117 - RNA, 19 nt, Human
augaagaaaaaauacauuu

SEQ ID NO: 3795118 - RNA, 21 nt, Human
augaagaaaagugggccagug

SEQ ID NO: 3795119 - RNA, 13 nt, Human
caagggauggugc

SEQ ID NO: 3795120 - RNA, 21 nt, Human
caagggcagaaugaaucuaug

SEQ ID NO: 3795121 - RNA, 14 nt, Human
caagggccugaugg

SEQ ID NO: 3795122 - RNA, 13 nt, Human
caagggccuggcc

SEQ ID NO: 3795123 - RNA, 18 nt, Human
caagggcggccuuuccca

SEQ ID NO: 3795124 - RNA, 19 nt, Human
caagggcggccuuucccac

SEQ ID NO: 3795125 - RNA, 19 nt, Human
caagggcuucugcacccuc

SEQ ID NO: 3795126 - RNA, 20 nt, Human
caagggcuucugcacccucc

SEQ ID NO: 3795127 - RNA, 21 nt, Human
caagggcuucugcacccucca

SEQ ID NO: 3795128 - RNA, 20 nt, Human
caagggcuuuguuuugcaca

SEQ ID NO: 3795129 - RNA, 16 nt, Human
caaggggaaaaucuca

SEQ ID NO: 3795130 - RNA, 21 nt, Human
caaggggacccauaggaaauc

SEQ ID NO: 3795131 - RNA, 16 nt, Human
caaggggcagucugga

SEQ ID NO: 3795132 - RNA, 17 nt, Human
caaggggcccaaauucu

SEQ ID NO: 3795133 - RNA, 22 nt, Human
caaggggcccuuggagcgugga

SEQ ID NO: 3795134 - RNA, 16 nt, Human
caaggggccugagcag

SEQ ID NO: 3795135 - RNA, 21 nt, Human
caaggggccugagcaguccuu

SEQ ID NO: 3795136 - RNA, 15 nt, Human
caagggggacugucu

SEQ ID NO: 3795137 - RNA, 15 nt, Human
caaggggugccuggg

SEQ ID NO: 3795138 - RNA, 19 nt, Human
caaggguagggugggccuu

SEQ ID NO: 3795139 - RNA, 16 nt, Human
caagggucaggccuuu

SEQ ID NO: 3795140 - RNA, 23 nt, Human
caagggucauuauggguuaggca

SEQ ID NO: 3795141 - RNA, 21 nt, Human
caagggugaugggaaagcauu

SEQ ID NO: 3795142 - RNA, 23 nt, Human
caagggugaugggaaagcauugu

SEQ ID NO: 3795143 - RNA, 21 nt, Human
caaggguggcaucccaguggc

SEQ ID NO: 3795144 - RNA, 16 nt, Human
caaggguuaaggccug

SEQ ID NO: 3795145 - RNA, 19 nt, Human
caaggguucagagacucag

SEQ ID NO: 3795146 - RNA, 20 nt, Human
caaggguucagagacucagg

SEQ ID NO: 3795147 - RNA, 13 nt, Human
caagguaaaauuc

SEQ ID NO: 3795148 - RNA, 13 nt, Human
caagguagaauga

SEQ ID NO: 3795149 - RNA, 16 nt, Human
caagguagccauccca

SEQ ID NO: 3795150 - RNA, 13 nt, Human
caaggucauuuuu

SEQ ID NO: 3795151 - RNA, 21 nt, Human
caagguccucugucagucaca

SEQ ID NO: 3795152 - RNA, 14 nt, Human
caaggucugcuuuu

SEQ ID NO: 3795153 - RNA, 18 nt, Human
caaggucuggccucaggu

SEQ ID NO: 3795154 - RNA, 16 nt, Human
caaggucuucagccau

SEQ ID NO: 3795155 - RNA, 13 nt, Human
caaggucuugcuc

SEQ ID NO: 3795156 - RNA, 15 nt, Human
caaggucuugcucuc

SEQ ID NO: 3795157 - RNA, 23 nt, Human
caaggugaagaugggaacgcaga

SEQ ID NO: 3795158 - RNA, 13 nt, Human
caaggugacagaa

SEQ ID NO: 3795159 - RNA, 15 nt, Human
caaggugcaggcagg

SEQ ID NO: 3795160 - RNA, 17 nt, Human
caaggugcuguugucau

SEQ ID NO: 3795161 - RNA, 15 nt, Human
caagguggaguggau

SEQ ID NO: 3795162 - RNA, 17 nt, Human
caagguggccaaauuau

SEQ ID NO: 3795163 - RNA, 12 nt, Human
caaggugggagg

SEQ ID NO: 3795164 - RNA, 17 nt, Human
caaggugggcugagccc

SEQ ID NO: 3795165 - RNA, 18 nt, Human
caaggugggcugagcccu

SEQ ID NO: 3795166 - RNA, 20 nt, Human
caaggugggcugagcccugg

SEQ ID NO: 3795167 - RNA, 23 nt, Human
caaggugggcugagcccuggcag

SEQ ID NO: 3795168 - RNA, 17 nt, Human
caagguguccuacagaa

SEQ ID NO: 3795169 - RNA, 16 nt, Human
caagguucccucugag

SEQ ID NO: 3795170 - RNA, 18 nt, Human
caagguucccucugagaa

SEQ ID NO: 3795171 - RNA, 13 nt, Human
caagguucuaacc

SEQ ID NO: 3795172 - RNA, 21 nt, Human
caagguucugggugcaggagc

SEQ ID NO: 3795173 - RNA, 17 nt, Human
caagguuggagcccagg

SEQ ID NO: 3795174 - RNA, 18 nt, Human
caagguuuaaagagucua

SEQ ID NO: 3795175 - RNA, 22 nt, Human
caagguuuaggcugguggccca

SEQ ID NO: 3795176 - RNA, 18 nt, Human
caagguuuuagguucuaa

SEQ ID NO: 3795177 - RNA, 23 nt, Human
caagguuuuagguucuaaaguuc

SEQ ID NO: 3795178 - RNA, 23 nt, Human
caaguaaauagcaacaugcuuca

SEQ ID NO: 3795179 - RNA, 13 nt, Human
caaguaagaagac

SEQ ID NO: 3795180 - RNA, 16 nt, Human
caaguaagaagacaug

SEQ ID NO: 3795181 - RNA, 18 nt, Human
caaguaagaagacaugaa

SEQ ID NO: 3795182 - RNA, 16 nt, Human
caaguaagaggcugga

SEQ ID NO: 3795183 - RNA, 23 nt, Human
caaguaauugugaaaaaguuaaa

SEQ ID NO: 3795184 - RNA, 14 nt, Human
caaguaauuucagu

SEQ ID NO: 3795185 - RNA, 20 nt, Human
caaguacauggcuagcuuuu

SEQ ID NO: 3795186 - RNA, 13 nt, Human
caaguagauaaau

SEQ ID NO: 3795187 - RNA, 16 nt, Human
caaguagcauuuacug

SEQ ID NO: 3795188 - RNA, 17 nt, Human
caaguagcauuuacugu

SEQ ID NO: 3795189 - RNA, 21 nt, Human
caaguagcugggauuuuaaac

SEQ ID NO: 3795190 - RNA, 13 nt, Human
caaguaguucugu

SEQ ID NO: 3795191 - RNA, 17 nt, Human
caaguaguucuguauuu

SEQ ID NO: 3795192 - RNA, 20 nt, Human
caaguaguucuguauuugaa

SEQ ID NO: 3795193 - RNA, 18 nt, Human
cacaccaggcgcuaauuc

SEQ ID NO: 3795194 - RNA, 19 nt, Human
cacaccaggcugugggccu

SEQ ID NO: 3795195 - RNA, 21 nt, Human
cacaccaggcugugggccuca

SEQ ID NO: 3795196 - RNA, 15 nt, Human
cacaccagggccagc

SEQ ID NO: 3795197 - RNA, 15 nt, Human
cacacccaaagcuga

SEQ ID NO: 3795198 - RNA, 14 nt, Human
cacacccagcccac

SEQ ID NO: 3795199 - RNA, 20 nt, Human
cacacccagcccacuucugc

SEQ ID NO: 3795200 - RNA, 13 nt, Human
cacaccccaccug

SEQ ID NO: 3795201 - RNA, 17 nt, Human
cacaccccaccugcgcu

SEQ ID NO: 3795202 - RNA, 23 nt, Human
cacacccccaccccuugcucuca

SEQ ID NO: 3795203 - RNA, 17 nt, Human
cacacccgcgccccgcg

SEQ ID NO: 3795204 - RNA, 19 nt, Human
cacacccucacucugccag

SEQ ID NO: 3795205 - RNA, 18 nt, Human
cacacccucucccaggac

SEQ ID NO: 3795206 - RNA, 13 nt, Human
cacacccugaggu

SEQ ID NO: 3795207 - RNA, 13 nt, Human
cacacccugcaag

SEQ ID NO: 3795208 - RNA, 15 nt, Human
cacacccugcaaggc

SEQ ID NO: 3795209 - RNA, 20 nt, Human
cacaccguguaaaccaaagc

SEQ ID NO: 3795210 - RNA, 22 nt, Human
cacaccuacuagucaccagaga

SEQ ID NO: 3795211 - RNA, 14 nt, Human
cacaccuagcguca

SEQ ID NO: 3795212 - RNA, 18 nt, Human
cacaccucacucuuuaua

SEQ ID NO: 3795213 - RNA, 15 nt, Human
cacaccucagaggcu

SEQ ID NO: 3795214 - RNA, 18 nt, Human
cacaccucaguucccuug

SEQ ID NO: 3795215 - RNA, 12 nt, Human
cacaccuccaca

SEQ ID NO: 3795216 - RNA, 12 nt, Human
cacaccuccucc

SEQ ID NO: 3795217 - RNA, 14 nt, Human
cacaccuccuccca

SEQ ID NO: 3795218 - RNA, 19 nt, Human
cacaccuccuucccucucu

SEQ ID NO: 3795219 - RNA, 22 nt, Human
cacaccuccuucccucucugga

SEQ ID NO: 3795220 - RNA, 14 nt, Human
cacaccucugccag

SEQ ID NO: 3795221 - RNA, 11 nt, Human
cacaccugagc

SEQ ID NO: 3795222 - RNA, 17 nt, Human
cacaccugagccagccu

SEQ ID NO: 3795223 - RNA, 18 nt, Human
cacaccugcagccucccu

SEQ ID NO: 3795224 - RNA, 15 nt, Human
cacaccugcccuaaa

SEQ ID NO: 3795225 - RNA, 14 nt, Human
cacaccuggcccug

SEQ ID NO: 3795226 - RNA, 19 nt, Human
cacaccuggcccuggggcc

SEQ ID NO: 3795227 - RNA, 22 nt, Human
cacaccuguaaucccagcacuu

SEQ ID NO: 3795228 - RNA, 20 nt, Human
cacaccuguagucccagcua

SEQ ID NO: 3795229 - RNA, 14 nt, Human
cacacgcacacaca

SEQ ID NO: 3795230 - RNA, 14 nt, Human
cacacgcacgcaca

SEQ ID NO: 3795231 - RNA, 17 nt, Human
cacacgcacgcacacac

SEQ ID NO: 3795232 - RNA, 19 nt, Human
cacacgcacgcacacacac

SEQ ID NO: 3795233 - RNA, 19 nt, Human
cacacgcaggaacucccag

SEQ ID NO: 3795234 - RNA, 22 nt, Human
cacacgcaggaacucccagcaa

SEQ ID NO: 3795235 - RNA, 21 nt, Human
cacacgccccaauuuucaggu

SEQ ID NO: 3795236 - RNA, 14 nt, Human
cacacgcgcgcaca

SEQ ID NO: 3795237 - RNA, 19 nt, Human
cacacgcgcgcgcacacac

SEQ ID NO: 3795238 - RNA, 12 nt, Human
cacacgcugccu

SEQ ID NO: 3795239 - RNA, 13 nt, Human
cacacgcugccuu

SEQ ID NO: 3795240 - RNA, 13 nt, Human
cacacgcugcucu

SEQ ID NO: 3795241 - RNA, 19 nt, Human
cacacgcugcucugcccca

SEQ ID NO: 3795242 - RNA, 20 nt, Human
cacacgguuugaagccugga

SEQ ID NO: 3795243 - RNA, 17 nt, Human
cacacguacuuaaauga

SEQ ID NO: 3795244 - RNA, 19 nt, Human
cacacgucauguuucuuca

SEQ ID NO: 3795245 - RNA, 18 nt, Human
cacacuaccgaauguguc

SEQ ID NO: 3795246 - RNA, 21 nt, Human
cacacuaccgaaugugucuuu

SEQ ID NO: 3795247 - RNA, 19 nt, Human
cacacuagccucuccagga

SEQ ID NO: 3795248 - RNA, 17 nt, Human
cacacuauuaccaugag

SEQ ID NO: 3795249 - RNA, 17 nt, Human
cacacucacuccugaga

SEQ ID NO: 3795250 - RNA, 19 nt, Human
cacacucacuccugagacc

SEQ ID NO: 3795251 - RNA, 12 nt, Human
cacacucacugc

SEQ ID NO: 3795252 - RNA, 19 nt, Human
cacacucagauccuccuca

SEQ ID NO: 3795253 - RNA, 13 nt, Human
cacacucagugca

SEQ ID NO: 3795254 - RNA, 14 nt, Human
cacacucauccccu

SEQ ID NO: 3795255 - RNA, 19 nt, Human
cacacucaugcauuguccu

SEQ ID NO: 3795256 - RNA, 20 nt, Human
cacacucaugcauuguccuc

SEQ ID NO: 3795257 - RNA, 16 nt, Human
cacacuccaagauaug

SEQ ID NO: 3795258 - RNA, 21 nt, Human
cacacucccaagguuggagcc

SEQ ID NO: 3795259 - RNA, 23 nt, Human
cacacucccaagguuggagccca

SEQ ID NO: 3795260 - RNA, 12 nt, Human
cacacucugacg

SEQ ID NO: 3795261 - RNA, 14 nt, Human
cacacugaggcagg

SEQ ID NO: 3795262 - RNA, 15 nt, Human
cacacugaggcaggg

SEQ ID NO: 3795263 - RNA, 14 nt, Human
cacacugcaacagg

SEQ ID NO: 3795264 - RNA, 16 nt, Human
cacacugcaagagccu

SEQ ID NO: 3795265 - RNA, 18 nt, Human
cacacugguacuuagagu

SEQ ID NO: 3795266 - RNA, 14 nt, Human
cacacugguucuca

SEQ ID NO: 3795267 - RNA, 22 nt, Human
cacacugugacacacuacacca

SEQ ID NO: 3795268 - RNA, 16 nt, Human
cacacugugcuuucua

SEQ ID NO: 3795269 - RNA, 23 nt, Human
cacacuguguccuggugcucucu

SEQ ID NO: 3795270 - RNA, 24 nt, Human
cacacuguguccuggugcucucug

SEQ ID NO: 3795271 - RNA, 22 nt, Human
cacacuuacuguaagacauuag

SEQ ID NO: 3795272 - RNA, 13 nt, Human
cacacuucaaacu

SEQ ID NO: 3795273 - RNA, 18 nt, Human
cacacuucaaacuacuuu

SEQ ID NO: 3795274 - RNA, 16 nt, Human
caaguggggcucgcca

SEQ ID NO: 3795275 - RNA, 21 nt, Human
caaguggggcucgccaugccg

SEQ ID NO: 3795276 - RNA, 14 nt, Human
caagugggggcaga

SEQ ID NO: 3795277 - RNA, 20 nt, Human
caagugggggcagagggcag

SEQ ID NO: 3795278 - RNA, 19 nt, Human
caaguggggugcugggagg

SEQ ID NO: 3795279 - RNA, 18 nt, Human
caaguggugguaacccug

SEQ ID NO: 3795280 - RNA, 19 nt, Human
caaguggugguaacccugg

SEQ ID NO: 3795281 - RNA, 15 nt, Human
caaguguaaaauauu

SEQ ID NO: 3795282 - RNA, 16 nt, Human
caaguguaaaauauuu

SEQ ID NO: 3795283 - RNA, 19 nt, Human
caaguguaaugaauaccuu

SEQ ID NO: 3795284 - RNA, 14 nt, Human
caaguguauaucag

SEQ ID NO: 3795285 - RNA, 16 nt, Human
caaguguauaucagaa

SEQ ID NO: 3795286 - RNA, 13 nt, Human
caagugucuucca

SEQ ID NO: 3795287 - RNA, 15 nt, Human
caagugugaauacug

SEQ ID NO: 3795288 - RNA, 19 nt, Human
caagugugcuuuagcuuga

SEQ ID NO: 3795289 - RNA, 11 nt, Human
caagugugugc

SEQ ID NO: 3795290 - RNA, 14 nt, Human
caagugugugcaca

SEQ ID NO: 3795291 - RNA, 17 nt, Human
caagugugugcaugugu

SEQ ID NO: 3795292 - RNA, 14 nt, Human
caaguuaaauguag

SEQ ID NO: 3795293 - RNA, 13 nt, Human
caaguuaagagaa

SEQ ID NO: 3795294 - RNA, 21 nt, Human
caaguuaagagaaacuuuaua

SEQ ID NO: 3795295 - RNA, 22 nt, Human
caaguuaagagaaacuuuauac

SEQ ID NO: 3795296 - RNA, 16 nt, Human
caaguuagcucaggag

SEQ ID NO: 3795297 - RNA, 16 nt, Human
caaguuauaaaucaau

SEQ ID NO: 3795298 - RNA, 20 nt, Human
caaguuauaaaucaauguca

SEQ ID NO: 3795299 - RNA, 19 nt, Human
caaguuauauaaagagaaa

SEQ ID NO: 3795300 - RNA, 21 nt, Human
caaguuauauaaagagaaaau

SEQ ID NO: 3795301 - RNA, 13 nt, Human
caaguuauuaauu

SEQ ID NO: 3795302 - RNA, 12 nt, Human
caaguuauugua

SEQ ID NO: 3795303 - RNA, 20 nt, Human
caaguuauuuuuaauuuggu

SEQ ID NO: 3795304 - RNA, 12 nt, Human
caaguucaagga

SEQ ID NO: 3795305 - RNA, 14 nt, Human
caaguucaaggacc

SEQ ID NO: 3795306 - RNA, 21 nt, Human
caaguuccuuggccaugcaga

SEQ ID NO: 3795307 - RNA, 16 nt, Human
caaguucgucuguugu

SEQ ID NO: 3795308 - RNA, 13 nt, Human
caaguucuagaga

SEQ ID NO: 3795309 - RNA, 19 nt, Human
caaguucuagagaagaggc

SEQ ID NO: 3795310 - RNA, 19 nt, Human
caaguugaggacuucuugc

SEQ ID NO: 3795311 - RNA, 13 nt, Human
caaguuggaguca

SEQ ID NO: 3795312 - RNA, 12 nt, Human
caaguuguaaau

SEQ ID NO: 3795313 - RNA, 18 nt, Human
caaguugugccaaauuau

SEQ ID NO: 3795314 - RNA, 21 nt, Human
caaguuguggugcugacaaag

SEQ ID NO: 3795315 - RNA, 17 nt, Human
caaguuguucaaacauu

SEQ ID NO: 3795316 - RNA, 21 nt, Human
caaguuguuccuuaagucaga

SEQ ID NO: 3795317 - RNA, 17 nt, Human
caaguuguuugagaaau

SEQ ID NO: 3795318 - RNA, 23 nt, Human
caaguuguuugagaaauuaagua

SEQ ID NO: 3795319 - RNA, 15 nt, Human
caaguuuauauauau

SEQ ID NO: 3795320 - RNA, 20 nt, Human
caaguuuaucaguaaauaac

SEQ ID NO: 3795321 - RNA, 18 nt, Human
caaguuuccaagcaaaug

SEQ ID NO: 3795322 - RNA, 23 nt, Human
caaguuucuagcuagaaauauga

SEQ ID NO: 3795323 - RNA, 12 nt, Human
caaguuugaauu

SEQ ID NO: 3795324 - RNA, 13 nt, Human
caaguuuugugaa

SEQ ID NO: 3795325 - RNA, 14 nt, Human
caaguuuugugaaa

SEQ ID NO: 3795326 - RNA, 18 nt, Human
caaguuuugugaaauuuu

SEQ ID NO: 3795327 - RNA, 19 nt, Human
caaguuuugugaaauuuuu

SEQ ID NO: 3795328 - RNA, 16 nt, Human
caauaaaaaaaagaaa

SEQ ID NO: 3795329 - RNA, 21 nt, Human
caauaaaaaaaagaaaugaaa

SEQ ID NO: 3795330 - RNA, 13 nt, Human
caauaaaaaauua

SEQ ID NO: 3795331 - RNA, 16 nt, Human
caauaaaaaauuauga

SEQ ID NO: 3795332 - RNA, 14 nt, Human
caauaaaaaucaua

SEQ ID NO: 3795333 - RNA, 17 nt, Human
caauaaaaauggcucag

SEQ ID NO: 3795334 - RNA, 13 nt, Human
caauaaaaauguu

SEQ ID NO: 3795335 - RNA, 12 nt, Human
caauaaaagcuu

SEQ ID NO: 3795336 - RNA, 20 nt, Human
caauaaaaucauguacauuu

SEQ ID NO: 3795337 - RNA, 15 nt, Human
caauaaaauggguuu

SEQ ID NO: 3795338 - RNA, 15 nt, Human
caauaaaaugugauu

SEQ ID NO: 3795339 - RNA, 16 nt, Human
cacagagucaaggccu

SEQ ID NO: 3795340 - RNA, 18 nt, Human
cacagagucaaggccugc

SEQ ID NO: 3795341 - RNA, 21 nt, Human
cacagaguuguuacauuuuua

SEQ ID NO: 3795342 - RNA, 19 nt, Human
cacagauaacugaaaauua

SEQ ID NO: 3795343 - RNA, 22 nt, Human
cacagauaacugaaaauuauuu

SEQ ID NO: 3795344 - RNA, 17 nt, Human
cacagauauacuuugug

SEQ ID NO: 3795345 - RNA, 20 nt, Human
cacagauauacuuuguggac

SEQ ID NO: 3795346 - RNA, 16 nt, Human
cacagaugcuccaggg

SEQ ID NO: 3795347 - RNA, 12 nt, Human
cacagauggauu

SEQ ID NO: 3795348 - RNA, 20 nt, Human
cacagauggauuugccugug

SEQ ID NO: 3795349 - RNA, 23 nt, Human
cacagauggauuugccugugcca

SEQ ID NO: 3795350 - RNA, 21 nt, Human
cacagauuguuucuauacaaa

SEQ ID NO: 3795351 - RNA, 12 nt, Human
cacagauuuuaa

SEQ ID NO: 3795352 - RNA, 21 nt, Human
cacagauuuuaauugucaugg

SEQ ID NO: 3795353 - RNA, 17 nt, Human
cacagcaaacugucccc

SEQ ID NO: 3795354 - RNA, 14 nt, Human
cacagcaaccccag

SEQ ID NO: 3795355 - RNA, 21 nt, Human
cacagcaacgaucacaaauga

SEQ ID NO: 3795356 - RNA, 18 nt, Human
cacagcaaggaggcuggc

SEQ ID NO: 3795357 - RNA, 21 nt, Human
cacagcaaggaggcuggcugg

SEQ ID NO: 3795358 - RNA, 23 nt, Human
cacagcacaaauuaguuauauau

SEQ ID NO: 3795359 - RNA, 12 nt, Human
cacagcacagcc

SEQ ID NO: 3795360 - RNA, 13 nt, Human
cacagcacaugcu

SEQ ID NO: 3795361 - RNA, 21 nt, Human
cacagcacaugcuggccagcc

SEQ ID NO: 3795362 - RNA, 20 nt, Human
cacagcacgggggccaagga

SEQ ID NO: 3795363 - RNA, 18 nt, Human
cacagcagcaucuucaaa

SEQ ID NO: 3795364 - RNA, 14 nt, Human
cacagcagccugcu

SEQ ID NO: 3795365 - RNA, 19 nt, Human
cacagcagccugcuuccca

SEQ ID NO: 3795366 - RNA, 14 nt, Human
cacagcagccuggg

SEQ ID NO: 3795367 - RNA, 16 nt, Human
cacagcagcugaacag

SEQ ID NO: 3795368 - RNA, 23 nt, Human
cacagcagcuuauaaugggcucu

SEQ ID NO: 3795369 - RNA, 16 nt, Human
cacagcaggcugccag

SEQ ID NO: 3795370 - RNA, 19 nt, Human
cacagcaggcugccagugc

SEQ ID NO: 3795371 - RNA, 22 nt, Human
cacagcaguugaaaagacucca

SEQ ID NO: 3795372 - RNA, 20 nt, Human
cacagcaucauuuugcauuc

SEQ ID NO: 3795373 - RNA, 13 nt, Human
cacagcaucugua

SEQ ID NO: 3795374 - RNA, 16 nt, Human
cacagccaaauuuaaa

SEQ ID NO: 3795375 - RNA, 18 nt, Human
cacagccacacacacaga

SEQ ID NO: 3795376 - RNA, 22 nt, Human
cacagccacacacacagaaaau

SEQ ID NO: 3795377 - RNA, 13 nt, Human
cacagccaccccu

SEQ ID NO: 3795378 - RNA, 16 nt, Human
cacagccagaaccccg

SEQ ID NO: 3795379 - RNA, 17 nt, Human
cacagccagacuggcac

SEQ ID NO: 3795380 - RNA, 17 nt, Human
cacagccagcaccuggc

SEQ ID NO: 3795381 - RNA, 15 nt, Human
cacagccaggugccu

SEQ ID NO: 3795382 - RNA, 17 nt, Human
cacagccaggugccuug

SEQ ID NO: 3795383 - RNA, 13 nt, Human
cacagccauccca

SEQ ID NO: 3795384 - RNA, 16 nt, Human
cacagccaucccagcc

SEQ ID NO: 3795385 - RNA, 20 nt, Human
cacagcccacguccugucag

SEQ ID NO: 3795386 - RNA, 14 nt, Human
cacagcccaggccu

SEQ ID NO: 3795387 - RNA, 16 nt, Human
cacagcccaggccucc

SEQ ID NO: 3795388 - RNA, 21 nt, Human
cacagcccaggccuccagcuc

SEQ ID NO: 3795389 - RNA, 22 nt, Human
cacagcccaggccuccagcuca

SEQ ID NO: 3795390 - RNA, 17 nt, Human
cacagcccgcaugcagc

SEQ ID NO: 3795391 - RNA, 23 nt, Human
cacagcccgcaugcagcagcuug

SEQ ID NO: 3795392 - RNA, 14 nt, Human
cacagcccucccgc

SEQ ID NO: 3795393 - RNA, 18 nt, Human
cacagcccugucagcaug

SEQ ID NO: 3795394 - RNA, 22 nt, Human
cacagcccugucagcaugaauu

SEQ ID NO: 3795395 - RNA, 23 nt, Human
cacagcccugucagcaugaauuu

SEQ ID NO: 3795396 - RNA, 14 nt, Human
cacagcccuuuugu

SEQ ID NO: 3795397 - RNA, 22 nt, Human
cacagccgcagccucccucuga

SEQ ID NO: 3795398 - RNA, 18 nt, Human
cacagccggggccugccu

SEQ ID NO: 3795399 - RNA, 19 nt, Human
cacagccuccccugccagg

SEQ ID NO: 3795400 - RNA, 11 nt, Human
cacagccucug

SEQ ID NO: 3795401 - RNA, 23 nt, Human
cacagccucugaccccuccucac

SEQ ID NO: 3795402 - RNA, 12 nt, Human
cacagccugggc

SEQ ID NO: 3795403 - RNA, 18 nt, Human
cacagccuucuccacugg

SEQ ID NO: 3795404 - RNA, 17 nt, Human
cacagcgagacuccguc

SEQ ID NO: 3795405 - RNA, 17 nt, Human
cacagcgagggcagcug

SEQ ID NO: 3795406 - RNA, 16 nt, Human
cacagcgccagccuca

SEQ ID NO: 3795407 - RNA, 21 nt, Human
cacagcggagguguggagccg

SEQ ID NO: 3795408 - RNA, 16 nt, Human
cacagcgucccuggcg

SEQ ID NO: 3795409 - RNA, 21 nt, Human
cacagcuaacaauugugaagu

SEQ ID NO: 3795410 - RNA, 15 nt, Human
cacagcuaccucuuc

SEQ ID NO: 3795411 - RNA, 16 nt, Human
cacagcuacucucccc

SEQ ID NO: 3795412 - RNA, 13 nt, Human
cacagcucaggag

SEQ ID NO: 3795413 - RNA, 17 nt, Human
cacagcucccuucuguu

SEQ ID NO: 3795414 - RNA, 10 nt, Human
cacagcuccu

SEQ ID NO: 3795415 - RNA, 21 nt, Human
cacagcuccuuuuccagagca

SEQ ID NO: 3795416 - RNA, 22 nt, Human
cacagcuccuuuuccagagcau

SEQ ID NO: 3795417 - RNA, 11 nt, Human
cacagcucugu

SEQ ID NO: 3795418 - RNA, 15 nt, Human
cacagcucuguccug

SEQ ID NO: 3795419 - RNA, 18 nt, Human
cacagcucuguccuggga

SEQ ID NO: 3795420 - RNA, 14 nt, Human
cacagcucuguguu

SEQ ID NO: 3795421 - RNA, 19 nt, Human
cacagcucuucuccaggcu

SEQ ID NO: 3795422 - RNA, 19 nt, Human
cacagcugagagacuuuua

SEQ ID NO: 3795423 - RNA, 19 nt, Human
cacagcugcagagacagag

SEQ ID NO: 3795424 - RNA, 22 nt, Human
cacagcugccucuucccucuuc

SEQ ID NO: 3795425 - RNA, 12 nt, Human
cacagcugcuca

SEQ ID NO: 3795426 - RNA, 22 nt, Human
cacagcugcucaauaaaguaca

SEQ ID NO: 3795427 - RNA, 17 nt, Human
cacagcuguauagcugc

SEQ ID NO: 3795428 - RNA, 20 nt, Human
cacagcuguauagcugcuuc

SEQ ID NO: 3795429 - RNA, 22 nt, Human
caauauagaaaaauaaaaaucu

SEQ ID NO: 3795430 - RNA, 19 nt, Human
caauauagaaacacgaacu

SEQ ID NO: 3795431 - RNA, 21 nt, Human
caauauauaaaaauauauaua

SEQ ID NO: 3795432 - RNA, 19 nt, Human
caauauaucuaaauugaau

SEQ ID NO: 3795433 - RNA, 21 nt, Human
caauauaucuaaauugaauaa

SEQ ID NO: 3795434 - RNA, 16 nt, Human
caauauauuaccagca

SEQ ID NO: 3795435 - RNA, 16 nt, Human
caauauauuuuguaug

SEQ ID NO: 3795436 - RNA, 14 nt, Human
caauaucagacuuu

SEQ ID NO: 3795437 - RNA, 20 nt, Human
caauaucaguuauuuuuuga

SEQ ID NO: 3795438 - RNA, 12 nt, Human
caauauccuaau

SEQ ID NO: 3795439 - RNA, 15 nt, Human
caauauccuaauaaa

SEQ ID NO: 3795440 - RNA, 19 nt, Human
caauauccuaauaaaaagg

SEQ ID NO: 3795441 - RNA, 14 nt, Human
caauauccucgcuc

SEQ ID NO: 3795442 - RNA, 23 nt, Human
caauaucugaagcccucccaggu

SEQ ID NO: 3795443 - RNA, 21 nt, Human
caauauguauuguaaacaugu

SEQ ID NO: 3795444 - RNA, 23 nt, Human
caauauguauuguaaacaugugu

SEQ ID NO: 3795445 - RNA, 22 nt, Human
caauaugugagugccuuuugca

SEQ ID NO: 3795446 - RNA, 12 nt, Human
caauauuaaaua

SEQ ID NO: 3795447 - RNA, 20 nt, Human
caauauuaaauacagacacu

SEQ ID NO: 3795448 - RNA, 15 nt, Human
caauauuaaaucugc

SEQ ID NO: 3795449 - RNA, 24 nt, Human
caauauuaaccuaaucaccaugua

SEQ ID NO: 3795450 - RNA, 14 nt, Human
caauauuauaauuu

SEQ ID NO: 3795451 - RNA, 18 nt, Human
caauauuauacuaagaaa

SEQ ID NO: 3795452 - RNA, 13 nt, Human
caauauucaaaug

SEQ ID NO: 3795453 - RNA, 15 nt, Human
caauauucaaaugcg

SEQ ID NO: 3795454 - RNA, 15 nt, Human
caauauucaauaaag

SEQ ID NO: 3795455 - RNA, 16 nt, Human
caauauucaauaaagc

SEQ ID NO: 3795456 - RNA, 21 nt, Human
caauauuccugaaugaaauau

SEQ ID NO: 3795457 - RNA, 14 nt, Human
caauauuccuuagu

SEQ ID NO: 3795458 - RNA, 19 nt, Human
caauauucucuguacauau

SEQ ID NO: 3795459 - RNA, 12 nt, Human
caauauugaauu

SEQ ID NO: 3795460 - RNA, 21 nt, Human
caauauugaauuuuuccuaug

SEQ ID NO: 3795461 - RNA, 14 nt, Human
caauauugacuuug

SEQ ID NO: 3795462 - RNA, 17 nt, Human
caauauugacuuugucu

SEQ ID NO: 3795463 - RNA, 16 nt, Human
caauauuguacaguuu

SEQ ID NO: 3795464 - RNA, 14 nt, Human
caauauuguauauu

SEQ ID NO: 3795465 - RNA, 16 nt, Human
caauauugucauuccu

SEQ ID NO: 3795466 - RNA, 22 nt, Human
caauauugucucccuuccagca

SEQ ID NO: 3795467 - RNA, 14 nt, Human
caauauuguuucua

SEQ ID NO: 3795468 - RNA, 15 nt, Human
caauauuuaaggaga

SEQ ID NO: 3795469 - RNA, 17 nt, Human
caauauuuauaaagaau

SEQ ID NO: 3795470 - RNA, 19 nt, Human
caauauuuauggaugcaac

SEQ ID NO: 3795471 - RNA, 12 nt, Human
caauauuuauua

SEQ ID NO: 3795472 - RNA, 13 nt, Human
caauauuuauuau

SEQ ID NO: 3795473 - RNA, 16 nt, Human
caauauuuauuguauu

SEQ ID NO: 3795474 - RNA, 12 nt, Human
caauauuucaga

SEQ ID NO: 3795475 - RNA, 20 nt, Human
caauauuucagauaaucaca

SEQ ID NO: 3795476 - RNA, 14 nt, Human
caauauuuccucau

SEQ ID NO: 3795477 - RNA, 17 nt, Human
caauauuuccucaugug

SEQ ID NO: 3795478 - RNA, 15 nt, Human
caauauuugaauuuu

SEQ ID NO: 3795479 - RNA, 15 nt, Human
caauauuuguagaag

SEQ ID NO: 3795480 - RNA, 11 nt, Human
caauauuuuaa

SEQ ID NO: 3795481 - RNA, 14 nt, Human
caauauuuuaagca

SEQ ID NO: 3795482 - RNA, 17 nt, Human
caauauuuuaugguuau

SEQ ID NO: 3795483 - RNA, 22 nt, Human
caauauuuuaugguuauguuuu

SEQ ID NO: 3795484 - RNA, 21 nt, Human
augcaagagugauugcagcuu

SEQ ID NO: 3795485 - RNA, 12 nt, Human
augcaagauauu

SEQ ID NO: 3795486 - RNA, 14 nt, Human
augcaagcagagga

SEQ ID NO: 3795487 - RNA, 23 nt, Human
augcaagcuaguggcuucaaaau

SEQ ID NO: 3795488 - RNA, 14 nt, Human
augcaaggaaggaa

SEQ ID NO: 3795489 - RNA, 20 nt, Human
augcaaggaaggaaagaaag

SEQ ID NO: 3795490 - RNA, 22 nt, Human
augcaaggaccaggacucccuc

SEQ ID NO: 3795491 - RNA, 16 nt, Human
augcaaggucauuuuu

SEQ ID NO: 3795492 - RNA, 15 nt, Human
augcaauaaaauuau

SEQ ID NO: 3795493 - RNA, 19 nt, Human
augcaauaaaauuauuugc

SEQ ID NO: 3795494 - RNA, 20 nt, Human
augcaauaaaauuauuugca

SEQ ID NO: 3795495 - RNA, 21 nt, Human
augcaauaaaauuauuugcag

SEQ ID NO: 3795496 - RNA, 23 nt, Human
augcaauaaaauuuaaaaaauaa

SEQ ID NO: 3795497 - RNA, 22 nt, Human
augcaauagaagugcuccccuc

SEQ ID NO: 3795498 - RNA, 20 nt, Human
augcaauauaucuaaauuga

SEQ ID NO: 3795499 - RNA, 21 nt, Human
augcaauauaucuaaauugaa

SEQ ID NO: 3795500 - RNA, 22 nt, Human
augcaauauaucuaaauugaau

SEQ ID NO: 3795501 - RNA, 17 nt, Human
augcaauuuccuuuuuu

SEQ ID NO: 3795502 - RNA, 12 nt, Human
augcaauuugau

SEQ ID NO: 3795503 - RNA, 13 nt, Human
augcaauuuuuau

SEQ ID NO: 3795504 - RNA, 16 nt, Human
augcacaaugucuugg

SEQ ID NO: 3795505 - RNA, 14 nt, Human
augcacaauuccau

SEQ ID NO: 3795506 - RNA, 21 nt, Human
augcacacacacacgcuuucu

SEQ ID NO: 3795507 - RNA, 16 nt, Human
augcacacacauauau

SEQ ID NO: 3795508 - RNA, 21 nt, Human
augcacacagugcuuuccgug

SEQ ID NO: 3795509 - RNA, 19 nt, Human
augcacacauuuuuuaaau

SEQ ID NO: 3795510 - RNA, 22 nt, Human
augcacacuagccucuccagga

SEQ ID NO: 3795511 - RNA, 18 nt, Human
augcacagagaagcuggg

SEQ ID NO: 3795512 - RNA, 17 nt, Human
augcacagaguuguuac

SEQ ID NO: 3795513 - RNA, 18 nt, Human
augcacagaguuguuaca

SEQ ID NO: 3795514 - RNA, 21 nt, Human
augcacagaguuguuacauuu

SEQ ID NO: 3795515 - RNA, 16 nt, Human
augcacagauauacuu

SEQ ID NO: 3795516 - RNA, 17 nt, Human
augcacagauauacuuu

SEQ ID NO: 3795517 - RNA, 19 nt, Human
augcacagauauacuuugu

SEQ ID NO: 3795518 - RNA, 12 nt, Human
augcacagcugu

SEQ ID NO: 3795519 - RNA, 18 nt, Human
augcacaguauuuguaau

SEQ ID NO: 3795520 - RNA, 14 nt, Human
augcaccaccaagc

SEQ ID NO: 3795521 - RNA, 20 nt, Human
augcaccuagcugugcaaga

SEQ ID NO: 3795522 - RNA, 14 nt, Human
augcaccuggaaua

SEQ ID NO: 3795523 - RNA, 18 nt, Human
augcaccuugugucugua

SEQ ID NO: 3795524 - RNA, 13 nt, Human
augcacggccucg

SEQ ID NO: 3795525 - RNA, 22 nt, Human
augcacgugugcacacacacca

SEQ ID NO: 3795526 - RNA, 13 nt, Human
augcacuaugagg

SEQ ID NO: 3795527 - RNA, 14 nt, Human
augcacucagcucu

SEQ ID NO: 3795528 - RNA, 23 nt, Human
augcacugacccuuccagacaua

SEQ ID NO: 3795529 - RNA, 12 nt, Human
augcacugugaa

SEQ ID NO: 3795530 - RNA, 13 nt, Human
augcacugugaag

SEQ ID NO: 3795531 - RNA, 21 nt, Human
augcacuuaaagaaguauuuu

SEQ ID NO: 3795532 - RNA, 18 nt, Human
augcacuuugcuuuaaua

SEQ ID NO: 3795533 - RNA, 19 nt, Human
augcacuuugcuuuaauau

SEQ ID NO: 3795534 - RNA, 23 nt, Human
augcacuuugcuuuaauauaaau

SEQ ID NO: 3795535 - RNA, 11 nt, Human
augcagaaaua

SEQ ID NO: 3795536 - RNA, 13 nt, Human
augcagaaggaag

SEQ ID NO: 3795537 - RNA, 22 nt, Human
augcagacaugagugcgugcuc

SEQ ID NO: 3795538 - RNA, 21 nt, Human
augcagagagccauuuuguga

SEQ ID NO: 3795539 - RNA, 22 nt, Human
augcagagagccauuuugugaa

SEQ ID NO: 3795540 - RNA, 23 nt, Human
augcagagcgccgugaguucuca

SEQ ID NO: 3795541 - RNA, 23 nt, Human
augcagagguaaaagugugagca

SEQ ID NO: 3795542 - RNA, 15 nt, Human
augcagagucagcag

SEQ ID NO: 3795543 - RNA, 17 nt, Human
augcagagucagcagaa

SEQ ID NO: 3795544 - RNA, 16 nt, Human
augcagaguugacaug

SEQ ID NO: 3795545 - RNA, 17 nt, Human
augcagauagaaucaau

SEQ ID NO: 3795546 - RNA, 14 nt, Human
augcagaugccaga

SEQ ID NO: 3795547 - RNA, 15 nt, Human
augcagaugccuggg

SEQ ID NO: 3795548 - RNA, 23 nt, Human
augcagauggggcucccgcccgu

SEQ ID NO: 3795549 - RNA, 11 nt, Human
augcagcagcu

SEQ ID NO: 3795550 - RNA, 12 nt, Human
augcagcauuug

SEQ ID NO: 3795551 - RNA, 14 nt, Human
augcagcauuugau

SEQ ID NO: 3795552 - RNA, 17 nt, Human
augcagccacuuaggac

SEQ ID NO: 3795553 - RNA, 18 nt, Human
augcagccacuuaggaca

SEQ ID NO: 3795554 - RNA, 15 nt, Human
augcagcccaugccc

SEQ ID NO: 3795555 - RNA, 14 nt, Human
augcagcccauuuc

SEQ ID NO: 3795556 - RNA, 20 nt, Human
augcagcccauuucuccaga

SEQ ID NO: 3795557 - RNA, 14 nt, Human
augcagccucacag

SEQ ID NO: 3795558 - RNA, 13 nt, Human
augcagcucaaga

SEQ ID NO: 3795559 - RNA, 16 nt, Human
augcagcucuuccugg

SEQ ID NO: 3795560 - RNA, 22 nt, Human
augcaggagcuucugggagauu

SEQ ID NO: 3795561 - RNA, 19 nt, Human
augcagggauugcugccac

SEQ ID NO: 3795562 - RNA, 15 nt, Human
augcagggcagucau

SEQ ID NO: 3795563 - RNA, 16 nt, Human
augcagggggcuccug

SEQ ID NO: 3795564 - RNA, 22 nt, Human
augcagguuagaaauaauguca

SEQ ID NO: 3795565 - RNA, 13 nt, Human
augcagguuuuau

SEQ ID NO: 3795566 - RNA, 16 nt, Human
augcaguaaauuaucu

SEQ ID NO: 3795567 - RNA, 17 nt, Human
augcaguacaggacaua

SEQ ID NO: 3795568 - RNA, 18 nt, Human
augcaguacuaacauuua

SEQ ID NO: 3795569 - RNA, 23 nt, Human
augcaguaugguacauuuuucaa

SEQ ID NO: 3795570 - RNA, 19 nt, Human
augcagucuccucuuuaaa

SEQ ID NO: 3795571 - RNA, 22 nt, Human
augcagucuuagaucauaguuu

SEQ ID NO: 3795572 - RNA, 13 nt, Human
augcagugccagg

SEQ ID NO: 3795573 - RNA, 17 nt, Human
augcagugcucgcuguu

SEQ ID NO: 3795574 - RNA, 24 nt, Human
augcagugcucgcuguugcugaau

SEQ ID NO: 3795575 - RNA, 23 nt, Human
augcaguguagauuuuauagugu

SEQ ID NO: 3795576 - RNA, 19 nt, Human
augcaguuagcugaagaau

SEQ ID NO: 3795577 - RNA, 20 nt, Human
augcaguuagcugaagaauu

SEQ ID NO: 3795578 - RNA, 13 nt, Human
augcaguucugaa

SEQ ID NO: 3795579 - RNA, 13 nt, Human
augcaguuugaaa

SEQ ID NO: 3795580 - RNA, 18 nt, Human
augcaguuugaaauucug

SEQ ID NO: 3795581 - RNA, 22 nt, Human
augcaguuugaaauucugaauu

SEQ ID NO: 3795582 - RNA, 14 nt, Human
augcauaaauaugc

SEQ ID NO: 3795583 - RNA, 15 nt, Human
augcauaaauaugca

SEQ ID NO: 3795584 - RNA, 16 nt, Human
augcauaaauaugcag

SEQ ID NO: 3795585 - RNA, 20 nt, Human
augcauaacugacaaaucaa

SEQ ID NO: 3795586 - RNA, 19 nt, Human
augcauaauaauccugcaa

SEQ ID NO: 3795587 - RNA, 23 nt, Human
augcauaauaauccugcaaagua

SEQ ID NO: 3795588 - RNA, 23 nt, Human
augcauacacacacacacacagc

SEQ ID NO: 3795589 - RNA, 17 nt, Human
augcauacacucucaaa

SEQ ID NO: 3795590 - RNA, 14 nt, Human
augcauacauacac

SEQ ID NO: 3795591 - RNA, 16 nt, Human
augcauagagugugau

SEQ ID NO: 3795592 - RNA, 23 nt, Human
augcauagucccagcuacccagg

SEQ ID NO: 3795593 - RNA, 20 nt, Human
augcauaugucacuagaaug

SEQ ID NO: 3795594 - RNA, 23 nt, Human
augcauaugucacuagaauggau

SEQ ID NO: 3795595 - RNA, 13 nt, Human
augcauauuacug

SEQ ID NO: 3795596 - RNA, 14 nt, Human
augcauauuacugu

SEQ ID NO: 3795597 - RNA, 16 nt, Human
augcauauuauuuuau

SEQ ID NO: 3795598 - RNA, 15 nt, Human
augcauauuguauua

SEQ ID NO: 3795599 - RNA, 17 nt, Human
augcauauuugcaaagu

SEQ ID NO: 3795600 - RNA, 21 nt, Human
augcauauuugcaaaguguau

SEQ ID NO: 3795601 - RNA, 15 nt, Human
augcaucaauccugu

SEQ ID NO: 3795602 - RNA, 20 nt, Human
augcaucagaaagggagggc

SEQ ID NO: 3795603 - RNA, 14 nt, Human
augcauccauuccu

SEQ ID NO: 3795604 - RNA, 18 nt, Human
augcauccauuccucagg

SEQ ID NO: 3795605 - RNA, 14 nt, Human
augcaucuagauua

SEQ ID NO: 3795606 - RNA, 17 nt, Human
augcaucuccaccugcu

SEQ ID NO: 3795607 - RNA, 16 nt, Human
augcaucuuacugaag

SEQ ID NO: 3795608 - RNA, 19 nt, Human
augcaucuuugauguguug

SEQ ID NO: 3795609 - RNA, 21 nt, Human
augcaucuuugauguguuguu

SEQ ID NO: 3795610 - RNA, 16 nt, Human
augcaugaaguaauau

SEQ ID NO: 3795611 - RNA, 13 nt, Human
augcaugcaaaug

SEQ ID NO: 3795612 - RNA, 17 nt, Human
augcaugcacuguuccc

SEQ ID NO: 3795613 - RNA, 17 nt, Human
augcaugcuuuccauau

SEQ ID NO: 3795614 - RNA, 22 nt, Human
augcauggugccccaggaccag

SEQ ID NO: 3795615 - RNA, 18 nt, Human
augcaugguuucagcacu

SEQ ID NO: 3795616 - RNA, 16 nt, Human
augcaugucaaacaug

SEQ ID NO: 3795617 - RNA, 15 nt, Human
augcaugucuuuuaa

SEQ ID NO: 3795618 - RNA, 17 nt, Human
augcaugugaagaaagg

SEQ ID NO: 3795619 - RNA, 18 nt, Human
augcauguugaccauguc

SEQ ID NO: 3795620 - RNA, 22 nt, Human
augcauguugaccaugucuaug

SEQ ID NO: 3795621 - RNA, 19 nt, Human
augcauguuuuccagcucc

SEQ ID NO: 3795622 - RNA, 12 nt, Human
augcauuaaacc

SEQ ID NO: 3795623 - RNA, 21 nt, Human
augcauuauaggaucauuugu

SEQ ID NO: 3795624 - RNA, 19 nt, Human
augcauucacauuuagaaa

SEQ ID NO: 3795625 - RNA, 23 nt, Human
augcauucacauuuagaaaagug

SEQ ID NO: 3795626 - RNA, 14 nt, Human
augcauucuucucu

SEQ ID NO: 3795627 - RNA, 18 nt, Human
augcauugauauugugaa

SEQ ID NO: 3795628 - RNA, 22 nt, Human
cacagcaggcugccagugccug

SEQ ID NO: 3795629 - RNA, 17 nt, Human
cacagcagugagacugg

SEQ ID NO: 3795630 - RNA, 14 nt, Human
cacagcaucucagc

SEQ ID NO: 3795631 - RNA, 15 nt, Human
cacagcaucucagcu

SEQ ID NO: 3795632 - RNA, 16 nt, Human
cacagcaucucagcuc

SEQ ID NO: 3795633 - RNA, 16 nt, Human
cacagcauuguauaug

SEQ ID NO: 3795634 - RNA, 10 nt, Human
cacagccaca

SEQ ID NO: 3795635 - RNA, 17 nt, Human
cacagccacacacacag

SEQ ID NO: 3795636 - RNA, 15 nt, Human
cacagccagcaccug

SEQ ID NO: 3795637 - RNA, 16 nt, Human
cacagccagcaccugg

SEQ ID NO: 3795638 - RNA, 18 nt, Human
cacagccaggggagcaga

SEQ ID NO: 3795639 - RNA, 15 nt, Human
augcauuguugaggu

SEQ ID NO: 3795640 - RNA, 22 nt, Human
augcauuguuguucugcucaau

SEQ ID NO: 3795641 - RNA, 10 nt, Human
augcauuuga

SEQ ID NO: 3795642 - RNA, 12 nt, Human
augcauuugaaa

SEQ ID NO: 3795643 - RNA, 13 nt, Human
augcauuugaggu

SEQ ID NO: 3795644 - RNA, 23 nt, Human
augcauuugaggucaaguaagaa

SEQ ID NO: 3795645 - RNA, 18 nt, Human
augcauuuggguccagga

SEQ ID NO: 3795646 - RNA, 22 nt, Human
augcauuuggguccaggaggaa

SEQ ID NO: 3795647 - RNA, 12 nt, Human
augcauuuugca

SEQ ID NO: 3795648 - RNA, 18 nt, Human
augcauuuugcagcagug

SEQ ID NO: 3795649 - RNA, 23 nt, Human
augcauuuuguuugguauuguau

SEQ ID NO: 3795650 - RNA, 19 nt, Human
augccaaaaaaaaauacau

SEQ ID NO: 3795651 - RNA, 18 nt, Human
augccaaaaaaagacagg

SEQ ID NO: 3795652 - RNA, 23 nt, Human
augccaaagaucacuuguuguuu

SEQ ID NO: 3795653 - RNA, 15 nt, Human
augccaaauuaaaaa

SEQ ID NO: 3795654 - RNA, 18 nt, Human
augccaaauuaaaaaaga

SEQ ID NO: 3795655 - RNA, 13 nt, Human
augccaacaagaa

SEQ ID NO: 3795656 - RNA, 16 nt, Human
augccaacaagaaugc

SEQ ID NO: 3795657 - RNA, 18 nt, Human
augccaacaagaaugcau

SEQ ID NO: 3795658 - RNA, 21 nt, Human
augccaacaagaaugcauuga

SEQ ID NO: 3795659 - RNA, 14 nt, Human
augccaacuugucc

SEQ ID NO: 3795660 - RNA, 23 nt, Human
augccaagaaguuuaaggaauau

SEQ ID NO: 3795661 - RNA, 19 nt, Human
augccaagcacugugcuca

SEQ ID NO: 3795662 - RNA, 21 nt, Human
augccaagcacugugcucagg

SEQ ID NO: 3795663 - RNA, 23 nt, Human
augccaaguuguuugagaaauua

SEQ ID NO: 3795664 - RNA, 16 nt, Human
augccaauacuaguca

SEQ ID NO: 3795665 - RNA, 22 nt, Human
augccaauuagcaauugacugu

SEQ ID NO: 3795666 - RNA, 13 nt, Human
augccaauuucuc

SEQ ID NO: 3795667 - RNA, 14 nt, Human
augccacacaccuu

SEQ ID NO: 3795668 - RNA, 16 nt, Human
augccacacagagugg

SEQ ID NO: 3795669 - RNA, 21 nt, Human
augccacaccaagcugugcca

SEQ ID NO: 3795670 - RNA, 22 nt, Human
augccacaccaagcugugccac

SEQ ID NO: 3795671 - RNA, 13 nt, Human
augccacagcccu

SEQ ID NO: 3795672 - RNA, 15 nt, Human
augccacagcccugu

SEQ ID NO: 3795673 - RNA, 15 nt, Human
augccacauucaaaa

SEQ ID NO: 3795674 - RNA, 17 nt, Human
augccacgggaaguuua

SEQ ID NO: 3795675 - RNA, 21 nt, Human
augccacguuccacaguugcc

SEQ ID NO: 3795676 - RNA, 17 nt, Human
augccacuaaauugaca

SEQ ID NO: 3795677 - RNA, 14 nt, Human
augccacuccuccc

SEQ ID NO: 3795678 - RNA, 18 nt, Human
augccacuccucccuccg

SEQ ID NO: 3795679 - RNA, 14 nt, Human
augccacugccuuc

SEQ ID NO: 3795680 - RNA, 17 nt, Human
augccacugccuucgcu

SEQ ID NO: 3795681 - RNA, 18 nt, Human
augccacugccuucgcuu

SEQ ID NO: 3795682 - RNA, 18 nt, Human
augccacuucuaagaaaa

SEQ ID NO: 3795683 - RNA, 20 nt, Human
augccagagcaaagggccag

SEQ ID NO: 3795684 - RNA, 13 nt, Human
augccagcuggcc

SEQ ID NO: 3795685 - RNA, 16 nt, Human
augccaggaccagucc

SEQ ID NO: 3795686 - RNA, 19 nt, Human
augccagguucuauuugga

SEQ ID NO: 3795687 - RNA, 20 nt, Human
augccagguucuauuuggaa

SEQ ID NO: 3795688 - RNA, 14 nt, Human
augccagugugcug

SEQ ID NO: 3795689 - RNA, 22 nt, Human
augccauagaaauguagguccu

SEQ ID NO: 3795690 - RNA, 15 nt, Human
augccaucaucuccu

SEQ ID NO: 3795691 - RNA, 12 nt, Human
augccauccuca

SEQ ID NO: 3795692 - RNA, 21 nt, Human
augccauccucaaacacugca

SEQ ID NO: 3795693 - RNA, 23 nt, Human
augccauccucaaacacugcagg

SEQ ID NO: 3795694 - RNA, 21 nt, Human
augccauccucuuucucuuuu

SEQ ID NO: 3795695 - RNA, 14 nt, Human
augccaugaugccu

SEQ ID NO: 3795696 - RNA, 17 nt, Human
augccauggacagaaga

SEQ ID NO: 3795697 - RNA, 19 nt, Human
augccauggacagaagaag

SEQ ID NO: 3795698 - RNA, 14 nt, Human
augccauuuguuua

SEQ ID NO: 3795699 - RNA, 23 nt, Human
augcccacauuuagucucuuuau

SEQ ID NO: 3795700 - RNA, 10 nt, Human
augcccagag

SEQ ID NO: 3795701 - RNA, 20 nt, Human
augcccagagggcccaggca

SEQ ID NO: 3795702 - RNA, 12 nt, Human
augcccagcccc

SEQ ID NO: 3795703 - RNA, 17 nt, Human
augcccagccccuucug

SEQ ID NO: 3795704 - RNA, 15 nt, Human
augcccagugagacu

SEQ ID NO: 3795705 - RNA, 14 nt, Human
augccccaaauaua

SEQ ID NO: 3795706 - RNA, 15 nt, Human
augccccaaauauag

SEQ ID NO: 3795707 - RNA, 16 nt, Human
augcccccagcuggcc

SEQ ID NO: 3795708 - RNA, 13 nt, Human
augccccccucaa

SEQ ID NO: 3795709 - RNA, 22 nt, Human
augccccccucaaaccuccucu

SEQ ID NO: 3795710 - RNA, 18 nt, Human
augcccccucgugccagu

SEQ ID NO: 3795711 - RNA, 13 nt, Human
augcccccuuuca

SEQ ID NO: 3795712 - RNA, 19 nt, Human
augcccccuuucagauguc

SEQ ID NO: 3795713 - RNA, 20 nt, Human
augccccggccaccucugcg

SEQ ID NO: 3795714 - RNA, 21 nt, Human
augccccgucccccucuggcu

SEQ ID NO: 3795715 - RNA, 20 nt, Human
augccccuguacuccagccu

SEQ ID NO: 3795716 - RNA, 21 nt, Human
augcccucccuucucccugga

SEQ ID NO: 3795717 - RNA, 15 nt, Human
augcccuccucuccc

SEQ ID NO: 3795718 - RNA, 10 nt, Human
augcccucuc

SEQ ID NO: 3795719 - RNA, 13 nt, Human
augcccucucagg

SEQ ID NO: 3795720 - RNA, 14 nt, Human
augcccugcuccag

SEQ ID NO: 3795721 - RNA, 23 nt, Human
augcccugugcaaccucuuggcc

SEQ ID NO: 3795722 - RNA, 16 nt, Human
augcccuucuccuuau

SEQ ID NO: 3795723 - RNA, 22 nt, Human
augcccuuucuugaauugcauu

SEQ ID NO: 3795724 - RNA, 16 nt, Human
augccgauuucuguaa

SEQ ID NO: 3795725 - RNA, 17 nt, Human
augccgcgaugggucag

SEQ ID NO: 3795726 - RNA, 22 nt, Human
augccgcugcauccgugagcag

SEQ ID NO: 3795727 - RNA, 17 nt, Human
augccggaugugcuuuu

SEQ ID NO: 3795728 - RNA, 22 nt, Human
augccguuacuuuucauauuug

SEQ ID NO: 3795729 - RNA, 21 nt, Human
augccuaagaagaugacuucc

SEQ ID NO: 3795730 - RNA, 16 nt, Human
augccucacuaauuuu

SEQ ID NO: 3795731 - RNA, 20 nt, Human
augccucacuaauuuuugua

SEQ ID NO: 3795732 - RNA, 19 nt, Human
augccucaguguauuugua

SEQ ID NO: 3795733 - RNA, 20 nt, Human
augccucaguguauuuguau

SEQ ID NO: 3795734 - RNA, 14 nt, Human
augccucccugacc

SEQ ID NO: 3795735 - RNA, 14 nt, Human
augccuccucagga

SEQ ID NO: 3795736 - RNA, 15 nt, Human
augccuccucaggag

SEQ ID NO: 3795737 - RNA, 14 nt, Human
augccuccuuccuc

SEQ ID NO: 3795738 - RNA, 19 nt, Human
augccucucucaggccaaa

SEQ ID NO: 3795739 - RNA, 14 nt, Human
augccucugaggcc

SEQ ID NO: 3795740 - RNA, 17 nt, Human
augccucugaggccagc

SEQ ID NO: 3795741 - RNA, 20 nt, Human
augccucugaggccagccug

SEQ ID NO: 3795742 - RNA, 23 nt, Human
augccucugaggccagccuggcc

SEQ ID NO: 3795743 - RNA, 18 nt, Human
augccucugccaaaggau

SEQ ID NO: 3795744 - RNA, 22 nt, Human
augccucugccaaaggauguga

SEQ ID NO: 3795745 - RNA, 14 nt, Human
augccucugucuag

SEQ ID NO: 3795746 - RNA, 14 nt, Human
augccugagggugg

SEQ ID NO: 3795747 - RNA, 15 nt, Human
augccugagggugga

SEQ ID NO: 3795748 - RNA, 17 nt, Human
augccugaggguggaga

SEQ ID NO: 3795749 - RNA, 19 nt, Human
augccugccccaaacaaau

SEQ ID NO: 3795750 - RNA, 16 nt, Human
augccugcggaguugu

SEQ ID NO: 3795751 - RNA, 19 nt, Human
augccugcucuuuggccug

SEQ ID NO: 3795752 - RNA, 20 nt, Human
augccuggauggggcugcac

SEQ ID NO: 3795753 - RNA, 23 nt, Human
augccuggauggggcugcaccgg

SEQ ID NO: 3795754 - RNA, 17 nt, Human
augccugggcagaagga

SEQ ID NO: 3795755 - RNA, 16 nt, Human
augccuggucuuuccu

SEQ ID NO: 3795756 - RNA, 15 nt, Human
augccugguggcagc

SEQ ID NO: 3795757 - RNA, 21 nt, Human
augccugguggcagcugcggu

SEQ ID NO: 3795758 - RNA, 16 nt, Human
augccuguaauucagu

SEQ ID NO: 3795759 - RNA, 19 nt, Human
augccugucuuaauuuucu

SEQ ID NO: 3795760 - RNA, 15 nt, Human
augccuguggcugcg

SEQ ID NO: 3795761 - RNA, 19 nt, Human
augccuuaaaauggaauug

SEQ ID NO: 3795762 - RNA, 16 nt, Human
augccuuacucuucuu

SEQ ID NO: 3795763 - RNA, 16 nt, Human
augccuuacuuuguau

SEQ ID NO: 3795764 - RNA, 16 nt, Human
augccuuccccugggc

SEQ ID NO: 3795765 - RNA, 12 nt, Human
augccuugugcu

SEQ ID NO: 3795766 - RNA, 21 nt, Human
augccuuuaaaguaugaaucu

SEQ ID NO: 3795767 - RNA, 21 nt, Human
augccuuucuaguccuauucu

SEQ ID NO: 3795768 - RNA, 15 nt, Human
augccuuugagacag

SEQ ID NO: 3795769 - RNA, 13 nt, Human
augccuuuguaag

SEQ ID NO: 3795770 - RNA, 15 nt, Human
augccuuuguaaguu

SEQ ID NO: 3795771 - RNA, 16 nt, Human
augccuuuguaaguua

SEQ ID NO: 3795772 - RNA, 18 nt, Human
augcgcaggcuggcccug

SEQ ID NO: 3795773 - RNA, 16 nt, Human
cacguaaugaaacuug

SEQ ID NO: 3795774 - RNA, 15 nt, Human
cacguacaaaaucca

SEQ ID NO: 3795775 - RNA, 18 nt, Human
cacguacacacacauaca

SEQ ID NO: 3795776 - RNA, 17 nt, Human
cacguaguagggucagg

SEQ ID NO: 3795777 - RNA, 20 nt, Human
cacgucacguguagugucca

SEQ ID NO: 3795778 - RNA, 13 nt, Human
cacgucccccugg

SEQ ID NO: 3795779 - RNA, 15 nt, Human
cacgucccccugggg

SEQ ID NO: 3795780 - RNA, 20 nt, Human
cacgucccccuggggcuucu

SEQ ID NO: 3795781 - RNA, 19 nt, Human
cacguccugagaaagcuca

SEQ ID NO: 3795782 - RNA, 16 nt, Human
cacguccugucagugc

SEQ ID NO: 3795783 - RNA, 17 nt, Human
cacguccugucagugcc

SEQ ID NO: 3795784 - RNA, 18 nt, Human
cacgucugacccucucca

SEQ ID NO: 3795785 - RNA, 14 nt, Human
cacgugacacaaac

SEQ ID NO: 3795786 - RNA, 16 nt, Human
cacgugcagcucaagg

SEQ ID NO: 3795787 - RNA, 13 nt, Human
cacgugccaggcc

SEQ ID NO: 3795788 - RNA, 16 nt, Human
cacgugccaggcccgg

SEQ ID NO: 3795789 - RNA, 23 nt, Human
cacguggagagcuggugcccgga

SEQ ID NO: 3795790 - RNA, 18 nt, Human
cacguggccucuugagca

SEQ ID NO: 3795791 - RNA, 15 nt, Human
cacgugggaaccccc

SEQ ID NO: 3795792 - RNA, 21 nt, Human
cacgugggaaccccccuccca

SEQ ID NO: 3795793 - RNA, 19 nt, Human
cacgugggcuccccucuuc

SEQ ID NO: 3795794 - RNA, 20 nt, Human
cacguguaacugucagccgg

SEQ ID NO: 3795795 - RNA, 17 nt, Human
cacguguguuuuucuau

SEQ ID NO: 3795796 - RNA, 19 nt, Human
cacguguguuuuucuauua

SEQ ID NO: 3795797 - RNA, 20 nt, Human
cacguguguuuuucuauuaa

SEQ ID NO: 3795798 - RNA, 22 nt, Human
cacguguguuuuucuauuaaaa

SEQ ID NO: 3795799 - RNA, 23 nt, Human
cacguguguuuuucuauuaaaag

SEQ ID NO: 3795800 - RNA, 18 nt, Human
cacguuccacaguugcca

SEQ ID NO: 3795801 - RNA, 22 nt, Human
cacguucuuacuaguuucccuu

SEQ ID NO: 3795802 - RNA, 14 nt, Human
cacguuuuaaggac

SEQ ID NO: 3795803 - RNA, 16 nt, Human
cacguuuuaaggacug

SEQ ID NO: 3795804 - RNA, 19 nt, Human
cacuaaaacacacaggugc

SEQ ID NO: 3795805 - RNA, 15 nt, Human
cacuaaaauuuuagg

SEQ ID NO: 3795806 - RNA, 22 nt, Human
cacuaaacucugaauaagcacu

SEQ ID NO: 3795807 - RNA, 12 nt, Human
cacuaaagcagu

SEQ ID NO: 3795808 - RNA, 18 nt, Human
cacuaaagccagccugac

SEQ ID NO: 3795809 - RNA, 20 nt, Human
cacuaaagccagccugaccu

SEQ ID NO: 3795810 - RNA, 21 nt, Human
cacuaaagccagccugaccuu

SEQ ID NO: 3795811 - RNA, 15 nt, Human
cacuaaaguauguaa

SEQ ID NO: 3795812 - RNA, 13 nt, Human
cacuaaaucagag

SEQ ID NO: 3795813 - RNA, 16 nt, Human
cacuaaaucagagaca

SEQ ID NO: 3795814 - RNA, 13 nt, Human
cacuaaauguuaa

SEQ ID NO: 3795815 - RNA, 16 nt, Human
cacuaaauguuaaaga

SEQ ID NO: 3795816 - RNA, 21 nt, Human
cacuaaauugacacuuaaaaa

SEQ ID NO: 3795817 - RNA, 14 nt, Human
cacuaacagagugg

SEQ ID NO: 3795818 - RNA, 20 nt, Human
cacuaacauuauauugcaau

SEQ ID NO: 3795819 - RNA, 14 nt, Human
cacuaaccuugccu

SEQ ID NO: 3795820 - RNA, 11 nt, Human
cacuaacuaga

SEQ ID NO: 3795821 - RNA, 20 nt, Human
cacuaagaacaaaagaagca

SEQ ID NO: 3795822 - RNA, 16 nt, Human
cacuaagcagaggagg

SEQ ID NO: 3795823 - RNA, 12 nt, Human
cacuaaggggcc

SEQ ID NO: 3795824 - RNA, 17 nt, Human
cacuaaggugugcucug

SEQ ID NO: 3795825 - RNA, 16 nt, Human
cacuaauauauuuaaa

SEQ ID NO: 3795826 - RNA, 20 nt, Human
cacuaauauauuuaaaaaua

SEQ ID NO: 3795827 - RNA, 12 nt, Human
cacuaauucaua

SEQ ID NO: 3795828 - RNA, 18 nt, Human
cacuaauuuuuguauuau

SEQ ID NO: 3795829 - RNA, 13 nt, Human
cacuacaaccucc

SEQ ID NO: 3795830 - RNA, 14 nt, Human
cacuacaaccuccg

SEQ ID NO: 3795831 - RNA, 21 nt, Human
cacuacaagucagcuccagcu

SEQ ID NO: 3795832 - RNA, 16 nt, Human
cacuacaccacacaca

SEQ ID NO: 3795833 - RNA, 17 nt, Human
cacuacaccacacacaa

SEQ ID NO: 3795834 - RNA, 23 nt, Human
cacuacaccacacacaacagcca

SEQ ID NO: 3795835 - RNA, 23 nt, Human
cacuacaccuggcugagguuccu

SEQ ID NO: 3795836 - RNA, 16 nt, Human
cacuacacuccagccu

SEQ ID NO: 3795837 - RNA, 20 nt, Human
cacuacacuccagccugagc

SEQ ID NO: 3795838 - RNA, 21 nt, Human
cacuacacuccagccugagca

SEQ ID NO: 3795839 - RNA, 14 nt, Human
cacuacauaaacug

SEQ ID NO: 3795840 - RNA, 17 nt, Human
cacuacauaaacugacu

SEQ ID NO: 3795841 - RNA, 21 nt, Human
cacuacaugcagcccaugccc

SEQ ID NO: 3795842 - RNA, 15 nt, Human
cacuacauucuguua

SEQ ID NO: 3795843 - RNA, 16 nt, Human
cacuacauucuguuaa

SEQ ID NO: 3795844 - RNA, 15 nt, Human
cacuaccgauucuuu

SEQ ID NO: 3795845 - RNA, 12 nt, Human
cacccccagccc

SEQ ID NO: 3795846 - RNA, 19 nt, Human
cacccccagccugggccua

SEQ ID NO: 3795847 - RNA, 12 nt, Human
cacccccagcuc

SEQ ID NO: 3795848 - RNA, 18 nt, Human
caccccccacacucacuc

SEQ ID NO: 3795849 - RNA, 18 nt, Human
caccccccagaaccuguc

SEQ ID NO: 3795850 - RNA, 20 nt, Human
caccccccagaaccuguccu

SEQ ID NO: 3795851 - RNA, 21 nt, Human
caccccccagaaccuguccuu

SEQ ID NO: 3795852 - RNA, 12 nt, Human
caccccccaggc

SEQ ID NO: 3795853 - RNA, 13 nt, Human
caccccccugggc

SEQ ID NO: 3795854 - RNA, 16 nt, Human
caccccccuguucuaa

SEQ ID NO: 3795855 - RNA, 16 nt, Human
cacccccgccucccuc

SEQ ID NO: 3795856 - RNA, 11 nt, Human
cacccccguca

SEQ ID NO: 3795857 - RNA, 18 nt, Human
cacccccucaccccucca

SEQ ID NO: 3795858 - RNA, 19 nt, Human
cacccccucccacccccag

SEQ ID NO: 3795859 - RNA, 15 nt, Human
cacccccuccccagg

SEQ ID NO: 3795860 - RNA, 15 nt, Human
cacccccuccugcug

SEQ ID NO: 3795861 - RNA, 17 nt, Human
cacccccuccugcugca

SEQ ID NO: 3795862 - RNA, 17 nt, Human
cacccccugcccugcac

SEQ ID NO: 3795863 - RNA, 16 nt, Human
cacccccuucagugcc

SEQ ID NO: 3795864 - RNA, 20 nt, Human
cacccccuucagugcccacc

SEQ ID NO: 3795865 - RNA, 18 nt, Human
cacccccuucuccaucca

SEQ ID NO: 3795866 - RNA, 17 nt, Human
cacccccuucucugcuc

SEQ ID NO: 3795867 - RNA, 16 nt, Human
caccccgaggcccugc

SEQ ID NO: 3795868 - RNA, 20 nt, Human
caccccgaggcccugcaugg

SEQ ID NO: 3795869 - RNA, 22 nt, Human
caccccgaggcccugcaugggc

SEQ ID NO: 3795870 - RNA, 16 nt, Human
caccccgccugcccuc

SEQ ID NO: 3795871 - RNA, 15 nt, Human
caccccgcucugcau

SEQ ID NO: 3795872 - RNA, 19 nt, Human
caccccgcuguaagcuccu

SEQ ID NO: 3795873 - RNA, 23 nt, Human
caccccggcccccugcccguucu

SEQ ID NO: 3795874 - RNA, 15 nt, Human
caccccgggcucucu

SEQ ID NO: 3795875 - RNA, 20 nt, Human
caccccggggacccugugac

SEQ ID NO: 3795876 - RNA, 22 nt, Human
caccccgucugggguucagccc

SEQ ID NO: 3795877 - RNA, 20 nt, Human
caccccguuacagcucccca

SEQ ID NO: 3795878 - RNA, 15 nt, Human
caccccuaaagagau

SEQ ID NO: 3795879 - RNA, 10 nt, Human
caccccuccc

SEQ ID NO: 3795880 - RNA, 15 nt, Human
caccccuccccugcc

SEQ ID NO: 3795881 - RNA, 13 nt, Human
caccccucccucu

SEQ ID NO: 3795882 - RNA, 12 nt, Human
caccccuccuuc

SEQ ID NO: 3795883 - RNA, 23 nt, Human
caccccuccuuccuugaccagca

SEQ ID NO: 3795884 - RNA, 18 nt, Human
caccccugcccccacuuc

SEQ ID NO: 3795885 - RNA, 18 nt, Human
caccccugcccccagccc

SEQ ID NO: 3795886 - RNA, 16 nt, Human
caccccugcccuggga

SEQ ID NO: 3795887 - RNA, 12 nt, Human
caccccugccuc

SEQ ID NO: 3795888 - RNA, 14 nt, Human
caccccugccucca

SEQ ID NO: 3795889 - RNA, 22 nt, Human
caccccugccuccacccucuga

SEQ ID NO: 3795890 - RNA, 23 nt, Human
caccccugccuccacccucugag

SEQ ID NO: 3795891 - RNA, 10 nt, Human
caccccugcu

SEQ ID NO: 3795892 - RNA, 18 nt, Human
caccccuggaagagccca

SEQ ID NO: 3795893 - RNA, 19 nt, Human
caccccuggaagagcccag

SEQ ID NO: 3795894 - RNA, 20 nt, Human
caccccuggaagagcccagu

SEQ ID NO: 3795895 - RNA, 18 nt, Human
caccccugggggcucuca

SEQ ID NO: 3795896 - RNA, 17 nt, Human
caccccuguccucacug

SEQ ID NO: 3795897 - RNA, 23 nt, Human
caccccuguccucacugcucccu

SEQ ID NO: 3795898 - RNA, 13 nt, Human
caccccugucucu

SEQ ID NO: 3795899 - RNA, 22 nt, Human
caccccugugcuccgugccucc

SEQ ID NO: 3795900 - RNA, 17 nt, Human
caccccuuauccaggac

SEQ ID NO: 3795901 - RNA, 11 nt, Human
caccccuucca

SEQ ID NO: 3795902 - RNA, 15 nt, Human
caccccuuccaugug

SEQ ID NO: 3795903 - RNA, 16 nt, Human
caccccuuccaugugg

SEQ ID NO: 3795904 - RNA, 16 nt, Human
caccccuuccugggca

SEQ ID NO: 3795905 - RNA, 19 nt, Human
caccccuugcucucaaccc

SEQ ID NO: 3795906 - RNA, 21 nt, Human
cacccgacgucauguauuuga

SEQ ID NO: 3795907 - RNA, 14 nt, Human
cacccgacuccagu

SEQ ID NO: 3795908 - RNA, 12 nt, Human
cacccgaggcug

SEQ ID NO: 3795909 - RNA, 15 nt, Human
cacccgaggcugccc

SEQ ID NO: 3795910 - RNA, 13 nt, Human
cacccgaugcugc

SEQ ID NO: 3795911 - RNA, 18 nt, Human
cacccgaugcugcuuucc

SEQ ID NO: 3795912 - RNA, 19 nt, Human
cacccgaugcugcuuuccc

SEQ ID NO: 3795913 - RNA, 16 nt, Human
cacccggccccugcug

SEQ ID NO: 3795914 - RNA, 17 nt, Human
cacccggccccugcugg

SEQ ID NO: 3795915 - RNA, 21 nt, Human
cacccggcugcagaggccaga

SEQ ID NO: 3795916 - RNA, 22 nt, Human
cacccggugaccucuagcccug

SEQ ID NO: 3795917 - RNA, 16 nt, Human
cacccguguuuguaaa

SEQ ID NO: 3795918 - RNA, 20 nt, Human
cacucaagaagcaggcuaca

SEQ ID NO: 3795919 - RNA, 23 nt, Human
cacucaagaagcaggcuacacug

SEQ ID NO: 3795920 - RNA, 14 nt, Human
cacucaagcacuga

SEQ ID NO: 3795921 - RNA, 16 nt, Human
cacucaagccaagcag

SEQ ID NO: 3795922 - RNA, 11 nt, Human
cacucaaggcg

SEQ ID NO: 3795923 - RNA, 17 nt, Human
cacucaaggcggugcuu

SEQ ID NO: 3795924 - RNA, 21 nt, Human
cacucaaggcggugcuugaua

SEQ ID NO: 3795925 - RNA, 19 nt, Human
cacucaaguucaaggacca

SEQ ID NO: 3795926 - RNA, 17 nt, Human
cacucaaugcagccaga

SEQ ID NO: 3795927 - RNA, 17 nt, Human
cacucacaacagcugcc

SEQ ID NO: 3795928 - RNA, 22 nt, Human
cacucacacagccaggugccuu

SEQ ID NO: 3795929 - RNA, 23 nt, Human
cacucacagagucaaggccugcu

SEQ ID NO: 3795930 - RNA, 14 nt, Human
cacucacaugcugg

SEQ ID NO: 3795931 - RNA, 18 nt, Human
cacucaccaguguccccu

SEQ ID NO: 3795932 - RNA, 14 nt, Human
cacucaccaugaag

SEQ ID NO: 3795933 - RNA, 17 nt, Human
cacucacuaggccccca

SEQ ID NO: 3795934 - RNA, 15 nt, Human
cacucacuccugaga

SEQ ID NO: 3795935 - RNA, 17 nt, Human
cacucacugcggagaac

SEQ ID NO: 3795936 - RNA, 24 nt, Human
cacucagaaaagacgcaccagccc

SEQ ID NO: 3795937 - RNA, 13 nt, Human
cacucagaagccu

SEQ ID NO: 3795938 - RNA, 23 nt, Human
cacucagaagccugggggccugg

SEQ ID NO: 3795939 - RNA, 12 nt, Human
cacucagaccug

SEQ ID NO: 3795940 - RNA, 13 nt, Human
cacucagcacaag

SEQ ID NO: 3795941 - RNA, 14 nt, Human
cacucagcaccacu

SEQ ID NO: 3795942 - RNA, 17 nt, Human
cacucagcacuuggccc

SEQ ID NO: 3795943 - RNA, 12 nt, Human
cacucagccccu

SEQ ID NO: 3795944 - RNA, 18 nt, Human
cacucagccccuaggagu

SEQ ID NO: 3795945 - RNA, 22 nt, Human
cacucagcucuuggcuccacug

SEQ ID NO: 3795946 - RNA, 11 nt, Human
cacucagcugu

SEQ ID NO: 3795947 - RNA, 20 nt, Human
cacucaggggucacugaggc

SEQ ID NO: 3795948 - RNA, 18 nt, Human
cacucagucucucuucuc

SEQ ID NO: 3795949 - RNA, 13 nt, Human
cacucaugcugaa

SEQ ID NO: 3795950 - RNA, 18 nt, Human
cacucauucugaauuaau

SEQ ID NO: 3795951 - RNA, 22 nt, Human
cacucauugaccugaggcccuu

SEQ ID NO: 3795952 - RNA, 23 nt, Human
cacucauugcugagccucugcuc

SEQ ID NO: 3795953 - RNA, 14 nt, Human
cacucauuucaucu

SEQ ID NO: 3795954 - RNA, 22 nt, Human
cacuccaaccuaaccugugucu

SEQ ID NO: 3795955 - RNA, 23 nt, Human
cacuccaaccuaaccugugucug

SEQ ID NO: 3795956 - RNA, 19 nt, Human
cacuccaagauauggacac

SEQ ID NO: 3795957 - RNA, 13 nt, Human
cacuccaauuaag

SEQ ID NO: 3795958 - RNA, 21 nt, Human
cacuccaauuaaggauuuuau

SEQ ID NO: 3795959 - RNA, 15 nt, Human
cacuccaccacccaa

SEQ ID NO: 3795960 - RNA, 18 nt, Human
cacuccaccacccaaaag

SEQ ID NO: 3795961 - RNA, 19 nt, Human
cacuccaccacccaaaagu

SEQ ID NO: 3795962 - RNA, 16 nt, Human
cacuccagaccccugg

SEQ ID NO: 3795963 - RNA, 14 nt, Human
cacuccagccugag

SEQ ID NO: 3795964 - RNA, 15 nt, Human
cacuccagcugggau

SEQ ID NO: 3795965 - RNA, 20 nt, Human
cacuccaggaaggggcugga

SEQ ID NO: 3795966 - RNA, 13 nt, Human
cacuccagggaca

SEQ ID NO: 3795967 - RNA, 21 nt, Human
cacuccagggacacacagccu

SEQ ID NO: 3795968 - RNA, 16 nt, Human
cacuccagugagacag

SEQ ID NO: 3795969 - RNA, 22 nt, Human
cacuccaugcuuagucacugcc

SEQ ID NO: 3795970 - RNA, 15 nt, Human
cacucccacccaguc

SEQ ID NO: 3795971 - RNA, 17 nt, Human
cacucccaccugacaca

SEQ ID NO: 3795972 - RNA, 18 nt, Human
cacucccaccugcaucug

SEQ ID NO: 3795973 - RNA, 22 nt, Human
cacucccaccugcaucuggggc

SEQ ID NO: 3795974 - RNA, 12 nt, Human
cacucccagcau

SEQ ID NO: 3795975 - RNA, 15 nt, Human
cacuccccagccugg

SEQ ID NO: 3795976 - RNA, 14 nt, Human
cacuccccuagggg

SEQ ID NO: 3795977 - RNA, 22 nt, Human
cacucccgagacggcacugaga

SEQ ID NO: 3795978 - RNA, 13 nt, Human
cacucccucacaa

SEQ ID NO: 3795979 - RNA, 14 nt, Human
cacucccuccuaac

SEQ ID NO: 3795980 - RNA, 12 nt, Human
cacucccugcaa

SEQ ID NO: 3795981 - RNA, 17 nt, Human
cacucccugcaaccuga

SEQ ID NO: 3795982 - RNA, 22 nt, Human
cacucccuucccaugacccagg

SEQ ID NO: 3795983 - RNA, 18 nt, Human
cacucccuucuaccugcc

SEQ ID NO: 3795984 - RNA, 19 nt, Human
cacucccuucuaccugcca

SEQ ID NO: 3795985 - RNA, 22 nt, Human
cacucccuucuaccugccacuc

SEQ ID NO: 3795986 - RNA, 14 nt, Human
cacucccuucuccu

SEQ ID NO: 3795987 - RNA, 19 nt, Human
cacucccuugcuggcccca

SEQ ID NO: 3795988 - RNA, 20 nt, Human
cacucccuugcuggccccag

SEQ ID NO: 3795989 - RNA, 19 nt, Human
cacuccgagaggugggcca

SEQ ID NO: 3795990 - RNA, 17 nt, Human
cacuccggugugccugc

SEQ ID NO: 3795991 - RNA, 14 nt, Human
cacuccuaccuggu

SEQ ID NO: 3795992 - RNA, 21 nt, Human
cacuccuagagaacgcagccc

SEQ ID NO: 3795993 - RNA, 15 nt, Human
cacuccuccaaagga

SEQ ID NO: 3795994 - RNA, 13 nt, Human
cacuccucccucc

SEQ ID NO: 3795995 - RNA, 17 nt, Human
cacuccucccugaugua

SEQ ID NO: 3795996 - RNA, 18 nt, Human
cacuccucccugauguac

SEQ ID NO: 3795997 - RNA, 12 nt, Human
cacuccucugac

SEQ ID NO: 3795998 - RNA, 13 nt, Human
cacuccucugacu

SEQ ID NO: 3795999 - RNA, 13 nt, Human
cacuccucugcug

SEQ ID NO: 3796000 - RNA, 16 nt, Human
cacuccucugcugacc

SEQ ID NO: 3796001 - RNA, 13 nt, Human
cacuccugccaag

SEQ ID NO: 3796002 - RNA, 12 nt, Human
cacuccugcucu

SEQ ID NO: 3796003 - RNA, 11 nt, Human
cacuccugcug

SEQ ID NO: 3796004 - RNA, 12 nt, Human
cacuccugcugu

SEQ ID NO: 3796005 - RNA, 21 nt, Human
cacuccugcuuaaucuucaaa

SEQ ID NO: 3796006 - RNA, 11 nt, Human
cacuccugggg

SEQ ID NO: 3796007 - RNA, 12 nt, Human
cacuccuggggc

SEQ ID NO: 3796008 - RNA, 13 nt, Human
cacuccuguacac

SEQ ID NO: 3796009 - RNA, 11 nt, Human
cacuccuuccu

SEQ ID NO: 3796010 - RNA, 13 nt, Human
cacuccuuccugc

SEQ ID NO: 3796011 - RNA, 21 nt, Human
cacuccuuccugccaccugcu

SEQ ID NO: 3796012 - RNA, 16 nt, Human
auggugcuuaaguucc

SEQ ID NO: 3796013 - RNA, 19 nt, Human
augguggaugauccccacg

SEQ ID NO: 3796014 - RNA, 19 nt, Human
augguggcaugcaccugca

SEQ ID NO: 3796015 - RNA, 15 nt, Human
augguggcuggguug

SEQ ID NO: 3796016 - RNA, 17 nt, Human
augguggcuggguugga

SEQ ID NO: 3796017 - RNA, 18 nt, Human
augguggcuucagcucca

SEQ ID NO: 3796018 - RNA, 21 nt, Human
augguggugcaugucugcaaa

SEQ ID NO: 3796019 - RNA, 19 nt, Human
auggugguuguuucuucca

SEQ ID NO: 3796020 - RNA, 18 nt, Human
augguguacauaauguau

SEQ ID NO: 3796021 - RNA, 22 nt, Human
augguguagcccucccacuuug

SEQ ID NO: 3796022 - RNA, 18 nt, Human
auggugucucuucuuuag

SEQ ID NO: 3796023 - RNA, 20 nt, Human
auggugugaccacugcagaa

SEQ ID NO: 3796024 - RNA, 14 nt, Human
augguguuacauau

SEQ ID NO: 3796025 - RNA, 22 nt, Human
augguguucuccugcugcuccc

SEQ ID NO: 3796026 - RNA, 17 nt, Human
augguguuuuucuugua

SEQ ID NO: 3796027 - RNA, 15 nt, Human
augguuacaaucauu

SEQ ID NO: 3796028 - RNA, 20 nt, Human
augguuacaaucauugcuga

SEQ ID NO: 3796029 - RNA, 13 nt, Human
augguuacacugu

SEQ ID NO: 3796030 - RNA, 23 nt, Human
augguuacacuguuagaacacua

SEQ ID NO: 3796031 - RNA, 17 nt, Human
augguuaccaugucuuu

SEQ ID NO: 3796032 - RNA, 22 nt, Human
augguuaccaugucuuucucuc

SEQ ID NO: 3796033 - RNA, 21 nt, Human
augguuaccucugcauaaaua

SEQ ID NO: 3796034 - RNA, 14 nt, Human
augguuaugaaaga

SEQ ID NO: 3796035 - RNA, 16 nt, Human
augguuauguuuuucu

SEQ ID NO: 3796036 - RNA, 21 nt, Human
augguucagaauuaaacuuuu

SEQ ID NO: 3796037 - RNA, 19 nt, Human
augguucuggcuguuugag

SEQ ID NO: 3796038 - RNA, 14 nt, Human
augguucuucaccu

SEQ ID NO: 3796039 - RNA, 19 nt, Human
augguugagaaaugaauaa

SEQ ID NO: 3796040 - RNA, 14 nt, Human
augguuguauuaga

SEQ ID NO: 3796041 - RNA, 14 nt, Human
augguuuaaaagaa

SEQ ID NO: 3796042 - RNA, 16 nt, Human
augguuuaacaaaaug

SEQ ID NO: 3796043 - RNA, 21 nt, Human
augguuuacauccuucacugc

SEQ ID NO: 3796044 - RNA, 21 nt, Human
augguuuauuuuguauugugg

SEQ ID NO: 3796045 - RNA, 13 nt, Human
augguuucagcac

SEQ ID NO: 3796046 - RNA, 15 nt, Human
augguuucuugcaag

SEQ ID NO: 3796047 - RNA, 21 nt, Human
augguuugaauauaaacacua

SEQ ID NO: 3796048 - RNA, 16 nt, Human
augguuugcaaggaag

SEQ ID NO: 3796049 - RNA, 14 nt, Human
augguuuggagcug

SEQ ID NO: 3796050 - RNA, 14 nt, Human
augguuuuaaacuu

SEQ ID NO: 3796051 - RNA, 14 nt, Human
augguuuucaaaau

SEQ ID NO: 3796052 - RNA, 16 nt, Human
augguuuucaaaauaa

SEQ ID NO: 3796053 - RNA, 21 nt, Human
augguuuuuaaauuuuguaau

SEQ ID NO: 3796054 - RNA, 18 nt, Human
augguuuuugagauauua

SEQ ID NO: 3796055 - RNA, 13 nt, Human
auguaaaaaagaa

SEQ ID NO: 3796056 - RNA, 13 nt, Human
auguaaaacauuu

SEQ ID NO: 3796057 - RNA, 17 nt, Human
auguaaaagaaaaucca

SEQ ID NO: 3796058 - RNA, 19 nt, Human
auguaaaagaacuuacuga

SEQ ID NO: 3796059 - RNA, 17 nt, Human
auguaaaagacuuuuuu

SEQ ID NO: 3796060 - RNA, 21 nt, Human
auguaaaagagucaucuggua

SEQ ID NO: 3796061 - RNA, 15 nt, Human
auguaaaaggccaaa

SEQ ID NO: 3796062 - RNA, 18 nt, Human
auguaaaaggccaaaccu

SEQ ID NO: 3796063 - RNA, 21 nt, Human
auguaaaaucuugucaugugu

SEQ ID NO: 3796064 - RNA, 15 nt, Human
augugugaggagcug

SEQ ID NO: 3796065 - RNA, 19 nt, Human
augugugaggagcugcugg

SEQ ID NO: 3796066 - RNA, 16 nt, Human
augugugagugcaugu

SEQ ID NO: 3796067 - RNA, 17 nt, Human
augugugagugugugca

SEQ ID NO: 3796068 - RNA, 21 nt, Human
augugugauucaaugccucug

SEQ ID NO: 3796069 - RNA, 20 nt, Human
augugugcauguguguauaa

SEQ ID NO: 3796070 - RNA, 13 nt, Human
augugugcccagc

SEQ ID NO: 3796071 - RNA, 16 nt, Human
augugugguggccuca

SEQ ID NO: 3796072 - RNA, 17 nt, Human
auguguguaagugugug

SEQ ID NO: 3796073 - RNA, 23 nt, Human
auguguguauaagugcacacaga

SEQ ID NO: 3796074 - RNA, 13 nt, Human
auguguguaugug

SEQ ID NO: 3796075 - RNA, 14 nt, Human
auguguguaugugu

SEQ ID NO: 3796076 - RNA, 11 nt, Human
augugugugca

SEQ ID NO: 3796077 - RNA, 10 nt, Human
augugugugu

SEQ ID NO: 3796078 - RNA, 12 nt, Human
auguguguguau

SEQ ID NO: 3796079 - RNA, 13 nt, Human
auguguguguaug

SEQ ID NO: 3796080 - RNA, 12 nt, Human
augugugugugu

SEQ ID NO: 3796081 - RNA, 16 nt, Human
auguguguguguguau

SEQ ID NO: 3796082 - RNA, 18 nt, Human
auguguguugauacuguu

SEQ ID NO: 3796083 - RNA, 20 nt, Human
auguguguugauacuguugc

SEQ ID NO: 3796084 - RNA, 16 nt, Human
auguguguuuugcuaa

SEQ ID NO: 3796085 - RNA, 23 nt, Human
auguguguuuugcuaaaggaaaa

SEQ ID NO: 3796086 - RNA, 14 nt, Human
auguguuaaucuua

SEQ ID NO: 3796087 - RNA, 17 nt, Human
auguguuaaucuuaaug

SEQ ID NO: 3796088 - RNA, 22 nt, Human
auguguucccuuugucuuucaa

SEQ ID NO: 3796089 - RNA, 14 nt, Human
auguguugaaaaaa

SEQ ID NO: 3796090 - RNA, 14 nt, Human
auguguugaaaacc

SEQ ID NO: 3796091 - RNA, 16 nt, Human
auguguugaaaaccaa

SEQ ID NO: 3796092 - RNA, 22 nt, Human
auguguugaaaaccaaaaugac

SEQ ID NO: 3796093 - RNA, 14 nt, Human
auguguugaaacug

SEQ ID NO: 3796094 - RNA, 14 nt, Human
auguguugugauag

SEQ ID NO: 3796095 - RNA, 15 nt, Human
auguguuuacuuuaa

SEQ ID NO: 3796096 - RNA, 12 nt, Human
auguguuuagaa

SEQ ID NO: 3796097 - RNA, 17 nt, Human
auguguuuagaauugaa

SEQ ID NO: 3796098 - RNA, 18 nt, Human
auguguuuaugugagcug

SEQ ID NO: 3796099 - RNA, 18 nt, Human
auguguuucacaguuuga

SEQ ID NO: 3796100 - RNA, 21 nt, Human
auguguuucacaguuugaaau

SEQ ID NO: 3796101 - RNA, 23 nt, Human
auguguuucacaguuugaaauaa

SEQ ID NO: 3796102 - RNA, 15 nt, Human
auguguuugcuuucu

SEQ ID NO: 3796103 - RNA, 16 nt, Human
auguguuugcuuucug

SEQ ID NO: 3796104 - RNA, 18 nt, Human
auguguuugguucugggg

SEQ ID NO: 3796105 - RNA, 16 nt, Human
auguguuugugugugu

SEQ ID NO: 3796106 - RNA, 14 nt, Human
auguguuuuagagu

SEQ ID NO: 3796107 - RNA, 21 nt, Human
auguuaaaaaaauaagaagaa

SEQ ID NO: 3796108 - RNA, 22 nt, Human
auguuaaaaaaauaagaagaau

SEQ ID NO: 3796109 - RNA, 14 nt, Human
auguuaaaauaaau

SEQ ID NO: 3796110 - RNA, 12 nt, Human
auguuaaaaugu

SEQ ID NO: 3796111 - RNA, 15 nt, Human
auguuaaaauguguu

SEQ ID NO: 3796112 - RNA, 12 nt, Human
auguuaaaccau

SEQ ID NO: 3796113 - RNA, 13 nt, Human
auguuaaaccaug

SEQ ID NO: 3796114 - RNA, 20 nt, Human
auguuaaaccaugggauaaa

SEQ ID NO: 3796115 - RNA, 21 nt, Human
auguuaaacuagcauaucugc

SEQ ID NO: 3796116 - RNA, 21 nt, Human
auguuaaacuuacuuaguguu

SEQ ID NO: 3796117 - RNA, 18 nt, Human
auguuaaagagaaugagu

SEQ ID NO: 3796118 - RNA, 18 nt, Human
auguuaaauaaauuguau

SEQ ID NO: 3796119 - RNA, 24 nt, Human
auguuaaauaggcggggcuugccu

SEQ ID NO: 3796120 - RNA, 23 nt, Human
auguuaaauuuguaaguuucagg

SEQ ID NO: 3796121 - RNA, 20 nt, Human
auguuaacacauuuuguaua

SEQ ID NO: 3796122 - RNA, 21 nt, Human
auguuaacacauuuuguauaa

SEQ ID NO: 3796123 - RNA, 23 nt, Human
auguuaaccagaauaaaguucug

SEQ ID NO: 3796124 - RNA, 23 nt, Human
auguuaacugacaagcuccauuu

SEQ ID NO: 3796125 - RNA, 20 nt, Human
auguuaagacuugacagugg

SEQ ID NO: 3796126 - RNA, 13 nt, Human
auguuaagcagau

SEQ ID NO: 3796127 - RNA, 17 nt, Human
auguuaaggaaacucuu

SEQ ID NO: 3796128 - RNA, 19 nt, Human
auguuaaguccucccugac

SEQ ID NO: 3796129 - RNA, 15 nt, Human
auguuaaguuacuuc

SEQ ID NO: 3796130 - RNA, 14 nt, Human
auguuaaguuauau

SEQ ID NO: 3796131 - RNA, 19 nt, Human
auguuaaguugauggugau

SEQ ID NO: 3796132 - RNA, 15 nt, Human
auguuaauauugauu

SEQ ID NO: 3796133 - RNA, 13 nt, Human
auguuaauauuuc

SEQ ID NO: 3796134 - RNA, 17 nt, Human
auguuacaaguuuauau

SEQ ID NO: 3796135 - RNA, 20 nt, Human
auguuacaaguuuauauaua

SEQ ID NO: 3796136 - RNA, 19 nt, Human
auguuacauaagauaaaug

SEQ ID NO: 3796137 - RNA, 23 nt, Human
auguuacauaguguaggcuuuac

SEQ ID NO: 3796138 - RNA, 14 nt, Human
auguuacauuauua

SEQ ID NO: 3796139 - RNA, 14 nt, Human
auguuaccucugaa

SEQ ID NO: 3796140 - RNA, 17 nt, Human
auguuacuacaugcacu

SEQ ID NO: 3796141 - RNA, 13 nt, Human
auguuacugauca

SEQ ID NO: 3796142 - RNA, 20 nt, Human
auguuagcuccaaagcauuu

SEQ ID NO: 3796143 - RNA, 16 nt, Human
auguuagggugcucug

SEQ ID NO: 3796144 - RNA, 22 nt, Human
auguuaguuaccuuauaguuac

SEQ ID NO: 3796145 - RNA, 15 nt, Human
auguuaguuucuugg

SEQ ID NO: 3796146 - RNA, 14 nt, Human
auguuauagaacuu

SEQ ID NO: 3796147 - RNA, 14 nt, Human
auguuauagcugca

SEQ ID NO: 3796148 - RNA, 14 nt, Human
auguuauagugaau

SEQ ID NO: 3796149 - RNA, 15 nt, Human
auguuauauauaaau

SEQ ID NO: 3796150 - RNA, 19 nt, Human
auguuauaucauauguaua

SEQ ID NO: 3796151 - RNA, 20 nt, Human
auguuauauuuuucuuaaaa

SEQ ID NO: 3796152 - RNA, 21 nt, Human
auguuaucuuauacuguacaa

SEQ ID NO: 3796153 - RNA, 15 nt, Human
auguuaucuucucaa

SEQ ID NO: 3796154 - RNA, 17 nt, Human
auguuaucuucucaagu

SEQ ID NO: 3796155 - RNA, 21 nt, Human
auguuaucuucucaaguucua

SEQ ID NO: 3796156 - RNA, 21 nt, Human
auguuaugauaaaaaauuuug

SEQ ID NO: 3796157 - RNA, 12 nt, Human
auguuauguaua

SEQ ID NO: 3796158 - RNA, 18 nt, Human
auguuauuuauauauugg

SEQ ID NO: 3796159 - RNA, 20 nt, Human
auguuauuuauauauuggua

SEQ ID NO: 3796160 - RNA, 12 nt, Human
auguuauuuccc

SEQ ID NO: 3796161 - RNA, 17 nt, Human
auguuauuucugcaaac

SEQ ID NO: 3796162 - RNA, 15 nt, Human
auguuauuuguaaua

SEQ ID NO: 3796163 - RNA, 17 nt, Human
auguucaaagccacauu

SEQ ID NO: 3796164 - RNA, 22 nt, Human
auguucaacuggagacacuauu

SEQ ID NO: 3796165 - RNA, 12 nt, Human
auguucaauuau

SEQ ID NO: 3796166 - RNA, 19 nt, Human
auguucacgcaacuugaaa

SEQ ID NO: 3796167 - RNA, 14 nt, Human
auguucacuuuuga

SEQ ID NO: 3796168 - RNA, 18 nt, Human
auguucacuuuugacaaa

SEQ ID NO: 3796169 - RNA, 20 nt, Human
auguucacuuuugacaaagg

SEQ ID NO: 3796170 - RNA, 20 nt, Human
auguucagauugcuuugauu

SEQ ID NO: 3796171 - RNA, 16 nt, Human
auguucagcacugucc

SEQ ID NO: 3796172 - RNA, 22 nt, Human
auguucagcacugucccuugcc

SEQ ID NO: 3796173 - RNA, 18 nt, Human
auguucaguguaauuucu

SEQ ID NO: 3796174 - RNA, 11 nt, Human
auguucauuua

SEQ ID NO: 3796175 - RNA, 18 nt, Human
auguucauuuguuuguuu

SEQ ID NO: 3796176 - RNA, 18 nt, Human
auguuccaauaaacagga

SEQ ID NO: 3796177 - RNA, 14 nt, Human
auguuccacuaacc

SEQ ID NO: 3796178 - RNA, 14 nt, Human
auguucccuucucc

SEQ ID NO: 3796179 - RNA, 16 nt, Human
auguuccucaaagcuu

SEQ ID NO: 3796180 - RNA, 20 nt, Human
auguuccuucaagaucaugu

SEQ ID NO: 3796181 - RNA, 15 nt, Human
auguucggguguggg

SEQ ID NO: 3796182 - RNA, 15 nt, Human
auguucuaaggcucu

SEQ ID NO: 3796183 - RNA, 17 nt, Human
auguucuaaggcucuga

SEQ ID NO: 3796184 - RNA, 19 nt, Human
auguucuaaggcucugaga

SEQ ID NO: 3796185 - RNA, 21 nt, Human
auguucuagucugcuuuggua

SEQ ID NO: 3796186 - RNA, 14 nt, Human
auguucuauugugg

SEQ ID NO: 3796187 - RNA, 17 nt, Human
auguucucugaggacac

SEQ ID NO: 3796188 - RNA, 18 nt, Human
auguucugacauuaacag

SEQ ID NO: 3796189 - RNA, 20 nt, Human
auguucugacauuaacaguu

SEQ ID NO: 3796190 - RNA, 22 nt, Human
auguucugacccugcuucaaau

SEQ ID NO: 3796191 - RNA, 12 nt, Human
auguucugcccc

SEQ ID NO: 3796192 - RNA, 17 nt, Human
auguucugcccccagcc

SEQ ID NO: 3796193 - RNA, 12 nt, Human
auguucugggac

SEQ ID NO: 3796194 - RNA, 13 nt, Human
auguucugggaca

SEQ ID NO: 3796195 - RNA, 13 nt, Human
auguucugucccu

SEQ ID NO: 3796196 - RNA, 23 nt, Human
auguucugucccuugccccccug

SEQ ID NO: 3796197 - RNA, 18 nt, Human
auguucugugauacagaa

SEQ ID NO: 3796198 - RNA, 16 nt, Human
auguucuguuugcugu

SEQ ID NO: 3796199 - RNA, 13 nt, Human
auguucuuccagu

SEQ ID NO: 3796200 - RNA, 16 nt, Human
auguucuuuauauaca

SEQ ID NO: 3796201 - RNA, 22 nt, Human
auguucuuuauauacaauaaug

SEQ ID NO: 3796202 - RNA, 19 nt, Human
auguucuuuggaaaguaca

SEQ ID NO: 3796203 - RNA, 16 nt, Human
auguugaaaagucaaa

SEQ ID NO: 3796204 - RNA, 19 nt, Human
auguugaaaagucaaacug

SEQ ID NO: 3796205 - RNA, 19 nt, Human
auguugaacaaaauaaauu

SEQ ID NO: 3796206 - RNA, 19 nt, Human
auguugacauaccuuuuau

SEQ ID NO: 3796207 - RNA, 12 nt, Human
auguugacauuu

SEQ ID NO: 3796208 - RNA, 13 nt, Human
auguugacauuug

SEQ ID NO: 3796209 - RNA, 16 nt, Human
auguugagaaucccaa

SEQ ID NO: 3796210 - RNA, 18 nt, Human
cacugagcacuguuuucu

SEQ ID NO: 3796211 - RNA, 19 nt, Human
cacugagcacuguuuucua

SEQ ID NO: 3796212 - RNA, 22 nt, Human
cacugagcacuguuuucuagug

SEQ ID NO: 3796213 - RNA, 14 nt, Human
cacugagccccccc

SEQ ID NO: 3796214 - RNA, 13 nt, Human
cacugaggcaggg

SEQ ID NO: 3796215 - RNA, 17 nt, Human
cacugaggcagggaagu

SEQ ID NO: 3796216 - RNA, 16 nt, Human
cacugaggccugagac

SEQ ID NO: 3796217 - RNA, 19 nt, Human
cacugaggccugagaccca

SEQ ID NO: 3796218 - RNA, 21 nt, Human
cacugaggccugagacccagg

SEQ ID NO: 3796219 - RNA, 23 nt, Human
cacugaggccugagacccaggac

SEQ ID NO: 3796220 - RNA, 10 nt, Human
cacugagggc

SEQ ID NO: 3796221 - RNA, 13 nt, Human
cacugagggccac

SEQ ID NO: 3796222 - RNA, 15 nt, Human
cacugaguuuuccau

SEQ ID NO: 3796223 - RNA, 20 nt, Human
cacugauauaucaugaguga

SEQ ID NO: 3796224 - RNA, 19 nt, Human
cacugauauuuuaccucuu

SEQ ID NO: 3796225 - RNA, 22 nt, Human
cacugauauuuuaccucuuauu

SEQ ID NO: 3796226 - RNA, 15 nt, Human
cacugauccagcccu

SEQ ID NO: 3796227 - RNA, 17 nt, Human
cacugaugcugccccuc

SEQ ID NO: 3796228 - RNA, 16 nt, Human
cacugaugcuuagaug

SEQ ID NO: 3796229 - RNA, 19 nt, Human
cacugauuucacaacagau

SEQ ID NO: 3796230 - RNA, 21 nt, Human
cacugauuucacaacagauca

SEQ ID NO: 3796231 - RNA, 23 nt, Human
cacugauuugacauagucuggcu

SEQ ID NO: 3796232 - RNA, 14 nt, Human
cacugauuuggaga

SEQ ID NO: 3796233 - RNA, 13 nt, Human
cacugcaaccucc

SEQ ID NO: 3796234 - RNA, 19 nt, Human
cacugcaaccuccaccucg

SEQ ID NO: 3796235 - RNA, 23 nt, Human
cacugcaaccuccgccucuuggg

SEQ ID NO: 3796236 - RNA, 20 nt, Human
auguugcucagucucccuuu

SEQ ID NO: 3796237 - RNA, 20 nt, Human
auguugcugaaaaaugggca

SEQ ID NO: 3796238 - RNA, 16 nt, Human
auguuggauaaggaau

SEQ ID NO: 3796239 - RNA, 17 nt, Human
auguuggauaaggaauu

SEQ ID NO: 3796240 - RNA, 20 nt, Human
auguuggauuuauaaaugcu

SEQ ID NO: 3796241 - RNA, 17 nt, Human
auguuggccaggcuggu

SEQ ID NO: 3796242 - RNA, 21 nt, Human
auguuggccaggcuggucuaa

SEQ ID NO: 3796243 - RNA, 12 nt, Human
auguugggacug

SEQ ID NO: 3796244 - RNA, 15 nt, Human
auguugguugcacuu

SEQ ID NO: 3796245 - RNA, 16 nt, Human
auguugguugcacuuu

SEQ ID NO: 3796246 - RNA, 19 nt, Human
auguugguugcacuuugua

SEQ ID NO: 3796247 - RNA, 20 nt, Human
auguugguugcacuuuguag

SEQ ID NO: 3796248 - RNA, 18 nt, Human
auguugguuuacuuucaa

SEQ ID NO: 3796249 - RNA, 18 nt, Human
auguuguaaacaggaagc

SEQ ID NO: 3796250 - RNA, 14 nt, Human
auguuguaauauuu

SEQ ID NO: 3796251 - RNA, 14 nt, Human
auguuguaaugcug

SEQ ID NO: 3796252 - RNA, 18 nt, Human
auguuguaaugcugcacu

SEQ ID NO: 3796253 - RNA, 14 nt, Human
auguugucaaagag

SEQ ID NO: 3796254 - RNA, 14 nt, Human
auguugucuaagaa

SEQ ID NO: 3796255 - RNA, 17 nt, Human
auguugucuaagaaauu

SEQ ID NO: 3796256 - RNA, 14 nt, Human
auguugugaagaug

SEQ ID NO: 3796257 - RNA, 17 nt, Human
auguugugaauaauuac

SEQ ID NO: 3796258 - RNA, 16 nt, Human
auguugugguuuguug

SEQ ID NO: 3796259 - RNA, 17 nt, Human
auguuguuaugcuauua

SEQ ID NO: 3796260 - RNA, 13 nt, Human
auguuguuauuua

SEQ ID NO: 3796261 - RNA, 15 nt, Human
auguuguuauuuaaa

SEQ ID NO: 3796262 - RNA, 14 nt, Human
auguuguugaaagg

SEQ ID NO: 3796263 - RNA, 16 nt, Human
auguuguuuauaauaa

SEQ ID NO: 3796264 - RNA, 20 nt, Human
auguuguuuauaauaaaaau

SEQ ID NO: 3796265 - RNA, 22 nt, Human
auguuguuuauaauaaaaauau

SEQ ID NO: 3796266 - RNA, 19 nt, Human
auguuguuuuguacagaug

SEQ ID NO: 3796267 - RNA, 14 nt, Human
auguuuaaaacauc

SEQ ID NO: 3796268 - RNA, 20 nt, Human
auguuuaaaauuucuuagaa

SEQ ID NO: 3796269 - RNA, 14 nt, Human
auguuuaaacauuu

SEQ ID NO: 3796270 - RNA, 17 nt, Human
auguuuaacuuaaucaa

SEQ ID NO: 3796271 - RNA, 14 nt, Human
auguuuaagauuua

SEQ ID NO: 3796272 - RNA, 14 nt, Human
auguuuaaucauau

SEQ ID NO: 3796273 - RNA, 17 nt, Human
auguuuaaucuguuaug

SEQ ID NO: 3796274 - RNA, 19 nt, Human
auguuuacagaggacagua

SEQ ID NO: 3796275 - RNA, 19 nt, Human
auguuuagacuuuaacaua

SEQ ID NO: 3796276 - RNA, 21 nt, Human
auguuuagacuuuaacauaag

SEQ ID NO: 3796277 - RNA, 21 nt, Human
auguuuagauagggcugggca

SEQ ID NO: 3796278 - RNA, 14 nt, Human
auguuuaguaaacu

SEQ ID NO: 3796279 - RNA, 19 nt, Human
auguuuauaacuauucagu

SEQ ID NO: 3796280 - RNA, 23 nt, Human
auguuuauaucugcaaaaaaccu

SEQ ID NO: 3796281 - RNA, 20 nt, Human
auguuuaugcaaggaaggaa

SEQ ID NO: 3796282 - RNA, 13 nt, Human
auguuuauuaaau

SEQ ID NO: 3796283 - RNA, 17 nt, Human
auguuuauuaaaugcuu

SEQ ID NO: 3796284 - RNA, 18 nt, Human
auguuuauucuucuagag

SEQ ID NO: 3796285 - RNA, 21 nt, Human
auguuuauucuucuagaguuc

SEQ ID NO: 3796286 - RNA, 20 nt, Human
auguuuauuuaaaagagcag

SEQ ID NO: 3796287 - RNA, 13 nt, Human
auguuuauuuaua

SEQ ID NO: 3796288 - RNA, 13 nt, Human
auguuucaaacuu

SEQ ID NO: 3796289 - RNA, 14 nt, Human
auguuucaaacuuu

SEQ ID NO: 3796290 - RNA, 16 nt, Human
auguuucacacaaaca

SEQ ID NO: 3796291 - RNA, 22 nt, Human
auguuucauguuuugugacuau

SEQ ID NO: 3796292 - RNA, 24 nt, Human
auguuuccagcagaagacaaaaag

SEQ ID NO: 3796293 - RNA, 15 nt, Human
auguuuccagcauuc

SEQ ID NO: 3796294 - RNA, 16 nt, Human
auguuuccagcauucc

SEQ ID NO: 3796295 - RNA, 24 nt, Human
auguuucucuuugauuauuugcau

SEQ ID NO: 3796296 - RNA, 12 nt, Human
auguuucuggau

SEQ ID NO: 3796297 - RNA, 21 nt, Human
auguuucuuugaucaugaaua

SEQ ID NO: 3796298 - RNA, 18 nt, Human
auguuucuuuguaaugaa

SEQ ID NO: 3796299 - RNA, 18 nt, Human
auguuucuuuuguaugua

SEQ ID NO: 3796300 - RNA, 11 nt, Human
auguuugaaua

SEQ ID NO: 3796301 - RNA, 21 nt, Human
auguuugaauauggacaagag

SEQ ID NO: 3796302 - RNA, 23 nt, Human
auguuugagcaguggccuacaaa

SEQ ID NO: 3796303 - RNA, 19 nt, Human
auguuugcaccuuucuagu

SEQ ID NO: 3796304 - RNA, 13 nt, Human
auguuugcagggg

SEQ ID NO: 3796305 - RNA, 22 nt, Human
auguuugccucugccucugaca

SEQ ID NO: 3796306 - RNA, 16 nt, Human
auguuugcuauugaca

SEQ ID NO: 3796307 - RNA, 22 nt, Human
auguuugcucagaacacauucu

SEQ ID NO: 3796308 - RNA, 20 nt, Human
auguuugcugaacauuggag

SEQ ID NO: 3796309 - RNA, 15 nt, Human
auguuuggcucugcu

SEQ ID NO: 3796310 - RNA, 23 nt, Human
auguuugggcagaagggagaagg

SEQ ID NO: 3796311 - RNA, 12 nt, Human
auguuugggguc

SEQ ID NO: 3796312 - RNA, 13 nt, Human
auguuugguaaga

SEQ ID NO: 3796313 - RNA, 19 nt, Human
auguuuggugcauagaacu

SEQ ID NO: 3796314 - RNA, 21 nt, Human
auguuuggugcauagaacugg

SEQ ID NO: 3796315 - RNA, 14 nt, Human
auguuuguaaaacu

SEQ ID NO: 3796316 - RNA, 21 nt, Human
auguuugucucaguuggaaau

SEQ ID NO: 3796317 - RNA, 17 nt, Human
auguuugugcaguaacu

SEQ ID NO: 3796318 - RNA, 13 nt, Human
auguuuguggccu

SEQ ID NO: 3796319 - RNA, 14 nt, Human
auguuuguggccuc

SEQ ID NO: 3796320 - RNA, 12 nt, Human
auguuuuaaaga

SEQ ID NO: 3796321 - RNA, 15 nt, Human
auguuuuaaauguac

SEQ ID NO: 3796322 - RNA, 18 nt, Human
auguuuuaagaggcaggg

SEQ ID NO: 3796323 - RNA, 15 nt, Human
auguuuuaaggcuuc

SEQ ID NO: 3796324 - RNA, 15 nt, Human
auguuuuaauuccau

SEQ ID NO: 3796325 - RNA, 17 nt, Human
auguuuuaauuccauga

SEQ ID NO: 3796326 - RNA, 18 nt, Human
auguuuuaauuccaugaa

SEQ ID NO: 3796327 - RNA, 14 nt, Human
auguuuuacacugu

SEQ ID NO: 3796328 - RNA, 20 nt, Human
auguuuuaccguaauaauua

SEQ ID NO: 3796329 - RNA, 19 nt, Human
auguuuuagacaaauacuc

SEQ ID NO: 3796330 - RNA, 22 nt, Human
auguuuuagacaaauacucaug

SEQ ID NO: 3796331 - RNA, 17 nt, Human
auguuuuagcacagcgu

SEQ ID NO: 3796332 - RNA, 16 nt, Human
auguuuuauaaguuca

SEQ ID NO: 3796333 - RNA, 22 nt, Human
auguuuuaucguccagugacuu

SEQ ID NO: 3796334 - RNA, 18 nt, Human
auguuuuauuauuucuau

SEQ ID NO: 3796335 - RNA, 20 nt, Human
auguuuuauuauuucuauua

SEQ ID NO: 3796336 - RNA, 12 nt, Human
auguuuucagcu

SEQ ID NO: 3796337 - RNA, 17 nt, Human
auguuuucaggcuagau

SEQ ID NO: 3796338 - RNA, 18 nt, Human
auguuuuccagcuccuca

SEQ ID NO: 3796339 - RNA, 16 nt, Human
auguuuuccauuguuu

SEQ ID NO: 3796340 - RNA, 22 nt, Human
auguuuucgaaaaucaaauggu

SEQ ID NO: 3796341 - RNA, 18 nt, Human
auguuuucugaaaauaua

SEQ ID NO: 3796342 - RNA, 16 nt, Human
auguuuucuuugcaaa

SEQ ID NO: 3796343 - RNA, 21 nt, Human
auguuuucuuugcaaaguauu

SEQ ID NO: 3796344 - RNA, 18 nt, Human
auguuuucuuugcuuuaa

SEQ ID NO: 3796345 - RNA, 16 nt, Human
auguuuugacauuuuu

SEQ ID NO: 3796346 - RNA, 22 nt, Human
auguuuugguagauuaaauaua

SEQ ID NO: 3796347 - RNA, 15 nt, Human
auguuuugguaucug

SEQ ID NO: 3796348 - RNA, 23 nt, Human
auguuuugguaucuguucuuuaa

SEQ ID NO: 3796349 - RNA, 19 nt, Human
auguuuuguaaacauuuau

SEQ ID NO: 3796350 - RNA, 15 nt, Human
auguuuuguaaacuu

SEQ ID NO: 3796351 - RNA, 16 nt, Human
auguuuuguaaacuuu

SEQ ID NO: 3796352 - RNA, 18 nt, Human
auguuuuguaaacuuuga

SEQ ID NO: 3796353 - RNA, 20 nt, Human
auguuuuguaaacuuugaaa

SEQ ID NO: 3796354 - RNA, 21 nt, Human
caaagccuguucauggcagau

SEQ ID NO: 3796355 - RNA, 12 nt, Human
caaagccuucau

SEQ ID NO: 3796356 - RNA, 16 nt, Human
caaagccuucucccua

SEQ ID NO: 3796357 - RNA, 17 nt, Human
caaagccuugugucuac

SEQ ID NO: 3796358 - RNA, 19 nt, Human
caaagcgaauuuuaaaaga

SEQ ID NO: 3796359 - RNA, 14 nt, Human
caaagcuaggccug

SEQ ID NO: 3796360 - RNA, 16 nt, Human
caaagcuaggccuggc

SEQ ID NO: 3796361 - RNA, 18 nt, Human
caaagcuaggccuggcca

SEQ ID NO: 3796362 - RNA, 20 nt, Human
caaagcugacgaggcugggc

SEQ ID NO: 3796363 - RNA, 12 nt, Human
caaagcugagcc

SEQ ID NO: 3796364 - RNA, 14 nt, Human
caaagcugcccacu

SEQ ID NO: 3796365 - RNA, 23 nt, Human
caaagcugcuaaaucuccuauuu

SEQ ID NO: 3796366 - RNA, 17 nt, Human
caaagcuggcucaccuu

SEQ ID NO: 3796367 - RNA, 20 nt, Human
caaagcuguuaaacuguuag

SEQ ID NO: 3796368 - RNA, 22 nt, Human
caaagcuguuaaacuguuagca

SEQ ID NO: 3796369 - RNA, 22 nt, Human
caaagcuuagcaggagaggaga

SEQ ID NO: 3796370 - RNA, 15 nt, Human
caaagcuuccauucc

SEQ ID NO: 3796371 - RNA, 21 nt, Human
caaagcuucuaucccaggagg

SEQ ID NO: 3796372 - RNA, 14 nt, Human
caaagcuugaagau

SEQ ID NO: 3796373 - RNA, 22 nt, Human
caaagcuuggaagagccugcag

SEQ ID NO: 3796374 - RNA, 16 nt, Human
caaagcuuuccugccc

SEQ ID NO: 3796375 - RNA, 23 nt, Human
caaagcuuuccugccccaggccu

SEQ ID NO: 3796376 - RNA, 17 nt, Human
caaagcuuucuuuguuu

SEQ ID NO: 3796377 - RNA, 20 nt, Human
caaagcuuuuagaaauacug

SEQ ID NO: 3796378 - RNA, 12 nt, Human
caaaggaagcac

SEQ ID NO: 3796379 - RNA, 14 nt, Human
caaaggaagcacau

SEQ ID NO: 3796380 - RNA, 20 nt, Human
caaaggaagcuuucucugcu

SEQ ID NO: 3796381 - RNA, 21 nt, Human
caaaggaaggacccugaggcc

SEQ ID NO: 3796382 - RNA, 17 nt, Human
caaaggaagguggaugg

SEQ ID NO: 3796383 - RNA, 20 nt, Human
caaaggaagugcccccuccc

SEQ ID NO: 3796384 - RNA, 19 nt, Human
caaaggaaucuccaguuuu

SEQ ID NO: 3796385 - RNA, 22 nt, Human
caaaggaaucuccaguuuucag

SEQ ID NO: 3796386 - RNA, 14 nt, Human
caaaggagauugga

SEQ ID NO: 3796387 - RNA, 11 nt, Human
caaaggagccu

SEQ ID NO: 3796388 - RNA, 15 nt, Human
caaaggagccuguga

SEQ ID NO: 3796389 - RNA, 17 nt, Human
caaaggagcucgaagga

SEQ ID NO: 3796390 - RNA, 17 nt, Human
caaaggaggcuggcagg

SEQ ID NO: 3796391 - RNA, 20 nt, Human
caaaggagggucaggaagga

SEQ ID NO: 3796392 - RNA, 14 nt, Human
caaaggaugugaua

SEQ ID NO: 3796393 - RNA, 19 nt, Human
caaaggauuaauugcugca

SEQ ID NO: 3796394 - RNA, 20 nt, Human
caaaggcaaguuaagagaaa

SEQ ID NO: 3796395 - RNA, 14 nt, Human
caaaggccaaacug

SEQ ID NO: 3796396 - RNA, 19 nt, Human
caaaggccagaccugcaga

SEQ ID NO: 3796397 - RNA, 13 nt, Human
caaaggccagggu

SEQ ID NO: 3796398 - RNA, 17 nt, Human
caaaggccccagcaucu

SEQ ID NO: 3796399 - RNA, 13 nt, Human
caaaggcugggac

SEQ ID NO: 3796400 - RNA, 18 nt, Human
caaaggcuguauucagca

SEQ ID NO: 3796401 - RNA, 19 nt, Human
caaaggcuguauucagcaa

SEQ ID NO: 3796402 - RNA, 17 nt, Human
caaagggaaauaucauu

SEQ ID NO: 3796403 - RNA, 18 nt, Human
caaagggaaauaucauuu

SEQ ID NO: 3796404 - RNA, 14 nt, Human
caaagggagagaga

SEQ ID NO: 3796405 - RNA, 15 nt, Human
caaagggagcagaac

SEQ ID NO: 3796406 - RNA, 18 nt, Human
caaagggagucugccagg

SEQ ID NO: 3796407 - RNA, 20 nt, Human
caaagggcacagcaucugua

SEQ ID NO: 3796408 - RNA, 23 nt, Human
caaagggcacagcaucuguaguc

SEQ ID NO: 3796409 - RNA, 20 nt, Human
caaagggccugcccagacaa

SEQ ID NO: 3796410 - RNA, 14 nt, Human
caaagggcugaaag

SEQ ID NO: 3796411 - RNA, 15 nt, Human
caaaggggacaggcc

SEQ ID NO: 3796412 - RNA, 18 nt, Human
caaaggggacaggccuca

SEQ ID NO: 3796413 - RNA, 23 nt, Human
caaaggggaucauaaaguuagaa

SEQ ID NO: 3796414 - RNA, 22 nt, Human
caaagggggaggcuaaagccca

SEQ ID NO: 3796415 - RNA, 24 nt, Human
caaaggguacuuccacugauggaa

SEQ ID NO: 3796416 - RNA, 23 nt, Human
caaaggguaucaggugcugccau

SEQ ID NO: 3796417 - RNA, 16 nt, Human
caaaggguccagaagg

SEQ ID NO: 3796418 - RNA, 20 nt, Human
caaagggugaagcuauuuau

SEQ ID NO: 3796419 - RNA, 18 nt, Human
caaaggguuuuaauguag

SEQ ID NO: 3796420 - RNA, 13 nt, Human
caaaggucuuuuu

SEQ ID NO: 3796421 - RNA, 20 nt, Human
caaaggucuuuuuaaaccag

SEQ ID NO: 3796422 - RNA, 14 nt, Human
caaagguggcucuc

SEQ ID NO: 3796423 - RNA, 21 nt, Human
caaagguucuagguuucaaag

SEQ ID NO: 3796424 - RNA, 22 nt, Human
caaagguucuagguuucaaaga

SEQ ID NO: 3796425 - RNA, 16 nt, Human
caaagguuuaaaugaa

SEQ ID NO: 3796426 - RNA, 16 nt, Human
caaagguuuggaagga

SEQ ID NO: 3796427 - RNA, 17 nt, Human
caaagguuuggaaggag

SEQ ID NO: 3796428 - RNA, 21 nt, Human
caaagguuuggaaggagcaga

SEQ ID NO: 3796429 - RNA, 14 nt, Human
caaaguaaaagaaa

SEQ ID NO: 3796430 - RNA, 18 nt, Human
caaaguaaugacagaaca

SEQ ID NO: 3796431 - RNA, 18 nt, Human
caaaguaauuuggaaauu

SEQ ID NO: 3796432 - RNA, 20 nt, Human
caaaguacacuguuucaaac

SEQ ID NO: 3796433 - RNA, 15 nt, Human
caaaguacagaauuu

SEQ ID NO: 3796434 - RNA, 20 nt, Human
caaaguacagguacuuuguc

SEQ ID NO: 3796435 - RNA, 14 nt, Human
caaaguagaagucu

SEQ ID NO: 3796436 - RNA, 21 nt, Human
caaaguagaagucuuagaugu

SEQ ID NO: 3796437 - RNA, 17 nt, Human
caaaguagaucaugcau

SEQ ID NO: 3796438 - RNA, 18 nt, Human
caaaguauaaauuugugu

SEQ ID NO: 3796439 - RNA, 19 nt, Human
caaaguauaaauuugugua

SEQ ID NO: 3796440 - RNA, 19 nt, Human
caaaguaucaggacgagaa

SEQ ID NO: 3796441 - RNA, 19 nt, Human
caaaguaucccuacuguaa

SEQ ID NO: 3796442 - RNA, 21 nt, Human
caaaguaucccuacuguaauu

SEQ ID NO: 3796443 - RNA, 14 nt, Human
caaaguauuaagca

SEQ ID NO: 3796444 - RNA, 16 nt, Human
caaaguauuaagcaua

SEQ ID NO: 3796445 - RNA, 19 nt, Human
caaaguauuaagcauauau

SEQ ID NO: 3796446 - RNA, 16 nt, Human
caaaguauuguaaauu

SEQ ID NO: 3796447 - RNA, 22 nt, Human
caaaguauuuuuuuaucuuggg

SEQ ID NO: 3796448 - RNA, 16 nt, Human
caaagucaagccacau

SEQ ID NO: 3796449 - RNA, 20 nt, Human
caaagucagaacaaauucag

SEQ ID NO: 3796450 - RNA, 17 nt, Human
caaagucaugauguuuu

SEQ ID NO: 3796451 - RNA, 19 nt, Human
caaagucuaaaguuuacag

SEQ ID NO: 3796452 - RNA, 20 nt, Human
caaagucuaaaguuuacagu

SEQ ID NO: 3796453 - RNA, 14 nt, Human
caaagucuguguga

SEQ ID NO: 3796454 - RNA, 23 nt, Human
caaagugaaggacauagagguau

SEQ ID NO: 3796455 - RNA, 12 nt, Human
caaagugcaagg

SEQ ID NO: 3796456 - RNA, 22 nt, Human
caaagugcuauuacgaaguuca

SEQ ID NO: 3796457 - RNA, 15 nt, Human
caaagugcugagauu

SEQ ID NO: 3796458 - RNA, 20 nt, Human
caaagugcugggauuacagg

SEQ ID NO: 3796459 - RNA, 23 nt, Human
caaaguggaaggaaagaugcuca

SEQ ID NO: 3796460 - RNA, 13 nt, Human
caaaguggcaaaa

SEQ ID NO: 3796461 - RNA, 22 nt, Human
caaaguguauuaggaaguguuu

SEQ ID NO: 3796462 - RNA, 23 nt, Human
caaaguguauuuuauaaaauuaa

SEQ ID NO: 3796463 - RNA, 12 nt, Human
caaaguguguau

SEQ ID NO: 3796464 - RNA, 11 nt, Human
caaaguguuaa

SEQ ID NO: 3796465 - RNA, 14 nt, Human
caggccuccuacag

SEQ ID NO: 3796466 - RNA, 12 nt, Human
caggccucucca

SEQ ID NO: 3796467 - RNA, 17 nt, Human
caggccucuguguccuu

SEQ ID NO: 3796468 - RNA, 22 nt, Human
caggccucuguguccuucccug

SEQ ID NO: 3796469 - RNA, 16 nt, Human
caggccugagauuuca

SEQ ID NO: 3796470 - RNA, 21 nt, Human
caggccugagauuucaucugc

SEQ ID NO: 3796471 - RNA, 23 nt, Human
caggccugagauuucaucugcuc

SEQ ID NO: 3796472 - RNA, 12 nt, Human
caggccugcagc

SEQ ID NO: 3796473 - RNA, 12 nt, Human
caggccugccag

SEQ ID NO: 3796474 - RNA, 17 nt, Human
caggccugccucccacu

SEQ ID NO: 3796475 - RNA, 20 nt, Human
caggccuggcaaguggguga

SEQ ID NO: 3796476 - RNA, 16 nt, Human
caggccugggucugug

SEQ ID NO: 3796477 - RNA, 19 nt, Human
caggccuguguagcuguga

SEQ ID NO: 3796478 - RNA, 23 nt, Human
caggccuguguagcugugaccug

SEQ ID NO: 3796479 - RNA, 14 nt, Human
caggccuguugcuu

SEQ ID NO: 3796480 - RNA, 16 nt, Human
caggccuguugcuuuu

SEQ ID NO: 3796481 - RNA, 16 nt, Human
caggccuuaucuccaa

SEQ ID NO: 3796482 - RNA, 17 nt, Human
caggccuuugagcucag

SEQ ID NO: 3796483 - RNA, 20 nt, Human
caggcgagagaggagccaga

SEQ ID NO: 3796484 - RNA, 16 nt, Human
caggcgauccaccugu

SEQ ID NO: 3796485 - RNA, 15 nt, Human
caggcgccccuuccc

SEQ ID NO: 3796486 - RNA, 15 nt, Human
caggcgcuaauucaa

SEQ ID NO: 3796487 - RNA, 16 nt, Human
caggcgcuagcacagc

SEQ ID NO: 3796488 - RNA, 19 nt, Human
caggcgcuagcacagcucc

SEQ ID NO: 3796489 - RNA, 20 nt, Human
caggcgcuagcacagcuccc

SEQ ID NO: 3796490 - RNA, 16 nt, Human
caggcgggaggaggug

SEQ ID NO: 3796491 - RNA, 15 nt, Human
caggcgggcucaagg

SEQ ID NO: 3796492 - RNA, 15 nt, Human
caggcggugggcacc

SEQ ID NO: 3796493 - RNA, 18 nt, Human
caggcgugagccaccucg

SEQ ID NO: 3796494 - RNA, 23 nt, Human
caggcuaaacauccaauauuuuc

SEQ ID NO: 3796495 - RNA, 14 nt, Human
caggcuacucuccu

SEQ ID NO: 3796496 - RNA, 15 nt, Human
caggcuacucuccuc

SEQ ID NO: 3796497 - RNA, 16 nt, Human
caggcuacucuccucg

SEQ ID NO: 3796498 - RNA, 15 nt, Human
caguuaagaaaaaaa

SEQ ID NO: 3796499 - RNA, 20 nt, Human
caguuaagaaaaaaauaauu

SEQ ID NO: 3796500 - RNA, 22 nt, Human
caguuaagaaaaaaauaauuuu

SEQ ID NO: 3796501 - RNA, 17 nt, Human
caguuaagccuuuggaa

SEQ ID NO: 3796502 - RNA, 15 nt, Human
caguuaaguuuuucc

SEQ ID NO: 3796503 - RNA, 15 nt, Human
caguuaaucuugcuu

SEQ ID NO: 3796504 - RNA, 14 nt, Human
caguuaauuuuucc

SEQ ID NO: 3796505 - RNA, 16 nt, Human
caguuaauuuuuccaa

SEQ ID NO: 3796506 - RNA, 22 nt, Human
caguuacaaauuauaauguauu

SEQ ID NO: 3796507 - RNA, 12 nt, Human
caguuacacaug

SEQ ID NO: 3796508 - RNA, 14 nt, Human
caguuacagaaagu

SEQ ID NO: 3796509 - RNA, 15 nt, Human
caguuacagaaagug

SEQ ID NO: 3796510 - RNA, 22 nt, Human
caguuaccacacaucuaugaua

SEQ ID NO: 3796511 - RNA, 18 nt, Human
caguuaccauuaaaccau

SEQ ID NO: 3796512 - RNA, 14 nt, Human
caguuacucagccc

SEQ ID NO: 3796513 - RNA, 13 nt, Human
caguuacucugaa

SEQ ID NO: 3796514 - RNA, 15 nt, Human
caguuacucugaagg

SEQ ID NO: 3796515 - RNA, 16 nt, Human
caguuacucugaaggg

SEQ ID NO: 3796516 - RNA, 15 nt, Human
caguuacuuuuccuu

SEQ ID NO: 3796517 - RNA, 19 nt, Human
caguuacuuuuccuugcau

SEQ ID NO: 3796518 - RNA, 17 nt, Human
caguuagagaugccucc

SEQ ID NO: 3796519 - RNA, 15 nt, Human
caguuagcaaacuuu

SEQ ID NO: 3796520 - RNA, 19 nt, Human
caguuaggguugaguuacu

SEQ ID NO: 3796521 - RNA, 18 nt, Human
caguuauauuuugcaguu

SEQ ID NO: 3796522 - RNA, 16 nt, Human
caguuaucuaaguuaa

SEQ ID NO: 3796523 - RNA, 22 nt, Human
caguuaugauuuuuuuuucaua

SEQ ID NO: 3796524 - RNA, 20 nt, Human
caguuaugugaaugaucucu

SEQ ID NO: 3796525 - RNA, 16 nt, Human
caguuaugugaccuca

SEQ ID NO: 3796526 - RNA, 21 nt, Human
caguuaugugaccucacgugc

SEQ ID NO: 3796527 - RNA, 17 nt, Human
caguuauuauauuuaca

SEQ ID NO: 3796528 - RNA, 22 nt, Human
caguuauuauauuuacaaaugg

SEQ ID NO: 3796529 - RNA, 20 nt, Human
caguuauugguggaaucuuu

SEQ ID NO: 3796530 - RNA, 21 nt, Human
caguuauugguggaaucuuua

SEQ ID NO: 3796531 - RNA, 17 nt, Human
caguuauugucccuggc

SEQ ID NO: 3796532 - RNA, 14 nt, Human
caguuauuuauagu

SEQ ID NO: 3796533 - RNA, 14 nt, Human
caguuauuuugaua

SEQ ID NO: 3796534 - RNA, 21 nt, Human
caguucaaaauucuaaaugua

SEQ ID NO: 3796535 - RNA, 15 nt, Human
caguucaaagucaug

SEQ ID NO: 3796536 - RNA, 19 nt, Human
caguucaaucucccgcugc

SEQ ID NO: 3796537 - RNA, 18 nt, Human
caguucacacccugcaag

SEQ ID NO: 3796538 - RNA, 13 nt, Human
caguucagcacca

SEQ ID NO: 3796539 - RNA, 16 nt, Human
caguucagcaccaccc

SEQ ID NO: 3796540 - RNA, 17 nt, Human
caguucagcaccacccu

SEQ ID NO: 3796541 - RNA, 20 nt, Human
caguucaggagucccaagga

SEQ ID NO: 3796542 - RNA, 23 nt, Human
caguucaguaauaaacuguguuu

SEQ ID NO: 3796543 - RNA, 21 nt, Human
caguucaguaccuggaggagg

SEQ ID NO: 3796544 - RNA, 19 nt, Human
caguucaguggcagggcuc

SEQ ID NO: 3796545 - RNA, 16 nt, Human
caguucaucgauuuuc

SEQ ID NO: 3796546 - RNA, 19 nt, Human
caguucaucgauuuucuau

SEQ ID NO: 3796547 - RNA, 23 nt, Human
caguuccaaucaguagcuuaaga

SEQ ID NO: 3796548 - RNA, 23 nt, Human
caguucccagaaucaaagcaaug

SEQ ID NO: 3796549 - RNA, 17 nt, Human
caguuccccuggaagca

SEQ ID NO: 3796550 - RNA, 14 nt, Human
caguucccuuggcc

SEQ ID NO: 3796551 - RNA, 20 nt, Human
caguuccggauuggcuugug

SEQ ID NO: 3796552 - RNA, 13 nt, Human
caguuccucgccc

SEQ ID NO: 3796553 - RNA, 14 nt, Human
caguuccucgcccu

SEQ ID NO: 3796554 - RNA, 17 nt, Human
caguuccucgcccuggg

SEQ ID NO: 3796555 - RNA, 18 nt, Human
caguuccucgcccugggu

SEQ ID NO: 3796556 - RNA, 19 nt, Human
caguuccuguggcucccuc

SEQ ID NO: 3796557 - RNA, 21 nt, Human
caguucgacucugugcuggcc

SEQ ID NO: 3796558 - RNA, 20 nt, Human
caguucgccuggagcccucc

SEQ ID NO: 3796559 - RNA, 17 nt, Human
caguucuacagaaaaac

SEQ ID NO: 3796560 - RNA, 17 nt, Human
caguucuacucaggcug

SEQ ID NO: 3796561 - RNA, 18 nt, Human
caguucuaguuugcauuc

SEQ ID NO: 3796562 - RNA, 18 nt, Human
caguucugcaaauagaaa

SEQ ID NO: 3796563 - RNA, 21 nt, Human
caguucugcuccucuccaggc

SEQ ID NO: 3796564 - RNA, 23 nt, Human
caguucuggauggugugccuucc

SEQ ID NO: 3796565 - RNA, 17 nt, Human
caguucugggugcuccc

SEQ ID NO: 3796566 - RNA, 12 nt, Human
caguucuuagcc

SEQ ID NO: 3796567 - RNA, 14 nt, Human
caguucuugaguug

SEQ ID NO: 3796568 - RNA, 20 nt, Human
caguucuuugggccagacau

SEQ ID NO: 3796569 - RNA, 14 nt, Human
caguugaaaagacu

SEQ ID NO: 3796570 - RNA, 22 nt, Human
caguugaaaagacuccaaagaa

SEQ ID NO: 3796571 - RNA, 21 nt, Human
caguugaauuuauggaaucua

SEQ ID NO: 3796572 - RNA, 14 nt, Human
caguugacagcagg

SEQ ID NO: 3796573 - RNA, 16 nt, Human
caguugagacaagaaa

SEQ ID NO: 3796574 - RNA, 13 nt, Human
caguugcacagca

SEQ ID NO: 3796575 - RNA, 15 nt, Human
caguugcacagcauc

SEQ ID NO: 3796576 - RNA, 17 nt, Human
caguugcacagcaucuc

SEQ ID NO: 3796577 - RNA, 20 nt, Human
caguugcacuuggccucugg

SEQ ID NO: 3796578 - RNA, 19 nt, Human
caguugcagucacucuagu

SEQ ID NO: 3796579 - RNA, 15 nt, Human
caguugccaccaccu

SEQ ID NO: 3796580 - RNA, 16 nt, Human
caguugccaccaccuc

SEQ ID NO: 3796581 - RNA, 18 nt, Human
caguugccaccaccucug

SEQ ID NO: 3796582 - RNA, 13 nt, Human
caguugccuuuua

SEQ ID NO: 3796583 - RNA, 15 nt, Human
caguugcuaaacacu

SEQ ID NO: 3796584 - RNA, 21 nt, Human
caguugcuaaacacugcgcuu

SEQ ID NO: 3796585 - RNA, 13 nt, Human
caguugcugguaa

SEQ ID NO: 3796586 - RNA, 23 nt, Human
caguugcugguaaaaugaagaau

SEQ ID NO: 3796587 - RNA, 14 nt, Human
caguugcuugucuu

SEQ ID NO: 3796588 - RNA, 17 nt, Human
caguuggagcuccagcc

SEQ ID NO: 3796589 - RNA, 22 nt, Human
caguuggaguuuuuuguaccaa

SEQ ID NO: 3796590 - RNA, 17 nt, Human
caguuggccagagagcc

SEQ ID NO: 3796591 - RNA, 18 nt, Human
caguuggccagagagccu

SEQ ID NO: 3796592 - RNA, 14 nt, Human
caguugggagcacu

SEQ ID NO: 3796593 - RNA, 17 nt, Human
caguugggagcacugga

SEQ ID NO: 3796594 - RNA, 17 nt, Human
caguugguaacuuuugu

SEQ ID NO: 3796595 - RNA, 20 nt, Human
caguuggucccccuuccaug

SEQ ID NO: 3796596 - RNA, 22 nt, Human
caguuggucccccuuccaugga

SEQ ID NO: 3796597 - RNA, 22 nt, Human
caguuguaacauucuauuucaa

SEQ ID NO: 3796598 - RNA, 19 nt, Human
caguuguagaauguauugu

SEQ ID NO: 3796599 - RNA, 21 nt, Human
caguuguaggguuacagagac

SEQ ID NO: 3796600 - RNA, 23 nt, Human
caguuguaggguuacagagaccu

SEQ ID NO: 3796601 - RNA, 14 nt, Human
caguuguauuuaac

SEQ ID NO: 3796602 - RNA, 18 nt, Human
caguugucccgauuguaa

SEQ ID NO: 3796603 - RNA, 21 nt, Human
caguugucccgauuguaacuc

SEQ ID NO: 3796604 - RNA, 22 nt, Human
caguugucccgauuguaacuca

SEQ ID NO: 3796605 - RNA, 12 nt, Human
caguuguccucc

SEQ ID NO: 3796606 - RNA, 13 nt, Human
caguugucucuga

SEQ ID NO: 3796607 - RNA, 15 nt, Human
caguugucucugaug

SEQ ID NO: 3796608 - RNA, 17 nt, Human
caguugucucugaugca

SEQ ID NO: 3796609 - RNA, 12 nt, Human
caguugugcagc

SEQ ID NO: 3796610 - RNA, 21 nt, Human
caguuguggugugaguaucag

SEQ ID NO: 3796611 - RNA, 17 nt, Human
caguuguuagugugucu

SEQ ID NO: 3796612 - RNA, 21 nt, Human
caguuguuaguuacuaccucc

SEQ ID NO: 3796613 - RNA, 23 nt, Human
caguuguucaauaauaaauauuu

SEQ ID NO: 3796614 - RNA, 12 nt, Human
caguuguucuuu

SEQ ID NO: 3796615 - RNA, 15 nt, Human
caguuguuggccucc

SEQ ID NO: 3796616 - RNA, 21 nt, Human
caguuguuuguuuuugcuugu

SEQ ID NO: 3796617 - RNA, 16 nt, Human
caguuuaaaaaaauug

SEQ ID NO: 3796618 - RNA, 15 nt, Human
caguuuaaaagcacg

SEQ ID NO: 3796619 - RNA, 12 nt, Human
caguuuaaagca

SEQ ID NO: 3796620 - RNA, 13 nt, Human
caguuuaaugaag

SEQ ID NO: 3796621 - RNA, 16 nt, Human
aaaccauuuuuguuac

SEQ ID NO: 3796622 - RNA, 18 nt, Human
aaaccauuuuuguuacuc

SEQ ID NO: 3796623 - RNA, 23 nt, Human
aaacccaccuuguuggagccugc

SEQ ID NO: 3796624 - RNA, 22 nt, Human
aaacccagcugcaccccuuccu

SEQ ID NO: 3796625 - RNA, 19 nt, Human
aaacccauaggcccacaca

SEQ ID NO: 3796626 - RNA, 17 nt, Human
aaaccccaaacagugac

SEQ ID NO: 3796627 - RNA, 16 nt, Human
aaacccgacagaggga

SEQ ID NO: 3796628 - RNA, 18 nt, Human
aaacccgacagagggaag

SEQ ID NO: 3796629 - RNA, 15 nt, Human
aaacccgaggguuga

SEQ ID NO: 3796630 - RNA, 21 nt, Human
aaacccguuuuaugauuuacu

SEQ ID NO: 3796631 - RNA, 13 nt, Human
aaacccuagccuu

SEQ ID NO: 3796632 - RNA, 15 nt, Human
aaacccuagccuugc

SEQ ID NO: 3796633 - RNA, 17 nt, Human
aaacccuagccuugcuu

SEQ ID NO: 3796634 - RNA, 18 nt, Human
aaacccuagccuugcuug

SEQ ID NO: 3796635 - RNA, 21 nt, Human
aaacccuagguucccgguccc

SEQ ID NO: 3796636 - RNA, 14 nt, Human
aaacccucagagcc

SEQ ID NO: 3796637 - RNA, 14 nt, Human
aaacccugucaaac

SEQ ID NO: 3796638 - RNA, 15 nt, Human
aaacccugucaaaca

SEQ ID NO: 3796639 - RNA, 17 nt, Human
aaacccugucaaacauu

SEQ ID NO: 3796640 - RNA, 14 nt, Human
aaacccuucagugc

SEQ ID NO: 3796641 - RNA, 16 nt, Human
aaacccuugaaaagac

SEQ ID NO: 3796642 - RNA, 16 nt, Human
aaaccgaauaaauguu

SEQ ID NO: 3796643 - RNA, 20 nt, Human
caguuugaucacacuauuuu

SEQ ID NO: 3796644 - RNA, 17 nt, Human
caguuugcaaaaaaugu

SEQ ID NO: 3796645 - RNA, 18 nt, Human
caguuugcaccugucccc

SEQ ID NO: 3796646 - RNA, 21 nt, Human
caguuugcagaaaagcaccug

SEQ ID NO: 3796647 - RNA, 16 nt, Human
caguuugguauuugcg

SEQ ID NO: 3796648 - RNA, 21 nt, Human
caguuugguugguaacucugu

SEQ ID NO: 3796649 - RNA, 15 nt, Human
caguuuguaaauguu

SEQ ID NO: 3796650 - RNA, 16 nt, Human
caguuuguaaauguua

SEQ ID NO: 3796651 - RNA, 17 nt, Human
caguuuguaaauguuau

SEQ ID NO: 3796652 - RNA, 23 nt, Human
caguuuguaaauguuauuucugc

SEQ ID NO: 3796653 - RNA, 16 nt, Human
caguuugucacaugaa

SEQ ID NO: 3796654 - RNA, 23 nt, Human
caguuugugugucuuaauuauua

SEQ ID NO: 3796655 - RNA, 21 nt, Human
caguuuguuaguaugaggcau

SEQ ID NO: 3796656 - RNA, 13 nt, Human
caguuuguuuaca

SEQ ID NO: 3796657 - RNA, 16 nt, Human
caguuuguuuacacac

SEQ ID NO: 3796658 - RNA, 18 nt, Human
caguuuguuuacacacgu

SEQ ID NO: 3796659 - RNA, 14 nt, Human
caguuuuaacaaau

SEQ ID NO: 3796660 - RNA, 12 nt, Human
caguuuuaacug

SEQ ID NO: 3796661 - RNA, 15 nt, Human
caguuuuaacugugg

SEQ ID NO: 3796662 - RNA, 16 nt, Human
caguuuuaacugugga

SEQ ID NO: 3796663 - RNA, 22 nt, Human
caguuuuaacuguggauauugu

SEQ ID NO: 3796664 - RNA, 21 nt, Human
caguuuuaugcucuuuuuuac

SEQ ID NO: 3796665 - RNA, 22 nt, Human
caguuuucaagucaaauuaaua

SEQ ID NO: 3796666 - RNA, 13 nt, Human
caguuuucauagu

SEQ ID NO: 3796667 - RNA, 12 nt, Human
caguuuuccaug

SEQ ID NO: 3796668 - RNA, 14 nt, Human
caguuuuccaugaa

SEQ ID NO: 3796669 - RNA, 16 nt, Human
caguuuuccaugaaaa

SEQ ID NO: 3796670 - RNA, 18 nt, Human
caguuuuccaugaaaacg

SEQ ID NO: 3796671 - RNA, 19 nt, Human
caguuuuccaugaaaacgu

SEQ ID NO: 3796672 - RNA, 14 nt, Human
caguuuucugagaa

SEQ ID NO: 3796673 - RNA, 23 nt, Human
caguuuugacaucagccagcugc

SEQ ID NO: 3796674 - RNA, 20 nt, Human
caguuuugaccuaacauacc

SEQ ID NO: 3796675 - RNA, 19 nt, Human
caguuuugguguguaacuu

SEQ ID NO: 3796676 - RNA, 22 nt, Human
caguuuuuaacucuacugugua

SEQ ID NO: 3796677 - RNA, 22 nt, Human
caguuuuucagaguggaaugcu

SEQ ID NO: 3796678 - RNA, 12 nt, Human
caguuuuucagg

SEQ ID NO: 3796679 - RNA, 21 nt, Human
caguuuuucauaagauauuuu

SEQ ID NO: 3796680 - RNA, 23 nt, Human
caguuuuucauaagauauuuuau

SEQ ID NO: 3796681 - RNA, 20 nt, Human
caguuuuucauuuuaaaaag

SEQ ID NO: 3796682 - RNA, 15 nt, Human
caguuuuucuuaaua

SEQ ID NO: 3796683 - RNA, 13 nt, Human
caguuuuuguguu

SEQ ID NO: 3796684 - RNA, 19 nt, Human
caguuuuuuuuuucuuguc

SEQ ID NO: 3796685 - RNA, 23 nt, Human
cauaaaaacaacuuuauacccag

SEQ ID NO: 3796686 - RNA, 23 nt, Human
cauaaaaagccugcaauuucaua

SEQ ID NO: 3796687 - RNA, 13 nt, Human
cauaaaaagcuga

SEQ ID NO: 3796688 - RNA, 13 nt, Human
cauaaaaaggaca

SEQ ID NO: 3796689 - RNA, 22 nt, Human
cauaaaaaggacaucagcaaac

SEQ ID NO: 3796690 - RNA, 18 nt, Human
cauaaaaaguuaaaaaaa

SEQ ID NO: 3796691 - RNA, 16 nt, Human
cauaaaagaaauaaac

SEQ ID NO: 3796692 - RNA, 19 nt, Human
cauaaaauaaaguauauau

SEQ ID NO: 3796693 - RNA, 20 nt, Human
cauaaaauaaaguauauaua

SEQ ID NO: 3796694 - RNA, 19 nt, Human
cauaaaauaaggagcauau

SEQ ID NO: 3796695 - RNA, 14 nt, Human
cauaaaaucaaaac

SEQ ID NO: 3796696 - RNA, 20 nt, Human
cauaaacaagaccacguuuc

SEQ ID NO: 3796697 - RNA, 13 nt, Human
cauaaacugacuu

SEQ ID NO: 3796698 - RNA, 16 nt, Human
cauaaacuucaugguc

SEQ ID NO: 3796699 - RNA, 18 nt, Human
cauaaagaagauguuuaa

SEQ ID NO: 3796700 - RNA, 12 nt, Human
cauaaagaagca

SEQ ID NO: 3796701 - RNA, 21 nt, Human
cauaaagaagcaauaaagaag

SEQ ID NO: 3796702 - RNA, 13 nt, Human
cauaaagcaaaua

SEQ ID NO: 3796703 - RNA, 16 nt, Human
cauaaagcaggcagaa

SEQ ID NO: 3796704 - RNA, 22 nt, Human
cauaaagccauguuuccucuuu

SEQ ID NO: 3796705 - RNA, 21 nt, Human
cauaaagccuuggauguauau

SEQ ID NO: 3796706 - RNA, 20 nt, Human
cauaaagcucaaaugaaaug

SEQ ID NO: 3796707 - RNA, 21 nt, Human
cauaaagcucaaaugaaaugu

SEQ ID NO: 3796708 - RNA, 21 nt, Human
cauaaaggauaaacuuuuaga

SEQ ID NO: 3796709 - RNA, 23 nt, Human
cauaaaggugguaugugugugua

SEQ ID NO: 3796710 - RNA, 14 nt, Human
cauaaaguaaauac

SEQ ID NO: 3796711 - RNA, 22 nt, Human
cauaaaguaaauacaugcauau

SEQ ID NO: 3796712 - RNA, 12 nt, Human
cauaaaguacuu

SEQ ID NO: 3796713 - RNA, 18 nt, Human
cauaaauaaaaugaccag

SEQ ID NO: 3796714 - RNA, 18 nt, Human
cauaaaucugugaacuug

SEQ ID NO: 3796715 - RNA, 22 nt, Human
cauaaaucugugaacuugaaau

SEQ ID NO: 3796716 - RNA, 23 nt, Human
cauaaaucugugaacuugaaauu

SEQ ID NO: 3796717 - RNA, 14 nt, Human
cauaaaugcagccc

SEQ ID NO: 3796718 - RNA, 18 nt, Human
cauaaaugcagcccauuu

SEQ ID NO: 3796719 - RNA, 12 nt, Human
cauaaauuauuu

SEQ ID NO: 3796720 - RNA, 19 nt, Human
cauaaauucaacuuuguaa

SEQ ID NO: 3796721 - RNA, 20 nt, Human
cauaaauucaacuuuguaaa

SEQ ID NO: 3796722 - RNA, 20 nt, Human
cauaaauuuacuuuacacaa

SEQ ID NO: 3796723 - RNA, 20 nt, Human
cauaaauuuaguauuuuguu

SEQ ID NO: 3796724 - RNA, 18 nt, Human
cauaacaaauaaccaacc

SEQ ID NO: 3796725 - RNA, 17 nt, Human
cauaacaggguaaauua

SEQ ID NO: 3796726 - RNA, 19 nt, Human
cauaacagugccauugucu

SEQ ID NO: 3796727 - RNA, 22 nt, Human
cauaacagugccauugucuuua

SEQ ID NO: 3796728 - RNA, 12 nt, Human
cauaacauaaau

SEQ ID NO: 3796729 - RNA, 21 nt, Human
cauaacauaaaucugugaacu

SEQ ID NO: 3796730 - RNA, 20 nt, Human
cauaacauuuucagaauagu

SEQ ID NO: 3796731 - RNA, 13 nt, Human
cauaaccacugcu

SEQ ID NO: 3796732 - RNA, 18 nt, Human
cauaacccacuugucacu

SEQ ID NO: 3796733 - RNA, 22 nt, Human
cauaacggaucagaaauacaga

SEQ ID NO: 3796734 - RNA, 19 nt, Human
cauaacuaaauuugauacu

SEQ ID NO: 3796735 - RNA, 20 nt, Human
cauaacuaaauuugauacuu

SEQ ID NO: 3796736 - RNA, 22 nt, Human
cauaacuaaauuugauacuuau

SEQ ID NO: 3796737 - RNA, 15 nt, Human
cauaacugacaaauc

SEQ ID NO: 3796738 - RNA, 21 nt, Human
cauaacugacaaaucaaguuu

SEQ ID NO: 3796739 - RNA, 19 nt, Human
cauaacugccuugaaccug

SEQ ID NO: 3796740 - RNA, 23 nt, Human
cauaacuuauugcugauuuuaau

SEQ ID NO: 3796741 - RNA, 13 nt, Human
cauaacuuccugu

SEQ ID NO: 3796742 - RNA, 19 nt, Human
cauaagaaaacuaagaaau

SEQ ID NO: 3796743 - RNA, 21 nt, Human
cauaagaccauaacagccaac

SEQ ID NO: 3796744 - RNA, 18 nt, Human
cauaagacuuugggauag

SEQ ID NO: 3796745 - RNA, 23 nt, Human
cauaagagccacaggucuuuaug

SEQ ID NO: 3796746 - RNA, 14 nt, Human
cauaagauaaaugu

SEQ ID NO: 3796747 - RNA, 17 nt, Human
cauaagauauuuuucau

SEQ ID NO: 3796748 - RNA, 15 nt, Human
cauaagcaacaauuu

SEQ ID NO: 3796749 - RNA, 17 nt, Human
cauaagcaacaauuuuc

SEQ ID NO: 3796750 - RNA, 21 nt, Human
cauaagcaacaauuuucagau

SEQ ID NO: 3796751 - RNA, 20 nt, Human
cauaagccaaaacugagcau

SEQ ID NO: 3796752 - RNA, 15 nt, Human
cauaagccaauuuuu

SEQ ID NO: 3796753 - RNA, 21 nt, Human
cauaagccuccauuuaguucu

SEQ ID NO: 3796754 - RNA, 22 nt, Human
cauaagcuauagacccgaggaa

SEQ ID NO: 3796755 - RNA, 14 nt, Human
cauaagcucagaau

SEQ ID NO: 3796756 - RNA, 17 nt, Human
cauaagcuuccauuuua

SEQ ID NO: 3796757 - RNA, 17 nt, Human
cauaaggaaacuggguu

SEQ ID NO: 3796758 - RNA, 15 nt, Human
cauaaggcuucaaaa

SEQ ID NO: 3796759 - RNA, 19 nt, Human
cauaaggcuucaaaauguu

SEQ ID NO: 3796760 - RNA, 21 nt, Human
cauaagggagcguagaaucug

SEQ ID NO: 3796761 - RNA, 21 nt, Human
cauaagggguuugccauuuga

SEQ ID NO: 3796762 - RNA, 21 nt, Human
cauaagguuucguuucuguau

SEQ ID NO: 3796763 - RNA, 17 nt, Human
cauaagguuuuuaugca

SEQ ID NO: 3796764 - RNA, 16 nt, Human
cauaaguaauucaaga

SEQ ID NO: 3796765 - RNA, 22 nt, Human
cauaaguauuuggaauuagaac

SEQ ID NO: 3796766 - RNA, 14 nt, Human
cauaagugaauuua

SEQ ID NO: 3796767 - RNA, 22 nt, Human
cauaagugcuauugcagagccg

SEQ ID NO: 3796768 - RNA, 23 nt, Human
cauaauaaaaaauuaugacaaug

SEQ ID NO: 3796769 - RNA, 18 nt, Human
cauaauaaauaucuguac

SEQ ID NO: 3796770 - RNA, 17 nt, Human
cauaauaagcuaaagag

SEQ ID NO: 3796771 - RNA, 16 nt, Human
cauaauacugaaccac

SEQ ID NO: 3796772 - RNA, 17 nt, Human
cauaauacugaaccacu

SEQ ID NO: 3796773 - RNA, 21 nt, Human
caaaguuaaacgugaugugcu

SEQ ID NO: 3796774 - RNA, 16 nt, Human
caaaguuaaccuaccu

SEQ ID NO: 3796775 - RNA, 17 nt, Human
caaaguuaaccuaccug

SEQ ID NO: 3796776 - RNA, 21 nt, Human
caaaguucccuacuuccugug

SEQ ID NO: 3796777 - RNA, 22 nt, Human
caaaguucccuacuuccuguga

SEQ ID NO: 3796778 - RNA, 20 nt, Human
caaaguucuaauaauuucua

SEQ ID NO: 3796779 - RNA, 22 nt, Human
caaaguuguuguaaccugcugu

SEQ ID NO: 3796780 - RNA, 16 nt, Human
caaaguuucaauuugu

SEQ ID NO: 3796781 - RNA, 16 nt, Human
caaaguuucagaguau

SEQ ID NO: 3796782 - RNA, 20 nt, Human
caaaguuuugaaaagcuauu

SEQ ID NO: 3796783 - RNA, 18 nt, Human
caaauaaaaagugcuuuu

SEQ ID NO: 3796784 - RNA, 15 nt, Human
caaauaaaaauauug

SEQ ID NO: 3796785 - RNA, 22 nt, Human
cagggaaggaggagccuguccu

SEQ ID NO: 3796786 - RNA, 23 nt, Human
cagggaaggaggagccuguccug

SEQ ID NO: 3796787 - RNA, 18 nt, Human
cagggaaggaucccauga

SEQ ID NO: 3796788 - RNA, 14 nt, Human
cagggaaggcaggc

SEQ ID NO: 3796789 - RNA, 15 nt, Human
cagggaaggcaggca

SEQ ID NO: 3796790 - RNA, 16 nt, Human
cagggaaggcaggcag

SEQ ID NO: 3796791 - RNA, 20 nt, Human
cagggaaggcaggcagggcu

SEQ ID NO: 3796792 - RNA, 21 nt, Human
cagggaaggcaggcagggcuc

SEQ ID NO: 3796793 - RNA, 23 nt, Human
cagggaaggcaggcagggcucuc

SEQ ID NO: 3796794 - RNA, 15 nt, Human
cagggaaggccugac

SEQ ID NO: 3796795 - RNA, 23 nt, Human
cagggaaggccugacuucugcug

SEQ ID NO: 3796796 - RNA, 21 nt, Human
cagggaagggacugggagggg

SEQ ID NO: 3796797 - RNA, 14 nt, Human
cagggaagucccca

SEQ ID NO: 3796798 - RNA, 14 nt, Human
cagggaauccaagc

SEQ ID NO: 3796799 - RNA, 23 nt, Human
cagggaauuucaggaacuagaga

SEQ ID NO: 3796800 - RNA, 14 nt, Human
cagggaauuucuau

SEQ ID NO: 3796801 - RNA, 16 nt, Human
cagggacaccagccag

SEQ ID NO: 3796802 - RNA, 17 nt, Human
cagggacaccagccagg

SEQ ID NO: 3796803 - RNA, 21 nt, Human
cagggacaccagccaggcucu

SEQ ID NO: 3796804 - RNA, 23 nt, Human
cagggacaccagccaggcucugu

SEQ ID NO: 3796805 - RNA, 22 nt, Human
cagggacaccugggagaaaucu

SEQ ID NO: 3796806 - RNA, 15 nt, Human
cagggacacgggcag

SEQ ID NO: 3796807 - RNA, 18 nt, Human
cagggacagagacaccug

SEQ ID NO: 3796808 - RNA, 22 nt, Human
cagggacagagacaccugcacc

SEQ ID NO: 3796809 - RNA, 14 nt, Human
cagggacagagcca

SEQ ID NO: 3796810 - RNA, 19 nt, Human
cagggacagaggccccagc

SEQ ID NO: 3796811 - RNA, 21 nt, Human
cagggacagaggccccagccu

SEQ ID NO: 3796812 - RNA, 23 nt, Human
cagggacagaggccccagccucc

SEQ ID NO: 3796813 - RNA, 13 nt, Human
cagggacagaggg

SEQ ID NO: 3796814 - RNA, 14 nt, Human
cagggacagagggg

SEQ ID NO: 3796815 - RNA, 23 nt, Human
cagggacagaggggguggccucc

SEQ ID NO: 3796816 - RNA, 14 nt, Human
cagggacagcaacu

SEQ ID NO: 3796817 - RNA, 14 nt, Human
cagggaccacagca

SEQ ID NO: 3796818 - RNA, 14 nt, Human
cagggaccauggcu

SEQ ID NO: 3796819 - RNA, 21 nt, Human
cagggaccgcccccugucucu

SEQ ID NO: 3796820 - RNA, 23 nt, Human
cagggaccggcggaccccagcca

SEQ ID NO: 3796821 - RNA, 19 nt, Human
cagggacgaagaagagcca

SEQ ID NO: 3796822 - RNA, 21 nt, Human
cagggacugaaaaccucuccu

SEQ ID NO: 3796823 - RNA, 14 nt, Human
cagggacugccagu

SEQ ID NO: 3796824 - RNA, 18 nt, Human
cagggacuguuccugucu

SEQ ID NO: 3796825 - RNA, 14 nt, Human
cagggacuugaagu

SEQ ID NO: 3796826 - RNA, 15 nt, Human
cagggacuugaaguu

SEQ ID NO: 3796827 - RNA, 12 nt, Human
cagggagaagcu

SEQ ID NO: 3796828 - RNA, 19 nt, Human
cagggagacccguccauuu

SEQ ID NO: 3796829 - RNA, 22 nt, Human
cagggagaccgagcgcuuucug

SEQ ID NO: 3796830 - RNA, 23 nt, Human
cagggagacgguuuccagggagg

SEQ ID NO: 3796831 - RNA, 15 nt, Human
cagggagagcccagg

SEQ ID NO: 3796832 - RNA, 21 nt, Human
cagggagcaggcggugggcac

SEQ ID NO: 3796833 - RNA, 18 nt, Human
cagggagcaugagaggag

SEQ ID NO: 3796834 - RNA, 22 nt, Human
cagggagcaugagaggaggcag

SEQ ID NO: 3796835 - RNA, 15 nt, Human
cagggagcauggcug

SEQ ID NO: 3796836 - RNA, 19 nt, Human
cagggagcauuuuccucca

SEQ ID NO: 3796837 - RNA, 19 nt, Human
cagggagccuagaagcugg

SEQ ID NO: 3796838 - RNA, 12 nt, Human
cagggagccucc

SEQ ID NO: 3796839 - RNA, 14 nt, Human
cagggagccuccug

SEQ ID NO: 3796840 - RNA, 22 nt, Human
cagggagccuuugguucuggcc

SEQ ID NO: 3796841 - RNA, 15 nt, Human
cagggagcggccggc

SEQ ID NO: 3796842 - RNA, 22 nt, Human
cagggagcugggcccgacaugg

SEQ ID NO: 3796843 - RNA, 17 nt, Human
cagggagcugggcuucc

SEQ ID NO: 3796844 - RNA, 22 nt, Human
cagggaggagaggggaagggcc

SEQ ID NO: 3796845 - RNA, 21 nt, Human
cagggaggagguggcagcccu

SEQ ID NO: 3796846 - RNA, 22 nt, Human
cagggaggagguggcagcccug

SEQ ID NO: 3796847 - RNA, 17 nt, Human
cagggaggcccugugcc

SEQ ID NO: 3796848 - RNA, 23 nt, Human
cagggaggccgaagcuaacaggg

SEQ ID NO: 3796849 - RNA, 14 nt, Human
cagggagggccugg

SEQ ID NO: 3796850 - RNA, 18 nt, Human
cagggagggccugggccc

SEQ ID NO: 3796851 - RNA, 16 nt, Human
cagggagggcuucugc

SEQ ID NO: 3796852 - RNA, 13 nt, Human
cagggaggggacu

SEQ ID NO: 3796853 - RNA, 21 nt, Human
cagggaggggacuauuuauga

SEQ ID NO: 3796854 - RNA, 22 nt, Human
cagggaggggccggcccugugu

SEQ ID NO: 3796855 - RNA, 17 nt, Human
cagggaggucaggcccu

SEQ ID NO: 3796856 - RNA, 13 nt, Human
cagggaguccccu

SEQ ID NO: 3796857 - RNA, 22 nt, Human
cagggaguccccuccccggccc

SEQ ID NO: 3796858 - RNA, 20 nt, Human
cagggaguguaguaaagccg

SEQ ID NO: 3796859 - RNA, 19 nt, Human
cagggauaaggccuguggg

SEQ ID NO: 3796860 - RNA, 12 nt, Human
cagggaugagca

SEQ ID NO: 3796861 - RNA, 20 nt, Human
cagggaugagcauggagcug

SEQ ID NO: 3796862 - RNA, 22 nt, Human
cagggaugagcauggagcuggc

SEQ ID NO: 3796863 - RNA, 23 nt, Human
cagggaugagcauggagcuggcc

SEQ ID NO: 3796864 - RNA, 20 nt, Human
cagggaugauucaagccauu

SEQ ID NO: 3796865 - RNA, 20 nt, Human
cagggaugcccuggaggugg

SEQ ID NO: 3796866 - RNA, 19 nt, Human
cagggauggccguuggcca

SEQ ID NO: 3796867 - RNA, 16 nt, Human
cagggaugguguucaa

SEQ ID NO: 3796868 - RNA, 20 nt, Human
cagggauguggguuccacag

SEQ ID NO: 3796869 - RNA, 22 nt, Human
cagggauguggguuccacagac

SEQ ID NO: 3796870 - RNA, 20 nt, Human
cagggauuaaccucugcacu

SEQ ID NO: 3796871 - RNA, 20 nt, Human
cagggauugauuuuaaaaug

SEQ ID NO: 3796872 - RNA, 16 nt, Human
cagggauugcugccac

SEQ ID NO: 3796873 - RNA, 14 nt, Human
cagggauuugagga

SEQ ID NO: 3796874 - RNA, 20 nt, Human
cagggauuuguccuugggga

SEQ ID NO: 3796875 - RNA, 15 nt, Human
cagggcaaaauauuc

SEQ ID NO: 3796876 - RNA, 12 nt, Human
cagggcaaagcc

SEQ ID NO: 3796877 - RNA, 16 nt, Human
cagggcaaagccaggu

SEQ ID NO: 3796878 - RNA, 20 nt, Human
cagggcaaagccaggucccu

SEQ ID NO: 3796879 - RNA, 21 nt, Human
cagggcaaaugacaugcacug

SEQ ID NO: 3796880 - RNA, 23 nt, Human
cagggcaaaugacaugcacugac

SEQ ID NO: 3796881 - RNA, 21 nt, Human
cagggcaagcuccgcaggacu

SEQ ID NO: 3796882 - RNA, 22 nt, Human
cagggcaagcuccgcaggacuu

SEQ ID NO: 3796883 - RNA, 17 nt, Human
cagggcaaucaauguuc

SEQ ID NO: 3796884 - RNA, 13 nt, Human
cagggcacaggag

SEQ ID NO: 3796885 - RNA, 19 nt, Human
cagggcacaggagcuaccu

SEQ ID NO: 3796886 - RNA, 20 nt, Human
cagggcacaggagcuaccug

SEQ ID NO: 3796887 - RNA, 18 nt, Human
cagggcacaggccaugga

SEQ ID NO: 3796888 - RNA, 18 nt, Human
cagggcacagggccuggc

SEQ ID NO: 3796889 - RNA, 16 nt, Human
cagggcaccaagccca

SEQ ID NO: 3796890 - RNA, 21 nt, Human
cagggcaccaagcccacaggu

SEQ ID NO: 3796891 - RNA, 15 nt, Human
cagggcaccugccac

SEQ ID NO: 3796892 - RNA, 19 nt, Human
cagggcagagugagaccca

SEQ ID NO: 3796893 - RNA, 16 nt, Human
cagggcagcacacggc

SEQ ID NO: 3796894 - RNA, 16 nt, Human
cagggcagccagggag

SEQ ID NO: 3796895 - RNA, 13 nt, Human
cagggcagcgcca

SEQ ID NO: 3796896 - RNA, 18 nt, Human
cagggcagcgccaggcug

SEQ ID NO: 3796897 - RNA, 19 nt, Human
cagggcagcgccaggcuga

SEQ ID NO: 3796898 - RNA, 16 nt, Human
cagggcagcugggccc

SEQ ID NO: 3796899 - RNA, 17 nt, Human
cagggcagcugggccca

SEQ ID NO: 3796900 - RNA, 18 nt, Human
cagggcagcugggcccaa

SEQ ID NO: 3796901 - RNA, 16 nt, Human
cagggcaggaccagcc

SEQ ID NO: 3796902 - RNA, 15 nt, Human
cagggcagggcucug

SEQ ID NO: 3796903 - RNA, 19 nt, Human
cagggcagggcucugauau

SEQ ID NO: 3796904 - RNA, 23 nt, Human
cagggcaguaccugagggucugu

SEQ ID NO: 3796905 - RNA, 17 nt, Human
cagggcaucuccaggaa

SEQ ID NO: 3796906 - RNA, 16 nt, Human
cagggcaucucugggc

SEQ ID NO: 3796907 - RNA, 17 nt, Human
cagggcaucucugggcu

SEQ ID NO: 3796908 - RNA, 18 nt, Human
cagggcaucuugcuggcu

SEQ ID NO: 3796909 - RNA, 20 nt, Human
cagggcaucuugcuggcuac

SEQ ID NO: 3796910 - RNA, 14 nt, Human
cagggcaugaaaug

SEQ ID NO: 3796911 - RNA, 24 nt, Human
cagggcaugaaaugaacacaaauu

SEQ ID NO: 3796912 - RNA, 18 nt, Human
cagggcaugccccggcca

SEQ ID NO: 3796913 - RNA, 22 nt, Human
cagggcaugccccggccaccuc

SEQ ID NO: 3796914 - RNA, 19 nt, Human
cagggccaacuugagggcc

SEQ ID NO: 3796915 - RNA, 22 nt, Human
cagggccaacuugagggcccag

SEQ ID NO: 3796916 - RNA, 16 nt, Human
cagggccaauccccag

SEQ ID NO: 3796917 - RNA, 16 nt, Human
cagggccacgcuccag

SEQ ID NO: 3796918 - RNA, 20 nt, Human
cagggccacgcuccagcugc

SEQ ID NO: 3796919 - RNA, 23 nt, Human
cagggccacgcuccagcugcccc

SEQ ID NO: 3796920 - RNA, 15 nt, Human
cagggccacgugcca

SEQ ID NO: 3796921 - RNA, 13 nt, Human
cagggccacuccc

SEQ ID NO: 3796922 - RNA, 19 nt, Human
cagggccacucccggcacu

SEQ ID NO: 3796923 - RNA, 20 nt, Human
cagggccacucugccucugc

SEQ ID NO: 3796924 - RNA, 20 nt, Human
cagggccaggacugagcccc

SEQ ID NO: 3796925 - RNA, 18 nt, Human
cauaauacugaaccacuu

SEQ ID NO: 3796926 - RNA, 17 nt, Human
cauaauccaguaaaaua

SEQ ID NO: 3796927 - RNA, 19 nt, Human
cagguuguaguaaagaaau

SEQ ID NO: 3796928 - RNA, 12 nt, Human
cagguuuaacau

SEQ ID NO: 3796929 - RNA, 14 nt, Human
cagguuuaagcugu

SEQ ID NO: 3796930 - RNA, 21 nt, Human
cagguuuaaguagauuucaug

SEQ ID NO: 3796931 - RNA, 23 nt, Human
cagguuugggaccccuggugguu

SEQ ID NO: 3796932 - RNA, 17 nt, Human
cagguuuuaaaagccuu

SEQ ID NO: 3796933 - RNA, 19 nt, Human
cagguuuucugggugucca

SEQ ID NO: 3796934 - RNA, 12 nt, Human
cagguuuuucaa

SEQ ID NO: 3796935 - RNA, 16 nt, Human
cagguuuuucaauuaa

SEQ ID NO: 3796936 - RNA, 17 nt, Human
caguaaaauuauacugu

SEQ ID NO: 3796937 - RNA, 15 nt, Human
caguaaaauugccau

SEQ ID NO: 3796938 - RNA, 21 nt, Human
caguaaaauugccauauugca

SEQ ID NO: 3796939 - RNA, 16 nt, Human
caguaaacagaggagu

SEQ ID NO: 3796940 - RNA, 14 nt, Human
caguaaaccacuga

SEQ ID NO: 3796941 - RNA, 13 nt, Human
caguaaaccuguc

SEQ ID NO: 3796942 - RNA, 17 nt, Human
caguaaacuuagaguuu

SEQ ID NO: 3796943 - RNA, 13 nt, Human
caguaaagagaaa

SEQ ID NO: 3796944 - RNA, 19 nt, Human
caguaaagagaaacuuugu

SEQ ID NO: 3796945 - RNA, 15 nt, Human
caguaaauaaauugu

SEQ ID NO: 3796946 - RNA, 19 nt, Human
caguaaauaaauuguuuga

SEQ ID NO: 3796947 - RNA, 17 nt, Human
caguaaauaacuggaaa

SEQ ID NO: 3796948 - RNA, 22 nt, Human
caguaaaugggggugcauuuga

SEQ ID NO: 3796949 - RNA, 13 nt, Human
caguaacacaggc

SEQ ID NO: 3796950 - RNA, 15 nt, Human
caguaacaggcucaa

SEQ ID NO: 3796951 - RNA, 18 nt, Human
caguaacagggccuugcu

SEQ ID NO: 3796952 - RNA, 20 nt, Human
caguaacccccuuaaauuua

SEQ ID NO: 3796953 - RNA, 14 nt, Human
caguaacuaaagcu

SEQ ID NO: 3796954 - RNA, 18 nt, Human
caguaacuguuuuuuaag

SEQ ID NO: 3796955 - RNA, 14 nt, Human
caguaacuuuaugu

SEQ ID NO: 3796956 - RNA, 16 nt, Human
caguaacuuuaugugu

SEQ ID NO: 3796957 - RNA, 17 nt, Human
caguaacuuuaugugua

SEQ ID NO: 3796958 - RNA, 19 nt, Human
caguaagaucacuguuuag

SEQ ID NO: 3796959 - RNA, 15 nt, Human
caguaagccacugcc

SEQ ID NO: 3796960 - RNA, 15 nt, Human
caguaaguuaucuuu

SEQ ID NO: 3796961 - RNA, 20 nt, Human
caguaaguuaucuuugaaua

SEQ ID NO: 3796962 - RNA, 15 nt, Human
caguaauaaaacauc

SEQ ID NO: 3796963 - RNA, 21 nt, Human
caguaauaaaugaaugucacu

SEQ ID NO: 3796964 - RNA, 12 nt, Human
caguaauaacuc

SEQ ID NO: 3796965 - RNA, 13 nt, Human
caguaauaacucu

SEQ ID NO: 3796966 - RNA, 17 nt, Human
caguaauagcacugcca

SEQ ID NO: 3796967 - RNA, 12 nt, Human
caguaauccugu

SEQ ID NO: 3796968 - RNA, 13 nt, Human
caguaauccugua

SEQ ID NO: 3796969 - RNA, 16 nt, Human
caguaauccuguagga

SEQ ID NO: 3796970 - RNA, 12 nt, Human
cauccuggcugc

SEQ ID NO: 3796971 - RNA, 12 nt, Human
cauccuggguaa

SEQ ID NO: 3796972 - RNA, 19 nt, Human
cauccugucaucugagaau

SEQ ID NO: 3796973 - RNA, 15 nt, Human
cauccuuauccuuca

SEQ ID NO: 3796974 - RNA, 22 nt, Human
cauccuuauccuucaucuuuua

SEQ ID NO: 3796975 - RNA, 17 nt, Human
cauccuucccacucugu

SEQ ID NO: 3796976 - RNA, 13 nt, Human
cauccuucccuuu

SEQ ID NO: 3796977 - RNA, 12 nt, Human
cauccuuccuau

SEQ ID NO: 3796978 - RNA, 14 nt, Human
cauccuuccuuccc

SEQ ID NO: 3796979 - RNA, 16 nt, Human
cauccuuccuucccac

SEQ ID NO: 3796980 - RNA, 12 nt, Human
cauccuucugcc

SEQ ID NO: 3796981 - RNA, 21 nt, Human
cauccuuggucuuuguaucuu

SEQ ID NO: 3796982 - RNA, 13 nt, Human
cauccuugucuua

SEQ ID NO: 3796983 - RNA, 20 nt, Human
cauccuuguggcacauuuuu

SEQ ID NO: 3796984 - RNA, 19 nt, Human
cauccuuuacguguuuaaa

SEQ ID NO: 3796985 - RNA, 19 nt, Human
cauccuuucacuucuuucc

SEQ ID NO: 3796986 - RNA, 16 nt, Human
cauccuuucugccucu

SEQ ID NO: 3796987 - RNA, 16 nt, Human
cauccuuugcacuguc

SEQ ID NO: 3796988 - RNA, 18 nt, Human
cauccuuugcagggcagc

SEQ ID NO: 3796989 - RNA, 19 nt, Human
cauccuuuucugcagaggg

SEQ ID NO: 3796990 - RNA, 15 nt, Human
caucgaauguguaca

SEQ ID NO: 3796991 - RNA, 16 nt, Human
caucgcaccauucuga

SEQ ID NO: 3796992 - RNA, 13 nt, Human
caucgcacugugg

SEQ ID NO: 3796993 - RNA, 13 nt, Human
caucgccagacaa

SEQ ID NO: 3796994 - RNA, 16 nt, Human
caucggaaaaauaauc

SEQ ID NO: 3796995 - RNA, 17 nt, Human
caucggccuagggcccc

SEQ ID NO: 3796996 - RNA, 22 nt, Human
caucggugaaacuaacagauaa

SEQ ID NO: 3796997 - RNA, 17 nt, Human
caucgugaagaagccug

SEQ ID NO: 3796998 - RNA, 23 nt, Human
caucguugcaaccacugcaauau

SEQ ID NO: 3796999 - RNA, 15 nt, Human
caucguugcccccau

SEQ ID NO: 3797000 - RNA, 23 nt, Human
caucuaaaaauagacuuaaaucu

SEQ ID NO: 3797001 - RNA, 17 nt, Human
caucuaaaaauauacau

SEQ ID NO: 3797002 - RNA, 23 nt, Human
caucuaaaaauauacauguuuau

SEQ ID NO: 3797003 - RNA, 18 nt, Human
caucuaaacuaagaugug

SEQ ID NO: 3797004 - RNA, 21 nt, Human
caucuaaacugcccccucugc

SEQ ID NO: 3797005 - RNA, 12 nt, Human
caucuaaacuuu

SEQ ID NO: 3797006 - RNA, 14 nt, Human
caucuaaacuuuaa

SEQ ID NO: 3797007 - RNA, 19 nt, Human
caucuaaccucaucuucuu

SEQ ID NO: 3797008 - RNA, 20 nt, Human
caucuaagcugcagcuuccu

SEQ ID NO: 3797009 - RNA, 21 nt, Human
caucuaagcugcagcuuccug

SEQ ID NO: 3797010 - RNA, 23 nt, Human
caucuaauagcggguuacuuuca

SEQ ID NO: 3797011 - RNA, 21 nt, Human
caucuaauucucuguggaaug

SEQ ID NO: 3797012 - RNA, 16 nt, Human
caucuaauucugauuc

SEQ ID NO: 3797013 - RNA, 23 nt, Human
caucuaauuuuauuuugugaagu

SEQ ID NO: 3797014 - RNA, 20 nt, Human
caucuacaaaacauuaaacu

SEQ ID NO: 3797015 - RNA, 19 nt, Human
caucuaccuuuucucuuca

SEQ ID NO: 3797016 - RNA, 13 nt, Human
caucuagccagcc

SEQ ID NO: 3797017 - RNA, 21 nt, Human
caucuagccagccccucuucc

SEQ ID NO: 3797018 - RNA, 12 nt, Human
caucuaggauuu

SEQ ID NO: 3797019 - RNA, 20 nt, Human
caucuaggggagccuugauu

SEQ ID NO: 3797020 - RNA, 18 nt, Human
caucuagguaaauuacag

SEQ ID NO: 3797021 - RNA, 22 nt, Human
caucuagugagcagucaggaaa

SEQ ID NO: 3797022 - RNA, 14 nt, Human
caucuauaaagaag

SEQ ID NO: 3797023 - RNA, 13 nt, Human
caucuaucuaguu

SEQ ID NO: 3797024 - RNA, 17 nt, Human
caucuaucuaguucuaa

SEQ ID NO: 3797025 - RNA, 19 nt, Human
caucuaugucccuugcugu

SEQ ID NO: 3797026 - RNA, 15 nt, Human
caucuauuucugaga

SEQ ID NO: 3797027 - RNA, 14 nt, Human
caucuauuuugaug

SEQ ID NO: 3797028 - RNA, 17 nt, Human
caucuauuuugaugcag

SEQ ID NO: 3797029 - RNA, 16 nt, Human
caucuauuuuggauug

SEQ ID NO: 3797030 - RNA, 13 nt, Human
caucucacagcua

SEQ ID NO: 3797031 - RNA, 16 nt, Human
caucucaccuccugcu

SEQ ID NO: 3797032 - RNA, 18 nt, Human
caucucaccuccugcugg

SEQ ID NO: 3797033 - RNA, 18 nt, Human
caucucagacccuuuagc

SEQ ID NO: 3797034 - RNA, 20 nt, Human
caucucagccuaccaugaga

SEQ ID NO: 3797035 - RNA, 20 nt, Human
caucucaggacacuuccgua

SEQ ID NO: 3797036 - RNA, 18 nt, Human
caucucaggagauuucau

SEQ ID NO: 3797037 - RNA, 17 nt, Human
caucucaggccaccugc

SEQ ID NO: 3797038 - RNA, 17 nt, Human
caucucaggccagagcc

SEQ ID NO: 3797039 - RNA, 17 nt, Human
caucucaguaugaauua

SEQ ID NO: 3797040 - RNA, 17 nt, Human
caucucaguccucaaag

SEQ ID NO: 3797041 - RNA, 18 nt, Human
caucucaucaugucuauu

SEQ ID NO: 3797042 - RNA, 23 nt, Human
caucucaugaggggagaggagac

SEQ ID NO: 3797043 - RNA, 23 nt, Human
caucucauguaucaucuggauag

SEQ ID NO: 3797044 - RNA, 19 nt, Human
caucucauuuaauccuccc

SEQ ID NO: 3797045 - RNA, 20 nt, Human
caucucauuuaauccucccu

SEQ ID NO: 3797046 - RNA, 20 nt, Human
caucuccaagaaugcugaaa

SEQ ID NO: 3797047 - RNA, 16 nt, Human
caucuccacccccagc

SEQ ID NO: 3797048 - RNA, 15 nt, Human
caucuccaucagcug

SEQ ID NO: 3797049 - RNA, 21 nt, Human
caucucccacccuguaccuca

SEQ ID NO: 3797050 - RNA, 13 nt, Human
caucuccccucag

SEQ ID NO: 3797051 - RNA, 14 nt, Human
caucucccugcuuu

SEQ ID NO: 3797052 - RNA, 13 nt, Human
caucucccuuccu

SEQ ID NO: 3797053 - RNA, 19 nt, Human
caucuccuauaaucuguca

SEQ ID NO: 3797054 - RNA, 20 nt, Human
caucuccuauaaucugucaa

SEQ ID NO: 3797055 - RNA, 21 nt, Human
caucuccuauaaucugucaaa

SEQ ID NO: 3797056 - RNA, 22 nt, Human
caucuccugaggaucagaaagu

SEQ ID NO: 3797057 - RNA, 22 nt, Human
caucuccugccuuccuccuggg

SEQ ID NO: 3797058 - RNA, 15 nt, Human
caucuccugugcaug

SEQ ID NO: 3797059 - RNA, 17 nt, Human
caucucgcucccuccca

SEQ ID NO: 3797060 - RNA, 22 nt, Human
caucucgcucccucccaggacu

SEQ ID NO: 3797061 - RNA, 15 nt, Human
caucucggagcaucc

SEQ ID NO: 3797062 - RNA, 21 nt, Human
caucucggagcaucccggagg

SEQ ID NO: 3797063 - RNA, 23 nt, Human
caucucuaacagcucaggaucuc

SEQ ID NO: 3797064 - RNA, 16 nt, Human
caucucucauccucca

SEQ ID NO: 3797065 - RNA, 17 nt, Human
caucucucauccuccag

SEQ ID NO: 3797066 - RNA, 16 nt, Human
caucucucccuccccu

SEQ ID NO: 3797067 - RNA, 21 nt, Human
caucucucuacuccuaccuca

SEQ ID NO: 3797068 - RNA, 15 nt, Human
caucucucugcccaa

SEQ ID NO: 3797069 - RNA, 11 nt, Human
caucucugcac

SEQ ID NO: 3797070 - RNA, 13 nt, Human
caucucugcucca

SEQ ID NO: 3797071 - RNA, 16 nt, Human
caucucuggaugccug

SEQ ID NO: 3797072 - RNA, 16 nt, Human
caucuuuuuaaagcuu

SEQ ID NO: 3797073 - RNA, 13 nt, Human
caugaaaaagcag

SEQ ID NO: 3797074 - RNA, 15 nt, Human
caugaaaaagcagcu

SEQ ID NO: 3797075 - RNA, 18 nt, Human
caugaaaaagcagcuacc

SEQ ID NO: 3797076 - RNA, 19 nt, Human
caugaaaaagcagcuacca

SEQ ID NO: 3797077 - RNA, 14 nt, Human
caugaaaacacauu

SEQ ID NO: 3797078 - RNA, 19 nt, Human
caugaaaacguuuuauugu

SEQ ID NO: 3797079 - RNA, 15 nt, Human
caugaaaauagcaau

SEQ ID NO: 3797080 - RNA, 16 nt, Human
caugaaaauccuacca

SEQ ID NO: 3797081 - RNA, 13 nt, Human
caugaaaaugcaa

SEQ ID NO: 3797082 - RNA, 11 nt, Human
caugaaacacc

SEQ ID NO: 3797083 - RNA, 19 nt, Human
caugaaacagaaacaaaaa

SEQ ID NO: 3797084 - RNA, 17 nt, Human
caugaaagacuucucua

SEQ ID NO: 3797085 - RNA, 24 nt, Human
caugaaaguagacaguuuugagaa

SEQ ID NO: 3797086 - RNA, 22 nt, Human
caugaaaguagcagugugaagu

SEQ ID NO: 3797087 - RNA, 13 nt, Human
caugaaauaaaau

SEQ ID NO: 3797088 - RNA, 18 nt, Human
caugaaauaaaauauauc

SEQ ID NO: 3797089 - RNA, 13 nt, Human
caugaaauaugca

SEQ ID NO: 3797090 - RNA, 13 nt, Human
caugaaaugaaca

SEQ ID NO: 3797091 - RNA, 24 nt, Human
caugaaauugucuagcagagcagg

SEQ ID NO: 3797092 - RNA, 16 nt, Human
caugaacacacugugu

SEQ ID NO: 3797093 - RNA, 20 nt, Human
caugaacacacuguguccug

SEQ ID NO: 3797094 - RNA, 18 nt, Human
caugaacacccuuagaaa

SEQ ID NO: 3797095 - RNA, 20 nt, Human
caugaacuuagauuuuacau

SEQ ID NO: 3797096 - RNA, 13 nt, Human
caugaagaccaca

SEQ ID NO: 3797097 - RNA, 18 nt, Human
caugaagagaagcaauuu

SEQ ID NO: 3797098 - RNA, 21 nt, Human
caugaagagaagcaauuuugg

SEQ ID NO: 3797099 - RNA, 14 nt, Human
caugaagagcaaaa

SEQ ID NO: 3797100 - RNA, 18 nt, Human
caugaagauguagaggag

SEQ ID NO: 3797101 - RNA, 18 nt, Human
caugaagauucuuuccca

SEQ ID NO: 3797102 - RNA, 22 nt, Human
caugaagccacagcccaggccu

SEQ ID NO: 3797103 - RNA, 16 nt, Human
caugaagccuguggau

SEQ ID NO: 3797104 - RNA, 12 nt, Human
caugaagccuuu

SEQ ID NO: 3797105 - RNA, 19 nt, Human
caugaagccuuuugaaagg

SEQ ID NO: 3797106 - RNA, 16 nt, Human
caugaaggugucauac

SEQ ID NO: 3797107 - RNA, 19 nt, Human
caugaaguaauaugcacac

SEQ ID NO: 3797108 - RNA, 20 nt, Human
caugaaguuuccuuggcugg

SEQ ID NO: 3797109 - RNA, 23 nt, Human
caugaaguuuccuuggcuggugc

SEQ ID NO: 3797110 - RNA, 17 nt, Human
caugaaucaaaagugcc

SEQ ID NO: 3797111 - RNA, 18 nt, Human
caugaaucaaaagugccu

SEQ ID NO: 3797112 - RNA, 16 nt, Human
caugaaucgcuucucu

SEQ ID NO: 3797113 - RNA, 16 nt, Human
caugaaugcacacuag

SEQ ID NO: 3797114 - RNA, 19 nt, Human
caugaauguaaauuuguac

SEQ ID NO: 3797115 - RNA, 17 nt, Human
caugaauguaucaggaa

SEQ ID NO: 3797116 - RNA, 17 nt, Human
caugaauuauuacagug

SEQ ID NO: 3797117 - RNA, 22 nt, Human
caugaauuuauugcacauuguu

SEQ ID NO: 3797118 - RNA, 23 nt, Human
caugaauuuauugcacauuguuc

SEQ ID NO: 3797119 - RNA, 22 nt, Human
caugaauuuguaaugucuugag

SEQ ID NO: 3797120 - RNA, 13 nt, Human
caugaauuuuaca

SEQ ID NO: 3797121 - RNA, 16 nt, Human
caugaauuuuagcuuu

SEQ ID NO: 3797122 - RNA, 19 nt, Human
caugacaacuuugccagcu

SEQ ID NO: 3797123 - RNA, 17 nt, Human
caugacaagccccaggc

SEQ ID NO: 3797124 - RNA, 12 nt, Human
caugacacagcu

SEQ ID NO: 3797125 - RNA, 18 nt, Human
caugacacgaauauugcu

SEQ ID NO: 3797126 - RNA, 14 nt, Human
caugacacugaaau

SEQ ID NO: 3797127 - RNA, 13 nt, Human
caugacagccucc

SEQ ID NO: 3797128 - RNA, 20 nt, Human
caugacagcgcuaaacguug

SEQ ID NO: 3797129 - RNA, 23 nt, Human
caugacaguucauucagggccga

SEQ ID NO: 3797130 - RNA, 15 nt, Human
caugacauaacagug

SEQ ID NO: 3797131 - RNA, 18 nt, Human
caugacauaugacuugau

SEQ ID NO: 3797132 - RNA, 15 nt, Human
caugacauguuauau

SEQ ID NO: 3797133 - RNA, 23 nt, Human
caugacauuccuaaacuaucuuu

SEQ ID NO: 3797134 - RNA, 15 nt, Human
caugacccaccccug

SEQ ID NO: 3797135 - RNA, 18 nt, Human
cagucccccaaccccagc

SEQ ID NO: 3797136 - RNA, 20 nt, Human
caguccccccacccucauuc

SEQ ID NO: 3797137 - RNA, 19 nt, Human
cagucccccuauccuuggc

SEQ ID NO: 3797138 - RNA, 23 nt, Human
cagucccccuauccuuggcacca

SEQ ID NO: 3797139 - RNA, 16 nt, Human
cagucccccugcccca

SEQ ID NO: 3797140 - RNA, 23 nt, Human
caguccccguggccaucccugug

SEQ ID NO: 3797141 - RNA, 15 nt, Human
caguccccucccauc

SEQ ID NO: 3797142 - RNA, 14 nt, Human
caguccccuucccu

SEQ ID NO: 3797143 - RNA, 13 nt, Human
cagucccugccaa

SEQ ID NO: 3797144 - RNA, 16 nt, Human
cagucccugccaaugg

SEQ ID NO: 3797145 - RNA, 12 nt, Human
cagucccugggg

SEQ ID NO: 3797146 - RNA, 21 nt, Human
cagucccugggggaagcccug

SEQ ID NO: 3797147 - RNA, 16 nt, Human
cagucccuuuaaagaa

SEQ ID NO: 3797148 - RNA, 21 nt, Human
caguccuacucaagcgggugg

SEQ ID NO: 3797149 - RNA, 18 nt, Human
caguccuagaauguuuca

SEQ ID NO: 3797150 - RNA, 18 nt, Human
caguccuagcugcacagg

SEQ ID NO: 3797151 - RNA, 17 nt, Human
caguccuaucugggcuu

SEQ ID NO: 3797152 - RNA, 14 nt, Human
caguccucccaucu

SEQ ID NO: 3797153 - RNA, 13 nt, Human
caguccuccccuc

SEQ ID NO: 3797154 - RNA, 23 nt, Human
caguccuccccucacagccucug

SEQ ID NO: 3797155 - RNA, 13 nt, Human
caguccucuccac

SEQ ID NO: 3797156 - RNA, 12 nt, Human
caguccugccug

SEQ ID NO: 3797157 - RNA, 15 nt, Human
caguccugccuggcc

SEQ ID NO: 3797158 - RNA, 17 nt, Human
caguccugccuggccag

SEQ ID NO: 3797159 - RNA, 14 nt, Human
caguccugcuccag

SEQ ID NO: 3797160 - RNA, 18 nt, Human
caguccugcucucuaccc

SEQ ID NO: 3797161 - RNA, 23 nt, Human
caguccugcucucuacccagccc

SEQ ID NO: 3797162 - RNA, 11 nt, Human
caguccuggcc

SEQ ID NO: 3797163 - RNA, 19 nt, Human
caguccuggccuggcuucu

SEQ ID NO: 3797164 - RNA, 13 nt, Human
caguccugggaga

SEQ ID NO: 3797165 - RNA, 23 nt, Human
caguccugggagaaccucaggcu

SEQ ID NO: 3797166 - RNA, 17 nt, Human
caguccuguaguuuuau

SEQ ID NO: 3797167 - RNA, 18 nt, Human
caguccuguaguuuuauu

SEQ ID NO: 3797168 - RNA, 12 nt, Human
caguccuguccu

SEQ ID NO: 3797169 - RNA, 15 nt, Human
caguccuuaaaaauc

SEQ ID NO: 3797170 - RNA, 16 nt, Human
caguccuuaaaaauca

SEQ ID NO: 3797171 - RNA, 18 nt, Human
caguccuuaccagcagag

SEQ ID NO: 3797172 - RNA, 15 nt, Human
caguccuuccaccuc

SEQ ID NO: 3797173 - RNA, 20 nt, Human
caguccuuuguaaacagugu

SEQ ID NO: 3797174 - RNA, 19 nt, Human
cagucgccuuucagcaggc

SEQ ID NO: 3797175 - RNA, 17 nt, Human
cagucgcgcugccugug

SEQ ID NO: 3797176 - RNA, 13 nt, Human
cagucgggggcug

SEQ ID NO: 3797177 - RNA, 14 nt, Human
cagucgggggcugg

SEQ ID NO: 3797178 - RNA, 18 nt, Human
cagucgucgcacagucuc

SEQ ID NO: 3797179 - RNA, 20 nt, Human
cagucgucgcacagucucuc

SEQ ID NO: 3797180 - RNA, 13 nt, Human
cagucgugccugu

SEQ ID NO: 3797181 - RNA, 14 nt, Human
cagucgugccugug

SEQ ID NO: 3797182 - RNA, 14 nt, Human
cagucguucccagu

SEQ ID NO: 3797183 - RNA, 21 nt, Human
cagucuaaauuuauuauuuaa

SEQ ID NO: 3797184 - RNA, 22 nt, Human
cagucuacccagagaagccccu

SEQ ID NO: 3797185 - RNA, 19 nt, Human
cagucuaguugccaaaucu

SEQ ID NO: 3797186 - RNA, 17 nt, Human
cagucuauccacagaga

SEQ ID NO: 3797187 - RNA, 17 nt, Human
cagucuauucacagaag

SEQ ID NO: 3797188 - RNA, 12 nt, Human
cagucucacauu

SEQ ID NO: 3797189 - RNA, 20 nt, Human
cagucucaccauuuccccag

SEQ ID NO: 3797190 - RNA, 17 nt, Human
cagucucacccagacuc

SEQ ID NO: 3797191 - RNA, 19 nt, Human
cagucucaggagcaugggg

SEQ ID NO: 3797192 - RNA, 16 nt, Human
cagucuccaccaggaa

SEQ ID NO: 3797193 - RNA, 15 nt, Human
cagucuccggccucu

SEQ ID NO: 3797194 - RNA, 18 nt, Human
cagucuccggccucucca

SEQ ID NO: 3797195 - RNA, 15 nt, Human
cagucuccucuuuaa

SEQ ID NO: 3797196 - RNA, 17 nt, Human
cagucuccucuuuaaaa

SEQ ID NO: 3797197 - RNA, 19 nt, Human
cagucuccucuuuaaaaca

SEQ ID NO: 3797198 - RNA, 21 nt, Human
cagucucucucucucucuccc

SEQ ID NO: 3797199 - RNA, 17 nt, Human
cagucucucuucucucc

SEQ ID NO: 3797200 - RNA, 12 nt, Human
cagucucugccu

SEQ ID NO: 3797201 - RNA, 17 nt, Human
cagucucugccuugccu

SEQ ID NO: 3797202 - RNA, 23 nt, Human
cagucucugcuccaccuuucagc

SEQ ID NO: 3797203 - RNA, 20 nt, Human
cagucucuuuaaucuucagu

SEQ ID NO: 3797204 - RNA, 13 nt, Human
cagucugaaguuu

SEQ ID NO: 3797205 - RNA, 12 nt, Human
cagucugacccu

SEQ ID NO: 3797206 - RNA, 19 nt, Human
cagucugauucccaagcuc

SEQ ID NO: 3797207 - RNA, 23 nt, Human
cagucugauucccaagcucugcu

SEQ ID NO: 3797208 - RNA, 15 nt, Human
cagucuggaaugcag

SEQ ID NO: 3797209 - RNA, 19 nt, Human
cagucuggaaugcaguggu

SEQ ID NO: 3797210 - RNA, 13 nt, Human
cagucuggagggg

SEQ ID NO: 3797211 - RNA, 18 nt, Human
cagucuggaggggcaugg

SEQ ID NO: 3797212 - RNA, 18 nt, Human
cagucuggcugagcccug

SEQ ID NO: 3797213 - RNA, 23 nt, Human
cagucugucaugaacauguuccu

SEQ ID NO: 3797214 - RNA, 14 nt, Human
cagucugucuucug

SEQ ID NO: 3797215 - RNA, 17 nt, Human
cagucugucuucuguau

SEQ ID NO: 3797216 - RNA, 21 nt, Human
cagucuguuccccauggccac

SEQ ID NO: 3797217 - RNA, 15 nt, Human
caugguuuggagcug

SEQ ID NO: 3797218 - RNA, 18 nt, Human
caugguuuggagcugauc

SEQ ID NO: 3797219 - RNA, 22 nt, Human
cauguaaaacaaaaaacaauau

SEQ ID NO: 3797220 - RNA, 14 nt, Human
cauguaaaagaguc

SEQ ID NO: 3797221 - RNA, 21 nt, Human
cauguaaacaaaauuuaguuu

SEQ ID NO: 3797222 - RNA, 17 nt, Human
cauguaaagaaaugucu

SEQ ID NO: 3797223 - RNA, 18 nt, Human
cauguaaagaaaugucuu

SEQ ID NO: 3797224 - RNA, 18 nt, Human
cauguaaagugucagaag

SEQ ID NO: 3797225 - RNA, 14 nt, Human
cauguaaauaauac

SEQ ID NO: 3797226 - RNA, 21 nt, Human
cauguaaauaccagacugcag

SEQ ID NO: 3797227 - RNA, 23 nt, Human
cauguaaauaccagacugcaggu

SEQ ID NO: 3797228 - RNA, 17 nt, Human
cauguaacagaaagggc

SEQ ID NO: 3797229 - RNA, 18 nt, Human
cauguaaccggcauguuu

SEQ ID NO: 3797230 - RNA, 21 nt, Human
cauguaacugccuagaaacaa

SEQ ID NO: 3797231 - RNA, 23 nt, Human
cauguaagcugaaaauauggcaa

SEQ ID NO: 3797232 - RNA, 12 nt, Human
cauguaauaaaa

SEQ ID NO: 3797233 - RNA, 22 nt, Human
cauguaauaaaaaguauauguu

SEQ ID NO: 3797234 - RNA, 18 nt, Human
cauguaauuaaguacuau

SEQ ID NO: 3797235 - RNA, 14 nt, Human
cauguaauuugugu

SEQ ID NO: 3797236 - RNA, 22 nt, Human
cauguacagagaacuaacacua

SEQ ID NO: 3797237 - RNA, 13 nt, Human
cauguacauuugg

SEQ ID NO: 3797238 - RNA, 19 nt, Human
cauguacccuaaggucauu

SEQ ID NO: 3797239 - RNA, 16 nt, Human
cauguaccuccccugc

SEQ ID NO: 3797240 - RNA, 22 nt, Human
cauguaccuccccugccuugcu

SEQ ID NO: 3797241 - RNA, 22 nt, Human
cauguacuaguuuuaguuuucu

SEQ ID NO: 3797242 - RNA, 22 nt, Human
cauguacuguaguuuuucuuca

SEQ ID NO: 3797243 - RNA, 13 nt, Human
cauguacuuguuu

SEQ ID NO: 3797244 - RNA, 22 nt, Human
cauguacuuuuuaguaauuucu

SEQ ID NO: 3797245 - RNA, 14 nt, Human
cauguagaaaacaa

SEQ ID NO: 3797246 - RNA, 18 nt, Human
cauguagcccccuggccu

SEQ ID NO: 3797247 - RNA, 15 nt, Human
cauguagcugaguuu

SEQ ID NO: 3797248 - RNA, 19 nt, Human
cauguaguaacacuaauau

SEQ ID NO: 3797249 - RNA, 23 nt, Human
cauguaguaacacuaauauauuu

SEQ ID NO: 3797250 - RNA, 19 nt, Human
cauguaguaucaaauauua

SEQ ID NO: 3797251 - RNA, 23 nt, Human
cauguagugugggaggcuccugu

SEQ ID NO: 3797252 - RNA, 21 nt, Human
cauguauaaaugaaguuuaua

SEQ ID NO: 3797253 - RNA, 14 nt, Human
cauguauaaaugug

SEQ ID NO: 3797254 - RNA, 17 nt, Human
cauguauaaaugugaua

SEQ ID NO: 3797255 - RNA, 15 nt, Human
cauguauaauauuuu

SEQ ID NO: 3797256 - RNA, 15 nt, Human
cauguauaguugcuu

SEQ ID NO: 3797257 - RNA, 20 nt, Human
cauguauaguugcuuuugaa

SEQ ID NO: 3797258 - RNA, 18 nt, Human
cauguaucauaauuacca

SEQ ID NO: 3797259 - RNA, 19 nt, Human
cauguaucauaauuaccaa

SEQ ID NO: 3797260 - RNA, 15 nt, Human
cauguaucaucugga

SEQ ID NO: 3797261 - RNA, 14 nt, Human
cauguaucuaccuc

SEQ ID NO: 3797262 - RNA, 13 nt, Human
cauguaugucuug

SEQ ID NO: 3797263 - RNA, 12 nt, Human
cauguauguuuc

SEQ ID NO: 3797264 - RNA, 12 nt, Human
cauguauguuuu

SEQ ID NO: 3797265 - RNA, 14 nt, Human
cauguauuggccug

SEQ ID NO: 3797266 - RNA, 18 nt, Human
cauguauuggccuggagg

SEQ ID NO: 3797267 - RNA, 14 nt, Human
cauguauugugucu

SEQ ID NO: 3797268 - RNA, 20 nt, Human
cauguauugugucuuuugca

SEQ ID NO: 3797269 - RNA, 23 nt, Human
cauguauugugucuuuugcauga

SEQ ID NO: 3797270 - RNA, 20 nt, Human
cauguauuuaucucuauuua

SEQ ID NO: 3797271 - RNA, 20 nt, Human
cauguauuuggugauuacau

SEQ ID NO: 3797272 - RNA, 13 nt, Human
caugucaaacaug

SEQ ID NO: 3797273 - RNA, 15 nt, Human
caugucaacagcguu

SEQ ID NO: 3797274 - RNA, 13 nt, Human
caugucacugcag

SEQ ID NO: 3797275 - RNA, 18 nt, Human
caugucagcaaaaagcaa

SEQ ID NO: 3797276 - RNA, 20 nt, Human
caugucagcaaaaagcaaaa

SEQ ID NO: 3797277 - RNA, 12 nt, Human
cauguccaaaga

SEQ ID NO: 3797278 - RNA, 15 nt, Human
cauguccaaagaggc

SEQ ID NO: 3797279 - RNA, 16 nt, Human
cauguccaaagaggcu

SEQ ID NO: 3797280 - RNA, 15 nt, Human
cauguccaagaagcc

SEQ ID NO: 3797281 - RNA, 16 nt, Human
cauguccaagaagccc

SEQ ID NO: 3797282 - RNA, 20 nt, Human
cauguccagcaccuugugcc

SEQ ID NO: 3797283 - RNA, 19 nt, Human
cauguccauacacuuuguu

SEQ ID NO: 3797284 - RNA, 22 nt, Human
cauguccauacacuuuguugca

SEQ ID NO: 3797285 - RNA, 23 nt, Human
cauguccauacacuuuguugcaa

SEQ ID NO: 3797286 - RNA, 21 nt, Human
cauguccccaaaccugcaagg

SEQ ID NO: 3797287 - RNA, 15 nt, Human
cauguccccucccag

SEQ ID NO: 3797288 - RNA, 16 nt, Human
cauguccccucccaga

SEQ ID NO: 3797289 - RNA, 18 nt, Human
cauguccccucccagagc

SEQ ID NO: 3797290 - RNA, 17 nt, Human
caugucccuacaccccu

SEQ ID NO: 3797291 - RNA, 19 nt, Human
cauguccuaauucuucugu

SEQ ID NO: 3797292 - RNA, 14 nt, Human
cauguccuaugugu

SEQ ID NO: 3797293 - RNA, 13 nt, Human
cauguccugccua

SEQ ID NO: 3797294 - RNA, 14 nt, Human
cauguccuguguca

SEQ ID NO: 3797295 - RNA, 15 nt, Human
cauguccugugucag

SEQ ID NO: 3797296 - RNA, 17 nt, Human
cauguccuucugagccc

SEQ ID NO: 3797297 - RNA, 19 nt, Human
cauguccuuugcgccugug

SEQ ID NO: 3797298 - RNA, 18 nt, Human
caugucgccucugcauuc

SEQ ID NO: 3797299 - RNA, 20 nt, Human
caugucgccucugcauucag

SEQ ID NO: 3797300 - RNA, 13 nt, Human
caugucggccucu

SEQ ID NO: 3797301 - RNA, 14 nt, Human
caugucggccucua

SEQ ID NO: 3797302 - RNA, 14 nt, Human
caugucgugaccaa

SEQ ID NO: 3797303 - RNA, 16 nt, Human
caugucuccuacugag

SEQ ID NO: 3797304 - RNA, 20 nt, Human
caugucuccuacugaggaua

SEQ ID NO: 3797305 - RNA, 17 nt, Human
caugucuccuauccugg

SEQ ID NO: 3797306 - RNA, 14 nt, Human
caugucugcauuuc

SEQ ID NO: 3797307 - RNA, 17 nt, Human
caugucuuaaugaaguu

SEQ ID NO: 3797308 - RNA, 14 nt, Human
caugucuuauuuaa

SEQ ID NO: 3797309 - RNA, 15 nt, Human
caugucuuauuuaaa

SEQ ID NO: 3797310 - RNA, 13 nt, Human
caugucuuguaca

SEQ ID NO: 3797311 - RNA, 17 nt, Human
caugucuuucuccaggg

SEQ ID NO: 3797312 - RNA, 23 nt, Human
caugucuuuucuugcaugaggcu

SEQ ID NO: 3797313 - RNA, 12 nt, Human
caugugaaaccu

SEQ ID NO: 3797314 - RNA, 18 nt, Human
caugugaaaccuuuuuua

SEQ ID NO: 3797315 - RNA, 24 nt, Human
caugugaaaccuuuuuuaagauuu

SEQ ID NO: 3797316 - RNA, 13 nt, Human
caugugacauuua

SEQ ID NO: 3797317 - RNA, 13 nt, Human
caugugacucuga

SEQ ID NO: 3797318 - RNA, 17 nt, Human
caugugacucuggcuug

SEQ ID NO: 3797319 - RNA, 17 nt, Human
caugugaucucauuguu

SEQ ID NO: 3797320 - RNA, 17 nt, Human
caugugaugagaggaaa

SEQ ID NO: 3797321 - RNA, 21 nt, Human
caugugaugagaggaaaucac

SEQ ID NO: 3797322 - RNA, 19 nt, Human
caugugauggacacuccag

SEQ ID NO: 3797323 - RNA, 17 nt, Human
caugugcauaguuucuu

SEQ ID NO: 3797324 - RNA, 22 nt, Human
caugugccacaacgccuggcua

SEQ ID NO: 3797325 - RNA, 24 nt, Human
caugugccagggcaaugaugaaug

SEQ ID NO: 3797326 - RNA, 21 nt, Human
caugugccagguuuuuggucu

SEQ ID NO: 3797327 - RNA, 12 nt, Human
caugugcccucc

SEQ ID NO: 3797328 - RNA, 14 nt, Human
caugugcccuccug

SEQ ID NO: 3797329 - RNA, 15 nt, Human
caugugccugaucca

SEQ ID NO: 3797330 - RNA, 19 nt, Human
caugugccugauccagccu

SEQ ID NO: 3797331 - RNA, 20 nt, Human
caugugccugcaccaggaga

SEQ ID NO: 3797332 - RNA, 21 nt, Human
caugugccugcaccaggagac

SEQ ID NO: 3797333 - RNA, 22 nt, Human
caugugccugcaccaggagaca

SEQ ID NO: 3797334 - RNA, 20 nt, Human
caugugcuacaggggccaga

SEQ ID NO: 3797335 - RNA, 22 nt, Human
caugugcuacaggggccagaag

SEQ ID NO: 3797336 - RNA, 19 nt, Human
caugugcugugaccauuua

SEQ ID NO: 3797337 - RNA, 16 nt, Human
cauguggaaagugaau

SEQ ID NO: 3797338 - RNA, 22 nt, Human
cauguggaaagugaauuugaau

SEQ ID NO: 3797339 - RNA, 19 nt, Human
cauguggcuccucccagcc

SEQ ID NO: 3797340 - RNA, 12 nt, Human
cauguggcugga

SEQ ID NO: 3797341 - RNA, 20 nt, Human
cauguggcuuuuuuaaaaaa

SEQ ID NO: 3797342 - RNA, 21 nt, Human
caaguuuucuuccaugauuuu

SEQ ID NO: 3797343 - RNA, 16 nt, Human
caaguuuugugaaauu

SEQ ID NO: 3797344 - RNA, 20 nt, Human
caaguuuugugaaauuuuuc

SEQ ID NO: 3797345 - RNA, 21 nt, Human
caaguuuugugaaauuuuuca

SEQ ID NO: 3797346 - RNA, 13 nt, Human
caauaaaaaaaag

SEQ ID NO: 3797347 - RNA, 20 nt, Human
caauaaaaaaaagaaaugaa

SEQ ID NO: 3797348 - RNA, 20 nt, Human
caauaaaaacauugccuuug

SEQ ID NO: 3797349 - RNA, 12 nt, Human
caauaaaacauu

SEQ ID NO: 3797350 - RNA, 15 nt, Human
caauaaaacauuaau

SEQ ID NO: 3797351 - RNA, 20 nt, Human
caauaaaagcaauuccaacc

SEQ ID NO: 3797352 - RNA, 17 nt, Human
caauaaaagcccaggag

SEQ ID NO: 3797353 - RNA, 19 nt, Human
caauaaaagcccaggagcc

SEQ ID NO: 3797354 - RNA, 13 nt, Human
caauaaaauagca

SEQ ID NO: 3797355 - RNA, 17 nt, Human
caauaaaauuauuugca

SEQ ID NO: 3797356 - RNA, 19 nt, Human
caauaaaauuauuugcagg

SEQ ID NO: 3797357 - RNA, 11 nt, Human
caauaaaauuu

SEQ ID NO: 3797358 - RNA, 13 nt, Human
caauaaaauuuaa

SEQ ID NO: 3797359 - RNA, 20 nt, Human
caauaaaauuuaaaaaauaa

SEQ ID NO: 3797360 - RNA, 18 nt, Human
caauaaaauuucuaagag

SEQ ID NO: 3797361 - RNA, 14 nt, Human
caaucauuguacag

SEQ ID NO: 3797362 - RNA, 12 nt, Human
caaucauuguuu

SEQ ID NO: 3797363 - RNA, 12 nt, Human
caaucauuucuc

SEQ ID NO: 3797364 - RNA, 15 nt, Human
caauccaagagucug

SEQ ID NO: 3797365 - RNA, 19 nt, Human
caauccagguacgcacaga

SEQ ID NO: 3797366 - RNA, 22 nt, Human
caauccagguacgcacagacag

SEQ ID NO: 3797367 - RNA, 23 nt, Human
caauccauguuaguuuuuacuuu

SEQ ID NO: 3797368 - RNA, 17 nt, Human
caaucccaccaacccuc

SEQ ID NO: 3797369 - RNA, 23 nt, Human
caaucccaccaacccucagagcc

SEQ ID NO: 3797370 - RNA, 21 nt, Human
caauccccucauucaggaaaa

SEQ ID NO: 3797371 - RNA, 16 nt, Human
caaucccugaucccug

SEQ ID NO: 3797372 - RNA, 22 nt, Human
caaucccuuaauauccuaaaca

SEQ ID NO: 3797373 - RNA, 20 nt, Human
caauccuaauuucuccuccc

SEQ ID NO: 3797374 - RNA, 17 nt, Human
caauccuagguaggguu

SEQ ID NO: 3797375 - RNA, 15 nt, Human
caauccuagugcuuu

SEQ ID NO: 3797376 - RNA, 14 nt, Human
caauccuaugcaug

SEQ ID NO: 3797377 - RNA, 23 nt, Human
caauccuaugcaugguuucagca

SEQ ID NO: 3797378 - RNA, 16 nt, Human
caauccucacugggug

SEQ ID NO: 3797379 - RNA, 18 nt, Human
caauccucccacuucagc

SEQ ID NO: 3797380 - RNA, 12 nt, Human
caauccuggcuc

SEQ ID NO: 3797381 - RNA, 11 nt, Human
caauccuuaca

SEQ ID NO: 3797382 - RNA, 12 nt, Human
caauccuuacaa

SEQ ID NO: 3797383 - RNA, 16 nt, Human
caauccuuacaaauga

SEQ ID NO: 3797384 - RNA, 20 nt, Human
caaucgacuggguuuauguc

SEQ ID NO: 3797385 - RNA, 23 nt, Human
caaucgguguguagugauguuuc

SEQ ID NO: 3797386 - RNA, 12 nt, Human
caaucuaauuuu

SEQ ID NO: 3797387 - RNA, 19 nt, Human
caaucuauugcuucaccau

SEQ ID NO: 3797388 - RNA, 18 nt, Human
caaucucaaggaaucuuu

SEQ ID NO: 3797389 - RNA, 21 nt, Human
caaucucguauagaagucuuc

SEQ ID NO: 3797390 - RNA, 15 nt, Human
caaucucuucauuau

SEQ ID NO: 3797391 - RNA, 16 nt, Human
caaucuggaagaaaaa

SEQ ID NO: 3797392 - RNA, 20 nt, Human
caaucuggaugccucauuau

SEQ ID NO: 3797393 - RNA, 23 nt, Human
caaucugugaugacauucccugc

SEQ ID NO: 3797394 - RNA, 19 nt, Human
caaucuuaaggggcagcuu

SEQ ID NO: 3797395 - RNA, 22 nt, Human
caaucuuacuuuguaaauucug

SEQ ID NO: 3797396 - RNA, 14 nt, Human
caaucuucaauccu

SEQ ID NO: 3797397 - RNA, 13 nt, Human
caaucuugcaugu

SEQ ID NO: 3797398 - RNA, 18 nt, Human
caaucuugcauguaacgc

SEQ ID NO: 3797399 - RNA, 22 nt, Human
caaucuuuaaaccaauugcugc

SEQ ID NO: 3797400 - RNA, 15 nt, Human
caaugaaaaaaugua

SEQ ID NO: 3797401 - RNA, 20 nt, Human
caaugaaaacucuuugcugc

SEQ ID NO: 3797402 - RNA, 12 nt, Human
caaugaaaaguc

SEQ ID NO: 3797403 - RNA, 23 nt, Human
caaugaaauacacaaguaaacau

SEQ ID NO: 3797404 - RNA, 13 nt, Human
caaugaaaugaau

SEQ ID NO: 3797405 - RNA, 15 nt, Human
caaugaaccauaaau

SEQ ID NO: 3797406 - RNA, 16 nt, Human
caaugaaccauaaauu

SEQ ID NO: 3797407 - RNA, 13 nt, Human
caaugaaccccca

SEQ ID NO: 3797408 - RNA, 16 nt, Human
caaugaacggccuugc

SEQ ID NO: 3797409 - RNA, 14 nt, Human
caaugaagccagcu

SEQ ID NO: 3797410 - RNA, 21 nt, Human
caaugaauaaaaacucaagga

SEQ ID NO: 3797411 - RNA, 14 nt, Human
caaugaauauugaa

SEQ ID NO: 3797412 - RNA, 16 nt, Human
caaugacaaagcagau

SEQ ID NO: 3797413 - RNA, 17 nt, Human
caaugacaucucagggg

SEQ ID NO: 3797414 - RNA, 19 nt, Human
caaugacaucuucaaagcu

SEQ ID NO: 3797415 - RNA, 21 nt, Human
caaugaccuuucaauaggaaa

SEQ ID NO: 3797416 - RNA, 17 nt, Human
caaugacugugcuacug

SEQ ID NO: 3797417 - RNA, 15 nt, Human
caaugacuuacugua

SEQ ID NO: 3797418 - RNA, 18 nt, Human
caaugacuuacuguacau

SEQ ID NO: 3797419 - RNA, 21 nt, Human
caaugagacucuaggguccag

SEQ ID NO: 3797420 - RNA, 13 nt, Human
caaugagcauguu

SEQ ID NO: 3797421 - RNA, 14 nt, Human
caaugagcauguuu

SEQ ID NO: 3797422 - RNA, 18 nt, Human
caaugagcauguuuagac

SEQ ID NO: 3797423 - RNA, 17 nt, Human
caaugagcuuucugaac

SEQ ID NO: 3797424 - RNA, 20 nt, Human
caaugagcuuucugaacagc

SEQ ID NO: 3797425 - RNA, 22 nt, Human
caaugagcuuucugaacagcug

SEQ ID NO: 3797426 - RNA, 17 nt, Human
caaugaggucugaaaug

SEQ ID NO: 3797427 - RNA, 19 nt, Human
caaugaggucugaaaugga

SEQ ID NO: 3797428 - RNA, 19 nt, Human
caaugauccuguauucaga

SEQ ID NO: 3797429 - RNA, 16 nt, Human
caaugaucuagguuua

SEQ ID NO: 3797430 - RNA, 16 nt, Human
caaugauggcaauuuu

SEQ ID NO: 3797431 - RNA, 13 nt, Human
caaugauggucac

SEQ ID NO: 3797432 - RNA, 13 nt, Human
caaugauuauuuu

SEQ ID NO: 3797433 - RNA, 22 nt, Human
caaugauuguuaauuuacagcu

SEQ ID NO: 3797434 - RNA, 16 nt, Human
caaugcaagagugauu

SEQ ID NO: 3797435 - RNA, 13 nt, Human
caaugcacuuugu

SEQ ID NO: 3797436 - RNA, 14 nt, Human
caaugcagaugcca

SEQ ID NO: 3797437 - RNA, 16 nt, Human
caaugcagaugccaga

SEQ ID NO: 3797438 - RNA, 16 nt, Human
caaugcaguugucucu

SEQ ID NO: 3797439 - RNA, 16 nt, Human
caaugcaugcagccac

SEQ ID NO: 3797440 - RNA, 13 nt, Human
caaugcauuuugg

SEQ ID NO: 3797441 - RNA, 21 nt, Human
caaugcauuuuggaaagcucc

SEQ ID NO: 3797442 - RNA, 14 nt, Human
caaugccaagauaa

SEQ ID NO: 3797443 - RNA, 18 nt, Human
caaugccauccucaaaca

SEQ ID NO: 3797444 - RNA, 20 nt, Human
caaugcccguaaugcuuaga

SEQ ID NO: 3797445 - RNA, 17 nt, Human
caaugcucaggugcugg

SEQ ID NO: 3797446 - RNA, 20 nt, Human
caaugcugauguccucacca

SEQ ID NO: 3797447 - RNA, 21 nt, Human
caaugcugauuuggugaccaa

SEQ ID NO: 3797448 - RNA, 18 nt, Human
caaugcugcgucucccau

SEQ ID NO: 3797449 - RNA, 20 nt, Human
caaugcuggcuguuggcugg

SEQ ID NO: 3797450 - RNA, 22 nt, Human
caaugcuggcuguuggcugggg

SEQ ID NO: 3797451 - RNA, 23 nt, Human
caaugcuguauuuuaaaagaaug

SEQ ID NO: 3797452 - RNA, 17 nt, Human
caaugcuuuauuuguaa

SEQ ID NO: 3797453 - RNA, 18 nt, Human
caaugcuuuauuuguaaa

SEQ ID NO: 3797454 - RNA, 23 nt, Human
caaugcuuuauuuguaaauuuag

SEQ ID NO: 3797455 - RNA, 16 nt, Human
caauggaaaccucacg

SEQ ID NO: 3797456 - RNA, 16 nt, Human
caauggaaccuccuuu

SEQ ID NO: 3797457 - RNA, 13 nt, Human
caauggaagauuu

SEQ ID NO: 3797458 - RNA, 14 nt, Human
caauggaccggaga

SEQ ID NO: 3797459 - RNA, 22 nt, Human
caauggaguagaccccuggcug

SEQ ID NO: 3797460 - RNA, 17 nt, Human
caauggauuugaugcug

SEQ ID NO: 3797461 - RNA, 22 nt, Human
caauggauuugaugcuguuuga

SEQ ID NO: 3797462 - RNA, 12 nt, Human
caauggcagccu

SEQ ID NO: 3797463 - RNA, 15 nt, Human
caauggcagccuugg

SEQ ID NO: 3797464 - RNA, 17 nt, Human
caauggcuaauucccag

SEQ ID NO: 3797465 - RNA, 22 nt, Human
caauggcugcugaagcugccug

SEQ ID NO: 3797466 - RNA, 21 nt, Human
caaugggagcugaggccacac

SEQ ID NO: 3797467 - RNA, 20 nt, Human
caaugggauguaugaauaca

SEQ ID NO: 3797468 - RNA, 21 nt, Human
caaugggauguaugaauacag

SEQ ID NO: 3797469 - RNA, 15 nt, Human
caaugggcaaugaca

SEQ ID NO: 3797470 - RNA, 18 nt, Human
caaugggcacugggauga

SEQ ID NO: 3797471 - RNA, 15 nt, Human
caauggggccaguca

SEQ ID NO: 3797472 - RNA, 16 nt, Human
caaugguaauuauaaa

SEQ ID NO: 3797473 - RNA, 16 nt, Human
caaugguaguuucugu

SEQ ID NO: 3797474 - RNA, 21 nt, Human
caaugguguuauuugaaacuu

SEQ ID NO: 3797475 - RNA, 22 nt, Human
caaugguguucaccaucggcag

SEQ ID NO: 3797476 - RNA, 15 nt, Human
caaugguguuuuucu

SEQ ID NO: 3797477 - RNA, 19 nt, Human
caaugguguuuuucuugua

SEQ ID NO: 3797478 - RNA, 18 nt, Human
caaugguuugcaaggaag

SEQ ID NO: 3797479 - RNA, 19 nt, Human
caaugguuugcaaggaagc

SEQ ID NO: 3797480 - RNA, 16 nt, Human
caaugguuuuuaaauu

SEQ ID NO: 3797481 - RNA, 18 nt, Human
caaugguuuuuaaauuuu

SEQ ID NO: 3797482 - RNA, 23 nt, Human
caaugguuuuuaaauuuuguaau

SEQ ID NO: 3797483 - RNA, 17 nt, Human
caauguaagcauacuuu

SEQ ID NO: 3797484 - RNA, 18 nt, Human
caauguaauuaaacuguu

SEQ ID NO: 3797485 - RNA, 16 nt, Human
caauguagauaagugu

SEQ ID NO: 3797486 - RNA, 21 nt, Human
caauguagauaaguguucugu

SEQ ID NO: 3797487 - RNA, 17 nt, Human
caauguaucccuucuca

SEQ ID NO: 3797488 - RNA, 23 nt, Human
caauguaucccuucucacagcac

SEQ ID NO: 3797489 - RNA, 20 nt, Human
caauguauugauaagagggc

SEQ ID NO: 3797490 - RNA, 15 nt, Human
caauguauuuauuua

SEQ ID NO: 3797491 - RNA, 15 nt, Human
caaugucaaggugcu

SEQ ID NO: 3797492 - RNA, 18 nt, Human
caaugucaaugaacaagc

SEQ ID NO: 3797493 - RNA, 14 nt, Human
caaugucaggaaca

SEQ ID NO: 3797494 - RNA, 19 nt, Human
caaugucaggaacagaagg

SEQ ID NO: 3797495 - RNA, 21 nt, Human
caaugucaguauuucagugua

SEQ ID NO: 3797496 - RNA, 16 nt, Human
caaugucugcagcccu

SEQ ID NO: 3797497 - RNA, 18 nt, Human
caaugucugcagcccuga

SEQ ID NO: 3797498 - RNA, 19 nt, Human
caaugucugcagcccugag

SEQ ID NO: 3797499 - RNA, 15 nt, Human
caaugucuggagacc

SEQ ID NO: 3797500 - RNA, 16 nt, Human
caaugucuggagacca

SEQ ID NO: 3797501 - RNA, 12 nt, Human
caaugucugugc

SEQ ID NO: 3797502 - RNA, 13 nt, Human
caaugucugugcu

SEQ ID NO: 3797503 - RNA, 14 nt, Human
caaugucugugcua

SEQ ID NO: 3797504 - RNA, 11 nt, Human
caaugugaaaa

SEQ ID NO: 3797505 - RNA, 12 nt, Human
caaugugaaaaa

SEQ ID NO: 3797506 - RNA, 12 nt, Human
cacagcccuccc

SEQ ID NO: 3797507 - RNA, 17 nt, Human
cacagcccucccgcccc

SEQ ID NO: 3797508 - RNA, 18 nt, Human
cacagcccugucagugca

SEQ ID NO: 3797509 - RNA, 21 nt, Human
cacagcccugucagugcagcc

SEQ ID NO: 3797510 - RNA, 23 nt, Human
cacagcccuuaugcgguuaauuu

SEQ ID NO: 3797511 - RNA, 20 nt, Human
cacagccgauucaccugagc

SEQ ID NO: 3797512 - RNA, 21 nt, Human
cacagccgauucaccugagca

SEQ ID NO: 3797513 - RNA, 18 nt, Human
cacagccuagcacagcag

SEQ ID NO: 3797514 - RNA, 20 nt, Human
cacagccuagcacagcagcu

SEQ ID NO: 3797515 - RNA, 23 nt, Human
cacagccuccccugccagggcag

SEQ ID NO: 3797516 - RNA, 20 nt, Human
cacagccuccucugucugcc

SEQ ID NO: 3797517 - RNA, 21 nt, Human
cacagccuccucugucugccc

SEQ ID NO: 3797518 - RNA, 10 nt, Human
cacagccucu

SEQ ID NO: 3797519 - RNA, 12 nt, Human
cacagccucuga

SEQ ID NO: 3797520 - RNA, 19 nt, Human
cacagccucugaaaaccaa

SEQ ID NO: 3797521 - RNA, 14 nt, Human
cacagccucugacc

SEQ ID NO: 3797522 - RNA, 17 nt, Human
cacagccucugaccccu

SEQ ID NO: 3797523 - RNA, 21 nt, Human
cacagccucuuagaugcaguu

SEQ ID NO: 3797524 - RNA, 22 nt, Human
cacagccugcacuugggggcuc

SEQ ID NO: 3797525 - RNA, 23 nt, Human
cacagccugcacuugggggcuca

SEQ ID NO: 3797526 - RNA, 14 nt, Human
cacagccugggccc

SEQ ID NO: 3797527 - RNA, 21 nt, Human
cacagccugggccccagcucg

SEQ ID NO: 3797528 - RNA, 16 nt, Human
cacagcgagggcagcu

SEQ ID NO: 3797529 - RNA, 18 nt, Human
cacagcgagggcagcugc

SEQ ID NO: 3797530 - RNA, 15 nt, Human
cacagcgcuggccgg

SEQ ID NO: 3797531 - RNA, 21 nt, Human
cacagcggagucuguccugug

SEQ ID NO: 3797532 - RNA, 23 nt, Human
cacagcggagucuguccugugac

SEQ ID NO: 3797533 - RNA, 14 nt, Human
cacagcggccccug

SEQ ID NO: 3797534 - RNA, 20 nt, Human
cacagcggggccccagggcu

SEQ ID NO: 3797535 - RNA, 22 nt, Human
cacagcgucccuagcagugaac

SEQ ID NO: 3797536 - RNA, 14 nt, Human
cacagcgucccugg

SEQ ID NO: 3797537 - RNA, 22 nt, Human
cacagcgucccuggcgcaggug

SEQ ID NO: 3797538 - RNA, 20 nt, Human
cacagcuaacaauugugaag

SEQ ID NO: 3797539 - RNA, 22 nt, Human
cacagcuaacauggaaguacua

SEQ ID NO: 3797540 - RNA, 20 nt, Human
cacagcuacuugguuugugu

SEQ ID NO: 3797541 - RNA, 22 nt, Human
cacagcuaugaaggcuguacac

SEQ ID NO: 3797542 - RNA, 16 nt, Human
cacagcucaggaacua

SEQ ID NO: 3797543 - RNA, 19 nt, Human
cacagcucccaccccaccc

SEQ ID NO: 3797544 - RNA, 13 nt, Human
cacagcucccuuc

SEQ ID NO: 3797545 - RNA, 20 nt, Human
cacagcucuccggucucucu

SEQ ID NO: 3797546 - RNA, 15 nt, Human
cacagcucuucucca

SEQ ID NO: 3797547 - RNA, 17 nt, Human
cacagcucuucuccagg

SEQ ID NO: 3797548 - RNA, 18 nt, Human
cacagcucuucuccaggc

SEQ ID NO: 3797549 - RNA, 21 nt, Human
cacagcucuucuccaggcugu

SEQ ID NO: 3797550 - RNA, 18 nt, Human
cacagcugagagacuuuu

SEQ ID NO: 3797551 - RNA, 14 nt, Human
cacagcugagaggc

SEQ ID NO: 3797552 - RNA, 21 nt, Human
cacagcugccggucgcccuuu

SEQ ID NO: 3797553 - RNA, 18 nt, Human
cacagcugcucugugacc

SEQ ID NO: 3797554 - RNA, 14 nt, Human
cacagcugcuggag

SEQ ID NO: 3797555 - RNA, 15 nt, Human
cacagcugcuggaga

SEQ ID NO: 3797556 - RNA, 14 nt, Human
cacagcugggcugu

SEQ ID NO: 3797557 - RNA, 15 nt, Human
cacagcugggcugug

SEQ ID NO: 3797558 - RNA, 12 nt, Human
cacagcuguggu

SEQ ID NO: 3797559 - RNA, 22 nt, Human
cacagcuguggugagguugggc

SEQ ID NO: 3797560 - RNA, 17 nt, Human
cacagcuuagauuucau

SEQ ID NO: 3797561 - RNA, 19 nt, Human
cacagcuuagauuucauag

SEQ ID NO: 3797562 - RNA, 14 nt, Human
cacagcuucagcca

SEQ ID NO: 3797563 - RNA, 15 nt, Human
cacagcuuccccucu

SEQ ID NO: 3797564 - RNA, 14 nt, Human
caucuccaucagcu

SEQ ID NO: 3797565 - RNA, 16 nt, Human
caucuccaucagcugu

SEQ ID NO: 3797566 - RNA, 16 nt, Human
caucucccacccugua

SEQ ID NO: 3797567 - RNA, 18 nt, Human
caucucccagauaaugug

SEQ ID NO: 3797568 - RNA, 11 nt, Human
caucucccugc

SEQ ID NO: 3797569 - RNA, 13 nt, Human
caucucccugccu

SEQ ID NO: 3797570 - RNA, 14 nt, Human
caucucccugccug

SEQ ID NO: 3797571 - RNA, 16 nt, Human
caucucccuggugcuu

SEQ ID NO: 3797572 - RNA, 20 nt, Human
caucucccuggugcuuaugc

SEQ ID NO: 3797573 - RNA, 22 nt, Human
caucucccuuccugugggagca

SEQ ID NO: 3797574 - RNA, 18 nt, Human
caucuccuauaaucuguc

SEQ ID NO: 3797575 - RNA, 16 nt, Human
caucuccuuagaaaag

SEQ ID NO: 3797576 - RNA, 22 nt, Human
caucucgccaccccuccuuccu

SEQ ID NO: 3797577 - RNA, 18 nt, Human
caucucuaacagcucagg

SEQ ID NO: 3797578 - RNA, 20 nt, Human
caucucuaacagcucaggau

SEQ ID NO: 3797579 - RNA, 19 nt, Human
caucucuaccuucucccca

SEQ ID NO: 3797580 - RNA, 20 nt, Human
caucucuaccuucuccccag

SEQ ID NO: 3797581 - RNA, 21 nt, Human
caucucuaccuucuccccagc

SEQ ID NO: 3797582 - RNA, 22 nt, Human
caucucuacuaaaaauacaaac

SEQ ID NO: 3797583 - RNA, 18 nt, Human
caucucucagaagggagg

SEQ ID NO: 3797584 - RNA, 12 nt, Human
caucucucccca

SEQ ID NO: 3797585 - RNA, 13 nt, Human
caucucuccccaa

SEQ ID NO: 3797586 - RNA, 12 nt, Human
caucucucccuc

SEQ ID NO: 3797587 - RNA, 15 nt, Human
caucucucccucccc

SEQ ID NO: 3797588 - RNA, 23 nt, Human
caucucucccuccccugccauuu

SEQ ID NO: 3797589 - RNA, 23 nt, Human
caucucucuacuccuaccucagc

SEQ ID NO: 3797590 - RNA, 11 nt, Human
caucucucucc

SEQ ID NO: 3797591 - RNA, 13 nt, Human
caucucucugccc

SEQ ID NO: 3797592 - RNA, 21 nt, Human
caucucucuggcccucuaccc

SEQ ID NO: 3797593 - RNA, 14 nt, Human
caucucugacuuuc

SEQ ID NO: 3797594 - RNA, 22 nt, Human
caucucugcaaucuucucagaa

SEQ ID NO: 3797595 - RNA, 12 nt, Human
caucucugcuug

SEQ ID NO: 3797596 - RNA, 20 nt, Human
caucucugcuugagucaggu

SEQ ID NO: 3797597 - RNA, 13 nt, Human
caucucugcuugg

SEQ ID NO: 3797598 - RNA, 14 nt, Human
caucucuggaugcc

SEQ ID NO: 3797599 - RNA, 12 nt, Human
caucucugggcu

SEQ ID NO: 3797600 - RNA, 14 nt, Human
caucucugggcugg

SEQ ID NO: 3797601 - RNA, 19 nt, Human
caucucugucccauucccu

SEQ ID NO: 3797602 - RNA, 22 nt, Human
caucucugucccauucccuggg

SEQ ID NO: 3797603 - RNA, 21 nt, Human
caucucuuagcuccccuccaa

SEQ ID NO: 3797604 - RNA, 21 nt, Human
caucucuuccuccgaggccag

SEQ ID NO: 3797605 - RNA, 22 nt, Human
caucucuucuggguuccuuccu

SEQ ID NO: 3797606 - RNA, 20 nt, Human
caucucuugaggccaggagu

SEQ ID NO: 3797607 - RNA, 16 nt, Human
caucucuuguuuaaau

SEQ ID NO: 3797608 - RNA, 15 nt, Human
caucucuuugaauuu

SEQ ID NO: 3797609 - RNA, 22 nt, Human
caucucuuugaauuuucugugu

SEQ ID NO: 3797610 - RNA, 14 nt, Human
caucugaaauguua

SEQ ID NO: 3797611 - RNA, 23 nt, Human
caucugaauuugcccugggaaac

SEQ ID NO: 3797612 - RNA, 15 nt, Human
caucugaccacgugc

SEQ ID NO: 3797613 - RNA, 14 nt, Human
caucugaccagcag

SEQ ID NO: 3797614 - RNA, 21 nt, Human
caucugaccagcagcgccuuu

SEQ ID NO: 3797615 - RNA, 12 nt, Human
caucugacucac

SEQ ID NO: 3797616 - RNA, 14 nt, Human
caucugagaaaagc

SEQ ID NO: 3797617 - RNA, 20 nt, Human
caucugagagaggcuaaaau

SEQ ID NO: 3797618 - RNA, 14 nt, Human
caucugauaucuau

SEQ ID NO: 3797619 - RNA, 22 nt, Human
caucugauaucuauaguagaca

SEQ ID NO: 3797620 - RNA, 13 nt, Human
caucugauuaaaa

SEQ ID NO: 3797621 - RNA, 20 nt, Human
caucugcaaaaggccucuug

SEQ ID NO: 3797622 - RNA, 23 nt, Human
caucugcaaaaggccucuuguaa

SEQ ID NO: 3797623 - RNA, 19 nt, Human
caucugcaccccuucucuc

SEQ ID NO: 3797624 - RNA, 21 nt, Human
caucugcaccccuucucuccu

SEQ ID NO: 3797625 - RNA, 23 nt, Human
caucugcaccccuucucuccucc

SEQ ID NO: 3797626 - RNA, 19 nt, Human
caucugcacccuucuuuuc

SEQ ID NO: 3797627 - RNA, 20 nt, Human
caucugcacccuucuuuucu

SEQ ID NO: 3797628 - RNA, 21 nt, Human
caucugcacccuucuuuucuc

SEQ ID NO: 3797629 - RNA, 16 nt, Human
caucugcauugcccag

SEQ ID NO: 3797630 - RNA, 17 nt, Human
caucugcauugcccagu

SEQ ID NO: 3797631 - RNA, 17 nt, Human
caucugcccaacugugu

SEQ ID NO: 3797632 - RNA, 12 nt, Human
caucugcccagg

SEQ ID NO: 3797633 - RNA, 15 nt, Human
caucugcccaggggu

SEQ ID NO: 3797634 - RNA, 14 nt, Human
caucugccccuccc

SEQ ID NO: 3797635 - RNA, 20 nt, Human
caucugcccgccugcccacc

SEQ ID NO: 3797636 - RNA, 20 nt, Human
caucugccuuaaaaccaaag

SEQ ID NO: 3797637 - RNA, 17 nt, Human
caucugcgggggcagug

SEQ ID NO: 3797638 - RNA, 19 nt, Human
caucugcgggggcagugcu

SEQ ID NO: 3797639 - RNA, 20 nt, Human
caucugcgggggcagugcuc

SEQ ID NO: 3797640 - RNA, 16 nt, Human
caucugcgugacaaua

SEQ ID NO: 3797641 - RNA, 18 nt, Human
caucugcgugacaauaaa

SEQ ID NO: 3797642 - RNA, 15 nt, Human
caucugcucuccuuc

SEQ ID NO: 3797643 - RNA, 14 nt, Human
caucugcugguccg

SEQ ID NO: 3797644 - RNA, 14 nt, Human
caucugcugucuuu

SEQ ID NO: 3797645 - RNA, 21 nt, Human
caucugcugucuuuucuuugc

SEQ ID NO: 3797646 - RNA, 22 nt, Human
caucugcuuacaauucccugcu

SEQ ID NO: 3797647 - RNA, 12 nt, Human
caucuggaacca

SEQ ID NO: 3797648 - RNA, 20 nt, Human
caucuggagagcccagaguc

SEQ ID NO: 3797649 - RNA, 15 nt, Human
caucuggaguucuca

SEQ ID NO: 3797650 - RNA, 22 nt, Human
cauuuugggacaauuguuuuaa

SEQ ID NO: 3797651 - RNA, 22 nt, Human
cauuuugggguacccacugcuc

SEQ ID NO: 3797652 - RNA, 16 nt, Human
cauuuugguacuuugg

SEQ ID NO: 3797653 - RNA, 18 nt, Human
cauuuuguaacaaaugaa

SEQ ID NO: 3797654 - RNA, 16 nt, Human
cauuuuguaauaauaa

SEQ ID NO: 3797655 - RNA, 17 nt, Human
cauuuuguauaauugua

SEQ ID NO: 3797656 - RNA, 14 nt, Human
cauuuugugaaugg

SEQ ID NO: 3797657 - RNA, 16 nt, Human
cauuuugugaauggau

SEQ ID NO: 3797658 - RNA, 22 nt, Human
cauuuuguggucauuaagcauu

SEQ ID NO: 3797659 - RNA, 12 nt, Human
cauuuuguugua

SEQ ID NO: 3797660 - RNA, 13 nt, Human
cauuuuguuguaa

SEQ ID NO: 3797661 - RNA, 16 nt, Human
cauuuuguuguaaaaa

SEQ ID NO: 3797662 - RNA, 18 nt, Human
cauuuuguuguaaaaaga

SEQ ID NO: 3797663 - RNA, 20 nt, Human
cauuuuguuugguauuguau

SEQ ID NO: 3797664 - RNA, 23 nt, Human
cauuuuguuugguauuguauuua

SEQ ID NO: 3797665 - RNA, 14 nt, Human
cauuuuuaaauaca

SEQ ID NO: 3797666 - RNA, 14 nt, Human
cauuuuuaaaugug

SEQ ID NO: 3797667 - RNA, 18 nt, Human
cauuuuuaaauguguuuu

SEQ ID NO: 3797668 - RNA, 15 nt, Human
cauuuuuaaucauga

SEQ ID NO: 3797669 - RNA, 20 nt, Human
cauuuuuacaauguaauuau

SEQ ID NO: 3797670 - RNA, 14 nt, Human
cauuuuuaccauua

SEQ ID NO: 3797671 - RNA, 16 nt, Human
cauuuuuagccugugu

SEQ ID NO: 3797672 - RNA, 15 nt, Human
cauuuuuauuuauga

SEQ ID NO: 3797673 - RNA, 17 nt, Human
cauuuuuauuuaugaag

SEQ ID NO: 3797674 - RNA, 21 nt, Human
cauuuuucaacuuugaauaaa

SEQ ID NO: 3797675 - RNA, 12 nt, Human
cauuuuucaaua

SEQ ID NO: 3797676 - RNA, 15 nt, Human
cauuuuucaauauau

SEQ ID NO: 3797677 - RNA, 21 nt, Human
cauuuuucauucacuucucuu

SEQ ID NO: 3797678 - RNA, 16 nt, Human
cauuuuuccguaaaaa

SEQ ID NO: 3797679 - RNA, 13 nt, Human
cauuuuuccuaac

SEQ ID NO: 3797680 - RNA, 18 nt, Human
cauuuuuccuucccuucu

SEQ ID NO: 3797681 - RNA, 13 nt, Human
cauuuuucuucca

SEQ ID NO: 3797682 - RNA, 17 nt, Human
cauuuuucuuccaggau

SEQ ID NO: 3797683 - RNA, 14 nt, Human
cauuuuucuuguuu

SEQ ID NO: 3797684 - RNA, 19 nt, Human
cauuuuugaaacugcauuu

SEQ ID NO: 3797685 - RNA, 18 nt, Human
cauuuuugaauacaggca

SEQ ID NO: 3797686 - RNA, 20 nt, Human
cauuuuugaauacaggcaua

SEQ ID NO: 3797687 - RNA, 13 nt, Human
cauuuuuguacag

SEQ ID NO: 3797688 - RNA, 14 nt, Human
cauuuuuguacagu

SEQ ID NO: 3797689 - RNA, 14 nt, Human
cauuuuuuaaaaca

SEQ ID NO: 3797690 - RNA, 16 nt, Human
cauuuuuuaaaacaag

SEQ ID NO: 3797691 - RNA, 15 nt, Human
cauuuuuuaaaugca

SEQ ID NO: 3797692 - RNA, 19 nt, Human
cauuuuuuaaaugcaccug

SEQ ID NO: 3797693 - RNA, 23 nt, Human
cauuuuuuaauuuacuuguuuug

SEQ ID NO: 3797694 - RNA, 22 nt, Human
cauuuuuugggcagcaauuuaa

SEQ ID NO: 3797695 - RNA, 18 nt, Human
cauuuuuuucuaccuaua

SEQ ID NO: 3797696 - RNA, 17 nt, Human
cauuuuuuuucuuugaa

SEQ ID NO: 3797697 - RNA, 21 nt, Human
cauuuuuuuucuuugaauaaa

SEQ ID NO: 3797698 - RNA, 22 nt, Human
cauuuuuuuucuuugaauaaau

SEQ ID NO: 3797699 - RNA, 13 nt, Human
ccaaaaaaauacu

SEQ ID NO: 3797700 - RNA, 17 nt, Human
ccaaaaaaauccagaaa

SEQ ID NO: 3797701 - RNA, 12 nt, Human
ccaaaaaacuac

SEQ ID NO: 3797702 - RNA, 20 nt, Human
ccaaaaaagcuguauuuuga

SEQ ID NO: 3797703 - RNA, 12 nt, Human
ccaaaaaauauc

SEQ ID NO: 3797704 - RNA, 20 nt, Human
ccaaaaaauucuacaacaca

SEQ ID NO: 3797705 - RNA, 19 nt, Human
ccaaaaaccaguauuguac

SEQ ID NO: 3797706 - RNA, 20 nt, Human
ccaaaaaccaguauuguaca

SEQ ID NO: 3797707 - RNA, 16 nt, Human
ccaaaaagaccagacu

SEQ ID NO: 3797708 - RNA, 16 nt, Human
ccaaaaaucugccugg

SEQ ID NO: 3797709 - RNA, 17 nt, Human
ccaaaaaucugccuggg

SEQ ID NO: 3797710 - RNA, 14 nt, Human
ccaaaaauuauuau

SEQ ID NO: 3797711 - RNA, 12 nt, Human
ccaaaacaaaca

SEQ ID NO: 3797712 - RNA, 15 nt, Human
ccaaaacccaugugg

SEQ ID NO: 3797713 - RNA, 17 nt, Human
ccaaaaccgccagcucu

SEQ ID NO: 3797714 - RNA, 18 nt, Human
ccaaaaccgccagcucug

SEQ ID NO: 3797715 - RNA, 19 nt, Human
ccaaaaccgccagcucugu

SEQ ID NO: 3797716 - RNA, 20 nt, Human
ccaaaacucuccucugcugc

SEQ ID NO: 3797717 - RNA, 21 nt, Human
ccaaaacucuccucugcugcu

SEQ ID NO: 3797718 - RNA, 12 nt, Human
ccaaaacugcuc

SEQ ID NO: 3797719 - RNA, 16 nt, Human
ccaaaacugugcagag

SEQ ID NO: 3797720 - RNA, 16 nt, Human
ccaaaagauugcugaa

SEQ ID NO: 3797721 - RNA, 22 nt, Human
ccaaaagauugcugaaauuuua

SEQ ID NO: 3797722 - RNA, 20 nt, Human
ccaaaagccaauggcugcag

SEQ ID NO: 3797723 - RNA, 14 nt, Human
ccaaaagcugcuca

SEQ ID NO: 3797724 - RNA, 12 nt, Human
ccaaaaggaaaa

SEQ ID NO: 3797725 - RNA, 17 nt, Human
ccaaaaggaaaaagcuc

SEQ ID NO: 3797726 - RNA, 19 nt, Human
ccaaaagguuuaagaaaua

SEQ ID NO: 3797727 - RNA, 22 nt, Human
ccaaaagucaaaaggugccugu

SEQ ID NO: 3797728 - RNA, 18 nt, Human
ccaaaaguuuuccugaga

SEQ ID NO: 3797729 - RNA, 11 nt, Human
cacagcuuccu

SEQ ID NO: 3797730 - RNA, 12 nt, Human
cacagcuuccug

SEQ ID NO: 3797731 - RNA, 18 nt, Human
cacagcuugaccugaggc

SEQ ID NO: 3797732 - RNA, 20 nt, Human
cacagcuugaccugaggcug

SEQ ID NO: 3797733 - RNA, 21 nt, Human
cacagcuuuuaguacccaccu

SEQ ID NO: 3797734 - RNA, 23 nt, Human
cacagcuuuuaguacccaccuga

SEQ ID NO: 3797735 - RNA, 15 nt, Human
cacaggaaguagagg

SEQ ID NO: 3797736 - RNA, 19 nt, Human
cacaggacacagucagauu

SEQ ID NO: 3797737 - RNA, 23 nt, Human
cacaggacaggaaaguggcaccu

SEQ ID NO: 3797738 - RNA, 18 nt, Human
cacaggacagggguuccu

SEQ ID NO: 3797739 - RNA, 16 nt, Human
cacaggacucugccuc

SEQ ID NO: 3797740 - RNA, 21 nt, Human
cacaggagacacugugcuaua

SEQ ID NO: 3797741 - RNA, 18 nt, Human
cacaggagcuaccugugu

SEQ ID NO: 3797742 - RNA, 22 nt, Human
cacaggaggagaaaucucacuu

SEQ ID NO: 3797743 - RNA, 22 nt, Human
cacaggaggcaggcauggcccu

SEQ ID NO: 3797744 - RNA, 14 nt, Human
cacaggagggaggg

SEQ ID NO: 3797745 - RNA, 21 nt, Human
cacaggagggagggggaaggc

SEQ ID NO: 3797746 - RNA, 19 nt, Human
cacaggagggcggccuccu

SEQ ID NO: 3797747 - RNA, 22 nt, Human
cacaggagggcggccuccuucu

SEQ ID NO: 3797748 - RNA, 22 nt, Human
cacaggagggggucguggagag

SEQ ID NO: 3797749 - RNA, 23 nt, Human
cacaggagggggucguggagagc

SEQ ID NO: 3797750 - RNA, 20 nt, Human
cacaggauccuauucucacc

SEQ ID NO: 3797751 - RNA, 16 nt, Human
cacaggaugaagcauu

SEQ ID NO: 3797752 - RNA, 14 nt, Human
cacaggcaacugag

SEQ ID NO: 3797753 - RNA, 18 nt, Human
cacaggcaacugaggcag

SEQ ID NO: 3797754 - RNA, 20 nt, Human
cacaggcaacugaggcagac

SEQ ID NO: 3797755 - RNA, 15 nt, Human
cacaggcagcuuucu

SEQ ID NO: 3797756 - RNA, 19 nt, Human
cacaggcagcuuucuagaa

SEQ ID NO: 3797757 - RNA, 19 nt, Human
cacaggcagggcaggacca

SEQ ID NO: 3797758 - RNA, 22 nt, Human
cacaggcagggcaggaccagcc

SEQ ID NO: 3797759 - RNA, 11 nt, Human
cacaggcaggu

SEQ ID NO: 3797760 - RNA, 14 nt, Human
cacaggcaggucca

SEQ ID NO: 3797761 - RNA, 15 nt, Human
cacaggcagguccag

SEQ ID NO: 3797762 - RNA, 19 nt, Human
cacaggcagguccaggguu

SEQ ID NO: 3797763 - RNA, 20 nt, Human
cacaggcaguuacuucugag

SEQ ID NO: 3797764 - RNA, 16 nt, Human
cacaggcauuuccugg

SEQ ID NO: 3797765 - RNA, 18 nt, Human
cacaggcauuuccugggu

SEQ ID NO: 3797766 - RNA, 23 nt, Human
cacaggccacccugugcagaagg

SEQ ID NO: 3797767 - RNA, 17 nt, Human
cacaggcccggcuccag

SEQ ID NO: 3797768 - RNA, 18 nt, Human
cacaggcccuuccucucc

SEQ ID NO: 3797769 - RNA, 19 nt, Human
cacaggcccuuccucucca

SEQ ID NO: 3797770 - RNA, 23 nt, Human
cacaggcccuuccucuccacugc

SEQ ID NO: 3797771 - RNA, 18 nt, Human
cacaggcccuuuccucag

SEQ ID NO: 3797772 - RNA, 23 nt, Human
cacaggcccuuuccucaggcaag

SEQ ID NO: 3797773 - RNA, 16 nt, Human
cacaggccucccuguu

SEQ ID NO: 3797774 - RNA, 14 nt, Human
cacaggccugagau

SEQ ID NO: 3797775 - RNA, 23 nt, Human
cacaggccugagauuucaucugc

SEQ ID NO: 3797776 - RNA, 13 nt, Human
cacaggccugugu

SEQ ID NO: 3797777 - RNA, 15 nt, Human
cacaggcucaggcag

SEQ ID NO: 3797778 - RNA, 19 nt, Human
cacaggcucaggcaggggc

SEQ ID NO: 3797779 - RNA, 20 nt, Human
cacaggcugagugcaggccc

SEQ ID NO: 3797780 - RNA, 17 nt, Human
cacaggcugggcugggc

SEQ ID NO: 3797781 - RNA, 19 nt, Human
cacaggcuuagggacagga

SEQ ID NO: 3797782 - RNA, 22 nt, Human
cacagggacugaaaaccucucc

SEQ ID NO: 3797783 - RNA, 17 nt, Human
cacagggacuugaaguu

SEQ ID NO: 3797784 - RNA, 20 nt, Human
cacagggagugcacauaucc

SEQ ID NO: 3797785 - RNA, 15 nt, Human
cacagggcaguaccu

SEQ ID NO: 3797786 - RNA, 20 nt, Human
cacagggcaugccccggcca

SEQ ID NO: 3797787 - RNA, 13 nt, Human
cacagggccuggc

SEQ ID NO: 3797788 - RNA, 14 nt, Human
cacagggccuggcc

SEQ ID NO: 3797789 - RNA, 17 nt, Human
cacagggccuggcccau

SEQ ID NO: 3797790 - RNA, 18 nt, Human
cacaggggaaaagaggag

SEQ ID NO: 3797791 - RNA, 17 nt, Human
cacaggggaggugauag

SEQ ID NO: 3797792 - RNA, 16 nt, Human
cacagggucugcucuu

SEQ ID NO: 3797793 - RNA, 14 nt, Human
cacaggguugggcc

SEQ ID NO: 3797794 - RNA, 21 nt, Human
cagaaaccuauccucacugcc

SEQ ID NO: 3797795 - RNA, 20 nt, Human
cagaaacgaaguagaaaggg

SEQ ID NO: 3797796 - RNA, 17 nt, Human
cagaaacgcauccagca

SEQ ID NO: 3797797 - RNA, 24 nt, Human
cagaaagaaguggggacagagcag

SEQ ID NO: 3797798 - RNA, 19 nt, Human
cagaaagcagaacagugau

SEQ ID NO: 3797799 - RNA, 17 nt, Human
cagaaagcagaggcugg

SEQ ID NO: 3797800 - RNA, 16 nt, Human
cagaaagcauuacauu

SEQ ID NO: 3797801 - RNA, 20 nt, Human
cagaaagccccacccaggcc

SEQ ID NO: 3797802 - RNA, 23 nt, Human
cagaaagccccacccaggccagg

SEQ ID NO: 3797803 - RNA, 14 nt, Human
cagaaagccuauca

SEQ ID NO: 3797804 - RNA, 22 nt, Human
cagaaagccuaucaaagaccuu

SEQ ID NO: 3797805 - RNA, 14 nt, Human
cagaaagcugccug

SEQ ID NO: 3797806 - RNA, 16 nt, Human
cagaaaggaaaaacaa

SEQ ID NO: 3797807 - RNA, 18 nt, Human
cagaaaggaaaaccugaa

SEQ ID NO: 3797808 - RNA, 12 nt, Human
cagaaaggagag

SEQ ID NO: 3797809 - RNA, 13 nt, Human
cagaaaggagagu

SEQ ID NO: 3797810 - RNA, 20 nt, Human
cagaaaggauauuuaagaaa

SEQ ID NO: 3797811 - RNA, 18 nt, Human
cagaaagggagggcucug

SEQ ID NO: 3797812 - RNA, 19 nt, Human
cagaaagggagggcucuga

SEQ ID NO: 3797813 - RNA, 20 nt, Human
cagaaagggagggcucugag

SEQ ID NO: 3797814 - RNA, 21 nt, Human
cagaaagggagggcucugagg

SEQ ID NO: 3797815 - RNA, 15 nt, Human
cagaaagguucugcc

SEQ ID NO: 3797816 - RNA, 21 nt, Human
cagaaagucauuccuucuuuu

SEQ ID NO: 3797817 - RNA, 14 nt, Human
cagaaagugccuga

SEQ ID NO: 3797818 - RNA, 15 nt, Human
cagaaagugccugac

SEQ ID NO: 3797819 - RNA, 23 nt, Human
cagaaagugccuuucaggaucua

SEQ ID NO: 3797820 - RNA, 22 nt, Human
cagaaaguggugcucaguugua

SEQ ID NO: 3797821 - RNA, 23 nt, Human
cagaaagugugcuuuaugcugaa

SEQ ID NO: 3797822 - RNA, 20 nt, Human
cagaaauaaaguuggugaca

SEQ ID NO: 3797823 - RNA, 11 nt, Human
cagaaauacag

SEQ ID NO: 3797824 - RNA, 15 nt, Human
cagaaauacagauuu

SEQ ID NO: 3797825 - RNA, 13 nt, Human
cagaaauacauau

SEQ ID NO: 3797826 - RNA, 23 nt, Human
cagaaauaccaaaauuauuucag

SEQ ID NO: 3797827 - RNA, 14 nt, Human
cagaaauagacaaa

SEQ ID NO: 3797828 - RNA, 21 nt, Human
cagaaauagacaaaaaguaua

SEQ ID NO: 3797829 - RNA, 18 nt, Human
cagaaauauauauacaua

SEQ ID NO: 3797830 - RNA, 20 nt, Human
cagaaauauauauacauaug

SEQ ID NO: 3797831 - RNA, 15 nt, Human
cagaaauaugugguu

SEQ ID NO: 3797832 - RNA, 14 nt, Human
cagaaauccaucua

SEQ ID NO: 3797833 - RNA, 16 nt, Human
cagaaaucuagaagac

SEQ ID NO: 3797834 - RNA, 20 nt, Human
cagaaaugagaucaggcucu

SEQ ID NO: 3797835 - RNA, 23 nt, Human
cagaaaugagaucaggcucugcc

SEQ ID NO: 3797836 - RNA, 23 nt, Human
cagaaaugaggccauggacucug

SEQ ID NO: 3797837 - RNA, 14 nt, Human
cagaaaugcugcug

SEQ ID NO: 3797838 - RNA, 17 nt, Human
cagaaauggaaagcaga

SEQ ID NO: 3797839 - RNA, 21 nt, Human
cagaaauggggaauucucuaa

SEQ ID NO: 3797840 - RNA, 16 nt, Human
cagaaauguacagcaa

SEQ ID NO: 3797841 - RNA, 23 nt, Human
cagaaaugucaugagauugcugu

SEQ ID NO: 3797842 - RNA, 16 nt, Human
cagaaaugucccuuuc

SEQ ID NO: 3797843 - RNA, 22 nt, Human
cagaaaugucccuuucuucucc

SEQ ID NO: 3797844 - RNA, 17 nt, Human
cagaaauguguuaucac

SEQ ID NO: 3797845 - RNA, 17 nt, Human
cagaaauucuguuuuua

SEQ ID NO: 3797846 - RNA, 21 nt, Human
cagaaauuggaacagaauguu

SEQ ID NO: 3797847 - RNA, 19 nt, Human
cagaaauugguaccuugca

SEQ ID NO: 3797848 - RNA, 13 nt, Human
cagaaauuguaua

SEQ ID NO: 3797849 - RNA, 18 nt, Human
cagaaauuguauauugua

SEQ ID NO: 3797850 - RNA, 19 nt, Human
cagaaauuguauauuguaa

SEQ ID NO: 3797851 - RNA, 22 nt, Human
cagaaauuguauauuguaauuu

SEQ ID NO: 3797852 - RNA, 17 nt, Human
cagaaauuuaauucaga

SEQ ID NO: 3797853 - RNA, 18 nt, Human
cagaaauuuuuauuuuuc

SEQ ID NO: 3797854 - RNA, 14 nt, Human
cagaacaaaugaag

SEQ ID NO: 3797855 - RNA, 21 nt, Human
cagaacaagguucccucugag

SEQ ID NO: 3797856 - RNA, 18 nt, Human
cagaacacacuccaucag

SEQ ID NO: 3797857 - RNA, 14 nt, Human
cagaacacauucuu

SEQ ID NO: 3797858 - RNA, 19 nt, Human
cagaacacggcucacgcuu

SEQ ID NO: 3797859 - RNA, 11 nt, Human
cagaacacugu

SEQ ID NO: 3797860 - RNA, 12 nt, Human
cagaacagcaga

SEQ ID NO: 3797861 - RNA, 14 nt, Human
cagaacagcagagg

SEQ ID NO: 3797862 - RNA, 17 nt, Human
cagaacagccgcuccug

SEQ ID NO: 3797863 - RNA, 20 nt, Human
cagaacagcuguugacucua

SEQ ID NO: 3797864 - RNA, 15 nt, Human
cagaacagcuucagg

SEQ ID NO: 3797865 - RNA, 24 nt, Human
cagaacagcuucagguuaucgaaa

SEQ ID NO: 3797866 - RNA, 12 nt, Human
cagaacaggguc

SEQ ID NO: 3797867 - RNA, 18 nt, Human
cagaacagugauuaccag

SEQ ID NO: 3797868 - RNA, 21 nt, Human
cagaacaucgcgaugggaacc

SEQ ID NO: 3797869 - RNA, 15 nt, Human
cagaaccaauuauuu

SEQ ID NO: 3797870 - RNA, 22 nt, Human
cagaaccacacuugaaaccuuu

SEQ ID NO: 3797871 - RNA, 12 nt, Human
cagaaccacagg

SEQ ID NO: 3797872 - RNA, 10 nt, Human
cagaaccagg

SEQ ID NO: 3797873 - RNA, 17 nt, Human
cagaaccagucuuucaa

SEQ ID NO: 3797874 - RNA, 14 nt, Human
cagaacccagggcu

SEQ ID NO: 3797875 - RNA, 19 nt, Human
cagaacccagggcucugcc

SEQ ID NO: 3797876 - RNA, 19 nt, Human
cagaacccuuggcuugccc

SEQ ID NO: 3797877 - RNA, 18 nt, Human
cagaaccggagagccagc

SEQ ID NO: 3797878 - RNA, 14 nt, Human
cagaaccucuuccc

SEQ ID NO: 3797879 - RNA, 16 nt, Human
cagaaccucuucccca

SEQ ID NO: 3797880 - RNA, 18 nt, Human
cagaaccucuuccccaga

SEQ ID NO: 3797881 - RNA, 21 nt, Human
cagaaccucuuccccagaaag

SEQ ID NO: 3797882 - RNA, 21 nt, Human
cagaaccuggagggcuagaac

SEQ ID NO: 3797883 - RNA, 17 nt, Human
cagaaccuuguuauuuc

SEQ ID NO: 3797884 - RNA, 18 nt, Human
cagaaccuuguuauuucu

SEQ ID NO: 3797885 - RNA, 21 nt, Human
cagaacgaaccuuggccuggg

SEQ ID NO: 3797886 - RNA, 19 nt, Human
auuaucauguguaaucaau

SEQ ID NO: 3797887 - RNA, 22 nt, Human
auuaucauguguaaucaauaaa

SEQ ID NO: 3797888 - RNA, 12 nt, Human
auuaucccugaa

SEQ ID NO: 3797889 - RNA, 16 nt, Human
auuauccuagauuaua

SEQ ID NO: 3797890 - RNA, 21 nt, Human
auuaucggaagcagugccuuc

SEQ ID NO: 3797891 - RNA, 16 nt, Human
auuaucgggaacagug

SEQ ID NO: 3797892 - RNA, 20 nt, Human
auuaucguuuucuuaaagug

SEQ ID NO: 3797893 - RNA, 14 nt, Human
auuaucuagauacu

SEQ ID NO: 3797894 - RNA, 20 nt, Human
auuaucuauacauaucuuua

SEQ ID NO: 3797895 - RNA, 19 nt, Human
auuaucuauuugugugugu

SEQ ID NO: 3797896 - RNA, 14 nt, Human
auuaucugggcuua

SEQ ID NO: 3797897 - RNA, 16 nt, Human
auuaucuugauacauu

SEQ ID NO: 3797898 - RNA, 20 nt, Human
auuaucuugauacauucaaa

SEQ ID NO: 3797899 - RNA, 18 nt, Human
auuaucuuggaaagaaac

SEQ ID NO: 3797900 - RNA, 18 nt, Human
auuaucuuuguaauuauu

SEQ ID NO: 3797901 - RNA, 13 nt, Human
auuaugaaaauaa

SEQ ID NO: 3797902 - RNA, 21 nt, Human
auuaugaaacuuguguaaaua

SEQ ID NO: 3797903 - RNA, 18 nt, Human
auuaugaaacuuuuggaa

SEQ ID NO: 3797904 - RNA, 19 nt, Human
auuaugaagaaggugaaua

SEQ ID NO: 3797905 - RNA, 20 nt, Human
auuaugaauuacauuuguau

SEQ ID NO: 3797906 - RNA, 14 nt, Human
auuaugacuguuuu

SEQ ID NO: 3797907 - RNA, 21 nt, Human
auuaugacuguuuuuuaaacu

SEQ ID NO: 3797908 - RNA, 23 nt, Human
auuaugagauugguuuuccugug

SEQ ID NO: 3797909 - RNA, 15 nt, Human
auuaugauuagcuuu

SEQ ID NO: 3797910 - RNA, 17 nt, Human
auuaugcaaauucccag

SEQ ID NO: 3797911 - RNA, 16 nt, Human
auuaugcacuaaauau

SEQ ID NO: 3797912 - RNA, 18 nt, Human
auuaugcacuaaauauga

SEQ ID NO: 3797913 - RNA, 23 nt, Human
auuaugcaugaaguaauaugcac

SEQ ID NO: 3797914 - RNA, 16 nt, Human
auuaugcauuauauca

SEQ ID NO: 3797915 - RNA, 19 nt, Human
auuaugccuuuuuugauca

SEQ ID NO: 3797916 - RNA, 11 nt, Human
auuaugcuaag

SEQ ID NO: 3797917 - RNA, 13 nt, Human
auuaugcuaagaa

SEQ ID NO: 3797918 - RNA, 20 nt, Human
auuauggaaaaauaaaacug

SEQ ID NO: 3797919 - RNA, 15 nt, Human
auuauggaaaacugu

SEQ ID NO: 3797920 - RNA, 15 nt, Human
auuaugggucacagg

SEQ ID NO: 3797921 - RNA, 19 nt, Human
auuaugguaaaauuuugua

SEQ ID NO: 3797922 - RNA, 22 nt, Human
auuauguaaaauguuuuagcaa

SEQ ID NO: 3797923 - RNA, 13 nt, Human
auuauguaaaucc

SEQ ID NO: 3797924 - RNA, 14 nt, Human
auuauguagcucuu

SEQ ID NO: 3797925 - RNA, 17 nt, Human
auuauguccacugugua

SEQ ID NO: 3797926 - RNA, 19 nt, Human
auuaugugacauuuuacau

SEQ ID NO: 3797927 - RNA, 16 nt, Human
auuaugugguuuuaga

SEQ ID NO: 3797928 - RNA, 11 nt, Human
auuaugugugc

SEQ ID NO: 3797929 - RNA, 13 nt, Human
auuaugugugcau

SEQ ID NO: 3797930 - RNA, 22 nt, Human
auuauguuaaacuagcauaucu

SEQ ID NO: 3797931 - RNA, 19 nt, Human
auuauguuauugaaaaaaa

SEQ ID NO: 3797932 - RNA, 22 nt, Human
auuauguuauugaaaaaaauug

SEQ ID NO: 3797933 - RNA, 16 nt, Human
auuauguuguuagaga

SEQ ID NO: 3797934 - RNA, 12 nt, Human
auuauguuuaua

SEQ ID NO: 3797935 - RNA, 16 nt, Human
auuauguuuauauaaa

SEQ ID NO: 3797936 - RNA, 16 nt, Human
auuauguuuuuuaaaa

SEQ ID NO: 3797937 - RNA, 14 nt, Human
auuauuaacuacau

SEQ ID NO: 3797938 - RNA, 20 nt, Human
auucaauauugacauuugua

SEQ ID NO: 3797939 - RNA, 14 nt, Human
auucaaucuguaaa

SEQ ID NO: 3797940 - RNA, 18 nt, Human
auucaaucuguaaacugu

SEQ ID NO: 3797941 - RNA, 18 nt, Human
auucaaugccccugaauu

SEQ ID NO: 3797942 - RNA, 21 nt, Human
auucaauuaaagaaauaauuu

SEQ ID NO: 3797943 - RNA, 22 nt, Human
auucaauuaaagaaauaauuuu

SEQ ID NO: 3797944 - RNA, 14 nt, Human
auucaauuccucug

SEQ ID NO: 3797945 - RNA, 19 nt, Human
auucaauuuauucaagaaa

SEQ ID NO: 3797946 - RNA, 19 nt, Human
auucacaagacccaaaagg

SEQ ID NO: 3797947 - RNA, 16 nt, Human
auucacaagcugccuc

SEQ ID NO: 3797948 - RNA, 20 nt, Human
auucacaagcugccucccug

SEQ ID NO: 3797949 - RNA, 23 nt, Human
auucacaaguuaagauucuuggu

SEQ ID NO: 3797950 - RNA, 13 nt, Human
auucacaauagaa

SEQ ID NO: 3797951 - RNA, 22 nt, Human
auucacaaugaaaugcucuccu

SEQ ID NO: 3797952 - RNA, 14 nt, Human
auucacaauuauuc

SEQ ID NO: 3797953 - RNA, 15 nt, Human
auucacaccccaccu

SEQ ID NO: 3797954 - RNA, 18 nt, Human
auucacaccccaccugcg

SEQ ID NO: 3797955 - RNA, 11 nt, Human
auucacacugu

SEQ ID NO: 3797956 - RNA, 16 nt, Human
auucacacuguuccag

SEQ ID NO: 3797957 - RNA, 19 nt, Human
auucacagugcucuuuucu

SEQ ID NO: 3797958 - RNA, 22 nt, Human
auucacaguucuuugggccaga

SEQ ID NO: 3797959 - RNA, 20 nt, Human
auucacaucuaaccucaucu

SEQ ID NO: 3797960 - RNA, 18 nt, Human
auucacauuguuaagaaa

SEQ ID NO: 3797961 - RNA, 16 nt, Human
auucaccaguacauuc

SEQ ID NO: 3797962 - RNA, 18 nt, Human
auucaccauguaaaacaa

SEQ ID NO: 3797963 - RNA, 18 nt, Human
auucaccuaagagauucu

SEQ ID NO: 3797964 - RNA, 19 nt, Human
auucaccuccuaaaacaac

SEQ ID NO: 3797965 - RNA, 13 nt, Human
auucaccugagca

SEQ ID NO: 3797966 - RNA, 19 nt, Human
auucaccugccccaacucu

SEQ ID NO: 3797967 - RNA, 12 nt, Human
auucaccuguaa

SEQ ID NO: 3797968 - RNA, 16 nt, Human
auucaccuguaaaacu

SEQ ID NO: 3797969 - RNA, 18 nt, Human
auucaccuguaaaacuuu

SEQ ID NO: 3797970 - RNA, 23 nt, Human
auucaccuuccagugucucggag

SEQ ID NO: 3797971 - RNA, 16 nt, Human
auucacucaagcacug

SEQ ID NO: 3797972 - RNA, 18 nt, Human
auucacucaagcacugau

SEQ ID NO: 3797973 - RNA, 21 nt, Human
auucacucauacaucuggccg

SEQ ID NO: 3797974 - RNA, 12 nt, Human
auucacucccac

SEQ ID NO: 3797975 - RNA, 13 nt, Human
auucacucccaca

SEQ ID NO: 3797976 - RNA, 20 nt, Human
auucacugaaguucuccuga

SEQ ID NO: 3797977 - RNA, 15 nt, Human
auucacugcccccag

SEQ ID NO: 3797978 - RNA, 18 nt, Human
auucacuuagcagaaccu

SEQ ID NO: 3797979 - RNA, 12 nt, Human
auucacuucacg

SEQ ID NO: 3797980 - RNA, 13 nt, Human
auucacuucacgc

SEQ ID NO: 3797981 - RNA, 15 nt, Human
auucacuucacugug

SEQ ID NO: 3797982 - RNA, 14 nt, Human
auucacuugcauuu

SEQ ID NO: 3797983 - RNA, 22 nt, Human
auucagaaaauguucuguuugc

SEQ ID NO: 3797984 - RNA, 13 nt, Human
auucagaaaugag

SEQ ID NO: 3797985 - RNA, 24 nt, Human
auucagaaggaucuucaucugacu

SEQ ID NO: 3797986 - RNA, 15 nt, Human
auucagaaggggagg

SEQ ID NO: 3797987 - RNA, 12 nt, Human
auucagacagcu

SEQ ID NO: 3797988 - RNA, 13 nt, Human
auucagacagcug

SEQ ID NO: 3797989 - RNA, 14 nt, Human
auucagacagcugc
